United States Patent 8,969,254 (OLIGONUCLEOTIDE ARRAY FOR TISSUE TYPING) - sequence listing, part 17

SEQ ID NO: 387162 - DNA, 28 bp, Artificial Sequence
  Description of Artificial Sequence: Synthetic oligonucleotide
acccaccatctcgtctctgaccatgagg

SEQ ID NO: 387163 - DNA, 27 bp, Artificial Sequence
  Description of Artificial Sequence: Synthetic oligonucleotide
cccaccatctcgtctctgaccatgagg

SEQ ID NO: 387164 - DNA, 27 bp, Artificial Sequence
  Description of Artificial Sequence: Synthetic oligonucleotide
ccaccatctcgtctctgaccatgaggc

SEQ ID NO: 387165 - DNA, 27 bp, Artificial Sequence
  Description of Artificial Sequence: Synthetic oligonucleotide
caccatctcgtctctgaccatgaggcc

SEQ ID NO: 387166 - DNA, 28 bp, Artificial Sequence
  Description of Artificial Sequence: Synthetic oligonucleotide
accatctcgtctctgaccatgaggccac

SEQ ID NO: 387167 - DNA, 27 bp, Artificial Sequence
  Description of Artificial Sequence: Synthetic oligonucleotide
ccatctcgtctctgaccatgaggccac

SEQ ID NO: 387168 - DNA, 27 bp, Artificial Sequence
  Description of Artificial Sequence: Synthetic oligonucleotide
catctcgtctctgaccatgaggccacc

SEQ ID NO: 387169 - DNA, 27 bp, Artificial Sequence
  Description of Artificial Sequence: Synthetic oligonucleotide
atctcgtctctgaccatgaggccaccc

SEQ ID NO: 387170 - DNA, 27 bp, Artificial Sequence
  Description of Artificial Sequence: Synthetic oligonucleotide
tctcgtctctgaccatgaggccaccct

SEQ ID NO: 387171 - DNA, 26 bp, Artificial Sequence
  Description of Artificial Sequence: Synthetic oligonucleotide
ctcgtctctgaccatgaggccaccct

SEQ ID NO: 387172 - DNA, 27 bp, Artificial Sequence
  Description of Artificial Sequence: Synthetic oligonucleotide
tcgtctctgaccatgaggccaccctga

SEQ ID NO: 387173 - DNA, 31 bp, Artificial Sequence; identical to SEQ ID NO: 50301
  Description of Artificial Sequence: Synthetic oligonucleotide

SEQ ID NO: 387174 - DNA, 30 bp, Artificial Sequence; identical to SEQ ID NO: 50302
  Description of Artificial Sequence: Synthetic oligonucleotide

SEQ ID NO: 387175 - DNA, 31 bp, Artificial Sequence; identical to SEQ ID NO: 50303
  Description of Artificial Sequence: Synthetic oligonucleotide

SEQ ID NO: 387176 - DNA, 30 bp, Artificial Sequence; identical to SEQ ID NO: 50304
  Description of Artificial Sequence: Synthetic oligonucleotide

SEQ ID NO: 387177 - DNA, 32 bp, Artificial Sequence; identical to SEQ ID NO: 50305
  Description of Artificial Sequence: Synthetic oligonucleotide

SEQ ID NO: 387178 - DNA, 32 bp, Artificial Sequence; identical to SEQ ID NO: 50306
  Description of Artificial Sequence: Synthetic oligonucleotide

SEQ ID NO: 387179 - DNA, 31 bp, Artificial Sequence; identical to SEQ ID NO: 50307
  Description of Artificial Sequence: Synthetic oligonucleotide

SEQ ID NO: 387180 - DNA, 30 bp, Artificial Sequence; identical to SEQ ID NO: 50308
  Description of Artificial Sequence: Synthetic oligonucleotide

SEQ ID NO: 387181 - DNA, 31 bp, Artificial Sequence; identical to SEQ ID NO: 50309
  Description of Artificial Sequence: Synthetic oligonucleotide

SEQ ID NO: 387182 - DNA, 31 bp, Artificial Sequence; identical to SEQ ID NO: 50310
  Description of Artificial Sequence: Synthetic oligonucleotide

SEQ ID NO: 387183 - DNA, 30 bp, Artificial Sequence; identical to SEQ ID NO: 50311
  Description of Artificial Sequence: Synthetic oligonucleotide

SEQ ID NO: 387184 - DNA, 32 bp, Artificial Sequence; identical to SEQ ID NO: 50312
  Description of Artificial Sequence: Synthetic oligonucleotide

SEQ ID NO: 387185 - DNA, 33 bp, Artificial Sequence; identical to SEQ ID NO: 50313
  Description of Artificial Sequence: Synthetic oligonucleotide

SEQ ID NO: 387186 - DNA, 32 bp, Artificial Sequence; identical to SEQ ID NO: 50314
  Description of Artificial Sequence: Synthetic oligonucleotide

SEQ ID NO: 387187 - DNA, 32 bp, Artificial Sequence; identical to SEQ ID NO: 50315
  Description of Artificial Sequence: Synthetic oligonucleotide

SEQ ID NO: 387188 - DNA, 31 bp, Artificial Sequence; identical to SEQ ID NO: 50316
  Description of Artificial Sequence: Synthetic oligonucleotide

SEQ ID NO: 387189 - DNA, 32 bp, Artificial Sequence; identical to SEQ ID NO: 50317
  Description of Artificial Sequence: Synthetic oligonucleotide

SEQ ID NO: 387190 - DNA, 33 bp, Artificial Sequence; identical to SEQ ID NO: 50318
  Description of Artificial Sequence: Synthetic oligonucleotide

SEQ ID NO: 387191 - DNA, 32 bp, Artificial Sequence; identical to SEQ ID NO: 50319
  Description of Artificial Sequence: Synthetic oligonucleotide

SEQ ID NO: 387192 - DNA, 32 bp, Artificial Sequence; identical to SEQ ID NO: 50320
  Description of Artificial Sequence: Synthetic oligonucleotide

SEQ ID NO: 387193 - DNA, 33 bp, Artificial Sequence; identical to SEQ ID NO: 50321
  Description of Artificial Sequence: Synthetic oligonucleotide

SEQ ID NO: 387194 - DNA, 33 bp, Artificial Sequence; identical to SEQ ID NO: 50322
  Description of Artificial Sequence: Synthetic oligonucleotide

SEQ ID NO: 387195 - DNA, 32 bp, Artificial Sequence; identical to SEQ ID NO: 50323
  Description of Artificial Sequence: Synthetic oligonucleotide

SEQ ID NO: 387196 - DNA, 36 bp, Artificial Sequence; identical to SEQ ID NO: 50324
  Description of Artificial Sequence: Synthetic oligonucleotide

SEQ ID NO: 387197 - DNA, 35 bp, Artificial Sequence; identical to SEQ ID NO: 50325
  Description of Artificial Sequence: Synthetic oligonucleotide

SEQ ID NO: 387198 - DNA, 34 bp, Artificial Sequence; identical to SEQ ID NO: 50326
  Description of Artificial Sequence: Synthetic oligonucleotide

SEQ ID NO: 387199 - DNA, 34 bp, Artificial Sequence; identical to SEQ ID NO: 50327
  Description of Artificial Sequence: Synthetic oligonucleotide

SEQ ID NO: 387200 - DNA, 33 bp, Artificial Sequence; identical to SEQ ID NO: 50328
  Description of Artificial Sequence: Synthetic oligonucleotide

SEQ ID NO: 387201 - DNA, 22 bp, Artificial Sequence
  Description of Artificial Sequence: Synthetic oligonucleotide
tccaagaggggagccgcgggct

SEQ ID NO: 387202 - DNA, 21 bp, Artificial Sequence
  Description of Artificial Sequence: Synthetic oligonucleotide
ccaagaggggagccgcgggct

SEQ ID NO: 387203 - DNA, 21 bp, Artificial Sequence
  Description of Artificial Sequence: Synthetic oligonucleotide
caagaggggagccgcgggctc

SEQ ID NO: 387204 - DNA, 21 bp, Artificial Sequence
  Description of Artificial Sequence: Synthetic oligonucleotide
aagaggggagccgcgggctcc

SEQ ID NO: 387205 - DNA, 20 bp, Artificial Sequence
  Description of Artificial Sequence: Synthetic oligonucleotide
agaggggagccgcgggctcc

SEQ ID NO: 387206 - DNA, 20 bp, Artificial Sequence
  Description of Artificial Sequence: Synthetic oligonucleotide
gaggggagccgcgggctcct

SEQ ID NO: 387207 - DNA, 20 bp, Artificial Sequence
  Description of Artificial Sequence: Synthetic oligonucleotide
aggggagccgcgggctccgt

SEQ ID NO: 387208 - DNA, 20 bp, Artificial Sequence
  Description of Artificial Sequence: Synthetic oligonucleotide
ggggagccgcgggctccgtt

SEQ ID NO: 387209 - DNA, 20 bp, Artificial Sequence
  Description of Artificial Sequence: Synthetic oligonucleotide
gggagccgcgggctccgtgt

SEQ ID NO: 387210 - DNA, 20 bp, Artificial Sequence
  Description of Artificial Sequence: Synthetic oligonucleotide
ggagccgcgggctccgtggt

SEQ ID NO: 387211 - DNA, 20 bp, Artificial Sequence
  Description of Artificial Sequence: Synthetic oligonucleotide
gagccgcgggctccgtgggt

SEQ ID NO: 387212 - DNA, 20 bp, Artificial Sequence
  Description of Artificial Sequence: Synthetic oligonucleotide
agccgcgggctccgtgggtg

SEQ ID NO: 387213 - DNA, 20 bp, Artificial Sequence
  Description of Artificial Sequence: Synthetic oligonucleotide
gccgcgggctccgtgggtgt

SEQ ID NO: 387214 - DNA, 20 bp, Artificial Sequence
  Description of Artificial Sequence: Synthetic oligonucleotide
ccgcgggctccgtgggtgga

SEQ ID NO: 387215 - DNA, 20 bp, Artificial Sequence
  Description of Artificial Sequence: Synthetic oligonucleotide
cgcgggctccgtgggtggag

SEQ ID NO: 387216 - DNA, 21 bp, Artificial Sequence
  Description of Artificial Sequence: Synthetic oligonucleotide
gcgggctccgtgggtggagca

SEQ ID NO: 387217 - DNA, 24 bp, Artificial Sequence
  Description of Artificial Sequence: Synthetic oligonucleotide
agcgaggccgggtctcacacccta

SEQ ID NO: 387218 - DNA, 23 bp, Artificial Sequence
  Description of Artificial Sequence: Synthetic oligonucleotide
gcgaggccgggtctcacacccta

SEQ ID NO: 387219 - DNA, 24 bp, Artificial Sequence
  Description of Artificial Sequence: Synthetic oligonucleotide
cgaggccgggtctcacaccctaca

SEQ ID NO: 387220 - DNA, 25 bp, Artificial Sequence
  Description of Artificial Sequence: Synthetic oligonucleotide
gaggccgggtctcacaccctacagt

SEQ ID NO: 387221 - DNA, 25 bp, Artificial Sequence
  Description of Artificial Sequence: Synthetic oligonucleotide
aggccgggtctcacaccctacagtg

SEQ ID NO: 387222 - DNA, 24 bp, Artificial Sequence
  Description of Artificial Sequence: Synthetic oligonucleotide
ggccgggtctcacaccctacagtg

SEQ ID NO: 387223 - DNA, 26 bp, Artificial Sequence
  Description of Artificial Sequence: Synthetic oligonucleotide
gccgggtctcacaccctacagtggat

SEQ ID NO: 387224 - DNA, 27 bp, Artificial Sequence
  Description of Artificial Sequence: Synthetic oligonucleotide
ccgggtctcacaccctacagtggatgt

SEQ ID NO: 387225 - DNA, 29 bp, Artificial Sequence
  Description of Artificial Sequence: Synthetic oligonucleotide
cgggtctcacaccctacagtggatgtatg

SEQ ID NO: 387226 - DNA, 29 bp, Artificial Sequence
  Description of Artificial Sequence: Synthetic oligonucleotide
gggtctcacaccctacagtggatgtatgg

SEQ ID NO: 387227 - DNA, 29 bp, Artificial Sequence
  Description of Artificial Sequence: Synthetic oligonucleotide
ggtctcacaccctacagtggatgtatggc

SEQ ID NO: 387228 - DNA, 30 bp, Artificial Sequence
  Description of Artificial Sequence: Synthetic oligonucleotide
gtctcacaccctacagtggatgtatggctg

SEQ ID NO: 387229 - DNA, 30 bp, Artificial Sequence
  Description of Artificial Sequence: Synthetic oligonucleotide
tctcacaccctacagtggatgtatggctgc

SEQ ID NO: 387230 - DNA, 29 bp, Artificial Sequence
  Description of Artificial Sequence: Synthetic oligonucleotide
ctcacaccctacagtggatgtatggctgc

SEQ ID NO: 387231 - DNA, 29 bp, Artificial Sequence
  Description of Artificial Sequence: Synthetic oligonucleotide
tcacaccctacagtggatgtatggctgcg

SEQ ID NO: 387232 - DNA, 28 bp, Artificial Sequence
  Description of Artificial Sequence: Synthetic oligonucleotide
cacaccctacagtggatgtatggctgcg

SEQ ID NO: 387233 - DNA, 29 bp, Artificial Sequence
  Description of Artificial Sequence: Synthetic oligonucleotide
acaccctacagtggatgtatggctgcgac

SEQ ID NO: 387234 - DNA, 28 bp, Artificial Sequence
  Description of Artificial Sequence: Synthetic oligonucleotide
caccctacagtggatgtatggctgcgac

SEQ ID NO: 387235 - DNA, 28 bp, Artificial Sequence
  Description of Artificial Sequence: Synthetic oligonucleotide
accctacagtggatgtatggctgcgacc

SEQ ID NO: 387236 - DNA, 27 bp, Artificial Sequence
  Description of Artificial Sequence: Synthetic oligonucleotide
ccctacagtggatgtatggctgcgacc

SEQ ID NO: 387237 - DNA, 28 bp, Artificial Sequence
  Description of Artificial Sequence: Synthetic oligonucleotide
cctacagtggatgtatggctgcgacctg

SEQ ID NO: 387238 - DNA, 28 bp, Artificial Sequence
  Description of Artificial Sequence: Synthetic oligonucleotide
ctacagtggatgtatggctgcgacctgg

SEQ ID NO: 387239 - DNA, 28 bp, Artificial Sequence
  Description of Artificial Sequence: Synthetic oligonucleotide
tacagtggatgtatggctgcgacctggg

SEQ ID NO: 387240 - DNA, 27 bp, Artificial Sequence
  Description of Artificial Sequence: Synthetic oligonucleotide
acagtggatgtatggctgcgacctggg

SEQ ID NO: 387241 - DNA, 27 bp, Artificial Sequence
  Description of Artificial Sequence: Synthetic oligonucleotide
tacaaccagagcgaggccgggtctcat

SEQ ID NO: 387242 - DNA, 27 bp, Artificial Sequence
  Description of Artificial Sequence: Synthetic oligonucleotide
acaaccagagcgaggccgggtctcata

SEQ ID NO: 387243 - DNA, 26 bp, Artificial Sequence
  Description of Artificial Sequence: Synthetic oligonucleotide
caaccagagcgaggccgggtctcata

SEQ ID NO: 387244 - DNA, 26 bp, Artificial Sequence
  Description of Artificial Sequence: Synthetic oligonucleotide
aaccagagcgaggccgggtctcatac

SEQ ID NO: 387245 - DNA, 25 bp, Artificial Sequence
  Description of Artificial Sequence: Synthetic oligonucleotide
accagagcgaggccgggtctcatac

SEQ ID NO: 387246 - DNA, 24 bp, Artificial Sequence
  Description of Artificial Sequence: Synthetic oligonucleotide
ccagagcgaggccgggtctcatac

SEQ ID NO: 387247 - DNA, 24 bp, Artificial Sequence
  Description of Artificial Sequence: Synthetic oligonucleotide
cagagcgaggccgggtctcatacc

SEQ ID NO: 387248 - DNA, 25 bp, Artificial Sequence
  Description of Artificial Sequence: Synthetic oligonucleotide
agagcgaggccgggtctcataccct

SEQ ID NO: 387249 - DNA, 24 bp, Artificial Sequence
  Description of Artificial Sequence: Synthetic oligonucleotide
gagcgaggccgggtctcataccct

SEQ ID NO: 387250 - DNA, 24 bp, Artificial Sequence
  Description of Artificial Sequence: Synthetic oligonucleotide
agcgaggccgggtctcataccctc

SEQ ID NO: 387251 - DNA, 23 bp, Artificial Sequence
  Description of Artificial Sequence: Synthetic oligonucleotide
gcgaggccgggtctcataccctc

SEQ ID NO: 387252 - DNA, 24 bp, Artificial Sequence
  Description of Artificial Sequence: Synthetic oligonucleotide
cgaggccgggtctcataccctcca

SEQ ID NO: 387253 - DNA, 25 bp, Artificial Sequence
  Description of Artificial Sequence: Synthetic oligonucleotide
gaggccgggtctcataccctccagt

SEQ ID NO: 387254 - DNA, 25 bp, Artificial Sequence
  Description of Artificial Sequence: Synthetic oligonucleotide
aggccgggtctcataccctccagtg

SEQ ID NO: 387255 - DNA, 24 bp, Artificial Sequence
  Description of Artificial Sequence: Synthetic oligonucleotide
ggccgggtctcataccctccagtg

SEQ ID NO: 387256 - DNA, 26 bp, Artificial Sequence
  Description of Artificial Sequence: Synthetic oligonucleotide
gccgggtctcataccctccagtggat

SEQ ID NO: 387257 - DNA, 27 bp, Artificial Sequence
  Description of Artificial Sequence: Synthetic oligonucleotide
ccgggtctcataccctccagtggatgt

SEQ ID NO: 387258 - DNA, 29 bp, Artificial Sequence
  Description of Artificial Sequence: Synthetic oligonucleotide
cgggtctcataccctccagtggatgtatg

SEQ ID NO: 387259 - DNA, 29 bp, Artificial Sequence
  Description of Artificial Sequence: Synthetic oligonucleotide
gggtctcataccctccagtggatgtatgg

SEQ ID NO: 387260 - DNA, 29 bp, Artificial Sequence
  Description of Artificial Sequence: Synthetic oligonucleotide
ggtctcataccctccagtggatgtatggc

SEQ ID NO: 387261 - DNA, 30 bp, Artificial Sequence; identical to SEQ ID NO: 50365
  Description of Artificial Sequence: Synthetic oligonucleotide

SEQ ID NO: 387262 - DNA, 30 bp, Artificial Sequence; identical to SEQ ID NO: 50366
  Description of Artificial Sequence: Synthetic oligonucleotide

SEQ ID NO: 387263 - DNA, 29 bp, Artificial Sequence
  Description of Artificial Sequence: Synthetic oligonucleotide
ctcataccctccagtggatgtatggctgc

SEQ ID NO: 387264 - DNA, 29 bp, Artificial Sequence
  Description of Artificial Sequence: Synthetic oligonucleotide
tcataccctccagtggatgtatggctgcg

SEQ ID NO: 387265 - DNA, 28 bp, Artificial Sequence
  Description of Artificial Sequence: Synthetic oligonucleotide
cataccctccagtggatgtatggctgcg

SEQ ID NO: 387266 - DNA, 29 bp, Artificial Sequence
  Description of Artificial Sequence: Synthetic oligonucleotide
ataccctccagtggatgtatggctgcgac

SEQ ID NO: 387267 - DNA, 28 bp, Artificial Sequence
  Description of Artificial Sequence: Synthetic oligonucleotide
taccctccagtggatgtatggctgcgac

SEQ ID NO: 387268 - DNA, 32 bp, Artificial Sequence
  Description of Artificial Sequence: Synthetic oligonucleotide
cactccatgaggtatttctacaccgccgtatc

SEQ ID NO: 387269 - DNA, 32 bp, Artificial Sequence
  Description of Artificial Sequence: Synthetic oligonucleotide
actccatgaggtatttctacaccgccgtatcc

SEQ ID NO: 387270 - DNA, 31 bp, Artificial Sequence
  Description of Artificial Sequence: Synthetic oligonucleotide
ctccatgaggtatttctacaccgccgtatcc

SEQ ID NO: 387271 - DNA, 31 bp, Artificial Sequence
  Description of Artificial Sequence: Synthetic oligonucleotide
tccatgaggtatttctacaccgccgtatccc

SEQ ID NO: 387272 - DNA, 30 bp, Artificial Sequence
  Description of Artificial Sequence: Synthetic oligonucleotide
ccatgaggtatttctacaccgccgtatccc

SEQ ID NO: 387273 - DNA, 30 bp, Artificial Sequence
  Description of Artificial Sequence: Synthetic oligonucleotide
catgaggtatttctacaccgccgtatcccg

SEQ ID NO: 387274 - DNA, 30 bp, Artificial Sequence
  Description of Artificial Sequence: Synthetic oligonucleotide
atgaggtatttctacaccgccgtatcccgg

SEQ ID NO: 387275 - DNA, 29 bp, Artificial Sequence
  Description of Artificial Sequence: Synthetic oligonucleotide
tgaggtatttctacaccgccgtatcccgg

SEQ ID NO: 387276 - DNA, 28 bp, Artificial Sequence
  Description of Artificial Sequence: Synthetic oligonucleotide
gaggtatttctacaccgccgtatcccgg

SEQ ID NO: 387277 - DNA, 28 bp, Artificial Sequence
  Description of Artificial Sequence: Synthetic oligonucleotide
aggtatttctacaccgccgtatcccggc

SEQ ID NO: 387278 - DNA, 27 bp, Artificial Sequence
  Description of Artificial Sequence: Synthetic oligonucleotide
ggtatttctacaccgccgtatcccggc

SEQ ID NO: 387279 - DNA, 27 bp, Artificial Sequence
  Description of Artificial Sequence: Synthetic oligonucleotide
gtatttctacaccgccgtatcccggcc

SEQ ID NO: 387280 - DNA, 27 bp, Artificial Sequence
  Description of Artificial Sequence: Synthetic oligonucleotide
tatttctacaccgccgtatcccggccc

SEQ ID NO: 387281 - DNA, 26 bp, Artificial Sequence
  Description of Artificial Sequence: Synthetic oligonucleotide
atttctacaccgccgtatcccggccc

SEQ ID NO: 387282 - DNA, 25 bp, Artificial Sequence
  Description of Artificial Sequence: Synthetic oligonucleotide
tttctacaccgccgtatcccggccc

SEQ ID NO: 387283 - DNA, 24 bp, Artificial Sequence
  Description of Artificial Sequence: Synthetic oligonucleotide
ttctacaccgccgtatcccggccc

SEQ ID NO: 387284 - DNA, 23 bp, Artificial Sequence
  Description of Artificial Sequence: Synthetic oligonucleotide
tctacaccgccgtatcccggccc

SEQ ID NO: 387285 - DNA, 22 bp, Artificial Sequence
  Description of Artificial Sequence: Synthetic oligonucleotide
ctacaccgccgtatcccggccc

SEQ ID NO: 387286 - DNA, 22 bp, Artificial Sequence
  Description of Artificial Sequence: Synthetic oligonucleotide
tacaccgccgtatcccggcccg

SEQ ID NO: 387287 - DNA, 21 bp, Artificial Sequence
  Description of Artificial Sequence: Synthetic oligonucleotide
acaccgccgtatcccggcccg

SEQ ID NO: 387288 - DNA, 20 bp, Artificial Sequence
  Description of Artificial Sequence: Synthetic oligonucleotide
caccgccgtatcccggcccg

SEQ ID NO: 387289 - DNA, 20 bp, Artificial Sequence
  Description of Artificial Sequence: Synthetic oligonucleotide
accgccgtatcccggcccgg

SEQ ID NO: 387290 - DNA, 20 bp, Artificial Sequence
  Description of Artificial Sequence: Synthetic oligonucleotide
ccgccgtatcccggcccggt

SEQ ID NO: 387291 - DNA, 20 bp, Artificial Sequence
  Description of Artificial Sequence: Synthetic oligonucleotide
cgccgtatcccggcccggct

SEQ ID NO: 387292 - DNA, 20 bp, Artificial Sequence
  Description of Artificial Sequence: Synthetic oligonucleotide
gccgtatcccggcccggcct

SEQ ID NO: 387293 - DNA, 20 bp, Artificial Sequence
  Description of Artificial Sequence: Synthetic oligonucleotide
ccgtatcccggcccggccgt

SEQ ID NO: 387294 - DNA, 20 bp, Artificial Sequence
  Description of Artificial Sequence: Synthetic oligonucleotide
cgtatcccggcccggccgct

SEQ ID NO: 387295 - DNA, 20 bp, Artificial Sequence
  Description of Artificial Sequence: Synthetic oligonucleotide
gtatcccggcccggccgcgt

SEQ ID NO: 387296 - DNA, 20 bp, Artificial Sequence
  Description of Artificial Sequence: Synthetic oligonucleotide
tatcccggcccggccgcgga

SEQ ID NO: 387297 - DNA, 20 bp, Artificial Sequence
  Description of Artificial Sequence: Synthetic oligonucleotide
atcccggcccggccgcggat

SEQ ID NO: 387298 - DNA, 20 bp, Artificial Sequence
  Description of Artificial Sequence: Synthetic oligonucleotide
gcccgtgcggcggagcagtg

SEQ ID NO: 387299 - DNA, 21 bp, Artificial Sequence
  Description of Artificial Sequence: Synthetic oligonucleotide
cccgtgcggcggagcagtgga

SEQ ID NO: 387300 - DNA, 22 bp, Artificial Sequence
  Description of Artificial Sequence: Synthetic oligonucleotide
ccgtgcggcggagcagtggaga

SEQ ID NO: 387301 - DNA, 22 bp, Artificial Sequence
  Description of Artificial Sequence: Synthetic oligonucleotide
cgtgcggcggagcagtggagag

SEQ ID NO: 387302 - DNA, 22 bp, Artificial Sequence
  Description of Artificial Sequence: Synthetic oligonucleotide
gtgcggcggagcagtggagagc

SEQ ID NO: 387303 - DNA, 24 bp, Artificial Sequence
  Description of Artificial Sequence: Synthetic oligonucleotide
tgcggcggagcagtggagagccta

SEQ ID NO: 387304 - DNA, 23 bp, Artificial Sequence
  Description of Artificial Sequence: Synthetic oligonucleotide
gcggcggagcagtggagagccta

SEQ ID NO: 387305 - DNA, 23 bp, Artificial Sequence
  Description of Artificial Sequence: Synthetic oligonucleotide
cggcggagcagtggagagcctac

SEQ ID NO: 387306 - DNA, 21 bp, Artificial Sequence
  Description of Artificial Sequence: Synthetic oligonucleotide
caagaggggagccgcgggcgt

SEQ ID NO: 387307 - DNA, 21 bp, Artificial Sequence
  Description of Artificial Sequence: Synthetic oligonucleotide
aagaggggagccgcgggcgtc

SEQ ID NO: 387308 - DNA, 20 bp, Artificial Sequence
  Description of Artificial Sequence: Synthetic oligonucleotide
agaggggagccgcgggcgtc

SEQ ID NO: 387309 - DNA, 20 bp, Artificial Sequence
  Description of Artificial Sequence: Synthetic oligonucleotide
gaggggagccgcgggcgtct

SEQ ID NO: 387310 - DNA, 20 bp, Artificial Sequence
  Description of Artificial Sequence: Synthetic oligonucleotide
aggggagccgcgggcgtcgt

SEQ ID NO: 387311 - DNA, 20 bp, Artificial Sequence
  Description of Artificial Sequence: Synthetic oligonucleotide
ggggagccgcgggcgtcgtt

SEQ ID NO: 387312 - DNA, 20 bp, Artificial Sequence
  Description of Artificial Sequence: Synthetic oligonucleotide
gggagccgcgggcgtcgtgt

SEQ ID NO: 387313 - DNA, 20 bp, Artificial Sequence
  Description of Artificial Sequence: Synthetic oligonucleotide
ggagccgcgggcgtcgtggt

SEQ ID NO: 387314 - DNA, 20 bp, Artificial Sequence
  Description of Artificial Sequence: Synthetic oligonucleotide
gagccgcgggcgtcgtgggt

SEQ ID NO: 387315 - DNA, 20 bp, Artificial Sequence
  Description of Artificial Sequence: Synthetic oligonucleotide
agccgcgggcgtcgtgggtg

SEQ ID NO: 387316 - DNA, 20 bp, Artificial Sequence
  Description of Artificial Sequence: Synthetic oligonucleotide
gccgcgggcgtcgtgggtgt

SEQ ID NO: 387317 - DNA, 20 bp, Artificial Sequence
  Description of Artificial Sequence: Synthetic oligonucleotide
ccgcgggcgtcgtgggtgga

SEQ ID NO: 387318 - DNA, 20 bp, Artificial Sequence
  Description of Artificial Sequence: Synthetic oligonucleotide
cgcgggcgtcgtgggtggag

SEQ ID NO: 387319 - DNA, 21 bp, Artificial Sequence
  Description of Artificial Sequence: Synthetic oligonucleotide
gcgggcgtcgtgggtggagca

SEQ ID NO: 387320 - DNA, 21 bp, Artificial Sequence
  Description of Artificial Sequence: Synthetic oligonucleotide
cgggcgtcgtgggtggagcag

SEQ ID NO: 387321 - DNA, 22 bp, Artificial Sequence
  Description of Artificial Sequence: Synthetic oligonucleotide
gggcgtcgtgggtggagcagga

SEQ ID NO: 387322 - DNA, 22 bp, Artificial Sequence
  Description of Artificial Sequence: Synthetic oligonucleotide
ggcgtcgtgggtggagcaggag

SEQ ID NO: 387323 - DNA, 22 bp, Artificial Sequence
  Description of Artificial Sequence: Synthetic oligonucleotide
gcgtcgtgggtggagcaggagg

SEQ ID NO: 387324 - DNA, 22 bp, Artificial Sequence
  Description of Artificial Sequence: Synthetic oligonucleotide
cgtcgtgggtggagcaggaggg

SEQ ID NO: 387325 - DNA, 22 bp, Artificial Sequence
  Description of Artificial Sequence: Synthetic oligonucleotide
gtcgtgggtggagcaggagggg

SEQ ID NO: 387326 - DNA, 22 bp, Artificial Sequence
  Description of Artificial Sequence: Synthetic oligonucleotide
tcgtgggtggagcaggaggggc

SEQ ID NO: 387327 - DNA, 21 bp, Artificial Sequence
  Description of Artificial Sequence: Synthetic oligonucleotide
aggtcccgggcggggctctct

SEQ ID NO: 387328 - DNA, 20 bp, Artificial Sequence
  Description of Artificial Sequence: Synthetic oligonucleotide
ggtcccgggcggggctctct

SEQ ID NO: 387329 - DNA, 20 bp, Artificial Sequence
  Description of Artificial Sequence: Synthetic oligonucleotide
gtcccgggcggggctctctg

SEQ ID NO: 387330 - DNA, 20 bp, Artificial Sequence
  Description of Artificial Sequence: Synthetic oligonucleotide
tcccgggcggggctctctgg

SEQ ID NO: 387331 - DNA, 20 bp, Artificial Sequence
  Description of Artificial Sequence: Synthetic oligonucleotide
cccgggcggggctctctggt

SEQ ID NO: 387332 - DNA, 20 bp, Artificial Sequence
  Description of Artificial Sequence: Synthetic oligonucleotide
ccgggcggggctctctgggt

SEQ ID NO: 387333 - DNA, 21 bp, Artificial Sequence
  Description of Artificial Sequence: Synthetic oligonucleotide
cgggcggggctctctgggtct

SEQ ID NO: 387334 - DNA, 23 bp, Artificial Sequence
  Description of Artificial Sequence: Synthetic oligonucleotide
gggcggggctctctgggtctcaa

SEQ ID NO: 387335 - DNA, 23 bp, Artificial Sequence
  Description of Artificial Sequence: Synthetic oligonucleotide
ggcggggctctctgggtctcaag

SEQ ID NO: 387336 - DNA, 24 bp, Artificial Sequence
  Description of Artificial Sequence: Synthetic oligonucleotide
gcggggctctctgggtctcaagct

SEQ ID NO: 387337 - DNA, 24 bp, Artificial Sequence
  Description of Artificial Sequence: Synthetic oligonucleotide
cggggctctctgggtctcaagctc

SEQ ID NO: 387338 - DNA, 24 bp, Artificial Sequence
  Description of Artificial Sequence: Synthetic oligonucleotide
ggggctctctgggtctcaagctcc

SEQ ID NO: 387339 - DNA, 25 bp, Artificial Sequence
  Description of Artificial Sequence: Synthetic oligonucleotide
gggctctctgggtctcaagctccca

SEQ ID NO: 387340 - DNA, 25 bp, Artificial Sequence
  Description of Artificial Sequence: Synthetic oligonucleotide
ggctctctgggtctcaagctcccag

SEQ ID NO: 387341 - DNA, 25 bp, Artificial Sequence
  Description of Artificial Sequence: Synthetic oligonucleotide
gctctctgggtctcaagctcccagg

SEQ ID NO: 387342 - DNA, 25 bp, Artificial Sequence
  Description of Artificial Sequence: Synthetic oligonucleotide
ctctctgggtctcaagctcccaggg

SEQ ID NO: 387343 - DNA, 25 bp, Artificial Sequence
  Description of Artificial Sequence: Synthetic oligonucleotide
tctctgggtctcaagctcccagggc

SEQ ID NO: 387344 - DNA, 24 bp, Artificial Sequence
  Description of Artificial Sequence: Synthetic oligonucleotide
ctctgggtctcaagctcccagggc

SEQ ID NO: 387345 - DNA, 24 bp, Artificial Sequence
  Description of Artificial Sequence: Synthetic oligonucleotide
tctgggtctcaagctcccagggcc

SEQ ID NO: 387346 - DNA, 23 bp, Artificial Sequence
  Description of Artificial Sequence: Synthetic oligonucleotide
ctgggtctcaagctcccagggcc

SEQ ID NO: 387347 - DNA, 24 bp, Artificial Sequence
  Description of Artificial Sequence: Synthetic oligonucleotide
tgggtctcaagctcccagggccgt

SEQ ID NO: 387348 - DNA, 23 bp, Artificial Sequence
  Description of Artificial Sequence: Synthetic oligonucleotide
gggtctcaagctcccagggccgt

SEQ ID NO: 387349 - DNA, 24 bp, Artificial Sequence
  Description of Artificial Sequence: Synthetic oligonucleotide
ggtctcaagctcccagggccgtgt

SEQ ID NO: 387350 - DNA, 25 bp, Artificial Sequence
  Description of Artificial Sequence: Synthetic oligonucleotide
gtctcaagctcccagggccgtgtct

SEQ ID NO: 387351 - DNA, 25 bp, Artificial Sequence
  Description of Artificial Sequence: Synthetic oligonucleotide
tctcaagctcccagggccgtgtctg

SEQ ID NO: 387352 - DNA, 24 bp, Artificial Sequence
  Description of Artificial Sequence: Synthetic oligonucleotide
ctcaagctcccagggccgtgtctg

SEQ ID NO: 387353 - DNA, 27 bp, Artificial Sequence
  Description of Artificial Sequence: Synthetic oligonucleotide
tcaagctcccagggccgtgtctgcatt

SEQ ID NO: 387354 - DNA, 26 bp, Artificial Sequence
  Description of Artificial Sequence: Synthetic oligonucleotide
caagctcccagggccgtgtctgcatt

SEQ ID NO: 387355 - DNA, 26 bp, Artificial Sequence
  Description of Artificial Sequence: Synthetic oligonucleotide
aagctcccagggccgtgtctgcattg

SEQ ID NO: 387356 - DNA, 25 bp, Artificial Sequence
  Description of Artificial Sequence: Synthetic oligonucleotide
agctcccagggccgtgtctgcattg

SEQ ID NO: 387357 - DNA, 24 bp, Artificial Sequence
  Description of Artificial Sequence: Synthetic oligonucleotide
gctcccagggccgtgtctgcattg

SEQ ID NO: 387358 - DNA, 24 bp, Artificial Sequence
  Description of Artificial Sequence: Synthetic oligonucleotide
ctcccagggccgtgtctgcattgg

SEQ ID NO: 387359 - DNA, 24 bp, Artificial Sequence
  Description of Artificial Sequence: Synthetic oligonucleotide
tcccagggccgtgtctgcattggg

SEQ ID NO: 387360 - DNA, 23 bp, Artificial Sequence
  Description of Artificial Sequence: Synthetic oligonucleotide
cccagggccgtgtctgcattggg

SEQ ID NO: 387361 - DNA, 24 bp, Artificial Sequence
  Description of Artificial Sequence: Synthetic oligonucleotide
ccagggccgtgtctgcattgggga

SEQ ID NO: 387362 - DNA, 24 bp, Artificial Sequence
  Description of Artificial Sequence: Synthetic oligonucleotide
cagggccgtgtctgcattggggag

SEQ ID NO: 387363 - DNA, 24 bp, Artificial Sequence
  Description of Artificial Sequence: Synthetic oligonucleotide
ccgtgtctgcattggggaggcgca

SEQ ID NO: 387364 - DNA, 24 bp, Artificial Sequence
  Description of Artificial Sequence: Synthetic oligonucleotide
cgtgtctgcattggggaggcgcag

SEQ ID NO: 387365 - DNA, 24 bp, Artificial Sequence
  Description of Artificial Sequence: Synthetic oligonucleotide
gtgtctgcattggggaggcgcagc

SEQ ID NO: 387366 - DNA, 26 bp, Artificial Sequence
  Description of Artificial Sequence: Synthetic oligonucleotide
agcgttggggattccccactcccact

SEQ ID NO: 387367 - DNA, 25 bp, Artificial Sequence
  Description of Artificial Sequence: Synthetic oligonucleotide
gcgttggggattccccactcccact

SEQ ID NO: 387368 - DNA, 25 bp, Artificial Sequence
  Description of Artificial Sequence: Synthetic oligonucleotide
cgttggggattccccactcccactc

SEQ ID NO: 387369 - DNA, 25 bp, Artificial Sequence
  Description of Artificial Sequence: Synthetic oligonucleotide
gttggggattccccactcccactcc

SEQ ID NO: 387370 - DNA, 25 bp, Artificial Sequence
  Description of Artificial Sequence: Synthetic oligonucleotide
ttggggattccccactcccactccc

SEQ ID NO: 387371 - DNA, 24 bp, Artificial Sequence
  Description of Artificial Sequence: Synthetic oligonucleotide
tggggattccccactcccactccc

SEQ ID NO: 387372 - DNA, 23 bp, Artificial Sequence
  Description of Artificial Sequence: Synthetic oligonucleotide
ggggattccccactcccactccc

SEQ ID NO: 387373 - DNA, 24 bp, Artificial Sequence
  Description of Artificial Sequence: Synthetic oligonucleotide
gggattccccactcccactcccct

SEQ ID NO: 387374 - DNA, 25 bp, Artificial Sequence
  Description of Artificial Sequence: Synthetic oligonucleotide
ggattccccactcccactcccctga

SEQ ID NO: 387375 - DNA, 27 bp, Artificial Sequence
  Description of Artificial Sequence: Synthetic oligonucleotide
gattccccactcccactcccctgagtt

SEQ ID NO: 387376 - DNA, 28 bp, Artificial Sequence
  Description of Artificial Sequence: Synthetic oligonucleotide
attccccactcccactcccctgagtttc

SEQ ID NO: 387377 - DNA, 27 bp, Artificial Sequence
  Description of Artificial Sequence: Synthetic oligonucleotide
ttccccactcccactcccctgagtttc

SEQ ID NO: 387378 - DNA, 27 bp, Artificial Sequence
  Description of Artificial Sequence: Synthetic oligonucleotide
tccccactcccactcccctgagtttca

SEQ ID NO: 387379 - DNA, 26 bp, Artificial Sequence
  Description of Artificial Sequence: Synthetic oligonucleotide
ccccactcccactcccctgagtttca

SEQ ID NO: 387380 - DNA, 27 bp, Artificial Sequence
  Description of Artificial Sequence: Synthetic oligonucleotide
cccactcccactcccctgagtttcact

SEQ ID NO: 387381 - DNA, 28 bp, Artificial Sequence
  Description of Artificial Sequence: Synthetic oligonucleotide
ccactcccactcccctgagtttcacttc

SEQ ID NO: 387382 - DNA, 30 bp, Artificial Sequence
  Description of Artificial Sequence: Synthetic oligonucleotide
cactcccactcccctgagtttcacttcttc

SEQ ID NO: 387383 - DNA, 31 bp, Artificial Sequence
  Description of Artificial Sequence: Synthetic oligonucleotide
actcccactcccctgagtttcacttcttctc

SEQ ID NO: 387384 - DNA, 30 bp, Artificial Sequence
  Description of Artificial Sequence: Synthetic oligonucleotide
ctcccactcccctgagtttcacttcttctc

SEQ ID NO: 387385 - DNA, 30 bp, Artificial Sequence
  Description of Artificial Sequence: Synthetic oligonucleotide
tcccactcccctgagtttcacttcttctcc

SEQ ID NO: 387386 - DNA, 31 bp, Artificial Sequence
  Description of Artificial Sequence: Synthetic oligonucleotide
tcgggttctagagaagccaatcagcgtctac

SEQ ID NO: 387387 - DNA, 30 bp, Artificial Sequence
  Description of Artificial Sequence: Synthetic oligonucleotide
cgggttctagagaagccaatcagcgtctac

SEQ ID NO: 387388 - DNA, 30 bp, Artificial Sequence
  Description of Artificial Sequence: Synthetic oligonucleotide
gggttctagagaagccaatcagcgtctacg

SEQ ID NO: 387389 - DNA, 30 bp, Artificial Sequence
  Description of Artificial Sequence: Synthetic oligonucleotide
ggttctagagaagccaatcagcgtctacgc

SEQ ID NO: 387390 - DNA, 31 bp, Artificial Sequence
  Description of Artificial Sequence: Synthetic oligonucleotide
gttctagagaagccaatcagcgtctacgcag

SEQ ID NO: 387391 - DNA, 32 bp, Artificial Sequence
  Description of Artificial Sequence: Synthetic oligonucleotide
ttctagagaagccaatcagcgtctacgcagtc

SEQ ID NO: 387392 - DNA, 31 bp, Artificial Sequence
  Description of Artificial Sequence: Synthetic oligonucleotide
tctagagaagccaatcagcgtctacgcagtc

SEQ ID NO: 387393 - DNA, 30 bp, Artificial Sequence
  Description of Artificial Sequence: Synthetic oligonucleotide
ctagagaagccaatcagcgtctacgcagtc

SEQ ID NO: 387394 - DNA, 30 bp, Artificial Sequence
  Description of Artificial Sequence: Synthetic oligonucleotide
tagagaagccaatcagcgtctacgcagtcc

SEQ ID NO: 387395 - DNA, 29 bp, Artificial Sequence
  Description of Artificial Sequence: Synthetic oligonucleotide
agagaagccaatcagcgtctacgcagtcc

SEQ ID NO: 387396 - DNA, 28 bp, Artificial Sequence
  Description of Artificial Sequence: Synthetic oligonucleotide
gagaagccaatcagcgtctacgcagtcc

SEQ ID NO: 387397 - DNA, 28 bp, Artificial Sequence
  Description of Artificial Sequence: Synthetic oligonucleotide
agaagccaatcagcgtctacgcagtccc

SEQ ID NO: 387398 - DNA, 27 bp, Artificial Sequence
  Description of Artificial Sequence: Synthetic oligonucleotide
gaagccaatcagcgtctacgcagtccc

SEQ ID NO: 387399 - DNA, 27 bp, Artificial Sequence
  Description of Artificial Sequence: Synthetic oligonucleotide
aagccaatcagcgtctacgcagtcccg

SEQ ID NO: 387400 - DNA, 26 bp, Artificial Sequence
  Description of Artificial Sequence: Synthetic oligonucleotide
agccaatcagcgtctacgcagtcccg

SEQ ID NO: 387401 - DNA, 25 bp, Artificial Sequence
  Description of Artificial Sequence: Synthetic oligonucleotide
gccaatcagcgtctacgcagtcccg

SEQ ID NO: 387402 - DNA, 27 bp, Artificial Sequence
  Description of Artificial Sequence: Synthetic oligonucleotide
ccaatcagcgtctacgcagtcccggtt

SEQ ID NO: 387403 - DNA, 27 bp, Artificial Sequence
  Description of Artificial Sequence: Synthetic oligonucleotide
caatcagcgtctacgcagtcccggttc

SEQ ID NO: 387404 - DNA, 28 bp, Artificial Sequence
  Description of Artificial Sequence: Synthetic oligonucleotide
aatcagcgtctacgcagtcccggttctg

SEQ ID NO: 387405 - DNA, 27 bp, Artificial Sequence
  Description of Artificial Sequence: Synthetic oligonucleotide
atcagcgtctacgcagtcccggttctg

SEQ ID NO: 387406 - DNA, 27 bp, Artificial Sequence
  Description of Artificial Sequence: Synthetic oligonucleotide
tcagcgtctacgcagtcccggttctga

SEQ ID NO: 387407 - DNA, 27 bp, Artificial Sequence
  Description of Artificial Sequence: Synthetic oligonucleotide
cagcgtctacgcagtcccggttctgaa

SEQ ID NO: 387408 - DNA, 27 bp, Artificial Sequence
  Description of Artificial Sequence: Synthetic oligonucleotide
agcgtctacgcagtcccggttctgaag

SEQ ID NO: 387409 - DNA, 27 bp, Artificial Sequence
  Description of Artificial Sequence: Synthetic oligonucleotide
gcgtctacgcagtcccggttctgaagt

SEQ ID NO: 387410 - DNA, 27 bp, Artificial Sequence
  Description of Artificial Sequence: Synthetic oligonucleotide
cgtctacgcagtcccggttctgaagtc

SEQ ID NO: 387411 - DNA, 28 bp, Artificial Sequence
  Description of Artificial Sequence: Synthetic oligonucleotide
gtctacgcagtcccggttctgaagtcac

SEQ ID NO: 387412 - DNA, 28 bp, Artificial Sequence
  Description of Artificial Sequence: Synthetic oligonucleotide
tctacgcagtcccggttctgaagtcacc

SEQ ID NO: 387413 - DNA, 27 bp, Artificial Sequence
  Description of Artificial Sequence: Synthetic oligonucleotide
ctacgcagtcccggttctgaagtcacc

SEQ ID NO: 387414 - DNA, 27 bp, Artificial Sequence
  Description of Artificial Sequence: Synthetic oligonucleotide
tacgcagtcccggttctgaagtcaccc

SEQ ID NO: 387415 - DNA, 27 bp, Artificial Sequence
  Description of Artificial Sequence: Synthetic oligonucleotide
acgcagtcccggttctgaagtcaccca

SEQ ID NO: 387416 - DNA, 26 bp, Artificial Sequence
  Description of Artificial Sequence: Synthetic oligonucleotide
cgcagtcccggttctgaagtcaccca

SEQ ID NO: 387417 - DNA, 26 bp, Artificial Sequence
  Description of Artificial Sequence: Synthetic oligonucleotide
gcagtcccggttctgaagtcacccac

SEQ ID NO: 387418 - DNA, 26 bp, Artificial Sequence
  Description of Artificial Sequence: Synthetic oligonucleotide
cagtcccggttctgaagtcacccacc

SEQ ID NO: 387419 - DNA, 26 bp, Artificial Sequence
  Description of Artificial Sequence: Synthetic oligonucleotide
agtcccggttctgaagtcacccaccc

SEQ ID NO: 387420 - DNA, 25 bp, Artificial Sequence
  Description of Artificial Sequence: Synthetic oligonucleotide
gtcccggttctgaagtcacccaccc

SEQ ID NO: 387421 - DNA, 25 bp, Artificial Sequence
  Description of Artificial Sequence: Synthetic oligonucleotide
tcccggttctgaagtcacccacccg

SEQ ID NO: 387422 - DNA, 24 bp, Artificial Sequence
  Description of Artificial Sequence: Synthetic oligonucleotide
cccggttctgaagtcacccacccg

SEQ ID NO: 387423 - DNA, 25 bp, Artificial Sequence
  Description of Artificial Sequence: Synthetic oligonucleotide
ccggttctgaagtcacccacccgga

SEQ ID NO: 387424 - DNA, 26 bp, Artificial Sequence
  Description of Artificial Sequence: Synthetic oligonucleotide
cggttctgaagtcacccacccggact

SEQ ID NO: 387425 - DNA, 27 bp, Artificial Sequence
  Description of Artificial Sequence: Synthetic oligonucleotide
ggttctgaagtcacccacccggactca

SEQ ID NO: 387426 - DNA, 27 bp, Artificial Sequence
  Description of Artificial Sequence: Synthetic oligonucleotide
gttctgaagtcacccacccggactcag

SEQ ID NO: 387427 - DNA, 30 bp, Artificial Sequence
  Description of Artificial Sequence: Synthetic oligonucleotide
ttctgaagtcacccacccggactcagattc

SEQ ID NO: 387428 - DNA, 29 bp, Artificial Sequence
  Description of Artificial Sequence: Synthetic oligonucleotide
tctgaagtcacccacccggactcagattc

SEQ ID NO: 387429 - DNA, 28 bp, Artificial Sequence
  Description of Artificial Sequence: Synthetic oligonucleotide
ctgaagtcacccacccggactcagattc

SEQ ID NO: 387430 - DNA, 29 bp, Artificial Sequence
  Description of Artificial Sequence: Synthetic oligonucleotide
tgaagtcacccacccggactcagattctc

SEQ ID NO: 387431 - DNA, 28 bp, Artificial Sequence
  Description of Artificial Sequence: Synthetic oligonucleotide
gaagtcacccacccggactcagattctc

SEQ ID NO: 387432 - DNA, 28 bp, Artificial Sequence
  Description of Artificial Sequence: Synthetic oligonucleotide
aagtcacccacccggactcagattctcc

SEQ ID NO: 387433 - DNA, 24 bp, Artificial Sequence
  Description of Artificial Sequence: Synthetic oligonucleotide
gagatgcgggtcatggcgccccaa

SEQ ID NO: 387434 - DNA, 24 bp, Artificial Sequence
  Description of Artificial Sequence: Synthetic oligonucleotide
agatgcgggtcatggcgccccaag

SEQ ID NO: 387435 - DNA, 23 bp, Artificial Sequence
  Description of Artificial Sequence: Synthetic oligonucleotide
gatgcgggtcatggcgccccaag

SEQ ID NO: 387436 - DNA, 23 bp, Artificial Sequence
  Description of Artificial Sequence: Synthetic oligonucleotide
atgcgggtcatggcgccccaagc

SEQ ID NO: 387437 - DNA, 22 bp, Artificial Sequence
  Description of Artificial Sequence: Synthetic oligonucleotide
tgcgggtcatggcgccccaagc

SEQ ID NO: 387438 - DNA, 21 bp, Artificial Sequence
  Description of Artificial Sequence: Synthetic oligonucleotide
gcgggtcatggcgccccaagc

SEQ ID NO: 387439 - DNA, 21 bp, Artificial Sequence
  Description of Artificial Sequence: Synthetic oligonucleotide
cgggtcatggcgccccaagcc

SEQ ID NO: 387440 - DNA, 22 bp, Artificial Sequence
  Description of Artificial Sequence: Synthetic oligonucleotide
gggtcatggcgccccaagccct

SEQ ID NO: 387441 - DNA, 22 bp, Artificial Sequence
  Description of Artificial Sequence: Synthetic oligonucleotide
ggtcatggcgccccaagccctc

SEQ ID NO: 387442 - DNA, 23 bp, Artificial Sequence
  Description of Artificial Sequence: Synthetic oligonucleotide
gtcatggcgccccaagccctcct

SEQ ID NO: 387443 - DNA, 23 bp, Artificial Sequence
  Description of Artificial Sequence: Synthetic oligonucleotide
tcatggcgccccaagccctcctc

SEQ ID NO: 387444 - DNA, 22 bp, Artificial Sequence
  Description of Artificial Sequence: Synthetic oligonucleotide
catggcgccccaagccctcctc

SEQ ID NO: 387445 - DNA, 23 bp, Artificial Sequence
  Description of Artificial Sequence: Synthetic oligonucleotide
atggcgccccaagccctcctcct

SEQ ID NO: 387446 - DNA, 22 bp, Artificial Sequence
  Description of Artificial Sequence: Synthetic oligonucleotide
tggcgccccaagccctcctcct

SEQ ID NO: 387447 - DNA, 21 bp, Artificial Sequence
  Description of Artificial Sequence: Synthetic oligonucleotide
ggcgccccaagccctcctcct

SEQ ID NO: 387448 - DNA, 21 bp, Artificial Sequence
  Description of Artificial Sequence: Synthetic oligonucleotide
gcgccccaagccctcctcctg

SEQ ID NO: 387449 - DNA, 22 bp, Artificial Sequence
  Description of Artificial Sequence: Synthetic oligonucleotide
cgccccaagccctcctcctgct

SEQ ID NO: 387450 - DNA, 22 bp, Artificial Sequence
  Description of Artificial Sequence: Synthetic oligonucleotide
gccccaagccctcctcctgctg

SEQ ID NO: 387451 - DNA, 23 bp, Artificial Sequence
  Description of Artificial Sequence: Synthetic oligonucleotide
ccccaagccctcctcctgctgct

SEQ ID NO: 387452 - DNA, 24 bp, Artificial Sequence
  Description of Artificial Sequence: Synthetic oligonucleotide
cccaagccctcctcctgctgctct

SEQ ID NO: 387453 - DNA, 24 bp, Artificial Sequence
  Description of Artificial Sequence: Synthetic oligonucleotide
ccaagccctcctcctgctgctctc

SEQ ID NO: 387454 - DNA, 24 bp, Artificial Sequence
  Description of Artificial Sequence: Synthetic oligonucleotide
caagccctcctcctgctgctctcg

SEQ ID NO: 387455 - DNA, 24 bp, Artificial Sequence
  Description of Artificial Sequence: Synthetic oligonucleotide
aagccctcctcctgctgctctcgg

SEQ ID NO: 387456 - DNA, 23 bp, Artificial Sequence
  Description of Artificial Sequence: Synthetic oligonucleotide
ctctcgggagccctggccctgat

SEQ ID NO: 387457 - DNA, 23 bp, Artificial Sequence
  Description of Artificial Sequence: Synthetic oligonucleotide
tctcgggagccctggccctgatc

SEQ ID NO: 387458 - DNA, 22 bp, Artificial Sequence
  Description of Artificial Sequence: Synthetic oligonucleotide
ctcgggagccctggccctgatc

SEQ ID NO: 387459 - DNA, 23 bp, Artificial Sequence
  Description of Artificial Sequence: Synthetic oligonucleotide
tcgggagccctggccctgatcga

SEQ ID NO: 387460 - DNA, 22 bp, Artificial Sequence
  Description of Artificial Sequence: Synthetic oligonucleotide
cgggagccctggccctgatcga

SEQ ID NO: 387461 - DNA, 23 bp, Artificial Sequence
  Description of Artificial Sequence: Synthetic oligonucleotide
gggagccctggccctgatcgaga

SEQ ID NO: 387462 - DNA, 23 bp, Artificial Sequence
  Description of Artificial Sequence: Synthetic oligonucleotide
ggagccctggccctgatcgagac

SEQ ID NO: 387463 - DNA, 24 bp, Artificial Sequence
  Description of Artificial Sequence: Synthetic oligonucleotide
gagccctggccctgatcgagacct

SEQ ID NO: 387464 - DNA, 24 bp, Artificial Sequence
  Description of Artificial Sequence: Synthetic oligonucleotide
agccctggccctgatcgagacctg

SEQ ID NO: 387465 - DNA, 23 bp, Artificial Sequence
  Description of Artificial Sequence: Synthetic oligonucleotide
gccctggccctgatcgagacctg

SEQ ID NO: 387466 - DNA, 23 bp, Artificial Sequence
  Description of Artificial Sequence: Synthetic oligonucleotide
ccctggccctgatcgagacctgg

SEQ ID NO: 387467 - DNA, 23 bp, Artificial Sequence
  Description of Artificial Sequence: Synthetic oligonucleotide
cctggccctgatcgagacctggg

SEQ ID NO: 387468 - DNA, 23 bp, Artificial Sequence
  Description of Artificial Sequence: Synthetic oligonucleotide
ctggccctgatcgagacctgggc

SEQ ID NO: 387469 - DNA, 23 bp, Artificial Sequence
  Description of Artificial Sequence: Synthetic oligonucleotide
tggccctgatcgagacctgggcc

SEQ ID NO: 387470 - DNA, 22 bp, Artificial Sequence
  Description of Artificial Sequence: Synthetic oligonucleotide
ggccctgatcgagacctgggcc

SEQ ID NO: 387471 - DNA, 22 bp, Artificial Sequence
  Description of Artificial Sequence: Synthetic oligonucleotide
gccctgatcgagacctgggccg

SEQ ID NO: 387472 - DNA, 22 bp, Artificial Sequence
  Description of Artificial Sequence: Synthetic oligonucleotide
ccctgatcgagacctgggccgg

SEQ ID NO: 387473 - DNA, 23 bp, Artificial Sequence
  Description of Artificial Sequence: Synthetic oligonucleotide
cctgatcgagacctgggccggct

SEQ ID NO: 387474 - DNA, 23 bp, Artificial Sequence
  Description of Artificial Sequence: Synthetic oligonucleotide
ctgatcgagacctgggccggctc

SEQ ID NO: 387475 - DNA, 23 bp, Artificial Sequence
  Description of Artificial Sequence: Synthetic oligonucleotide
tgatcgagacctgggccggctcc

SEQ ID NO: 387476 - DNA, 22 bp, Artificial Sequence
  Description of Artificial Sequence: Synthetic oligonucleotide
gatcgagacctgggccggctcc

SEQ ID NO: 387477 - DNA, 23 bp, Artificial Sequence
  Description of Artificial Sequence: Synthetic oligonucleotide
atcgagacctgggccggctccca

SEQ ID NO: 387478 - DNA, 22 bp, Artificial Sequence
  Description of Artificial Sequence: Synthetic oligonucleotide
tcgagacctgggccggctccca

SEQ ID NO: 387479 - DNA, 28 bp, Artificial Sequence
  Description of Artificial Sequence: Synthetic oligonucleotide
accatccagaggatgtatggctgcgacc

SEQ ID NO: 387480 - DNA, 27 bp, Artificial Sequence
  Description of Artificial Sequence: Synthetic oligonucleotide
ccatccagaggatgtatggctgcgacc

SEQ ID NO: 387481 - DNA, 23 bp, Artificial Sequence
  Description of Artificial Sequence: Synthetic oligonucleotide
cgcaagttggaggcggcccgtga

SEQ ID NO: 387482 - DNA, 23 bp, Artificial Sequence
  Description of Artificial Sequence: Synthetic oligonucleotide
gcaagttggaggcggcccgtgag

SEQ ID NO: 387483 - DNA, 23 bp, Artificial Sequence
  Description of Artificial Sequence: Synthetic oligonucleotide
caagttggaggcggcccgtgagg

SEQ ID NO: 387484 - DNA, 23 bp, Artificial Sequence
  Description of Artificial Sequence: Synthetic oligonucleotide
aagttggaggcggcccgtgaggc

SEQ ID NO: 387485 - DNA, 22 bp, Artificial Sequence
  Description of Artificial Sequence: Synthetic oligonucleotide
agttggaggcggcccgtgaggc

SEQ ID NO: 387486 - DNA, 21 bp, Artificial Sequence
  Description of Artificial Sequence: Synthetic oligonucleotide
gttggaggcggcccgtgaggc

SEQ ID NO: 387487 - DNA, 21 bp, Artificial Sequence
  Description of Artificial Sequence: Synthetic oligonucleotide
ttggaggcggcccgtgaggcg

SEQ ID NO: 387488 - DNA, 20 bp, Artificial Sequence
  Description of Artificial Sequence: Synthetic oligonucleotide
tggaggcggcccgtgaggcg

SEQ ID NO: 387489 - DNA, 22 bp, Artificial Sequence
  Description of Artificial Sequence: Synthetic oligonucleotide
cgagtgcgtggagtggctccgc

SEQ ID NO: 387490 - DNA, 22 bp, Artificial Sequence
  Description of Artificial Sequence: Synthetic oligonucleotide
gagtgcgtggagtggctccgcg

SEQ ID NO: 387491 - DNA, 25 bp, Artificial Sequence
  Description of Artificial Sequence: Synthetic oligonucleotide
agtgcgtggagtggctccgcggata

SEQ ID NO: 387492 - DNA, 24 bp, Artificial Sequence
  Description of Artificial Sequence: Synthetic oligonucleotide
gtgcgtggagtggctccgcggata

SEQ ID NO: 387493 - DNA, 24 bp, Artificial Sequence
  Description of Artificial Sequence: Synthetic oligonucleotide
tgcgtggagtggctccgcggatac

SEQ ID NO: 387494 - DNA, 23 bp, Artificial Sequence
  Description of Artificial Sequence: Synthetic oligonucleotide
gcgtggagtggctccgcggatac

SEQ ID NO: 387495 - DNA, 24 bp, Artificial Sequence
  Description of Artificial Sequence: Synthetic oligonucleotide
cgtggagtggctccgcggatacct

SEQ ID NO: 387496 - DNA, 24 bp, Artificial Sequence
  Description of Artificial Sequence: Synthetic oligonucleotide
gtggagtggctccgcggatacctg

SEQ ID NO: 387497 - DNA, 25 bp, Artificial Sequence
  Description of Artificial Sequence: Synthetic oligonucleotide
tggagtggctccgcggatacctgga

SEQ ID NO: 387498 - DNA, 24 bp, Artificial Sequence
  Description of Artificial Sequence: Synthetic oligonucleotide
ggagtggctccgcggatacctgga

SEQ ID NO: 387499 - DNA, 26 bp, Artificial Sequence
  Description of Artificial Sequence: Synthetic oligonucleotide
gagtggctccgcggatacctggagaa

SEQ ID NO: 387500 - DNA, 26 bp, Artificial Sequence
  Description of Artificial Sequence: Synthetic oligonucleotide
agtggctccgcggatacctggagaac

SEQ ID NO: 387501 - DNA, 25 bp, Artificial Sequence
  Description of Artificial Sequence: Synthetic oligonucleotide
gtggctccgcggatacctggagaac

SEQ ID NO: 387502 - DNA, 25 bp, Artificial Sequence
  Description of Artificial Sequence: Synthetic oligonucleotide
tggctccgcggatacctggagaacg

SEQ ID NO: 387503 - DNA, 24 bp, Artificial Sequence
  Description of Artificial Sequence: Synthetic oligonucleotide
ggctccgcggatacctggagaacg

SEQ ID NO: 387504 - DNA, 24 bp, Artificial Sequence
  Description of Artificial Sequence: Synthetic oligonucleotide
gctccgcggatacctggagaacgg

SEQ ID NO: 387505 - DNA, 26 bp, Artificial Sequence
  Description of Artificial Sequence: Synthetic oligonucleotide
ctccgcggatacctggagaacgggaa

SEQ ID NO: 387506 - DNA, 26 bp, Artificial Sequence
  Description of Artificial Sequence: Synthetic oligonucleotide
tccgcggatacctggagaacgggaag

SEQ ID NO: 387507 - DNA, 25 bp, Artificial Sequence
  Description of Artificial Sequence: Synthetic oligonucleotide
ccgcggatacctggagaacgggaag

SEQ ID NO: 387508 - DNA, 26 bp, Artificial Sequence
  Description of Artificial Sequence: Synthetic oligonucleotide
cgcggatacctggagaacgggaagga

SEQ ID NO: 387509 - DNA, 27 bp, Artificial Sequence
  Description of Artificial Sequence: Synthetic oligonucleotide
gcggatacctggagaacgggaaggaga

SEQ ID NO: 387510 - DNA, 27 bp, Artificial Sequence
  Description of Artificial Sequence: Synthetic oligonucleotide
cggatacctggagaacgggaaggagac

SEQ ID NO: 387511 - DNA, 27 bp, Artificial Sequence
  Description of Artificial Sequence: Synthetic oligonucleotide
ggatacctggagaacgggaaggagacg

SEQ ID NO: 387512 - DNA, 22 bp, Artificial Sequence
  Description of Artificial Sequence: Synthetic oligonucleotide
agacgctgcagcgcgcggaacg

SEQ ID NO: 387513 - DNA, 21 bp, Artificial Sequence
  Description of Artificial Sequence: Synthetic oligonucleotide
gacgctgcagcgcgcggaacg

SEQ ID NO: 387514 - DNA, 21 bp, Artificial Sequence
  Description of Artificial Sequence: Synthetic oligonucleotide
acgctgcagcgcgcggaacgc

SEQ ID NO: 387515 - DNA, 20 bp, Artificial Sequence
  Description of Artificial Sequence: Synthetic oligonucleotide
cgctgcagcgcgcggaacgc

SEQ ID NO: 387516 - DNA, 20 bp, Artificial Sequence
  Description of Artificial Sequence: Synthetic oligonucleotide
gctgcagcgcgcggaacgcc

SEQ ID NO: 387517 - DNA, 23 bp, Artificial Sequence
  Description of Artificial Sequence: Synthetic oligonucleotide
ctgcagcgcgcggaacgcccaaa

SEQ ID NO: 387518 - DNA, 24 bp, Artificial Sequence
  Description of Artificial Sequence: Synthetic oligonucleotide
tgcagcgcgcggaacgcccaaaga

SEQ ID NO: 387519 - DNA, 23 bp, Artificial Sequence
  Description of Artificial Sequence: Synthetic oligonucleotide
gcagcgcgcggaacgcccaaaga

SEQ ID NO: 387520 - DNA, 24 bp, Artificial Sequence
  Description of Artificial Sequence: Synthetic oligonucleotide
cagcgcgcggaacgcccaaagaca

SEQ ID NO: 387521 - DNA, 25 bp, Artificial Sequence
  Description of Artificial Sequence: Synthetic oligonucleotide
agcgcgcggaacgcccaaagacaca

SEQ ID NO: 387522 - DNA, 24 bp, Artificial Sequence
  Description of Artificial Sequence: Synthetic oligonucleotide
gcgcgcggaacgcccaaagacaca

SEQ ID NO: 387523 - DNA, 24 bp, Artificial Sequence
  Description of Artificial Sequence: Synthetic oligonucleotide
cgcgcggaacgcccaaagacacac

SEQ ID NO: 387524 - DNA, 25 bp, Artificial Sequence
  Description of Artificial Sequence: Synthetic oligonucleotide
gcgcggaacgcccaaagacacacgt

SEQ ID NO: 387525 - DNA, 26 bp, Artificial Sequence
  Description of Artificial Sequence: Synthetic oligonucleotide
cgcggaacgcccaaagacacacgtga

SEQ ID NO: 387526 - DNA, 26 bp, Artificial Sequence
  Description of Artificial Sequence: Synthetic oligonucleotide
gcggaacgcccaaagacacacgtgac

SEQ ID NO: 387527 - DNA, 26 bp, Artificial Sequence
  Description of Artificial Sequence: Synthetic oligonucleotide
cggaacgcccaaagacacacgtgacc

SEQ ID NO: 387528 - DNA, 27 bp, Artificial Sequence
  Description of Artificial Sequence: Synthetic oligonucleotide
ggaacgcccaaagacacacgtgaccca

SEQ ID NO: 387529 - DNA, 27 bp, Artificial Sequence
  Description of Artificial Sequence: Synthetic oligonucleotide
gaacgcccaaagacacacgtgacccac

SEQ ID NO: 387530 - DNA, 27 bp, Artificial Sequence
  Description of Artificial Sequence: Synthetic oligonucleotide
aacgcccaaagacacacgtgacccacc

SEQ ID NO: 387531 - DNA, 27 bp, Artificial Sequence
  Description of Artificial Sequence: Synthetic oligonucleotide
acgcccaaagacacacgtgacccacca

SEQ ID NO: 387532 - DNA, 27 bp, Artificial Sequence
  Description of Artificial Sequence: Synthetic oligonucleotide
cgcccaaagacacacgtgacccaccat

SEQ ID NO: 387533 - DNA, 27 bp, Artificial Sequence
  Description of Artificial Sequence: Synthetic oligonucleotide
gcccaaagacacacgtgacccaccatc

SEQ ID NO: 387534 - DNA, 25 bp, Artificial Sequence
  Description of Artificial Sequence: Synthetic oligonucleotide
tggcagcgggatggggaggaccaaa

SEQ ID NO: 387535 - DNA, 24 bp, Artificial Sequence
  Description of Artificial Sequence: Synthetic oligonucleotide
ggcagcgggatggggaggaccaaa

SEQ ID NO: 387536 - DNA, 25 bp, Artificial Sequence
  Description of Artificial Sequence: Synthetic oligonucleotide
gcagcgggatggggaggaccaaact

SEQ ID NO: 387537 - DNA, 26 bp, Artificial Sequence
  Description of Artificial Sequence: Synthetic oligonucleotide
cagcgggatggggaggaccaaactca

SEQ ID NO: 387538 - DNA, 26 bp, Artificial Sequence
  Description of Artificial Sequence: Synthetic oligonucleotide
agcgggatggggaggaccaaactcag

SEQ ID NO: 387539 - DNA, 25 bp, Artificial Sequence
  Description of Artificial Sequence: Synthetic oligonucleotide
gcgggatggggaggaccaaactcag

SEQ ID NO: 387540 - DNA, 26 bp, Artificial Sequence
  Description of Artificial Sequence: Synthetic oligonucleotide
cgggatggggaggaccaaactcagga

SEQ ID NO: 387541 - DNA, 25 bp, Artificial Sequence
  Description of Artificial Sequence: Synthetic oligonucleotide
agccctgcaccctgagatggaagcc

SEQ ID NO: 387542 - DNA, 24 bp, Artificial Sequence
  Description of Artificial Sequence: Synthetic oligonucleotide
gccctgcaccctgagatggaagcc

SEQ ID NO: 387543 - DNA, 25 bp, Artificial Sequence
  Description of Artificial Sequence: Synthetic oligonucleotide
ccctgcaccctgagatggaagccgt

SEQ ID NO: 387544 - DNA, 27 bp, Artificial Sequence
  Description of Artificial Sequence: Synthetic oligonucleotide
cctgcaccctgagatggaagccgtctt

SEQ ID NO: 387545 - DNA, 27 bp, Artificial Sequence
  Description of Artificial Sequence: Synthetic oligonucleotide
ctgcaccctgagatggaagccgtcttc

SEQ ID NO: 387546 - DNA, 27 bp, Artificial Sequence
  Description of Artificial Sequence: Synthetic oligonucleotide
tgcaccctgagatggaagccgtcttcc

SEQ ID NO: 387547 - DNA, 26 bp, Artificial Sequence
  Description of Artificial Sequence: Synthetic oligonucleotide
gcaccctgagatggaagccgtcttcc

SEQ ID NO: 387548 - DNA, 25 bp, Artificial Sequence
  Description of Artificial Sequence: Synthetic oligonucleotide
cgtcttcccagcccaccatccccaa

SEQ ID NO: 387549 - DNA, 27 bp, Artificial Sequence
  Description of Artificial Sequence: Synthetic oligonucleotide
gtcttcccagcccaccatccccaactt

SEQ ID NO: 387550 - DNA, 27 bp, Artificial Sequence
  Description of Artificial Sequence: Synthetic oligonucleotide
tcttcccagcccaccatccccaacttg

SEQ ID NO: 387551 - DNA, 26 bp, Artificial Sequence
  Description of Artificial Sequence: Synthetic oligonucleotide
cttcccagcccaccatccccaacttg

SEQ ID NO: 387552 - DNA, 26 bp, Artificial Sequence
  Description of Artificial Sequence: Synthetic oligonucleotide
ttcccagcccaccatccccaacttgg

SEQ ID NO: 387553 - DNA, 25 bp, Artificial Sequence
  Description of Artificial Sequence: Synthetic oligonucleotide
tcccagcccaccatccccaacttgg

SEQ ID NO: 387554 - DNA, 24 bp, Artificial Sequence
  Description of Artificial Sequence: Synthetic oligonucleotide
cccagcccaccatccccaacttgg

SEQ ID NO: 387555 - DNA, 24 bp, Artificial Sequence
  Description of Artificial Sequence: Synthetic oligonucleotide
ccagcccaccatccccaacttggg

SEQ ID NO: 387556 - DNA, 26 bp, Artificial Sequence
  Description of Artificial Sequence: Synthetic oligonucleotide
cagcccaccatccccaacttgggcat

SEQ ID NO: 387557 - DNA, 26 bp, Artificial Sequence
  Description of Artificial Sequence: Synthetic oligonucleotide
agcccaccatccccaacttgggcatc

SEQ ID NO: 387558 - DNA, 25 bp, Artificial Sequence
  Description of Artificial Sequence: Synthetic oligonucleotide
gcccaccatccccaacttgggcatc

SEQ ID NO: 387559 - DNA, 27 bp, Artificial Sequence
  Description of Artificial Sequence: Synthetic oligonucleotide
cccaccatccccaacttgggcatcgtt

SEQ ID NO: 387560 - DNA, 28 bp, Artificial Sequence
  Description of Artificial Sequence: Synthetic oligonucleotide
ccaccatccccaacttgggcatcgtttc

SEQ ID NO: 387561 - DNA, 29 bp, Artificial Sequence
  Description of Artificial Sequence: Synthetic oligonucleotide
caccatccccaacttgggcatcgtttctg

SEQ ID NO: 387562 - DNA, 29 bp, Artificial Sequence
  Description of Artificial Sequence: Synthetic oligonucleotide
accatccccaacttgggcatcgtttctgg

SEQ ID NO: 387563 - DNA, 28 bp, Artificial Sequence
  Description of Artificial Sequence: Synthetic oligonucleotide
ccatccccaacttgggcatcgtttctgg

SEQ ID NO: 387564 - DNA, 28 bp, Artificial Sequence
  Description of Artificial Sequence: Synthetic oligonucleotide
catccccaacttgggcatcgtttctggc

SEQ ID NO: 387565 - DNA, 28 bp, Artificial Sequence
  Description of Artificial Sequence: Synthetic oligonucleotide
atccccaacttgggcatcgtttctggcc

SEQ ID NO: 387566 - DNA, 27 bp, Artificial Sequence
  Description of Artificial Sequence: Synthetic oligonucleotide
tccccaacttgggcatcgtttctggcc

SEQ ID NO: 387567 - DNA, 26 bp, Artificial Sequence
  Description of Artificial Sequence: Synthetic oligonucleotide
ccccaacttgggcatcgtttctggcc

SEQ ID NO: 387568 - DNA, 27 bp, Artificial Sequence
  Description of Artificial Sequence: Synthetic oligonucleotide
cccaacttgggcatcgtttctggccca

SEQ ID NO: 387569 - DNA, 27 bp, Artificial Sequence
  Description of Artificial Sequence: Synthetic oligonucleotide
ccaacttgggcatcgtttctggcccag

SEQ ID NO: 387570 - DNA, 27 bp, Artificial Sequence
  Description of Artificial Sequence: Synthetic oligonucleotide
caacttgggcatcgtttctggcccagc

SEQ ID NO: 387571 - DNA, 28 bp, Artificial Sequence
  Description of Artificial Sequence: Synthetic oligonucleotide
aacttgggcatcgtttctggcccagctg

SEQ ID NO: 387572 - DNA, 27 bp, Artificial Sequence
  Description of Artificial Sequence: Synthetic oligonucleotide
acttgggcatcgtttctggcccagctg

SEQ ID NO: 387573 - DNA, 27 bp, Artificial Sequence
  Description of Artificial Sequence: Synthetic oligonucleotide
cttgggcatcgtttctggcccagctgt

SEQ ID NO: 387574 - DNA, 27 bp, Artificial Sequence
  Description of Artificial Sequence: Synthetic oligonucleotide
ttgggcatcgtttctggcccagctgtc

SEQ ID NO: 387575 - DNA, 26 bp, Artificial Sequence
  Description of Artificial Sequence: Synthetic oligonucleotide
tgggcatcgtttctggcccagctgtc

SEQ ID NO: 387576 - DNA, 25 bp, Artificial Sequence
  Description of Artificial Sequence: Synthetic oligonucleotide
gggcatcgtttctggcccagctgtc

SEQ ID NO: 387577 - DNA, 26 bp, Artificial Sequence
  Description of Artificial Sequence: Synthetic oligonucleotide
ggcatcgtttctggcccagctgtcct

SEQ ID NO: 387578 - DNA, 26 bp, Artificial Sequence
  Description of Artificial Sequence: Synthetic oligonucleotide
gcatcgtttctggcccagctgtcctg

SEQ ID NO: 387579 - DNA, 26 bp, Artificial Sequence
  Description of Artificial Sequence: Synthetic oligonucleotide
catcgtttctggcccagctgtcctgg

SEQ ID NO: 387580 - DNA, 27 bp, Artificial Sequence
  Description of Artificial Sequence: Synthetic oligonucleotide
atcgtttctggcccagctgtcctggct

SEQ ID NO: 387581 - DNA, 26 bp, Artificial Sequence
  Description of Artificial Sequence: Synthetic oligonucleotide
tcgtttctggcccagctgtcctggct

SEQ ID NO: 387582 - DNA, 25 bp, Artificial Sequence
  Description of Artificial Sequence: Synthetic oligonucleotide
cgtttctggcccagctgtcctggct

SEQ ID NO: 387583 - DNA, 26 bp, Artificial Sequence
  Description of Artificial Sequence: Synthetic oligonucleotide
gtttctggcccagctgtcctggctgt

SEQ ID NO: 387584 - DNA, 26 bp, Artificial Sequence
  Description of Artificial Sequence: Synthetic oligonucleotide
tttctggcccagctgtcctggctgtc

SEQ ID NO: 387585 - DNA, 25 bp, Artificial Sequence
  Description of Artificial Sequence: Synthetic oligonucleotide
ttctggcccagctgtcctggctgtc

SEQ ID NO: 387586 - DNA, 24 bp, Artificial Sequence
  Description of Artificial Sequence: Synthetic oligonucleotide
tctggcccagctgtcctggctgtc

SEQ ID NO: 387587 - DNA, 23 bp, Artificial Sequence
  Description of Artificial Sequence: Synthetic oligonucleotide
ctggcccagctgtcctggctgtc

SEQ ID NO: 387588 - DNA, 24 bp, Artificial Sequence
  Description of Artificial Sequence: Synthetic oligonucleotide
tggcccagctgtcctggctgtcct

SEQ ID NO: 387589 - DNA, 23 bp, Artificial Sequence
  Description of Artificial Sequence: Synthetic oligonucleotide
ggcccagctgtcctggctgtcct

SEQ ID NO: 387590 - DNA, 23 bp, Artificial Sequence
  Description of Artificial Sequence: Synthetic oligonucleotide
gcccagctgtcctggctgtcctg

SEQ ID NO: 387591 - DNA, 23 bp, Artificial Sequence
  Description of Artificial Sequence: Synthetic oligonucleotide
cccagctgtcctggctgtcctgg

SEQ ID NO: 387592 - DNA, 24 bp, Artificial Sequence
  Description of Artificial Sequence: Synthetic oligonucleotide
ccagctgtcctggctgtcctggct

SEQ ID NO: 387593 - DNA, 25 bp, Artificial Sequence
  Description of Artificial Sequence: Synthetic oligonucleotide
cagctgtcctggctgtcctggctgt

SEQ ID NO: 387594 - DNA, 25 bp, Artificial Sequence
  Description of Artificial Sequence: Synthetic oligonucleotide
agctgtcctggctgtcctggctgtc

SEQ ID NO: 387595 - DNA, 24 bp, Artificial Sequence
  Description of Artificial Sequence: Synthetic oligonucleotide
gctgtcctggctgtcctggctgtc

SEQ ID NO: 387596 - DNA, 25 bp, Artificial Sequence
  Description of Artificial Sequence: Synthetic oligonucleotide
ctgtcctggctgtcctggctgtcct

SEQ ID NO: 387597 - DNA, 25 bp, Artificial Sequence
  Description of Artificial Sequence: Synthetic oligonucleotide
tgtcctggctgtcctggctgtcctg

SEQ ID NO: 387598 - DNA, 24 bp, Artificial Sequence
  Description of Artificial Sequence: Synthetic oligonucleotide
gtcctggctgtcctggctgtcctg

SEQ ID NO: 387599 - DNA, 24 bp, Artificial Sequence
  Description of Artificial Sequence: Synthetic oligonucleotide
tcctggctgtcctggctgtcctgg

SEQ ID NO: 387600 - DNA, 23 bp, Artificial Sequence
  Description of Artificial Sequence: Synthetic oligonucleotide
cctggctgtcctggctgtcctgg

SEQ ID NO: 387601 - DNA, 24 bp, Artificial Sequence
  Description of Artificial Sequence: Synthetic oligonucleotide
ctggctgtcctggctgtcctggct

SEQ ID NO: 387602 - DNA, 25 bp, Artificial Sequence
  Description of Artificial Sequence: Synthetic oligonucleotide
tggctgtcctggctgtcctggctgt

SEQ ID NO: 387603 - DNA, 24 bp, Artificial Sequence
  Description of Artificial Sequence: Synthetic oligonucleotide
ggctgtcctggctgtcctggctgt

SEQ ID NO: 387604 - DNA, 26 bp, Artificial Sequence
  Description of Artificial Sequence: Synthetic oligonucleotide
ctgtcctggctgtcctggctgtccta

SEQ ID NO: 387605 - DNA, 26 bp, Artificial Sequence
  Description of Artificial Sequence: Synthetic oligonucleotide
tgtcctggctgtcctggctgtcctag

SEQ ID NO: 387606 - DNA, 25 bp, Artificial Sequence
  Description of Artificial Sequence: Synthetic oligonucleotide
gtcctggctgtcctggctgtcctag

SEQ ID NO: 387607 - DNA, 26 bp, Artificial Sequence
  Description of Artificial Sequence: Synthetic oligonucleotide
tcctggctgtcctggctgtcctagct

SEQ ID NO: 387608 - DNA, 28 bp, Artificial Sequence
  Description of Artificial Sequence: Synthetic oligonucleotide
tgtcctagctgtcctaggagctgtggtc

SEQ ID NO: 387609 - DNA, 27 bp, Artificial Sequence
  Description of Artificial Sequence: Synthetic oligonucleotide
gtcctagctgtcctaggagctgtggtc

SEQ ID NO: 387610 - DNA, 27 bp, Artificial Sequence
  Description of Artificial Sequence: Synthetic oligonucleotide
tcctagctgtcctaggagctgtggtcg

SEQ ID NO: 387611 - DNA, 26 bp, Artificial Sequence
  Description of Artificial Sequence: Synthetic oligonucleotide
cctagctgtcctaggagctgtggtcg

SEQ ID NO: 387612 - DNA, 27 bp, Artificial Sequence
  Description of Artificial Sequence: Synthetic oligonucleotide
ctagctgtcctaggagctgtggtcgct

SEQ ID NO: 387613 - DNA, 27 bp, Artificial Sequence
  Description of Artificial Sequence: Synthetic oligonucleotide
tagctgtcctaggagctgtggtcgctg

SEQ ID NO: 387614 - DNA, 26 bp, Artificial Sequence
  Description of Artificial Sequence: Synthetic oligonucleotide
agctgtcctaggagctgtggtcgctg

SEQ ID NO: 387615 - DNA, 25 bp, Artificial Sequence
  Description of Artificial Sequence: Synthetic oligonucleotide
gctgtcctaggagctgtggtcgctg

SEQ ID NO: 387616 - DNA, 26 bp, Artificial Sequence
  Description of Artificial Sequence: Synthetic oligonucleotide
ctgtcctaggagctgtggtcgctgct

SEQ ID NO: 387617 - DNA, 27 bp, Artificial Sequence
  Description of Artificial Sequence: Synthetic oligonucleotide
tgtcctaggagctgtggtcgctgctgt

SEQ ID NO: 387618 - DNA, 26 bp, Artificial Sequence
  Description of Artificial Sequence: Synthetic oligonucleotide
gtcctaggagctgtggtcgctgctgt

SEQ ID NO: 387619 - DNA, 27 bp, Artificial Sequence
  Description of Artificial Sequence: Synthetic oligonucleotide
tcctaggagctgtggtcgctgctgtga

SEQ ID NO: 387620 - DNA, 27 bp, Artificial Sequence
  Description of Artificial Sequence: Synthetic oligonucleotide
cctaggagctgtggtcgctgctgtgat

SEQ ID NO: 387621 - DNA, 28 bp, Artificial Sequence
  Description of Artificial Sequence: Synthetic oligonucleotide
ctaggagctgtggtcgctgctgtgatac

SEQ ID NO: 387622 - DNA, 31 bp, Artificial Sequence; identical to SEQ ID NO: 50590
  Description of Artificial Sequence: Synthetic oligonucleotide

SEQ ID NO: 387623 - DNA, 30 bp, Artificial Sequence; identical to SEQ ID NO: 50591
  Description of Artificial Sequence: Synthetic oligonucleotide

SEQ ID NO: 387624 - DNA, 29 bp, Artificial Sequence
  Description of Artificial Sequence: Synthetic oligonucleotide
ggagctgtggtcgctgctgtgatacatag

SEQ ID NO: 387625 - DNA, 29 bp, Artificial Sequence
  Description of Artificial Sequence: Synthetic oligonucleotide
gagctgtggtcgctgctgtgatacatagg

SEQ ID NO: 387626 - DNA, 30 bp, Artificial Sequence; identical to SEQ ID NO: 50594
  Description of Artificial Sequence: Synthetic oligonucleotide

SEQ ID NO: 387627 - DNA, 29 bp, Artificial Sequence
  Description of Artificial Sequence: Synthetic oligonucleotide
gctgtggtcgctgctgtgatacataggag

SEQ ID NO: 387628 - DNA, 29 bp, Artificial Sequence
  Description of Artificial Sequence: Synthetic oligonucleotide
ctgtggtcgctgctgtgatacataggagg

SEQ ID NO: 387629 - DNA, 31 bp, Artificial Sequence; identical to SEQ ID NO: 50597
  Description of Artificial Sequence: Synthetic oligonucleotide

SEQ ID NO: 387630 - DNA, 30 bp, Artificial Sequence; identical to SEQ ID NO: 50598
  Description of Artificial Sequence: Synthetic oligonucleotide

SEQ ID NO: 387631 - DNA, 31 bp, Artificial Sequence; identical to SEQ ID NO: 50599
  Description of Artificial Sequence: Synthetic oligonucleotide

SEQ ID NO: 387632 - DNA, 30 bp, Artificial Sequence; identical to SEQ ID NO: 50600
  Description of Artificial Sequence: Synthetic oligonucleotide

SEQ ID NO: 387633 - DNA, 30 bp, Artificial Sequence; identical to SEQ ID NO: 50601
  Description of Artificial Sequence: Synthetic oligonucleotide

SEQ ID NO: 387634 - DNA, 31 bp, Artificial Sequence; identical to SEQ ID NO: 50602
  Description of Artificial Sequence: Synthetic oligonucleotide

SEQ ID NO: 387635 - DNA, 30 bp, Artificial Sequence; identical to SEQ ID NO: 50603
  Description of Artificial Sequence: Synthetic oligonucleotide

SEQ ID NO: 387636 - DNA, 31 bp, Artificial Sequence; identical to SEQ ID NO: 50604
  Description of Artificial Sequence: Synthetic oligonucleotide

SEQ ID NO: 387637 - DNA, 31 bp, Artificial Sequence; identical to SEQ ID NO: 50605
  Description of Artificial Sequence: Synthetic oligonucleotide

SEQ ID NO: 387638 - DNA, 32 bp, Artificial Sequence; identical to SEQ ID NO: 50606
  Description of Artificial Sequence: Synthetic oligonucleotide

SEQ ID NO: 387639 - DNA, 31 bp, Artificial Sequence; identical to SEQ ID NO: 50607
  Description of Artificial Sequence: Synthetic oligonucleotide

SEQ ID NO: 387640 - DNA, 31 bp, Artificial Sequence; identical to SEQ ID NO: 50608
  Description of Artificial Sequence: Synthetic oligonucleotide

SEQ ID NO: 387641 - DNA, 35 bp, Artificial Sequence; identical to SEQ ID NO: 50609
  Description of Artificial Sequence: Synthetic oligonucleotide

SEQ ID NO: 387642 - DNA, 34 bp, Artificial Sequence; identical to SEQ ID NO: 50610
  Description of Artificial Sequence: Synthetic oligonucleotide

SEQ ID NO: 387643 - DNA, 34 bp, Artificial Sequence; identical to SEQ ID NO: 50611
  Description of Artificial Sequence: Synthetic oligonucleotide

SEQ ID NO: 387644 - DNA, 33 bp, Artificial Sequence; identical to SEQ ID NO: 50612
  Description of Artificial Sequence: Synthetic oligonucleotide

SEQ ID NO: 387645 - DNA, 34 bp, Artificial Sequence; identical to SEQ ID NO: 50613
  Description of Artificial Sequence: Synthetic oligonucleotide

SEQ ID NO: 387646 - DNA, 33 bp, Artificial Sequence; identical to SEQ ID NO: 50614
  Description of Artificial Sequence: Synthetic oligonucleotide

SEQ ID NO: 387647 - DNA, 32 bp, Artificial Sequence; identical to SEQ ID NO: 50615
  Description of Artificial Sequence: Synthetic oligonucleotide

SEQ ID NO: 387648 - DNA, 31 bp, Artificial Sequence; identical to SEQ ID NO: 50616
  Description of Artificial Sequence: Synthetic oligonucleotide

SEQ ID NO: 387649 - DNA, 31 bp, Artificial Sequence; identical to SEQ ID NO: 50617
  Description of Artificial Sequence: Synthetic oligonucleotide

SEQ ID NO: 387650 - DNA, 27 bp, Artificial Sequence
  Description of Artificial Sequence: Synthetic oligonucleotide
cagaggatgtatggctgcgacctggga

SEQ ID NO: 387651 - DNA, 27 bp, Artificial Sequence
  Description of Artificial Sequence: Synthetic oligonucleotide
agaggatgtatggctgcgacctgggac

SEQ ID NO: 387652 - DNA, 26 bp, Artificial Sequence
  Description of Artificial Sequence: Synthetic oligonucleotide
gaggatgtatggctgcgacctgggac

SEQ ID NO: 387653 - DNA, 26 bp, Artificial Sequence
  Description of Artificial Sequence: Synthetic oligonucleotide
aggatgtatggctgcgacctgggacc

SEQ ID NO: 387654 - DNA, 25 bp, Artificial Sequence
  Description of Artificial Sequence: Synthetic oligonucleotide
ggatgtatggctgcgacctgggacc

SEQ ID NO: 387655 - DNA, 25 bp, Artificial Sequence
  Description of Artificial Sequence: Synthetic oligonucleotide
gatgtatggctgcgacctgggaccc

SEQ ID NO: 387656 - DNA, 26 bp, Artificial Sequence
  Description of Artificial Sequence: Synthetic oligonucleotide
atgtatggctgcgacctgggacccga

SEQ ID NO: 387657 - DNA, 25 bp, Artificial Sequence
  Description of Artificial Sequence: Synthetic oligonucleotide
tgtatggctgcgacctgggacccga

SEQ ID NO: 387658 - DNA, 24 bp, Artificial Sequence
  Description of Artificial Sequence: Synthetic oligonucleotide
gtatggctgcgacctgggacccga

SEQ ID NO: 387659 - DNA, 24 bp, Artificial Sequence
  Description of Artificial Sequence: Synthetic oligonucleotide
tatggctgcgacctgggacccgac

SEQ ID NO: 387660 - DNA, 23 bp, Artificial Sequence
  Description of Artificial Sequence: Synthetic oligonucleotide
atggctgcgacctgggacccgac

SEQ ID NO: 387661 - DNA, 22 bp, Artificial Sequence
  Description of Artificial Sequence: Synthetic oligonucleotide
tggctgcgacctgggacccgac

SEQ ID NO: 387662 - DNA, 21 bp, Artificial Sequence
  Description of Artificial Sequence: Synthetic oligonucleotide
ggctgcgacctgggacccgac

SEQ ID NO: 387663 - DNA, 21 bp, Artificial Sequence
  Description of Artificial Sequence: Synthetic oligonucleotide
gctgcgacctgggacccgacg

SEQ ID NO: 387664 - DNA, 21 bp, Artificial Sequence
  Description of Artificial Sequence: Synthetic oligonucleotide
ctgcgacctgggacccgacgg

SEQ ID NO: 387665 - DNA, 21 bp, Artificial Sequence
  Description of Artificial Sequence: Synthetic oligonucleotide
tgcgacctgggacccgacggg

SEQ ID NO: 387666 - DNA, 20 bp, Artificial Sequence
  Description of Artificial Sequence: Synthetic oligonucleotide
gcgacctgggacccgacggg

SEQ ID NO: 387667 - DNA, 20 bp, Artificial Sequence
  Description of Artificial Sequence: Synthetic oligonucleotide
cgacctgggacccgacgggc

SEQ ID NO: 387668 - DNA, 20 bp, Artificial Sequence
  Description of Artificial Sequence: Synthetic oligonucleotide
gacctgggacccgacgggcg

SEQ ID NO: 387669 - DNA, 20 bp, Artificial Sequence
  Description of Artificial Sequence: Synthetic oligonucleotide
acctgggacccgacgggcgc

SEQ ID NO: 387670 - DNA, 20 bp, Artificial Sequence
  Description of Artificial Sequence: Synthetic oligonucleotide
cctgggacccgacgggcgct

SEQ ID NO: 387671 - DNA, 20 bp, Artificial Sequence
  Description of Artificial Sequence: Synthetic oligonucleotide
ctgggacccgacgggcgcct

SEQ ID NO: 387672 - DNA, 32 bp, Artificial Sequence
  Description of Artificial Sequence: Synthetic oligonucleotide
ttctcacaccatccagaggatgtatggctgtg

SEQ ID NO: 387673 - DNA, 31 bp, Artificial Sequence
  Description of Artificial Sequence: Synthetic oligonucleotide
tctcacaccatccagaggatgtatggctgtg

SEQ ID NO: 387674 - DNA, 30 bp, Artificial Sequence
  Description of Artificial Sequence: Synthetic oligonucleotide
ctcacaccatccagaggatgtatggctgtg

SEQ ID NO: 387675 - DNA, 31 bp, Artificial Sequence
  Description of Artificial Sequence: Synthetic oligonucleotide
tcacaccatccagaggatgtatggctgtgac

SEQ ID NO: 387676 - DNA, 30 bp, Artificial Sequence
  Description of Artificial Sequence: Synthetic oligonucleotide
cacaccatccagaggatgtatggctgtgac

SEQ ID NO: 387677 - DNA, 30 bp, Artificial Sequence
  Description of Artificial Sequence: Synthetic oligonucleotide
acaccatccagaggatgtatggctgtgacc

SEQ ID NO: 387678 - DNA, 29 bp, Artificial Sequence
  Description of Artificial Sequence: Synthetic oligonucleotide
caccatccagaggatgtatggctgtgacc

SEQ ID NO: 387679 - DNA, 30 bp, Artificial Sequence
  Description of Artificial Sequence: Synthetic oligonucleotide
accatccagaggatgtatggctgtgacctg

SEQ ID NO: 387680 - DNA, 29 bp, Artificial Sequence
  Description of Artificial Sequence: Synthetic oligonucleotide
ccatccagaggatgtatggctgtgacctg

SEQ ID NO: 387681 - DNA, 29 bp, Artificial Sequence
  Description of Artificial Sequence: Synthetic oligonucleotide
catccagaggatgtatggctgtgacctgg

SEQ ID NO: 387682 - DNA, 29 bp, Artificial Sequence
  Description of Artificial Sequence: Synthetic oligonucleotide
atccagaggatgtatggctgtgacctggg

SEQ ID NO: 387683 - DNA, 28 bp, Artificial Sequence
  Description of Artificial Sequence: Synthetic oligonucleotide
tccagaggatgtatggctgtgacctggg

SEQ ID NO: 387684 - DNA, 27 bp, Artificial Sequence
  Description of Artificial Sequence: Synthetic oligonucleotide
ccagaggatgtatggctgtgacctggg

SEQ ID NO: 387685 - DNA, 27 bp, Artificial Sequence
  Description of Artificial Sequence: Synthetic oligonucleotide
cagaggatgtatggctgtgacctgggg

SEQ ID NO: 387686 - DNA, 27 bp, Artificial Sequence
  Description of Artificial Sequence: Synthetic oligonucleotide
agaggatgtatggctgtgacctggggc

SEQ ID NO: 387687 - DNA, 26 bp, Artificial Sequence
  Description of Artificial Sequence: Synthetic oligonucleotide
gaggatgtatggctgtgacctggggc

SEQ ID NO: 387688 - DNA, 26 bp, Artificial Sequence
  Description of Artificial Sequence: Synthetic oligonucleotide
aggatgtatggctgtgacctggggcc

SEQ ID NO: 387689 - DNA, 25 bp, Artificial Sequence
  Description of Artificial Sequence: Synthetic oligonucleotide
ggatgtatggctgtgacctggggcc

SEQ ID NO: 387690 - DNA, 25 bp, Artificial Sequence
  Description of Artificial Sequence: Synthetic oligonucleotide
gatgtatggctgtgacctggggccc

SEQ ID NO: 387691 - DNA, 26 bp, Artificial Sequence
  Description of Artificial Sequence: Synthetic oligonucleotide
atgtatggctgtgacctggggcccga

SEQ ID NO: 387692 - DNA, 25 bp, Artificial Sequence
  Description of Artificial Sequence: Synthetic oligonucleotide
tgtatggctgtgacctggggcccga

SEQ ID NO: 387693 - DNA, 24 bp, Artificial Sequence
  Description of Artificial Sequence: Synthetic oligonucleotide
gtatggctgtgacctggggcccga

SEQ ID NO: 387694 - DNA, 24 bp, Artificial Sequence
  Description of Artificial Sequence: Synthetic oligonucleotide
tatggctgtgacctggggcccgac

SEQ ID NO: 387695 - DNA, 23 bp, Artificial Sequence
  Description of Artificial Sequence: Synthetic oligonucleotide
atggctgtgacctggggcccgac

SEQ ID NO: 387696 - DNA, 22 bp, Artificial Sequence
  Description of Artificial Sequence: Synthetic oligonucleotide
tggctgtgacctggggcccgac

SEQ ID NO: 387697 - DNA, 21 bp, Artificial Sequence
  Description of Artificial Sequence: Synthetic oligonucleotide
ggctgtgacctggggcccgac

SEQ ID NO: 387698 - DNA, 21 bp, Artificial Sequence
  Description of Artificial Sequence: Synthetic oligonucleotide
gctgtgacctggggcccgacg

SEQ ID NO: 387699 - DNA, 21 bp, Artificial Sequence
  Description of Artificial Sequence: Synthetic oligonucleotide
ctgtgacctggggcccgacgg

SEQ ID NO: 387700 - DNA, 21 bp, Artificial Sequence
  Description of Artificial Sequence: Synthetic oligonucleotide
tgtgacctggggcccgacggg

SEQ ID NO: 387701 - DNA, 20 bp, Artificial Sequence
  Description of Artificial Sequence: Synthetic oligonucleotide
gtgacctggggcccgacggg

SEQ ID NO: 387702 - DNA, 20 bp, Artificial Sequence
  Description of Artificial Sequence: Synthetic oligonucleotide
tgacctggggcccgacgggc

SEQ ID NO: 387703 - DNA, 24 bp, Artificial Sequence
  Description of Artificial Sequence: Synthetic oligonucleotide
ccctggccctgatcgagacctgga

SEQ ID NO: 387704 - DNA, 24 bp, Artificial Sequence
  Description of Artificial Sequence: Synthetic oligonucleotide
cctggccctgatcgagacctggac

SEQ ID NO: 387705 - DNA, 24 bp, Artificial Sequence
  Description of Artificial Sequence: Synthetic oligonucleotide
ctggccctgatcgagacctggacc

SEQ ID NO: 387706 - DNA, 24 bp, Artificial Sequence
  Description of Artificial Sequence: Synthetic oligonucleotide
tggccctgatcgagacctggaccg

SEQ ID NO: 387707 - DNA, 23 bp, Artificial Sequence
  Description of Artificial Sequence: Synthetic oligonucleotide
ggccctgatcgagacctggaccg

SEQ ID NO: 387708 - DNA, 23 bp, Artificial Sequence
  Description of Artificial Sequence: Synthetic oligonucleotide
gccctgatcgagacctggaccgg

SEQ ID NO: 387709 - DNA, 24 bp, Artificial Sequence
  Description of Artificial Sequence: Synthetic oligonucleotide
ccctgatcgagacctggaccggct

SEQ ID NO: 387710 - DNA, 24 bp, Artificial Sequence
  Description of Artificial Sequence: Synthetic oligonucleotide
cctgatcgagacctggaccggctc

SEQ ID NO: 387711 - DNA, 24 bp, Artificial Sequence
  Description of Artificial Sequence: Synthetic oligonucleotide
ctgatcgagacctggaccggctcc

SEQ ID NO: 387712 - DNA, 25 bp, Artificial Sequence
  Description of Artificial Sequence: Synthetic oligonucleotide
tgatcgagacctggaccggctccca

SEQ ID NO: 387713 - DNA, 24 bp, Artificial Sequence
  Description of Artificial Sequence: Synthetic oligonucleotide
gatcgagacctggaccggctccca

SEQ ID NO: 387714 - DNA, 25 bp, Artificial Sequence
  Description of Artificial Sequence: Synthetic oligonucleotide
atcgagacctggaccggctcccact

SEQ ID NO: 387715 - DNA, 24 bp, Artificial Sequence
  Description of Artificial Sequence: Synthetic oligonucleotide
tcgagacctggaccggctcccact

SEQ ID NO: 387716 - DNA, 23 bp, Artificial Sequence
  Description of Artificial Sequence: Synthetic oligonucleotide
cgagacctggaccggctcccact

SEQ ID NO: 387717 - DNA, 23 bp, Artificial Sequence
  Description of Artificial Sequence: Synthetic oligonucleotide
gagacctggaccggctcccactc

SEQ ID NO: 387718 - DNA, 25 bp, Artificial Sequence
  Description of Artificial Sequence: Synthetic oligonucleotide
agacctggaccggctcccactccat

SEQ ID NO: 387719 - DNA, 24 bp, Artificial Sequence
  Description of Artificial Sequence: Synthetic oligonucleotide
gacctggaccggctcccactccat

SEQ ID NO: 387720 - DNA, 25 bp, Artificial Sequence
  Description of Artificial Sequence: Synthetic oligonucleotide
acctggaccggctcccactccatga

SEQ ID NO: 387721 - DNA, 24 bp, Artificial Sequence
  Description of Artificial Sequence: Synthetic oligonucleotide
cctggaccggctcccactccatga

SEQ ID NO: 387722 - DNA, 24 bp, Artificial Sequence
  Description of Artificial Sequence: Synthetic oligonucleotide
ctggaccggctcccactccatgag

SEQ ID NO: 387723 - DNA, 27 bp, Artificial Sequence
  Description of Artificial Sequence: Synthetic oligonucleotide
tggaccggctcccactccatgaggtat

SEQ ID NO: 387724 - DNA, 27 bp, Artificial Sequence
  Description of Artificial Sequence: Synthetic oligonucleotide
ggaccggctcccactccatgaggtatt

SEQ ID NO: 387725 - DNA, 28 bp, Artificial Sequence
  Description of Artificial Sequence: Synthetic oligonucleotide
gaccggctcccactccatgaggtatttc

SEQ ID NO: 387726 - DNA, 30 bp, Artificial Sequence; identical to SEQ ID NO: 50642
  Description of Artificial Sequence: Synthetic oligonucleotide

SEQ ID NO: 387727 - DNA, 21 bp, Artificial Sequence
  Description of Artificial Sequence: Synthetic oligonucleotide
gccgtgggtggagcaggaggc

SEQ ID NO: 387728 - DNA, 21 bp, Artificial Sequence
  Description of Artificial Sequence: Synthetic oligonucleotide
ccgtgggtggagcaggaggcg

SEQ ID NO: 387729 - DNA, 21 bp, Artificial Sequence
  Description of Artificial Sequence: Synthetic oligonucleotide
cgtgggtggagcaggaggcgc

SEQ ID NO: 387730 - DNA, 21 bp, Artificial Sequence
  Description of Artificial Sequence: Synthetic oligonucleotide
gtgggtggagcaggaggcgcc

SEQ ID NO: 387731 - DNA, 21 bp, Artificial Sequence
  Description of Artificial Sequence: Synthetic oligonucleotide
tgggtggagcaggaggcgccg

SEQ ID NO: 387732 - DNA, 20 bp, Artificial Sequence
  Description of Artificial Sequence: Synthetic oligonucleotide
gggtggagcaggaggcgccg

SEQ ID NO: 387733 - DNA, 21 bp, Artificial Sequence
  Description of Artificial Sequence: Synthetic oligonucleotide
ggtggagcaggaggcgccgga

SEQ ID NO: 387734 - DNA, 25 bp, Artificial Sequence
  Description of Artificial Sequence: Synthetic oligonucleotide
gtggagcaggaggcgccggagtatt

SEQ ID NO: 387735 - DNA, 25 bp, Artificial Sequence
  Description of Artificial Sequence: Synthetic oligonucleotide
tggagcaggaggcgccggagtattg

SEQ ID NO: 387736 - DNA, 24 bp, Artificial Sequence
  Description of Artificial Sequence: Synthetic oligonucleotide
ggagcaggaggcgccggagtattg

SEQ ID NO: 387737 - DNA, 24 bp, Artificial Sequence
  Description of Artificial Sequence: Synthetic oligonucleotide
gagcaggaggcgccggagtattgg

SEQ ID NO: 387738 - DNA, 25 bp, Artificial Sequence
  Description of Artificial Sequence: Synthetic oligonucleotide
agcaggaggcgccggagtattggga

SEQ ID NO: 387739 - DNA, 24 bp, Artificial Sequence
  Description of Artificial Sequence: Synthetic oligonucleotide
gcaggaggcgccggagtattggga

SEQ ID NO: 387740 - DNA, 24 bp, Artificial Sequence
  Description of Artificial Sequence: Synthetic oligonucleotide
caggaggcgccggagtattgggac

SEQ ID NO: 387741 - DNA, 24 bp, Artificial Sequence
  Description of Artificial Sequence: Synthetic oligonucleotide
aggaggcgccggagtattgggacc

SEQ ID NO: 387742 - DNA, 23 bp, Artificial Sequence
  Description of Artificial Sequence: Synthetic oligonucleotide
ggaggcgccggagtattgggacc

SEQ ID NO: 387743 - DNA, 23 bp, Artificial Sequence
  Description of Artificial Sequence: Synthetic oligonucleotide
gaggcgccggagtattgggaccg

SEQ ID NO: 387744 - DNA, 23 bp, Artificial Sequence
  Description of Artificial Sequence: Synthetic oligonucleotide
aggcgccggagtattgggaccgg

SEQ ID NO: 387745 - DNA, 22 bp, Artificial Sequence
  Description of Artificial Sequence: Synthetic oligonucleotide
ggcgccggagtattgggaccgg

SEQ ID NO: 387746 - DNA, 23 bp, Artificial Sequence
  Description of Artificial Sequence: Synthetic oligonucleotide
gcgccggagtattgggaccggga

SEQ ID NO: 387747 - DNA, 24 bp, Artificial Sequence
  Description of Artificial Sequence: Synthetic oligonucleotide
cgccggagtattgggaccgggaga

SEQ ID NO: 387748 - DNA, 28 bp, Artificial Sequence
  Description of Artificial Sequence: Synthetic oligonucleotide
gctgtcctggttgtcctagctgtcctag

SEQ ID NO: 387749 - DNA, 28 bp, Artificial Sequence
  Description of Artificial Sequence: Synthetic oligonucleotide
ctgtcctggttgtcctagctgtcctagg

SEQ ID NO: 387750 - DNA, 29 bp, Artificial Sequence
  Description of Artificial Sequence: Synthetic oligonucleotide
tgtcctggttgtcctagctgtcctaggag

SEQ ID NO: 387751 - DNA, 28 bp, Artificial Sequence
  Description of Artificial Sequence: Synthetic oligonucleotide
gtcctggttgtcctagctgtcctaggag

SEQ ID NO: 387752 - DNA, 28 bp, Artificial Sequence
  Description of Artificial Sequence: Synthetic oligonucleotide
tcctggttgtcctagctgtcctaggagc

SEQ ID NO: 387753 - DNA, 27 bp, Artificial Sequence
  Description of Artificial Sequence: Synthetic oligonucleotide
cctggttgtcctagctgtcctaggagc

SEQ ID NO: 387754 - DNA, 28 bp, Artificial Sequence
  Description of Artificial Sequence: Synthetic oligonucleotide
ctggttgtcctagctgtcctaggagctg

SEQ ID NO: 387755 - DNA, 29 bp, Artificial Sequence
  Description of Artificial Sequence: Synthetic oligonucleotide
tggttgtcctagctgtcctaggagctgtg

SEQ ID NO: 387756 - DNA, 28 bp, Artificial Sequence
  Description of Artificial Sequence: Synthetic oligonucleotide
ggttgtcctagctgtcctaggagctgtg

SEQ ID NO: 387757 - DNA, 28 bp, Artificial Sequence
  Description of Artificial Sequence: Synthetic oligonucleotide
gttgtcctagctgtcctaggagctgtgg

SEQ ID NO: 387758 - DNA, 29 bp, Artificial Sequence
  Description of Artificial Sequence: Synthetic oligonucleotide
ttgtcctagctgtcctaggagctgtggtg

SEQ ID NO: 387759 - DNA, 34 bp, Artificial Sequence; identical to SEQ ID NO: 50692
  Description of Artificial Sequence: Synthetic oligonucleotide

SEQ ID NO: 387760 - DNA, 33 bp, Artificial Sequence; identical to SEQ ID NO: 50693
  Description of Artificial Sequence: Synthetic oligonucleotide

SEQ ID NO: 387761 - DNA, 32 bp, Artificial Sequence; identical to SEQ ID NO: 50694
  Description of Artificial Sequence: Synthetic oligonucleotide

SEQ ID NO: 387762 - DNA, 32 bp, Artificial Sequence; identical to SEQ ID NO: 50695
  Description of Artificial Sequence: Synthetic oligonucleotide

SEQ ID NO: 387763 - DNA, 33 bp, Artificial Sequence; identical to SEQ ID NO: 50696
  Description of Artificial Sequence: Synthetic oligonucleotide

SEQ ID NO: 387764 - DNA, 34 bp, Artificial Sequence; identical to SEQ ID NO: 50697
  Description of Artificial Sequence: Synthetic oligonucleotide

SEQ ID NO: 387765 - DNA, 36 bp, Artificial Sequence; identical to SEQ ID NO: 50698
  Description of Artificial Sequence: Synthetic oligonucleotide

SEQ ID NO: 387766 - DNA, 38 bp, Artificial Sequence; identical to SEQ ID NO: 50699
  Description of Artificial Sequence: Synthetic oligonucleotide

SEQ ID NO: 387767 - DNA, 39 bp, Artificial Sequence; identical to SEQ ID NO: 50700
  Description of Artificial Sequence: Synthetic oligonucleotide

SEQ ID NO: 387768 - DNA, 38 bp, Artificial Sequence; identical to SEQ ID NO: 50701
  Description of Artificial Sequence: Synthetic oligonucleotide

SEQ ID NO: 387769 - DNA, 39 bp, Artificial Sequence; identical to SEQ ID NO: 50702
  Description of Artificial Sequence: Synthetic oligonucleotide

SEQ ID NO: 387770 - DNA, 38 bp, Artificial Sequence; identical to SEQ ID NO: 50703
  Description of Artificial Sequence: Synthetic oligonucleotide

SEQ ID NO: 387771 - DNA, 37 bp, Artificial Sequence; identical to SEQ ID NO: 50704
  Description of Artificial Sequence: Synthetic oligonucleotide

SEQ ID NO: 387772 - DNA, 37 bp, Artificial Sequence; identical to SEQ ID NO: 50705
  Description of Artificial Sequence: Synthetic oligonucleotide

SEQ ID NO: 387773 - DNA, 36 bp, Artificial Sequence; identical to SEQ ID NO: 50706
  Description of Artificial Sequence: Synthetic oligonucleotide

SEQ ID NO: 387774 - DNA, 36 bp, Artificial Sequence; identical to SEQ ID NO: 50707
  Description of Artificial Sequence: Synthetic oligonucleotide

SEQ ID NO: 387775 - DNA, 35 bp, Artificial Sequence; identical to SEQ ID NO: 50708
  Description of Artificial Sequence: Synthetic oligonucleotide

SEQ ID NO: 387776 - DNA, 35 bp, Artificial Sequence; identical to SEQ ID NO: 50709
  Description of Artificial Sequence: Synthetic oligonucleotide

SEQ ID NO: 387777 - DNA, 34 bp, Artificial Sequence; identical to SEQ ID NO: 50710
  Description of Artificial Sequence: Synthetic oligonucleotide

SEQ ID NO: 387778 - DNA, 33 bp, Artificial Sequence; identical to SEQ ID NO: 50711
  Description of Artificial Sequence: Synthetic oligonucleotide

SEQ ID NO: 387779 - DNA, 32 bp, Artificial Sequence; identical to SEQ ID NO: 50712
  Description of Artificial Sequence: Synthetic oligonucleotide

SEQ ID NO: 387780 - DNA, 33 bp, Artificial Sequence; identical to SEQ ID NO: 50713
  Description of Artificial Sequence: Synthetic oligonucleotide

SEQ ID NO: 387781 - DNA, 32 bp, Artificial Sequence; identical to SEQ ID NO: 50714
  Description of Artificial Sequence: Synthetic oligonucleotide

SEQ ID NO: 387782 - DNA, 31 bp, Artificial Sequence; identical to SEQ ID NO: 50715
  Description of Artificial Sequence: Synthetic oligonucleotide

SEQ ID NO: 387783 - DNA, 32 bp, Artificial Sequence; identical to SEQ ID NO: 50716
  Description of Artificial Sequence: Synthetic oligonucleotide

SEQ ID NO: 387784 - DNA, 32 bp, Artificial Sequence; identical to SEQ ID NO: 50717
  Description of Artificial Sequence: Synthetic oligonucleotide

SEQ ID NO: 387785 - DNA, 31 bp, Artificial Sequence; identical to SEQ ID NO: 50718
  Description of Artificial Sequence: Synthetic oligonucleotide

SEQ ID NO: 387786 - DNA, 30 bp, Artificial Sequence; identical to SEQ ID NO: 50719
  Description of Artificial Sequence: Synthetic oligonucleotide

SEQ ID NO: 387787 - DNA, 29 bp, Artificial Sequence
  Description of Artificial Sequence: Synthetic oligonucleotide
tcagagctgtgatcttgagagccctctcc

SEQ ID NO: 387788 - DNA, 28 bp, Artificial Sequence
  Description of Artificial Sequence: Synthetic oligonucleotide
cagagctgtgatcttgagagccctctcc

SEQ ID NO: 387789 - DNA, 30 bp, Artificial Sequence; identical to SEQ ID NO: 50722
  Description of Artificial Sequence: Synthetic oligonucleotide

SEQ ID NO: 387790 - DNA, 29 bp, Artificial Sequence
  Description of Artificial Sequence: Synthetic oligonucleotide
gagctgtgatcttgagagccctctccttg

SEQ ID NO: 387791 - DNA, 29 bp, Artificial Sequence
  Description of Artificial Sequence: Synthetic oligonucleotide
agctgtgatcttgagagccctctccttgg

SEQ ID NO: 387792 - DNA, 28 bp, Artificial Sequence
  Description of Artificial Sequence: Synthetic oligonucleotide
gctgtgatcttgagagccctctccttgg

SEQ ID NO: 387793 - DNA, 28 bp, Artificial Sequence
  Description of Artificial Sequence: Synthetic oligonucleotide
ctgtgatcttgagagccctctccttggc

SEQ ID NO: 387794 - DNA, 31 bp, Artificial Sequence; identical to SEQ ID NO: 50727
  Description of Artificial Sequence: Synthetic oligonucleotide

SEQ ID NO: 387795 - DNA, 30 bp, Artificial Sequence; identical to SEQ ID NO: 50728
  Description of Artificial Sequence: Synthetic oligonucleotide

SEQ ID NO: 387796 - DNA, 30 bp, Artificial Sequence; identical to SEQ ID NO: 50729
  Description of Artificial Sequence: Synthetic oligonucleotide

SEQ ID NO: 387797 - DNA, 29 bp, Artificial Sequence
  Description of Artificial Sequence: Synthetic oligonucleotide
gatcttgagagccctctccttggctttcc

SEQ ID NO: 387798 - DNA, 30 bp, Artificial Sequence; identical to SEQ ID NO: 50731
  Description of Artificial Sequence: Synthetic oligonucleotide

SEQ ID NO: 387799 - DNA, 29 bp, Artificial Sequence
  Description of Artificial Sequence: Synthetic oligonucleotide
tcttgagagccctctccttggctttcctg

SEQ ID NO: 387800 - DNA, 28 bp, Artificial Sequence
  Description of Artificial Sequence: Synthetic oligonucleotide
cttgagagccctctccttggctttcctg

SEQ ID NO: 387801 - DNA, 28 bp, Artificial Sequence
  Description of Artificial Sequence: Synthetic oligonucleotide
ttgagagccctctccttggctttcctgc

SEQ ID NO: 387802 - DNA, 27 bp, Artificial Sequence
  Description of Artificial Sequence: Synthetic oligonucleotide
tgagagccctctccttggctttcctgc

SEQ ID NO: 387803 - DNA, 27 bp, Artificial Sequence
  Description of Artificial Sequence: Synthetic oligonucleotide
gagagccctctccttggctttcctgct

SEQ ID NO: 387804 - DNA, 27 bp, Artificial Sequence
  Description of Artificial Sequence: Synthetic oligonucleotide
agagccctctccttggctttcctgctg

SEQ ID NO: 387805 - DNA, 27 bp, Artificial Sequence
  Description of Artificial Sequence: Synthetic oligonucleotide
gagccctctccttggctttcctgctga

SEQ ID NO: 387806 - DNA, 27 bp, Artificial Sequence
  Description of Artificial Sequence: Synthetic oligonucleotide
agccctctccttggctttcctgctgag

SEQ ID NO: 387807 - DNA, 27 bp, Artificial Sequence
  Description of Artificial Sequence: Synthetic oligonucleotide
gccctctccttggctttcctgctgagt

SEQ ID NO: 387808 - DNA, 27 bp, Artificial Sequence
  Description of Artificial Sequence: Synthetic oligonucleotide
ccctctccttggctttcctgctgagtc

SEQ ID NO: 387809 - DNA, 28 bp, Artificial Sequence
  Description of Artificial Sequence: Synthetic oligonucleotide
cctctccttggctttcctgctgagtctc

SEQ ID NO: 387810 - DNA, 28 bp, Artificial Sequence
  Description of Artificial Sequence: Synthetic oligonucleotide
ctctccttggctttcctgctgagtctcc

SEQ ID NO: 387811 - DNA, 28 bp, Artificial Sequence
  Description of Artificial Sequence: Synthetic oligonucleotide
tctccttggctttcctgctgagtctccg

SEQ ID NO: 387812 - DNA, 27 bp, Artificial Sequence
  Description of Artificial Sequence: Synthetic oligonucleotide
ctccttggctttcctgctgagtctccg

SEQ ID NO: 387813 - DNA, 28 bp, Artificial Sequence
  Description of Artificial Sequence: Synthetic oligonucleotide
tccttggctttcctgctgagtctccgag

SEQ ID NO: 387814 - DNA, 27 bp, Artificial Sequence
  Description of Artificial Sequence: Synthetic oligonucleotide
ccttggctttcctgctgagtctccgag

SEQ ID NO: 387815 - DNA, 27 bp, Artificial Sequence
  Description of Artificial Sequence: Synthetic oligonucleotide
cttggctttcctgctgagtctccgagg

SEQ ID NO: 387816 - DNA, 28 bp, Artificial Sequence
  Description of Artificial Sequence: Synthetic oligonucleotide
ttggctttcctgctgagtctccgaggag

SEQ ID NO: 387817 - DNA, 27 bp, Artificial Sequence
  Description of Artificial Sequence: Synthetic oligonucleotide
tggctttcctgctgagtctccgaggag

SEQ ID NO: 387818 - DNA, 26 bp, Artificial Sequence
  Description of Artificial Sequence: Synthetic oligonucleotide
ggctttcctgctgagtctccgaggag

SEQ ID NO: 387819 - DNA, 27 bp, Artificial Sequence
  Description of Artificial Sequence: Synthetic oligonucleotide
gctttcctgctgagtctccgaggagct

SEQ ID NO: 387820 - DNA, 27 bp, Artificial Sequence
  Description of Artificial Sequence: Synthetic oligonucleotide
ctttcctgctgagtctccgaggagctg

SEQ ID NO: 387821 - DNA, 27 bp, Artificial Sequence
  Description of Artificial Sequence: Synthetic oligonucleotide
tttcctgctgagtctccgaggagctgg

SEQ ID NO: 387822 - DNA, 26 bp, Artificial Sequence
  Description of Artificial Sequence: Synthetic oligonucleotide
ttcctgctgagtctccgaggagctgg

SEQ ID NO: 387823 - DNA, 25 bp, Artificial Sequence
  Description of Artificial Sequence: Synthetic oligonucleotide
tcctgctgagtctccgaggagctgg

SEQ ID NO: 387824 - DNA, 24 bp, Artificial Sequence
  Description of Artificial Sequence: Synthetic oligonucleotide
cctgctgagtctccgaggagctgg

SEQ ID NO: 387825 - DNA, 24 bp, Artificial Sequence
  Description of Artificial Sequence: Synthetic oligonucleotide
ctgctgagtctccgaggagctggg

SEQ ID NO: 387826 - DNA, 24 bp, Artificial Sequence
  Description of Artificial Sequence: Synthetic oligonucleotide
tgctgagtctccgaggagctgggg

SEQ ID NO: 387827 - DNA, 23 bp, Artificial Sequence
  Description of Artificial Sequence: Synthetic oligonucleotide
gctgagtctccgaggagctgggg

SEQ ID NO: 387828 - DNA, 23 bp, Artificial Sequence
  Description of Artificial Sequence: Synthetic oligonucleotide
ctgagtctccgaggagctggggc

SEQ ID NO: 387829 - DNA, 25 bp, Artificial Sequence
  Description of Artificial Sequence: Synthetic oligonucleotide
tgagtctccgaggagctggggccat

SEQ ID NO: 387830 - DNA, 24 bp, Artificial Sequence
  Description of Artificial Sequence: Synthetic oligonucleotide
gagtctccgaggagctggggccat

SEQ ID NO: 387831 - DNA, 26 bp, Artificial Sequence
  Description of Artificial Sequence: Synthetic oligonucleotide
agtctccgaggagctggggccatcaa

SEQ ID NO: 387832 - DNA, 25 bp, Artificial Sequence
  Description of Artificial Sequence: Synthetic oligonucleotide
gtctccgaggagctggggccatcaa

SEQ ID NO: 387833 - DNA, 25 bp, Artificial Sequence
  Description of Artificial Sequence: Synthetic oligonucleotide
tctccgaggagctggggccatcaag

SEQ ID NO: 387834 - DNA, 24 bp, Artificial Sequence
  Description of Artificial Sequence: Synthetic oligonucleotide
ctccgaggagctggggccatcaag

SEQ ID NO: 387835 - DNA, 24 bp, Artificial Sequence
  Description of Artificial Sequence: Synthetic oligonucleotide
tccgaggagctggggccatcaagg

SEQ ID NO: 387836 - DNA, 23 bp, Artificial Sequence
  Description of Artificial Sequence: Synthetic oligonucleotide
ccgaggagctggggccatcaagg

SEQ ID NO: 387837 - DNA, 23 bp, Artificial Sequence
  Description of Artificial Sequence: Synthetic oligonucleotide
cgaggagctggggccatcaaggc

SEQ ID NO: 387838 - DNA, 23 bp, Artificial Sequence
  Description of Artificial Sequence: Synthetic oligonucleotide
gaggagctggggccatcaaggcg

SEQ ID NO: 387839 - DNA, 24 bp, Artificial Sequence
  Description of Artificial Sequence: Synthetic oligonucleotide
aggagctggggccatcaaggcgga

SEQ ID NO: 387840 - DNA, 23 bp, Artificial Sequence
  Description of Artificial Sequence: Synthetic oligonucleotide
ggagctggggccatcaaggcgga

SEQ ID NO: 387841 - DNA, 23 bp, Artificial Sequence
  Description of Artificial Sequence: Synthetic oligonucleotide
gagctggggccatcaaggcggac

SEQ ID NO: 387842 - DNA, 25 bp, Artificial Sequence
  Description of Artificial Sequence: Synthetic oligonucleotide
agctggggccatcaaggcggaccat

SEQ ID NO: 387843 - DNA, 24 bp, Artificial Sequence
  Description of Artificial Sequence: Synthetic oligonucleotide
gctggggccatcaaggcggaccat

SEQ ID NO: 387844 - DNA, 25 bp, Artificial Sequence
  Description of Artificial Sequence: Synthetic oligonucleotide
ctggggccatcaaggcggaccatgt

SEQ ID NO: 387845 - DNA, 26 bp, Artificial Sequence
  Description of Artificial Sequence: Synthetic oligonucleotide
tggggccatcaaggcggaccatgtgt

SEQ ID NO: 387846 - DNA, 25 bp, Artificial Sequence
  Description of Artificial Sequence: Synthetic oligonucleotide
ggggccatcaaggcggaccatgtgt

SEQ ID NO: 387847 - DNA, 27 bp, Artificial Sequence
  Description of Artificial Sequence: Synthetic oligonucleotide
gggccatcaaggcggaccatgtgtcaa

SEQ ID NO: 387848 - DNA, 27 bp, Artificial Sequence
  Description of Artificial Sequence: Synthetic oligonucleotide
ggccatcaaggcggaccatgtgtcaac

SEQ ID NO: 387849 - DNA, 31 bp, Artificial Sequence; identical to SEQ ID NO: 50782
  Description of Artificial Sequence: Synthetic oligonucleotide

SEQ ID NO: 387850 - DNA, 31 bp, Artificial Sequence; identical to SEQ ID NO: 50783
  Description of Artificial Sequence: Synthetic oligonucleotide

SEQ ID NO: 387851 - DNA, 31 bp, Artificial Sequence; identical to SEQ ID NO: 50784
  Description of Artificial Sequence: Synthetic oligonucleotide

SEQ ID NO: 387852 - DNA, 31 bp, Artificial Sequence; identical to SEQ ID NO: 50785
  Description of Artificial Sequence: Synthetic oligonucleotide

SEQ ID NO: 387853 - DNA, 30 bp, Artificial Sequence; identical to SEQ ID NO: 50786
  Description of Artificial Sequence: Synthetic oligonucleotide

SEQ ID NO: 387854 - DNA, 29 bp, Artificial Sequence
  Description of Artificial Sequence: Synthetic oligonucleotide
caaggcggaccatgtgtcaacttatgccg

SEQ ID NO: 387855 - DNA, 29 bp, Artificial Sequence
  Description of Artificial Sequence: Synthetic oligonucleotide
aaggcggaccatgtgtcaacttatgccgc

SEQ ID NO: 387856 - DNA, 28 bp, Artificial Sequence
  Description of Artificial Sequence: Synthetic oligonucleotide
aggcggaccatgtgtcaacttatgccgc

SEQ ID NO: 387857 - DNA, 27 bp, Artificial Sequence
  Description of Artificial Sequence: Synthetic oligonucleotide
ggcggaccatgtgtcaacttatgccgc

SEQ ID NO: 387858 - DNA, 27 bp, Artificial Sequence
  Description of Artificial Sequence: Synthetic oligonucleotide
gcggaccatgtgtcaacttatgccgcg

SEQ ID NO: 387859 - DNA, 30 bp, Artificial Sequence; identical to SEQ ID NO: 50792
  Description of Artificial Sequence: Synthetic oligonucleotide

SEQ ID NO: 387860 - DNA, 32 bp, Artificial Sequence; identical to SEQ ID NO: 50793
  Description of Artificial Sequence: Synthetic oligonucleotide

SEQ ID NO: 387861 - DNA, 33 bp, Artificial Sequence; identical to SEQ ID NO: 50794
  Description of Artificial Sequence: Synthetic oligonucleotide

SEQ ID NO: 387862 - DNA, 34 bp, Artificial Sequence; identical to SEQ ID NO: 50795
  Description of Artificial Sequence: Synthetic oligonucleotide

SEQ ID NO: 387863 - DNA, 33 bp, Artificial Sequence; identical to SEQ ID NO: 50796
  Description of Artificial Sequence: Synthetic oligonucleotide

SEQ ID NO: 387864 - DNA, 33 bp, Artificial Sequence; identical to SEQ ID NO: 50797
  Description of Artificial Sequence: Synthetic oligonucleotide

SEQ ID NO: 387865 - DNA, 33 bp, Artificial Sequence; identical to SEQ ID NO: 50798
  Description of Artificial Sequence: Synthetic oligonucleotide

SEQ ID NO: 387866 - DNA, 32 bp, Artificial Sequence; identical to SEQ ID NO: 50799
  Description of Artificial Sequence: Synthetic oligonucleotide

SEQ ID NO: 387867 - DNA, 31 bp, Artificial Sequence; identical to SEQ ID NO: 50800
  Description of Artificial Sequence: Synthetic oligonucleotide

SEQ ID NO: 387868 - DNA, 34 bp, Artificial Sequence; identical to SEQ ID NO: 50801
  Description of Artificial Sequence: Synthetic oligonucleotide

SEQ ID NO: 387869 - DNA, 33 bp, Artificial Sequence; identical to SEQ ID NO: 50802
  Description of Artificial Sequence: Synthetic oligonucleotide

SEQ ID NO: 387870 - DNA, 34 bp, Artificial Sequence; identical to SEQ ID NO: 50803
  Description of Artificial Sequence: Synthetic oligonucleotide

SEQ ID NO: 387871 - DNA, 33 bp, Artificial Sequence; identical to SEQ ID NO: 50804
  Description of Artificial Sequence: Synthetic oligonucleotide

SEQ ID NO: 387872 - DNA, 33 bp, Artificial Sequence; identical to SEQ ID NO: 50805
  Description of Artificial Sequence: Synthetic oligonucleotide

SEQ ID NO: 387873 - DNA, 32 bp, Artificial Sequence; identical to SEQ ID NO: 50806
  Description of Artificial Sequence: Synthetic oligonucleotide

SEQ ID NO: 387874 - DNA, 31 bp, Artificial Sequence; identical to SEQ ID NO: 50807
  Description of Artificial Sequence: Synthetic oligonucleotide

SEQ ID NO: 387875 - DNA, 33 bp, Artificial Sequence; identical to SEQ ID NO: 50808
  Description of Artificial Sequence: Synthetic oligonucleotide

SEQ ID NO: 387876 - DNA, 32 bp, Artificial Sequence; identical to SEQ ID NO: 50809
  Description of Artificial Sequence: Synthetic oligonucleotide

SEQ ID NO: 387877 - DNA, 31 bp, Artificial Sequence; identical to SEQ ID NO: 50810
  Description of Artificial Sequence: Synthetic oligonucleotide

SEQ ID NO: 387878 - DNA, 30 bp, Artificial Sequence; identical to SEQ ID NO: 50811
  Description of Artificial Sequence: Synthetic oligonucleotide

SEQ ID NO: 387879 - DNA, 29 bp, Artificial Sequence
  Description of Artificial Sequence: Synthetic oligonucleotide
gccgcgtttgtacagacgcatagaccaac

SEQ ID NO: 387880 - DNA, 30 bp, Artificial Sequence; identical to SEQ ID NO: 50813
  Description of Artificial Sequence: Synthetic oligonucleotide

SEQ ID NO: 387881 - DNA, 30 bp, Artificial Sequence; identical to SEQ ID NO: 50814
  Description of Artificial Sequence: Synthetic oligonucleotide

SEQ ID NO: 387882 - DNA, 30 bp, Artificial Sequence; identical to SEQ ID NO: 50815
  Description of Artificial Sequence: Synthetic oligonucleotide

SEQ ID NO: 387883 - DNA, 30 bp, Artificial Sequence; identical to SEQ ID NO: 50816
  Description of Artificial Sequence: Synthetic oligonucleotide

SEQ ID NO: 387884 - DNA, 31 bp, Artificial Sequence; identical to SEQ ID NO: 50817
  Description of Artificial Sequence: Synthetic oligonucleotide

SEQ ID NO: 387885 - DNA, 36 bp, Artificial Sequence; identical to SEQ ID NO: 50818
  Description of Artificial Sequence: Synthetic oligonucleotide

SEQ ID NO: 387886 - DNA, 35 bp, Artificial Sequence; identical to SEQ ID NO: 50819
  Description of Artificial Sequence: Synthetic oligonucleotide

SEQ ID NO: 387887 - DNA, 34 bp, Artificial Sequence; identical to SEQ ID NO: 50820
  Description of Artificial Sequence: Synthetic oligonucleotide

SEQ ID NO: 387888 - DNA, 33 bp, Artificial Sequence; identical to SEQ ID NO: 50821
  Description of Artificial Sequence: Synthetic oligonucleotide

SEQ ID NO: 387889 - DNA, 36 bp, Artificial Sequence; identical to SEQ ID NO: 50822
  Description of Artificial Sequence: Synthetic oligonucleotide

SEQ ID NO: 387890 - DNA, 35 bp, Artificial Sequence; identical to SEQ ID NO: 50823
  Description of Artificial Sequence: Synthetic oligonucleotide

SEQ ID NO: 387891 - DNA, 34 bp, Artificial Sequence; identical to SEQ ID NO: 50824
  Description of Artificial Sequence: Synthetic oligonucleotide

SEQ ID NO: 387892 - DNA, 39 bp, Artificial Sequence; identical to SEQ ID NO: 50825
  Description of Artificial Sequence: Synthetic oligonucleotide

SEQ ID NO: 387893 - DNA, 38 bp, Artificial Sequence; identical to SEQ ID NO: 50826
  Description of Artificial Sequence: Synthetic oligonucleotide

SEQ ID NO: 387894 - DNA, 40 bp, Artificial Sequence; identical to SEQ ID NO: 50827
  Description of Artificial Sequence: Synthetic oligonucleotide

SEQ ID NO: 387895 - DNA, 39 bp, Artificial Sequence; identical to SEQ ID NO: 50828
  Description of Artificial Sequence: Synthetic oligonucleotide

SEQ ID NO: 387896 - DNA, 41 bp, Artificial Sequence; identical to SEQ ID NO: 50829
  Description of Artificial Sequence: Synthetic oligonucleotide

SEQ ID NO: 387897 - DNA, 43 bp, Artificial Sequence; identical to SEQ ID NO: 50830
  Description of Artificial Sequence: Synthetic oligonucleotide

SEQ ID NO: 387898 - DNA, 44 bp, Artificial Sequence; identical to SEQ ID NO: 50831
  Description of Artificial Sequence: Synthetic oligonucleotide

SEQ ID NO: 387899 - DNA, 43 bp, Artificial Sequence; identical to SEQ ID NO: 50832
  Description of Artificial Sequence: Synthetic oligonucleotide

SEQ ID NO: 387900 - DNA, 42 bp, Artificial Sequence; identical to SEQ ID NO: 50833
  Description of Artificial Sequence: Synthetic oligonucleotide

SEQ ID NO: 387901 - DNA, 41 bp, Artificial Sequence; identical to SEQ ID NO: 50834
  Description of Artificial Sequence: Synthetic oligonucleotide

SEQ ID NO: 387902 - DNA, 43 bp, Artificial Sequence; identical to SEQ ID NO: 50835
  Description of Artificial Sequence: Synthetic oligonucleotide

SEQ ID NO: 387903 - DNA, 42 bp, Artificial Sequence; identical to SEQ ID NO: 50836
  Description of Artificial Sequence: Synthetic oligonucleotide

SEQ ID NO: 387904 - DNA, 44 bp, Artificial Sequence; identical to SEQ ID NO: 50837
  Description of Artificial Sequence: Synthetic oligonucleotide

SEQ ID NO: 387905 - DNA, 47 bp, Artificial Sequence; identical to SEQ ID NO: 50838
  Description of Artificial Sequence: Synthetic oligonucleotide

SEQ ID NO: 387906 - DNA, 46 bp, Artificial Sequence; identical to SEQ ID NO: 50839
  Description of Artificial Sequence: Synthetic oligonucleotide

SEQ ID NO: 387907 - DNA, 45 bp, Artificial Sequence; identical to SEQ ID NO: 50840
  Description of Artificial Sequence: Synthetic oligonucleotide

SEQ ID NO: 387908 - DNA, 46 bp, Artificial Sequence; identical to SEQ ID NO: 50841
  Description of Artificial Sequence: Synthetic oligonucleotide

SEQ ID NO: 387909 - DNA, 45 bp, Artificial Sequence; identical to SEQ ID NO: 50842
  Description of Artificial Sequence: Synthetic oligonucleotide

SEQ ID NO: 387910 - DNA, 45 bp, Artificial Sequence; identical to SEQ ID NO: 50843
  Description of Artificial Sequence: Synthetic oligonucleotide

SEQ ID NO: 387911 - DNA, 47 bp, Artificial Sequence; identical to SEQ ID NO: 50844
  Description of Artificial Sequence: Synthetic oligonucleotide

SEQ ID NO: 387912 - DNA, 48 bp, Artificial Sequence; identical to SEQ ID NO: 50845
  Description of Artificial Sequence: Synthetic oligonucleotide

SEQ ID NO: 387913 - DNA, 48 bp, Artificial Sequence; identical to SEQ ID NO: 50846
  Description of Artificial Sequence: Synthetic oligonucleotide

SEQ ID NO: 387914 - DNA, 47 bp, Artificial Sequence; identical to SEQ ID NO: 50847
  Description of Artificial Sequence: Synthetic oligonucleotide

SEQ ID NO: 387915 - DNA, 48 bp, Artificial Sequence; identical to SEQ ID NO: 50848
  Description of Artificial Sequence: Synthetic oligonucleotide

SEQ ID NO: 387916 - DNA, 47 bp, Artificial Sequence; identical to SEQ ID NO: 50849
  Description of Artificial Sequence: Synthetic oligonucleotide

SEQ ID NO: 387917 - DNA, 46 bp, Artificial Sequence; identical to SEQ ID NO: 50850
  Description of Artificial Sequence: Synthetic oligonucleotide

SEQ ID NO: 387918 - DNA, 45 bp, Artificial Sequence; identical to SEQ ID NO: 50851
  Description of Artificial Sequence: Synthetic oligonucleotide

SEQ ID NO: 387919 - DNA, 44 bp, Artificial Sequence; identical to SEQ ID NO: 50852
  Description of Artificial Sequence: Synthetic oligonucleotide

SEQ ID NO: 387920 - DNA, 43 bp, Artificial Sequence; identical to SEQ ID NO: 50853
  Description of Artificial Sequence: Synthetic oligonucleotide

SEQ ID NO: 387921 - DNA, 45 bp, Artificial Sequence; identical to SEQ ID NO: 50854
  Description of Artificial Sequence: Synthetic oligonucleotide

SEQ ID NO: 387922 - DNA, 44 bp, Artificial Sequence; identical to SEQ ID NO: 50855
  Description of Artificial Sequence: Synthetic oligonucleotide

SEQ ID NO: 387923 - DNA, 43 bp, Artificial Sequence; identical to SEQ ID NO: 50856
  Description of Artificial Sequence: Synthetic oligonucleotide

SEQ ID NO: 387924 - DNA, 42 bp, Artificial Sequence; identical to SEQ ID NO: 50857
  Description of Artificial Sequence: Synthetic oligonucleotide

SEQ ID NO: 387925 - DNA, 44 bp, Artificial Sequence; identical to SEQ ID NO: 50858
  Description of Artificial Sequence: Synthetic oligonucleotide

SEQ ID NO: 387926 - DNA, 43 bp, Artificial Sequence; identical to SEQ ID NO: 50859
  Description of Artificial Sequence: Synthetic oligonucleotide

SEQ ID NO: 387927 - DNA, 42 bp, Artificial Sequence; identical to SEQ ID NO: 50860
  Description of Artificial Sequence: Synthetic oligonucleotide

SEQ ID NO: 387928 - DNA, 41 bp, Artificial Sequence; identical to SEQ ID NO: 50861
  Description of Artificial Sequence: Synthetic oligonucleotide

SEQ ID NO: 387929 - DNA, 40 bp, Artificial Sequence; identical to SEQ ID NO: 50862
  Description of Artificial Sequence: Synthetic oligonucleotide

SEQ ID NO: 387930 - DNA, 39 bp, Artificial Sequence; identical to SEQ ID NO: 50863
  Description of Artificial Sequence: Synthetic oligonucleotide

SEQ ID NO: 387931 - DNA, 39 bp, Artificial Sequence; identical to SEQ ID NO: 50864
  Description of Artificial Sequence: Synthetic oligonucleotide

SEQ ID NO: 387932 - DNA, 38 bp, Artificial Sequence; identical to SEQ ID NO: 50865
  Description of Artificial Sequence: Synthetic oligonucleotide

SEQ ID NO: 387933 - DNA, 37 bp, Artificial Sequence; identical to SEQ ID NO: 50866
  Description of Artificial Sequence: Synthetic oligonucleotide

SEQ ID NO: 387934 - DNA, 38 bp, Artificial Sequence; identical to SEQ ID NO: 50867
  Description of Artificial Sequence: Synthetic oligonucleotide

SEQ ID NO: 387935 - DNA, 37 bp, Artificial Sequence; identical to SEQ ID NO: 50868
  Description of Artificial Sequence: Synthetic oligonucleotide

SEQ ID NO: 387936 - DNA, 36 bp, Artificial Sequence; identical to SEQ ID NO: 50869
  Description of Artificial Sequence: Synthetic oligonucleotide

SEQ ID NO: 387937 - DNA, 37 bp, Artificial Sequence; identical to SEQ ID NO: 50870
  Description of Artificial Sequence: Synthetic oligonucleotide

SEQ ID NO: 387938 - DNA, 36 bp, Artificial Sequence; identical to SEQ ID NO: 50871
  Description of Artificial Sequence: Synthetic oligonucleotide

SEQ ID NO: 387939 - DNA, 35 bp, Artificial Sequence; identical to SEQ ID NO: 50872
  Description of Artificial Sequence: Synthetic oligonucleotide

SEQ ID NO: 387940 - DNA, 35 bp, Artificial Sequence; identical to SEQ ID NO: 50873
  Description of Artificial Sequence: Synthetic oligonucleotide

SEQ ID NO: 387941 - DNA, 34 bp, Artificial Sequence; identical to SEQ ID NO: 50874
  Description of Artificial Sequence: Synthetic oligonucleotide

SEQ ID NO: 387942 - DNA, 34 bp, Artificial Sequence; identical to SEQ ID NO: 50875
  Description of Artificial Sequence: Synthetic oligonucleotide

SEQ ID NO: 387943 - DNA, 33 bp, Artificial Sequence; identical to SEQ ID NO: 50876
  Description of Artificial Sequence: Synthetic oligonucleotide

SEQ ID NO: 387944 - DNA, 32 bp, Artificial Sequence; identical to SEQ ID NO: 50877
  Description of Artificial Sequence: Synthetic oligonucleotide

SEQ ID NO: 387945 - DNA, 33 bp, Artificial Sequence; identical to SEQ ID NO: 50878
  Description of Artificial Sequence: Synthetic oligonucleotide

SEQ ID NO: 387946 - DNA, 32 bp, Artificial Sequence; identical to SEQ ID NO: 50879
  Description of Artificial Sequence: Synthetic oligonucleotide

SEQ ID NO: 387947 - DNA, 31 bp, Artificial Sequence; identical to SEQ ID NO: 50880
  Description of Artificial Sequence: Synthetic oligonucleotide

SEQ ID NO: 387948 - DNA, 32 bp, Artificial Sequence; identical to SEQ ID NO: 50881
  Description of Artificial Sequence: Synthetic oligonucleotide

SEQ ID NO: 387949 - DNA, 31 bp, Artificial Sequence; identical to SEQ ID NO: 50882
  Description of Artificial Sequence: Synthetic oligonucleotide

SEQ ID NO: 387950 - DNA, 30 bp, Artificial Sequence; identical to SEQ ID NO: 50883
  Description of Artificial Sequence: Synthetic oligonucleotide

SEQ ID NO: 387951 - DNA, 29 bp, Artificial Sequence
  Description of Artificial Sequence: Synthetic oligonucleotide
gtggatctggacaagaaggagaccgtctg

SEQ ID NO: 387952 - DNA, 29 bp, Artificial Sequence
  Description of Artificial Sequence: Synthetic oligonucleotide
tggatctggacaagaaggagaccgtctgg

SEQ ID NO: 387953 - DNA, 28 bp, Artificial Sequence
  Description of Artificial Sequence: Synthetic oligonucleotide
ggatctggacaagaaggagaccgtctgg

SEQ ID NO: 387954 - DNA, 28 bp, Artificial Sequence
  Description of Artificial Sequence: Synthetic oligonucleotide
gatctggacaagaaggagaccgtctggc

SEQ ID NO: 387955 - DNA, 30 bp, Artificial Sequence; identical to SEQ ID NO: 50888
  Description of Artificial Sequence: Synthetic oligonucleotide

SEQ ID NO: 387956 - DNA, 29 bp, Artificial Sequence
  Description of Artificial Sequence: Synthetic oligonucleotide
tctggacaagaaggagaccgtctggcatc

SEQ ID NO: 387957 - DNA, 28 bp, Artificial Sequence
  Description of Artificial Sequence: Synthetic oligonucleotide
ctggacaagaaggagaccgtctggcatc

SEQ ID NO: 387958 - DNA, 29 bp, Artificial Sequence
  Description of Artificial Sequence: Synthetic oligonucleotide
tggacaagaaggagaccgtctggcatctg

SEQ ID NO: 387959 - DNA, 28 bp, Artificial Sequence
  Description of Artificial Sequence: Synthetic oligonucleotide
ggacaagaaggagaccgtctggcatctg

SEQ ID NO: 387960 - DNA, 28 bp, Artificial Sequence
  Description of Artificial Sequence: Synthetic oligonucleotide
gacaagaaggagaccgtctggcatctgg

SEQ ID NO: 387961 - DNA, 29 bp, Artificial Sequence
  Description of Artificial Sequence: Synthetic oligonucleotide
acaagaaggagaccgtctggcatctggag

SEQ ID NO: 387962 - DNA, 28 bp, Artificial Sequence
  Description of Artificial Sequence: Synthetic oligonucleotide
caagaaggagaccgtctggcatctggag

SEQ ID NO: 387963 - DNA, 28 bp, Artificial Sequence
  Description of Artificial Sequence: Synthetic oligonucleotide
aagaaggagaccgtctggcatctggagg

SEQ ID NO: 387964 - DNA, 27 bp, Artificial Sequence
  Description of Artificial Sequence: Synthetic oligonucleotide
agaaggagaccgtctggcatctggagg

SEQ ID NO: 387965 - DNA, 27 bp, Artificial Sequence
  Description of Artificial Sequence: Synthetic oligonucleotide
gaaggagaccgtctggcatctggagga

SEQ ID NO: 387966 - DNA, 27 bp, Artificial Sequence
  Description of Artificial Sequence: Synthetic oligonucleotide
aaggagaccgtctggcatctggaggag

SEQ ID NO: 387967 - DNA, 27 bp, Artificial Sequence
  Description of Artificial Sequence: Synthetic oligonucleotide
aggagaccgtctggcatctggaggagt

SEQ ID NO: 387968 - DNA, 27 bp, Artificial Sequence
  Description of Artificial Sequence: Synthetic oligonucleotide
ggagaccgtctggcatctggaggagtt

SEQ ID NO: 387969 - DNA, 28 bp, Artificial Sequence
  Description of Artificial Sequence: Synthetic oligonucleotide
gagaccgtctggcatctggaggagtttg

SEQ ID NO: 387970 - DNA, 28 bp, Artificial Sequence
  Description of Artificial Sequence: Synthetic oligonucleotide
agaccgtctggcatctggaggagtttgg

SEQ ID NO: 387971 - DNA, 27 bp, Artificial Sequence
  Description of Artificial Sequence: Synthetic oligonucleotide
gaccgtctggcatctggaggagtttgg

SEQ ID NO: 387972 - DNA, 27 bp, Artificial Sequence
  Description of Artificial Sequence: Synthetic oligonucleotide
accgtctggcatctggaggagtttggc

SEQ ID NO: 387973 - DNA, 26 bp, Artificial Sequence
  Description of Artificial Sequence: Synthetic oligonucleotide
ccgtctggcatctggaggagtttggc

SEQ ID NO: 387974 - DNA, 27 bp, Artificial Sequence
  Description of Artificial Sequence: Synthetic oligonucleotide
cgtctggcatctggaggagtttggcca

SEQ ID NO: 387975 - DNA, 28 bp, Artificial Sequence
  Description of Artificial Sequence: Synthetic oligonucleotide
gtctggcatctggaggagtttggccaag

SEQ ID NO: 387976 - DNA, 28 bp, Artificial Sequence
  Description of Artificial Sequence: Synthetic oligonucleotide
tctggcatctggaggagtttggccaagc

SEQ ID NO: 387977 - DNA, 27 bp, Artificial Sequence
  Description of Artificial Sequence: Synthetic oligonucleotide
ctggcatctggaggagtttggccaagc

SEQ ID NO: 387978 - DNA, 27 bp, Artificial Sequence
  Description of Artificial Sequence: Synthetic oligonucleotide
tggcatctggaggagtttggccaagcc

SEQ ID NO: 387979 - DNA, 27 bp, Artificial Sequence
  Description of Artificial Sequence: Synthetic oligonucleotide
ggcatctggaggagtttggccaagcct

SEQ ID NO: 387980 - DNA, 30 bp, Artificial Sequence; identical to SEQ ID NO: 50913
  Description of Artificial Sequence: Synthetic oligonucleotide

SEQ ID NO: 387981 - DNA, 30 bp, Artificial Sequence; identical to SEQ ID NO: 50914
  Description of Artificial Sequence: Synthetic oligonucleotide

SEQ ID NO: 387982 - DNA, 33 bp, Artificial Sequence; identical to SEQ ID NO: 50915
  Description of Artificial Sequence: Synthetic oligonucleotide

SEQ ID NO: 387983 - DNA, 32 bp, Artificial Sequence; identical to SEQ ID NO: 50916
  Description of Artificial Sequence: Synthetic oligonucleotide

SEQ ID NO: 387984 - DNA, 31 bp, Artificial Sequence; identical to SEQ ID NO: 50917
  Description of Artificial Sequence: Synthetic oligonucleotide

SEQ ID NO: 387985 - DNA, 32 bp, Artificial Sequence; identical to SEQ ID NO: 50918
  Description of Artificial Sequence: Synthetic oligonucleotide

SEQ ID NO: 387986 - DNA, 31 bp, Artificial Sequence; identical to SEQ ID NO: 50919
  Description of Artificial Sequence: Synthetic oligonucleotide

SEQ ID NO: 387987 - DNA, 31 bp, Artificial Sequence; identical to SEQ ID NO: 50920
  Description of Artificial Sequence: Synthetic oligonucleotide

SEQ ID NO: 387988 - DNA, 31 bp, Artificial Sequence; identical to SEQ ID NO: 50921
  Description of Artificial Sequence: Synthetic oligonucleotide

SEQ ID NO: 387989 - DNA, 30 bp, Artificial Sequence; identical to SEQ ID NO: 50922
  Description of Artificial Sequence: Synthetic oligonucleotide

SEQ ID NO: 387990 - DNA, 31 bp, Artificial Sequence; identical to SEQ ID NO: 50923
  Description of Artificial Sequence: Synthetic oligonucleotide

SEQ ID NO: 387991 - DNA, 32 bp, Artificial Sequence; identical to SEQ ID NO: 50924
  Description of Artificial Sequence: Synthetic oligonucleotide

SEQ ID NO: 387992 - DNA, 31 bp, Artificial Sequence; identical to SEQ ID NO: 50925
  Description of Artificial Sequence: Synthetic oligonucleotide

SEQ ID NO: 387993 - DNA, 31 bp, Artificial Sequence; identical to SEQ ID NO: 50926
  Description of Artificial Sequence: Synthetic oligonucleotide

SEQ ID NO: 387994 - DNA, 30 bp, Artificial Sequence; identical to SEQ ID NO: 50927
  Description of Artificial Sequence: Synthetic oligonucleotide

SEQ ID NO: 387995 - DNA, 29 bp, Artificial Sequence
  Description of Artificial Sequence: Synthetic oligonucleotide
tggccaagccttttcctttgaggctcagg

SEQ ID NO: 387996 - DNA, 28 bp, Artificial Sequence
  Description of Artificial Sequence: Synthetic oligonucleotide
ggccaagccttttcctttgaggctcagg

SEQ ID NO: 387997 - DNA, 28 bp, Artificial Sequence
  Description of Artificial Sequence: Synthetic oligonucleotide
gccaagccttttcctttgaggctcaggg

SEQ ID NO: 387998 - DNA, 28 bp, Artificial Sequence
  Description of Artificial Sequence: Synthetic oligonucleotide
ccaagccttttcctttgaggctcagggc

SEQ ID NO: 387999 - DNA, 28 bp, Artificial Sequence
  Description of Artificial Sequence: Synthetic oligonucleotide
caagccttttcctttgaggctcagggcg

SEQ ID NO: 388000 - DNA, 28 bp, Artificial Sequence
  Description of Artificial Sequence: Synthetic oligonucleotide
aagccttttcctttgaggctcagggcgg

SEQ ID NO: 388001 - DNA, 27 bp, Artificial Sequence
  Description of Artificial Sequence: Synthetic oligonucleotide
agccttttcctttgaggctcagggcgg

SEQ ID NO: 388002 - DNA, 26 bp, Artificial Sequence
  Description of Artificial Sequence: Synthetic oligonucleotide
gccttttcctttgaggctcagggcgg

SEQ ID NO: 388003 - DNA, 26 bp, Artificial Sequence
  Description of Artificial Sequence: Synthetic oligonucleotide
ccttttcctttgaggctcagggcggg

SEQ ID NO: 388004 - DNA, 27 bp, Artificial Sequence
  Description of Artificial Sequence: Synthetic oligonucleotide
cttttcctttgaggctcagggcgggct

SEQ ID NO: 388005 - DNA, 27 bp, Artificial Sequence
  Description of Artificial Sequence: Synthetic oligonucleotide
ttttcctttgaggctcagggcgggctg

SEQ ID NO: 388006 - DNA, 26 bp, Artificial Sequence
  Description of Artificial Sequence: Synthetic oligonucleotide
tttcctttgaggctcagggcgggctg

SEQ ID NO: 388007 - DNA, 25 bp, Artificial Sequence
  Description of Artificial Sequence: Synthetic oligonucleotide
ttcctttgaggctcagggcgggctg

SEQ ID NO: 388008 - DNA, 24 bp, Artificial Sequence
  Description of Artificial Sequence: Synthetic oligonucleotide
tcctttgaggctcagggcgggctg

SEQ ID NO: 388009 - DNA, 23 bp, Artificial Sequence
  Description of Artificial Sequence: Synthetic oligonucleotide
cctttgaggctcagggcgggctg

SEQ ID NO: 388010 - DNA, 23 bp, Artificial Sequence
  Description of Artificial Sequence: Synthetic oligonucleotide
ctttgaggctcagggcgggctgg

SEQ ID NO: 388011 - DNA, 26 bp, Artificial Sequence
  Description of Artificial Sequence: Synthetic oligonucleotide
tttgaggctcagggcgggctggctaa

SEQ ID NO: 388012 - DNA, 25 bp, Artificial Sequence
  Description of Artificial Sequence: Synthetic oligonucleotide
ttgaggctcagggcgggctggctaa

SEQ ID NO: 388013 - DNA, 24 bp, Artificial Sequence
  Description of Artificial Sequence: Synthetic oligonucleotide
tgaggctcagggcgggctggctaa

SEQ ID NO: 388014 - DNA, 23 bp, Artificial Sequence
  Description of Artificial Sequence: Synthetic oligonucleotide
gaggctcagggcgggctggctaa

SEQ ID NO: 388015 - DNA, 26 bp, Artificial Sequence
  Description of Artificial Sequence: Synthetic oligonucleotide
aggctcagggcgggctggctaacatt

SEQ ID NO: 388016 - DNA, 25 bp, Artificial Sequence
  Description of Artificial Sequence: Synthetic oligonucleotide
ggctcagggcgggctggctaacatt

SEQ ID NO: 388017 - DNA, 25 bp, Artificial Sequence
  Description of Artificial Sequence: Synthetic oligonucleotide
gctcagggcgggctggctaacattg

SEQ ID NO: 388018 - DNA, 27 bp, Artificial Sequence
  Description of Artificial Sequence: Synthetic oligonucleotide
ctcagggcgggctggctaacattgcta

SEQ ID NO: 388019 - DNA, 31 bp, Artificial Sequence; identical to SEQ ID NO: 50952
  Description of Artificial Sequence: Synthetic oligonucleotide

SEQ ID NO: 388020 - DNA, 30 bp, Artificial Sequence; identical to SEQ ID NO: 50953
  Description of Artificial Sequence: Synthetic oligonucleotide

SEQ ID NO: 388021 - DNA, 32 bp, Artificial Sequence; identical to SEQ ID NO: 50954
  Description of Artificial Sequence: Synthetic oligonucleotide

SEQ ID NO: 388022 - DNA, 31 bp, Artificial Sequence; identical to SEQ ID NO: 50955
  Description of Artificial Sequence: Synthetic oligonucleotide

SEQ ID NO: 388023 - DNA, 33 bp, Artificial Sequence; identical to SEQ ID NO: 50956
  Description of Artificial Sequence: Synthetic oligonucleotide

SEQ ID NO: 388024 - DNA, 35 bp, Artificial Sequence; identical to SEQ ID NO: 50957
  Description of Artificial Sequence: Synthetic oligonucleotide

SEQ ID NO: 388025 - DNA, 37 bp, Artificial Sequence; identical to SEQ ID NO: 50958
  Description of Artificial Sequence: Synthetic oligonucleotide

SEQ ID NO: 388026 - DNA, 41 bp, Artificial Sequence; identical to SEQ ID NO: 50959
  Description of Artificial Sequence: Synthetic oligonucleotide

SEQ ID NO: 388027 - DNA, 41 bp, Artificial Sequence; identical to SEQ ID NO: 50960
  Description of Artificial Sequence: Synthetic oligonucleotide

SEQ ID NO: 388028 - DNA, 43 bp, Artificial Sequence; identical to SEQ ID NO: 50961
  Description of Artificial Sequence: Synthetic oligonucleotide

SEQ ID NO: 388029 - DNA, 45 bp, Artificial Sequence; identical to SEQ ID NO: 50962
  Description of Artificial Sequence: Synthetic oligonucleotide

SEQ ID NO: 388030 - DNA, 45 bp, Artificial Sequence; identical to SEQ ID NO: 50963
  Description of Artificial Sequence: Synthetic oligonucleotide

SEQ ID NO: 388031 - DNA, 44 bp, Artificial Sequence; identical to SEQ ID NO: 50964
  Description of Artificial Sequence: Synthetic oligonucleotide

SEQ ID NO: 388032 - DNA, 45 bp, Artificial Sequence; identical to SEQ ID NO: 50965
  Description of Artificial Sequence: Synthetic oligonucleotide

SEQ ID NO: 388033 - DNA, 45 bp, Artificial Sequence; identical to SEQ ID NO: 50966
  Description of Artificial Sequence: Synthetic oligonucleotide

SEQ ID NO: 388034 - DNA, 45 bp, Artificial Sequence; identical to SEQ ID NO: 50967
  Description of Artificial Sequence: Synthetic oligonucleotide

SEQ ID NO: 388035 - DNA, 44 bp, Artificial Sequence; identical to SEQ ID NO: 50968
  Description of Artificial Sequence: Synthetic oligonucleotide

SEQ ID NO: 388036 - DNA, 43 bp, Artificial Sequence; identical to SEQ ID NO: 50969
  Description of Artificial Sequence: Synthetic oligonucleotide

SEQ ID NO: 388037 - DNA, 42 bp, Artificial Sequence; identical to SEQ ID NO: 50970
  Description of Artificial Sequence: Synthetic oligonucleotide

SEQ ID NO: 388038 - DNA, 44 bp, Artificial Sequence; identical to SEQ ID NO: 50971
  Description of Artificial Sequence: Synthetic oligonucleotide

SEQ ID NO: 388039 - DNA, 43 bp, Artificial Sequence; identical to SEQ ID NO: 50972
  Description of Artificial Sequence: Synthetic oligonucleotide

SEQ ID NO: 388040 - DNA, 42 bp, Artificial Sequence; identical to SEQ ID NO: 50973
  Description of Artificial Sequence: Synthetic oligonucleotide

SEQ ID NO: 388041 - DNA, 41 bp, Artificial Sequence; identical to SEQ ID NO: 50974
  Description of Artificial Sequence: Synthetic oligonucleotide

SEQ ID NO: 388042 - DNA, 41 bp, Artificial Sequence; identical to SEQ ID NO: 50975
  Description of Artificial Sequence: Synthetic oligonucleotide

SEQ ID NO: 388043 - DNA, 43 bp, Artificial Sequence; identical to SEQ ID NO: 50976
  Description of Artificial Sequence: Synthetic oligonucleotide

SEQ ID NO: 388044 - DNA, 42 bp, Artificial Sequence; identical to SEQ ID NO: 50977
  Description of Artificial Sequence: Synthetic oligonucleotide

SEQ ID NO: 388045 - DNA, 41 bp, Artificial Sequence; identical to SEQ ID NO: 50978
  Description of Artificial Sequence: Synthetic oligonucleotide

SEQ ID NO: 388046 - DNA, 40 bp, Artificial Sequence; identical to SEQ ID NO: 50979
  Description of Artificial Sequence: Synthetic oligonucleotide

SEQ ID NO: 388047 - DNA, 39 bp, Artificial Sequence; identical to SEQ ID NO: 50980
  Description of Artificial Sequence: Synthetic oligonucleotide

SEQ ID NO: 388048 - DNA, 38 bp, Artificial Sequence; identical to SEQ ID NO: 50981
  Description of Artificial Sequence: Synthetic oligonucleotide

SEQ ID NO: 388049 - DNA, 37 bp, Artificial Sequence; identical to SEQ ID NO: 50982
  Description of Artificial Sequence: Synthetic oligonucleotide

SEQ ID NO: 388050 - DNA, 37 bp, Artificial Sequence; identical to SEQ ID NO: 50983
  Description of Artificial Sequence: Synthetic oligonucleotide

SEQ ID NO: 388051 - DNA, 36 bp, Artificial Sequence; identical to SEQ ID NO: 50984
  Description of Artificial Sequence: Synthetic oligonucleotide

SEQ ID NO: 388052 - DNA, 35 bp, Artificial Sequence; identical to SEQ ID NO: 50985
  Description of Artificial Sequence: Synthetic oligonucleotide

SEQ ID NO: 388053 - DNA, 36 bp, Artificial Sequence; identical to SEQ ID NO: 50986
  Description of Artificial Sequence: Synthetic oligonucleotide

SEQ ID NO: 388054 - DNA, 35 bp, Artificial Sequence; identical to SEQ ID NO: 50987
  Description of Artificial Sequence: Synthetic oligonucleotide

SEQ ID NO: 388055 - DNA, 34 bp, Artificial Sequence; identical to SEQ ID NO: 50988
  Description of Artificial Sequence: Synthetic oligonucleotide

SEQ ID NO: 388056 - DNA, 35 bp, Artificial Sequence; identical to SEQ ID NO: 50989
  Description of Artificial Sequence: Synthetic oligonucleotide

SEQ ID NO: 388057 - DNA, 34 bp, Artificial Sequence; identical to SEQ ID NO: 50990
  Description of Artificial Sequence: Synthetic oligonucleotide

SEQ ID NO: 388058 - DNA, 33 bp, Artificial Sequence; identical to SEQ ID NO: 50991
  Description of Artificial Sequence: Synthetic oligonucleotide

SEQ ID NO: 388059 - DNA, 34 bp, Artificial Sequence; identical to SEQ ID NO: 50992
  Description of Artificial Sequence: Synthetic oligonucleotide

SEQ ID NO: 388060 - DNA, 33 bp, Artificial Sequence; identical to SEQ ID NO: 50993
  Description of Artificial Sequence: Synthetic oligonucleotide

SEQ ID NO: 388061 - DNA, 32 bp, Artificial Sequence; identical to SEQ ID NO: 50994
  Description of Artificial Sequence: Synthetic oligonucleotide

SEQ ID NO: 388062 - DNA, 33 bp, Artificial Sequence; identical to SEQ ID NO: 50995
  Description of Artificial Sequence: Synthetic oligonucleotide

SEQ ID NO: 388063 - DNA, 32 bp, Artificial Sequence; identical to SEQ ID NO: 50996
  Description of Artificial Sequence: Synthetic oligonucleotide

SEQ ID NO: 388064 - DNA, 31 bp, Artificial Sequence; identical to SEQ ID NO: 50997
  Description of Artificial Sequence: Synthetic oligonucleotide

SEQ ID NO: 388065 - DNA, 30 bp, Artificial Sequence; identical to SEQ ID NO: 50998
  Description of Artificial Sequence: Synthetic oligonucleotide

SEQ ID NO: 388066 - DNA, 29 bp, Artificial Sequence
  Description of Artificial Sequence: Synthetic oligonucleotide
ccttgatccagcgttccaaccacactcag

SEQ ID NO: 388067 - DNA, 29 bp, Artificial Sequence
  Description of Artificial Sequence: Synthetic oligonucleotide
cttgatccagcgttccaaccacactcagg

SEQ ID NO: 388068 - DNA, 29 bp, Artificial Sequence
  Description of Artificial Sequence: Synthetic oligonucleotide
ttgatccagcgttccaaccacactcaggc

SEQ ID NO: 388069 - DNA, 28 bp, Artificial Sequence
  Description of Artificial Sequence: Synthetic oligonucleotide
tgatccagcgttccaaccacactcaggc

SEQ ID NO: 388070 - DNA, 27 bp, Artificial Sequence
  Description of Artificial Sequence: Synthetic oligonucleotide
gatccagcgttccaaccacactcaggc

SEQ ID NO: 388071 - DNA, 27 bp, Artificial Sequence
  Description of Artificial Sequence: Synthetic oligonucleotide
atccagcgttccaaccacactcaggcc

SEQ ID NO: 388072 - DNA, 27 bp, Artificial Sequence
  Description of Artificial Sequence: Synthetic oligonucleotide
tccagcgttccaaccacactcaggcca

SEQ ID NO: 388073 - DNA, 26 bp, Artificial Sequence
  Description of Artificial Sequence: Synthetic oligonucleotide
ccagcgttccaaccacactcaggcca

SEQ ID NO: 388074 - DNA, 26 bp, Artificial Sequence
  Description of Artificial Sequence: Synthetic oligonucleotide
cagcgttccaaccacactcaggccac

SEQ ID NO: 388075 - DNA, 27 bp, Artificial Sequence
  Description of Artificial Sequence: Synthetic oligonucleotide
agcgttccaaccacactcaggccacca

SEQ ID NO: 388076 - DNA, 27 bp, Artificial Sequence
  Description of Artificial Sequence: Synthetic oligonucleotide
gcgttccaaccacactcaggccaccaa

SEQ ID NO: 388077 - DNA, 27 bp, Artificial Sequence
  Description of Artificial Sequence: Synthetic oligonucleotide
cgttccaaccacactcaggccaccaac

SEQ ID NO: 388078 - DNA, 27 bp, Artificial Sequence
  Description of Artificial Sequence: Synthetic oligonucleotide
gttccaaccacactcaggccaccaacg

SEQ ID NO: 388079 - DNA, 29 bp, Artificial Sequence
  Description of Artificial Sequence: Synthetic oligonucleotide
ttccaaccacactcaggccaccaacgatc

SEQ ID NO: 388080 - DNA, 28 bp, Artificial Sequence
  Description of Artificial Sequence: Synthetic oligonucleotide
tccaaccacactcaggccaccaacgatc

SEQ ID NO: 388081 - DNA, 27 bp, Artificial Sequence
  Description of Artificial Sequence: Synthetic oligonucleotide
ccaaccacactcaggccaccaacgatc

SEQ ID NO: 388082 - DNA, 27 bp, Artificial Sequence
  Description of Artificial Sequence: Synthetic oligonucleotide
caaccacactcaggccaccaacgatcc

SEQ ID NO: 388083 - DNA, 27 bp, Artificial Sequence
  Description of Artificial Sequence: Synthetic oligonucleotide
aaccacactcaggccaccaacgatccc

SEQ ID NO: 388084 - DNA, 26 bp, Artificial Sequence
  Description of Artificial Sequence: Synthetic oligonucleotide
accacactcaggccaccaacgatccc

SEQ ID NO: 388085 - DNA, 25 bp, Artificial Sequence
  Description of Artificial Sequence: Synthetic oligonucleotide
ccacactcaggccaccaacgatccc

SEQ ID NO: 388086 - DNA, 25 bp, Artificial Sequence
  Description of Artificial Sequence: Synthetic oligonucleotide
cacactcaggccaccaacgatcccc

SEQ ID NO: 388087 - DNA, 26 bp, Artificial Sequence
  Description of Artificial Sequence: Synthetic oligonucleotide
acactcaggccaccaacgatccccct

SEQ ID NO: 388088 - DNA, 25 bp, Artificial Sequence
  Description of Artificial Sequence: Synthetic oligonucleotide
cactcaggccaccaacgatccccct

SEQ ID NO: 388089 - DNA, 26 bp, Artificial Sequence
  Description of Artificial Sequence: Synthetic oligonucleotide
actcaggccaccaacgatccccctga

SEQ ID NO: 388090 - DNA, 25 bp, Artificial Sequence
  Description of Artificial Sequence: Synthetic oligonucleotide
ctcaggccaccaacgatccccctga

SEQ ID NO: 388091 - DNA, 25 bp, Artificial Sequence
  Description of Artificial Sequence: Synthetic oligonucleotide
tcaggccaccaacgatccccctgag

SEQ ID NO: 388092 - DNA, 24 bp, Artificial Sequence
  Description of Artificial Sequence: Synthetic oligonucleotide
caggccaccaacgatccccctgag

SEQ ID NO: 388093 - DNA, 25 bp, Artificial Sequence
  Description of Artificial Sequence: Synthetic oligonucleotide
aggccaccaacgatccccctgaggt

SEQ ID NO: 388094 - DNA, 24 bp, Artificial Sequence
  Description of Artificial Sequence: Synthetic oligonucleotide
ggccaccaacgatccccctgaggt

SEQ ID NO: 388095 - DNA, 25 bp, Artificial Sequence
  Description of Artificial Sequence: Synthetic oligonucleotide
gccaccaacgatccccctgaggtga

SEQ ID NO: 388096 - DNA, 25 bp, Artificial Sequence
  Description of Artificial Sequence: Synthetic oligonucleotide
ccaccaacgatccccctgaggtgac

SEQ ID NO: 388097 - DNA, 25 bp, Artificial Sequence
  Description of Artificial Sequence: Synthetic oligonucleotide
caccaacgatccccctgaggtgacc

SEQ ID NO: 388098 - DNA, 26 bp, Artificial Sequence
  Description of Artificial Sequence: Synthetic oligonucleotide
accaacgatccccctgaggtgaccgt

SEQ ID NO: 388099 - DNA, 25 bp, Artificial Sequence
  Description of Artificial Sequence: Synthetic oligonucleotide
ccaacgatccccctgaggtgaccgt

SEQ ID NO: 388100 - DNA, 27 bp, Artificial Sequence
  Description of Artificial Sequence: Synthetic oligonucleotide
caacgatccccctgaggtgaccgtgtt

SEQ ID NO: 388101 - DNA, 28 bp, Artificial Sequence
  Description of Artificial Sequence: Synthetic oligonucleotide
aacgatccccctgaggtgaccgtgtttc

SEQ ID NO: 388102 - DNA, 27 bp, Artificial Sequence
  Description of Artificial Sequence: Synthetic oligonucleotide
acgatccccctgaggtgaccgtgtttc

SEQ ID NO: 388103 - DNA, 26 bp, Artificial Sequence
  Description of Artificial Sequence: Synthetic oligonucleotide
cgatccccctgaggtgaccgtgtttc

SEQ ID NO: 388104 - DNA, 26 bp, Artificial Sequence
  Description of Artificial Sequence: Synthetic oligonucleotide
gatccccctgaggtgaccgtgtttcc

SEQ ID NO: 388105 - DNA, 27 bp, Artificial Sequence
  Description of Artificial Sequence: Synthetic oligonucleotide
atccccctgaggtgaccgtgtttccca

SEQ ID NO: 388106 - DNA, 27 bp, Artificial Sequence
  Description of Artificial Sequence: Synthetic oligonucleotide
tccccctgaggtgaccgtgtttcccaa

SEQ ID NO: 388107 - DNA, 26 bp, Artificial Sequence
  Description of Artificial Sequence: Synthetic oligonucleotide
ccccctgaggtgaccgtgtttcccaa

SEQ ID NO: 388108 - DNA, 26 bp, Artificial Sequence
  Description of Artificial Sequence: Synthetic oligonucleotide
cccctgaggtgaccgtgtttcccaag

SEQ ID NO: 388109 - DNA, 27 bp, Artificial Sequence
  Description of Artificial Sequence: Synthetic oligonucleotide
ccctgaggtgaccgtgtttcccaagga

SEQ ID NO: 388110 - DNA, 27 bp, Artificial Sequence
  Description of Artificial Sequence: Synthetic oligonucleotide
cctgaggtgaccgtgtttcccaaggag

SEQ ID NO: 388111 - DNA, 27 bp, Artificial Sequence
  Description of Artificial Sequence: Synthetic oligonucleotide
ctgaggtgaccgtgtttcccaaggagc

SEQ ID NO: 388112 - DNA, 27 bp, Artificial Sequence
  Description of Artificial Sequence: Synthetic oligonucleotide
tgaggtgaccgtgtttcccaaggagcc

SEQ ID NO: 388113 - DNA, 27 bp, Artificial Sequence
  Description of Artificial Sequence: Synthetic oligonucleotide
gaggtgaccgtgtttcccaaggagcct

SEQ ID NO: 388114 - DNA, 27 bp, Artificial Sequence
  Description of Artificial Sequence: Synthetic oligonucleotide
aggtgaccgtgtttcccaaggagcctg

SEQ ID NO: 388115 - DNA, 27 bp, Artificial Sequence
  Description of Artificial Sequence: Synthetic oligonucleotide
ggtgaccgtgtttcccaaggagcctgt

SEQ ID NO: 388116 - DNA, 27 bp, Artificial Sequence
  Description of Artificial Sequence: Synthetic oligonucleotide
gtgaccgtgtttcccaaggagcctgtg

SEQ ID NO: 388117 - DNA, 27 bp, Artificial Sequence
  Description of Artificial Sequence: Synthetic oligonucleotide
tgaccgtgtttcccaaggagcctgtgg

SEQ ID NO: 388118 - DNA, 27 bp, Artificial Sequence
  Description of Artificial Sequence: Synthetic oligonucleotide
gaccgtgtttcccaaggagcctgtgga

SEQ ID NO: 388119 - DNA, 27 bp, Artificial Sequence
  Description of Artificial Sequence: Synthetic oligonucleotide
accgtgtttcccaaggagcctgtggag

SEQ ID NO: 388120 - DNA, 26 bp, Artificial Sequence
  Description of Artificial Sequence: Synthetic oligonucleotide
ccgtgtttcccaaggagcctgtggag

SEQ ID NO: 388121 - DNA, 27 bp, Artificial Sequence
  Description of Artificial Sequence: Synthetic oligonucleotide
cgtgtttcccaaggagcctgtggagct

SEQ ID NO: 388122 - DNA, 27 bp, Artificial Sequence
  Description of Artificial Sequence: Synthetic oligonucleotide
gtgtttcccaaggagcctgtggagctg

SEQ ID NO: 388123 - DNA, 27 bp, Artificial Sequence
  Description of Artificial Sequence: Synthetic oligonucleotide
tgtttcccaaggagcctgtggagctgg

SEQ ID NO: 388124 - DNA, 26 bp, Artificial Sequence
  Description of Artificial Sequence: Synthetic oligonucleotide
gtttcccaaggagcctgtggagctgg

SEQ ID NO: 388125 - DNA, 26 bp, Artificial Sequence
  Description of Artificial Sequence: Synthetic oligonucleotide
tttcccaaggagcctgtggagctggg

SEQ ID NO: 388126 - DNA, 25 bp, Artificial Sequence
  Description of Artificial Sequence: Synthetic oligonucleotide
ttcccaaggagcctgtggagctggg

SEQ ID NO: 388127 - DNA, 24 bp, Artificial Sequence
  Description of Artificial Sequence: Synthetic oligonucleotide
tcccaaggagcctgtggagctggg

SEQ ID NO: 388128 - DNA, 23 bp, Artificial Sequence
  Description of Artificial Sequence: Synthetic oligonucleotide
cccaaggagcctgtggagctggg

SEQ ID NO: 388129 - DNA, 23 bp, Artificial Sequence
  Description of Artificial Sequence: Synthetic oligonucleotide
ccaaggagcctgtggagctgggc

SEQ ID NO: 388130 - DNA, 24 bp, Artificial Sequence
  Description of Artificial Sequence: Synthetic oligonucleotide
caaggagcctgtggagctgggcca

SEQ ID NO: 388131 - DNA, 24 bp, Artificial Sequence
  Description of Artificial Sequence: Synthetic oligonucleotide
aaggagcctgtggagctgggccag

SEQ ID NO: 388132 - DNA, 23 bp, Artificial Sequence
  Description of Artificial Sequence: Synthetic oligonucleotide
aggagcctgtggagctgggccag

SEQ ID NO: 388133 - DNA, 22 bp, Artificial Sequence
  Description of Artificial Sequence: Synthetic oligonucleotide
ggagcctgtggagctgggccag

SEQ ID NO: 388134 - DNA, 22 bp, Artificial Sequence
  Description of Artificial Sequence: Synthetic oligonucleotide
gagcctgtggagctgggccagc

SEQ ID NO: 388135 - DNA, 22 bp, Artificial Sequence
  Description of Artificial Sequence: Synthetic oligonucleotide
agcctgtggagctgggccagcc

SEQ ID NO: 388136 - DNA, 21 bp, Artificial Sequence
  Description of Artificial Sequence: Synthetic oligonucleotide
gcctgtggagctgggccagcc

SEQ ID NO: 388137 - DNA, 23 bp, Artificial Sequence
  Description of Artificial Sequence: Synthetic oligonucleotide
cctgtggagctgggccagcccaa

SEQ ID NO: 388138 - DNA, 24 bp, Artificial Sequence
  Description of Artificial Sequence: Synthetic oligonucleotide
ctgtggagctgggccagcccaaca

SEQ ID NO: 388139 - DNA, 24 bp, Artificial Sequence
  Description of Artificial Sequence: Synthetic oligonucleotide
tgtggagctgggccagcccaacac

SEQ ID NO: 388140 - DNA, 23 bp, Artificial Sequence
  Description of Artificial Sequence: Synthetic oligonucleotide
gtggagctgggccagcccaacac

SEQ ID NO: 388141 - DNA, 23 bp, Artificial Sequence
  Description of Artificial Sequence: Synthetic oligonucleotide
tggagctgggccagcccaacacc

SEQ ID NO: 388142 - DNA, 22 bp, Artificial Sequence
  Description of Artificial Sequence: Synthetic oligonucleotide
ggagctgggccagcccaacacc

SEQ ID NO: 388143 - DNA, 23 bp, Artificial Sequence
  Description of Artificial Sequence: Synthetic oligonucleotide
gagctgggccagcccaacaccct

SEQ ID NO: 388144 - DNA, 25 bp, Artificial Sequence
  Description of Artificial Sequence: Synthetic oligonucleotide
agctgggccagcccaacaccctcat

SEQ ID NO: 388145 - DNA, 24 bp, Artificial Sequence
  Description of Artificial Sequence: Synthetic oligonucleotide
gctgggccagcccaacaccctcat

SEQ ID NO: 388146 - DNA, 25 bp, Artificial Sequence
  Description of Artificial Sequence: Synthetic oligonucleotide
ctgggccagcccaacaccctcatct

SEQ ID NO: 388147 - DNA, 25 bp, Artificial Sequence
  Description of Artificial Sequence: Synthetic oligonucleotide
tgggccagcccaacaccctcatctg

SEQ ID NO: 388148 - DNA, 24 bp, Artificial Sequence
  Description of Artificial Sequence: Synthetic oligonucleotide
gggccagcccaacaccctcatctg

SEQ ID NO: 388149 - DNA, 24 bp, Artificial Sequence
  Description of Artificial Sequence: Synthetic oligonucleotide
ggccagcccaacaccctcatctgc

SEQ ID NO: 388150 - DNA, 25 bp, Artificial Sequence
  Description of Artificial Sequence: Synthetic oligonucleotide
gccagcccaacaccctcatctgcca

SEQ ID NO: 388151 - DNA, 27 bp, Artificial Sequence
  Description of Artificial Sequence: Synthetic oligonucleotide
ccagcccaacaccctcatctgccacat

SEQ ID NO: 388152 - DNA, 28 bp, Artificial Sequence
  Description of Artificial Sequence: Synthetic oligonucleotide
cagcccaacaccctcatctgccacattg

SEQ ID NO: 388153 - DNA, 29 bp, Artificial Sequence
  Description of Artificial Sequence: Synthetic oligonucleotide
agcccaacaccctcatctgccacattgac

SEQ ID NO: 388154 - DNA, 28 bp, Artificial Sequence
  Description of Artificial Sequence: Synthetic oligonucleotide
gcccaacaccctcatctgccacattgac

SEQ ID NO: 388155 - DNA, 30 bp, Artificial Sequence; identical to SEQ ID NO: 51088
  Description of Artificial Sequence: Synthetic oligonucleotide

SEQ ID NO: 388156 - DNA, 32 bp, Artificial Sequence; identical to SEQ ID NO: 51089
  Description of Artificial Sequence: Synthetic oligonucleotide

SEQ ID NO: 388157 - DNA, 34 bp, Artificial Sequence; identical to SEQ ID NO: 51090
  Description of Artificial Sequence: Synthetic oligonucleotide

SEQ ID NO: 388158 - DNA, 34 bp, Artificial Sequence; identical to SEQ ID NO: 51091
  Description of Artificial Sequence: Synthetic oligonucleotide

SEQ ID NO: 388159 - DNA, 33 bp, Artificial Sequence; identical to SEQ ID NO: 51092
  Description of Artificial Sequence: Synthetic oligonucleotide

SEQ ID NO: 388160 - DNA, 32 bp, Artificial Sequence; identical to SEQ ID NO: 51093
  Description of Artificial Sequence: Synthetic oligonucleotide

SEQ ID NO: 388161 - DNA, 32 bp, Artificial Sequence; identical to SEQ ID NO: 51094
  Description of Artificial Sequence: Synthetic oligonucleotide

SEQ ID NO: 388162 - DNA, 31 bp, Artificial Sequence; identical to SEQ ID NO: 51095
  Description of Artificial Sequence: Synthetic oligonucleotide

SEQ ID NO: 388163 - DNA, 32 bp, Artificial Sequence; identical to SEQ ID NO: 51096
  Description of Artificial Sequence: Synthetic oligonucleotide

SEQ ID NO: 388164 - DNA, 32 bp, Artificial Sequence; identical to SEQ ID NO: 51097
  Description of Artificial Sequence: Synthetic oligonucleotide

SEQ ID NO: 388165 - DNA, 33 bp, Artificial Sequence; identical to SEQ ID NO: 51098
  Description of Artificial Sequence: Synthetic oligonucleotide

SEQ ID NO: 388166 - DNA, 32 bp, Artificial Sequence; identical to SEQ ID NO: 51099
  Description of Artificial Sequence: Synthetic oligonucleotide

SEQ ID NO: 388167 - DNA, 33 bp, Artificial Sequence; identical to SEQ ID NO: 51100
  Description of Artificial Sequence: Synthetic oligonucleotide

SEQ ID NO: 388168 - DNA, 32 bp, Artificial Sequence; identical to SEQ ID NO: 51101
  Description of Artificial Sequence: Synthetic oligonucleotide

SEQ ID NO: 388169 - DNA, 31 bp, Artificial Sequence; identical to SEQ ID NO: 51102
  Description of Artificial Sequence: Synthetic oligonucleotide

SEQ ID NO: 388170 - DNA, 31 bp, Artificial Sequence; identical to SEQ ID NO: 51103
  Description of Artificial Sequence: Synthetic oligonucleotide

SEQ ID NO: 388171 - DNA, 30 bp, Artificial Sequence; identical to SEQ ID NO: 51104
  Description of Artificial Sequence: Synthetic oligonucleotide

SEQ ID NO: 388172 - DNA, 31 bp, Artificial Sequence; identical to SEQ ID NO: 51105
  Description of Artificial Sequence: Synthetic oligonucleotide

SEQ ID NO: 388173 - DNA, 33 bp, Artificial Sequence; identical to SEQ ID NO: 51106
  Description of Artificial Sequence: Synthetic oligonucleotide

SEQ ID NO: 388174 - DNA, 33 bp, Artificial Sequence; identical to SEQ ID NO: 51107
  Description of Artificial Sequence: Synthetic oligonucleotide

SEQ ID NO: 388175 - DNA, 32 bp, Artificial Sequence; identical to SEQ ID NO: 51108
  Description of Artificial Sequence: Synthetic oligonucleotide

SEQ ID NO: 388176 - DNA, 33 bp, Artificial Sequence; identical to SEQ ID NO: 51109
  Description of Artificial Sequence: Synthetic oligonucleotide

SEQ ID NO: 388177 - DNA, 32 bp, Artificial Sequence; identical to SEQ ID NO: 51110
  Description of Artificial Sequence: Synthetic oligonucleotide

SEQ ID NO: 388178 - DNA, 31 bp, Artificial Sequence; identical to SEQ ID NO: 51111
  Description of Artificial Sequence: Synthetic oligonucleotide

SEQ ID NO: 388179 - DNA, 30 bp, Artificial Sequence; identical to SEQ ID NO: 51112
  Description of Artificial Sequence: Synthetic oligonucleotide

SEQ ID NO: 388180 - DNA, 31 bp, Artificial Sequence; identical to SEQ ID NO: 51113
  Description of Artificial Sequence: Synthetic oligonucleotide

SEQ ID NO: 388181 - DNA, 30 bp, Artificial Sequence; identical to SEQ ID NO: 51114
  Description of Artificial Sequence: Synthetic oligonucleotide

SEQ ID NO: 388182 - DNA, 30 bp, Artificial Sequence; identical to SEQ ID NO: 51115
  Description of Artificial Sequence: Synthetic oligonucleotide

SEQ ID NO: 388183 - DNA, 29 bp, Artificial Sequence
  Description of Artificial Sequence: Synthetic oligonucleotide
agttcttcccaccagtgctcaacgtcacg

SEQ ID NO: 388184 - DNA, 28 bp, Artificial Sequence
  Description of Artificial Sequence: Synthetic oligonucleotide
gttcttcccaccagtgctcaacgtcacg

SEQ ID NO: 388185 - DNA, 29 bp, Artificial Sequence
  Description of Artificial Sequence: Synthetic oligonucleotide
ttcttcccaccagtgctcaacgtcacgtg

SEQ ID NO: 388186 - DNA, 28 bp, Artificial Sequence
  Description of Artificial Sequence: Synthetic oligonucleotide
tcttcccaccagtgctcaacgtcacgtg

SEQ ID NO: 388187 - DNA, 27 bp, Artificial Sequence
  Description of Artificial Sequence: Synthetic oligonucleotide
cttcccaccagtgctcaacgtcacgtg

SEQ ID NO: 388188 - DNA, 27 bp, Artificial Sequence
  Description of Artificial Sequence: Synthetic oligonucleotide
ttcccaccagtgctcaacgtcacgtgg

SEQ ID NO: 388189 - DNA, 26 bp, Artificial Sequence
  Description of Artificial Sequence: Synthetic oligonucleotide
tcccaccagtgctcaacgtcacgtgg

SEQ ID NO: 388190 - DNA, 25 bp, Artificial Sequence
  Description of Artificial Sequence: Synthetic oligonucleotide
cccaccagtgctcaacgtcacgtgg

SEQ ID NO: 388191 - DNA, 26 bp, Artificial Sequence
  Description of Artificial Sequence: Synthetic oligonucleotide
ccaccagtgctcaacgtcacgtggct

SEQ ID NO: 388192 - DNA, 27 bp, Artificial Sequence
  Description of Artificial Sequence: Synthetic oligonucleotide
caccagtgctcaacgtcacgtggctgt

SEQ ID NO: 388193 - DNA, 27 bp, Artificial Sequence
  Description of Artificial Sequence: Synthetic oligonucleotide
accagtgctcaacgtcacgtggctgtg

SEQ ID NO: 388194 - DNA, 26 bp, Artificial Sequence
  Description of Artificial Sequence: Synthetic oligonucleotide
ccagtgctcaacgtcacgtggctgtg

SEQ ID NO: 388195 - DNA, 27 bp, Artificial Sequence
  Description of Artificial Sequence: Synthetic oligonucleotide
cagtgctcaacgtcacgtggctgtgca

SEQ ID NO: 388196 - DNA, 28 bp, Artificial Sequence
  Description of Artificial Sequence: Synthetic oligonucleotide
agtgctcaacgtcacgtggctgtgcaac

SEQ ID NO: 388197 - DNA, 27 bp, Artificial Sequence
  Description of Artificial Sequence: Synthetic oligonucleotide
gtgctcaacgtcacgtggctgtgcaac

SEQ ID NO: 388198 - DNA, 27 bp, Artificial Sequence
  Description of Artificial Sequence: Synthetic oligonucleotide
tgctcaacgtcacgtggctgtgcaacg

SEQ ID NO: 388199 - DNA, 26 bp, Artificial Sequence
  Description of Artificial Sequence: Synthetic oligonucleotide
gctcaacgtcacgtggctgtgcaacg

SEQ ID NO: 388200 - DNA, 26 bp, Artificial Sequence
  Description of Artificial Sequence: Synthetic oligonucleotide
ctcaacgtcacgtggctgtgcaacgg

SEQ ID NO: 388201 - DNA, 26 bp, Artificial Sequence
  Description of Artificial Sequence: Synthetic oligonucleotide
tcaacgtcacgtggctgtgcaacggg

SEQ ID NO: 388202 - DNA, 25 bp, Artificial Sequence
  Description of Artificial Sequence: Synthetic oligonucleotide
caacgtcacgtggctgtgcaacggg

SEQ ID NO: 388203 - DNA, 26 bp, Artificial Sequence
  Description of Artificial Sequence: Synthetic oligonucleotide
aacgtcacgtggctgtgcaacgggga

SEQ ID NO: 388204 - DNA, 25 bp, Artificial Sequence
  Description of Artificial Sequence: Synthetic oligonucleotide
acgtcacgtggctgtgcaacgggga

SEQ ID NO: 388205 - DNA, 24 bp, Artificial Sequence
  Description of Artificial Sequence: Synthetic oligonucleotide
cgtcacgtggctgtgcaacgggga

SEQ ID NO: 388206 - DNA, 24 bp, Artificial Sequence
  Description of Artificial Sequence: Synthetic oligonucleotide
gtcacgtggctgtgcaacggggag

SEQ ID NO: 388207 - DNA, 25 bp, Artificial Sequence
  Description of Artificial Sequence: Synthetic oligonucleotide
tcacgtggctgtgcaacggggagct

SEQ ID NO: 388208 - DNA, 24 bp, Artificial Sequence
  Description of Artificial Sequence: Synthetic oligonucleotide
cacgtggctgtgcaacggggagct

SEQ ID NO: 388209 - DNA, 24 bp, Artificial Sequence
  Description of Artificial Sequence: Synthetic oligonucleotide
acgtggctgtgcaacggggagctg

SEQ ID NO: 388210 - DNA, 23 bp, Artificial Sequence
  Description of Artificial Sequence: Synthetic oligonucleotide
cgtggctgtgcaacggggagctg

SEQ ID NO: 388211 - DNA, 24 bp, Artificial Sequence
  Description of Artificial Sequence: Synthetic oligonucleotide
gtggctgtgcaacggggagctggt

SEQ ID NO: 388212 - DNA, 25 bp, Artificial Sequence
  Description of Artificial Sequence: Synthetic oligonucleotide
tggctgtgcaacggggagctggtca

SEQ ID NO: 388213 - DNA, 24 bp, Artificial Sequence
  Description of Artificial Sequence: Synthetic oligonucleotide
ggctgtgcaacggggagctggtca

SEQ ID NO: 388214 - DNA, 25 bp, Artificial Sequence
  Description of Artificial Sequence: Synthetic oligonucleotide
gctgtgcaacggggagctggtcact

SEQ ID NO: 388215 - DNA, 26 bp, Artificial Sequence
  Description of Artificial Sequence: Synthetic oligonucleotide
ctgtgcaacggggagctggtcactga

SEQ ID NO: 388216 - DNA, 26 bp, Artificial Sequence
  Description of Artificial Sequence: Synthetic oligonucleotide
tgtgcaacggggagctggtcactgag

SEQ ID NO: 388217 - DNA, 25 bp, Artificial Sequence
  Description of Artificial Sequence: Synthetic oligonucleotide
gtgcaacggggagctggtcactgag

SEQ ID NO: 388218 - DNA, 25 bp, Artificial Sequence
  Description of Artificial Sequence: Synthetic oligonucleotide
tgcaacggggagctggtcactgagg

SEQ ID NO: 388219 - DNA, 24 bp, Artificial Sequence
  Description of Artificial Sequence: Synthetic oligonucleotide
gcaacggggagctggtcactgagg

SEQ ID NO: 388220 - DNA, 25 bp, Artificial Sequence
  Description of Artificial Sequence: Synthetic oligonucleotide
caacggggagctggtcactgagggt

SEQ ID NO: 388221 - DNA, 26 bp, Artificial Sequence
  Description of Artificial Sequence: Synthetic oligonucleotide
aacggggagctggtcactgagggtgt

SEQ ID NO: 388222 - DNA, 25 bp, Artificial Sequence
  Description of Artificial Sequence: Synthetic oligonucleotide
acggggagctggtcactgagggtgt

SEQ ID NO: 388223 - DNA, 24 bp, Artificial Sequence
  Description of Artificial Sequence: Synthetic oligonucleotide
cggggagctggtcactgagggtgt

SEQ ID NO: 388224 - DNA, 24 bp, Artificial Sequence
  Description of Artificial Sequence: Synthetic oligonucleotide
ggggagctggtcactgagggtgtc

SEQ ID NO: 388225 - DNA, 24 bp, Artificial Sequence
  Description of Artificial Sequence: Synthetic oligonucleotide
gggagctggtcactgagggtgtcg

SEQ ID NO: 388226 - DNA, 25 bp, Artificial Sequence
  Description of Artificial Sequence: Synthetic oligonucleotide
ggagctggtcactgagggtgtcgct

SEQ ID NO: 388227 - DNA, 26 bp, Artificial Sequence
  Description of Artificial Sequence: Synthetic oligonucleotide
gagctggtcactgagggtgtcgctga

SEQ ID NO: 388228 - DNA, 27 bp, Artificial Sequence
  Description of Artificial Sequence: Synthetic oligonucleotide
agctggtcactgagggtgtcgctgaga

SEQ ID NO: 388229 - DNA, 26 bp, Artificial Sequence
  Description of Artificial Sequence: Synthetic oligonucleotide
gctggtcactgagggtgtcgctgaga

SEQ ID NO: 388230 - DNA, 26 bp, Artificial Sequence
  Description of Artificial Sequence: Synthetic oligonucleotide
ctggtcactgagggtgtcgctgagag

SEQ ID NO: 388231 - DNA, 26 bp, Artificial Sequence
  Description of Artificial Sequence: Synthetic oligonucleotide
tggtcactgagggtgtcgctgagagc

SEQ ID NO: 388232 - DNA, 25 bp, Artificial Sequence
  Description of Artificial Sequence: Synthetic oligonucleotide
ggtcactgagggtgtcgctgagagc

SEQ ID NO: 388233 - DNA, 26 bp, Artificial Sequence
  Description of Artificial Sequence: Synthetic oligonucleotide
gtcactgagggtgtcgctgagagcct

SEQ ID NO: 388234 - DNA, 27 bp, Artificial Sequence
  Description of Artificial Sequence: Synthetic oligonucleotide
tcactgagggtgtcgctgagagcctct

SEQ ID NO: 388235 - DNA, 27 bp, Artificial Sequence
  Description of Artificial Sequence: Synthetic oligonucleotide
cactgagggtgtcgctgagagcctctt

SEQ ID NO: 388236 - DNA, 27 bp, Artificial Sequence
  Description of Artificial Sequence: Synthetic oligonucleotide
actgagggtgtcgctgagagcctcttc

SEQ ID NO: 388237 - DNA, 26 bp, Artificial Sequence
  Description of Artificial Sequence: Synthetic oligonucleotide
ctgagggtgtcgctgagagcctcttc

SEQ ID NO: 388238 - DNA, 27 bp, Artificial Sequence
  Description of Artificial Sequence: Synthetic oligonucleotide
tgagggtgtcgctgagagcctcttcct

SEQ ID NO: 388239 - DNA, 26 bp, Artificial Sequence
  Description of Artificial Sequence: Synthetic oligonucleotide
gagggtgtcgctgagagcctcttcct

SEQ ID NO: 388240 - DNA, 26 bp, Artificial Sequence
  Description of Artificial Sequence: Synthetic oligonucleotide
agggtgtcgctgagagcctcttcctg

SEQ ID NO: 388241 - DNA, 25 bp, Artificial Sequence
  Description of Artificial Sequence: Synthetic oligonucleotide
gggtgtcgctgagagcctcttcctg

SEQ ID NO: 388242 - DNA, 25 bp, Artificial Sequence
  Description of Artificial Sequence: Synthetic oligonucleotide
ggtgtcgctgagagcctcttcctgc

SEQ ID NO: 388243 - DNA, 25 bp, Artificial Sequence
  Description of Artificial Sequence: Synthetic oligonucleotide
gtgtcgctgagagcctcttcctgcc

SEQ ID NO: 388244 - DNA, 26 bp, Artificial Sequence
  Description of Artificial Sequence: Synthetic oligonucleotide
tgtcgctgagagcctcttcctgccca

SEQ ID NO: 388245 - DNA, 25 bp, Artificial Sequence
  Description of Artificial Sequence: Synthetic oligonucleotide
gtcgctgagagcctcttcctgccca

SEQ ID NO: 388246 - DNA, 27 bp, Artificial Sequence
  Description of Artificial Sequence: Synthetic oligonucleotide
tcgctgagagcctcttcctgcccagaa

SEQ ID NO: 388247 - DNA, 26 bp, Artificial Sequence
  Description of Artificial Sequence: Synthetic oligonucleotide
cgctgagagcctcttcctgcccagaa

SEQ ID NO: 388248 - DNA, 27 bp, Artificial Sequence
  Description of Artificial Sequence: Synthetic oligonucleotide
gctgagagcctcttcctgcccagaaca

SEQ ID NO: 388249 - DNA, 27 bp, Artificial Sequence
  Description of Artificial Sequence: Synthetic oligonucleotide
ctgagagcctcttcctgcccagaacag

SEQ ID NO: 388250 - DNA, 31 bp, Artificial Sequence; identical to SEQ ID NO: 51183
  Description of Artificial Sequence: Synthetic oligonucleotide

SEQ ID NO: 388251 - DNA, 30 bp, Artificial Sequence; identical to SEQ ID NO: 51184
  Description of Artificial Sequence: Synthetic oligonucleotide

SEQ ID NO: 388252 - DNA, 31 bp, Artificial Sequence; identical to SEQ ID NO: 51185
  Description of Artificial Sequence: Synthetic oligonucleotide

SEQ ID NO: 388253 - DNA, 30 bp, Artificial Sequence; identical to SEQ ID NO: 51186
  Description of Artificial Sequence: Synthetic oligonucleotide

SEQ ID NO: 388254 - DNA, 30 bp, Artificial Sequence; identical to SEQ ID NO: 51187
  Description of Artificial Sequence: Synthetic oligonucleotide

SEQ ID NO: 388255 - DNA, 29 bp, Artificial Sequence
  Description of Artificial Sequence: Synthetic oligonucleotide
gcctcttcctgcccagaacagattacagc

SEQ ID NO: 388256 - DNA, 31 bp, Artificial Sequence; identical to SEQ ID NO: 51189
  Description of Artificial Sequence: Synthetic oligonucleotide

SEQ ID NO: 388257 - DNA, 31 bp, Artificial Sequence; identical to SEQ ID NO: 51190
  Description of Artificial Sequence: Synthetic oligonucleotide

SEQ ID NO: 388258 - DNA, 32 bp, Artificial Sequence; identical to SEQ ID NO: 51191
  Description of Artificial Sequence: Synthetic oligonucleotide

SEQ ID NO: 388259 - DNA, 31 bp, Artificial Sequence; identical to SEQ ID NO: 51192
  Description of Artificial Sequence: Synthetic oligonucleotide

SEQ ID NO: 388260 - DNA, 33 bp, Artificial Sequence; identical to SEQ ID NO: 51193
  Description of Artificial Sequence: Synthetic oligonucleotide

SEQ ID NO: 388261 - DNA, 32 bp, Artificial Sequence; identical to SEQ ID NO: 51194
  Description of Artificial Sequence: Synthetic oligonucleotide

SEQ ID NO: 388262 - DNA, 31 bp, Artificial Sequence; identical to SEQ ID NO: 51195
  Description of Artificial Sequence: Synthetic oligonucleotide

SEQ ID NO: 388263 - DNA, 33 bp, Artificial Sequence; identical to SEQ ID NO: 51196
  Description of Artificial Sequence: Synthetic oligonucleotide

SEQ ID NO: 388264 - DNA, 33 bp, Artificial Sequence; identical to SEQ ID NO: 51197
  Description of Artificial Sequence: Synthetic oligonucleotide

SEQ ID NO: 388265 - DNA, 32 bp, Artificial Sequence; identical to SEQ ID NO: 51198
  Description of Artificial Sequence: Synthetic oligonucleotide

SEQ ID NO: 388266 - DNA, 36 bp, Artificial Sequence; identical to SEQ ID NO: 51199
  Description of Artificial Sequence: Synthetic oligonucleotide

SEQ ID NO: 388267 - DNA, 36 bp, Artificial Sequence; identical to SEQ ID NO: 51200
  Description of Artificial Sequence: Synthetic oligonucleotide

SEQ ID NO: 388268 - DNA, 37 bp, Artificial Sequence; identical to SEQ ID NO: 51201
  Description of Artificial Sequence: Synthetic oligonucleotide

SEQ ID NO: 388269 - DNA, 38 bp, Artificial Sequence; identical to SEQ ID NO: 51202
  Description of Artificial Sequence: Synthetic oligonucleotide

SEQ ID NO: 388270 - DNA, 37 bp, Artificial Sequence; identical to SEQ ID NO: 51203
  Description of Artificial Sequence: Synthetic oligonucleotide

SEQ ID NO: 388271 - DNA, 37 bp, Artificial Sequence; identical to SEQ ID NO: 51204
  Description of Artificial Sequence: Synthetic oligonucleotide

SEQ ID NO: 388272 - DNA, 36 bp, Artificial Sequence; identical to SEQ ID NO: 51205
  Description of Artificial Sequence: Synthetic oligonucleotide

SEQ ID NO: 388273 - DNA, 35 bp, Artificial Sequence; identical to SEQ ID NO: 51206
  Description of Artificial Sequence: Synthetic oligonucleotide

SEQ ID NO: 388274 - DNA, 38 bp, Artificial Sequence; identical to SEQ ID NO: 51207
  Description of Artificial Sequence: Synthetic oligonucleotide

SEQ ID NO: 388275 - DNA, 37 bp, Artificial Sequence; identical to SEQ ID NO: 51208
  Description of Artificial Sequence: Synthetic oligonucleotide

SEQ ID NO: 388276 - DNA, 38 bp, Artificial Sequence; identical to SEQ ID NO: 51209
  Description of Artificial Sequence: Synthetic oligonucleotide

SEQ ID NO: 388277 - DNA, 37 bp, Artificial Sequence; identical to SEQ ID NO: 51210
  Description of Artificial Sequence: Synthetic oligonucleotide

SEQ ID NO: 388278 - DNA, 36 bp, Artificial Sequence; identical to SEQ ID NO: 51211
  Description of Artificial Sequence: Synthetic oligonucleotide

SEQ ID NO: 388279 - DNA, 35 bp, Artificial Sequence; identical to SEQ ID NO: 51212
  Description of Artificial Sequence: Synthetic oligonucleotide

SEQ ID NO: 388280 - DNA, 34 bp, Artificial Sequence; identical to SEQ ID NO: 51213
  Description of Artificial Sequence: Synthetic oligonucleotide

SEQ ID NO: 388281 - DNA, 34 bp, Artificial Sequence; identical to SEQ ID NO: 51214
  Description of Artificial Sequence: Synthetic oligonucleotide

SEQ ID NO: 388282 - DNA, 33 bp, Artificial Sequence; identical to SEQ ID NO: 51215
  Description of Artificial Sequence: Synthetic oligonucleotide

SEQ ID NO: 388283 - DNA, 33 bp, Artificial Sequence; identical to SEQ ID NO: 51216
  Description of Artificial Sequence: Synthetic oligonucleotide

SEQ ID NO: 388284 - DNA, 33 bp, Artificial Sequence; identical to SEQ ID NO: 51217
  Description of Artificial Sequence: Synthetic oligonucleotide

SEQ ID NO: 388285 - DNA, 32 bp, Artificial Sequence; identical to SEQ ID NO: 51218
  Description of Artificial Sequence: Synthetic oligonucleotide

SEQ ID NO: 388286 - DNA, 31 bp, Artificial Sequence; identical to SEQ ID NO: 51219
  Description of Artificial Sequence: Synthetic oligonucleotide

SEQ ID NO: 388287 - DNA, 32 bp, Artificial Sequence; identical to SEQ ID NO: 51220
  Description of Artificial Sequence: Synthetic oligonucleotide

SEQ ID NO: 388288 - DNA, 33 bp, Artificial Sequence; identical to SEQ ID NO: 51221
  Description of Artificial Sequence: Synthetic oligonucleotide

SEQ ID NO: 388289 - DNA, 32 bp, Artificial Sequence; identical to SEQ ID NO: 51222
  Description of Artificial Sequence: Synthetic oligonucleotide

SEQ ID NO: 388290 - DNA, 32 bp, Artificial Sequence; identical to SEQ ID NO: 51223
  Description of Artificial Sequence: Synthetic oligonucleotide

SEQ ID NO: 388291 - DNA, 31 bp, Artificial Sequence; identical to SEQ ID NO: 51224
  Description of Artificial Sequence: Synthetic oligonucleotide

SEQ ID NO: 388292 - DNA, 30 bp, Artificial Sequence; identical to SEQ ID NO: 51225
  Description of Artificial Sequence: Synthetic oligonucleotide

SEQ ID NO: 388293 - DNA, 31 bp, Artificial Sequence; identical to SEQ ID NO: 51226
  Description of Artificial Sequence: Synthetic oligonucleotide

SEQ ID NO: 388294 - DNA, 30 bp, Artificial Sequence; identical to SEQ ID NO: 51227
  Description of Artificial Sequence: Synthetic oligonucleotide

SEQ ID NO: 388295 - DNA, 29 bp, Artificial Sequence
  Description of Artificial Sequence: Synthetic oligonucleotide
ccattacctgacctttgtgccctcagcag

SEQ ID NO: 388296 - DNA, 30 bp, Artificial Sequence; identical to SEQ ID NO: 51229
  Description of Artificial Sequence: Synthetic oligonucleotide

SEQ ID NO: 388297 - DNA, 30 bp, Artificial Sequence; identical to SEQ ID NO: 51230
  Description of Artificial Sequence: Synthetic oligonucleotide

SEQ ID NO: 388298 - DNA, 29 bp, Artificial Sequence
  Description of Artificial Sequence: Synthetic oligonucleotide
ttacctgacctttgtgccctcagcagagg

SEQ ID NO: 388299 - DNA, 28 bp, Artificial Sequence
  Description of Artificial Sequence: Synthetic oligonucleotide
tacctgacctttgtgccctcagcagagg

SEQ ID NO: 388300 - DNA, 27 bp, Artificial Sequence
  Description of Artificial Sequence: Synthetic oligonucleotide
acctgacctttgtgccctcagcagagg

SEQ ID NO: 388301 - DNA, 27 bp, Artificial Sequence
  Description of Artificial Sequence: Synthetic oligonucleotide
cctgacctttgtgccctcagcagagga

SEQ ID NO: 388302 - DNA, 27 bp, Artificial Sequence
  Description of Artificial Sequence: Synthetic oligonucleotide
ctgacctttgtgccctcagcagaggac

SEQ ID NO: 388303 - DNA, 29 bp, Artificial Sequence
  Description of Artificial Sequence: Synthetic oligonucleotide
tgacctttgtgccctcagcagaggacttc

SEQ ID NO: 388304 - DNA, 28 bp, Artificial Sequence
  Description of Artificial Sequence: Synthetic oligonucleotide
gacctttgtgccctcagcagaggacttc

SEQ ID NO: 388305 - DNA, 31 bp, Artificial Sequence; identical to SEQ ID NO: 51238
  Description of Artificial Sequence: Synthetic oligonucleotide

SEQ ID NO: 388306 - DNA, 30 bp, Artificial Sequence; identical to SEQ ID NO: 51239
  Description of Artificial Sequence: Synthetic oligonucleotide

SEQ ID NO: 388307 - DNA, 31 bp, Artificial Sequence; identical to SEQ ID NO: 51240
  Description of Artificial Sequence: Synthetic oligonucleotide

SEQ ID NO: 388308 - DNA, 32 bp, Artificial Sequence; identical to SEQ ID NO: 51241
  Description of Artificial Sequence: Synthetic oligonucleotide

SEQ ID NO: 388309 - DNA, 31 bp, Artificial Sequence; identical to SEQ ID NO: 51242
  Description of Artificial Sequence: Synthetic oligonucleotide

SEQ ID NO: 388310 - DNA, 30 bp, Artificial Sequence; identical to SEQ ID NO: 51243
  Description of Artificial Sequence: Synthetic oligonucleotide

SEQ ID NO: 388311 - DNA, 29 bp, Artificial Sequence
  Description of Artificial Sequence: Synthetic oligonucleotide
gtgccctcagcagaggacttctatgactg

SEQ ID NO: 388312 - DNA, 29 bp, Artificial Sequence
  Description of Artificial Sequence: Synthetic oligonucleotide
tgccctcagcagaggacttctatgactgc

SEQ ID NO: 388313 - DNA, 28 bp, Artificial Sequence
  Description of Artificial Sequence: Synthetic oligonucleotide
gccctcagcagaggacttctatgactgc

SEQ ID NO: 388314 - DNA, 29 bp, Artificial Sequence
  Description of Artificial Sequence: Synthetic oligonucleotide
ccctcagcagaggacttctatgactgcag

SEQ ID NO: 388315 - DNA, 29 bp, Artificial Sequence
  Description of Artificial Sequence: Synthetic oligonucleotide
cctcagcagaggacttctatgactgcagg

SEQ ID NO: 388316 - DNA, 29 bp, Artificial Sequence
  Description of Artificial Sequence: Synthetic oligonucleotide
ctcagcagaggacttctatgactgcaggg

SEQ ID NO: 388317 - DNA, 30 bp, Artificial Sequence; identical to SEQ ID NO: 51250
  Description of Artificial Sequence: Synthetic oligonucleotide

SEQ ID NO: 388318 - DNA, 29 bp, Artificial Sequence
  Description of Artificial Sequence: Synthetic oligonucleotide
cagcagaggacttctatgactgcagggtg

SEQ ID NO: 388319 - DNA, 29 bp, Artificial Sequence
  Description of Artificial Sequence: Synthetic oligonucleotide
agcagaggacttctatgactgcagggtgg

SEQ ID NO: 388320 - DNA, 28 bp, Artificial Sequence
  Description of Artificial Sequence: Synthetic oligonucleotide
gcagaggacttctatgactgcagggtgg

SEQ ID NO: 388321 - DNA, 29 bp, Artificial Sequence
  Description of Artificial Sequence: Synthetic oligonucleotide
cagaggacttctatgactgcagggtggag

SEQ ID NO: 388322 - DNA, 29 bp, Artificial Sequence
  Description of Artificial Sequence: Synthetic oligonucleotide
agaggacttctatgactgcagggtggagc

SEQ ID NO: 388323 - DNA, 28 bp, Artificial Sequence
  Description of Artificial Sequence: Synthetic oligonucleotide
gaggacttctatgactgcagggtggagc

SEQ ID NO: 388324 - DNA, 29 bp, Artificial Sequence
  Description of Artificial Sequence: Synthetic oligonucleotide
aggacttctatgactgcagggtggagcac

SEQ ID NO: 388325 - DNA, 28 bp, Artificial Sequence
  Description of Artificial Sequence: Synthetic oligonucleotide
ggacttctatgactgcagggtggagcac

SEQ ID NO: 388326 - DNA, 29 bp, Artificial Sequence
  Description of Artificial Sequence: Synthetic oligonucleotide
gacttctatgactgcagggtggagcactg

SEQ ID NO: 388327 - DNA, 29 bp, Artificial Sequence
  Description of Artificial Sequence: Synthetic oligonucleotide
acttctatgactgcagggtggagcactgg

SEQ ID NO: 388328 - DNA, 28 bp, Artificial Sequence
  Description of Artificial Sequence: Synthetic oligonucleotide
cttctatgactgcagggtggagcactgg

SEQ ID NO: 388329 - DNA, 28 bp, Artificial Sequence
  Description of Artificial Sequence: Synthetic oligonucleotide
ttctatgactgcagggtggagcactggg

SEQ ID NO: 388330 - DNA, 27 bp, Artificial Sequence
  Description of Artificial Sequence: Synthetic oligonucleotide
tctatgactgcagggtggagcactggg

SEQ ID NO: 388331 - DNA, 26 bp, Artificial Sequence
  Description of Artificial Sequence: Synthetic oligonucleotide
ctatgactgcagggtggagcactggg

SEQ ID NO: 388332 - DNA, 26 bp, Artificial Sequence
  Description of Artificial Sequence: Synthetic oligonucleotide
tatgactgcagggtggagcactgggg

SEQ ID NO: 388333 - DNA, 25 bp, Artificial Sequence
  Description of Artificial Sequence: Synthetic oligonucleotide
atgactgcagggtggagcactgggg

SEQ ID NO: 388334 - DNA, 24 bp, Artificial Sequence
  Description of Artificial Sequence: Synthetic oligonucleotide
tgactgcagggtggagcactgggg

SEQ ID NO: 388335 - DNA, 23 bp, Artificial Sequence
  Description of Artificial Sequence: Synthetic oligonucleotide
gactgcagggtggagcactgggg

SEQ ID NO: 388336 - DNA, 25 bp, Artificial Sequence
  Description of Artificial Sequence: Synthetic oligonucleotide
actgcagggtggagcactggggctt

SEQ ID NO: 388337 - DNA, 24 bp, Artificial Sequence
  Description of Artificial Sequence: Synthetic oligonucleotide
ctgcagggtggagcactggggctt

SEQ ID NO: 388338 - DNA, 24 bp, Artificial Sequence
  Description of Artificial Sequence: Synthetic oligonucleotide
tgcagggtggagcactggggcttg

SEQ ID NO: 388339 - DNA, 23 bp, Artificial Sequence
  Description of Artificial Sequence: Synthetic oligonucleotide
gcagggtggagcactggggcttg

SEQ ID NO: 388340 - DNA, 24 bp, Artificial Sequence
  Description of Artificial Sequence: Synthetic oligonucleotide
cagggtggagcactggggcttgga

SEQ ID NO: 388341 - DNA, 24 bp, Artificial Sequence
  Description of Artificial Sequence: Synthetic oligonucleotide
agggtggagcactggggcttggac

SEQ ID NO: 388342 - DNA, 23 bp, Artificial Sequence
  Description of Artificial Sequence: Synthetic oligonucleotide
gggtggagcactggggcttggac

SEQ ID NO: 388343 - DNA, 24 bp, Artificial Sequence
  Description of Artificial Sequence: Synthetic oligonucleotide
ggtggagcactggggcttggacca

SEQ ID NO: 388344 - DNA, 24 bp, Artificial Sequence
  Description of Artificial Sequence: Synthetic oligonucleotide
gtggagcactggggcttggaccag

SEQ ID NO: 388345 - DNA, 24 bp, Artificial Sequence
  Description of Artificial Sequence: Synthetic oligonucleotide
tggagcactggggcttggaccagc

SEQ ID NO: 388346 - DNA, 23 bp, Artificial Sequence
  Description of Artificial Sequence: Synthetic oligonucleotide
ggagcactggggcttggaccagc

SEQ ID NO: 388347 - DNA, 23 bp, Artificial Sequence
  Description of Artificial Sequence: Synthetic oligonucleotide
gagcactggggcttggaccagcc

SEQ ID NO: 388348 - DNA, 23 bp, Artificial Sequence
  Description of Artificial Sequence: Synthetic oligonucleotide
agcactggggcttggaccagccg

SEQ ID NO: 388349 - DNA, 22 bp, Artificial Sequence
  Description of Artificial Sequence: Synthetic oligonucleotide
gcactggggcttggaccagccg

SEQ ID NO: 388350 - DNA, 23 bp, Artificial Sequence
  Description of Artificial Sequence: Synthetic oligonucleotide
cactggggcttggaccagccgct

SEQ ID NO: 388351 - DNA, 23 bp, Artificial Sequence
  Description of Artificial Sequence: Synthetic oligonucleotide
actggggcttggaccagccgctc

SEQ ID NO: 388352 - DNA, 22 bp, Artificial Sequence
  Description of Artificial Sequence: Synthetic oligonucleotide
ctggggcttggaccagccgctc

SEQ ID NO: 388353 - DNA, 23 bp, Artificial Sequence
  Description of Artificial Sequence: Synthetic oligonucleotide
tggggcttggaccagccgctcct

SEQ ID NO: 388354 - DNA, 22 bp, Artificial Sequence
  Description of Artificial Sequence: Synthetic oligonucleotide
ggggcttggaccagccgctcct

SEQ ID NO: 388355 - DNA, 24 bp, Artificial Sequence
  Description of Artificial Sequence: Synthetic oligonucleotide
gggcttggaccagccgctcctcaa

SEQ ID NO: 388356 - DNA, 24 bp, Artificial Sequence
  Description of Artificial Sequence: Synthetic oligonucleotide
ggcttggaccagccgctcctcaag

SEQ ID NO: 388357 - DNA, 25 bp, Artificial Sequence
  Description of Artificial Sequence: Synthetic oligonucleotide
gcttggaccagccgctcctcaagca

SEQ ID NO: 388358 - DNA, 26 bp, Artificial Sequence
  Description of Artificial Sequence: Synthetic oligonucleotide
cttggaccagccgctcctcaagcact

SEQ ID NO: 388359 - DNA, 26 bp, Artificial Sequence
  Description of Artificial Sequence: Synthetic oligonucleotide
ttggaccagccgctcctcaagcactg

SEQ ID NO: 388360 - DNA, 25 bp, Artificial Sequence
  Description of Artificial Sequence: Synthetic oligonucleotide
tggaccagccgctcctcaagcactg

SEQ ID NO: 388361 - DNA, 24 bp, Artificial Sequence
  Description of Artificial Sequence: Synthetic oligonucleotide
ggaccagccgctcctcaagcactg

SEQ ID NO: 388362 - DNA, 24 bp, Artificial Sequence
  Description of Artificial Sequence: Synthetic oligonucleotide
gaccagccgctcctcaagcactgg

SEQ ID NO: 388363 - DNA, 25 bp, Artificial Sequence
  Description of Artificial Sequence: Synthetic oligonucleotide
accagccgctcctcaagcactggga

SEQ ID NO: 388364 - DNA, 24 bp, Artificial Sequence
  Description of Artificial Sequence: Synthetic oligonucleotide
ccagccgctcctcaagcactggga

SEQ ID NO: 388365 - DNA, 24 bp, Artificial Sequence
  Description of Artificial Sequence: Synthetic oligonucleotide
cagccgctcctcaagcactgggag

SEQ ID NO: 388366 - DNA, 24 bp, Artificial Sequence
  Description of Artificial Sequence: Synthetic oligonucleotide
agccgctcctcaagcactgggagg

SEQ ID NO: 388367 - DNA, 23 bp, Artificial Sequence
  Description of Artificial Sequence: Synthetic oligonucleotide
gccgctcctcaagcactgggagg

SEQ ID NO: 388368 - DNA, 23 bp, Artificial Sequence
  Description of Artificial Sequence: Synthetic oligonucleotide
ccgctcctcaagcactgggaggc

SEQ ID NO: 388369 - DNA, 23 bp, Artificial Sequence
  Description of Artificial Sequence: Synthetic oligonucleotide
cgctcctcaagcactgggaggcc

SEQ ID NO: 388370 - DNA, 25 bp, Artificial Sequence
  Description of Artificial Sequence: Synthetic oligonucleotide
gctcctcaagcactgggaggcccaa

SEQ ID NO: 388371 - DNA, 26 bp, Artificial Sequence
  Description of Artificial Sequence: Synthetic oligonucleotide
ctcctcaagcactgggaggcccaaga

SEQ ID NO: 388372 - DNA, 26 bp, Artificial Sequence
  Description of Artificial Sequence: Synthetic oligonucleotide
tcctcaagcactgggaggcccaagag

SEQ ID NO: 388373 - DNA, 25 bp, Artificial Sequence
  Description of Artificial Sequence: Synthetic oligonucleotide
cctcaagcactgggaggcccaagag

SEQ ID NO: 388374 - DNA, 25 bp, Artificial Sequence
  Description of Artificial Sequence: Synthetic oligonucleotide
ctcaagcactgggaggcccaagagc

SEQ ID NO: 388375 - DNA, 27 bp, Artificial Sequence
  Description of Artificial Sequence: Synthetic oligonucleotide
tcaagcactgggaggcccaagagccaa

SEQ ID NO: 388376 - DNA, 27 bp, Artificial Sequence
  Description of Artificial Sequence: Synthetic oligonucleotide
caagcactgggaggcccaagagccaat

SEQ ID NO: 388377 - DNA, 27 bp, Artificial Sequence
  Description of Artificial Sequence: Synthetic oligonucleotide
aagcactgggaggcccaagagccaatc

SEQ ID NO: 388378 - DNA, 26 bp, Artificial Sequence
  Description of Artificial Sequence: Synthetic oligonucleotide
agcactgggaggcccaagagccaatc

SEQ ID NO: 388379 - DNA, 25 bp, Artificial Sequence
  Description of Artificial Sequence: Synthetic oligonucleotide
gcactgggaggcccaagagccaatc

SEQ ID NO: 388380 - DNA, 26 bp, Artificial Sequence
  Description of Artificial Sequence: Synthetic oligonucleotide
cactgggaggcccaagagccaatcca

SEQ ID NO: 388381 - DNA, 27 bp, Artificial Sequence
  Description of Artificial Sequence: Synthetic oligonucleotide
actgggaggcccaagagccaatccaga

SEQ ID NO: 388382 - DNA, 27 bp, Artificial Sequence
  Description of Artificial Sequence: Synthetic oligonucleotide
ctgggaggcccaagagccaatccagat

SEQ ID NO: 388383 - DNA, 27 bp, Artificial Sequence
  Description of Artificial Sequence: Synthetic oligonucleotide
tgggaggcccaagagccaatccagatg

SEQ ID NO: 388384 - DNA, 26 bp, Artificial Sequence
  Description of Artificial Sequence: Synthetic oligonucleotide
gggaggcccaagagccaatccagatg

SEQ ID NO: 388385 - DNA, 26 bp, Artificial Sequence
  Description of Artificial Sequence: Synthetic oligonucleotide
ggaggcccaagagccaatccagatgc

SEQ ID NO: 388386 - DNA, 27 bp, Artificial Sequence
  Description of Artificial Sequence: Synthetic oligonucleotide
gaggcccaagagccaatccagatgcct

SEQ ID NO: 388387 - DNA, 27 bp, Artificial Sequence
  Description of Artificial Sequence: Synthetic oligonucleotide
aggcccaagagccaatccagatgcctg

SEQ ID NO: 388388 - DNA, 27 bp, Artificial Sequence
  Description of Artificial Sequence: Synthetic oligonucleotide
ggcccaagagccaatccagatgcctga

SEQ ID NO: 388389 - DNA, 27 bp, Artificial Sequence
  Description of Artificial Sequence: Synthetic oligonucleotide
gcccaagagccaatccagatgcctgag

SEQ ID NO: 388390 - DNA, 28 bp, Artificial Sequence
  Description of Artificial Sequence: Synthetic oligonucleotide
cccaagagccaatccagatgcctgagac

SEQ ID NO: 388391 - DNA, 30 bp, Artificial Sequence; identical to SEQ ID NO: 51324
  Description of Artificial Sequence: Synthetic oligonucleotide

SEQ ID NO: 388392 - DNA, 30 bp, Artificial Sequence; identical to SEQ ID NO: 51325
  Description of Artificial Sequence: Synthetic oligonucleotide

SEQ ID NO: 388393 - DNA, 30 bp, Artificial Sequence; identical to SEQ ID NO: 51326
  Description of Artificial Sequence: Synthetic oligonucleotide

SEQ ID NO: 388394 - DNA, 29 bp, Artificial Sequence
  Description of Artificial Sequence: Synthetic oligonucleotide
agagccaatccagatgcctgagacaacgg

SEQ ID NO: 388395 - DNA, 28 bp, Artificial Sequence
  Description of Artificial Sequence: Synthetic oligonucleotide
gagccaatccagatgcctgagacaacgg

SEQ ID NO: 388396 - DNA, 29 bp, Artificial Sequence
  Description of Artificial Sequence: Synthetic oligonucleotide
agccaatccagatgcctgagacaacggag

SEQ ID NO: 388397 - DNA, 28 bp, Artificial Sequence
  Description of Artificial Sequence: Synthetic oligonucleotide
gccaatccagatgcctgagacaacggag

SEQ ID NO: 388398 - DNA, 29 bp, Artificial Sequence
  Description of Artificial Sequence: Synthetic oligonucleotide
ccaatccagatgcctgagacaacggagac

SEQ ID NO: 388399 - DNA, 30 bp, Artificial Sequence; identical to SEQ ID NO: 51332
  Description of Artificial Sequence: Synthetic oligonucleotide

SEQ ID NO: 388400 - DNA, 31 bp, Artificial Sequence; identical to SEQ ID NO: 51333
  Description of Artificial Sequence: Synthetic oligonucleotide

SEQ ID NO: 388401 - DNA, 30 bp, Artificial Sequence; identical to SEQ ID NO: 51334
  Description of Artificial Sequence: Synthetic oligonucleotide

SEQ ID NO: 388402 - DNA, 29 bp, Artificial Sequence
  Description of Artificial Sequence: Synthetic oligonucleotide
tccagatgcctgagacaacggagactgtg

SEQ ID NO: 388403 - DNA, 28 bp, Artificial Sequence
  Description of Artificial Sequence: Synthetic oligonucleotide
ccagatgcctgagacaacggagactgtg

SEQ ID NO: 388404 - DNA, 28 bp, Artificial Sequence
  Description of Artificial Sequence: Synthetic oligonucleotide
cagatgcctgagacaacggagactgtgc

SEQ ID NO: 388405 - DNA, 29 bp, Artificial Sequence
  Description of Artificial Sequence: Synthetic oligonucleotide
agatgcctgagacaacggagactgtgctc

SEQ ID NO: 388406 - DNA, 28 bp, Artificial Sequence
  Description of Artificial Sequence: Synthetic oligonucleotide
gatgcctgagacaacggagactgtgctc

SEQ ID NO: 388407 - DNA, 29 bp, Artificial Sequence
  Description of Artificial Sequence: Synthetic oligonucleotide
atgcctgagacaacggagactgtgctctg

SEQ ID NO: 388408 - DNA, 28 bp, Artificial Sequence
  Description of Artificial Sequence: Synthetic oligonucleotide
tgcctgagacaacggagactgtgctctg

SEQ ID NO: 388409 - DNA, 27 bp, Artificial Sequence
  Description of Artificial Sequence: Synthetic oligonucleotide
gcctgagacaacggagactgtgctctg

SEQ ID NO: 388410 - DNA, 28 bp, Artificial Sequence
  Description of Artificial Sequence: Synthetic oligonucleotide
cctgagacaacggagactgtgctctgtg

SEQ ID NO: 388411 - DNA, 28 bp, Artificial Sequence
  Description of Artificial Sequence: Synthetic oligonucleotide
ctgagacaacggagactgtgctctgtgc

SEQ ID NO: 388412 - DNA, 28 bp, Artificial Sequence
  Description of Artificial Sequence: Synthetic oligonucleotide
tgagacaacggagactgtgctctgtgcc

SEQ ID NO: 388413 - DNA, 27 bp, Artificial Sequence
  Description of Artificial Sequence: Synthetic oligonucleotide
gagacaacggagactgtgctctgtgcc

SEQ ID NO: 388414 - DNA, 27 bp, Artificial Sequence
  Description of Artificial Sequence: Synthetic oligonucleotide
agacaacggagactgtgctctgtgccc

SEQ ID NO: 388415 - DNA, 27 bp, Artificial Sequence
  Description of Artificial Sequence: Synthetic oligonucleotide
gacaacggagactgtgctctgtgccct

SEQ ID NO: 388416 - DNA, 27 bp, Artificial Sequence
  Description of Artificial Sequence: Synthetic oligonucleotide
acaacggagactgtgctctgtgccctg

SEQ ID NO: 388417 - DNA, 26 bp, Artificial Sequence
  Description of Artificial Sequence: Synthetic oligonucleotide
caacggagactgtgctctgtgccctg

SEQ ID NO: 388418 - DNA, 26 bp, Artificial Sequence
  Description of Artificial Sequence: Synthetic oligonucleotide
aacggagactgtgctctgtgccctgg

SEQ ID NO: 388419 - DNA, 25 bp, Artificial Sequence
  Description of Artificial Sequence: Synthetic oligonucleotide
acggagactgtgctctgtgccctgg

SEQ ID NO: 388420 - DNA, 24 bp, Artificial Sequence
  Description of Artificial Sequence: Synthetic oligonucleotide
cggagactgtgctctgtgccctgg

SEQ ID NO: 388421 - DNA, 24 bp, Artificial Sequence
  Description of Artificial Sequence: Synthetic oligonucleotide
ggagactgtgctctgtgccctggg

SEQ ID NO: 388422 - DNA, 24 bp, Artificial Sequence
  Description of Artificial Sequence: Synthetic oligonucleotide
gagactgtgctctgtgccctgggc

SEQ ID NO: 388423 - DNA, 25 bp, Artificial Sequence
  Description of Artificial Sequence: Synthetic oligonucleotide
agactgtgctctgtgccctgggcct

SEQ ID NO: 388424 - DNA, 24 bp, Artificial Sequence
  Description of Artificial Sequence: Synthetic oligonucleotide
gactgtgctctgtgccctgggcct

SEQ ID NO: 388425 - DNA, 24 bp, Artificial Sequence
  Description of Artificial Sequence: Synthetic oligonucleotide
actgtgctctgtgccctgggcctg

SEQ ID NO: 388426 - DNA, 23 bp, Artificial Sequence
  Description of Artificial Sequence: Synthetic oligonucleotide
ctgtgctctgtgccctgggcctg

SEQ ID NO: 388427 - DNA, 24 bp, Artificial Sequence
  Description of Artificial Sequence: Synthetic oligonucleotide
tgtgctctgtgccctgggcctggt

SEQ ID NO: 388428 - DNA, 23 bp, Artificial Sequence
  Description of Artificial Sequence: Synthetic oligonucleotide
gtgctctgtgccctgggcctggt

SEQ ID NO: 388429 - DNA, 23 bp, Artificial Sequence
  Description of Artificial Sequence: Synthetic oligonucleotide
tgctctgtgccctgggcctggtg

SEQ ID NO: 388430 - DNA, 22 bp, Artificial Sequence
  Description of Artificial Sequence: Synthetic oligonucleotide
gctctgtgccctgggcctggtg

SEQ ID NO: 388431 - DNA, 23 bp, Artificial Sequence
  Description of Artificial Sequence: Synthetic oligonucleotide
ctctgtgccctgggcctggtgct

SEQ ID NO: 388432 - DNA, 23 bp, Artificial Sequence
  Description of Artificial Sequence: Synthetic oligonucleotide
tctgtgccctgggcctggtgctg

SEQ ID NO: 388433 - DNA, 22 bp, Artificial Sequence
  Description of Artificial Sequence: Synthetic oligonucleotide
ctgtgccctgggcctggtgctg

SEQ ID NO: 388434 - DNA, 22 bp, Artificial Sequence
  Description of Artificial Sequence: Synthetic oligonucleotide
tgtgccctgggcctggtgctgg

SEQ ID NO: 388435 - DNA, 21 bp, Artificial Sequence
  Description of Artificial Sequence: Synthetic oligonucleotide
gtgccctgggcctggtgctgg

SEQ ID NO: 388436 - DNA, 21 bp, Artificial Sequence
  Description of Artificial Sequence: Synthetic oligonucleotide
tgccctgggcctggtgctggg

SEQ ID NO: 388437 - DNA, 20 bp, Artificial Sequence
  Description of Artificial Sequence: Synthetic oligonucleotide
gccctgggcctggtgctggg

SEQ ID NO: 388438 - DNA, 20 bp, Artificial Sequence
  Description of Artificial Sequence: Synthetic oligonucleotide
ccctgggcctggtgctgggc

SEQ ID NO: 388439 - DNA, 22 bp, Artificial Sequence
  Description of Artificial Sequence: Synthetic oligonucleotide
cctgggcctggtgctgggccta

SEQ ID NO: 388440 - DNA, 23 bp, Artificial Sequence
  Description of Artificial Sequence: Synthetic oligonucleotide
ctgggcctggtgctgggcctagt

SEQ ID NO: 388441 - DNA, 23 bp, Artificial Sequence
  Description of Artificial Sequence: Synthetic oligonucleotide
tgggcctggtgctgggcctagtc

SEQ ID NO: 388442 - DNA, 22 bp, Artificial Sequence
  Description of Artificial Sequence: Synthetic oligonucleotide
gggcctggtgctgggcctagtc

SEQ ID NO: 388443 - DNA, 22 bp, Artificial Sequence
  Description of Artificial Sequence: Synthetic oligonucleotide
ggcctggtgctgggcctagtcg

SEQ ID NO: 388444 - DNA, 22 bp, Artificial Sequence
  Description of Artificial Sequence: Synthetic oligonucleotide
gcctggtgctgggcctagtcgg

SEQ ID NO: 388445 - DNA, 24 bp, Artificial Sequence
  Description of Artificial Sequence: Synthetic oligonucleotide
cctggtgctgggcctagtcggcat

SEQ ID NO: 388446 - DNA, 26 bp, Artificial Sequence
  Description of Artificial Sequence: Synthetic oligonucleotide
ctggtgctgggcctagtcggcatcat

SEQ ID NO: 388447 - DNA, 26 bp, Artificial Sequence
  Description of Artificial Sequence: Synthetic oligonucleotide
tggtgctgggcctagtcggcatcatc

SEQ ID NO: 388448 - DNA, 25 bp, Artificial Sequence
  Description of Artificial Sequence: Synthetic oligonucleotide
ggtgctgggcctagtcggcatcatc

SEQ ID NO: 388449 - DNA, 26 bp, Artificial Sequence
  Description of Artificial Sequence: Synthetic oligonucleotide
gtgctgggcctagtcggcatcatcgt

SEQ ID NO: 388450 - DNA, 26 bp, Artificial Sequence
  Description of Artificial Sequence: Synthetic oligonucleotide
tgctgggcctagtcggcatcatcgtg

SEQ ID NO: 388451 - DNA, 25 bp, Artificial Sequence
  Description of Artificial Sequence: Synthetic oligonucleotide
gctgggcctagtcggcatcatcgtg

SEQ ID NO: 388452 - DNA, 25 bp, Artificial Sequence
  Description of Artificial Sequence: Synthetic oligonucleotide
ctgggcctagtcggcatcatcgtgg

SEQ ID NO: 388453 - DNA, 25 bp, Artificial Sequence
  Description of Artificial Sequence: Synthetic oligonucleotide
tgggcctagtcggcatcatcgtggg

SEQ ID NO: 388454 - DNA, 24 bp, Artificial Sequence
  Description of Artificial Sequence: Synthetic oligonucleotide
gggcctagtcggcatcatcgtggg

SEQ ID NO: 388455 - DNA, 25 bp, Artificial Sequence
  Description of Artificial Sequence: Synthetic oligonucleotide
ggcctagtcggcatcatcgtgggca

SEQ ID NO: 388456 - DNA, 25 bp, Artificial Sequence
  Description of Artificial Sequence: Synthetic oligonucleotide
gcctagtcggcatcatcgtgggcac

SEQ ID NO: 388457 - DNA, 25 bp, Artificial Sequence
  Description of Artificial Sequence: Synthetic oligonucleotide
cctagtcggcatcatcgtgggcacc

SEQ ID NO: 388458 - DNA, 26 bp, Artificial Sequence
  Description of Artificial Sequence: Synthetic oligonucleotide
ctagtcggcatcatcgtgggcaccgt

SEQ ID NO: 388459 - DNA, 26 bp, Artificial Sequence
  Description of Artificial Sequence: Synthetic oligonucleotide
tagtcggcatcatcgtgggcaccgtc

SEQ ID NO: 388460 - DNA, 25 bp, Artificial Sequence
  Description of Artificial Sequence: Synthetic oligonucleotide
agtcggcatcatcgtgggcaccgtc

SEQ ID NO: 388461 - DNA, 24 bp, Artificial Sequence
  Description of Artificial Sequence: Synthetic oligonucleotide
gtcggcatcatcgtgggcaccgtc

SEQ ID NO: 388462 - DNA, 25 bp, Artificial Sequence
  Description of Artificial Sequence: Synthetic oligonucleotide
tcggcatcatcgtgggcaccgtcct

SEQ ID NO: 388463 - DNA, 24 bp, Artificial Sequence
  Description of Artificial Sequence: Synthetic oligonucleotide
cggcatcatcgtgggcaccgtcct

SEQ ID NO: 388464 - DNA, 26 bp, Artificial Sequence
  Description of Artificial Sequence: Synthetic oligonucleotide
ggcatcatcgtgggcaccgtcctcat

SEQ ID NO: 388465 - DNA, 27 bp, Artificial Sequence
  Description of Artificial Sequence: Synthetic oligonucleotide
gcatcatcgtgggcaccgtcctcatca

SEQ ID NO: 388466 - DNA, 31 bp, Artificial Sequence; identical to SEQ ID NO: 51399
  Description of Artificial Sequence: Synthetic oligonucleotide

SEQ ID NO: 388467 - DNA, 32 bp, Artificial Sequence; identical to SEQ ID NO: 51400
  Description of Artificial Sequence: Synthetic oligonucleotide

SEQ ID NO: 388468 - DNA, 31 bp, Artificial Sequence; identical to SEQ ID NO: 51401
  Description of Artificial Sequence: Synthetic oligonucleotide

SEQ ID NO: 388469 - DNA, 30 bp, Artificial Sequence; identical to SEQ ID NO: 51402
  Description of Artificial Sequence: Synthetic oligonucleotide

SEQ ID NO: 388470 - DNA, 31 bp, Artificial Sequence; identical to SEQ ID NO: 51403
  Description of Artificial Sequence: Synthetic oligonucleotide

SEQ ID NO: 388471 - DNA, 30 bp, Artificial Sequence; identical to SEQ ID NO: 51404
  Description of Artificial Sequence: Synthetic oligonucleotide

SEQ ID NO: 388472 - DNA, 29 bp, Artificial Sequence
  Description of Artificial Sequence: Synthetic oligonucleotide
cgtgggcaccgtcctcatcataaagtctc

SEQ ID NO: 388473 - DNA, 30 bp, Artificial Sequence; identical to SEQ ID NO: 51406
  Description of Artificial Sequence: Synthetic oligonucleotide

SEQ ID NO: 388474 - DNA, 30 bp, Artificial Sequence; identical to SEQ ID NO: 51407
  Description of Artificial Sequence: Synthetic oligonucleotide

SEQ ID NO: 388475 - DNA, 29 bp, Artificial Sequence
  Description of Artificial Sequence: Synthetic oligonucleotide
gggcaccgtcctcatcataaagtctctgc

SEQ ID NO: 388476 - DNA, 29 bp, Artificial Sequence
  Description of Artificial Sequence: Synthetic oligonucleotide
ggcaccgtcctcatcataaagtctctgcg

SEQ ID NO: 388477 - DNA, 31 bp, Artificial Sequence; identical to SEQ ID NO: 51410
  Description of Artificial Sequence: Synthetic oligonucleotide

SEQ ID NO: 388478 - DNA, 32 bp, Artificial Sequence; identical to SEQ ID NO: 51411
  Description of Artificial Sequence: Synthetic oligonucleotide

SEQ ID NO: 388479 - DNA, 32 bp, Artificial Sequence; identical to SEQ ID NO: 51412
  Description of Artificial Sequence: Synthetic oligonucleotide

SEQ ID NO: 388480 - DNA, 31 bp, Artificial Sequence; identical to SEQ ID NO: 51413
  Description of Artificial Sequence: Synthetic oligonucleotide

SEQ ID NO: 388481 - DNA, 31 bp, Artificial Sequence; identical to SEQ ID NO: 51414
  Description of Artificial Sequence: Synthetic oligonucleotide

SEQ ID NO: 388482 - DNA, 31 bp, Artificial Sequence; identical to SEQ ID NO: 51415
  Description of Artificial Sequence: Synthetic oligonucleotide

SEQ ID NO: 388483 - DNA, 33 bp, Artificial Sequence; identical to SEQ ID NO: 51416
  Description of Artificial Sequence: Synthetic oligonucleotide

SEQ ID NO: 388484 - DNA, 32 bp, Artificial Sequence; identical to SEQ ID NO: 51417
  Description of Artificial Sequence: Synthetic oligonucleotide

SEQ ID NO: 388485 - DNA, 33 bp, Artificial Sequence; identical to SEQ ID NO: 51418
  Description of Artificial Sequence: Synthetic oligonucleotide

SEQ ID NO: 388486 - DNA, 33 bp, Artificial Sequence; identical to SEQ ID NO: 51419
  Description of Artificial Sequence: Synthetic oligonucleotide

SEQ ID NO: 388487 - DNA, 32 bp, Artificial Sequence; identical to SEQ ID NO: 51420
  Description of Artificial Sequence: Synthetic oligonucleotide

SEQ ID NO: 388488 - DNA, 32 bp, Artificial Sequence; identical to SEQ ID NO: 51421
  Description of Artificial Sequence: Synthetic oligonucleotide

SEQ ID NO: 388489 - DNA, 31 bp, Artificial Sequence; identical to SEQ ID NO: 51422
  Description of Artificial Sequence: Synthetic oligonucleotide

SEQ ID NO: 388490 - DNA, 30 bp, Artificial Sequence; identical to SEQ ID NO: 51423
  Description of Artificial Sequence: Synthetic oligonucleotide

SEQ ID NO: 388491 - DNA, 30 bp, Artificial Sequence; identical to SEQ ID NO: 51424
  Description of Artificial Sequence: Synthetic oligonucleotide

SEQ ID NO: 388492 - DNA, 29 bp, Artificial Sequence
  Description of Artificial Sequence: Synthetic oligonucleotide
taaagtctctgcgttctggccatgacccc

SEQ ID NO: 388493 - DNA, 28 bp, Artificial Sequence
  Description of Artificial Sequence: Synthetic oligonucleotide
aaagtctctgcgttctggccatgacccc

SEQ ID NO: 388494 - DNA, 27 bp, Artificial Sequence
  Description of Artificial Sequence: Synthetic oligonucleotide
aagtctctgcgttctggccatgacccc

SEQ ID NO: 388495 - DNA, 26 bp, Artificial Sequence
  Description of Artificial Sequence: Synthetic oligonucleotide
agtctctgcgttctggccatgacccc

SEQ ID NO: 388496 - DNA, 25 bp, Artificial Sequence
  Description of Artificial Sequence: Synthetic oligonucleotide
gtctctgcgttctggccatgacccc

SEQ ID NO: 388497 - DNA, 25 bp, Artificial Sequence
  Description of Artificial Sequence: Synthetic oligonucleotide
tctctgcgttctggccatgaccccc

SEQ ID NO: 388498 - DNA, 24 bp, Artificial Sequence
  Description of Artificial Sequence: Synthetic oligonucleotide
ctctgcgttctggccatgaccccc

SEQ ID NO: 388499 - DNA, 24 bp, Artificial Sequence
  Description of Artificial Sequence: Synthetic oligonucleotide
tctgcgttctggccatgacccccg

SEQ ID NO: 388500 - DNA, 23 bp, Artificial Sequence
  Description of Artificial Sequence: Synthetic oligonucleotide
ctgcgttctggccatgacccccg

SEQ ID NO: 388501 - DNA, 23 bp, Artificial Sequence
  Description of Artificial Sequence: Synthetic oligonucleotide
tgcgttctggccatgacccccgg

SEQ ID NO: 388502 - DNA, 22 bp, Artificial Sequence
  Description of Artificial Sequence: Synthetic oligonucleotide
gcgttctggccatgacccccgg

SEQ ID NO: 388503 - DNA, 22 bp, Artificial Sequence
  Description of Artificial Sequence: Synthetic oligonucleotide
cgttctggccatgacccccggg

SEQ ID NO: 388504 - DNA, 22 bp, Artificial Sequence
  Description of Artificial Sequence: Synthetic oligonucleotide
gttctggccatgacccccgggc

SEQ ID NO: 388505 - DNA, 22 bp, Artificial Sequence
  Description of Artificial Sequence: Synthetic oligonucleotide
ttctggccatgacccccgggcc

SEQ ID NO: 388506 - DNA, 21 bp, Artificial Sequence
  Description of Artificial Sequence: Synthetic oligonucleotide
tctggccatgacccccgggcc

SEQ ID NO: 388507 - DNA, 20 bp, Artificial Sequence
  Description of Artificial Sequence: Synthetic oligonucleotide
ctggccatgacccccgggcc

SEQ ID NO: 388508 - DNA, 21 bp, Artificial Sequence
  Description of Artificial Sequence: Synthetic oligonucleotide
tggccatgacccccgggccca

SEQ ID NO: 388509 - DNA, 20 bp, Artificial Sequence
  Description of Artificial Sequence: Synthetic oligonucleotide
ggccatgacccccgggccca

SEQ ID NO: 388510 - DNA, 20 bp, Artificial Sequence
  Description of Artificial Sequence: Synthetic oligonucleotide
gccatgacccccgggcccag

SEQ ID NO: 388511 - DNA, 20 bp, Artificial Sequence
  Description of Artificial Sequence: Synthetic oligonucleotide
ccatgacccccgggcccagg

SEQ ID NO: 388512 - DNA, 20 bp, Artificial Sequence
  Description of Artificial Sequence: Synthetic oligonucleotide
catgacccccgggcccaggg

SEQ ID NO: 388513 - DNA, 21 bp, Artificial Sequence
  Description of Artificial Sequence: Synthetic oligonucleotide
atgacccccgggcccagggga

SEQ ID NO: 388514 - DNA, 20 bp, Artificial Sequence
  Description of Artificial Sequence: Synthetic oligonucleotide
tgacccccgggcccagggga

SEQ ID NO: 388515 - DNA, 20 bp, Artificial Sequence
  Description of Artificial Sequence: Synthetic oligonucleotide
gacccccgggcccaggggat

SEQ ID NO: 388516 - DNA, 20 bp, Artificial Sequence
  Description of Artificial Sequence: Synthetic oligonucleotide
acccccgggcccaggggact

SEQ ID NO: 388517 - DNA, 20 bp, Artificial Sequence
  Description of Artificial Sequence: Synthetic oligonucleotide
cccccgggcccaggggactt

SEQ ID NO: 388518 - DNA, 20 bp, Artificial Sequence
  Description of Artificial Sequence: Synthetic oligonucleotide
ccccgggcccaggggacctt

SEQ ID NO: 388519 - DNA, 20 bp, Artificial Sequence
  Description of Artificial Sequence: Synthetic oligonucleotide
cccgggcccaggggaccctt

SEQ ID NO: 388520 - DNA, 20 bp, Artificial Sequence
  Description of Artificial Sequence: Synthetic oligonucleotide
ccgggcccaggggaccctgt

SEQ ID NO: 388521 - DNA, 21 bp, Artificial Sequence
  Description of Artificial Sequence: Synthetic oligonucleotide
cgggcccaggggaccctgtga

SEQ ID NO: 388522 - DNA, 31 bp, Artificial Sequence; identical to SEQ ID NO: 51455
  Description of Artificial Sequence: Synthetic oligonucleotide

SEQ ID NO: 388523 - DNA, 32 bp, Artificial Sequence; identical to SEQ ID NO: 51456
  Description of Artificial Sequence: Synthetic oligonucleotide

SEQ ID NO: 388524 - DNA, 37 bp, Artificial Sequence; identical to SEQ ID NO: 51457
  Description of Artificial Sequence: Synthetic oligonucleotide

SEQ ID NO: 388525 - DNA, 40 bp, Artificial Sequence; identical to SEQ ID NO: 51458
  Description of Artificial Sequence: Synthetic oligonucleotide

SEQ ID NO: 388526 - DNA, 39 bp, Artificial Sequence; identical to SEQ ID NO: 51459
  Description of Artificial Sequence: Synthetic oligonucleotide

SEQ ID NO: 388527 - DNA, 38 bp, Artificial Sequence; identical to SEQ ID NO: 51460
  Description of Artificial Sequence: Synthetic oligonucleotide

SEQ ID NO: 388528 - DNA, 37 bp, Artificial Sequence; identical to SEQ ID NO: 51461
  Description of Artificial Sequence: Synthetic oligonucleotide

SEQ ID NO: 388529 - DNA, 42 bp, Artificial Sequence; identical to SEQ ID NO: 51462
  Description of Artificial Sequence: Synthetic oligonucleotide

SEQ ID NO: 388530 - DNA, 41 bp, Artificial Sequence; identical to SEQ ID NO: 51463
  Description of Artificial Sequence: Synthetic oligonucleotide

SEQ ID NO: 388531 - DNA, 40 bp, Artificial Sequence; identical to SEQ ID NO: 51464
  Description of Artificial Sequence: Synthetic oligonucleotide

SEQ ID NO: 388532 - DNA, 42 bp, Artificial Sequence; identical to SEQ ID NO: 51465
  Description of Artificial Sequence: Synthetic oligonucleotide

SEQ ID NO: 388533 - DNA, 41 bp, Artificial Sequence; identical to SEQ ID NO: 51466
  Description of Artificial Sequence: Synthetic oligonucleotide

SEQ ID NO: 388534 - DNA, 43 bp, Artificial Sequence; identical to SEQ ID NO: 51467
  Description of Artificial Sequence: Synthetic oligonucleotide

SEQ ID NO: 388535 - DNA, 42 bp, Artificial Sequence; identical to SEQ ID NO: 51468
  Description of Artificial Sequence: Synthetic oligonucleotide

SEQ ID NO: 388536 - DNA, 44 bp, Artificial Sequence; identical to SEQ ID NO: 51469
  Description of Artificial Sequence: Synthetic oligonucleotide

SEQ ID NO: 388537 - DNA, 45 bp, Artificial Sequence; identical to SEQ ID NO: 51470
  Description of Artificial Sequence: Synthetic oligonucleotide

SEQ ID NO: 388538 - DNA, 47 bp, Artificial Sequence; identical to SEQ ID NO: 51471
  Description of Artificial Sequence: Synthetic oligonucleotide

SEQ ID NO: 388539 - DNA, 46 bp, Artificial Sequence; identical to SEQ ID NO: 51472
  Description of Artificial Sequence: Synthetic oligonucleotide

SEQ ID NO: 388540 - DNA, 45 bp, Artificial Sequence; identical to SEQ ID NO: 51473
  Description of Artificial Sequence: Synthetic oligonucleotide

SEQ ID NO: 388541 - DNA, 44 bp, Artificial Sequence; identical to SEQ ID NO: 51474
  Description of Artificial Sequence: Synthetic oligonucleotide

SEQ ID NO: 388542 - DNA, 46 bp, Artificial Sequence; identical to SEQ ID NO: 51475
  Description of Artificial Sequence: Synthetic oligonucleotide

SEQ ID NO: 388543 - DNA, 45 bp, Artificial Sequence; identical to SEQ ID NO: 51476
  Description of Artificial Sequence: Synthetic oligonucleotide

SEQ ID NO: 388544 - DNA, 48 bp, Artificial Sequence; identical to SEQ ID NO: 51477
  Description of Artificial Sequence: Synthetic oligonucleotide

SEQ ID NO: 388545 - DNA, 49 bp, Artificial Sequence; identical to SEQ ID NO: 51478
  Description of Artificial Sequence: Synthetic oligonucleotide

SEQ ID NO: 388546 - DNA, 48 bp, Artificial Sequence; identical to SEQ ID NO: 51479
  Description of Artificial Sequence: Synthetic oligonucleotide

SEQ ID NO: 388547 - DNA, 47 bp, Artificial Sequence; identical to SEQ ID NO: 51480
  Description of Artificial Sequence: Synthetic oligonucleotide

SEQ ID NO: 388548 - DNA, 47 bp, Artificial Sequence; identical to SEQ ID NO: 51481
  Description of Artificial Sequence: Synthetic oligonucleotide

SEQ ID NO: 388549 - DNA, 46 bp, Artificial Sequence; identical to SEQ ID NO: 51482
  Description of Artificial Sequence: Synthetic oligonucleotide

SEQ ID NO: 388550 - DNA, 48 bp, Artificial Sequence; identical to SEQ ID NO: 51483
  Description of Artificial Sequence: Synthetic oligonucleotide

SEQ ID NO: 388551 - DNA, 49 bp, Artificial Sequence; identical to SEQ ID NO: 51484
  Description of Artificial Sequence: Synthetic oligonucleotide

SEQ ID NO: 388552 - DNA, 33 bp, Artificial Sequence; identical to SEQ ID NO: 51485
  Description of Artificial Sequence: Synthetic oligonucleotide

SEQ ID NO: 388553 - DNA, 33 bp, Artificial Sequence; identical to SEQ ID NO: 51486
  Description of Artificial Sequence: Synthetic oligonucleotide

SEQ ID NO: 388554 - DNA, 32 bp, Artificial Sequence; identical to SEQ ID NO: 51487
  Description of Artificial Sequence: Synthetic oligonucleotide

SEQ ID NO: 388555 - DNA, 31 bp, Artificial Sequence; identical to SEQ ID NO: 51488
  Description of Artificial Sequence: Synthetic oligonucleotide

SEQ ID NO: 388556 - DNA, 34 bp, Artificial Sequence; identical to SEQ ID NO: 51489
  Description of Artificial Sequence: Synthetic oligonucleotide

SEQ ID NO: 388557 - DNA, 33 bp, Artificial Sequence; identical to SEQ ID NO: 51490
  Description of Artificial Sequence: Synthetic oligonucleotide

SEQ ID NO: 388558 - DNA, 34 bp, Artificial Sequence; identical to SEQ ID NO: 51491
  Description of Artificial Sequence: Synthetic oligonucleotide

SEQ ID NO: 388559 - DNA, 33 bp, Artificial Sequence; identical to SEQ ID NO: 51492
  Description of Artificial Sequence: Synthetic oligonucleotide

SEQ ID NO: 388560 - DNA, 33 bp, Artificial Sequence; identical to SEQ ID NO: 51493
  Description of Artificial Sequence: Synthetic oligonucleotide

SEQ ID NO: 388561 - DNA, 32 bp, Artificial Sequence; identical to SEQ ID NO: 51494
  Description of Artificial Sequence: Synthetic oligonucleotide

SEQ ID NO: 388562 - DNA, 31 bp, Artificial Sequence; identical to SEQ ID NO: 51495
  Description of Artificial Sequence: Synthetic oligonucleotide

SEQ ID NO: 388563 - DNA, 33 bp, Artificial Sequence; identical to SEQ ID NO: 51496
  Description of Artificial Sequence: Synthetic oligonucleotide

SEQ ID NO: 388564 - DNA, 32 bp, Artificial Sequence; identical to SEQ ID NO: 51497
  Description of Artificial Sequence: Synthetic oligonucleotide

SEQ ID NO: 388565 - DNA, 31 bp, Artificial Sequence; identical to SEQ ID NO: 51498
  Description of Artificial Sequence: Synthetic oligonucleotide

SEQ ID NO: 388566 - DNA, 30 bp, Artificial Sequence; identical to SEQ ID NO: 51499
  Description of Artificial Sequence: Synthetic oligonucleotide

SEQ ID NO: 388567 - DNA, 29 bp, Artificial Sequence
  Description of Artificial Sequence: Synthetic oligonucleotide
gccgcgtttgtacagacccatagaccaac

SEQ ID NO: 388568 - DNA, 30 bp, Artificial Sequence; identical to SEQ ID NO: 51501
  Description of Artificial Sequence: Synthetic oligonucleotide

SEQ ID NO: 388569 - DNA, 30 bp, Artificial Sequence; identical to SEQ ID NO: 51502
  Description of Artificial Sequence: Synthetic oligonucleotide

SEQ ID NO: 388570 - DNA, 30 bp, Artificial Sequence; identical to SEQ ID NO: 51503
  Description of Artificial Sequence: Synthetic oligonucleotide

SEQ ID NO: 388571 - DNA, 30 bp, Artificial Sequence; identical to SEQ ID NO: 51504
  Description of Artificial Sequence: Synthetic oligonucleotide

SEQ ID NO: 388572 - DNA, 31 bp, Artificial Sequence; identical to SEQ ID NO: 51505
  Description of Artificial Sequence: Synthetic oligonucleotide

SEQ ID NO: 388573 - DNA, 36 bp, Artificial Sequence; identical to SEQ ID NO: 51506
  Description of Artificial Sequence: Synthetic oligonucleotide

SEQ ID NO: 388574 - DNA, 35 bp, Artificial Sequence; identical to SEQ ID NO: 51507
  Description of Artificial Sequence: Synthetic oligonucleotide

SEQ ID NO: 388575 - DNA, 34 bp, Artificial Sequence; identical to SEQ ID NO: 51508
  Description of Artificial Sequence: Synthetic oligonucleotide

SEQ ID NO: 388576 - DNA, 33 bp, Artificial Sequence; identical to SEQ ID NO: 51509
  Description of Artificial Sequence: Synthetic oligonucleotide

SEQ ID NO: 388577 - DNA, 36 bp, Artificial Sequence; identical to SEQ ID NO: 51510
  Description of Artificial Sequence: Synthetic oligonucleotide

SEQ ID NO: 388578 - DNA, 35 bp, Artificial Sequence; identical to SEQ ID NO: 51511
  Description of Artificial Sequence: Synthetic oligonucleotide

SEQ ID NO: 388579 - DNA, 34 bp, Artificial Sequence; identical to SEQ ID NO: 51512
  Description of Artificial Sequence: Synthetic oligonucleotide

SEQ ID NO: 388580 - DNA, 39 bp, Artificial Sequence; identical to SEQ ID NO: 51513
  Description of Artificial Sequence: Synthetic oligonucleotide

SEQ ID NO: 388581 - DNA, 38 bp, Artificial Sequence; identical to SEQ ID NO: 51514
  Description of Artificial Sequence: Synthetic oligonucleotide

SEQ ID NO: 388582 - DNA, 40 bp, Artificial Sequence; identical to SEQ ID NO: 51515
  Description of Artificial Sequence: Synthetic oligonucleotide

SEQ ID NO: 388583 - DNA, 39 bp, Artificial Sequence; identical to SEQ ID NO: 51516
  Description of Artificial Sequence: Synthetic oligonucleotide

SEQ ID NO: 388584 - DNA, 41 bp, Artificial Sequence; identical to SEQ ID NO: 51517
  Description of Artificial Sequence: Synthetic oligonucleotide

SEQ ID NO: 388585 - DNA, 29 bp, Artificial Sequence
  Description of Artificial Sequence: Synthetic oligonucleotide
ccaagccttttcctttgaggctcagggtg

SEQ ID NO: 388586 - DNA, 29 bp, Artificial Sequence
  Description of Artificial Sequence: Synthetic oligonucleotide
caagccttttcctttgaggctcagggtgg

SEQ ID NO: 388587 - DNA, 29 bp, Artificial Sequence
  Description of Artificial Sequence: Synthetic oligonucleotide
aagccttttcctttgaggctcagggtggg

SEQ ID NO: 388588 - DNA, 28 bp, Artificial Sequence
  Description of Artificial Sequence: Synthetic oligonucleotide
agccttttcctttgaggctcagggtggg

SEQ ID NO: 388589 - DNA, 27 bp, Artificial Sequence
  Description of Artificial Sequence: Synthetic oligonucleotide
gccttttcctttgaggctcagggtggg

SEQ ID NO: 388590 - DNA, 27 bp, Artificial Sequence
  Description of Artificial Sequence: Synthetic oligonucleotide
ccttttcctttgaggctcagggtgggc

SEQ ID NO: 388591 - DNA, 28 bp, Artificial Sequence
  Description of Artificial Sequence: Synthetic oligonucleotide
cttttcctttgaggctcagggtgggctg

SEQ ID NO: 388592 - DNA, 28 bp, Artificial Sequence
  Description of Artificial Sequence: Synthetic oligonucleotide
ttttcctttgaggctcagggtgggctgg

SEQ ID NO: 388593 - DNA, 27 bp, Artificial Sequence
  Description of Artificial Sequence: Synthetic oligonucleotide
tttcctttgaggctcagggtgggctgg

SEQ ID NO: 388594 - DNA, 26 bp, Artificial Sequence
  Description of Artificial Sequence: Synthetic oligonucleotide
ttcctttgaggctcagggtgggctgg

SEQ ID NO: 388595 - DNA, 25 bp, Artificial Sequence
  Description of Artificial Sequence: Synthetic oligonucleotide
tcctttgaggctcagggtgggctgg

SEQ ID NO: 388596 - DNA, 24 bp, Artificial Sequence
  Description of Artificial Sequence: Synthetic oligonucleotide
cctttgaggctcagggtgggctgg

SEQ ID NO: 388597 - DNA, 27 bp, Artificial Sequence
  Description of Artificial Sequence: Synthetic oligonucleotide
ctttgaggctcagggtgggctggctaa

SEQ ID NO: 388598 - DNA, 27 bp, Artificial Sequence
  Description of Artificial Sequence: Synthetic oligonucleotide
tttgaggctcagggtgggctggctaac

SEQ ID NO: 388599 - DNA, 27 bp, Artificial Sequence
  Description of Artificial Sequence: Synthetic oligonucleotide
ttgaggctcagggtgggctggctaaca

SEQ ID NO: 388600 - DNA, 27 bp, Artificial Sequence
  Description of Artificial Sequence: Synthetic oligonucleotide
tgaggctcagggtgggctggctaacat

SEQ ID NO: 388601 - DNA, 27 bp, Artificial Sequence
  Description of Artificial Sequence: Synthetic oligonucleotide
gaggctcagggtgggctggctaacatt

SEQ ID NO: 388602 - DNA, 27 bp, Artificial Sequence
  Description of Artificial Sequence: Synthetic oligonucleotide
aggctcagggtgggctggctaacattg

SEQ ID NO: 388603 - DNA, 26 bp, Artificial Sequence
  Description of Artificial Sequence: Synthetic oligonucleotide
ggctcagggtgggctggctaacattg

SEQ ID NO: 388604 - DNA, 27 bp, Artificial Sequence
  Description of Artificial Sequence: Synthetic oligonucleotide
gctcagggtgggctggctaacattgct

SEQ ID NO: 388605 - DNA, 32 bp, Artificial Sequence; identical to SEQ ID NO: 51538
  Description of Artificial Sequence: Synthetic oligonucleotide

SEQ ID NO: 388606 - DNA, 34 bp, Artificial Sequence; identical to SEQ ID NO: 51539
  Description of Artificial Sequence: Synthetic oligonucleotide

SEQ ID NO: 388607 - DNA, 33 bp, Artificial Sequence; identical to SEQ ID NO: 51540
  Description of Artificial Sequence: Synthetic oligonucleotide

SEQ ID NO: 388608 - DNA, 35 bp, Artificial Sequence; identical to SEQ ID NO: 51541
  Description of Artificial Sequence: Synthetic oligonucleotide

SEQ ID NO: 388609 - DNA, 34 bp, Artificial Sequence; identical to SEQ ID NO: 51542
  Description of Artificial Sequence: Synthetic oligonucleotide

SEQ ID NO: 388610 - DNA, 36 bp, Artificial Sequence; identical to SEQ ID NO: 51543
  Description of Artificial Sequence: Synthetic oligonucleotide

SEQ ID NO: 388611 - DNA, 38 bp, Artificial Sequence; identical to SEQ ID NO: 51544
  Description of Artificial Sequence: Synthetic oligonucleotide

SEQ ID NO: 388612 - DNA, 42 bp, Artificial Sequence; identical to SEQ ID NO: 51545
  Description of Artificial Sequence: Synthetic oligonucleotide

SEQ ID NO: 388613 - DNA, 40 bp, Artificial Sequence; identical to SEQ ID NO: 51546
  Description of Artificial Sequence: Synthetic oligonucleotide

SEQ ID NO: 388614 - DNA, 40 bp, Artificial Sequence; identical to SEQ ID NO: 51547
  Description of Artificial Sequence: Synthetic oligonucleotide

SEQ ID NO: 388615 - DNA, 42 bp, Artificial Sequence; identical to SEQ ID NO: 51548
  Description of Artificial Sequence: Synthetic oligonucleotide

SEQ ID NO: 388616 - DNA, 41 bp, Artificial Sequence; identical to SEQ ID NO: 51549
  Description of Artificial Sequence: Synthetic oligonucleotide

SEQ ID NO: 388617 - DNA, 40 bp, Artificial Sequence; identical to SEQ ID NO: 51550
  Description of Artificial Sequence: Synthetic oligonucleotide

SEQ ID NO: 388618 - DNA, 39 bp, Artificial Sequence; identical to SEQ ID NO: 51551
  Description of Artificial Sequence: Synthetic oligonucleotide

SEQ ID NO: 388619 - DNA, 40 bp, Artificial Sequence; identical to SEQ ID NO: 51552
  Description of Artificial Sequence: Synthetic oligonucleotide

SEQ ID NO: 388620 - DNA, 39 bp, Artificial Sequence; identical to SEQ ID NO: 51553
  Description of Artificial Sequence: Synthetic oligonucleotide

SEQ ID NO: 388621 - DNA, 41 bp, Artificial Sequence; identical to SEQ ID NO: 51554
  Description of Artificial Sequence: Synthetic oligonucleotide

SEQ ID NO: 388622 - DNA, 43 bp, Artificial Sequence; identical to SEQ ID NO: 51555
  Description of Artificial Sequence: Synthetic oligonucleotide

SEQ ID NO: 388623 - DNA, 42 bp, Artificial Sequence; identical to SEQ ID NO: 51556
  Description of Artificial Sequence: Synthetic oligonucleotide

SEQ ID NO: 388624 - DNA, 41 bp, Artificial Sequence; identical to SEQ ID NO: 51557
  Description of Artificial Sequence: Synthetic oligonucleotide

SEQ ID NO: 388625 - DNA, 44 bp, Artificial Sequence; identical to SEQ ID NO: 51558
  Description of Artificial Sequence: Synthetic oligonucleotide

SEQ ID NO: 388626 - DNA, 43 bp, Artificial Sequence; identical to SEQ ID NO: 51559
  Description of Artificial Sequence: Synthetic oligonucleotide

SEQ ID NO: 388627 - DNA, 44 bp, Artificial Sequence; identical to SEQ ID NO: 51560
  Description of Artificial Sequence: Synthetic oligonucleotide

SEQ ID NO: 388628 - DNA, 44 bp, Artificial Sequence; identical to SEQ ID NO: 51561
  Description of Artificial Sequence: Synthetic oligonucleotide

SEQ ID NO: 388629 - DNA, 46 bp, Artificial Sequence; identical to SEQ ID NO: 51562
  Description of Artificial Sequence: Synthetic oligonucleotide

SEQ ID NO: 388630 - DNA, 47 bp, Artificial Sequence; identical to SEQ ID NO: 51563
  Description of Artificial Sequence: Synthetic oligonucleotide

SEQ ID NO: 388631 - DNA, 46 bp, Artificial Sequence; identical to SEQ ID NO: 51564
  Description of Artificial Sequence: Synthetic oligonucleotide

SEQ ID NO: 388632 - DNA, 46 bp, Artificial Sequence; identical to SEQ ID NO: 51565
  Description of Artificial Sequence: Synthetic oligonucleotide

SEQ ID NO: 388633 - DNA, 45 bp, Artificial Sequence; identical to SEQ ID NO: 51566
  Description of Artificial Sequence: Synthetic oligonucleotide

SEQ ID NO: 388634 - DNA, 44 bp, Artificial Sequence; identical to SEQ ID NO: 51567
  Description of Artificial Sequence: Synthetic oligonucleotide

SEQ ID NO: 388635 - DNA, 43 bp, Artificial Sequence; identical to SEQ ID NO: 51568
  Description of Artificial Sequence: Synthetic oligonucleotide

SEQ ID NO: 388636 - DNA, 42 bp, Artificial Sequence; identical to SEQ ID NO: 51569
  Description of Artificial Sequence: Synthetic oligonucleotide

SEQ ID NO: 388637 - DNA, 41 bp, Artificial Sequence; identical to SEQ ID NO: 51570
  Description of Artificial Sequence: Synthetic oligonucleotide

SEQ ID NO: 388638 - DNA, 42 bp, Artificial Sequence; identical to SEQ ID NO: 51571
  Description of Artificial Sequence: Synthetic oligonucleotide

SEQ ID NO: 388639 - DNA, 41 bp, Artificial Sequence; identical to SEQ ID NO: 51572
  Description of Artificial Sequence: Synthetic oligonucleotide

SEQ ID NO: 388640 - DNA, 40 bp, Artificial Sequence; identical to SEQ ID NO: 51573
  Description of Artificial Sequence: Synthetic oligonucleotide

SEQ ID NO: 388641 - DNA, 39 bp, Artificial Sequence; identical to SEQ ID NO: 51574
  Description of Artificial Sequence: Synthetic oligonucleotide

SEQ ID NO: 388642 - DNA, 41 bp, Artificial Sequence; identical to SEQ ID NO: 51575
  Description of Artificial Sequence: Synthetic oligonucleotide

SEQ ID NO: 388643 - DNA, 40 bp, Artificial Sequence; identical to SEQ ID NO: 51576
  Description of Artificial Sequence: Synthetic oligonucleotide

SEQ ID NO: 388644 - DNA, 39 bp, Artificial Sequence; identical to SEQ ID NO: 51577
  Description of Artificial Sequence: Synthetic oligonucleotide

SEQ ID NO: 388645 - DNA, 38 bp, Artificial Sequence; identical to SEQ ID NO: 51578
  Description of Artificial Sequence: Synthetic oligonucleotide

SEQ ID NO: 388646 - DNA, 37 bp, Artificial Sequence; identical to SEQ ID NO: 51579
  Description of Artificial Sequence: Synthetic oligonucleotide

SEQ ID NO: 388647 - DNA, 36 bp, Artificial Sequence; identical to SEQ ID NO: 51580
  Description of Artificial Sequence: Synthetic oligonucleotide

SEQ ID NO: 388648 - DNA, 38 bp, Artificial Sequence; identical to SEQ ID NO: 51581
  Description of Artificial Sequence: Synthetic oligonucleotide

SEQ ID NO: 388649 - DNA, 37 bp, Artificial Sequence; identical to SEQ ID NO: 51582
  Description of Artificial Sequence: Synthetic oligonucleotide

SEQ ID NO: 388650 - DNA, 36 bp, Artificial Sequence; identical to SEQ ID NO: 51583
  Description of Artificial Sequence: Synthetic oligonucleotide

SEQ ID NO: 388651 - DNA, 36 bp, Artificial Sequence; identical to SEQ ID NO: 51584
  Description of Artificial Sequence: Synthetic oligonucleotide

SEQ ID NO: 388652 - DNA, 35 bp, Artificial Sequence; identical to SEQ ID NO: 51585
  Description of Artificial Sequence: Synthetic oligonucleotide

SEQ ID NO: 388653 - DNA, 26 bp, Artificial Sequence
  Description of Artificial Sequence: Synthetic oligonucleotide
tccagcgttccaaccacactcaggcc

SEQ ID NO: 388654 - DNA, 25 bp, Artificial Sequence
  Description of Artificial Sequence: Synthetic oligonucleotide
ccagcgttccaaccacactcaggcc

SEQ ID NO: 388655 - DNA, 25 bp, Artificial Sequence
  Description of Artificial Sequence: Synthetic oligonucleotide
cagcgttccaaccacactcaggccg

SEQ ID NO: 388656 - DNA, 25 bp, Artificial Sequence
  Description of Artificial Sequence: Synthetic oligonucleotide
agcgttccaaccacactcaggccgc

SEQ ID NO: 388657 - DNA, 24 bp, Artificial Sequence
  Description of Artificial Sequence: Synthetic oligonucleotide
gcgttccaaccacactcaggccgc

SEQ ID NO: 388658 - DNA, 27 bp, Artificial Sequence
  Description of Artificial Sequence: Synthetic oligonucleotide
cgttccaaccacactcaggccgccaat

SEQ ID NO: 388659 - DNA, 41 bp, Artificial Sequence; identical to SEQ ID NO: 51592
  Description of Artificial Sequence: Synthetic oligonucleotide

SEQ ID NO: 388660 - DNA, 40 bp, Artificial Sequence; identical to SEQ ID NO: 51593
  Description of Artificial Sequence: Synthetic oligonucleotide

SEQ ID NO: 388661 - DNA, 41 bp, Artificial Sequence; identical to SEQ ID NO: 51594
  Description of Artificial Sequence: Synthetic oligonucleotide

SEQ ID NO: 388662 - DNA, 43 bp, Artificial Sequence; identical to SEQ ID NO: 51595
  Description of Artificial Sequence: Synthetic oligonucleotide

SEQ ID NO: 388663 - DNA, 42 bp, Artificial Sequence; identical to SEQ ID NO: 51596
  Description of Artificial Sequence: Synthetic oligonucleotide

SEQ ID NO: 388664 - DNA, 41 bp, Artificial Sequence; identical to SEQ ID NO: 51597
  Description of Artificial Sequence: Synthetic oligonucleotide

SEQ ID NO: 388665 - DNA, 44 bp, Artificial Sequence; identical to SEQ ID NO: 51598
  Description of Artificial Sequence: Synthetic oligonucleotide

SEQ ID NO: 388666 - DNA, 43 bp, Artificial Sequence; identical to SEQ ID NO: 51599
  Description of Artificial Sequence: Synthetic oligonucleotide

SEQ ID NO: 388667 - DNA, 44 bp, Artificial Sequence; identical to SEQ ID NO: 51600
  Description of Artificial Sequence: Synthetic oligonucleotide

SEQ ID NO: 388668 - DNA, 44 bp, Artificial Sequence; identical to SEQ ID NO: 51601
  Description of Artificial Sequence: Synthetic oligonucleotide

SEQ ID NO: 388669 - DNA, 46 bp, Artificial Sequence; identical to SEQ ID NO: 51602
  Description of Artificial Sequence: Synthetic oligonucleotide

SEQ ID NO: 388670 - DNA, 47 bp, Artificial Sequence; identical to SEQ ID NO: 51603
  Description of Artificial Sequence: Synthetic oligonucleotide

SEQ ID NO: 388671 - DNA, 46 bp, Artificial Sequence; identical to SEQ ID NO: 51604
  Description of Artificial Sequence: Synthetic oligonucleotide

SEQ ID NO: 388672 - DNA, 46 bp, Artificial Sequence; identical to SEQ ID NO: 51605
  Description of Artificial Sequence: Synthetic oligonucleotide

SEQ ID NO: 388673 - DNA, 45 bp, Artificial Sequence; identical to SEQ ID NO: 51606
  Description of Artificial Sequence: Synthetic oligonucleotide

SEQ ID NO: 388674 - DNA, 44 bp, Artificial Sequence; identical to SEQ ID NO: 51607
  Description of Artificial Sequence: Synthetic oligonucleotide

SEQ ID NO: 388675 - DNA, 43 bp, Artificial Sequence; identical to SEQ ID NO: 51608
  Description of Artificial Sequence: Synthetic oligonucleotide

SEQ ID NO: 388676 - DNA, 42 bp, Artificial Sequence; identical to SEQ ID NO: 51609
  Description of Artificial Sequence: Synthetic oligonucleotide

SEQ ID NO: 388677 - DNA, 41 bp, Artificial Sequence; identical to SEQ ID NO: 51610
  Description of Artificial Sequence: Synthetic oligonucleotide

SEQ ID NO: 388678 - DNA, 48 bp, Artificial Sequence; identical to SEQ ID NO: 51611
  Description of Artificial Sequence: Synthetic oligonucleotide

SEQ ID NO: 388679 - DNA, 47 bp, Artificial Sequence; identical to SEQ ID NO: 51612
  Description of Artificial Sequence: Synthetic oligonucleotide

SEQ ID NO: 388680 - DNA, 46 bp, Artificial Sequence; identical to SEQ ID NO: 51613
  Description of Artificial Sequence: Synthetic oligonucleotide

SEQ ID NO: 388681 - DNA, 45 bp, Artificial Sequence; identical to SEQ ID NO: 51614
  Description of Artificial Sequence: Synthetic oligonucleotide

SEQ ID NO: 388682 - DNA, 45 bp, Artificial Sequence; identical to SEQ ID NO: 51615
  Description of Artificial Sequence: Synthetic oligonucleotide

SEQ ID NO: 388683 - DNA, 44 bp, Artificial Sequence; identical to SEQ ID NO: 51616
  Description of Artificial Sequence: Synthetic oligonucleotide

SEQ ID NO: 388684 - DNA, 43 bp, Artificial Sequence; identical to SEQ ID NO: 51617
  Description of Artificial Sequence: Synthetic oligonucleotide

SEQ ID NO: 388685 - DNA, 42 bp, Artificial Sequence; identical to SEQ ID NO: 51618
  Description of Artificial Sequence: Synthetic oligonucleotide

SEQ ID NO: 388686 - DNA, 41 bp, Artificial Sequence; identical to SEQ ID NO: 51619
  Description of Artificial Sequence: Synthetic oligonucleotide

SEQ ID NO: 388687 - DNA, 40 bp, Artificial Sequence; identical to SEQ ID NO: 51620
  Description of Artificial Sequence: Synthetic oligonucleotide

SEQ ID NO: 388688 - DNA, 41 bp, Artificial Sequence; identical to SEQ ID NO: 51621
  Description of Artificial Sequence: Synthetic oligonucleotide

SEQ ID NO: 388689 - DNA, 40 bp, Artificial Sequence; identical to SEQ ID NO: 51622
  Description of Artificial Sequence: Synthetic oligonucleotide

SEQ ID NO: 388690 - DNA, 39 bp, Artificial Sequence; identical to SEQ ID NO: 51623
  Description of Artificial Sequence: Synthetic oligonucleotide

SEQ ID NO: 388691 - DNA, 40 bp, Artificial Sequence; identical to SEQ ID NO: 51624
  Description of Artificial Sequence: Synthetic oligonucleotide

SEQ ID NO: 388692 - DNA, 39 bp, Artificial Sequence; identical to SEQ ID NO: 51625
  Description of Artificial Sequence: Synthetic oligonucleotide

SEQ ID NO: 388693 - DNA, 38 bp, Artificial Sequence; identical to SEQ ID NO: 51626
  Description of Artificial Sequence: Synthetic oligonucleotide

SEQ ID NO: 388694 - DNA, 38 bp, Artificial Sequence; identical to SEQ ID NO: 51627
  Description of Artificial Sequence: Synthetic oligonucleotide

SEQ ID NO: 388695 - DNA, 37 bp, Artificial Sequence; identical to SEQ ID NO: 51628
  Description of Artificial Sequence: Synthetic oligonucleotide

SEQ ID NO: 388696 - DNA, 36 bp, Artificial Sequence; identical to SEQ ID NO: 51629
  Description of Artificial Sequence: Synthetic oligonucleotide

SEQ ID NO: 388697 - DNA, 36 bp, Artificial Sequence; identical to SEQ ID NO: 51630
  Description of Artificial Sequence: Synthetic oligonucleotide

SEQ ID NO: 388698 - DNA, 35 bp, Artificial Sequence; identical to SEQ ID NO: 51631
  Description of Artificial Sequence: Synthetic oligonucleotide

SEQ ID NO: 388699 - DNA, 36 bp, Artificial Sequence; identical to SEQ ID NO: 51632
  Description of Artificial Sequence: Synthetic oligonucleotide

SEQ ID NO: 388700 - DNA, 37 bp, Artificial Sequence; identical to SEQ ID NO: 51633
  Description of Artificial Sequence: Synthetic oligonucleotide

SEQ ID NO: 388701 - DNA, 36 bp, Artificial Sequence; identical to SEQ ID NO: 51634
  Description of Artificial Sequence: Synthetic oligonucleotide

SEQ ID NO: 388702 - DNA, 36 bp, Artificial Sequence; identical to SEQ ID NO: 51635
  Description of Artificial Sequence: Synthetic oligonucleotide

SEQ ID NO: 388703 - DNA, 35 bp, Artificial Sequence; identical to SEQ ID NO: 51636
  Description of Artificial Sequence: Synthetic oligonucleotide

SEQ ID NO: 388704 - DNA, 34 bp, Artificial Sequence; identical to SEQ ID NO: 51637
  Description of Artificial Sequence: Synthetic oligonucleotide

SEQ ID NO: 388705 - DNA, 34 bp, Artificial Sequence; identical to SEQ ID NO: 51638
  Description of Artificial Sequence: Synthetic oligonucleotide

SEQ ID NO: 388706 - DNA, 33 bp, Artificial Sequence; identical to SEQ ID NO: 51639
  Description of Artificial Sequence: Synthetic oligonucleotide

SEQ ID NO: 388707 - DNA, 32 bp, Artificial Sequence; identical to SEQ ID NO: 51640
  Description of Artificial Sequence: Synthetic oligonucleotide

SEQ ID NO: 388708 - DNA, 31 bp, Artificial Sequence; identical to SEQ ID NO: 51641
  Description of Artificial Sequence: Synthetic oligonucleotide

SEQ ID NO: 388709 - DNA, 33 bp, Artificial Sequence; identical to SEQ ID NO: 51642
  Description of Artificial Sequence: Synthetic oligonucleotide

SEQ ID NO: 388710 - DNA, 32 bp, Artificial Sequence; identical to SEQ ID NO: 51643
  Description of Artificial Sequence: Synthetic oligonucleotide

SEQ ID NO: 388711 - DNA, 33 bp, Artificial Sequence; identical to SEQ ID NO: 51644
  Description of Artificial Sequence: Synthetic oligonucleotide

SEQ ID NO: 388712 - DNA, 33 bp, Artificial Sequence; identical to SEQ ID NO: 51645
  Description of Artificial Sequence: Synthetic oligonucleotide

SEQ ID NO: 388713 - DNA, 32 bp, Artificial Sequence; identical to SEQ ID NO: 51646
  Description of Artificial Sequence: Synthetic oligonucleotide

SEQ ID NO: 388714 - DNA, 31 bp, Artificial Sequence; identical to SEQ ID NO: 51647
  Description of Artificial Sequence: Synthetic oligonucleotide

SEQ ID NO: 388715 - DNA, 32 bp, Artificial Sequence; identical to SEQ ID NO: 51648
  Description of Artificial Sequence: Synthetic oligonucleotide

SEQ ID NO: 388716 - DNA, 31 bp, Artificial Sequence; identical to SEQ ID NO: 51649
  Description of Artificial Sequence: Synthetic oligonucleotide

SEQ ID NO: 388717 - DNA, 31 bp, Artificial Sequence; identical to SEQ ID NO: 51650
  Description of Artificial Sequence: Synthetic oligonucleotide

SEQ ID NO: 388718 - DNA, 32 bp, Artificial Sequence; identical to SEQ ID NO: 51651
  Description of Artificial Sequence: Synthetic oligonucleotide

SEQ ID NO: 388719 - DNA, 31 bp, Artificial Sequence; identical to SEQ ID NO: 51652
  Description of Artificial Sequence: Synthetic oligonucleotide

SEQ ID NO: 388720 - DNA, 30 bp, Artificial Sequence; identical to SEQ ID NO: 51653
  Description of Artificial Sequence: Synthetic oligonucleotide

SEQ ID NO: 388721 - DNA, 29 bp, Artificial Sequence
  Description of Artificial Sequence: Synthetic oligonucleotide
aaaaggagaccgtctggcatctggaggag

SEQ ID NO: 388722 - DNA, 28 bp, Artificial Sequence
  Description of Artificial Sequence: Synthetic oligonucleotide
aaaggagaccgtctggcatctggaggag

SEQ ID NO: 388723 - DNA, 42 bp, Artificial Sequence; identical to SEQ ID NO: 51656
  Description of Artificial Sequence: Synthetic oligonucleotide

SEQ ID NO: 388724 - DNA, 41 bp, Artificial Sequence; identical to SEQ ID NO: 51657
  Description of Artificial Sequence: Synthetic oligonucleotide

SEQ ID NO: 388725 - DNA, 40 bp, Artificial Sequence; identical to SEQ ID NO: 51658
  Description of Artificial Sequence: Synthetic oligonucleotide

SEQ ID NO: 388726 - DNA, 39 bp, Artificial Sequence; identical to SEQ ID NO: 51659
  Description of Artificial Sequence: Synthetic oligonucleotide

SEQ ID NO: 388727 - DNA, 41 bp, Artificial Sequence; identical to SEQ ID NO: 51660
  Description of Artificial Sequence: Synthetic oligonucleotide

SEQ ID NO: 388728 - DNA, 40 bp, Artificial Sequence; identical to SEQ ID NO: 51661
  Description of Artificial Sequence: Synthetic oligonucleotide

SEQ ID NO: 388729 - DNA, 39 bp, Artificial Sequence; identical to SEQ ID NO: 51662
  Description of Artificial Sequence: Synthetic oligonucleotide

SEQ ID NO: 388730 - DNA, 38 bp, Artificial Sequence; identical to SEQ ID NO: 51663
  Description of Artificial Sequence: Synthetic oligonucleotide

SEQ ID NO: 388731 - DNA, 37 bp, Artificial Sequence; identical to SEQ ID NO: 51664
  Description of Artificial Sequence: Synthetic oligonucleotide

SEQ ID NO: 388732 - DNA, 36 bp, Artificial Sequence; identical to SEQ ID NO: 51665
  Description of Artificial Sequence: Synthetic oligonucleotide

SEQ ID NO: 388733 - DNA, 38 bp, Artificial Sequence; identical to SEQ ID NO: 51666
  Description of Artificial Sequence: Synthetic oligonucleotide

SEQ ID NO: 388734 - DNA, 37 bp, Artificial Sequence; identical to SEQ ID NO: 51667
  Description of Artificial Sequence: Synthetic oligonucleotide

SEQ ID NO: 388735 - DNA, 36 bp, Artificial Sequence; identical to SEQ ID NO: 51668
  Description of Artificial Sequence: Synthetic oligonucleotide

SEQ ID NO: 388736 - DNA, 36 bp, Artificial Sequence; identical to SEQ ID NO: 51669
  Description of Artificial Sequence: Synthetic oligonucleotide

SEQ ID NO: 388737 - DNA, 35 bp, Artificial Sequence; identical to SEQ ID NO: 51670
  Description of Artificial Sequence: Synthetic oligonucleotide

SEQ ID NO: 388738 - DNA, 34 bp, Artificial Sequence; identical to SEQ ID NO: 51671
  Description of Artificial Sequence: Synthetic oligonucleotide

SEQ ID NO: 388739 - DNA, 35 bp, Artificial Sequence; identical to SEQ ID NO: 51672
  Description of Artificial Sequence: Synthetic oligonucleotide

SEQ ID NO: 388740 - DNA, 34 bp, Artificial Sequence; identical to SEQ ID NO: 51673
  Description of Artificial Sequence: Synthetic oligonucleotide

SEQ ID NO: 388741 - DNA, 33 bp, Artificial Sequence; identical to SEQ ID NO: 51674
  Description of Artificial Sequence: Synthetic oligonucleotide

SEQ ID NO: 388742 - DNA, 34 bp, Artificial Sequence; identical to SEQ ID NO: 51675
  Description of Artificial Sequence: Synthetic oligonucleotide

SEQ ID NO: 388743 - DNA, 33 bp, Artificial Sequence; identical to SEQ ID NO: 51676
  Description of Artificial Sequence: Synthetic oligonucleotide

SEQ ID NO: 388744 - DNA, 33 bp, Artificial Sequence; identical to SEQ ID NO: 51677
  Description of Artificial Sequence: Synthetic oligonucleotide

SEQ ID NO: 388745 - DNA, 33 bp, Artificial Sequence; identical to SEQ ID NO: 51678
  Description of Artificial Sequence: Synthetic oligonucleotide

SEQ ID NO: 388746 - DNA, 29 bp, Artificial Sequence
  Description of Artificial Sequence: Synthetic oligonucleotide
gtctggcatctggaggagtttggccaaac

SEQ ID NO: 388747 - DNA, 29 bp, Artificial Sequence
  Description of Artificial Sequence: Synthetic oligonucleotide
tctggcatctggaggagtttggccaaacc

SEQ ID NO: 388748 - DNA, 28 bp, Artificial Sequence
  Description of Artificial Sequence: Synthetic oligonucleotide
ctggcatctggaggagtttggccaaacc

SEQ ID NO: 388749 - DNA, 32 bp, Artificial Sequence; identical to SEQ ID NO: 51682
  Description of Artificial Sequence: Synthetic oligonucleotide

SEQ ID NO: 388750 - DNA, 31 bp, Artificial Sequence; identical to SEQ ID NO: 51683
  Description of Artificial Sequence: Synthetic oligonucleotide

SEQ ID NO: 388751 - DNA, 31 bp, Artificial Sequence; identical to SEQ ID NO: 51684
  Description of Artificial Sequence: Synthetic oligonucleotide

SEQ ID NO: 388752 - DNA, 34 bp, Artificial Sequence; identical to SEQ ID NO: 51685
  Description of Artificial Sequence: Synthetic oligonucleotide

SEQ ID NO: 388753 - DNA, 35 bp, Artificial Sequence; identical to SEQ ID NO: 51686
  Description of Artificial Sequence: Synthetic oligonucleotide

SEQ ID NO: 388754 - DNA, 34 bp, Artificial Sequence; identical to SEQ ID NO: 51687
  Description of Artificial Sequence: Synthetic oligonucleotide

SEQ ID NO: 388755 - DNA, 33 bp, Artificial Sequence; identical to SEQ ID NO: 51688
  Description of Artificial Sequence: Synthetic oligonucleotide

SEQ ID NO: 388756 - DNA, 33 bp, Artificial Sequence; identical to SEQ ID NO: 51689
  Description of Artificial Sequence: Synthetic oligonucleotide

SEQ ID NO: 388757 - DNA, 32 bp, Artificial Sequence; identical to SEQ ID NO: 51690
  Description of Artificial Sequence: Synthetic oligonucleotide

SEQ ID NO: 388758 - DNA, 32 bp, Artificial Sequence; identical to SEQ ID NO: 51691
  Description of Artificial Sequence: Synthetic oligonucleotide

SEQ ID NO: 388759 - DNA, 33 bp, Artificial Sequence; identical to SEQ ID NO: 51692
  Description of Artificial Sequence: Synthetic oligonucleotide

SEQ ID NO: 388760 - DNA, 32 bp, Artificial Sequence; identical to SEQ ID NO: 51693
  Description of Artificial Sequence: Synthetic oligonucleotide

SEQ ID NO: 388761 - DNA, 33 bp, Artificial Sequence; identical to SEQ ID NO: 51694
  Description of Artificial Sequence: Synthetic oligonucleotide

SEQ ID NO: 388762 - DNA, 33 bp, Artificial Sequence; identical to SEQ ID NO: 51695
  Description of Artificial Sequence: Synthetic oligonucleotide

SEQ ID NO: 388763 - DNA, 32 bp, Artificial Sequence; identical to SEQ ID NO: 51696
  Description of Artificial Sequence: Synthetic oligonucleotide

SEQ ID NO: 388764 - DNA, 32 bp, Artificial Sequence; identical to SEQ ID NO: 51697
  Description of Artificial Sequence: Synthetic oligonucleotide

SEQ ID NO: 388765 - DNA, 31 bp, Artificial Sequence; identical to SEQ ID NO: 51698
  Description of Artificial Sequence: Synthetic oligonucleotide

SEQ ID NO: 388766 - DNA, 30 bp, Artificial Sequence; identical to SEQ ID NO: 51699
  Description of Artificial Sequence: Synthetic oligonucleotide

SEQ ID NO: 388767 - DNA, 29 bp, Artificial Sequence
  Description of Artificial Sequence: Synthetic oligonucleotide
ggccaaaccttttcctttgaggctcaggg

SEQ ID NO: 388768 - DNA, 29 bp, Artificial Sequence
  Description of Artificial Sequence: Synthetic oligonucleotide
gccaaaccttttcctttgaggctcagggc

SEQ ID NO: 388769 - DNA, 29 bp, Artificial Sequence
  Description of Artificial Sequence: Synthetic oligonucleotide
ccaaaccttttcctttgaggctcagggcg

SEQ ID NO: 388770 - DNA, 29 bp, Artificial Sequence
  Description of Artificial Sequence: Synthetic oligonucleotide
caaaccttttcctttgaggctcagggcgg

SEQ ID NO: 388771 - DNA, 29 bp, Artificial Sequence
  Description of Artificial Sequence: Synthetic oligonucleotide
aaaccttttcctttgaggctcagggcggg

SEQ ID NO: 388772 - DNA, 28 bp, Artificial Sequence
  Description of Artificial Sequence: Synthetic oligonucleotide
aaccttttcctttgaggctcagggcggg

SEQ ID NO: 388773 - DNA, 27 bp, Artificial Sequence
  Description of Artificial Sequence: Synthetic oligonucleotide
accttttcctttgaggctcagggcggg

SEQ ID NO: 388774 - DNA, 26 bp, Artificial Sequence
  Description of Artificial Sequence: Synthetic oligonucleotide
cgtctggcatctggaggagtttggcc

SEQ ID NO: 388775 - DNA, 27 bp, Artificial Sequence
  Description of Artificial Sequence: Synthetic oligonucleotide
gtctggcatctggaggagtttggccga

SEQ ID NO: 388776 - DNA, 27 bp, Artificial Sequence
  Description of Artificial Sequence: Synthetic oligonucleotide
tctggcatctggaggagtttggccgag

SEQ ID NO: 388777 - DNA, 26 bp, Artificial Sequence
  Description of Artificial Sequence: Synthetic oligonucleotide
ctggcatctggaggagtttggccgag

SEQ ID NO: 388778 - DNA, 26 bp, Artificial Sequence
  Description of Artificial Sequence: Synthetic oligonucleotide
tggcatctggaggagtttggccgagc

SEQ ID NO: 388779 - DNA, 25 bp, Artificial Sequence
  Description of Artificial Sequence: Synthetic oligonucleotide
ggcatctggaggagtttggccgagc

SEQ ID NO: 388780 - DNA, 27 bp, Artificial Sequence
  Description of Artificial Sequence: Synthetic oligonucleotide
gcatctggaggagtttggccgagcctt

SEQ ID NO: 388781 - DNA, 29 bp, Artificial Sequence
  Description of Artificial Sequence: Synthetic oligonucleotide
catctggaggagtttggccgagccttttc

SEQ ID NO: 388782 - DNA, 29 bp, Artificial Sequence
  Description of Artificial Sequence: Synthetic oligonucleotide
atctggaggagtttggccgagccttttcc

SEQ ID NO: 388783 - DNA, 28 bp, Artificial Sequence
  Description of Artificial Sequence: Synthetic oligonucleotide
tctggaggagtttggccgagccttttcc

SEQ ID NO: 388784 - DNA, 27 bp, Artificial Sequence
  Description of Artificial Sequence: Synthetic oligonucleotide
ctggaggagtttggccgagccttttcc

SEQ ID NO: 388785 - DNA, 30 bp, Artificial Sequence; identical to SEQ ID NO: 51718
  Description of Artificial Sequence: Synthetic oligonucleotide

SEQ ID NO: 388786 - DNA, 29 bp, Artificial Sequence
  Description of Artificial Sequence: Synthetic oligonucleotide
ggaggagtttggccgagccttttcctttg

SEQ ID NO: 388787 - DNA, 30 bp, Artificial Sequence; identical to SEQ ID NO: 51720
  Description of Artificial Sequence: Synthetic oligonucleotide

SEQ ID NO: 388788 - DNA, 30 bp, Artificial Sequence; identical to SEQ ID NO: 51721
  Description of Artificial Sequence: Synthetic oligonucleotide

SEQ ID NO: 388789 - DNA, 29 bp, Artificial Sequence
  Description of Artificial Sequence: Synthetic oligonucleotide
ggagtttggccgagccttttcctttgagg

SEQ ID NO: 388790 - DNA, 29 bp, Artificial Sequence
  Description of Artificial Sequence: Synthetic oligonucleotide
gagtttggccgagccttttcctttgaggc

SEQ ID NO: 388791 - DNA, 30 bp, Artificial Sequence; identical to SEQ ID NO: 51724
  Description of Artificial Sequence: Synthetic oligonucleotide

SEQ ID NO: 388792 - DNA, 29 bp, Artificial Sequence
  Description of Artificial Sequence: Synthetic oligonucleotide
gtttggccgagccttttcctttgaggctc

SEQ ID NO: 388793 - DNA, 30 bp, Artificial Sequence; identical to SEQ ID NO: 51726
  Description of Artificial Sequence: Synthetic oligonucleotide

SEQ ID NO: 388794 - DNA, 29 bp, Artificial Sequence
  Description of Artificial Sequence: Synthetic oligonucleotide
ttggccgagccttttcctttgaggctcag

SEQ ID NO: 388795 - DNA, 28 bp, Artificial Sequence
  Description of Artificial Sequence: Synthetic oligonucleotide
tggccgagccttttcctttgaggctcag

SEQ ID NO: 388796 - DNA, 27 bp, Artificial Sequence
  Description of Artificial Sequence: Synthetic oligonucleotide
ggccgagccttttcctttgaggctcag

SEQ ID NO: 388797 - DNA, 27 bp, Artificial Sequence
  Description of Artificial Sequence: Synthetic oligonucleotide
gccgagccttttcctttgaggctcagg

SEQ ID NO: 388798 - DNA, 27 bp, Artificial Sequence
  Description of Artificial Sequence: Synthetic oligonucleotide
ccgagccttttcctttgaggctcaggg

SEQ ID NO: 388799 - DNA, 27 bp, Artificial Sequence
  Description of Artificial Sequence: Synthetic oligonucleotide
cgagccttttcctttgaggctcagggc

SEQ ID NO: 388800 - DNA, 27 bp, Artificial Sequence
  Description of Artificial Sequence: Synthetic oligonucleotide
gagccttttcctttgaggctcagggcg

SEQ ID NO: 388801 - DNA, 35 bp, Artificial Sequence; identical to SEQ ID NO: 51734
  Description of Artificial Sequence: Synthetic oligonucleotide

SEQ ID NO: 388802 - DNA, 34 bp, Artificial Sequence; identical to SEQ ID NO: 51735
  Description of Artificial Sequence: Synthetic oligonucleotide

SEQ ID NO: 388803 - DNA, 33 bp, Artificial Sequence; identical to SEQ ID NO: 51736
  Description of Artificial Sequence: Synthetic oligonucleotide

SEQ ID NO: 388804 - DNA, 32 bp, Artificial Sequence; identical to SEQ ID NO: 51737
  Description of Artificial Sequence: Synthetic oligonucleotide

SEQ ID NO: 388805 - DNA, 32 bp, Artificial Sequence; identical to SEQ ID NO: 51738
  Description of Artificial Sequence: Synthetic oligonucleotide

SEQ ID NO: 388806 - DNA, 31 bp, Artificial Sequence; identical to SEQ ID NO: 51739
  Description of Artificial Sequence: Synthetic oligonucleotide

SEQ ID NO: 388807 - DNA, 30 bp, Artificial Sequence; identical to SEQ ID NO: 51740
  Description of Artificial Sequence: Synthetic oligonucleotide

SEQ ID NO: 388808 - DNA, 33 bp, Artificial Sequence; identical to SEQ ID NO: 51741
  Description of Artificial Sequence: Synthetic oligonucleotide

SEQ ID NO: 388809 - DNA, 32 bp, Artificial Sequence; identical to SEQ ID NO: 51742
  Description of Artificial Sequence: Synthetic oligonucleotide

SEQ ID NO: 388810 - DNA, 37 bp, Artificial Sequence; identical to SEQ ID NO: 51743
  Description of Artificial Sequence: Synthetic oligonucleotide

SEQ ID NO: 388811 - DNA, 36 bp, Artificial Sequence; identical to SEQ ID NO: 51744
  Description of Artificial Sequence: Synthetic oligonucleotide

SEQ ID NO: 388812 - DNA, 38 bp, Artificial Sequence; identical to SEQ ID NO: 51745
  Description of Artificial Sequence: Synthetic oligonucleotide

SEQ ID NO: 388813 - DNA, 40 bp, Artificial Sequence; identical to SEQ ID NO: 51746
  Description of Artificial Sequence: Synthetic oligonucleotide

SEQ ID NO: 388814 - DNA, 42 bp, Artificial Sequence; identical to SEQ ID NO: 51747
  Description of Artificial Sequence: Synthetic oligonucleotide

SEQ ID NO: 388815 - DNA, 41 bp, Artificial Sequence; identical to SEQ ID NO: 51748
  Description of Artificial Sequence: Synthetic oligonucleotide

SEQ ID NO: 388816 - DNA, 40 bp, Artificial Sequence; identical to SEQ ID NO: 51749
  Description of Artificial Sequence: Synthetic oligonucleotide

SEQ ID NO: 388817 - DNA, 39 bp, Artificial Sequence; identical to SEQ ID NO: 51750
  Description of Artificial Sequence: Synthetic oligonucleotide

SEQ ID NO: 388818 - DNA, 40 bp, Artificial Sequence; identical to SEQ ID NO: 51751
  Description of Artificial Sequence: Synthetic oligonucleotide

SEQ ID NO: 388819 - DNA, 39 bp, Artificial Sequence; identical to SEQ ID NO: 51752
  Description of Artificial Sequence: Synthetic oligonucleotide

SEQ ID NO: 388820 - DNA, 41 bp, Artificial Sequence; identical to SEQ ID NO: 51753
  Description of Artificial Sequence: Synthetic oligonucleotide

SEQ ID NO: 388821 - DNA, 43 bp, Artificial Sequence; identical to SEQ ID NO: 51754
  Description of Artificial Sequence: Synthetic oligonucleotide

SEQ ID NO: 388822 - DNA, 42 bp, Artificial Sequence; identical to SEQ ID NO: 51755
  Description of Artificial Sequence: Synthetic oligonucleotide

SEQ ID NO: 388823 - DNA, 41 bp, Artificial Sequence; identical to SEQ ID NO: 51756
  Description of Artificial Sequence: Synthetic oligonucleotide

SEQ ID NO: 388824 - DNA, 44 bp, Artificial Sequence; identical to SEQ ID NO: 51757
  Description of Artificial Sequence: Synthetic oligonucleotide

SEQ ID NO: 388825 - DNA, 43 bp, Artificial Sequence; identical to SEQ ID NO: 51758
  Description of Artificial Sequence: Synthetic oligonucleotide

SEQ ID NO: 388826 - DNA, 44 bp, Artificial Sequence; identical to SEQ ID NO: 51759
  Description of Artificial Sequence: Synthetic oligonucleotide

SEQ ID NO: 388827 - DNA, 44 bp, Artificial Sequence; identical to SEQ ID NO: 51760
  Description of Artificial Sequence: Synthetic oligonucleotide

SEQ ID NO: 388828 - DNA, 46 bp, Artificial Sequence; identical to SEQ ID NO: 51761
  Description of Artificial Sequence: Synthetic oligonucleotide

SEQ ID NO: 388829 - DNA, 47 bp, Artificial Sequence; identical to SEQ ID NO: 51762
  Description of Artificial Sequence: Synthetic oligonucleotide

SEQ ID NO: 388830 - DNA, 46 bp, Artificial Sequence; identical to SEQ ID NO: 51763
  Description of Artificial Sequence: Synthetic oligonucleotide

SEQ ID NO: 388831 - DNA, 46 bp, Artificial Sequence; identical to SEQ ID NO: 51764
  Description of Artificial Sequence: Synthetic oligonucleotide

SEQ ID NO: 388832 - DNA, 45 bp, Artificial Sequence; identical to SEQ ID NO: 51765
  Description of Artificial Sequence: Synthetic oligonucleotide

SEQ ID NO: 388833 - DNA, 44 bp, Artificial Sequence; identical to SEQ ID NO: 51766
  Description of Artificial Sequence: Synthetic oligonucleotide

SEQ ID NO: 388834 - DNA, 43 bp, Artificial Sequence; identical to SEQ ID NO: 51767
  Description of Artificial Sequence: Synthetic oligonucleotide

SEQ ID NO: 388835 - DNA, 42 bp, Artificial Sequence; identical to SEQ ID NO: 51768
  Description of Artificial Sequence: Synthetic oligonucleotide

SEQ ID NO: 388836 - DNA, 30 bp, Artificial Sequence; identical to SEQ ID NO: 51769
  Description of Artificial Sequence: Synthetic oligonucleotide

SEQ ID NO: 388837 - DNA, 29 bp, Artificial Sequence
  Description of Artificial Sequence: Synthetic oligonucleotide
ggatctggacaagaaggagaccgtctgtc

SEQ ID NO: 388838 - DNA, 31 bp, Artificial Sequence; identical to SEQ ID NO: 51771
  Description of Artificial Sequence: Synthetic oligonucleotide

SEQ ID NO: 388839 - DNA, 32 bp, Artificial Sequence; identical to SEQ ID NO: 51772
  Description of Artificial Sequence: Synthetic oligonucleotide

SEQ ID NO: 388840 - DNA, 31 bp, Artificial Sequence; identical to SEQ ID NO: 51773
  Description of Artificial Sequence: Synthetic oligonucleotide

SEQ ID NO: 388841 - DNA, 30 bp, Artificial Sequence; identical to SEQ ID NO: 51774
  Description of Artificial Sequence: Synthetic oligonucleotide

SEQ ID NO: 388842 - DNA, 30 bp, Artificial Sequence; identical to SEQ ID NO: 51775
  Description of Artificial Sequence: Synthetic oligonucleotide

SEQ ID NO: 388843 - DNA, 29 bp, Artificial Sequence
  Description of Artificial Sequence: Synthetic oligonucleotide
ggacaagaaggagaccgtctgtcatctgg

SEQ ID NO: 388844 - DNA, 30 bp, Artificial Sequence; identical to SEQ ID NO: 51777
  Description of Artificial Sequence: Synthetic oligonucleotide

SEQ ID NO: 388845 - DNA, 30 bp, Artificial Sequence; identical to SEQ ID NO: 51778
  Description of Artificial Sequence: Synthetic oligonucleotide

SEQ ID NO: 388846 - DNA, 29 bp, Artificial Sequence
  Description of Artificial Sequence: Synthetic oligonucleotide
caagaaggagaccgtctgtcatctggagg

SEQ ID NO: 388847 - DNA, 30 bp, Artificial Sequence; identical to SEQ ID NO: 51780
  Description of Artificial Sequence: Synthetic oligonucleotide

SEQ ID NO: 388848 - DNA, 29 bp, Artificial Sequence
  Description of Artificial Sequence: Synthetic oligonucleotide
agaaggagaccgtctgtcatctggaggag

SEQ ID NO: 388849 - DNA, 28 bp, Artificial Sequence
  Description of Artificial Sequence: Synthetic oligonucleotide
gaaggagaccgtctgtcatctggaggag

SEQ ID NO: 388850 - DNA, 31 bp, Artificial Sequence; identical to SEQ ID NO: 51783
  Description of Artificial Sequence: Synthetic oligonucleotide

SEQ ID NO: 388851 - DNA, 30 bp, Artificial Sequence; identical to SEQ ID NO: 51784
  Description of Artificial Sequence: Synthetic oligonucleotide

SEQ ID NO: 388852 - DNA, 29 bp, Artificial Sequence
  Description of Artificial Sequence: Synthetic oligonucleotide
ggagaccgtctgtcatctggaggagtttg

SEQ ID NO: 388853 - DNA, 29 bp, Artificial Sequence
  Description of Artificial Sequence: Synthetic oligonucleotide
gagaccgtctgtcatctggaggagtttgg

SEQ ID NO: 388854 - DNA, 29 bp, Artificial Sequence
  Description of Artificial Sequence: Synthetic oligonucleotide
agaccgtctgtcatctggaggagtttggc

SEQ ID NO: 388855 - DNA, 28 bp, Artificial Sequence
  Description of Artificial Sequence: Synthetic oligonucleotide
gaccgtctgtcatctggaggagtttggc

SEQ ID NO: 388856 - DNA, 28 bp, Artificial Sequence
  Description of Artificial Sequence: Synthetic oligonucleotide
accgtctgtcatctggaggagtttggcc

SEQ ID NO: 388857 - DNA, 27 bp, Artificial Sequence
  Description of Artificial Sequence: Synthetic oligonucleotide
ccgtctgtcatctggaggagtttggcc

SEQ ID NO: 388858 - DNA, 29 bp, Artificial Sequence
  Description of Artificial Sequence: Synthetic oligonucleotide
cgtctgtcatctggaggagtttggccaag

SEQ ID NO: 388859 - DNA, 29 bp, Artificial Sequence
  Description of Artificial Sequence: Synthetic oligonucleotide
gtctgtcatctggaggagtttggccaagc

SEQ ID NO: 388860 - DNA, 29 bp, Artificial Sequence
  Description of Artificial Sequence: Synthetic oligonucleotide
tctgtcatctggaggagtttggccaagcc

SEQ ID NO: 388861 - DNA, 28 bp, Artificial Sequence
  Description of Artificial Sequence: Synthetic oligonucleotide
ctgtcatctggaggagtttggccaagcc

SEQ ID NO: 388862 - DNA, 32 bp, Artificial Sequence; identical to SEQ ID NO: 51795
  Description of Artificial Sequence: Synthetic oligonucleotide

SEQ ID NO: 388863 - DNA, 31 bp, Artificial Sequence; identical to SEQ ID NO: 51796
  Description of Artificial Sequence: Synthetic oligonucleotide

SEQ ID NO: 388864 - DNA, 31 bp, Artificial Sequence; identical to SEQ ID NO: 51797
  Description of Artificial Sequence: Synthetic oligonucleotide

SEQ ID NO: 388865 - DNA, 27 bp, Artificial Sequence
  Description of Artificial Sequence: Synthetic oligonucleotide
gttccaaccacactcaggccgccaatg

SEQ ID NO: 388866 - DNA, 29 bp, Artificial Sequence
  Description of Artificial Sequence: Synthetic oligonucleotide
ttccaaccacactcaggccgccaatgatc

SEQ ID NO: 388867 - DNA, 28 bp, Artificial Sequence
  Description of Artificial Sequence: Synthetic oligonucleotide
tccaaccacactcaggccgccaatgatc

SEQ ID NO: 388868 - DNA, 27 bp, Artificial Sequence
  Description of Artificial Sequence: Synthetic oligonucleotide
ccaaccacactcaggccgccaatgatc

SEQ ID NO: 388869 - DNA, 27 bp, Artificial Sequence
  Description of Artificial Sequence: Synthetic oligonucleotide
caaccacactcaggccgccaatgatcc

SEQ ID NO: 388870 - DNA, 27 bp, Artificial Sequence
  Description of Artificial Sequence: Synthetic oligonucleotide
aaccacactcaggccgccaatgatccc

SEQ ID NO: 388871 - DNA, 26 bp, Artificial Sequence
  Description of Artificial Sequence: Synthetic oligonucleotide
accacactcaggccgccaatgatccc

SEQ ID NO: 388872 - DNA, 25 bp, Artificial Sequence
  Description of Artificial Sequence: Synthetic oligonucleotide
ccacactcaggccgccaatgatccc

SEQ ID NO: 388873 - DNA, 25 bp, Artificial Sequence
  Description of Artificial Sequence: Synthetic oligonucleotide
cacactcaggccgccaatgatcccc

SEQ ID NO: 388874 - DNA, 26 bp, Artificial Sequence
  Description of Artificial Sequence: Synthetic oligonucleotide
acactcaggccgccaatgatccccct

SEQ ID NO: 388875 - DNA, 25 bp, Artificial Sequence
  Description of Artificial Sequence: Synthetic oligonucleotide
cactcaggccgccaatgatccccct

SEQ ID NO: 388876 - DNA, 26 bp, Artificial Sequence
  Description of Artificial Sequence: Synthetic oligonucleotide
actcaggccgccaatgatccccctga

SEQ ID NO: 388877 - DNA, 25 bp, Artificial Sequence
  Description of Artificial Sequence: Synthetic oligonucleotide
ctcaggccgccaatgatccccctga

SEQ ID NO: 388878 - DNA, 25 bp, Artificial Sequence
  Description of Artificial Sequence: Synthetic oligonucleotide
tcaggccgccaatgatccccctgag

SEQ ID NO: 388879 - DNA, 24 bp, Artificial Sequence
  Description of Artificial Sequence: Synthetic oligonucleotide
caggccgccaatgatccccctgag

SEQ ID NO: 388880 - DNA, 25 bp, Artificial Sequence
  Description of Artificial Sequence: Synthetic oligonucleotide
aggccgccaatgatccccctgaggt

SEQ ID NO: 388881 - DNA, 24 bp, Artificial Sequence
  Description of Artificial Sequence: Synthetic oligonucleotide
ggccgccaatgatccccctgaggt

SEQ ID NO: 388882 - DNA, 25 bp, Artificial Sequence
  Description of Artificial Sequence: Synthetic oligonucleotide
gccgccaatgatccccctgaggtga

SEQ ID NO: 388883 - DNA, 25 bp, Artificial Sequence
  Description of Artificial Sequence: Synthetic oligonucleotide
ccgccaatgatccccctgaggtgac

SEQ ID NO: 388884 - DNA, 25 bp, Artificial Sequence
  Description of Artificial Sequence: Synthetic oligonucleotide
cgccaatgatccccctgaggtgacc

SEQ ID NO: 388885 - DNA, 26 bp, Artificial Sequence
  Description of Artificial Sequence: Synthetic oligonucleotide
gccaatgatccccctgaggtgaccgt

SEQ ID NO: 388886 - DNA, 27 bp, Artificial Sequence
  Description of Artificial Sequence: Synthetic oligonucleotide
ccaatgatccccctgaggtgaccgtgt

SEQ ID NO: 388887 - DNA, 29 bp, Artificial Sequence
  Description of Artificial Sequence: Synthetic oligonucleotide
caatgatccccctgaggtgaccgtgtttc

SEQ ID NO: 388888 - DNA, 29 bp, Artificial Sequence
  Description of Artificial Sequence: Synthetic oligonucleotide
aatgatccccctgaggtgaccgtgtttcc

SEQ ID NO: 388889 - DNA, 28 bp, Artificial Sequence
  Description of Artificial Sequence: Synthetic oligonucleotide
atgatccccctgaggtgaccgtgtttcc

SEQ ID NO: 388890 - DNA, 27 bp, Artificial Sequence
  Description of Artificial Sequence: Synthetic oligonucleotide
tgatccccctgaggtgaccgtgtttcc

SEQ ID NO: 388891 - DNA, 29 bp, Artificial Sequence
  Description of Artificial Sequence: Synthetic oligonucleotide
cccaacaccctcatctgccacattgacag

SEQ ID NO: 388892 - DNA, 29 bp, Artificial Sequence
  Description of Artificial Sequence: Synthetic oligonucleotide
ccaacaccctcatctgccacattgacagg

SEQ ID NO: 388893 - DNA, 31 bp, Artificial Sequence; identical to SEQ ID NO: 51826
  Description of Artificial Sequence: Synthetic oligonucleotide

SEQ ID NO: 388894 - DNA, 33 bp, Artificial Sequence; identical to SEQ ID NO: 51827
  Description of Artificial Sequence: Synthetic oligonucleotide

SEQ ID NO: 388895 - DNA, 32 bp, Artificial Sequence; identical to SEQ ID NO: 51828
  Description of Artificial Sequence: Synthetic oligonucleotide

SEQ ID NO: 388896 - DNA, 31 bp, Artificial Sequence; identical to SEQ ID NO: 51829
  Description of Artificial Sequence: Synthetic oligonucleotide

SEQ ID NO: 388897 - DNA, 31 bp, Artificial Sequence; identical to SEQ ID NO: 51830
  Description of Artificial Sequence: Synthetic oligonucleotide

SEQ ID NO: 388898 - DNA, 30 bp, Artificial Sequence; identical to SEQ ID NO: 51831
  Description of Artificial Sequence: Synthetic oligonucleotide

SEQ ID NO: 388899 - DNA, 30 bp, Artificial Sequence; identical to SEQ ID NO: 51832
  Description of Artificial Sequence: Synthetic oligonucleotide

SEQ ID NO: 388900 - DNA, 31 bp, Artificial Sequence; identical to SEQ ID NO: 51833
  Description of Artificial Sequence: Synthetic oligonucleotide

SEQ ID NO: 388901 - DNA, 31 bp, Artificial Sequence; identical to SEQ ID NO: 51834
  Description of Artificial Sequence: Synthetic oligonucleotide

SEQ ID NO: 388902 - DNA, 30 bp, Artificial Sequence; identical to SEQ ID NO: 51835
  Description of Artificial Sequence: Synthetic oligonucleotide

SEQ ID NO: 388903 - DNA, 31 bp, Artificial Sequence; identical to SEQ ID NO: 51836
  Description of Artificial Sequence: Synthetic oligonucleotide

SEQ ID NO: 388904 - DNA, 30 bp, Artificial Sequence; identical to SEQ ID NO: 51837
  Description of Artificial Sequence: Synthetic oligonucleotide

SEQ ID NO: 388905 - DNA, 29 bp, Artificial Sequence
  Description of Artificial Sequence: Synthetic oligonucleotide
ctgccacattgacaggttcttcccaccag

SEQ ID NO: 388906 - DNA, 30 bp, Artificial Sequence; identical to SEQ ID NO: 51839
  Description of Artificial Sequence: Synthetic oligonucleotide

SEQ ID NO: 388907 - DNA, 29 bp, Artificial Sequence
  Description of Artificial Sequence: Synthetic oligonucleotide
gccacattgacaggttcttcccaccagtg

SEQ ID NO: 388908 - DNA, 29 bp, Artificial Sequence
  Description of Artificial Sequence: Synthetic oligonucleotide
ccacattgacaggttcttcccaccagtgc

SEQ ID NO: 388909 - DNA, 30 bp, Artificial Sequence; identical to SEQ ID NO: 51842
  Description of Artificial Sequence: Synthetic oligonucleotide

SEQ ID NO: 388910 - DNA, 32 bp, Artificial Sequence; identical to SEQ ID NO: 51843
  Description of Artificial Sequence: Synthetic oligonucleotide

SEQ ID NO: 388911 - DNA, 31 bp, Artificial Sequence; identical to SEQ ID NO: 51844
  Description of Artificial Sequence: Synthetic oligonucleotide

SEQ ID NO: 388912 - DNA, 31 bp, Artificial Sequence; identical to SEQ ID NO: 51845
  Description of Artificial Sequence: Synthetic oligonucleotide

SEQ ID NO: 388913 - DNA, 30 bp, Artificial Sequence; identical to SEQ ID NO: 51846
  Description of Artificial Sequence: Synthetic oligonucleotide

SEQ ID NO: 388914 - DNA, 29 bp, Artificial Sequence
  Description of Artificial Sequence: Synthetic oligonucleotide
tgacaggttcttcccaccagtgctcaacg

SEQ ID NO: 388915 - DNA, 28 bp, Artificial Sequence
  Description of Artificial Sequence: Synthetic oligonucleotide
gacaggttcttcccaccagtgctcaacg

SEQ ID NO: 388916 - DNA, 29 bp, Artificial Sequence
  Description of Artificial Sequence: Synthetic oligonucleotide
acaggttcttcccaccagtgctcaacgtc

SEQ ID NO: 388917 - DNA, 28 bp, Artificial Sequence
  Description of Artificial Sequence: Synthetic oligonucleotide
caggttcttcccaccagtgctcaacgtc

SEQ ID NO: 388918 - DNA, 29 bp, Artificial Sequence
  Description of Artificial Sequence: Synthetic oligonucleotide
aggttcttcccaccagtgctcaacgtcac

SEQ ID NO: 388919 - DNA, 28 bp, Artificial Sequence
  Description of Artificial Sequence: Synthetic oligonucleotide
ggttcttcccaccagtgctcaacgtcac

SEQ ID NO: 388920 - DNA, 30 bp, Artificial Sequence; identical to SEQ ID NO: 51853
  Description of Artificial Sequence: Synthetic oligonucleotide

SEQ ID NO: 388921 - DNA, 30 bp, Artificial Sequence; identical to SEQ ID NO: 51854
  Description of Artificial Sequence: Synthetic oligonucleotide

SEQ ID NO: 388922 - DNA, 29 bp, Artificial Sequence
  Description of Artificial Sequence: Synthetic oligonucleotide
tcttcccaccagtgctcaacgtcacatgg

SEQ ID NO: 388923 - DNA, 28 bp, Artificial Sequence
  Description of Artificial Sequence: Synthetic oligonucleotide
cttcccaccagtgctcaacgtcacatgg

SEQ ID NO: 388924 - DNA, 28 bp, Artificial Sequence
  Description of Artificial Sequence: Synthetic oligonucleotide
ttcccaccagtgctcaacgtcacatggc

SEQ ID NO: 388925 - DNA, 27 bp, Artificial Sequence
  Description of Artificial Sequence: Synthetic oligonucleotide
tcccaccagtgctcaacgtcacatggc

SEQ ID NO: 388926 - DNA, 27 bp, Artificial Sequence
  Description of Artificial Sequence: Synthetic oligonucleotide
cccaccagtgctcaacgtcacatggct

SEQ ID NO: 388927 - DNA, 27 bp, Artificial Sequence
  Description of Artificial Sequence: Synthetic oligonucleotide
ccaccagtgctcaacgtcacatggctg

SEQ ID NO: 388928 - DNA, 28 bp, Artificial Sequence
  Description of Artificial Sequence: Synthetic oligonucleotide
caccagtgctcaacgtcacatggctgtg

SEQ ID NO: 388929 - DNA, 28 bp, Artificial Sequence
  Description of Artificial Sequence: Synthetic oligonucleotide
accagtgctcaacgtcacatggctgtgc

SEQ ID NO: 388930 - DNA, 27 bp, Artificial Sequence
  Description of Artificial Sequence: Synthetic oligonucleotide
ccagtgctcaacgtcacatggctgtgc

SEQ ID NO: 388931 - DNA, 30 bp, Artificial Sequence; identical to SEQ ID NO: 51864
  Description of Artificial Sequence: Synthetic oligonucleotide

SEQ ID NO: 388932 - DNA, 30 bp, Artificial Sequence; identical to SEQ ID NO: 51865
  Description of Artificial Sequence: Synthetic oligonucleotide

SEQ ID NO: 388933 - DNA, 29 bp, Artificial Sequence
  Description of Artificial Sequence: Synthetic oligonucleotide
gtgctcaacgtcacatggctgtgcaatgg

SEQ ID NO: 388934 - DNA, 29 bp, Artificial Sequence
  Description of Artificial Sequence: Synthetic oligonucleotide
tgctcaacgtcacatggctgtgcaatggg

SEQ ID NO: 388935 - DNA, 28 bp, Artificial Sequence
  Description of Artificial Sequence: Synthetic oligonucleotide
gctcaacgtcacatggctgtgcaatggg

SEQ ID NO: 388936 - DNA, 28 bp, Artificial Sequence
  Description of Artificial Sequence: Synthetic oligonucleotide
ctcaacgtcacatggctgtgcaatgggg

SEQ ID NO: 388937 - DNA, 29 bp, Artificial Sequence
  Description of Artificial Sequence: Synthetic oligonucleotide
tcaacgtcacatggctgtgcaatggggag

SEQ ID NO: 388938 - DNA, 28 bp, Artificial Sequence
  Description of Artificial Sequence: Synthetic oligonucleotide
caacgtcacatggctgtgcaatggggag

SEQ ID NO: 388939 - DNA, 28 bp, Artificial Sequence
  Description of Artificial Sequence: Synthetic oligonucleotide
aacgtcacatggctgtgcaatggggagc

SEQ ID NO: 388940 - DNA, 27 bp, Artificial Sequence
  Description of Artificial Sequence: Synthetic oligonucleotide
acgtcacatggctgtgcaatggggagc

SEQ ID NO: 388941 - DNA, 26 bp, Artificial Sequence
  Description of Artificial Sequence: Synthetic oligonucleotide
cgtcacatggctgtgcaatggggagc

SEQ ID NO: 388942 - DNA, 27 bp, Artificial Sequence
  Description of Artificial Sequence: Synthetic oligonucleotide
gtcacatggctgtgcaatggggagcca

SEQ ID NO: 388943 - DNA, 27 bp, Artificial Sequence
  Description of Artificial Sequence: Synthetic oligonucleotide
tcacatggctgtgcaatggggagccag

SEQ ID NO: 388944 - DNA, 27 bp, Artificial Sequence
  Description of Artificial Sequence: Synthetic oligonucleotide
cacatggctgtgcaatggggagccagt

SEQ ID NO: 388945 - DNA, 27 bp, Artificial Sequence
  Description of Artificial Sequence: Synthetic oligonucleotide
acatggctgtgcaatggggagccagtc

SEQ ID NO: 388946 - DNA, 27 bp, Artificial Sequence
  Description of Artificial Sequence: Synthetic oligonucleotide
catggctgtgcaatggggagccagtca

SEQ ID NO: 388947 - DNA, 27 bp, Artificial Sequence
  Description of Artificial Sequence: Synthetic oligonucleotide
atggctgtgcaatggggagccagtcac

SEQ ID NO: 388948 - DNA, 27 bp, Artificial Sequence
  Description of Artificial Sequence: Synthetic oligonucleotide
tggctgtgcaatggggagccagtcact

SEQ ID NO: 388949 - DNA, 26 bp, Artificial Sequence
  Description of Artificial Sequence: Synthetic oligonucleotide
ggctgtgcaatggggagccagtcact

SEQ ID NO: 388950 - DNA, 27 bp, Artificial Sequence
  Description of Artificial Sequence: Synthetic oligonucleotide
gctgtgcaatggggagccagtcactga

SEQ ID NO: 388951 - DNA, 27 bp, Artificial Sequence
  Description of Artificial Sequence: Synthetic oligonucleotide
ctgtgcaatggggagccagtcactgag

SEQ ID NO: 388952 - DNA, 27 bp, Artificial Sequence
  Description of Artificial Sequence: Synthetic oligonucleotide
tgtgcaatggggagccagtcactgagg

SEQ ID NO: 388953 - DNA, 26 bp, Artificial Sequence
  Description of Artificial Sequence: Synthetic oligonucleotide
gtgcaatggggagccagtcactgagg

SEQ ID NO: 388954 - DNA, 27 bp, Artificial Sequence
  Description of Artificial Sequence: Synthetic oligonucleotide
tgcaatggggagccagtcactgagggt

SEQ ID NO: 388955 - DNA, 26 bp, Artificial Sequence
  Description of Artificial Sequence: Synthetic oligonucleotide
gcaatggggagccagtcactgagggt

SEQ ID NO: 388956 - DNA, 27 bp, Artificial Sequence
  Description of Artificial Sequence: Synthetic oligonucleotide
caatggggagccagtcactgagggtgt

SEQ ID NO: 388957 - DNA, 27 bp, Artificial Sequence
  Description of Artificial Sequence: Synthetic oligonucleotide
aatggggagccagtcactgagggtgtc

SEQ ID NO: 388958 - DNA, 26 bp, Artificial Sequence
  Description of Artificial Sequence: Synthetic oligonucleotide
atggggagccagtcactgagggtgtc

SEQ ID NO: 388959 - DNA, 25 bp, Artificial Sequence
  Description of Artificial Sequence: Synthetic oligonucleotide
tggggagccagtcactgagggtgtc

SEQ ID NO: 388960 - DNA, 24 bp, Artificial Sequence
  Description of Artificial Sequence: Synthetic oligonucleotide
ggggagccagtcactgagggtgtc

SEQ ID NO: 388961 - DNA, 24 bp, Artificial Sequence
  Description of Artificial Sequence: Synthetic oligonucleotide
gggagccagtcactgagggtgtcg

SEQ ID NO: 388962 - DNA, 25 bp, Artificial Sequence
  Description of Artificial Sequence: Synthetic oligonucleotide
ggagccagtcactgagggtgtcgct

SEQ ID NO: 388963 - DNA, 26 bp, Artificial Sequence
  Description of Artificial Sequence: Synthetic oligonucleotide
gagccagtcactgagggtgtcgctga

SEQ ID NO: 388964 - DNA, 27 bp, Artificial Sequence
  Description of Artificial Sequence: Synthetic oligonucleotide
agccagtcactgagggtgtcgctgaga

SEQ ID NO: 388965 - DNA, 26 bp, Artificial Sequence
  Description of Artificial Sequence: Synthetic oligonucleotide
gccagtcactgagggtgtcgctgaga

SEQ ID NO: 388966 - DNA, 26 bp, Artificial Sequence
  Description of Artificial Sequence: Synthetic oligonucleotide
ccagtcactgagggtgtcgctgagag

SEQ ID NO: 388967 - DNA, 26 bp, Artificial Sequence
  Description of Artificial Sequence: Synthetic oligonucleotide
cagtcactgagggtgtcgctgagagc

SEQ ID NO: 388968 - DNA, 27 bp, Artificial Sequence
  Description of Artificial Sequence: Synthetic oligonucleotide
agtcactgagggtgtcgctgagagcct

SEQ ID NO: 388969 - DNA, 27 bp, Artificial Sequence
  Description of Artificial Sequence: Synthetic oligonucleotide
tgacctttgtgccctcagcagaggacg

SEQ ID NO: 388970 - DNA, 27 bp, Artificial Sequence
  Description of Artificial Sequence: Synthetic oligonucleotide
gacctttgtgccctcagcagaggacgt

SEQ ID NO: 388971 - DNA, 27 bp, Artificial Sequence
  Description of Artificial Sequence: Synthetic oligonucleotide
acctttgtgccctcagcagaggacgtc

SEQ ID NO: 388972 - DNA, 27 bp, Artificial Sequence
  Description of Artificial Sequence: Synthetic oligonucleotide
cctttgtgccctcagcagaggacgtct

SEQ ID NO: 388973 - DNA, 29 bp, Artificial Sequence
  Description of Artificial Sequence: Synthetic oligonucleotide
ctttgtgccctcagcagaggacgtctatg

SEQ ID NO: 388974 - DNA, 30 bp, Artificial Sequence; identical to SEQ ID NO: 51907
  Description of Artificial Sequence: Synthetic oligonucleotide

SEQ ID NO: 388975 - DNA, 29 bp, Artificial Sequence
  Description of Artificial Sequence: Synthetic oligonucleotide
ttgtgccctcagcagaggacgtctatgac

SEQ ID NO: 388976 - DNA, 28 bp, Artificial Sequence
  Description of Artificial Sequence: Synthetic oligonucleotide
tgtgccctcagcagaggacgtctatgac

SEQ ID NO: 388977 - DNA, 27 bp, Artificial Sequence
  Description of Artificial Sequence: Synthetic oligonucleotide
gtgccctcagcagaggacgtctatgac

SEQ ID NO: 388978 - DNA, 28 bp, Artificial Sequence
  Description of Artificial Sequence: Synthetic oligonucleotide
tgccctcagcagaggacgtctatgactg

SEQ ID NO: 388979 - DNA, 27 bp, Artificial Sequence
  Description of Artificial Sequence: Synthetic oligonucleotide
gccctcagcagaggacgtctatgactg

SEQ ID NO: 388980 - DNA, 27 bp, Artificial Sequence
  Description of Artificial Sequence: Synthetic oligonucleotide
ccctcagcagaggacgtctatgactgc

SEQ ID NO: 388981 - DNA, 28 bp, Artificial Sequence
  Description of Artificial Sequence: Synthetic oligonucleotide
cctcagcagaggacgtctatgactgcag

SEQ ID NO: 388982 - DNA, 28 bp, Artificial Sequence
  Description of Artificial Sequence: Synthetic oligonucleotide
ctcagcagaggacgtctatgactgcagg

SEQ ID NO: 388983 - DNA, 28 bp, Artificial Sequence
  Description of Artificial Sequence: Synthetic oligonucleotide
tcagcagaggacgtctatgactgcaggg

SEQ ID NO: 388984 - DNA, 27 bp, Artificial Sequence
  Description of Artificial Sequence: Synthetic oligonucleotide
cagcagaggacgtctatgactgcaggg

SEQ ID NO: 388985 - DNA, 28 bp, Artificial Sequence
  Description of Artificial Sequence: Synthetic oligonucleotide
agcagaggacgtctatgactgcagggtg

SEQ ID NO: 388986 - DNA, 27 bp, Artificial Sequence
  Description of Artificial Sequence: Synthetic oligonucleotide
gcagaggacgtctatgactgcagggtg

SEQ ID NO: 388987 - DNA, 27 bp, Artificial Sequence
  Description of Artificial Sequence: Synthetic oligonucleotide
cagaggacgtctatgactgcagggtgg

SEQ ID NO: 388988 - DNA, 28 bp, Artificial Sequence
  Description of Artificial Sequence: Synthetic oligonucleotide
agaggacgtctatgactgcagggtggag

SEQ ID NO: 388989 - DNA, 27 bp, Artificial Sequence
  Description of Artificial Sequence: Synthetic oligonucleotide
gaggacgtctatgactgcagggtggag

SEQ ID NO: 388990 - DNA, 27 bp, Artificial Sequence
  Description of Artificial Sequence: Synthetic oligonucleotide
aggacgtctatgactgcagggtggagc

SEQ ID NO: 388991 - DNA, 27 bp, Artificial Sequence
  Description of Artificial Sequence: Synthetic oligonucleotide
ggacgtctatgactgcagggtggagca

SEQ ID NO: 388992 - DNA, 27 bp, Artificial Sequence
  Description of Artificial Sequence: Synthetic oligonucleotide
gacgtctatgactgcagggtggagcac

SEQ ID NO: 388993 - DNA, 28 bp, Artificial Sequence
  Description of Artificial Sequence: Synthetic oligonucleotide
acgtctatgactgcagggtggagcactg

SEQ ID NO: 388994 - DNA, 27 bp, Artificial Sequence
  Description of Artificial Sequence: Synthetic oligonucleotide
cgtctatgactgcagggtggagcactg

SEQ ID NO: 388995 - DNA, 27 bp, Artificial Sequence
  Description of Artificial Sequence: Synthetic oligonucleotide
gtctatgactgcagggtggagcactgg

SEQ ID NO: 388996 - DNA, 23 bp, Artificial Sequence
  Description of Artificial Sequence: Synthetic oligonucleotide
tgggcctggtgctgggcctagtg

SEQ ID NO: 388997 - DNA, 22 bp, Artificial Sequence
  Description of Artificial Sequence: Synthetic oligonucleotide
gggcctggtgctgggcctagtg

SEQ ID NO: 388998 - DNA, 22 bp, Artificial Sequence
  Description of Artificial Sequence: Synthetic oligonucleotide
ggcctggtgctgggcctagtgg

SEQ ID NO: 388999 - DNA, 22 bp, Artificial Sequence
  Description of Artificial Sequence: Synthetic oligonucleotide
gcctggtgctgggcctagtggg

SEQ ID NO: 389000 - DNA, 24 bp, Artificial Sequence
  Description of Artificial Sequence: Synthetic oligonucleotide
cctggtgctgggcctagtgggcat

SEQ ID NO: 389001 - DNA, 26 bp, Artificial Sequence
  Description of Artificial Sequence: Synthetic oligonucleotide
ctggtgctgggcctagtgggcatcat

SEQ ID NO: 389002 - DNA, 26 bp, Artificial Sequence
  Description of Artificial Sequence: Synthetic oligonucleotide
tggtgctgggcctagtgggcatcatc

SEQ ID NO: 389003 - DNA, 25 bp, Artificial Sequence
  Description of Artificial Sequence: Synthetic oligonucleotide
ggtgctgggcctagtgggcatcatc

SEQ ID NO: 389004 - DNA, 26 bp, Artificial Sequence
  Description of Artificial Sequence: Synthetic oligonucleotide
gtgctgggcctagtgggcatcatcgt

SEQ ID NO: 389005 - DNA, 26 bp, Artificial Sequence
  Description of Artificial Sequence: Synthetic oligonucleotide
tgctgggcctagtgggcatcatcgtg

SEQ ID NO: 389006 - DNA, 25 bp, Artificial Sequence
  Description of Artificial Sequence: Synthetic oligonucleotide
gctgggcctagtgggcatcatcgtg

SEQ ID NO: 389007 - DNA, 25 bp, Artificial Sequence
  Description of Artificial Sequence: Synthetic oligonucleotide
ctgggcctagtgggcatcatcgtgg

SEQ ID NO: 389008 - DNA, 25 bp, Artificial Sequence
  Description of Artificial Sequence: Synthetic oligonucleotide
tgggcctagtgggcatcatcgtggg

SEQ ID NO: 389009 - DNA, 24 bp, Artificial Sequence
  Description of Artificial Sequence: Synthetic oligonucleotide
gggcctagtgggcatcatcgtggg

SEQ ID NO: 389010 - DNA, 25 bp, Artificial Sequence
  Description of Artificial Sequence: Synthetic oligonucleotide
ggcctagtgggcatcatcgtgggca

SEQ ID NO: 389011 - DNA, 25 bp, Artificial Sequence
  Description of Artificial Sequence: Synthetic oligonucleotide
gcctagtgggcatcatcgtgggcac

SEQ ID NO: 389012 - DNA, 25 bp, Artificial Sequence
  Description of Artificial Sequence: Synthetic oligonucleotide
cctagtgggcatcatcgtgggcacc

SEQ ID NO: 389013 - DNA, 26 bp, Artificial Sequence
  Description of Artificial Sequence: Synthetic oligonucleotide
ctagtgggcatcatcgtgggcaccgt

SEQ ID NO: 389014 - DNA, 26 bp, Artificial Sequence
  Description of Artificial Sequence: Synthetic oligonucleotide
tagtgggcatcatcgtgggcaccgtc

SEQ ID NO: 389015 - DNA, 25 bp, Artificial Sequence
  Description of Artificial Sequence: Synthetic oligonucleotide
agtgggcatcatcgtgggcaccgtc

SEQ ID NO: 389016 - DNA, 24 bp, Artificial Sequence
  Description of Artificial Sequence: Synthetic oligonucleotide
gtgggcatcatcgtgggcaccgtc

SEQ ID NO: 389017 - DNA, 25 bp, Artificial Sequence
  Description of Artificial Sequence: Synthetic oligonucleotide
tgggcatcatcgtgggcaccgtcct

SEQ ID NO: 389018 - DNA, 24 bp, Artificial Sequence
  Description of Artificial Sequence: Synthetic oligonucleotide
gggcatcatcgtgggcaccgtcct

SEQ ID NO: 389019 - DNA, 20 bp, Artificial Sequence
  Description of Artificial Sequence: Synthetic oligonucleotide
atgacccccgggcccagggg

SEQ ID NO: 389020 - DNA, 20 bp, Artificial Sequence
  Description of Artificial Sequence: Synthetic oligonucleotide
tgacccccgggcccaggggt

SEQ ID NO: 389021 - DNA, 20 bp, Artificial Sequence
  Description of Artificial Sequence: Synthetic oligonucleotide
gacccccgggcccaggggtt

SEQ ID NO: 389022 - DNA, 20 bp, Artificial Sequence
  Description of Artificial Sequence: Synthetic oligonucleotide
acccccgggcccaggggctt

SEQ ID NO: 389023 - DNA, 20 bp, Artificial Sequence
  Description of Artificial Sequence: Synthetic oligonucleotide
cccccgggcccaggggcttt

SEQ ID NO: 389024 - DNA, 20 bp, Artificial Sequence
  Description of Artificial Sequence: Synthetic oligonucleotide
ccccgggcccaggggccttt

SEQ ID NO: 389025 - DNA, 20 bp, Artificial Sequence
  Description of Artificial Sequence: Synthetic oligonucleotide
cccgggcccaggggcccttt

SEQ ID NO: 389026 - DNA, 20 bp, Artificial Sequence
  Description of Artificial Sequence: Synthetic oligonucleotide
ccgggcccaggggccccttt

SEQ ID NO: 389027 - DNA, 20 bp, Artificial Sequence
  Description of Artificial Sequence: Synthetic oligonucleotide
cgggcccaggggcccctgtt

SEQ ID NO: 389028 - DNA, 20 bp, Artificial Sequence
  Description of Artificial Sequence: Synthetic oligonucleotide
gggcccaggggcccctgtga

SEQ ID NO: 389029 - DNA, 31 bp, Artificial Sequence; identical to SEQ ID NO: 51962
  Description of Artificial Sequence: Synthetic oligonucleotide

SEQ ID NO: 389030 - DNA, 32 bp, Artificial Sequence; identical to SEQ ID NO: 51963
  Description of Artificial Sequence: Synthetic oligonucleotide

SEQ ID NO: 389031 - DNA, 37 bp, Artificial Sequence; identical to SEQ ID NO: 51964
  Description of Artificial Sequence: Synthetic oligonucleotide

SEQ ID NO: 389032 - DNA, 40 bp, Artificial Sequence; identical to SEQ ID NO: 51965
  Description of Artificial Sequence: Synthetic oligonucleotide

SEQ ID NO: 389033 - DNA, 39 bp, Artificial Sequence; identical to SEQ ID NO: 51966
  Description of Artificial Sequence: Synthetic oligonucleotide

SEQ ID NO: 389034 - DNA, 38 bp, Artificial Sequence; identical to SEQ ID NO: 51967
  Description of Artificial Sequence: Synthetic oligonucleotide

SEQ ID NO: 389035 - DNA, 37 bp, Artificial Sequence; identical to SEQ ID NO: 51968
  Description of Artificial Sequence: Synthetic oligonucleotide

SEQ ID NO: 389036 - DNA, 42 bp, Artificial Sequence; identical to SEQ ID NO: 51969
  Description of Artificial Sequence: Synthetic oligonucleotide

SEQ ID NO: 389037 - DNA, 41 bp, Artificial Sequence; identical to SEQ ID NO: 51970
  Description of Artificial Sequence: Synthetic oligonucleotide

SEQ ID NO: 389038 - DNA, 40 bp, Artificial Sequence; identical to SEQ ID NO: 51971
  Description of Artificial Sequence: Synthetic oligonucleotide

SEQ ID NO: 389039 - DNA, 42 bp, Artificial Sequence; identical to SEQ ID NO: 51972
  Description of Artificial Sequence: Synthetic oligonucleotide

SEQ ID NO: 389040 - DNA, 41 bp, Artificial Sequence; identical to SEQ ID NO: 51973
  Description of Artificial Sequence: Synthetic oligonucleotide

SEQ ID NO: 389041 - DNA, 45 bp, Artificial Sequence; identical to SEQ ID NO: 51974
  Description of Artificial Sequence: Synthetic oligonucleotide

SEQ ID NO: 389042 - DNA, 44 bp, Artificial Sequence; identical to SEQ ID NO: 51975
  Description of Artificial Sequence: Synthetic oligonucleotide

SEQ ID NO: 389043 - DNA, 43 bp, Artificial Sequence; identical to SEQ ID NO: 51976
  Description of Artificial Sequence: Synthetic oligonucleotide

SEQ ID NO: 389044 - DNA, 42 bp, Artificial Sequence; identical to SEQ ID NO: 51977
  Description of Artificial Sequence: Synthetic oligonucleotide

SEQ ID NO: 389045 - DNA, 43 bp, Artificial Sequence; identical to SEQ ID NO: 51978
  Description of Artificial Sequence: Synthetic oligonucleotide

SEQ ID NO: 389046 - DNA, 42 bp, Artificial Sequence; identical to SEQ ID NO: 51979
  Description of Artificial Sequence: Synthetic oligonucleotide

SEQ ID NO: 389047 - DNA, 44 bp, Artificial Sequence; identical to SEQ ID NO: 51980
  Description of Artificial Sequence: Synthetic oligonucleotide

SEQ ID NO: 389048 - DNA, 47 bp, Artificial Sequence; identical to SEQ ID NO: 51981
  Description of Artificial Sequence: Synthetic oligonucleotide

SEQ ID NO: 389049 - DNA, 46 bp, Artificial Sequence; identical to SEQ ID NO: 51982
  Description of Artificial Sequence: Synthetic oligonucleotide

SEQ ID NO: 389050 - DNA, 45 bp, Artificial Sequence; identical to SEQ ID NO: 51983
  Description of Artificial Sequence: Synthetic oligonucleotide

SEQ ID NO: 389051 - DNA, 46 bp, Artificial Sequence; identical to SEQ ID NO: 51984
  Description of Artificial Sequence: Synthetic oligonucleotide

SEQ ID NO: 389052 - DNA, 45 bp, Artificial Sequence; identical to SEQ ID NO: 51985
  Description of Artificial Sequence: Synthetic oligonucleotide

SEQ ID NO: 389053 - DNA, 45 bp, Artificial Sequence; identical to SEQ ID NO: 51986
  Description of Artificial Sequence: Synthetic oligonucleotide

SEQ ID NO: 389054 - DNA, 47 bp, Artificial Sequence; identical to SEQ ID NO: 51987
  Description of Artificial Sequence: Synthetic oligonucleotide

SEQ ID NO: 389055 - DNA, 45 bp, Artificial Sequence; identical to SEQ ID NO: 51988
  Description of Artificial Sequence: Synthetic oligonucleotide

SEQ ID NO: 389056 - DNA, 44 bp, Artificial Sequence; identical to SEQ ID NO: 51989
  Description of Artificial Sequence: Synthetic oligonucleotide

SEQ ID NO: 389057 - DNA, 43 bp, Artificial Sequence; identical to SEQ ID NO: 51990
  Description of Artificial Sequence: Synthetic oligonucleotide

SEQ ID NO: 389058 - DNA, 42 bp, Artificial Sequence; identical to SEQ ID NO: 51991
  Description of Artificial Sequence: Synthetic oligonucleotide

SEQ ID NO: 389059 - DNA, 44 bp, Artificial Sequence; identical to SEQ ID NO: 51992
  Description of Artificial Sequence: Synthetic oligonucleotide

SEQ ID NO: 389060 - DNA, 43 bp, Artificial Sequence; identical to SEQ ID NO: 51993
  Description of Artificial Sequence: Synthetic oligonucleotide

SEQ ID NO: 389061 - DNA, 42 bp, Artificial Sequence; identical to SEQ ID NO: 51994
  Description of Artificial Sequence: Synthetic oligonucleotide

SEQ ID NO: 389062 - DNA, 41 bp, Artificial Sequence; identical to SEQ ID NO: 51995
  Description of Artificial Sequence: Synthetic oligonucleotide

SEQ ID NO: 389063 - DNA, 40 bp, Artificial Sequence; identical to SEQ ID NO: 51996
  Description of Artificial Sequence: Synthetic oligonucleotide

SEQ ID NO: 389064 - DNA, 39 bp, Artificial Sequence; identical to SEQ ID NO: 51997
  Description of Artificial Sequence: Synthetic oligonucleotide

SEQ ID NO: 389065 - DNA, 39 bp, Artificial Sequence; identical to SEQ ID NO: 51998
  Description of Artificial Sequence: Synthetic oligonucleotide

SEQ ID NO: 389066 - DNA, 38 bp, Artificial Sequence; identical to SEQ ID NO: 51999
  Description of Artificial Sequence: Synthetic oligonucleotide

SEQ ID NO: 389067 - DNA, 37 bp, Artificial Sequence; identical to SEQ ID NO: 52000
  Description of Artificial Sequence: Synthetic oligonucleotide

SEQ ID NO: 389068 - DNA, 38 bp, Artificial Sequence; identical to SEQ ID NO: 52001
  Description of Artificial Sequence: Synthetic oligonucleotide

SEQ ID NO: 389069 - DNA, 37 bp, Artificial Sequence; identical to SEQ ID NO: 52002
  Description of Artificial Sequence: Synthetic oligonucleotide

SEQ ID NO: 389070 - DNA, 36 bp, Artificial Sequence; identical to SEQ ID NO: 52003
  Description of Artificial Sequence: Synthetic oligonucleotide

SEQ ID NO: 389071 - DNA, 37 bp, Artificial Sequence; identical to SEQ ID NO: 52004
  Description of Artificial Sequence: Synthetic oligonucleotide

SEQ ID NO: 389072 - DNA, 36 bp, Artificial Sequence; identical to SEQ ID NO: 52005
  Description of Artificial Sequence: Synthetic oligonucleotide

SEQ ID NO: 389073 - DNA, 35 bp, Artificial Sequence; identical to SEQ ID NO: 52006
  Description of Artificial Sequence: Synthetic oligonucleotide

SEQ ID NO: 389074 - DNA, 35 bp, Artificial Sequence; identical to SEQ ID NO: 52007
  Description of Artificial Sequence: Synthetic oligonucleotide

SEQ ID NO: 389075 - DNA, 34 bp, Artificial Sequence; identical to SEQ ID NO: 52008
  Description of Artificial Sequence: Synthetic oligonucleotide

SEQ ID NO: 389076 - DNA, 34 bp, Artificial Sequence; identical to SEQ ID NO: 52009
  Description of Artificial Sequence: Synthetic oligonucleotide

SEQ ID NO: 389077 - DNA, 35 bp, Artificial Sequence; identical to SEQ ID NO: 52010
  Description of Artificial Sequence: Synthetic oligonucleotide

SEQ ID NO: 389078 - DNA, 34 bp, Artificial Sequence; identical to SEQ ID NO: 52011
  Description of Artificial Sequence: Synthetic oligonucleotide

SEQ ID NO: 389079 - DNA, 35 bp, Artificial Sequence; identical to SEQ ID NO: 52012
  Description of Artificial Sequence: Synthetic oligonucleotide

SEQ ID NO: 389080 - DNA, 34 bp, Artificial Sequence; identical to SEQ ID NO: 52013
  Description of Artificial Sequence: Synthetic oligonucleotide

SEQ ID NO: 389081 - DNA, 33 bp, Artificial Sequence; identical to SEQ ID NO: 52014
  Description of Artificial Sequence: Synthetic oligonucleotide

SEQ ID NO: 389082 - DNA, 33 bp, Artificial Sequence; identical to SEQ ID NO: 52015
  Description of Artificial Sequence: Synthetic oligonucleotide

SEQ ID NO: 389083 - DNA, 32 bp, Artificial Sequence; identical to SEQ ID NO: 52016
  Description of Artificial Sequence: Synthetic oligonucleotide

SEQ ID NO: 389084 - DNA, 31 bp, Artificial Sequence; identical to SEQ ID NO: 52017
  Description of Artificial Sequence: Synthetic oligonucleotide

SEQ ID NO: 389085 - DNA, 30 bp, Artificial Sequence; identical to SEQ ID NO: 52018
  Description of Artificial Sequence: Synthetic oligonucleotide

SEQ ID NO: 389086 - DNA, 30 bp, Artificial Sequence; identical to SEQ ID NO: 52019
  Description of Artificial Sequence: Synthetic oligonucleotide

SEQ ID NO: 389087 - DNA, 29 bp, Artificial Sequence
  Description of Artificial Sequence: Synthetic oligonucleotide
ggatctggataagaaggagaccgtctggc

SEQ ID NO: 389088 - DNA, 31 bp, Artificial Sequence; identical to SEQ ID NO: 52021
  Description of Artificial Sequence: Synthetic oligonucleotide

SEQ ID NO: 389089 - DNA, 32 bp, Artificial Sequence; identical to SEQ ID NO: 52022
  Description of Artificial Sequence: Synthetic oligonucleotide

SEQ ID NO: 389090 - DNA, 31 bp, Artificial Sequence; identical to SEQ ID NO: 52023
  Description of Artificial Sequence: Synthetic oligonucleotide

SEQ ID NO: 389091 - DNA, 30 bp, Artificial Sequence; identical to SEQ ID NO: 52024
  Description of Artificial Sequence: Synthetic oligonucleotide

SEQ ID NO: 389092 - DNA, 30 bp, Artificial Sequence; identical to SEQ ID NO: 52025
  Description of Artificial Sequence: Synthetic oligonucleotide

SEQ ID NO: 389093 - DNA, 29 bp, Artificial Sequence
  Description of Artificial Sequence: Synthetic oligonucleotide
ggataagaaggagaccgtctggcatctgg

SEQ ID NO: 389094 - DNA, 30 bp, Artificial Sequence; identical to SEQ ID NO: 52027
  Description of Artificial Sequence: Synthetic oligonucleotide

SEQ ID NO: 389095 - DNA, 30 bp, Artificial Sequence; identical to SEQ ID NO: 52028
  Description of Artificial Sequence: Synthetic oligonucleotide

SEQ ID NO: 389096 - DNA, 29 bp, Artificial Sequence
  Description of Artificial Sequence: Synthetic oligonucleotide
taagaaggagaccgtctggcatctggagg

SEQ ID NO: 389097 - DNA, 28 bp, Artificial Sequence
  Description of Artificial Sequence: Synthetic oligonucleotide
cgagccttttcctttgaggctcagggtg

SEQ ID NO: 389098 - DNA, 28 bp, Artificial Sequence
  Description of Artificial Sequence: Synthetic oligonucleotide
gagccttttcctttgaggctcagggtgg

SEQ ID NO: 389099 - DNA, 38 bp, Artificial Sequence; identical to SEQ ID NO: 52032
  Description of Artificial Sequence: Synthetic oligonucleotide

SEQ ID NO: 389100 - DNA, 37 bp, Artificial Sequence; identical to SEQ ID NO: 52033
  Description of Artificial Sequence: Synthetic oligonucleotide

SEQ ID NO: 389101 - DNA, 36 bp, Artificial Sequence; identical to SEQ ID NO: 52034
  Description of Artificial Sequence: Synthetic oligonucleotide

SEQ ID NO: 389102 - DNA, 36 bp, Artificial Sequence; identical to SEQ ID NO: 52035
  Description of Artificial Sequence: Synthetic oligonucleotide

SEQ ID NO: 389103 - DNA, 35 bp, Artificial Sequence; identical to SEQ ID NO: 52036
  Description of Artificial Sequence: Synthetic oligonucleotide

SEQ ID NO: 389104 - DNA, 34 bp, Artificial Sequence; identical to SEQ ID NO: 52037
  Description of Artificial Sequence: Synthetic oligonucleotide

SEQ ID NO: 389105 - DNA, 33 bp, Artificial Sequence; identical to SEQ ID NO: 52038
  Description of Artificial Sequence: Synthetic oligonucleotide

SEQ ID NO: 389106 - DNA, 32 bp, Artificial Sequence; identical to SEQ ID NO: 52039
  Description of Artificial Sequence: Synthetic oligonucleotide

SEQ ID NO: 389107 - DNA, 33 bp, Artificial Sequence; identical to SEQ ID NO: 52040
  Description of Artificial Sequence: Synthetic oligonucleotide

SEQ ID NO: 389108 - DNA, 34 bp, Artificial Sequence; identical to SEQ ID NO: 52041
  Description of Artificial Sequence: Synthetic oligonucleotide

SEQ ID NO: 389109 - DNA, 39 bp, Artificial Sequence; identical to SEQ ID NO: 52042
  Description of Artificial Sequence: Synthetic oligonucleotide

SEQ ID NO: 389110 - DNA, 38 bp, Artificial Sequence; identical to SEQ ID NO: 52043
  Description of Artificial Sequence: Synthetic oligonucleotide

SEQ ID NO: 389111 - DNA, 37 bp, Artificial Sequence; identical to SEQ ID NO: 52044
  Description of Artificial Sequence: Synthetic oligonucleotide

SEQ ID NO: 389112 - DNA, 40 bp, Artificial Sequence; identical to SEQ ID NO: 52045
  Description of Artificial Sequence: Synthetic oligonucleotide

SEQ ID NO: 389113 - DNA, 39 bp, Artificial Sequence; identical to SEQ ID NO: 52046
  Description of Artificial Sequence: Synthetic oligonucleotide

SEQ ID NO: 389114 - DNA, 38 bp, Artificial Sequence; identical to SEQ ID NO: 52047
  Description of Artificial Sequence: Synthetic oligonucleotide

SEQ ID NO: 389115 - DNA, 37 bp, Artificial Sequence; identical to SEQ ID NO: 52048
  Description of Artificial Sequence: Synthetic oligonucleotide

SEQ ID NO: 389116 - DNA, 42 bp, Artificial Sequence; identical to SEQ ID NO: 52049
  Description of Artificial Sequence: Synthetic oligonucleotide

SEQ ID NO: 389117 - DNA, 41 bp, Artificial Sequence; identical to SEQ ID NO: 52050
  Description of Artificial Sequence: Synthetic oligonucleotide

SEQ ID NO: 389118 - DNA, 40 bp, Artificial Sequence; identical to SEQ ID NO: 52051
  Description of Artificial Sequence: Synthetic oligonucleotide

SEQ ID NO: 389119 - DNA, 42 bp, Artificial Sequence; identical to SEQ ID NO: 52052
  Description of Artificial Sequence: Synthetic oligonucleotide

SEQ ID NO: 389120 - DNA, 41 bp, Artificial Sequence; identical to SEQ ID NO: 52053
  Description of Artificial Sequence: Synthetic oligonucleotide

SEQ ID NO: 389121 - DNA, 43 bp, Artificial Sequence; identical to SEQ ID NO: 52054
  Description of Artificial Sequence: Synthetic oligonucleotide

SEQ ID NO: 389122 - DNA, 42 bp, Artificial Sequence; identical to SEQ ID NO: 52055
  Description of Artificial Sequence: Synthetic oligonucleotide

SEQ ID NO: 389123 - DNA, 44 bp, Artificial Sequence; identical to SEQ ID NO: 52056
  Description of Artificial Sequence: Synthetic oligonucleotide

SEQ ID NO: 389124 - DNA, 39 bp, Artificial Sequence; identical to SEQ ID NO: 52057
  Description of Artificial Sequence: Synthetic oligonucleotide

SEQ ID NO: 389125 - DNA, 38 bp, Artificial Sequence; identical to SEQ ID NO: 52058
  Description of Artificial Sequence: Synthetic oligonucleotide

SEQ ID NO: 389126 - DNA, 37 bp, Artificial Sequence; identical to SEQ ID NO: 52059
  Description of Artificial Sequence: Synthetic oligonucleotide

SEQ ID NO: 389127 - DNA, 36 bp, Artificial Sequence; identical to SEQ ID NO: 52060
  Description of Artificial Sequence: Synthetic oligonucleotide

SEQ ID NO: 389128 - DNA, 35 bp, Artificial Sequence; identical to SEQ ID NO: 52061
  Description of Artificial Sequence: Synthetic oligonucleotide

SEQ ID NO: 389129 - DNA, 35 bp, Artificial Sequence; identical to SEQ ID NO: 52062
  Description of Artificial Sequence: Synthetic oligonucleotide

SEQ ID NO: 389130 - DNA, 34 bp, Artificial Sequence; identical to SEQ ID NO: 52063
  Description of Artificial Sequence: Synthetic oligonucleotide

SEQ ID NO: 389131 - DNA, 34 bp, Artificial Sequence; identical to SEQ ID NO: 52064
  Description of Artificial Sequence: Synthetic oligonucleotide

SEQ ID NO: 389132 - DNA, 35 bp, Artificial Sequence; identical to SEQ ID NO: 52065
  Description of Artificial Sequence: Synthetic oligonucleotide

SEQ ID NO: 389133 - DNA, 34 bp, Artificial Sequence; identical to SEQ ID NO: 52066
  Description of Artificial Sequence: Synthetic oligonucleotide

SEQ ID NO: 389134 - DNA, 33 bp, Artificial Sequence; identical to SEQ ID NO: 52067
  Description of Artificial Sequence: Synthetic oligonucleotide

SEQ ID NO: 389135 - DNA, 34 bp, Artificial Sequence; identical to SEQ ID NO: 52068
  Description of Artificial Sequence: Synthetic oligonucleotide

SEQ ID NO: 389136 - DNA, 34 bp, Artificial Sequence; identical to SEQ ID NO: 52069
  Description of Artificial Sequence: Synthetic oligonucleotide

SEQ ID NO: 389137 - DNA, 33 bp, Artificial Sequence; identical to SEQ ID NO: 52070
  Description of Artificial Sequence: Synthetic oligonucleotide

SEQ ID NO: 389138 - DNA, 34 bp, Artificial Sequence; identical to SEQ ID NO: 52071
  Description of Artificial Sequence: Synthetic oligonucleotide

SEQ ID NO: 389139 - DNA, 33 bp, Artificial Sequence; identical to SEQ ID NO: 52072
  Description of Artificial Sequence: Synthetic oligonucleotide

SEQ ID NO: 389140 - DNA, 32 bp, Artificial Sequence; identical to SEQ ID NO: 52073
  Description of Artificial Sequence: Synthetic oligonucleotide

SEQ ID NO: 389141 - DNA, 33 bp, Artificial Sequence; identical to SEQ ID NO: 52074
  Description of Artificial Sequence: Synthetic oligonucleotide

SEQ ID NO: 389142 - DNA, 32 bp, Artificial Sequence; identical to SEQ ID NO: 52075
  Description of Artificial Sequence: Synthetic oligonucleotide

SEQ ID NO: 389143 - DNA, 31 bp, Artificial Sequence; identical to SEQ ID NO: 52076
  Description of Artificial Sequence: Synthetic oligonucleotide

SEQ ID NO: 389144 - DNA, 31 bp, Artificial Sequence; identical to SEQ ID NO: 52077
  Description of Artificial Sequence: Synthetic oligonucleotide

SEQ ID NO: 389145 - DNA, 32 bp, Artificial Sequence; identical to SEQ ID NO: 52078
  Description of Artificial Sequence: Synthetic oligonucleotide

SEQ ID NO: 389146 - DNA, 31 bp, Artificial Sequence; identical to SEQ ID NO: 52079
  Description of Artificial Sequence: Synthetic oligonucleotide

SEQ ID NO: 389147 - DNA, 30 bp, Artificial Sequence; identical to SEQ ID NO: 52080
  Description of Artificial Sequence: Synthetic oligonucleotide

SEQ ID NO: 389148 - DNA, 29 bp, Artificial Sequence
  Description of Artificial Sequence: Synthetic oligonucleotide
acctgacctttgtaccctcagcagaggac

SEQ ID NO: 389149 - DNA, 28 bp, Artificial Sequence
  Description of Artificial Sequence: Synthetic oligonucleotide
cctgacctttgtaccctcagcagaggac

SEQ ID NO: 389150 - DNA, 28 bp, Artificial Sequence
  Description of Artificial Sequence: Synthetic oligonucleotide
ctgacctttgtaccctcagcagaggacg

SEQ ID NO: 389151 - DNA, 29 bp, Artificial Sequence
  Description of Artificial Sequence: Synthetic oligonucleotide
tgacctttgtaccctcagcagaggacgtc

SEQ ID NO: 389152 - DNA, 28 bp, Artificial Sequence
  Description of Artificial Sequence: Synthetic oligonucleotide
gacctttgtaccctcagcagaggacgtc

SEQ ID NO: 389153 - DNA, 31 bp, Artificial Sequence; identical to SEQ ID NO: 52086
  Description of Artificial Sequence: Synthetic oligonucleotide

SEQ ID NO: 389154 - DNA, 30 bp, Artificial Sequence; identical to SEQ ID NO: 52087
  Description of Artificial Sequence: Synthetic oligonucleotide

SEQ ID NO: 389155 - DNA, 31 bp, Artificial Sequence; identical to SEQ ID NO: 52088
  Description of Artificial Sequence: Synthetic oligonucleotide

SEQ ID NO: 389156 - DNA, 32 bp, Artificial Sequence; identical to SEQ ID NO: 52089
  Description of Artificial Sequence: Synthetic oligonucleotide

SEQ ID NO: 389157 - DNA, 31 bp, Artificial Sequence; identical to SEQ ID NO: 52090
  Description of Artificial Sequence: Synthetic oligonucleotide

SEQ ID NO: 389158 - DNA, 30 bp, Artificial Sequence; identical to SEQ ID NO: 52091
  Description of Artificial Sequence: Synthetic oligonucleotide

SEQ ID NO: 389159 - DNA, 29 bp, Artificial Sequence
  Description of Artificial Sequence: Synthetic oligonucleotide
gtaccctcagcagaggacgtctatgactg

SEQ ID NO: 389160 - DNA, 29 bp, Artificial Sequence
  Description of Artificial Sequence: Synthetic oligonucleotide
taccctcagcagaggacgtctatgactgc

SEQ ID NO: 389161 - DNA, 28 bp, Artificial Sequence
  Description of Artificial Sequence: Synthetic oligonucleotide
accctcagcagaggacgtctatgactgc

SEQ ID NO: 389162 - DNA, 35 bp, Artificial Sequence; identical to SEQ ID NO: 52095
  Description of Artificial Sequence: Synthetic oligonucleotide

SEQ ID NO: 389163 - DNA, 36 bp, Artificial Sequence; identical to SEQ ID NO: 52096
  Description of Artificial Sequence: Synthetic oligonucleotide

SEQ ID NO: 389164 - DNA, 36 bp, Artificial Sequence; identical to SEQ ID NO: 52097
  Description of Artificial Sequence: Synthetic oligonucleotide

SEQ ID NO: 389165 - DNA, 36 bp, Artificial Sequence; identical to SEQ ID NO: 52098
  Description of Artificial Sequence: Synthetic oligonucleotide

SEQ ID NO: 389166 - DNA, 35 bp, Artificial Sequence; identical to SEQ ID NO: 52099
  Description of Artificial Sequence: Synthetic oligonucleotide

SEQ ID NO: 389167 - DNA, 38 bp, Artificial Sequence; identical to SEQ ID NO: 52100
  Description of Artificial Sequence: Synthetic oligonucleotide

SEQ ID NO: 389168 - DNA, 39 bp, Artificial Sequence; identical to SEQ ID NO: 52101
  Description of Artificial Sequence: Synthetic oligonucleotide

SEQ ID NO: 389169 - DNA, 38 bp, Artificial Sequence; identical to SEQ ID NO: 52102
  Description of Artificial Sequence: Synthetic oligonucleotide

SEQ ID NO: 389170 - DNA, 37 bp, Artificial Sequence; identical to SEQ ID NO: 52103
  Description of Artificial Sequence: Synthetic oligonucleotide

SEQ ID NO: 389171 - DNA, 37 bp, Artificial Sequence; identical to SEQ ID NO: 52104
  Description of Artificial Sequence: Synthetic oligonucleotide

SEQ ID NO: 389172 - DNA, 36 bp, Artificial Sequence; identical to SEQ ID NO: 52105
  Description of Artificial Sequence: Synthetic oligonucleotide

SEQ ID NO: 389173 - DNA, 38 bp, Artificial Sequence; identical to SEQ ID NO: 52106
  Description of Artificial Sequence: Synthetic oligonucleotide

SEQ ID NO: 389174 - DNA, 37 bp, Artificial Sequence; identical to SEQ ID NO: 52107
  Description of Artificial Sequence: Synthetic oligonucleotide

SEQ ID NO: 389175 - DNA, 25 bp, Artificial Sequence
  Description of Artificial Sequence: Synthetic oligonucleotide
cgccaatgatccccctgaggtgacg

SEQ ID NO: 389176 - DNA, 26 bp, Artificial Sequence
  Description of Artificial Sequence: Synthetic oligonucleotide
gccaatgatccccctgaggtgacggt

SEQ ID NO: 389177 - DNA, 27 bp, Artificial Sequence
  Description of Artificial Sequence: Synthetic oligonucleotide
ccaatgatccccctgaggtgacggtgt

SEQ ID NO: 389178 - DNA, 29 bp, Artificial Sequence
  Description of Artificial Sequence: Synthetic oligonucleotide
caatgatccccctgaggtgacggtgtttc

SEQ ID NO: 389179 - DNA, 29 bp, Artificial Sequence
  Description of Artificial Sequence: Synthetic oligonucleotide
aatgatccccctgaggtgacggtgtttcc

SEQ ID NO: 389180 - DNA, 28 bp, Artificial Sequence
  Description of Artificial Sequence: Synthetic oligonucleotide
atgatccccctgaggtgacggtgtttcc

SEQ ID NO: 389181 - DNA, 27 bp, Artificial Sequence
  Description of Artificial Sequence: Synthetic oligonucleotide
tgatccccctgaggtgacggtgtttcc

SEQ ID NO: 389182 - DNA, 26 bp, Artificial Sequence
  Description of Artificial Sequence: Synthetic oligonucleotide
gatccccctgaggtgacggtgtttcc

SEQ ID NO: 389183 - DNA, 27 bp, Artificial Sequence
  Description of Artificial Sequence: Synthetic oligonucleotide
atccccctgaggtgacggtgtttccca

SEQ ID NO: 389184 - DNA, 27 bp, Artificial Sequence
  Description of Artificial Sequence: Synthetic oligonucleotide
tccccctgaggtgacggtgtttcccaa

SEQ ID NO: 389185 - DNA, 26 bp, Artificial Sequence
  Description of Artificial Sequence: Synthetic oligonucleotide
ccccctgaggtgacggtgtttcccaa

SEQ ID NO: 389186 - DNA, 26 bp, Artificial Sequence
  Description of Artificial Sequence: Synthetic oligonucleotide
cccctgaggtgacggtgtttcccaag

SEQ ID NO: 389187 - DNA, 27 bp, Artificial Sequence
  Description of Artificial Sequence: Synthetic oligonucleotide
ccctgaggtgacggtgtttcccaagga

SEQ ID NO: 389188 - DNA, 27 bp, Artificial Sequence
  Description of Artificial Sequence: Synthetic oligonucleotide
cctgaggtgacggtgtttcccaaggag

SEQ ID NO: 389189 - DNA, 27 bp, Artificial Sequence
  Description of Artificial Sequence: Synthetic oligonucleotide
ctgaggtgacggtgtttcccaaggagc

SEQ ID NO: 389190 - DNA, 27 bp, Artificial Sequence
  Description of Artificial Sequence: Synthetic oligonucleotide
tgaggtgacggtgtttcccaaggagcc

SEQ ID NO: 389191 - DNA, 27 bp, Artificial Sequence
  Description of Artificial Sequence: Synthetic oligonucleotide
gaggtgacggtgtttcccaaggagcct

SEQ ID NO: 389192 - DNA, 27 bp, Artificial Sequence
  Description of Artificial Sequence: Synthetic oligonucleotide
aggtgacggtgtttcccaaggagcctg

SEQ ID NO: 389193 - DNA, 27 bp, Artificial Sequence
  Description of Artificial Sequence: Synthetic oligonucleotide
ggtgacggtgtttcccaaggagcctgt

SEQ ID NO: 389194 - DNA, 27 bp, Artificial Sequence
  Description of Artificial Sequence: Synthetic oligonucleotide
gtgacggtgtttcccaaggagcctgtg

SEQ ID NO: 389195 - DNA, 27 bp, Artificial Sequence
  Description of Artificial Sequence: Synthetic oligonucleotide
tgacggtgtttcccaaggagcctgtgg

SEQ ID NO: 389196 - DNA, 27 bp, Artificial Sequence
  Description of Artificial Sequence: Synthetic oligonucleotide
gacggtgtttcccaaggagcctgtgga

SEQ ID NO: 389197 - DNA, 27 bp, Artificial Sequence
  Description of Artificial Sequence: Synthetic oligonucleotide
acggtgtttcccaaggagcctgtggag

SEQ ID NO: 389198 - DNA, 26 bp, Artificial Sequence
  Description of Artificial Sequence: Synthetic oligonucleotide
cggtgtttcccaaggagcctgtggag

SEQ ID NO: 389199 - DNA, 27 bp, Artificial Sequence
  Description of Artificial Sequence: Synthetic oligonucleotide
ggtgtttcccaaggagcctgtggagct

SEQ ID NO: 389200 - DNA, 33 bp, Artificial Sequence; identical to SEQ ID NO: 52133
  Description of Artificial Sequence: Synthetic oligonucleotide

SEQ ID NO: 389201 - DNA, 32 bp, Artificial Sequence; identical to SEQ ID NO: 52134
  Description of Artificial Sequence: Synthetic oligonucleotide

SEQ ID NO: 389202 - DNA, 33 bp, Artificial Sequence; identical to SEQ ID NO: 52135
  Description of Artificial Sequence: Synthetic oligonucleotide

SEQ ID NO: 389203 - DNA, 32 bp, Artificial Sequence; identical to SEQ ID NO: 52136
  Description of Artificial Sequence: Synthetic oligonucleotide

SEQ ID NO: 389204 - DNA, 31 bp, Artificial Sequence; identical to SEQ ID NO: 52137
  Description of Artificial Sequence: Synthetic oligonucleotide

SEQ ID NO: 389205 - DNA, 30 bp, Artificial Sequence; identical to SEQ ID NO: 52138
  Description of Artificial Sequence: Synthetic oligonucleotide

SEQ ID NO: 389206 - DNA, 31 bp, Artificial Sequence; identical to SEQ ID NO: 52139
  Description of Artificial Sequence: Synthetic oligonucleotide

SEQ ID NO: 389207 - DNA, 30 bp, Artificial Sequence; identical to SEQ ID NO: 52140
  Description of Artificial Sequence: Synthetic oligonucleotide

SEQ ID NO: 389208 - DNA, 32 bp, Artificial Sequence; identical to SEQ ID NO: 52141
  Description of Artificial Sequence: Synthetic oligonucleotide

SEQ ID NO: 389209 - DNA, 31 bp, Artificial Sequence; identical to SEQ ID NO: 52142
  Description of Artificial Sequence: Synthetic oligonucleotide

SEQ ID NO: 389210 - DNA, 31 bp, Artificial Sequence; identical to SEQ ID NO: 52143
  Description of Artificial Sequence: Synthetic oligonucleotide

SEQ ID NO: 389211 - DNA, 31 bp, Artificial Sequence; identical to SEQ ID NO: 52144
  Description of Artificial Sequence: Synthetic oligonucleotide

SEQ ID NO: 389212 - DNA, 30 bp, Artificial Sequence; identical to SEQ ID NO: 52145
  Description of Artificial Sequence: Synthetic oligonucleotide

SEQ ID NO: 389213 - DNA, 29 bp, Artificial Sequence
  Description of Artificial Sequence: Synthetic oligonucleotide
cttcccaccagtgctcaatgtcacatggc

SEQ ID NO: 389214 - DNA, 30 bp, Artificial Sequence; identical to SEQ ID NO: 52147
  Description of Artificial Sequence: Synthetic oligonucleotide

SEQ ID NO: 389215 - DNA, 29 bp, Artificial Sequence
  Description of Artificial Sequence: Synthetic oligonucleotide
tcccaccagtgctcaatgtcacatggctg

SEQ ID NO: 389216 - DNA, 28 bp, Artificial Sequence
  Description of Artificial Sequence: Synthetic oligonucleotide
cccaccagtgctcaatgtcacatggctg

SEQ ID NO: 389217 - DNA, 29 bp, Artificial Sequence
  Description of Artificial Sequence: Synthetic oligonucleotide
ccaccagtgctcaatgtcacatggctgtg

SEQ ID NO: 389218 - DNA, 29 bp, Artificial Sequence
  Description of Artificial Sequence: Synthetic oligonucleotide
caccagtgctcaatgtcacatggctgtgc

SEQ ID NO: 389219 - DNA, 32 bp, Artificial Sequence; identical to SEQ ID NO: 52152
  Description of Artificial Sequence: Synthetic oligonucleotide

SEQ ID NO: 389220 - DNA, 31 bp, Artificial Sequence; identical to SEQ ID NO: 52153
  Description of Artificial Sequence: Synthetic oligonucleotide

SEQ ID NO: 389221 - DNA, 31 bp, Artificial Sequence; identical to SEQ ID NO: 52154
  Description of Artificial Sequence: Synthetic oligonucleotide

SEQ ID NO: 389222 - DNA, 31 bp, Artificial Sequence; identical to SEQ ID NO: 52155
  Description of Artificial Sequence: Synthetic oligonucleotide

SEQ ID NO: 389223 - DNA, 30 bp, Artificial Sequence; identical to SEQ ID NO: 52156
  Description of Artificial Sequence: Synthetic oligonucleotide

SEQ ID NO: 389224 - DNA, 30 bp, Artificial Sequence; identical to SEQ ID NO: 52157
  Description of Artificial Sequence: Synthetic oligonucleotide

SEQ ID NO: 389225 - DNA, 29 bp, Artificial Sequence
  Description of Artificial Sequence: Synthetic oligonucleotide
gctcaatgtcacatggctgtgcaatgggg

SEQ ID NO: 389226 - DNA, 30 bp, Artificial Sequence; identical to SEQ ID NO: 52159
  Description of Artificial Sequence: Synthetic oligonucleotide

SEQ ID NO: 389227 - DNA, 30 bp, Artificial Sequence; identical to SEQ ID NO: 52160
  Description of Artificial Sequence: Synthetic oligonucleotide

SEQ ID NO: 389228 - DNA, 29 bp, Artificial Sequence
  Description of Artificial Sequence: Synthetic oligonucleotide
caatgtcacatggctgtgcaatggggagc

SEQ ID NO: 389229 - DNA, 29 bp, Artificial Sequence
  Description of Artificial Sequence: Synthetic oligonucleotide
aatgtcacatggctgtgcaatggggagcc

SEQ ID NO: 389230 - DNA, 28 bp, Artificial Sequence
  Description of Artificial Sequence: Synthetic oligonucleotide
atgtcacatggctgtgcaatggggagcc

SEQ ID NO: 389231 - DNA, 27 bp, Artificial Sequence
  Description of Artificial Sequence: Synthetic oligonucleotide
tgtcacatggctgtgcaatggggagcc

SEQ ID NO: 389232 - DNA, 26 bp, Artificial Sequence
  Description of Artificial Sequence: Synthetic oligonucleotide
gtcacatggctgtgcaatggggagcc

SEQ ID NO: 389233 - DNA, 26 bp, Artificial Sequence
  Description of Artificial Sequence: Synthetic oligonucleotide
tcacatggctgtgcaatggggagccg

SEQ ID NO: 389234 - DNA, 25 bp, Artificial Sequence
  Description of Artificial Sequence: Synthetic oligonucleotide
cacatggctgtgcaatggggagccg

SEQ ID NO: 389235 - DNA, 26 bp, Artificial Sequence
  Description of Artificial Sequence: Synthetic oligonucleotide
acatggctgtgcaatggggagccggt

SEQ ID NO: 389236 - DNA, 25 bp, Artificial Sequence
  Description of Artificial Sequence: Synthetic oligonucleotide
catggctgtgcaatggggagccggt

SEQ ID NO: 389237 - DNA, 26 bp, Artificial Sequence
  Description of Artificial Sequence: Synthetic oligonucleotide
atggctgtgcaatggggagccggtca

SEQ ID NO: 389238 - DNA, 25 bp, Artificial Sequence
  Description of Artificial Sequence: Synthetic oligonucleotide
tggctgtgcaatggggagccggtca

SEQ ID NO: 389239 - DNA, 24 bp, Artificial Sequence
  Description of Artificial Sequence: Synthetic oligonucleotide
ggctgtgcaatggggagccggtca

SEQ ID NO: 389240 - DNA, 25 bp, Artificial Sequence
  Description of Artificial Sequence: Synthetic oligonucleotide
gctgtgcaatggggagccggtcact

SEQ ID NO: 389241 - DNA, 26 bp, Artificial Sequence
  Description of Artificial Sequence: Synthetic oligonucleotide
ctgtgcaatggggagccggtcactga

SEQ ID NO: 389242 - DNA, 26 bp, Artificial Sequence
  Description of Artificial Sequence: Synthetic oligonucleotide
tgtgcaatggggagccggtcactgag

SEQ ID NO: 389243 - DNA, 25 bp, Artificial Sequence
  Description of Artificial Sequence: Synthetic oligonucleotide
gtgcaatggggagccggtcactgag

SEQ ID NO: 389244 - DNA, 25 bp, Artificial Sequence
  Description of Artificial Sequence: Synthetic oligonucleotide
tgcaatggggagccggtcactgagg

SEQ ID NO: 389245 - DNA, 24 bp, Artificial Sequence
  Description of Artificial Sequence: Synthetic oligonucleotide
gcaatggggagccggtcactgagg

SEQ ID NO: 389246 - DNA, 25 bp, Artificial Sequence
  Description of Artificial Sequence: Synthetic oligonucleotide
caatggggagccggtcactgagggt

SEQ ID NO: 389247 - DNA, 26 bp, Artificial Sequence
  Description of Artificial Sequence: Synthetic oligonucleotide
aatggggagccggtcactgagggtgt

SEQ ID NO: 389248 - DNA, 25 bp, Artificial Sequence
  Description of Artificial Sequence: Synthetic oligonucleotide
atggggagccggtcactgagggtgt

SEQ ID NO: 389249 - DNA, 24 bp, Artificial Sequence
  Description of Artificial Sequence: Synthetic oligonucleotide
tggggagccggtcactgagggtgt

SEQ ID NO: 389250 - DNA, 23 bp, Artificial Sequence
  Description of Artificial Sequence: Synthetic oligonucleotide
ggggagccggtcactgagggtgt

SEQ ID NO: 389251 - DNA, 23 bp, Artificial Sequence
  Description of Artificial Sequence: Synthetic oligonucleotide
gggagccggtcactgagggtgtc

SEQ ID NO: 389252 - DNA, 23 bp, Artificial Sequence
  Description of Artificial Sequence: Synthetic oligonucleotide
ggagccggtcactgagggtgtcg

SEQ ID NO: 389253 - DNA, 24 bp, Artificial Sequence
  Description of Artificial Sequence: Synthetic oligonucleotide
gagccggtcactgagggtgtcgct

SEQ ID NO: 389254 - DNA, 25 bp, Artificial Sequence
  Description of Artificial Sequence: Synthetic oligonucleotide
agccggtcactgagggtgtcgctga

SEQ ID NO: 389255 - DNA, 24 bp, Artificial Sequence
  Description of Artificial Sequence: Synthetic oligonucleotide
gccggtcactgagggtgtcgctga

SEQ ID NO: 389256 - DNA, 25 bp, Artificial Sequence
  Description of Artificial Sequence: Synthetic oligonucleotide
ccggtcactgagggtgtcgctgaga

SEQ ID NO: 389257 - DNA, 25 bp, Artificial Sequence
  Description of Artificial Sequence: Synthetic oligonucleotide
cggtcactgagggtgtcgctgagag

SEQ ID NO: 389258 - DNA, 32 bp, Artificial Sequence; identical to SEQ ID NO: 52191
  Description of Artificial Sequence: Synthetic oligonucleotide

SEQ ID NO: 389259 - DNA, 32 bp, Artificial Sequence; identical to SEQ ID NO: 52192
  Description of Artificial Sequence: Synthetic oligonucleotide

SEQ ID NO: 389260 - DNA, 33 bp, Artificial Sequence; identical to SEQ ID NO: 52193
  Description of Artificial Sequence: Synthetic oligonucleotide

SEQ ID NO: 389261 - DNA, 32 bp, Artificial Sequence; identical to SEQ ID NO: 52194
  Description of Artificial Sequence: Synthetic oligonucleotide

SEQ ID NO: 389262 - DNA, 33 bp, Artificial Sequence; identical to SEQ ID NO: 52195
  Description of Artificial Sequence: Synthetic oligonucleotide

SEQ ID NO: 389263 - DNA, 34 bp, Artificial Sequence; identical to SEQ ID NO: 52196
  Description of Artificial Sequence: Synthetic oligonucleotide

SEQ ID NO: 389264 - DNA, 36 bp, Artificial Sequence; identical to SEQ ID NO: 52197
  Description of Artificial Sequence: Synthetic oligonucleotide

SEQ ID NO: 389265 - DNA, 40 bp, Artificial Sequence; identical to SEQ ID NO: 52198
  Description of Artificial Sequence: Synthetic oligonucleotide

SEQ ID NO: 389266 - DNA, 40 bp, Artificial Sequence; identical to SEQ ID NO: 52199
  Description of Artificial Sequence: Synthetic oligonucleotide

SEQ ID NO: 389267 - DNA, 42 bp, Artificial Sequence; identical to SEQ ID NO: 52200
  Description of Artificial Sequence: Synthetic oligonucleotide

SEQ ID NO: 389268 - DNA, 44 bp, Artificial Sequence; identical to SEQ ID NO: 52201
  Description of Artificial Sequence: Synthetic oligonucleotide

SEQ ID NO: 389269 - DNA, 43 bp, Artificial Sequence; identical to SEQ ID NO: 52202
  Description of Artificial Sequence: Synthetic oligonucleotide

SEQ ID NO: 389270 - DNA, 43 bp, Artificial Sequence; identical to SEQ ID NO: 52203
  Description of Artificial Sequence: Synthetic oligonucleotide

SEQ ID NO: 389271 - DNA, 44 bp, Artificial Sequence; identical to SEQ ID NO: 52204
  Description of Artificial Sequence: Synthetic oligonucleotide

SEQ ID NO: 389272 - DNA, 44 bp, Artificial Sequence; identical to SEQ ID NO: 52205
  Description of Artificial Sequence: Synthetic oligonucleotide

SEQ ID NO: 389273 - DNA, 43 bp, Artificial Sequence; identical to SEQ ID NO: 52206
  Description of Artificial Sequence: Synthetic oligonucleotide

SEQ ID NO: 389274 - DNA, 42 bp, Artificial Sequence; identical to SEQ ID NO: 52207
  Description of Artificial Sequence: Synthetic oligonucleotide

SEQ ID NO: 389275 - DNA, 41 bp, Artificial Sequence; identical to SEQ ID NO: 52208
  Description of Artificial Sequence: Synthetic oligonucleotide

SEQ ID NO: 389276 - DNA, 41 bp, Artificial Sequence; identical to SEQ ID NO: 52209
  Description of Artificial Sequence: Synthetic oligonucleotide

SEQ ID NO: 389277 - DNA, 40 bp, Artificial Sequence; identical to SEQ ID NO: 52210
  Description of Artificial Sequence: Synthetic oligonucleotide

SEQ ID NO: 389278 - DNA, 39 bp, Artificial Sequence; identical to SEQ ID NO: 52211
  Description of Artificial Sequence: Synthetic oligonucleotide

SEQ ID NO: 389279 - DNA, 38 bp, Artificial Sequence; identical to SEQ ID NO: 52212
  Description of Artificial Sequence: Synthetic oligonucleotide

SEQ ID NO: 389280 - DNA, 40 bp, Artificial Sequence; identical to SEQ ID NO: 52213
  Description of Artificial Sequence: Synthetic oligonucleotide

SEQ ID NO: 389281 - DNA, 40 bp, Artificial Sequence; identical to SEQ ID NO: 52214
  Description of Artificial Sequence: Synthetic oligonucleotide

SEQ ID NO: 389282 - DNA, 39 bp, Artificial Sequence; identical to SEQ ID NO: 52215
  Description of Artificial Sequence: Synthetic oligonucleotide

SEQ ID NO: 389283 - DNA, 38 bp, Artificial Sequence; identical to SEQ ID NO: 52216
  Description of Artificial Sequence: Synthetic oligonucleotide

SEQ ID NO: 389284 - DNA, 37 bp, Artificial Sequence; identical to SEQ ID NO: 52217
  Description of Artificial Sequence: Synthetic oligonucleotide

SEQ ID NO: 389285 - DNA, 36 bp, Artificial Sequence; identical to SEQ ID NO: 52218
  Description of Artificial Sequence: Synthetic oligonucleotide

SEQ ID NO: 389286 - DNA, 35 bp, Artificial Sequence; identical to SEQ ID NO: 52219
  Description of Artificial Sequence: Synthetic oligonucleotide

SEQ ID NO: 389287 - DNA, 34 bp, Artificial Sequence; identical to SEQ ID NO: 52220
  Description of Artificial Sequence: Synthetic oligonucleotide

SEQ ID NO: 389288 - DNA, 36 bp, Artificial Sequence; identical to SEQ ID NO: 52221
  Description of Artificial Sequence: Synthetic oligonucleotide

SEQ ID NO: 389289 - DNA, 35 bp, Artificial Sequence; identical to SEQ ID NO: 52222
  Description of Artificial Sequence: Synthetic oligonucleotide

SEQ ID NO: 389290 - DNA, 34 bp, Artificial Sequence; identical to SEQ ID NO: 52223
  Description of Artificial Sequence: Synthetic oligonucleotide

SEQ ID NO: 389291 - DNA, 34 bp, Artificial Sequence; identical to SEQ ID NO: 52224
  Description of Artificial Sequence: Synthetic oligonucleotide

SEQ ID NO: 389292 - DNA, 33 bp, Artificial Sequence; identical to SEQ ID NO: 52225
  Description of Artificial Sequence: Synthetic oligonucleotide

SEQ ID NO: 389293 - DNA, 32 bp, Artificial Sequence; identical to SEQ ID NO: 52226
  Description of Artificial Sequence: Synthetic oligonucleotide

SEQ ID NO: 389294 - DNA, 33 bp, Artificial Sequence; identical to SEQ ID NO: 52227
  Description of Artificial Sequence: Synthetic oligonucleotide

SEQ ID NO: 389295 - DNA, 30 bp, Artificial Sequence; identical to SEQ ID NO: 52228
  Description of Artificial Sequence: Synthetic oligonucleotide

SEQ ID NO: 389296 - DNA, 29 bp, Artificial Sequence
  Description of Artificial Sequence: Synthetic oligonucleotide
cagggcgggctggctaacattgctatatc

SEQ ID NO: 389297 - DNA, 29 bp, Artificial Sequence
  Description of Artificial Sequence: Synthetic oligonucleotide
agggcgggctggctaacattgctatatcg

SEQ ID NO: 389298 - DNA, 28 bp, Artificial Sequence
  Description of Artificial Sequence: Synthetic oligonucleotide
gggcgggctggctaacattgctatatcg

SEQ ID NO: 389299 - DNA, 30 bp, Artificial Sequence; identical to SEQ ID NO: 52232
  Description of Artificial Sequence: Synthetic oligonucleotide

SEQ ID NO: 389300 - DNA, 32 bp, Artificial Sequence; identical to SEQ ID NO: 52233
  Description of Artificial Sequence: Synthetic oligonucleotide

SEQ ID NO: 389301 - DNA, 34 bp, Artificial Sequence; identical to SEQ ID NO: 52234
  Description of Artificial Sequence: Synthetic oligonucleotide

SEQ ID NO: 389302 - DNA, 36 bp, Artificial Sequence; identical to SEQ ID NO: 52235
  Description of Artificial Sequence: Synthetic oligonucleotide

SEQ ID NO: 389303 - DNA, 40 bp, Artificial Sequence; identical to SEQ ID NO: 52236
  Description of Artificial Sequence: Synthetic oligonucleotide

SEQ ID NO: 389304 - DNA, 40 bp, Artificial Sequence; identical to SEQ ID NO: 52237
  Description of Artificial Sequence: Synthetic oligonucleotide

SEQ ID NO: 389305 - DNA, 42 bp, Artificial Sequence; identical to SEQ ID NO: 52238
  Description of Artificial Sequence: Synthetic oligonucleotide

SEQ ID NO: 389306 - DNA, 44 bp, Artificial Sequence; identical to SEQ ID NO: 52239
  Description of Artificial Sequence: Synthetic oligonucleotide

SEQ ID NO: 389307 - DNA, 43 bp, Artificial Sequence; identical to SEQ ID NO: 52240
  Description of Artificial Sequence: Synthetic oligonucleotide

SEQ ID NO: 389308 - DNA, 43 bp, Artificial Sequence; identical to SEQ ID NO: 52241
  Description of Artificial Sequence: Synthetic oligonucleotide

SEQ ID NO: 389309 - DNA, 44 bp, Artificial Sequence; identical to SEQ ID NO: 52242
  Description of Artificial Sequence: Synthetic oligonucleotide

SEQ ID NO: 389310 - DNA, 44 bp, Artificial Sequence; identical to SEQ ID NO: 52243
  Description of Artificial Sequence: Synthetic oligonucleotide

SEQ ID NO: 389311 - DNA, 43 bp, Artificial Sequence; identical to SEQ ID NO: 52244
  Description of Artificial Sequence: Synthetic oligonucleotide

SEQ ID NO: 389312 - DNA, 42 bp, Artificial Sequence; identical to SEQ ID NO: 52245
  Description of Artificial Sequence: Synthetic oligonucleotide

SEQ ID NO: 389313 - DNA, 41 bp, Artificial Sequence; identical to SEQ ID NO: 52246
  Description of Artificial Sequence: Synthetic oligonucleotide

SEQ ID NO: 389314 - DNA, 41 bp, Artificial Sequence; identical to SEQ ID NO: 52247
  Description of Artificial Sequence: Synthetic oligonucleotide

SEQ ID NO: 389315 - DNA, 40 bp, Artificial Sequence; identical to SEQ ID NO: 52248
  Description of Artificial Sequence: Synthetic oligonucleotide

SEQ ID NO: 389316 - DNA, 39 bp, Artificial Sequence; identical to SEQ ID NO: 52249
  Description of Artificial Sequence: Synthetic oligonucleotide

SEQ ID NO: 389317 - DNA, 38 bp, Artificial Sequence; identical to SEQ ID NO: 52250
  Description of Artificial Sequence: Synthetic oligonucleotide

SEQ ID NO: 389318 - DNA, 40 bp, Artificial Sequence; identical to SEQ ID NO: 52251
  Description of Artificial Sequence: Synthetic oligonucleotide

SEQ ID NO: 389319 - DNA, 40 bp, Artificial Sequence; identical to SEQ ID NO: 52252
  Description of Artificial Sequence: Synthetic oligonucleotide

SEQ ID NO: 389320 - DNA, 39 bp, Artificial Sequence; identical to SEQ ID NO: 52253
  Description of Artificial Sequence: Synthetic oligonucleotide

SEQ ID NO: 389321 - DNA, 38 bp, Artificial Sequence; identical to SEQ ID NO: 52254
  Description of Artificial Sequence: Synthetic oligonucleotide

SEQ ID NO: 389322 - DNA, 37 bp, Artificial Sequence; identical to SEQ ID NO: 52255
  Description of Artificial Sequence: Synthetic oligonucleotide

SEQ ID NO: 389323 - DNA, 36 bp, Artificial Sequence; identical to SEQ ID NO: 52256
  Description of Artificial Sequence: Synthetic oligonucleotide

SEQ ID NO: 389324 - DNA, 35 bp, Artificial Sequence; identical to SEQ ID NO: 52257
  Description of Artificial Sequence: Synthetic oligonucleotide

SEQ ID NO: 389325 - DNA, 40 bp, Artificial Sequence; identical to SEQ ID NO: 52258
  Description of Artificial Sequence: Synthetic oligonucleotide

SEQ ID NO: 389326 - DNA, 31 bp, Artificial Sequence; identical to SEQ ID NO: 52259
  Description of Artificial Sequence: Synthetic oligonucleotide

SEQ ID NO: 389327 - DNA, 31 bp, Artificial Sequence; identical to SEQ ID NO: 52260
  Description of Artificial Sequence: Synthetic oligonucleotide

SEQ ID NO: 389328 - DNA, 32 bp, Artificial Sequence; identical to SEQ ID NO: 52261
  Description of Artificial Sequence: Synthetic oligonucleotide

SEQ ID NO: 389329 - DNA, 33 bp, Artificial Sequence; identical to SEQ ID NO: 52262
  Description of Artificial Sequence: Synthetic oligonucleotide

SEQ ID NO: 389330 - DNA, 38 bp, Artificial Sequence; identical to SEQ ID NO: 52263
  Description of Artificial Sequence: Synthetic oligonucleotide

SEQ ID NO: 389331 - DNA, 41 bp, Artificial Sequence; identical to SEQ ID NO: 52264
  Description of Artificial Sequence: Synthetic oligonucleotide

SEQ ID NO: 389332 - DNA, 42 bp, Artificial Sequence; identical to SEQ ID NO: 52265
  Description of Artificial Sequence: Synthetic oligonucleotide

SEQ ID NO: 389333 - DNA, 41 bp, Artificial Sequence; identical to SEQ ID NO: 52266
  Description of Artificial Sequence: Synthetic oligonucleotide

SEQ ID NO: 389334 - DNA, 40 bp, Artificial Sequence; identical to SEQ ID NO: 52267
  Description of Artificial Sequence: Synthetic oligonucleotide

SEQ ID NO: 389335 - DNA, 39 bp, Artificial Sequence; identical to SEQ ID NO: 52268
  Description of Artificial Sequence: Synthetic oligonucleotide

SEQ ID NO: 389336 - DNA, 42 bp, Artificial Sequence; identical to SEQ ID NO: 52269
  Description of Artificial Sequence: Synthetic oligonucleotide

SEQ ID NO: 389337 - DNA, 41 bp, Artificial Sequence; identical to SEQ ID NO: 52270
  Description of Artificial Sequence: Synthetic oligonucleotide

SEQ ID NO: 389338 - DNA, 40 bp, Artificial Sequence; identical to SEQ ID NO: 52271
  Description of Artificial Sequence: Synthetic oligonucleotide

SEQ ID NO: 389339 - DNA, 42 bp, Artificial Sequence; identical to SEQ ID NO: 52272
  Description of Artificial Sequence: Synthetic oligonucleotide

SEQ ID NO: 389340 - DNA, 41 bp, Artificial Sequence; identical to SEQ ID NO: 52273
  Description of Artificial Sequence: Synthetic oligonucleotide

SEQ ID NO: 389341 - DNA, 43 bp, Artificial Sequence; identical to SEQ ID NO: 52274
  Description of Artificial Sequence: Synthetic oligonucleotide

SEQ ID NO: 389342 - DNA, 42 bp, Artificial Sequence; identical to SEQ ID NO: 52275
  Description of Artificial Sequence: Synthetic oligonucleotide

SEQ ID NO: 389343 - DNA, 44 bp, Artificial Sequence; identical to SEQ ID NO: 52276
  Description of Artificial Sequence: Synthetic oligonucleotide

SEQ ID NO: 389344 - DNA, 45 bp, Artificial Sequence; identical to SEQ ID NO: 52277
  Description of Artificial Sequence: Synthetic oligonucleotide

SEQ ID NO: 389345 - DNA, 47 bp, Artificial Sequence; identical to SEQ ID NO: 52278
  Description of Artificial Sequence: Synthetic oligonucleotide

SEQ ID NO: 389346 - DNA, 46 bp, Artificial Sequence; identical to SEQ ID NO: 52279
  Description of Artificial Sequence: Synthetic oligonucleotide

SEQ ID NO: 389347 - DNA, 45 bp, Artificial Sequence; identical to SEQ ID NO: 52280
  Description of Artificial Sequence: Synthetic oligonucleotide

SEQ ID NO: 389348 - DNA, 44 bp, Artificial Sequence; identical to SEQ ID NO: 52281
  Description of Artificial Sequence: Synthetic oligonucleotide

SEQ ID NO: 389349 - DNA, 46 bp, Artificial Sequence; identical to SEQ ID NO: 52282
  Description of Artificial Sequence: Synthetic oligonucleotide

SEQ ID NO: 389350 - DNA, 45 bp, Artificial Sequence; identical to SEQ ID NO: 52283
  Description of Artificial Sequence: Synthetic oligonucleotide

SEQ ID NO: 389351 - DNA, 44 bp, Artificial Sequence; identical to SEQ ID NO: 52284
  Description of Artificial Sequence: Synthetic oligonucleotide

SEQ ID NO: 389352 - DNA, 47 bp, Artificial Sequence; identical to SEQ ID NO: 52285
  Description of Artificial Sequence: Synthetic oligonucleotide

SEQ ID NO: 389353 - DNA, 46 bp, Artificial Sequence; identical to SEQ ID NO: 52286
  Description of Artificial Sequence: Synthetic oligonucleotide

SEQ ID NO: 389354 - DNA, 45 bp, Artificial Sequence; identical to SEQ ID NO: 52287
  Description of Artificial Sequence: Synthetic oligonucleotide

SEQ ID NO: 389355 - DNA, 46 bp, Artificial Sequence; identical to SEQ ID NO: 52288
  Description of Artificial Sequence: Synthetic oligonucleotide

SEQ ID NO: 389356 - DNA, 45 bp, Artificial Sequence; identical to SEQ ID NO: 52289
  Description of Artificial Sequence: Synthetic oligonucleotide

SEQ ID NO: 389357 - DNA, 45 bp, Artificial Sequence; identical to SEQ ID NO: 52290
  Description of Artificial Sequence: Synthetic oligonucleotide

SEQ ID NO: 389358 - DNA, 47 bp, Artificial Sequence; identical to SEQ ID NO: 52291
  Description of Artificial Sequence: Synthetic oligonucleotide

SEQ ID NO: 389359 - DNA, 46 bp, Artificial Sequence; identical to SEQ ID NO: 52292
  Description of Artificial Sequence: Synthetic oligonucleotide

SEQ ID NO: 389360 - DNA, 47 bp, Artificial Sequence; identical to SEQ ID NO: 52293
  Description of Artificial Sequence: Synthetic oligonucleotide

SEQ ID NO: 389361 - DNA, 46 bp, Artificial Sequence; identical to SEQ ID NO: 52294
  Description of Artificial Sequence: Synthetic oligonucleotide

SEQ ID NO: 389362 - DNA, 46 bp, Artificial Sequence; identical to SEQ ID NO: 52295
  Description of Artificial Sequence: Synthetic oligonucleotide

SEQ ID NO: 389363 - DNA, 45 bp, Artificial Sequence; identical to SEQ ID NO: 52296
  Description of Artificial Sequence: Synthetic oligonucleotide

SEQ ID NO: 389364 - DNA, 44 bp, Artificial Sequence; identical to SEQ ID NO: 52297
  Description of Artificial Sequence: Synthetic oligonucleotide

SEQ ID NO: 389365 - DNA, 43 bp, Artificial Sequence; identical to SEQ ID NO: 52298
  Description of Artificial Sequence: Synthetic oligonucleotide

SEQ ID NO: 389366 - DNA, 42 bp, Artificial Sequence; identical to SEQ ID NO: 52299
  Description of Artificial Sequence: Synthetic oligonucleotide

SEQ ID NO: 389367 - DNA, 41 bp, Artificial Sequence; identical to SEQ ID NO: 52300
  Description of Artificial Sequence: Synthetic oligonucleotide

SEQ ID NO: 389368 - DNA, 42 bp, Artificial Sequence; identical to SEQ ID NO: 52301
  Description of Artificial Sequence: Synthetic oligonucleotide

SEQ ID NO: 389369 - DNA, 41 bp, Artificial Sequence; identical to SEQ ID NO: 52302
  Description of Artificial Sequence: Synthetic oligonucleotide

SEQ ID NO: 389370 - DNA, 40 bp, Artificial Sequence; identical to SEQ ID NO: 52303
  Description of Artificial Sequence: Synthetic oligonucleotide

SEQ ID NO: 389371 - DNA, 39 bp, Artificial Sequence; identical to SEQ ID NO: 52304
  Description of Artificial Sequence: Synthetic oligonucleotide

SEQ ID NO: 389372 - DNA, 41 bp, Artificial Sequence; identical to SEQ ID NO: 52305
  Description of Artificial Sequence: Synthetic oligonucleotide

SEQ ID NO: 389373 - DNA, 40 bp, Artificial Sequence; identical to SEQ ID NO: 52306
  Description of Artificial Sequence: Synthetic oligonucleotide

SEQ ID NO: 389374 - DNA, 42 bp, Artificial Sequence; identical to SEQ ID NO: 52307
  Description of Artificial Sequence: Synthetic oligonucleotide

SEQ ID NO: 389375 - DNA, 41 bp, Artificial Sequence; identical to SEQ ID NO: 52308
  Description of Artificial Sequence: Synthetic oligonucleotide

SEQ ID NO: 389376 - DNA, 40 bp, Artificial Sequence; identical to SEQ ID NO: 52309
  Description of Artificial Sequence: Synthetic oligonucleotide

SEQ ID NO: 389377 - DNA, 39 bp, Artificial Sequence; identical to SEQ ID NO: 52310
  Description of Artificial Sequence: Synthetic oligonucleotide

SEQ ID NO: 389378 - DNA, 39 bp, Artificial Sequence; identical to SEQ ID NO: 52311
  Description of Artificial Sequence: Synthetic oligonucleotide

SEQ ID NO: 389379 - DNA, 38 bp, Artificial Sequence; identical to SEQ ID NO: 52312
  Description of Artificial Sequence: Synthetic oligonucleotide

SEQ ID NO: 389380 - DNA, 37 bp, Artificial Sequence; identical to SEQ ID NO: 52313
  Description of Artificial Sequence: Synthetic oligonucleotide

SEQ ID NO: 389381 - DNA, 38 bp, Artificial Sequence; identical to SEQ ID NO: 52314
  Description of Artificial Sequence: Synthetic oligonucleotide

SEQ ID NO: 389382 - DNA, 37 bp, Artificial Sequence; identical to SEQ ID NO: 52315
  Description of Artificial Sequence: Synthetic oligonucleotide

SEQ ID NO: 389383 - DNA, 42 bp, Artificial Sequence; identical to SEQ ID NO: 52316
  Description of Artificial Sequence: Synthetic oligonucleotide

SEQ ID NO: 389384 - DNA, 42 bp, Artificial Sequence; identical to SEQ ID NO: 52317
  Description of Artificial Sequence: Synthetic oligonucleotide

SEQ ID NO: 389385 - DNA, 42 bp, Artificial Sequence; identical to SEQ ID NO: 52318
  Description of Artificial Sequence: Synthetic oligonucleotide

SEQ ID NO: 389386 - DNA, 45 bp, Artificial Sequence; identical to SEQ ID NO: 52319
  Description of Artificial Sequence: Synthetic oligonucleotide

SEQ ID NO: 389387 - DNA, 45 bp, Artificial Sequence; identical to SEQ ID NO: 52320
  Description of Artificial Sequence: Synthetic oligonucleotide

SEQ ID NO: 389388 - DNA, 44 bp, Artificial Sequence; identical to SEQ ID NO: 52321
  Description of Artificial Sequence: Synthetic oligonucleotide

SEQ ID NO: 389389 - DNA, 45 bp, Artificial Sequence; identical to SEQ ID NO: 52322
  Description of Artificial Sequence: Synthetic oligonucleotide

SEQ ID NO: 389390 - DNA, 45 bp, Artificial Sequence; identical to SEQ ID NO: 52323
  Description of Artificial Sequence: Synthetic oligonucleotide

SEQ ID NO: 389391 - DNA, 45 bp, Artificial Sequence; identical to SEQ ID NO: 52324
  Description of Artificial Sequence: Synthetic oligonucleotide

SEQ ID NO: 389392 - DNA, 44 bp, Artificial Sequence; identical to SEQ ID NO: 52325
  Description of Artificial Sequence: Synthetic oligonucleotide

SEQ ID NO: 389393 - DNA, 43 bp, Artificial Sequence; identical to SEQ ID NO: 52326
  Description of Artificial Sequence: Synthetic oligonucleotide

SEQ ID NO: 389394 - DNA, 42 bp, Artificial Sequence; identical to SEQ ID NO: 52327
  Description of Artificial Sequence: Synthetic oligonucleotide

SEQ ID NO: 389395 - DNA, 44 bp, Artificial Sequence; identical to SEQ ID NO: 52328
  Description of Artificial Sequence: Synthetic oligonucleotide

SEQ ID NO: 389396 - DNA, 43 bp, Artificial Sequence; identical to SEQ ID NO: 52329
  Description of Artificial Sequence: Synthetic oligonucleotide

SEQ ID NO: 389397 - DNA, 42 bp, Artificial Sequence; identical to SEQ ID NO: 52330
  Description of Artificial Sequence: Synthetic oligonucleotide

SEQ ID NO: 389398 - DNA, 41 bp, Artificial Sequence; identical to SEQ ID NO: 52331
  Description of Artificial Sequence: Synthetic oligonucleotide

SEQ ID NO: 389399 - DNA, 41 bp, Artificial Sequence; identical to SEQ ID NO: 52332
  Description of Artificial Sequence: Synthetic oligonucleotide

SEQ ID NO: 389400 - DNA, 43 bp, Artificial Sequence; identical to SEQ ID NO: 52333
  Description of Artificial Sequence: Synthetic oligonucleotide

SEQ ID NO: 389401 - DNA, 42 bp, Artificial Sequence; identical to SEQ ID NO: 52334
  Description of Artificial Sequence: Synthetic oligonucleotide

SEQ ID NO: 389402 - DNA, 41 bp, Artificial Sequence; identical to SEQ ID NO: 52335
  Description of Artificial Sequence: Synthetic oligonucleotide

SEQ ID NO: 389403 - DNA, 40 bp, Artificial Sequence; identical to SEQ ID NO: 52336
  Description of Artificial Sequence: Synthetic oligonucleotide

SEQ ID NO: 389404 - DNA, 39 bp, Artificial Sequence; identical to SEQ ID NO: 52337
  Description of Artificial Sequence: Synthetic oligonucleotide

SEQ ID NO: 389405 - DNA, 38 bp, Artificial Sequence; identical to SEQ ID NO: 52338
  Description of Artificial Sequence: Synthetic oligonucleotide

SEQ ID NO: 389406 - DNA, 37 bp, Artificial Sequence; identical to SEQ ID NO: 52339
  Description of Artificial Sequence: Synthetic oligonucleotide

SEQ ID NO: 389407 - DNA, 37 bp, Artificial Sequence; identical to SEQ ID NO: 52340
  Description of Artificial Sequence: Synthetic oligonucleotide

SEQ ID NO: 389408 - DNA, 36 bp, Artificial Sequence; identical to SEQ ID NO: 52341
  Description of Artificial Sequence: Synthetic oligonucleotide

SEQ ID NO: 389409 - DNA, 35 bp, Artificial Sequence; identical to SEQ ID NO: 52342
  Description of Artificial Sequence: Synthetic oligonucleotide

SEQ ID NO: 389410 - DNA, 36 bp, Artificial Sequence; identical to SEQ ID NO: 52343
  Description of Artificial Sequence: Synthetic oligonucleotide

SEQ ID NO: 389411 - DNA, 35 bp, Artificial Sequence; identical to SEQ ID NO: 52344
  Description of Artificial Sequence: Synthetic oligonucleotide

SEQ ID NO: 389412 - DNA, 34 bp, Artificial Sequence; identical to SEQ ID NO: 52345
  Description of Artificial Sequence: Synthetic oligonucleotide

SEQ ID NO: 389413 - DNA, 35 bp, Artificial Sequence; identical to SEQ ID NO: 52346
  Description of Artificial Sequence: Synthetic oligonucleotide

SEQ ID NO: 389414 - DNA, 34 bp, Artificial Sequence; identical to SEQ ID NO: 52347
  Description of Artificial Sequence: Synthetic oligonucleotide

SEQ ID NO: 389415 - DNA, 33 bp, Artificial Sequence; identical to SEQ ID NO: 52348
  Description of Artificial Sequence: Synthetic oligonucleotide

SEQ ID NO: 389416 - DNA, 34 bp, Artificial Sequence; identical to SEQ ID NO: 52349
  Description of Artificial Sequence: Synthetic oligonucleotide

SEQ ID NO: 389417 - DNA, 33 bp, Artificial Sequence; identical to SEQ ID NO: 52350
  Description of Artificial Sequence: Synthetic oligonucleotide

SEQ ID NO: 389418 - DNA, 32 bp, Artificial Sequence; identical to SEQ ID NO: 52351
  Description of Artificial Sequence: Synthetic oligonucleotide

SEQ ID NO: 389419 - DNA, 33 bp, Artificial Sequence; identical to SEQ ID NO: 52352
  Description of Artificial Sequence: Synthetic oligonucleotide

SEQ ID NO: 389420 - DNA, 32 bp, Artificial Sequence; identical to SEQ ID NO: 52353
  Description of Artificial Sequence: Synthetic oligonucleotide

SEQ ID NO: 389421 - DNA, 31 bp, Artificial Sequence; identical to SEQ ID NO: 52354
  Description of Artificial Sequence: Synthetic oligonucleotide

SEQ ID NO: 389422 - DNA, 30 bp, Artificial Sequence; identical to SEQ ID NO: 52355
  Description of Artificial Sequence: Synthetic oligonucleotide

SEQ ID NO: 389423 - DNA, 29 bp, Artificial Sequence
  Description of Artificial Sequence: Synthetic oligonucleotide
tcgctatccagcgttccaaccacactcag

SEQ ID NO: 389424 - DNA, 28 bp, Artificial Sequence
  Description of Artificial Sequence: Synthetic oligonucleotide
cgctatccagcgttccaaccacactcag

SEQ ID NO: 389425 - DNA, 28 bp, Artificial Sequence
  Description of Artificial Sequence: Synthetic oligonucleotide
gctatccagcgttccaaccacactcagg

SEQ ID NO: 389426 - DNA, 28 bp, Artificial Sequence
  Description of Artificial Sequence: Synthetic oligonucleotide
ctatccagcgttccaaccacactcaggc

SEQ ID NO: 389427 - DNA, 28 bp, Artificial Sequence
  Description of Artificial Sequence: Synthetic oligonucleotide
tatccagcgttccaaccacactcaggcc

SEQ ID NO: 389428 - DNA, 27 bp, Artificial Sequence
  Description of Artificial Sequence: Synthetic oligonucleotide
ctgaggtgaccgtgtttcccaaggagg

SEQ ID NO: 389429 - DNA, 27 bp, Artificial Sequence
  Description of Artificial Sequence: Synthetic oligonucleotide
tgaggtgaccgtgtttcccaaggaggc

SEQ ID NO: 389430 - DNA, 27 bp, Artificial Sequence
  Description of Artificial Sequence: Synthetic oligonucleotide
gaggtgaccgtgtttcccaaggaggct

SEQ ID NO: 389431 - DNA, 27 bp, Artificial Sequence
  Description of Artificial Sequence: Synthetic oligonucleotide
aggtgaccgtgtttcccaaggaggctg

SEQ ID NO: 389432 - DNA, 27 bp, Artificial Sequence
  Description of Artificial Sequence: Synthetic oligonucleotide
ggtgaccgtgtttcccaaggaggctgt

SEQ ID NO: 389433 - DNA, 27 bp, Artificial Sequence
  Description of Artificial Sequence: Synthetic oligonucleotide
gtgaccgtgtttcccaaggaggctgtg

SEQ ID NO: 389434 - DNA, 27 bp, Artificial Sequence
  Description of Artificial Sequence: Synthetic oligonucleotide
tgaccgtgtttcccaaggaggctgtgg

SEQ ID NO: 389435 - DNA, 27 bp, Artificial Sequence
  Description of Artificial Sequence: Synthetic oligonucleotide
gaccgtgtttcccaaggaggctgtgga

SEQ ID NO: 389436 - DNA, 27 bp, Artificial Sequence
  Description of Artificial Sequence: Synthetic oligonucleotide
accgtgtttcccaaggaggctgtggag

SEQ ID NO: 389437 - DNA, 26 bp, Artificial Sequence
  Description of Artificial Sequence: Synthetic oligonucleotide
ccgtgtttcccaaggaggctgtggag

SEQ ID NO: 389438 - DNA, 27 bp, Artificial Sequence
  Description of Artificial Sequence: Synthetic oligonucleotide
cgtgtttcccaaggaggctgtggagct

SEQ ID NO: 389439 - DNA, 27 bp, Artificial Sequence
  Description of Artificial Sequence: Synthetic oligonucleotide
gtgtttcccaaggaggctgtggagctg

SEQ ID NO: 389440 - DNA, 27 bp, Artificial Sequence
  Description of Artificial Sequence: Synthetic oligonucleotide
tgtttcccaaggaggctgtggagctgg

SEQ ID NO: 389441 - DNA, 26 bp, Artificial Sequence
  Description of Artificial Sequence: Synthetic oligonucleotide
gtttcccaaggaggctgtggagctgg

SEQ ID NO: 389442 - DNA, 26 bp, Artificial Sequence
  Description of Artificial Sequence: Synthetic oligonucleotide
tttcccaaggaggctgtggagctggg

SEQ ID NO: 389443 - DNA, 25 bp, Artificial Sequence
  Description of Artificial Sequence: Synthetic oligonucleotide
ttcccaaggaggctgtggagctggg

SEQ ID NO: 389444 - DNA, 24 bp, Artificial Sequence
  Description of Artificial Sequence: Synthetic oligonucleotide
tcccaaggaggctgtggagctggg

SEQ ID NO: 389445 - DNA, 23 bp, Artificial Sequence
  Description of Artificial Sequence: Synthetic oligonucleotide
cccaaggaggctgtggagctggg

SEQ ID NO: 389446 - DNA, 23 bp, Artificial Sequence
  Description of Artificial Sequence: Synthetic oligonucleotide
ccaaggaggctgtggagctgggc

SEQ ID NO: 389447 - DNA, 24 bp, Artificial Sequence
  Description of Artificial Sequence: Synthetic oligonucleotide
caaggaggctgtggagctgggcca

SEQ ID NO: 389448 - DNA, 24 bp, Artificial Sequence
  Description of Artificial Sequence: Synthetic oligonucleotide
aaggaggctgtggagctgggccag

SEQ ID NO: 389449 - DNA, 23 bp, Artificial Sequence
  Description of Artificial Sequence: Synthetic oligonucleotide
aggaggctgtggagctgggccag

SEQ ID NO: 389450 - DNA, 22 bp, Artificial Sequence
  Description of Artificial Sequence: Synthetic oligonucleotide
ggaggctgtggagctgggccag

SEQ ID NO: 389451 - DNA, 22 bp, Artificial Sequence
  Description of Artificial Sequence: Synthetic oligonucleotide
gaggctgtggagctgggccagc

SEQ ID NO: 389452 - DNA, 22 bp, Artificial Sequence
  Description of Artificial Sequence: Synthetic oligonucleotide
aggctgtggagctgggccagcc

SEQ ID NO: 389453 - DNA, 21 bp, Artificial Sequence
  Description of Artificial Sequence: Synthetic oligonucleotide
ggctgtggagctgggccagcc

SEQ ID NO: 389454 - DNA, 23 bp, Artificial Sequence
  Description of Artificial Sequence: Synthetic oligonucleotide
gctgtggagctgggccagcccaa

SEQ ID NO: 389455 - DNA, 32 bp, Artificial Sequence; identical to SEQ ID NO: 52388
  Description of Artificial Sequence: Synthetic oligonucleotide

SEQ ID NO: 389456 - DNA, 31 bp, Artificial Sequence; identical to SEQ ID NO: 52389
  Description of Artificial Sequence: Synthetic oligonucleotide

SEQ ID NO: 389457 - DNA, 29 bp, Artificial Sequence
  Description of Artificial Sequence: Synthetic oligonucleotide
ccaagagccaatccagatgcctgagacag

SEQ ID NO: 389458 - DNA, 29 bp, Artificial Sequence
  Description of Artificial Sequence: Synthetic oligonucleotide
caagagccaatccagatgcctgagacagc

SEQ ID NO: 389459 - DNA, 29 bp, Artificial Sequence
  Description of Artificial Sequence: Synthetic oligonucleotide
aagagccaatccagatgcctgagacagcg

SEQ ID NO: 389460 - DNA, 28 bp, Artificial Sequence
  Description of Artificial Sequence: Synthetic oligonucleotide
agagccaatccagatgcctgagacagcg

SEQ ID NO: 389461 - DNA, 27 bp, Artificial Sequence
  Description of Artificial Sequence: Synthetic oligonucleotide
gagccaatccagatgcctgagacagcg

SEQ ID NO: 389462 - DNA, 27 bp, Artificial Sequence
  Description of Artificial Sequence: Synthetic oligonucleotide
agccaatccagatgcctgagacagcgg

SEQ ID NO: 389463 - DNA, 27 bp, Artificial Sequence
  Description of Artificial Sequence: Synthetic oligonucleotide
gccaatccagatgcctgagacagcgga

SEQ ID NO: 389464 - DNA, 27 bp, Artificial Sequence
  Description of Artificial Sequence: Synthetic oligonucleotide
ccaatccagatgcctgagacagcggag

SEQ ID NO: 389465 - DNA, 28 bp, Artificial Sequence
  Description of Artificial Sequence: Synthetic oligonucleotide
caatccagatgcctgagacagcggagac

SEQ ID NO: 389466 - DNA, 29 bp, Artificial Sequence
  Description of Artificial Sequence: Synthetic oligonucleotide
aatccagatgcctgagacagcggagactg

SEQ ID NO: 389467 - DNA, 28 bp, Artificial Sequence
  Description of Artificial Sequence: Synthetic oligonucleotide
atccagatgcctgagacagcggagactg

SEQ ID NO: 389468 - DNA, 27 bp, Artificial Sequence
  Description of Artificial Sequence: Synthetic oligonucleotide
tccagatgcctgagacagcggagactg

SEQ ID NO: 389469 - DNA, 27 bp, Artificial Sequence
  Description of Artificial Sequence: Synthetic oligonucleotide
ccagatgcctgagacagcggagactgt

SEQ ID NO: 389470 - DNA, 27 bp, Artificial Sequence
  Description of Artificial Sequence: Synthetic oligonucleotide
cagatgcctgagacagcggagactgtg

SEQ ID NO: 389471 - DNA, 27 bp, Artificial Sequence
  Description of Artificial Sequence: Synthetic oligonucleotide
agatgcctgagacagcggagactgtgc

SEQ ID NO: 389472 - DNA, 27 bp, Artificial Sequence
  Description of Artificial Sequence: Synthetic oligonucleotide
gatgcctgagacagcggagactgtgct

SEQ ID NO: 389473 - DNA, 27 bp, Artificial Sequence
  Description of Artificial Sequence: Synthetic oligonucleotide
atgcctgagacagcggagactgtgctc

SEQ ID NO: 389474 - DNA, 27 bp, Artificial Sequence
  Description of Artificial Sequence: Synthetic oligonucleotide
tgcctgagacagcggagactgtgctct

SEQ ID NO: 389475 - DNA, 26 bp, Artificial Sequence
  Description of Artificial Sequence: Synthetic oligonucleotide
gcctgagacagcggagactgtgctct

SEQ ID NO: 389476 - DNA, 27 bp, Artificial Sequence
  Description of Artificial Sequence: Synthetic oligonucleotide
cctgagacagcggagactgtgctctgt

SEQ ID NO: 389477 - DNA, 27 bp, Artificial Sequence
  Description of Artificial Sequence: Synthetic oligonucleotide
ctgagacagcggagactgtgctctgtg

SEQ ID NO: 389478 - DNA, 27 bp, Artificial Sequence
  Description of Artificial Sequence: Synthetic oligonucleotide
tgagacagcggagactgtgctctgtgc

SEQ ID NO: 389479 - DNA, 26 bp, Artificial Sequence
  Description of Artificial Sequence: Synthetic oligonucleotide
gagacagcggagactgtgctctgtgc

SEQ ID NO: 389480 - DNA, 26 bp, Artificial Sequence
  Description of Artificial Sequence: Synthetic oligonucleotide
agacagcggagactgtgctctgtgcc

SEQ ID NO: 389481 - DNA, 25 bp, Artificial Sequence
  Description of Artificial Sequence: Synthetic oligonucleotide
gacagcggagactgtgctctgtgcc

SEQ ID NO: 389482 - DNA, 26 bp, Artificial Sequence
  Description of Artificial Sequence: Synthetic oligonucleotide
acagcggagactgtgctctgtgccct

SEQ ID NO: 389483 - DNA, 25 bp, Artificial Sequence
  Description of Artificial Sequence: Synthetic oligonucleotide
cagcggagactgtgctctgtgccct

SEQ ID NO: 389484 - DNA, 25 bp, Artificial Sequence
  Description of Artificial Sequence: Synthetic oligonucleotide
agcggagactgtgctctgtgccctg

SEQ ID NO: 389485 - DNA, 24 bp, Artificial Sequence
  Description of Artificial Sequence: Synthetic oligonucleotide
gcggagactgtgctctgtgccctg

SEQ ID NO: 389486 - DNA, 28 bp, Artificial Sequence
  Description of Artificial Sequence: Synthetic oligonucleotide
atgatggttctgcaggtttctgcggccc

SEQ ID NO: 389487 - DNA, 27 bp, Artificial Sequence
  Description of Artificial Sequence: Synthetic oligonucleotide
tgatggttctgcaggtttctgcggccc

SEQ ID NO: 389488 - DNA, 26 bp, Artificial Sequence
  Description of Artificial Sequence: Synthetic oligonucleotide
gatggttctgcaggtttctgcggccc

SEQ ID NO: 389489 - DNA, 26 bp, Artificial Sequence
  Description of Artificial Sequence: Synthetic oligonucleotide
atggttctgcaggtttctgcggcccc

SEQ ID NO: 389490 - DNA, 25 bp, Artificial Sequence
  Description of Artificial Sequence: Synthetic oligonucleotide
tggttctgcaggtttctgcggcccc

SEQ ID NO: 389491 - DNA, 24 bp, Artificial Sequence
  Description of Artificial Sequence: Synthetic oligonucleotide
ggttctgcaggtttctgcggcccc

SEQ ID NO: 389492 - DNA, 24 bp, Artificial Sequence
  Description of Artificial Sequence: Synthetic oligonucleotide
gttctgcaggtttctgcggccccc

SEQ ID NO: 389493 - DNA, 24 bp, Artificial Sequence
  Description of Artificial Sequence: Synthetic oligonucleotide
ttctgcaggtttctgcggcccccc

SEQ ID NO: 389494 - DNA, 23 bp, Artificial Sequence
  Description of Artificial Sequence: Synthetic oligonucleotide
tctgcaggtttctgcggcccccc

SEQ ID NO: 389495 - DNA, 22 bp, Artificial Sequence
  Description of Artificial Sequence: Synthetic oligonucleotide
ctgcaggtttctgcggcccccc

SEQ ID NO: 389496 - DNA, 22 bp, Artificial Sequence
  Description of Artificial Sequence: Synthetic oligonucleotide
tgcaggtttctgcggccccccg

SEQ ID NO: 389497 - DNA, 21 bp, Artificial Sequence
  Description of Artificial Sequence: Synthetic oligonucleotide
gcaggtttctgcggccccccg

SEQ ID NO: 389498 - DNA, 22 bp, Artificial Sequence
  Description of Artificial Sequence: Synthetic oligonucleotide
caggtttctgcggccccccgga

SEQ ID NO: 389499 - DNA, 23 bp, Artificial Sequence
  Description of Artificial Sequence: Synthetic oligonucleotide
aggtttctgcggccccccggaca

SEQ ID NO: 389500 - DNA, 22 bp, Artificial Sequence
  Description of Artificial Sequence: Synthetic oligonucleotide
ggtttctgcggccccccggaca

SEQ ID NO: 389501 - DNA, 23 bp, Artificial Sequence
  Description of Artificial Sequence: Synthetic oligonucleotide
gtttctgcggccccccggacagt

SEQ ID NO: 389502 - DNA, 23 bp, Artificial Sequence
  Description of Artificial Sequence: Synthetic oligonucleotide
tttctgcggccccccggacagtg

SEQ ID NO: 389503 - DNA, 22 bp, Artificial Sequence
  Description of Artificial Sequence: Synthetic oligonucleotide
ttctgcggccccccggacagtg

SEQ ID NO: 389504 - DNA, 21 bp, Artificial Sequence
  Description of Artificial Sequence: Synthetic oligonucleotide
tctgcggccccccggacagtg

SEQ ID NO: 389505 - DNA, 20 bp, Artificial Sequence
  Description of Artificial Sequence: Synthetic oligonucleotide
ctgcggccccccggacagtg

SEQ ID NO: 389506 - DNA, 20 bp, Artificial Sequence
  Description of Artificial Sequence: Synthetic oligonucleotide
tgcggccccccggacagtgg

SEQ ID NO: 389507 - DNA, 20 bp, Artificial Sequence
  Description of Artificial Sequence: Synthetic oligonucleotide
gcggccccccggacagtggt

SEQ ID NO: 389508 - DNA, 20 bp, Artificial Sequence
  Description of Artificial Sequence: Synthetic oligonucleotide
cggccccccggacagtggct

SEQ ID NO: 389509 - DNA, 21 bp, Artificial Sequence
  Description of Artificial Sequence: Synthetic oligonucleotide
ggccccccggacagtggctct

SEQ ID NO: 389510 - DNA, 22 bp, Artificial Sequence
  Description of Artificial Sequence: Synthetic oligonucleotide
gccccccggacagtggctctga

SEQ ID NO: 389511 - DNA, 22 bp, Artificial Sequence
  Description of Artificial Sequence: Synthetic oligonucleotide
ccccccggacagtggctctgac

SEQ ID NO: 389512 - DNA, 22 bp, Artificial Sequence
  Description of Artificial Sequence: Synthetic oligonucleotide
cccccggacagtggctctgacg

SEQ ID NO: 389513 - DNA, 22 bp, Artificial Sequence
  Description of Artificial Sequence: Synthetic oligonucleotide
ccccggacagtggctctgacgg

SEQ ID NO: 389514 - DNA, 22 bp, Artificial Sequence
  Description of Artificial Sequence: Synthetic oligonucleotide
cccggacagtggctctgacggc

SEQ ID NO: 389515 - DNA, 25 bp, Artificial Sequence
  Description of Artificial Sequence: Synthetic oligonucleotide
ccggacagtggctctgacggcgtta

SEQ ID NO: 389516 - DNA, 26 bp, Artificial Sequence
  Description of Artificial Sequence: Synthetic oligonucleotide
cggacagtggctctgacggcgttact

SEQ ID NO: 389517 - DNA, 27 bp, Artificial Sequence
  Description of Artificial Sequence: Synthetic oligonucleotide
ggacagtggctctgacggcgttactga

SEQ ID NO: 389518 - DNA, 28 bp, Artificial Sequence
  Description of Artificial Sequence: Synthetic oligonucleotide
gacagtggctctgacggcgttactgatg

SEQ ID NO: 389519 - DNA, 28 bp, Artificial Sequence
  Description of Artificial Sequence: Synthetic oligonucleotide
acagtggctctgacggcgttactgatgg

SEQ ID NO: 389520 - DNA, 27 bp, Artificial Sequence
  Description of Artificial Sequence: Synthetic oligonucleotide
cagtggctctgacggcgttactgatgg

SEQ ID NO: 389521 - DNA, 28 bp, Artificial Sequence
  Description of Artificial Sequence: Synthetic oligonucleotide
agtggctctgacggcgttactgatggtg

SEQ ID NO: 389522 - DNA, 27 bp, Artificial Sequence
  Description of Artificial Sequence: Synthetic oligonucleotide
gtggctctgacggcgttactgatggtg

SEQ ID NO: 389523 - DNA, 27 bp, Artificial Sequence
  Description of Artificial Sequence: Synthetic oligonucleotide
tggctctgacggcgttactgatggtgc

SEQ ID NO: 389524 - DNA, 27 bp, Artificial Sequence
  Description of Artificial Sequence: Synthetic oligonucleotide
ggctctgacggcgttactgatggtgct

SEQ ID NO: 389525 - DNA, 27 bp, Artificial Sequence
  Description of Artificial Sequence: Synthetic oligonucleotide
gctctgacggcgttactgatggtgctg

SEQ ID NO: 389526 - DNA, 27 bp, Artificial Sequence
  Description of Artificial Sequence: Synthetic oligonucleotide
ctctgacggcgttactgatggtgctgc

SEQ ID NO: 389527 - DNA, 28 bp, Artificial Sequence
  Description of Artificial Sequence: Synthetic oligonucleotide
tctgacggcgttactgatggtgctgctc

SEQ ID NO: 389528 - DNA, 27 bp, Artificial Sequence
  Description of Artificial Sequence: Synthetic oligonucleotide
ctgacggcgttactgatggtgctgctc

SEQ ID NO: 389529 - DNA, 28 bp, Artificial Sequence
  Description of Artificial Sequence: Synthetic oligonucleotide
tgacggcgttactgatggtgctgctcac

SEQ ID NO: 389530 - DNA, 27 bp, Artificial Sequence
  Description of Artificial Sequence: Synthetic oligonucleotide
gacggcgttactgatggtgctgctcac

SEQ ID NO: 389531 - DNA, 29 bp, Artificial Sequence
  Description of Artificial Sequence: Synthetic oligonucleotide
acggcgttactgatggtgctgctcacatc

SEQ ID NO: 389532 - DNA, 28 bp, Artificial Sequence
  Description of Artificial Sequence: Synthetic oligonucleotide
cggcgttactgatggtgctgctcacatc

SEQ ID NO: 389533 - DNA, 29 bp, Artificial Sequence
  Description of Artificial Sequence: Synthetic oligonucleotide
ggcgttactgatggtgctgctcacatctg

SEQ ID NO: 389534 - DNA, 30 bp, Artificial Sequence; identical to SEQ ID NO: 52467
  Description of Artificial Sequence: Synthetic oligonucleotide

SEQ ID NO: 389535 - DNA, 30 bp, Artificial Sequence; identical to SEQ ID NO: 52468
  Description of Artificial Sequence: Synthetic oligonucleotide

SEQ ID NO: 389536 - DNA, 31 bp, Artificial Sequence; identical to SEQ ID NO: 52469
  Description of Artificial Sequence: Synthetic oligonucleotide

SEQ ID NO: 389537 - DNA, 31 bp, Artificial Sequence; identical to SEQ ID NO: 52470
  Description of Artificial Sequence: Synthetic oligonucleotide

SEQ ID NO: 389538 - DNA, 30 bp, Artificial Sequence; identical to SEQ ID NO: 52471
  Description of Artificial Sequence: Synthetic oligonucleotide

SEQ ID NO: 389539 - DNA, 29 bp, Artificial Sequence
  Description of Artificial Sequence: Synthetic oligonucleotide
actgatggtgctgctcacatctgtggtcc

SEQ ID NO: 389540 - DNA, 28 bp, Artificial Sequence
  Description of Artificial Sequence: Synthetic oligonucleotide
ctgatggtgctgctcacatctgtggtcc

SEQ ID NO: 389541 - DNA, 29 bp, Artificial Sequence
  Description of Artificial Sequence: Synthetic oligonucleotide
tgatggtgctgctcacatctgtggtccag

SEQ ID NO: 389542 - DNA, 28 bp, Artificial Sequence
  Description of Artificial Sequence: Synthetic oligonucleotide
gatggtgctgctcacatctgtggtccag

SEQ ID NO: 389543 - DNA, 28 bp, Artificial Sequence
  Description of Artificial Sequence: Synthetic oligonucleotide
atggtgctgctcacatctgtggtccagg

SEQ ID NO: 389544 - DNA, 27 bp, Artificial Sequence
  Description of Artificial Sequence: Synthetic oligonucleotide
tggtgctgctcacatctgtggtccagg

SEQ ID NO: 389545 - DNA, 26 bp, Artificial Sequence
  Description of Artificial Sequence: Synthetic oligonucleotide
ggtgctgctcacatctgtggtccagg

SEQ ID NO: 389546 - DNA, 26 bp, Artificial Sequence
  Description of Artificial Sequence: Synthetic oligonucleotide
gtgctgctcacatctgtggtccaggg

SEQ ID NO: 389547 - DNA, 27 bp, Artificial Sequence
  Description of Artificial Sequence: Synthetic oligonucleotide
tgctgctcacatctgtggtccagggca

SEQ ID NO: 389548 - DNA, 26 bp, Artificial Sequence
  Description of Artificial Sequence: Synthetic oligonucleotide
gctgctcacatctgtggtccagggca

SEQ ID NO: 389549 - DNA, 26 bp, Artificial Sequence
  Description of Artificial Sequence: Synthetic oligonucleotide
ctgctcacatctgtggtccagggcag

SEQ ID NO: 389550 - DNA, 26 bp, Artificial Sequence
  Description of Artificial Sequence: Synthetic oligonucleotide
tgctcacatctgtggtccagggcagg

SEQ ID NO: 389551 - DNA, 25 bp, Artificial Sequence
  Description of Artificial Sequence: Synthetic oligonucleotide
gctcacatctgtggtccagggcagg

SEQ ID NO: 389552 - DNA, 25 bp, Artificial Sequence
  Description of Artificial Sequence: Synthetic oligonucleotide
ctcacatctgtggtccagggcaggg

SEQ ID NO: 389553 - DNA, 25 bp, Artificial Sequence
  Description of Artificial Sequence: Synthetic oligonucleotide
tcacatctgtggtccagggcagggc

SEQ ID NO: 389554 - DNA, 24 bp, Artificial Sequence
  Description of Artificial Sequence: Synthetic oligonucleotide
cacatctgtggtccagggcagggc

SEQ ID NO: 389555 - DNA, 25 bp, Artificial Sequence
  Description of Artificial Sequence: Synthetic oligonucleotide
acatctgtggtccagggcagggcca

SEQ ID NO: 389556 - DNA, 24 bp, Artificial Sequence
  Description of Artificial Sequence: Synthetic oligonucleotide
catctgtggtccagggcagggcca

SEQ ID NO: 389557 - DNA, 25 bp, Artificial Sequence
  Description of Artificial Sequence: Synthetic oligonucleotide
atctgtggtccagggcagggccact

SEQ ID NO: 389558 - DNA, 24 bp, Artificial Sequence
  Description of Artificial Sequence: Synthetic oligonucleotide
tctgtggtccagggcagggccact

SEQ ID NO: 389559 - DNA, 23 bp, Artificial Sequence
  Description of Artificial Sequence: Synthetic oligonucleotide
ctgtggtccagggcagggccact

SEQ ID NO: 389560 - DNA, 23 bp, Artificial Sequence
  Description of Artificial Sequence: Synthetic oligonucleotide
tgtggtccagggcagggccactc

SEQ ID NO: 389561 - DNA, 22 bp, Artificial Sequence
  Description of Artificial Sequence: Synthetic oligonucleotide
gtggtccagggcagggccactc

SEQ ID NO: 389562 - DNA, 23 bp, Artificial Sequence
  Description of Artificial Sequence: Synthetic oligonucleotide
tggtccagggcagggccactcca

SEQ ID NO: 389563 - DNA, 22 bp, Artificial Sequence
  Description of Artificial Sequence: Synthetic oligonucleotide
ggtccagggcagggccactcca

SEQ ID NO: 389564 - DNA, 23 bp, Artificial Sequence
  Description of Artificial Sequence: Synthetic oligonucleotide
gtccagggcagggccactccaga

SEQ ID NO: 389565 - DNA, 27 bp, Artificial Sequence
  Description of Artificial Sequence: Synthetic oligonucleotide
tccagggcagggccactccagagaatt

SEQ ID NO: 389566 - DNA, 27 bp, Artificial Sequence
  Description of Artificial Sequence: Synthetic oligonucleotide
ccagggcagggccactccagagaatta

SEQ ID NO: 389567 - DNA, 27 bp, Artificial Sequence
  Description of Artificial Sequence: Synthetic oligonucleotide
cagggcagggccactccagagaattac

SEQ ID NO: 389568 - DNA, 27 bp, Artificial Sequence
  Description of Artificial Sequence: Synthetic oligonucleotide
agggcagggccactccagagaattacg

SEQ ID NO: 389569 - DNA, 27 bp, Artificial Sequence
  Description of Artificial Sequence: Synthetic oligonucleotide
gggcagggccactccagagaattacgt

SEQ ID NO: 389570 - DNA, 27 bp, Artificial Sequence
  Description of Artificial Sequence: Synthetic oligonucleotide
ggcagggccactccagagaattacgtg

SEQ ID NO: 389571 - DNA, 29 bp, Artificial Sequence
  Description of Artificial Sequence: Synthetic oligonucleotide
gcagggccactccagagaattacgtgtac

SEQ ID NO: 389572 - DNA, 29 bp, Artificial Sequence
  Description of Artificial Sequence: Synthetic oligonucleotide
cagggccactccagagaattacgtgtacc

SEQ ID NO: 389573 - DNA, 30 bp, Artificial Sequence; identical to SEQ ID NO: 52506
  Description of Artificial Sequence: Synthetic oligonucleotide

SEQ ID NO: 389574 - DNA, 29 bp, Artificial Sequence
  Description of Artificial Sequence: Synthetic oligonucleotide
gggccactccagagaattacgtgtaccag

SEQ ID NO: 389575 - DNA, 29 bp, Artificial Sequence
  Description of Artificial Sequence: Synthetic oligonucleotide
ggccactccagagaattacgtgtaccagg

SEQ ID NO: 389576 - DNA, 29 bp, Artificial Sequence
  Description of Artificial Sequence: Synthetic oligonucleotide
gccactccagagaattacgtgtaccaggg

SEQ ID NO: 389577 - DNA, 30 bp, Artificial Sequence; identical to SEQ ID NO: 52510
  Description of Artificial Sequence: Synthetic oligonucleotide

SEQ ID NO: 389578 - DNA, 30 bp, Artificial Sequence; identical to SEQ ID NO: 52511
  Description of Artificial Sequence: Synthetic oligonucleotide

SEQ ID NO: 389579 - DNA, 30 bp, Artificial Sequence; identical to SEQ ID NO: 52512
  Description of Artificial Sequence: Synthetic oligonucleotide

SEQ ID NO: 389580 - DNA, 29 bp, Artificial Sequence
  Description of Artificial Sequence: Synthetic oligonucleotide
ctccagagaattacgtgtaccagggacgg

SEQ ID NO: 389581 - DNA, 29 bp, Artificial Sequence
  Description of Artificial Sequence: Synthetic oligonucleotide
tccagagaattacgtgtaccagggacggc

SEQ ID NO: 389582 - DNA, 28 bp, Artificial Sequence
  Description of Artificial Sequence: Synthetic oligonucleotide
ccagagaattacgtgtaccagggacggc

SEQ ID NO: 389583 - DNA, 29 bp, Artificial Sequence
  Description of Artificial Sequence: Synthetic oligonucleotide
cagagaattacgtgtaccagggacggcag

SEQ ID NO: 389584 - DNA, 29 bp, Artificial Sequence
  Description of Artificial Sequence: Synthetic oligonucleotide
agagaattacgtgtaccagggacggcagg

SEQ ID NO: 389585 - DNA, 28 bp, Artificial Sequence
  Description of Artificial Sequence: Synthetic oligonucleotide
gagaattacgtgtaccagggacggcagg

SEQ ID NO: 389586 - DNA, 31 bp, Artificial Sequence; identical to SEQ ID NO: 52519
  Description of Artificial Sequence: Synthetic oligonucleotide

SEQ ID NO: 389587 - DNA, 30 bp, Artificial Sequence; identical to SEQ ID NO: 52520
  Description of Artificial Sequence: Synthetic oligonucleotide

SEQ ID NO: 389588 - DNA, 30 bp, Artificial Sequence; identical to SEQ ID NO: 52521
  Description of Artificial Sequence: Synthetic oligonucleotide

SEQ ID NO: 389589 - DNA, 29 bp, Artificial Sequence
  Description of Artificial Sequence: Synthetic oligonucleotide
attacgtgtaccagggacggcaggaatgc

SEQ ID NO: 389590 - DNA, 28 bp, Artificial Sequence
  Description of Artificial Sequence: Synthetic oligonucleotide
ttacgtgtaccagggacggcaggaatgc

SEQ ID NO: 389591 - DNA, 27 bp, Artificial Sequence
  Description of Artificial Sequence: Synthetic oligonucleotide
tacgtgtaccagggacggcaggaatgc

SEQ ID NO: 389592 - DNA, 27 bp, Artificial Sequence
  Description of Artificial Sequence: Synthetic oligonucleotide
acgtgtaccagggacggcaggaatgct

SEQ ID NO: 389593 - DNA, 27 bp, Artificial Sequence
  Description of Artificial Sequence: Synthetic oligonucleotide
cgtgtaccagggacggcaggaatgcta

SEQ ID NO: 389594 - DNA, 27 bp, Artificial Sequence
  Description of Artificial Sequence: Synthetic oligonucleotide
gtgtaccagggacggcaggaatgctac

SEQ ID NO: 389595 - DNA, 27 bp, Artificial Sequence
  Description of Artificial Sequence: Synthetic oligonucleotide
tgtaccagggacggcaggaatgctacg

SEQ ID NO: 389596 - DNA, 26 bp, Artificial Sequence
  Description of Artificial Sequence: Synthetic oligonucleotide
gtaccagggacggcaggaatgctacg

SEQ ID NO: 389597 - DNA, 26 bp, Artificial Sequence
  Description of Artificial Sequence: Synthetic oligonucleotide
taccagggacggcaggaatgctacgc

SEQ ID NO: 389598 - DNA, 25 bp, Artificial Sequence
  Description of Artificial Sequence: Synthetic oligonucleotide
accagggacggcaggaatgctacgc

SEQ ID NO: 389599 - DNA, 24 bp, Artificial Sequence
  Description of Artificial Sequence: Synthetic oligonucleotide
ccagggacggcaggaatgctacgc

SEQ ID NO: 389600 - DNA, 27 bp, Artificial Sequence
  Description of Artificial Sequence: Synthetic oligonucleotide
cagggacggcaggaatgctacgcgttt

SEQ ID NO: 389601 - DNA, 30 bp, Artificial Sequence; identical to SEQ ID NO: 52534
  Description of Artificial Sequence: Synthetic oligonucleotide

SEQ ID NO: 389602 - DNA, 29 bp, Artificial Sequence
  Description of Artificial Sequence: Synthetic oligonucleotide
gggacggcaggaatgctacgcgtttaatg

SEQ ID NO: 389603 - DNA, 29 bp, Artificial Sequence
  Description of Artificial Sequence: Synthetic oligonucleotide
ggacggcaggaatgctacgcgtttaatgg

SEQ ID NO: 389604 - DNA, 29 bp, Artificial Sequence
  Description of Artificial Sequence: Synthetic oligonucleotide
gacggcaggaatgctacgcgtttaatggg

SEQ ID NO: 389605 - DNA, 30 bp, Artificial Sequence; identical to SEQ ID NO: 52538
  Description of Artificial Sequence: Synthetic oligonucleotide

SEQ ID NO: 389606 - DNA, 29 bp, Artificial Sequence
  Description of Artificial Sequence: Synthetic oligonucleotide
cggcaggaatgctacgcgtttaatgggac

SEQ ID NO: 389607 - DNA, 30 bp, Artificial Sequence; identical to SEQ ID NO: 52540
  Description of Artificial Sequence: Synthetic oligonucleotide

SEQ ID NO: 389608 - DNA, 31 bp, Artificial Sequence; identical to SEQ ID NO: 52541
  Description of Artificial Sequence: Synthetic oligonucleotide

SEQ ID NO: 389609 - DNA, 31 bp, Artificial Sequence; identical to SEQ ID NO: 52542
  Description of Artificial Sequence: Synthetic oligonucleotide

SEQ ID NO: 389610 - DNA, 31 bp, Artificial Sequence; identical to SEQ ID NO: 52543
  Description of Artificial Sequence: Synthetic oligonucleotide

SEQ ID NO: 389611 - DNA, 30 bp, Artificial Sequence; identical to SEQ ID NO: 52544
  Description of Artificial Sequence: Synthetic oligonucleotide

SEQ ID NO: 389612 - DNA, 30 bp, Artificial Sequence; identical to SEQ ID NO: 52545
  Description of Artificial Sequence: Synthetic oligonucleotide

SEQ ID NO: 389613 - DNA, 32 bp, Artificial Sequence; identical to SEQ ID NO: 52546
  Description of Artificial Sequence: Synthetic oligonucleotide

SEQ ID NO: 389614 - DNA, 31 bp, Artificial Sequence; identical to SEQ ID NO: 52547
  Description of Artificial Sequence: Synthetic oligonucleotide

SEQ ID NO: 389615 - DNA, 30 bp, Artificial Sequence; identical to SEQ ID NO: 52548
  Description of Artificial Sequence: Synthetic oligonucleotide

SEQ ID NO: 389616 - DNA, 29 bp, Artificial Sequence
  Description of Artificial Sequence: Synthetic oligonucleotide
gctacgcgtttaatgggacacagcgcttc

SEQ ID NO: 389617 - DNA, 29 bp, Artificial Sequence
  Description of Artificial Sequence: Synthetic oligonucleotide
ctacgcgtttaatgggacacagcgcttcc

SEQ ID NO: 389618 - DNA, 30 bp, Artificial Sequence; identical to SEQ ID NO: 52551
  Description of Artificial Sequence: Synthetic oligonucleotide

SEQ ID NO: 389619 - DNA, 29 bp, Artificial Sequence
  Description of Artificial Sequence: Synthetic oligonucleotide
acgcgtttaatgggacacagcgcttcctg

SEQ ID NO: 389620 - DNA, 28 bp, Artificial Sequence
  Description of Artificial Sequence: Synthetic oligonucleotide
cgcgtttaatgggacacagcgcttcctg

SEQ ID NO: 389621 - DNA, 28 bp, Artificial Sequence
  Description of Artificial Sequence: Synthetic oligonucleotide
gcgtttaatgggacacagcgcttcctgg

SEQ ID NO: 389622 - DNA, 29 bp, Artificial Sequence
  Description of Artificial Sequence: Synthetic oligonucleotide
cgtttaatgggacacagcgcttcctggag

SEQ ID NO: 389623 - DNA, 30 bp, Artificial Sequence; identical to SEQ ID NO: 52556
  Description of Artificial Sequence: Synthetic oligonucleotide

SEQ ID NO: 389624 - DNA, 33 bp, Artificial Sequence; identical to SEQ ID NO: 52557
  Description of Artificial Sequence: Synthetic oligonucleotide

SEQ ID NO: 389625 - DNA, 32 bp, Artificial Sequence; identical to SEQ ID NO: 52558
  Description of Artificial Sequence: Synthetic oligonucleotide

SEQ ID NO: 389626 - DNA, 31 bp, Artificial Sequence; identical to SEQ ID NO: 52559
  Description of Artificial Sequence: Synthetic oligonucleotide

SEQ ID NO: 389627 - DNA, 30 bp, Artificial Sequence; identical to SEQ ID NO: 52560
  Description of Artificial Sequence: Synthetic oligonucleotide

SEQ ID NO: 389628 - DNA, 29 bp, Artificial Sequence
  Description of Artificial Sequence: Synthetic oligonucleotide
atgggacacagcgcttcctggagagatac

SEQ ID NO: 389629 - DNA, 28 bp, Artificial Sequence
  Description of Artificial Sequence: Synthetic oligonucleotide
tgggacacagcgcttcctggagagatac

SEQ ID NO: 389630 - DNA, 27 bp, Artificial Sequence
  Description of Artificial Sequence: Synthetic oligonucleotide
gggacacagcgcttcctggagagatac

SEQ ID NO: 389631 - DNA, 29 bp, Artificial Sequence
  Description of Artificial Sequence: Synthetic oligonucleotide
ggacacagcgcttcctggagagatacatc

SEQ ID NO: 389632 - DNA, 31 bp, Artificial Sequence; identical to SEQ ID NO: 52565
  Description of Artificial Sequence: Synthetic oligonucleotide

SEQ ID NO: 389633 - DNA, 33 bp, Artificial Sequence; identical to SEQ ID NO: 52566
  Description of Artificial Sequence: Synthetic oligonucleotide

SEQ ID NO: 389634 - DNA, 32 bp, Artificial Sequence; identical to SEQ ID NO: 52567
  Description of Artificial Sequence: Synthetic oligonucleotide

SEQ ID NO: 389635 - DNA, 32 bp, Artificial Sequence; identical to SEQ ID NO: 52568
  Description of Artificial Sequence: Synthetic oligonucleotide

SEQ ID NO: 389636 - DNA, 31 bp, Artificial Sequence; identical to SEQ ID NO: 52569
  Description of Artificial Sequence: Synthetic oligonucleotide

SEQ ID NO: 389637 - DNA, 31 bp, Artificial Sequence; identical to SEQ ID NO: 52570
  Description of Artificial Sequence: Synthetic oligonucleotide

SEQ ID NO: 389638 - DNA, 30 bp, Artificial Sequence; identical to SEQ ID NO: 52571
  Description of Artificial Sequence: Synthetic oligonucleotide

SEQ ID NO: 389639 - DNA, 30 bp, Artificial Sequence; identical to SEQ ID NO: 52572
  Description of Artificial Sequence: Synthetic oligonucleotide

SEQ ID NO: 389640 - DNA, 30 bp, Artificial Sequence; identical to SEQ ID NO: 52573
  Description of Artificial Sequence: Synthetic oligonucleotide

SEQ ID NO: 389641 - DNA, 31 bp, Artificial Sequence; identical to SEQ ID NO: 52574
  Description of Artificial Sequence: Synthetic oligonucleotide

SEQ ID NO: 389642 - DNA, 31 bp, Artificial Sequence; identical to SEQ ID NO: 52575
  Description of Artificial Sequence: Synthetic oligonucleotide

SEQ ID NO: 389643 - DNA, 30 bp, Artificial Sequence; identical to SEQ ID NO: 52576
  Description of Artificial Sequence: Synthetic oligonucleotide

SEQ ID NO: 389644 - DNA, 29 bp, Artificial Sequence
  Description of Artificial Sequence: Synthetic oligonucleotide
cctggagagatacatctacaaccgggagg

SEQ ID NO: 389645 - DNA, 30 bp, Artificial Sequence; identical to SEQ ID NO: 52578
  Description of Artificial Sequence: Synthetic oligonucleotide

SEQ ID NO: 389646 - DNA, 32 bp, Artificial Sequence; identical to SEQ ID NO: 52579
  Description of Artificial Sequence: Synthetic oligonucleotide

SEQ ID NO: 389647 - DNA, 31 bp, Artificial Sequence; identical to SEQ ID NO: 52580
  Description of Artificial Sequence: Synthetic oligonucleotide

SEQ ID NO: 389648 - DNA, 31 bp, Artificial Sequence; identical to SEQ ID NO: 52581
  Description of Artificial Sequence: Synthetic oligonucleotide

SEQ ID NO: 389649 - DNA, 31 bp, Artificial Sequence; identical to SEQ ID NO: 52582
  Description of Artificial Sequence: Synthetic oligonucleotide

SEQ ID NO: 389650 - DNA, 30 bp, Artificial Sequence; identical to SEQ ID NO: 52583
  Description of Artificial Sequence: Synthetic oligonucleotide

SEQ ID NO: 389651 - DNA, 30 bp, Artificial Sequence; identical to SEQ ID NO: 52584
  Description of Artificial Sequence: Synthetic oligonucleotide

SEQ ID NO: 389652 - DNA, 29 bp, Artificial Sequence
  Description of Artificial Sequence: Synthetic oligonucleotide
gatacatctacaaccgggaggagtacgcg

SEQ ID NO: 389653 - DNA, 29 bp, Artificial Sequence
  Description of Artificial Sequence: Synthetic oligonucleotide
atacatctacaaccgggaggagtacgcgc

SEQ ID NO: 389654 - DNA, 28 bp, Artificial Sequence
  Description of Artificial Sequence: Synthetic oligonucleotide
tacatctacaaccgggaggagtacgcgc

SEQ ID NO: 389655 - DNA, 27 bp, Artificial Sequence
  Description of Artificial Sequence: Synthetic oligonucleotide
acatctacaaccgggaggagtacgcgc

SEQ ID NO: 389656 - DNA, 26 bp, Artificial Sequence
  Description of Artificial Sequence: Synthetic oligonucleotide
catctacaaccgggaggagtacgcgc

SEQ ID NO: 389657 - DNA, 26 bp, Artificial Sequence
  Description of Artificial Sequence: Synthetic oligonucleotide
atctacaaccgggaggagtacgcgcg

SEQ ID NO: 389658 - DNA, 25 bp, Artificial Sequence
  Description of Artificial Sequence: Synthetic oligonucleotide
tctacaaccgggaggagtacgcgcg

SEQ ID NO: 389659 - DNA, 24 bp, Artificial Sequence
  Description of Artificial Sequence: Synthetic oligonucleotide
ctacaaccgggaggagtacgcgcg

SEQ ID NO: 389660 - DNA, 26 bp, Artificial Sequence
  Description of Artificial Sequence: Synthetic oligonucleotide
tacaaccgggaggagtacgcgcgctt

SEQ ID NO: 389661 - DNA, 25 bp, Artificial Sequence
  Description of Artificial Sequence: Synthetic oligonucleotide
acaaccgggaggagtacgcgcgctt

SEQ ID NO: 389662 - DNA, 24 bp, Artificial Sequence
  Description of Artificial Sequence: Synthetic oligonucleotide
caaccgggaggagtacgcgcgctt

SEQ ID NO: 389663 - DNA, 24 bp, Artificial Sequence
  Description of Artificial Sequence: Synthetic oligonucleotide
aaccgggaggagtacgcgcgcttc

SEQ ID NO: 389664 - DNA, 23 bp, Artificial Sequence
  Description of Artificial Sequence: Synthetic oligonucleotide
accgggaggagtacgcgcgcttc

SEQ ID NO: 389665 - DNA, 22 bp, Artificial Sequence
  Description of Artificial Sequence: Synthetic oligonucleotide
ccgggaggagtacgcgcgcttc

SEQ ID NO: 389666 - DNA, 23 bp, Artificial Sequence
  Description of Artificial Sequence: Synthetic oligonucleotide
cgggaggagtacgcgcgcttcga

SEQ ID NO: 389667 - DNA, 24 bp, Artificial Sequence
  Description of Artificial Sequence: Synthetic oligonucleotide
gggaggagtacgcgcgcttcgaca

SEQ ID NO: 389668 - DNA, 24 bp, Artificial Sequence
  Description of Artificial Sequence: Synthetic oligonucleotide
ggaggagtacgcgcgcttcgacag

SEQ ID NO: 389669 - DNA, 24 bp, Artificial Sequence
  Description of Artificial Sequence: Synthetic oligonucleotide
gaggagtacgcgcgcttcgacagc

SEQ ID NO: 389670 - DNA, 25 bp, Artificial Sequence
  Description of Artificial Sequence: Synthetic oligonucleotide
aggagtacgcgcgcttcgacagcga

SEQ ID NO: 389671 - DNA, 24 bp, Artificial Sequence
  Description of Artificial Sequence: Synthetic oligonucleotide
ggagtacgcgcgcttcgacagcga

SEQ ID NO: 389672 - DNA, 24 bp, Artificial Sequence
  Description of Artificial Sequence: Synthetic oligonucleotide
gagtacgcgcgcttcgacagcgac

SEQ ID NO: 389673 - DNA, 25 bp, Artificial Sequence
  Description of Artificial Sequence: Synthetic oligonucleotide
agtacgcgcgcttcgacagcgacgt

SEQ ID NO: 389674 - DNA, 24 bp, Artificial Sequence
  Description of Artificial Sequence: Synthetic oligonucleotide
gtacgcgcgcttcgacagcgacgt

SEQ ID NO: 389675 - DNA, 24 bp, Artificial Sequence
  Description of Artificial Sequence: Synthetic oligonucleotide
tacgcgcgcttcgacagcgacgtg

SEQ ID NO: 389676 - DNA, 23 bp, Artificial Sequence
  Description of Artificial Sequence: Synthetic oligonucleotide
acgcgcgcttcgacagcgacgtg

SEQ ID NO: 389677 - DNA, 22 bp, Artificial Sequence
  Description of Artificial Sequence: Synthetic oligonucleotide
cgcgcgcttcgacagcgacgtg

SEQ ID NO: 389678 - DNA, 22 bp, Artificial Sequence
  Description of Artificial Sequence: Synthetic oligonucleotide
gcgcgcttcgacagcgacgtgg

SEQ ID NO: 389679 - DNA, 22 bp, Artificial Sequence
  Description of Artificial Sequence: Synthetic oligonucleotide
cgcgcttcgacagcgacgtggg

SEQ ID NO: 389680 - DNA, 22 bp, Artificial Sequence
  Description of Artificial Sequence: Synthetic oligonucleotide
gcgcttcgacagcgacgtgggg

SEQ ID NO: 389681 - DNA, 23 bp, Artificial Sequence
  Description of Artificial Sequence: Synthetic oligonucleotide
cgcttcgacagcgacgtggggga

SEQ ID NO: 389682 - DNA, 25 bp, Artificial Sequence
  Description of Artificial Sequence: Synthetic oligonucleotide
gcttcgacagcgacgtgggggagtt

SEQ ID NO: 389683 - DNA, 25 bp, Artificial Sequence
  Description of Artificial Sequence: Synthetic oligonucleotide
cttcgacagcgacgtgggggagttc

SEQ ID NO: 389684 - DNA, 25 bp, Artificial Sequence
  Description of Artificial Sequence: Synthetic oligonucleotide
ttcgacagcgacgtgggggagttcc

SEQ ID NO: 389685 - DNA, 24 bp, Artificial Sequence
  Description of Artificial Sequence: Synthetic oligonucleotide
tcgacagcgacgtgggggagttcc

SEQ ID NO: 389686 - DNA, 23 bp, Artificial Sequence
  Description of Artificial Sequence: Synthetic oligonucleotide
cgacagcgacgtgggggagttcc

SEQ ID NO: 389687 - DNA, 23 bp, Artificial Sequence
  Description of Artificial Sequence: Synthetic oligonucleotide
gacagcgacgtgggggagttccg

SEQ ID NO: 389688 - DNA, 23 bp, Artificial Sequence
  Description of Artificial Sequence: Synthetic oligonucleotide
acagcgacgtgggggagttccgg

SEQ ID NO: 389689 - DNA, 22 bp, Artificial Sequence
  Description of Artificial Sequence: Synthetic oligonucleotide
cagcgacgtgggggagttccgg

SEQ ID NO: 389690 - DNA, 22 bp, Artificial Sequence
  Description of Artificial Sequence: Synthetic oligonucleotide
agcgacgtgggggagttccggg

SEQ ID NO: 389691 - DNA, 21 bp, Artificial Sequence
  Description of Artificial Sequence: Synthetic oligonucleotide
gcgacgtgggggagttccggg

SEQ ID NO: 389692 - DNA, 21 bp, Artificial Sequence
  Description of Artificial Sequence: Synthetic oligonucleotide
cgacgtgggggagttccgggc

SEQ ID NO: 389693 - DNA, 21 bp, Artificial Sequence
  Description of Artificial Sequence: Synthetic oligonucleotide
gacgtgggggagttccgggcg

SEQ ID NO: 389694 - DNA, 22 bp, Artificial Sequence
  Description of Artificial Sequence: Synthetic oligonucleotide
acgtgggggagttccgggcggt

SEQ ID NO: 389695 - DNA, 21 bp, Artificial Sequence
  Description of Artificial Sequence: Synthetic oligonucleotide
cgtgggggagttccgggcggt

SEQ ID NO: 389696 - DNA, 22 bp, Artificial Sequence
  Description of Artificial Sequence: Synthetic oligonucleotide
gtgggggagttccgggcggtga

SEQ ID NO: 389697 - DNA, 22 bp, Artificial Sequence
  Description of Artificial Sequence: Synthetic oligonucleotide
tgggggagttccgggcggtgac

SEQ ID NO: 389698 - DNA, 21 bp, Artificial Sequence
  Description of Artificial Sequence: Synthetic oligonucleotide
gggggagttccgggcggtgac

SEQ ID NO: 389699 - DNA, 21 bp, Artificial Sequence
  Description of Artificial Sequence: Synthetic oligonucleotide
ggggagttccgggcggtgacg

SEQ ID NO: 389700 - DNA, 22 bp, Artificial Sequence
  Description of Artificial Sequence: Synthetic oligonucleotide
gggagttccgggcggtgacgga

SEQ ID NO: 389701 - DNA, 22 bp, Artificial Sequence
  Description of Artificial Sequence: Synthetic oligonucleotide
ggagttccgggcggtgacggag

SEQ ID NO: 389702 - DNA, 23 bp, Artificial Sequence
  Description of Artificial Sequence: Synthetic oligonucleotide
gagttccgggcggtgacggagct

SEQ ID NO: 389703 - DNA, 23 bp, Artificial Sequence
  Description of Artificial Sequence: Synthetic oligonucleotide
agttccgggcggtgacggagctg

SEQ ID NO: 389704 - DNA, 22 bp, Artificial Sequence
  Description of Artificial Sequence: Synthetic oligonucleotide
gttccgggcggtgacggagctg

SEQ ID NO: 389705 - DNA, 22 bp, Artificial Sequence
  Description of Artificial Sequence: Synthetic oligonucleotide
ttccgggcggtgacggagctgg

SEQ ID NO: 389706 - DNA, 21 bp, Artificial Sequence
  Description of Artificial Sequence: Synthetic oligonucleotide
tccgggcggtgacggagctgg

SEQ ID NO: 389707 - DNA, 20 bp, Artificial Sequence
  Description of Artificial Sequence: Synthetic oligonucleotide
ccgggcggtgacggagctgg

SEQ ID NO: 389708 - DNA, 20 bp, Artificial Sequence
  Description of Artificial Sequence: Synthetic oligonucleotide
cgggcggtgacggagctggg

SEQ ID NO: 389709 - DNA, 20 bp, Artificial Sequence
  Description of Artificial Sequence: Synthetic oligonucleotide
gggcggtgacggagctgggg

SEQ ID NO: 389710 - DNA, 20 bp, Artificial Sequence
  Description of Artificial Sequence: Synthetic oligonucleotide
ggcggtgacggagctggggc

SEQ ID NO: 389711 - DNA, 20 bp, Artificial Sequence
  Description of Artificial Sequence: Synthetic oligonucleotide
gcggtgacggagctggggcg

SEQ ID NO: 389712 - DNA, 20 bp, Artificial Sequence
  Description of Artificial Sequence: Synthetic oligonucleotide
cggtgacggagctggggcgg

SEQ ID NO: 389713 - DNA, 20 bp, Artificial Sequence
  Description of Artificial Sequence: Synthetic oligonucleotide
ggtgacggagctggggcggc

SEQ ID NO: 389714 - DNA, 21 bp, Artificial Sequence
  Description of Artificial Sequence: Synthetic oligonucleotide
gtgacggagctggggcggcct

SEQ ID NO: 389715 - DNA, 21 bp, Artificial Sequence
  Description of Artificial Sequence: Synthetic oligonucleotide
tgacggagctggggcggcctg

SEQ ID NO: 389716 - DNA, 20 bp, Artificial Sequence
  Description of Artificial Sequence: Synthetic oligonucleotide
gacggagctggggcggcctg

SEQ ID NO: 389717 - DNA, 21 bp, Artificial Sequence
  Description of Artificial Sequence: Synthetic oligonucleotide
acggagctggggcggcctgct

SEQ ID NO: 389718 - DNA, 20 bp, Artificial Sequence
  Description of Artificial Sequence: Synthetic oligonucleotide
cggagctggggcggcctgct

SEQ ID NO: 389719 - DNA, 20 bp, Artificial Sequence
  Description of Artificial Sequence: Synthetic oligonucleotide
ggagctggggcggcctgctg

SEQ ID NO: 389720 - DNA, 20 bp, Artificial Sequence
  Description of Artificial Sequence: Synthetic oligonucleotide
gagctggggcggcctgctgc

SEQ ID NO: 389721 - DNA, 20 bp, Artificial Sequence
  Description of Artificial Sequence: Synthetic oligonucleotide
agctggggcggcctgctgcg

SEQ ID NO: 389722 - DNA, 20 bp, Artificial Sequence
  Description of Artificial Sequence: Synthetic oligonucleotide
gctggggcggcctgctgcgt

SEQ ID NO: 389723 - DNA, 20 bp, Artificial Sequence
  Description of Artificial Sequence: Synthetic oligonucleotide
ctggggcggcctgctgcgga

SEQ ID NO: 389724 - DNA, 22 bp, Artificial Sequence
  Description of Artificial Sequence: Synthetic oligonucleotide
tggggcggcctgctgcggagta

SEQ ID NO: 389725 - DNA, 21 bp, Artificial Sequence
  Description of Artificial Sequence: Synthetic oligonucleotide
ggggcggcctgctgcggagta

SEQ ID NO: 389726 - DNA, 22 bp, Artificial Sequence
  Description of Artificial Sequence: Synthetic oligonucleotide
gggcggcctgctgcggagtact

SEQ ID NO: 389727 - DNA, 22 bp, Artificial Sequence
  Description of Artificial Sequence: Synthetic oligonucleotide
ggcggcctgctgcggagtactg

SEQ ID NO: 389728 - DNA, 24 bp, Artificial Sequence
  Description of Artificial Sequence: Synthetic oligonucleotide
gcggcctgctgcggagtactggaa

SEQ ID NO: 389729 - DNA, 25 bp, Artificial Sequence
  Description of Artificial Sequence: Synthetic oligonucleotide
cggcctgctgcggagtactggaaca

SEQ ID NO: 389730 - DNA, 25 bp, Artificial Sequence
  Description of Artificial Sequence: Synthetic oligonucleotide
ggcctgctgcggagtactggaacag

SEQ ID NO: 389731 - DNA, 25 bp, Artificial Sequence
  Description of Artificial Sequence: Synthetic oligonucleotide
gcctgctgcggagtactggaacagc

SEQ ID NO: 389732 - DNA, 26 bp, Artificial Sequence
  Description of Artificial Sequence: Synthetic oligonucleotide
cctgctgcggagtactggaacagcca

SEQ ID NO: 389733 - DNA, 27 bp, Artificial Sequence
  Description of Artificial Sequence: Synthetic oligonucleotide
ctgctgcggagtactggaacagccaga

SEQ ID NO: 389734 - DNA, 28 bp, Artificial Sequence
  Description of Artificial Sequence: Synthetic oligonucleotide
tgctgcggagtactggaacagccagaag

SEQ ID NO: 389735 - DNA, 27 bp, Artificial Sequence
  Description of Artificial Sequence: Synthetic oligonucleotide
gctgcggagtactggaacagccagaag

SEQ ID NO: 389736 - DNA, 27 bp, Artificial Sequence
  Description of Artificial Sequence: Synthetic oligonucleotide
ctgcggagtactggaacagccagaagg

SEQ ID NO: 389737 - DNA, 28 bp, Artificial Sequence
  Description of Artificial Sequence: Synthetic oligonucleotide
tgcggagtactggaacagccagaaggac

SEQ ID NO: 389738 - DNA, 27 bp, Artificial Sequence
  Description of Artificial Sequence: Synthetic oligonucleotide
gcggagtactggaacagccagaaggac

SEQ ID NO: 389739 - DNA, 29 bp, Artificial Sequence
  Description of Artificial Sequence: Synthetic oligonucleotide
cggagtactggaacagccagaaggacatc

SEQ ID NO: 389740 - DNA, 29 bp, Artificial Sequence
  Description of Artificial Sequence: Synthetic oligonucleotide
ggagtactggaacagccagaaggacatcc

SEQ ID NO: 389741 - DNA, 30 bp, Artificial Sequence; identical to SEQ ID NO: 52674
  Description of Artificial Sequence: Synthetic oligonucleotide

SEQ ID NO: 389742 - DNA, 30 bp, Artificial Sequence; identical to SEQ ID NO: 52675
  Description of Artificial Sequence: Synthetic oligonucleotide

SEQ ID NO: 389743 - DNA, 29 bp, Artificial Sequence
  Description of Artificial Sequence: Synthetic oligonucleotide
gtactggaacagccagaaggacatcctgg

SEQ ID NO: 389744 - DNA, 30 bp, Artificial Sequence; identical to SEQ ID NO: 52677
  Description of Artificial Sequence: Synthetic oligonucleotide

SEQ ID NO: 389745 - DNA, 29 bp, Artificial Sequence
  Description of Artificial Sequence: Synthetic oligonucleotide
actggaacagccagaaggacatcctggag

SEQ ID NO: 389746 - DNA, 28 bp, Artificial Sequence
  Description of Artificial Sequence: Synthetic oligonucleotide
ctggaacagccagaaggacatcctggag

SEQ ID NO: 389747 - DNA, 28 bp, Artificial Sequence
  Description of Artificial Sequence: Synthetic oligonucleotide
tggaacagccagaaggacatcctggagg

SEQ ID NO: 389748 - DNA, 27 bp, Artificial Sequence
  Description of Artificial Sequence: Synthetic oligonucleotide
ggaacagccagaaggacatcctggagg

SEQ ID NO: 389749 - DNA, 28 bp, Artificial Sequence
  Description of Artificial Sequence: Synthetic oligonucleotide
gaacagccagaaggacatcctggaggag

SEQ ID NO: 389750 - DNA, 30 bp, Artificial Sequence; identical to SEQ ID NO: 52683
  Description of Artificial Sequence: Synthetic oligonucleotide

SEQ ID NO: 389751 - DNA, 29 bp, Artificial Sequence
  Description of Artificial Sequence: Synthetic oligonucleotide
acagccagaaggacatcctggaggagaag

SEQ ID NO: 389752 - DNA, 28 bp, Artificial Sequence
  Description of Artificial Sequence: Synthetic oligonucleotide
cagccagaaggacatcctggaggagaag

SEQ ID NO: 389753 - DNA, 28 bp, Artificial Sequence
  Description of Artificial Sequence: Synthetic oligonucleotide
agccagaaggacatcctggaggagaagc

SEQ ID NO: 389754 - DNA, 27 bp, Artificial Sequence
  Description of Artificial Sequence: Synthetic oligonucleotide
gccagaaggacatcctggaggagaagc

SEQ ID NO: 389755 - DNA, 27 bp, Artificial Sequence
  Description of Artificial Sequence: Synthetic oligonucleotide
ccagaaggacatcctggaggagaagcg

SEQ ID NO: 389756 - DNA, 27 bp, Artificial Sequence
  Description of Artificial Sequence: Synthetic oligonucleotide
cagaaggacatcctggaggagaagcgg

SEQ ID NO: 389757 - DNA, 27 bp, Artificial Sequence
  Description of Artificial Sequence: Synthetic oligonucleotide
agaaggacatcctggaggagaagcggg

SEQ ID NO: 389758 - DNA, 26 bp, Artificial Sequence
  Description of Artificial Sequence: Synthetic oligonucleotide
gaaggacatcctggaggagaagcggg

SEQ ID NO: 389759 - DNA, 27 bp, Artificial Sequence
  Description of Artificial Sequence: Synthetic oligonucleotide
aaggacatcctggaggagaagcgggca

SEQ ID NO: 389760 - DNA, 26 bp, Artificial Sequence
  Description of Artificial Sequence: Synthetic oligonucleotide
aggacatcctggaggagaagcgggca

SEQ ID NO: 389761 - DNA, 25 bp, Artificial Sequence
  Description of Artificial Sequence: Synthetic oligonucleotide
ggacatcctggaggagaagcgggca

SEQ ID NO: 389762 - DNA, 26 bp, Artificial Sequence
  Description of Artificial Sequence: Synthetic oligonucleotide
gacatcctggaggagaagcgggcagt

SEQ ID NO: 389763 - DNA, 26 bp, Artificial Sequence
  Description of Artificial Sequence: Synthetic oligonucleotide
acatcctggaggagaagcgggcagtg

SEQ ID NO: 389764 - DNA, 25 bp, Artificial Sequence
  Description of Artificial Sequence: Synthetic oligonucleotide
catcctggaggagaagcgggcagtg

SEQ ID NO: 389765 - DNA, 25 bp, Artificial Sequence
  Description of Artificial Sequence: Synthetic oligonucleotide
atcctggaggagaagcgggcagtgc

SEQ ID NO: 389766 - DNA, 24 bp, Artificial Sequence
  Description of Artificial Sequence: Synthetic oligonucleotide
tcctggaggagaagcgggcagtgc

SEQ ID NO: 389767 - DNA, 23 bp, Artificial Sequence
  Description of Artificial Sequence: Synthetic oligonucleotide
cctggaggagaagcgggcagtgc

SEQ ID NO: 389768 - DNA, 23 bp, Artificial Sequence
  Description of Artificial Sequence: Synthetic oligonucleotide
ctggaggagaagcgggcagtgcc

SEQ ID NO: 389769 - DNA, 23 bp, Artificial Sequence
  Description of Artificial Sequence: Synthetic oligonucleotide
tggaggagaagcgggcagtgccg

SEQ ID NO: 389770 - DNA, 22 bp, Artificial Sequence
  Description of Artificial Sequence: Synthetic oligonucleotide
ggaggagaagcgggcagtgccg

SEQ ID NO: 389771 - DNA, 23 bp, Artificial Sequence
  Description of Artificial Sequence: Synthetic oligonucleotide
gaggagaagcgggcagtgccgga

SEQ ID NO: 389772 - DNA, 24 bp, Artificial Sequence
  Description of Artificial Sequence: Synthetic oligonucleotide
aggagaagcgggcagtgccggaca

SEQ ID NO: 389773 - DNA, 23 bp, Artificial Sequence
  Description of Artificial Sequence: Synthetic oligonucleotide
ggagaagcgggcagtgccggaca

SEQ ID NO: 389774 - DNA, 23 bp, Artificial Sequence
  Description of Artificial Sequence: Synthetic oligonucleotide
gagaagcgggcagtgccggacag

SEQ ID NO: 389775 - DNA, 23 bp, Artificial Sequence
  Description of Artificial Sequence: Synthetic oligonucleotide
agaagcgggcagtgccggacagg

SEQ ID NO: 389776 - DNA, 22 bp, Artificial Sequence
  Description of Artificial Sequence: Synthetic oligonucleotide
gaagcgggcagtgccggacagg

SEQ ID NO: 389777 - DNA, 25 bp, Artificial Sequence
  Description of Artificial Sequence: Synthetic oligonucleotide
aagcgggcagtgccggacagggtat

SEQ ID NO: 389778 - DNA, 24 bp, Artificial Sequence
  Description of Artificial Sequence: Synthetic oligonucleotide
agcgggcagtgccggacagggtat

SEQ ID NO: 389779 - DNA, 23 bp, Artificial Sequence
  Description of Artificial Sequence: Synthetic oligonucleotide
gcgggcagtgccggacagggtat

SEQ ID NO: 389780 - DNA, 23 bp, Artificial Sequence
  Description of Artificial Sequence: Synthetic oligonucleotide
cgggcagtgccggacagggtatg

SEQ ID NO: 389781 - DNA, 24 bp, Artificial Sequence
  Description of Artificial Sequence: Synthetic oligonucleotide
gggcagtgccggacagggtatgca

SEQ ID NO: 389782 - DNA, 25 bp, Artificial Sequence
  Description of Artificial Sequence: Synthetic oligonucleotide
ggcagtgccggacagggtatgcaga

SEQ ID NO: 389783 - DNA, 26 bp, Artificial Sequence
  Description of Artificial Sequence: Synthetic oligonucleotide
gcagtgccggacagggtatgcagaca

SEQ ID NO: 389784 - DNA, 27 bp, Artificial Sequence
  Description of Artificial Sequence: Synthetic oligonucleotide
cagtgccggacagggtatgcagacaca

SEQ ID NO: 389785 - DNA, 28 bp, Artificial Sequence
  Description of Artificial Sequence: Synthetic oligonucleotide
agtgccggacagggtatgcagacacaac

SEQ ID NO: 389786 - DNA, 27 bp, Artificial Sequence
  Description of Artificial Sequence: Synthetic oligonucleotide
gtgccggacagggtatgcagacacaac

SEQ ID NO: 389787 - DNA, 29 bp, Artificial Sequence
  Description of Artificial Sequence: Synthetic oligonucleotide
tgccggacagggtatgcagacacaactac

SEQ ID NO: 389788 - DNA, 28 bp, Artificial Sequence
  Description of Artificial Sequence: Synthetic oligonucleotide
gccggacagggtatgcagacacaactac

SEQ ID NO: 389789 - DNA, 28 bp, Artificial Sequence
  Description of Artificial Sequence: Synthetic oligonucleotide
ccggacagggtatgcagacacaactacg

SEQ ID NO: 389790 - DNA, 29 bp, Artificial Sequence
  Description of Artificial Sequence: Synthetic oligonucleotide
cggacagggtatgcagacacaactacgag

SEQ ID NO: 389791 - DNA, 29 bp, Artificial Sequence
  Description of Artificial Sequence: Synthetic oligonucleotide
ggacagggtatgcagacacaactacgagc

SEQ ID NO: 389792 - DNA, 30 bp, Artificial Sequence; identical to SEQ ID NO: 52725
  Description of Artificial Sequence: Synthetic oligonucleotide

SEQ ID NO: 389793 - DNA, 30 bp, Artificial Sequence; identical to SEQ ID NO: 52726
  Description of Artificial Sequence: Synthetic oligonucleotide

SEQ ID NO: 389794 - DNA, 29 bp, Artificial Sequence
  Description of Artificial Sequence: Synthetic oligonucleotide
cagggtatgcagacacaactacgagctgg

SEQ ID NO: 389795 - DNA, 30 bp, Artificial Sequence; identical to SEQ ID NO: 52728
  Description of Artificial Sequence: Synthetic oligonucleotide

SEQ ID NO: 389796 - DNA, 29 bp, Artificial Sequence
  Description of Artificial Sequence: Synthetic oligonucleotide
gggtatgcagacacaactacgagctggac

SEQ ID NO: 389797 - DNA, 29 bp, Artificial Sequence
  Description of Artificial Sequence: Synthetic oligonucleotide
ggtatgcagacacaactacgagctggacg

SEQ ID NO: 389798 - DNA, 30 bp, Artificial Sequence; identical to SEQ ID NO: 52731
  Description of Artificial Sequence: Synthetic oligonucleotide

SEQ ID NO: 389799 - DNA, 30 bp, Artificial Sequence; identical to SEQ ID NO: 52732
  Description of Artificial Sequence: Synthetic oligonucleotide

SEQ ID NO: 389800 - DNA, 29 bp, Artificial Sequence
  Description of Artificial Sequence: Synthetic oligonucleotide
atgcagacacaactacgagctggacgagg

SEQ ID NO: 389801 - DNA, 28 bp, Artificial Sequence
  Description of Artificial Sequence: Synthetic oligonucleotide
tgcagacacaactacgagctggacgagg

SEQ ID NO: 389802 - DNA, 27 bp, Artificial Sequence
  Description of Artificial Sequence: Synthetic oligonucleotide
gcagacacaactacgagctggacgagg

SEQ ID NO: 389803 - DNA, 27 bp, Artificial Sequence
  Description of Artificial Sequence: Synthetic oligonucleotide
cagacacaactacgagctggacgaggc

SEQ ID NO: 389804 - DNA, 27 bp, Artificial Sequence
  Description of Artificial Sequence: Synthetic oligonucleotide
agacacaactacgagctggacgaggcc

SEQ ID NO: 389805 - DNA, 26 bp, Artificial Sequence
  Description of Artificial Sequence: Synthetic oligonucleotide
gacacaactacgagctggacgaggcc

SEQ ID NO: 389806 - DNA, 27 bp, Artificial Sequence
  Description of Artificial Sequence: Synthetic oligonucleotide
acacaactacgagctggacgaggccgt

SEQ ID NO: 389807 - DNA, 26 bp, Artificial Sequence
  Description of Artificial Sequence: Synthetic oligonucleotide
cacaactacgagctggacgaggccgt

SEQ ID NO: 389808 - DNA, 27 bp, Artificial Sequence
  Description of Artificial Sequence: Synthetic oligonucleotide
acaactacgagctggacgaggccgtga

SEQ ID NO: 389809 - DNA, 26 bp, Artificial Sequence
  Description of Artificial Sequence: Synthetic oligonucleotide
caactacgagctggacgaggccgtga

SEQ ID NO: 389810 - DNA, 26 bp, Artificial Sequence
  Description of Artificial Sequence: Synthetic oligonucleotide
aactacgagctggacgaggccgtgac

SEQ ID NO: 389811 - DNA, 25 bp, Artificial Sequence
  Description of Artificial Sequence: Synthetic oligonucleotide
actacgagctggacgaggccgtgac

SEQ ID NO: 389812 - DNA, 24 bp, Artificial Sequence
  Description of Artificial Sequence: Synthetic oligonucleotide
ctacgagctggacgaggccgtgac

SEQ ID NO: 389813 - DNA, 24 bp, Artificial Sequence
  Description of Artificial Sequence: Synthetic oligonucleotide
tacgagctggacgaggccgtgacc

SEQ ID NO: 389814 - DNA, 23 bp, Artificial Sequence
  Description of Artificial Sequence: Synthetic oligonucleotide
acgagctggacgaggccgtgacc

SEQ ID NO: 389815 - DNA, 22 bp, Artificial Sequence
  Description of Artificial Sequence: Synthetic oligonucleotide
cgagctggacgaggccgtgacc

SEQ ID NO: 389816 - DNA, 23 bp, Artificial Sequence
  Description of Artificial Sequence: Synthetic oligonucleotide
gagctggacgaggccgtgaccct

SEQ ID NO: 389817 - DNA, 23 bp, Artificial Sequence
  Description of Artificial Sequence: Synthetic oligonucleotide
agctggacgaggccgtgaccctg

SEQ ID NO: 389818 - DNA, 22 bp, Artificial Sequence
  Description of Artificial Sequence: Synthetic oligonucleotide
gctggacgaggccgtgaccctg

SEQ ID NO: 389819 - DNA, 23 bp, Artificial Sequence
  Description of Artificial Sequence: Synthetic oligonucleotide
ctggacgaggccgtgaccctgca

SEQ ID NO: 389820 - DNA, 23 bp, Artificial Sequence
  Description of Artificial Sequence: Synthetic oligonucleotide
tggacgaggccgtgaccctgcag

SEQ ID NO: 389821 - DNA, 22 bp, Artificial Sequence
  Description of Artificial Sequence: Synthetic oligonucleotide
ggacgaggccgtgaccctgcag

SEQ ID NO: 389822 - DNA, 22 bp, Artificial Sequence
  Description of Artificial Sequence: Synthetic oligonucleotide
gacgaggccgtgaccctgcagc

SEQ ID NO: 389823 - DNA, 22 bp, Artificial Sequence
  Description of Artificial Sequence: Synthetic oligonucleotide
acgaggccgtgaccctgcagcg

SEQ ID NO: 389824 - DNA, 21 bp, Artificial Sequence
  Description of Artificial Sequence: Synthetic oligonucleotide
cgaggccgtgaccctgcagcg

SEQ ID NO: 389825 - DNA, 21 bp, Artificial Sequence
  Description of Artificial Sequence: Synthetic oligonucleotide
gaggccgtgaccctgcagcgc

SEQ ID NO: 389826 - DNA, 21 bp, Artificial Sequence
  Description of Artificial Sequence: Synthetic oligonucleotide
aggccgtgaccctgcagcgcc

SEQ ID NO: 389827 - DNA, 20 bp, Artificial Sequence
  Description of Artificial Sequence: Synthetic oligonucleotide
ggccgtgaccctgcagcgcc

SEQ ID NO: 389828 - DNA, 21 bp, Artificial Sequence
  Description of Artificial Sequence: Synthetic oligonucleotide
gccgtgaccctgcagcgccga

SEQ ID NO: 389829 - DNA, 22 bp, Artificial Sequence
  Description of Artificial Sequence: Synthetic oligonucleotide
ccgtgaccctgcagcgccgagt

SEQ ID NO: 389830 - DNA, 22 bp, Artificial Sequence
  Description of Artificial Sequence: Synthetic oligonucleotide
cgtgaccctgcagcgccgagtc

SEQ ID NO: 389831 - DNA, 23 bp, Artificial Sequence
  Description of Artificial Sequence: Synthetic oligonucleotide
gtgaccctgcagcgccgagtcca

SEQ ID NO: 389832 - DNA, 23 bp, Artificial Sequence
  Description of Artificial Sequence: Synthetic oligonucleotide
tgaccctgcagcgccgagtccag

SEQ ID NO: 389833 - DNA, 22 bp, Artificial Sequence
  Description of Artificial Sequence: Synthetic oligonucleotide
gaccctgcagcgccgagtccag

SEQ ID NO: 389834 - DNA, 22 bp, Artificial Sequence
  Description of Artificial Sequence: Synthetic oligonucleotide
accctgcagcgccgagtccagc

SEQ ID NO: 389835 - DNA, 21 bp, Artificial Sequence
  Description of Artificial Sequence: Synthetic oligonucleotide
ccctgcagcgccgagtccagc

SEQ ID NO: 389836 - DNA, 24 bp, Artificial Sequence
  Description of Artificial Sequence: Synthetic oligonucleotide
cctgcagcgccgagtccagcctaa

SEQ ID NO: 389837 - DNA, 24 bp, Artificial Sequence
  Description of Artificial Sequence: Synthetic oligonucleotide
ctgcagcgccgagtccagcctaag

SEQ ID NO: 389838 - DNA, 25 bp, Artificial Sequence
  Description of Artificial Sequence: Synthetic oligonucleotide
tgcagcgccgagtccagcctaaggt

SEQ ID NO: 389839 - DNA, 24 bp, Artificial Sequence
  Description of Artificial Sequence: Synthetic oligonucleotide
gcagcgccgagtccagcctaaggt

SEQ ID NO: 389840 - DNA, 26 bp, Artificial Sequence
  Description of Artificial Sequence: Synthetic oligonucleotide
cagcgccgagtccagcctaaggtgaa

SEQ ID NO: 389841 - DNA, 26 bp, Artificial Sequence
  Description of Artificial Sequence: Synthetic oligonucleotide
agcgccgagtccagcctaaggtgaac

SEQ ID NO: 389842 - DNA, 25 bp, Artificial Sequence
  Description of Artificial Sequence: Synthetic oligonucleotide
gcgccgagtccagcctaaggtgaac

SEQ ID NO: 389843 - DNA, 27 bp, Artificial Sequence
  Description of Artificial Sequence: Synthetic oligonucleotide
cgccgagtccagcctaaggtgaacgtt

SEQ ID NO: 389844 - DNA, 28 bp, Artificial Sequence
  Description of Artificial Sequence: Synthetic oligonucleotide
gccgagtccagcctaaggtgaacgtttc

SEQ ID NO: 389845 - DNA, 28 bp, Artificial Sequence
  Description of Artificial Sequence: Synthetic oligonucleotide
ccgagtccagcctaaggtgaacgtttcc

SEQ ID NO: 389846 - DNA, 28 bp, Artificial Sequence
  Description of Artificial Sequence: Synthetic oligonucleotide
cgagtccagcctaaggtgaacgtttccc

SEQ ID NO: 389847 - DNA, 28 bp, Artificial Sequence
  Description of Artificial Sequence: Synthetic oligonucleotide
gagtccagcctaaggtgaacgtttcccc

SEQ ID NO: 389848 - DNA, 28 bp, Artificial Sequence
  Description of Artificial Sequence: Synthetic oligonucleotide
agtccagcctaaggtgaacgtttccccc

SEQ ID NO: 389849 - DNA, 27 bp, Artificial Sequence
  Description of Artificial Sequence: Synthetic oligonucleotide
gtccagcctaaggtgaacgtttccccc

SEQ ID NO: 389850 - DNA, 28 bp, Artificial Sequence
  Description of Artificial Sequence: Synthetic oligonucleotide
tccagcctaaggtgaacgtttccccctc

SEQ ID NO: 389851 - DNA, 27 bp, Artificial Sequence
  Description of Artificial Sequence: Synthetic oligonucleotide
ccagcctaaggtgaacgtttccccctc

SEQ ID NO: 389852 - DNA, 27 bp, Artificial Sequence
  Description of Artificial Sequence: Synthetic oligonucleotide
cagcctaaggtgaacgtttccccctcc

SEQ ID NO: 389853 - DNA, 29 bp, Artificial Sequence
  Description of Artificial Sequence: Synthetic oligonucleotide
agcctaaggtgaacgtttccccctccaag

SEQ ID NO: 389854 - DNA, 28 bp, Artificial Sequence
  Description of Artificial Sequence: Synthetic oligonucleotide
gcctaaggtgaacgtttccccctccaag

SEQ ID NO: 389855 - DNA, 30 bp, Artificial Sequence; identical to SEQ ID NO: 52788
  Description of Artificial Sequence: Synthetic oligonucleotide

SEQ ID NO: 389856 - DNA, 30 bp, Artificial Sequence; identical to SEQ ID NO: 52789
  Description of Artificial Sequence: Synthetic oligonucleotide

SEQ ID NO: 389857 - DNA, 30 bp, Artificial Sequence; identical to SEQ ID NO: 52790
  Description of Artificial Sequence: Synthetic oligonucleotide

SEQ ID NO: 389858 - DNA, 29 bp, Artificial Sequence
  Description of Artificial Sequence: Synthetic oligonucleotide
aaggtgaacgtttccccctccaagaaggg

SEQ ID NO: 389859 - DNA, 28 bp, Artificial Sequence
  Description of Artificial Sequence: Synthetic oligonucleotide
aggtgaacgtttccccctccaagaaggg

SEQ ID NO: 389860 - DNA, 27 bp, Artificial Sequence
  Description of Artificial Sequence: Synthetic oligonucleotide
ggtgaacgtttccccctccaagaaggg

SEQ ID NO: 389861 - DNA, 27 bp, Artificial Sequence
  Description of Artificial Sequence: Synthetic oligonucleotide
gtgaacgtttccccctccaagaagggg

SEQ ID NO: 389862 - DNA, 27 bp, Artificial Sequence
  Description of Artificial Sequence: Synthetic oligonucleotide
tgaacgtttccccctccaagaaggggc

SEQ ID NO: 389863 - DNA, 26 bp, Artificial Sequence
  Description of Artificial Sequence: Synthetic oligonucleotide
gaacgtttccccctccaagaaggggc

SEQ ID NO: 389864 - DNA, 26 bp, Artificial Sequence
  Description of Artificial Sequence: Synthetic oligonucleotide
aacgtttccccctccaagaaggggcc

SEQ ID NO: 389865 - DNA, 25 bp, Artificial Sequence
  Description of Artificial Sequence: Synthetic oligonucleotide
acgtttccccctccaagaaggggcc

SEQ ID NO: 389866 - DNA, 24 bp, Artificial Sequence
  Description of Artificial Sequence: Synthetic oligonucleotide
cgtttccccctccaagaaggggcc

SEQ ID NO: 389867 - DNA, 24 bp, Artificial Sequence
  Description of Artificial Sequence: Synthetic oligonucleotide
gtttccccctccaagaaggggccc

SEQ ID NO: 389868 - DNA, 25 bp, Artificial Sequence
  Description of Artificial Sequence: Synthetic oligonucleotide
tttccccctccaagaaggggcccct

SEQ ID NO: 389869 - DNA, 24 bp, Artificial Sequence
  Description of Artificial Sequence: Synthetic oligonucleotide
ttccccctccaagaaggggcccct

SEQ ID NO: 389870 - DNA, 23 bp, Artificial Sequence
  Description of Artificial Sequence: Synthetic oligonucleotide
tccccctccaagaaggggcccct

SEQ ID NO: 389871 - DNA, 22 bp, Artificial Sequence
  Description of Artificial Sequence: Synthetic oligonucleotide
ccccctccaagaaggggcccct

SEQ ID NO: 389872 - DNA, 22 bp, Artificial Sequence
  Description of Artificial Sequence: Synthetic oligonucleotide
cccctccaagaaggggcccctg

SEQ ID NO: 389873 - DNA, 23 bp, Artificial Sequence
  Description of Artificial Sequence: Synthetic oligonucleotide
ccctccaagaaggggcccctgca

SEQ ID NO: 389874 - DNA, 23 bp, Artificial Sequence
  Description of Artificial Sequence: Synthetic oligonucleotide
cctccaagaaggggcccctgcag

SEQ ID NO: 389875 - DNA, 24 bp, Artificial Sequence
  Description of Artificial Sequence: Synthetic oligonucleotide
ctccaagaaggggcccctgcagca

SEQ ID NO: 389876 - DNA, 24 bp, Artificial Sequence
  Description of Artificial Sequence: Synthetic oligonucleotide
tccaagaaggggcccctgcagcac

SEQ ID NO: 389877 - DNA, 23 bp, Artificial Sequence
  Description of Artificial Sequence: Synthetic oligonucleotide
ccaagaaggggcccctgcagcac

SEQ ID NO: 389878 - DNA, 24 bp, Artificial Sequence
  Description of Artificial Sequence: Synthetic oligonucleotide
caagaaggggcccctgcagcacca

SEQ ID NO: 389879 - DNA, 26 bp, Artificial Sequence
  Description of Artificial Sequence: Synthetic oligonucleotide
aagaaggggcccctgcagcaccacaa

SEQ ID NO: 389880 - DNA, 25 bp, Artificial Sequence
  Description of Artificial Sequence: Synthetic oligonucleotide
agaaggggcccctgcagcaccacaa

SEQ ID NO: 389881 - DNA, 24 bp, Artificial Sequence
  Description of Artificial Sequence: Synthetic oligonucleotide
gaaggggcccctgcagcaccacaa

SEQ ID NO: 389882 - DNA, 24 bp, Artificial Sequence
  Description of Artificial Sequence: Synthetic oligonucleotide
aaggggcccctgcagcaccacaac

SEQ ID NO: 389883 - DNA, 23 bp, Artificial Sequence
  Description of Artificial Sequence: Synthetic oligonucleotide
aggggcccctgcagcaccacaac

SEQ ID NO: 389884 - DNA, 22 bp, Artificial Sequence
  Description of Artificial Sequence: Synthetic oligonucleotide
ggggcccctgcagcaccacaac

SEQ ID NO: 389885 - DNA, 23 bp, Artificial Sequence
  Description of Artificial Sequence: Synthetic oligonucleotide
gggcccctgcagcaccacaacct

SEQ ID NO: 389886 - DNA, 23 bp, Artificial Sequence
  Description of Artificial Sequence: Synthetic oligonucleotide
ggcccctgcagcaccacaacctg

SEQ ID NO: 389887 - DNA, 25 bp, Artificial Sequence
  Description of Artificial Sequence: Synthetic oligonucleotide
gcccctgcagcaccacaacctgctt

SEQ ID NO: 389888 - DNA, 26 bp, Artificial Sequence
  Description of Artificial Sequence: Synthetic oligonucleotide
cccctgcagcaccacaacctgcttgt

SEQ ID NO: 389889 - DNA, 27 bp, Artificial Sequence
  Description of Artificial Sequence: Synthetic oligonucleotide
ccctgcagcaccacaacctgcttgtct

SEQ ID NO: 389890 - DNA, 27 bp, Artificial Sequence
  Description of Artificial Sequence: Synthetic oligonucleotide
cctgcagcaccacaacctgcttgtctg

SEQ ID NO: 389891 - DNA, 27 bp, Artificial Sequence
  Description of Artificial Sequence: Synthetic oligonucleotide
ctgcagcaccacaacctgcttgtctgc

SEQ ID NO: 389892 - DNA, 27 bp, Artificial Sequence
  Description of Artificial Sequence: Synthetic oligonucleotide
tgcagcaccacaacctgcttgtctgcc

SEQ ID NO: 389893 - DNA, 27 bp, Artificial Sequence
  Description of Artificial Sequence: Synthetic oligonucleotide
gcagcaccacaacctgcttgtctgcca

SEQ ID NO: 389894 - DNA, 27 bp, Artificial Sequence
  Description of Artificial Sequence: Synthetic oligonucleotide
cagcaccacaacctgcttgtctgccac

SEQ ID NO: 389895 - DNA, 27 bp, Artificial Sequence
  Description of Artificial Sequence: Synthetic oligonucleotide
agcaccacaacctgcttgtctgccacg

SEQ ID NO: 389896 - DNA, 27 bp, Artificial Sequence
  Description of Artificial Sequence: Synthetic oligonucleotide
gcaccacaacctgcttgtctgccacgt

SEQ ID NO: 389897 - DNA, 27 bp, Artificial Sequence
  Description of Artificial Sequence: Synthetic oligonucleotide
caccacaacctgcttgtctgccacgtg

SEQ ID NO: 389898 - DNA, 28 bp, Artificial Sequence
  Description of Artificial Sequence: Synthetic oligonucleotide
accacaacctgcttgtctgccacgtgac

SEQ ID NO: 389899 - DNA, 27 bp, Artificial Sequence
  Description of Artificial Sequence: Synthetic oligonucleotide
ccacaacctgcttgtctgccacgtgac

SEQ ID NO: 389900 - DNA, 28 bp, Artificial Sequence
  Description of Artificial Sequence: Synthetic oligonucleotide
cacaacctgcttgtctgccacgtgacag

SEQ ID NO: 389901 - DNA, 32 bp, Artificial Sequence; identical to SEQ ID NO: 52834
  Description of Artificial Sequence: Synthetic oligonucleotide

SEQ ID NO: 389902 - DNA, 31 bp, Artificial Sequence; identical to SEQ ID NO: 52835
  Description of Artificial Sequence: Synthetic oligonucleotide

SEQ ID NO: 389903 - DNA, 33 bp, Artificial Sequence; identical to SEQ ID NO: 52836
  Description of Artificial Sequence: Synthetic oligonucleotide

SEQ ID NO: 389904 - DNA, 32 bp, Artificial Sequence; identical to SEQ ID NO: 52837
  Description of Artificial Sequence: Synthetic oligonucleotide

SEQ ID NO: 389905 - DNA, 31 bp, Artificial Sequence; identical to SEQ ID NO: 52838
  Description of Artificial Sequence: Synthetic oligonucleotide

SEQ ID NO: 389906 - DNA, 31 bp, Artificial Sequence; identical to SEQ ID NO: 52839
  Description of Artificial Sequence: Synthetic oligonucleotide

SEQ ID NO: 389907 - DNA, 31 bp, Artificial Sequence; identical to SEQ ID NO: 52840
  Description of Artificial Sequence: Synthetic oligonucleotide

SEQ ID NO: 389908 - DNA, 30 bp, Artificial Sequence; identical to SEQ ID NO: 52841
  Description of Artificial Sequence: Synthetic oligonucleotide

SEQ ID NO: 389909 - DNA, 31 bp, Artificial Sequence; identical to SEQ ID NO: 52842
  Description of Artificial Sequence: Synthetic oligonucleotide

SEQ ID NO: 389910 - DNA, 31 bp, Artificial Sequence; identical to SEQ ID NO: 52843
  Description of Artificial Sequence: Synthetic oligonucleotide

SEQ ID NO: 389911 - DNA, 30 bp, Artificial Sequence; identical to SEQ ID NO: 52844
  Description of Artificial Sequence: Synthetic oligonucleotide

SEQ ID NO: 389912 - DNA, 29 bp, Artificial Sequence
  Description of Artificial Sequence: Synthetic oligonucleotide
gtctgccacgtgacagatttctacccagg

SEQ ID NO: 389913 - DNA, 29 bp, Artificial Sequence
  Description of Artificial Sequence: Synthetic oligonucleotide
tctgccacgtgacagatttctacccaggc

SEQ ID NO: 389914 - DNA, 28 bp, Artificial Sequence
  Description of Artificial Sequence: Synthetic oligonucleotide
ctgccacgtgacagatttctacccaggc

SEQ ID NO: 389915 - DNA, 29 bp, Artificial Sequence
  Description of Artificial Sequence: Synthetic oligonucleotide
tgccacgtgacagatttctacccaggcag

SEQ ID NO: 389916 - DNA, 28 bp, Artificial Sequence
  Description of Artificial Sequence: Synthetic oligonucleotide
gccacgtgacagatttctacccaggcag

SEQ ID NO: 389917 - DNA, 28 bp, Artificial Sequence
  Description of Artificial Sequence: Synthetic oligonucleotide
ccacgtgacagatttctacccaggcagc

SEQ ID NO: 389918 - DNA, 31 bp, Artificial Sequence; identical to SEQ ID NO: 52851
  Description of Artificial Sequence: Synthetic oligonucleotide

SEQ ID NO: 389919 - DNA, 33 bp, Artificial Sequence; identical to SEQ ID NO: 52852
  Description of Artificial Sequence: Synthetic oligonucleotide

SEQ ID NO: 389920 - DNA, 32 bp, Artificial Sequence; identical to SEQ ID NO: 52853
  Description of Artificial Sequence: Synthetic oligonucleotide

SEQ ID NO: 389921 - DNA, 33 bp, Artificial Sequence; identical to SEQ ID NO: 52854
  Description of Artificial Sequence: Synthetic oligonucleotide

SEQ ID NO: 389922 - DNA, 33 bp, Artificial Sequence; identical to SEQ ID NO: 52855
  Description of Artificial Sequence: Synthetic oligonucleotide

SEQ ID NO: 389923 - DNA, 32 bp, Artificial Sequence; identical to SEQ ID NO: 52856
  Description of Artificial Sequence: Synthetic oligonucleotide

SEQ ID NO: 389924 - DNA, 32 bp, Artificial Sequence; identical to SEQ ID NO: 52857
  Description of Artificial Sequence: Synthetic oligonucleotide

SEQ ID NO: 389925 - DNA, 31 bp, Artificial Sequence; identical to SEQ ID NO: 52858
  Description of Artificial Sequence: Synthetic oligonucleotide

SEQ ID NO: 389926 - DNA, 33 bp, Artificial Sequence; identical to SEQ ID NO: 52859
  Description of Artificial Sequence: Synthetic oligonucleotide

SEQ ID NO: 389927 - DNA, 32 bp, Artificial Sequence; identical to SEQ ID NO: 52860
  Description of Artificial Sequence: Synthetic oligonucleotide

SEQ ID NO: 389928 - DNA, 32 bp, Artificial Sequence; identical to SEQ ID NO: 52861
  Description of Artificial Sequence: Synthetic oligonucleotide

SEQ ID NO: 389929 - DNA, 31 bp, Artificial Sequence; identical to SEQ ID NO: 52862
  Description of Artificial Sequence: Synthetic oligonucleotide

SEQ ID NO: 389930 - DNA, 30 bp, Artificial Sequence; identical to SEQ ID NO: 52863
  Description of Artificial Sequence: Synthetic oligonucleotide

SEQ ID NO: 389931 - DNA, 29 bp, Artificial Sequence
  Description of Artificial Sequence: Synthetic oligonucleotide
tctacccaggcagcattcaagtccgatgg

SEQ ID NO: 389932 - DNA, 28 bp, Artificial Sequence
  Description of Artificial Sequence: Synthetic oligonucleotide
ctacccaggcagcattcaagtccgatgg

SEQ ID NO: 389933 - DNA, 30 bp, Artificial Sequence; identical to SEQ ID NO: 52866
  Description of Artificial Sequence: Synthetic oligonucleotide

SEQ ID NO: 389934 - DNA, 29 bp, Artificial Sequence
  Description of Artificial Sequence: Synthetic oligonucleotide
acccaggcagcattcaagtccgatggttc

SEQ ID NO: 389935 - DNA, 28 bp, Artificial Sequence
  Description of Artificial Sequence: Synthetic oligonucleotide
cccaggcagcattcaagtccgatggttc

SEQ ID NO: 389936 - DNA, 28 bp, Artificial Sequence
  Description of Artificial Sequence: Synthetic oligonucleotide
ccaggcagcattcaagtccgatggttcc

SEQ ID NO: 389937 - DNA, 29 bp, Artificial Sequence
  Description of Artificial Sequence: Synthetic oligonucleotide
caggcagcattcaagtccgatggttcctg

SEQ ID NO: 389938 - DNA, 32 bp, Artificial Sequence; identical to SEQ ID NO: 52871
  Description of Artificial Sequence: Synthetic oligonucleotide

SEQ ID NO: 389939 - DNA, 31 bp, Artificial Sequence; identical to SEQ ID NO: 52872
  Description of Artificial Sequence: Synthetic oligonucleotide

SEQ ID NO: 389940 - DNA, 31 bp, Artificial Sequence; identical to SEQ ID NO: 52873
  Description of Artificial Sequence: Synthetic oligonucleotide

SEQ ID NO: 389941 - DNA, 32 bp, Artificial Sequence; identical to SEQ ID NO: 52874
  Description of Artificial Sequence: Synthetic oligonucleotide

SEQ ID NO: 389942 - DNA, 33 bp, Artificial Sequence; identical to SEQ ID NO: 52875
  Description of Artificial Sequence: Synthetic oligonucleotide

SEQ ID NO: 389943 - DNA, 32 bp, Artificial Sequence; identical to SEQ ID NO: 52876
  Description of Artificial Sequence: Synthetic oligonucleotide

SEQ ID NO: 389944 - DNA, 32 bp, Artificial Sequence; identical to SEQ ID NO: 52877
  Description of Artificial Sequence: Synthetic oligonucleotide

SEQ ID NO: 389945 - DNA, 33 bp, Artificial Sequence; identical to SEQ ID NO: 52878
  Description of Artificial Sequence: Synthetic oligonucleotide

SEQ ID NO: 389946 - DNA, 32 bp, Artificial Sequence; identical to SEQ ID NO: 52879
  Description of Artificial Sequence: Synthetic oligonucleotide

SEQ ID NO: 389947 - DNA, 31 bp, Artificial Sequence; identical to SEQ ID NO: 52880
  Description of Artificial Sequence: Synthetic oligonucleotide

SEQ ID NO: 389948 - DNA, 30 bp, Artificial Sequence; identical to SEQ ID NO: 52881
  Description of Artificial Sequence: Synthetic oligonucleotide

SEQ ID NO: 389949 - DNA, 30 bp, Artificial Sequence; identical to SEQ ID NO: 52882
  Description of Artificial Sequence: Synthetic oligonucleotide

SEQ ID NO: 389950 - DNA, 29 bp, Artificial Sequence
  Description of Artificial Sequence: Synthetic oligonucleotide
agtccgatggttcctgaatggacaggagg

SEQ ID NO: 389951 - DNA, 28 bp, Artificial Sequence
  Description of Artificial Sequence: Synthetic oligonucleotide
gtccgatggttcctgaatggacaggagg

SEQ ID NO: 389952 - DNA, 31 bp, Artificial Sequence; identical to SEQ ID NO: 52885
  Description of Artificial Sequence: Synthetic oligonucleotide

SEQ ID NO: 389953 - DNA, 30 bp, Artificial Sequence; identical to SEQ ID NO: 52886
  Description of Artificial Sequence: Synthetic oligonucleotide

SEQ ID NO: 389954 - DNA, 31 bp, Artificial Sequence; identical to SEQ ID NO: 52887
  Description of Artificial Sequence: Synthetic oligonucleotide

SEQ ID NO: 389955 - DNA, 31 bp, Artificial Sequence; identical to SEQ ID NO: 52888
  Description of Artificial Sequence: Synthetic oligonucleotide

SEQ ID NO: 389956 - DNA, 32 bp, Artificial Sequence; identical to SEQ ID NO: 52889
  Description of Artificial Sequence: Synthetic oligonucleotide

SEQ ID NO: 389957 - DNA, 31 bp, Artificial Sequence; identical to SEQ ID NO: 52890
  Description of Artificial Sequence: Synthetic oligonucleotide

SEQ ID NO: 389958 - DNA, 30 bp, Artificial Sequence; identical to SEQ ID NO: 52891
  Description of Artificial Sequence: Synthetic oligonucleotide

SEQ ID NO: 389959 - DNA, 30 bp, Artificial Sequence; identical to SEQ ID NO: 52892
  Description of Artificial Sequence: Synthetic oligonucleotide

SEQ ID NO: 389960 - DNA, 30 bp, Artificial Sequence; identical to SEQ ID NO: 52893
  Description of Artificial Sequence: Synthetic oligonucleotide

SEQ ID NO: 389961 - DNA, 29 bp, Artificial Sequence
  Description of Artificial Sequence: Synthetic oligonucleotide
tcctgaatggacaggaggaaacagctggg

SEQ ID NO: 389962 - DNA, 28 bp, Artificial Sequence
  Description of Artificial Sequence: Synthetic oligonucleotide
cctgaatggacaggaggaaacagctggg

SEQ ID NO: 389963 - DNA, 28 bp, Artificial Sequence
  Description of Artificial Sequence: Synthetic oligonucleotide
ctgaatggacaggaggaaacagctgggg

SEQ ID NO: 389964 - DNA, 29 bp, Artificial Sequence
  Description of Artificial Sequence: Synthetic oligonucleotide
tgaatggacaggaggaaacagctggggtc

SEQ ID NO: 389965 - DNA, 28 bp, Artificial Sequence
  Description of Artificial Sequence: Synthetic oligonucleotide
gaatggacaggaggaaacagctggggtc

SEQ ID NO: 389966 - DNA, 28 bp, Artificial Sequence
  Description of Artificial Sequence: Synthetic oligonucleotide
aatggacaggaggaaacagctggggtcg

SEQ ID NO: 389967 - DNA, 27 bp, Artificial Sequence
  Description of Artificial Sequence: Synthetic oligonucleotide
atggacaggaggaaacagctggggtcg

SEQ ID NO: 389968 - DNA, 27 bp, Artificial Sequence
  Description of Artificial Sequence: Synthetic oligonucleotide
tggacaggaggaaacagctggggtcgt

SEQ ID NO: 389969 - DNA, 26 bp, Artificial Sequence
  Description of Artificial Sequence: Synthetic oligonucleotide
ggacaggaggaaacagctggggtcgt

SEQ ID NO: 389970 - DNA, 27 bp, Artificial Sequence
  Description of Artificial Sequence: Synthetic oligonucleotide
gacaggaggaaacagctggggtcgtgt

SEQ ID NO: 389971 - DNA, 27 bp, Artificial Sequence
  Description of Artificial Sequence: Synthetic oligonucleotide
acaggaggaaacagctggggtcgtgtc

SEQ ID NO: 389972 - DNA, 26 bp, Artificial Sequence
  Description of Artificial Sequence: Synthetic oligonucleotide
caggaggaaacagctggggtcgtgtc

SEQ ID NO: 389973 - DNA, 27 bp, Artificial Sequence
  Description of Artificial Sequence: Synthetic oligonucleotide
aggaggaaacagctggggtcgtgtcca

SEQ ID NO: 389974 - DNA, 26 bp, Artificial Sequence
  Description of Artificial Sequence: Synthetic oligonucleotide
ggaggaaacagctggggtcgtgtcca

SEQ ID NO: 389975 - DNA, 26 bp, Artificial Sequence
  Description of Artificial Sequence: Synthetic oligonucleotide
gaggaaacagctggggtcgtgtccac

SEQ ID NO: 389976 - DNA, 27 bp, Artificial Sequence
  Description of Artificial Sequence: Synthetic oligonucleotide
aggaaacagctggggtcgtgtccacca

SEQ ID NO: 389977 - DNA, 27 bp, Artificial Sequence
  Description of Artificial Sequence: Synthetic oligonucleotide
ggaaacagctggggtcgtgtccaccaa

SEQ ID NO: 389978 - DNA, 27 bp, Artificial Sequence
  Description of Artificial Sequence: Synthetic oligonucleotide
gaaacagctggggtcgtgtccaccaac

SEQ ID NO: 389979 - DNA, 27 bp, Artificial Sequence
  Description of Artificial Sequence: Synthetic oligonucleotide
aaacagctggggtcgtgtccaccaacc

SEQ ID NO: 389980 - DNA, 27 bp, Artificial Sequence
  Description of Artificial Sequence: Synthetic oligonucleotide
aacagctggggtcgtgtccaccaacct

SEQ ID NO: 389981 - DNA, 26 bp, Artificial Sequence
  Description of Artificial Sequence: Synthetic oligonucleotide
acagctggggtcgtgtccaccaacct

SEQ ID NO: 389982 - DNA, 25 bp, Artificial Sequence
  Description of Artificial Sequence: Synthetic oligonucleotide
cagctggggtcgtgtccaccaacct

SEQ ID NO: 389983 - DNA, 27 bp, Artificial Sequence
  Description of Artificial Sequence: Synthetic oligonucleotide
agctggggtcgtgtccaccaacctgat

SEQ ID NO: 389984 - DNA, 26 bp, Artificial Sequence
  Description of Artificial Sequence: Synthetic oligonucleotide
gctggggtcgtgtccaccaacctgat

SEQ ID NO: 389985 - DNA, 26 bp, Artificial Sequence
  Description of Artificial Sequence: Synthetic oligonucleotide
ctggggtcgtgtccaccaacctgatc

SEQ ID NO: 389986 - DNA, 26 bp, Artificial Sequence
  Description of Artificial Sequence: Synthetic oligonucleotide
tggggtcgtgtccaccaacctgatcc

SEQ ID NO: 389987 - DNA, 25 bp, Artificial Sequence
  Description of Artificial Sequence: Synthetic oligonucleotide
ggggtcgtgtccaccaacctgatcc

SEQ ID NO: 389988 - DNA, 27 bp, Artificial Sequence
  Description of Artificial Sequence: Synthetic oligonucleotide
gggtcgtgtccaccaacctgatccgta

SEQ ID NO: 389989 - DNA, 29 bp, Artificial Sequence
  Description of Artificial Sequence: Synthetic oligonucleotide
ggtcgtgtccaccaacctgatccgtaatg

SEQ ID NO: 389990 - DNA, 29 bp, Artificial Sequence
  Description of Artificial Sequence: Synthetic oligonucleotide
gtcgtgtccaccaacctgatccgtaatgg

SEQ ID NO: 389991 - DNA, 30 bp, Artificial Sequence; identical to SEQ ID NO: 52924
  Description of Artificial Sequence: Synthetic oligonucleotide

SEQ ID NO: 389992 - DNA, 29 bp, Artificial Sequence
  Description of Artificial Sequence: Synthetic oligonucleotide
cgtgtccaccaacctgatccgtaatggag

SEQ ID NO: 389993 - DNA, 30 bp, Artificial Sequence; identical to SEQ ID NO: 52926
  Description of Artificial Sequence: Synthetic oligonucleotide

SEQ ID NO: 389994 - DNA, 31 bp, Artificial Sequence; identical to SEQ ID NO: 52927
  Description of Artificial Sequence: Synthetic oligonucleotide

SEQ ID NO: 389995 - DNA, 30 bp, Artificial Sequence; identical to SEQ ID NO: 52928
  Description of Artificial Sequence: Synthetic oligonucleotide

SEQ ID NO: 389996 - DNA, 30 bp, Artificial Sequence; identical to SEQ ID NO: 52929
  Description of Artificial Sequence: Synthetic oligonucleotide

SEQ ID NO: 389997 - DNA, 29 bp, Artificial Sequence
  Description of Artificial Sequence: Synthetic oligonucleotide
ccaccaacctgatccgtaatggagactgg

SEQ ID NO: 389998 - DNA, 30 bp, Artificial Sequence; identical to SEQ ID NO: 52931
  Description of Artificial Sequence: Synthetic oligonucleotide

SEQ ID NO: 389999 - DNA, 30 bp, Artificial Sequence; identical to SEQ ID NO: 52932
  Description of Artificial Sequence: Synthetic oligonucleotide

SEQ ID NO: 390000 - DNA, 29 bp, Artificial Sequence
  Description of Artificial Sequence: Synthetic oligonucleotide
ccaacctgatccgtaatggagactggacc

SEQ ID NO: 390001 - DNA, 31 bp, Artificial Sequence; identical to SEQ ID NO: 52934
  Description of Artificial Sequence: Synthetic oligonucleotide

SEQ ID NO: 390002 - DNA, 31 bp, Artificial Sequence; identical to SEQ ID NO: 52935
  Description of Artificial Sequence: Synthetic oligonucleotide

SEQ ID NO: 390003 - DNA, 30 bp, Artificial Sequence; identical to SEQ ID NO: 52936
  Description of Artificial Sequence: Synthetic oligonucleotide

SEQ ID NO: 390004 - DNA, 29 bp, Artificial Sequence
  Description of Artificial Sequence: Synthetic oligonucleotide
cctgatccgtaatggagactggaccttcc

SEQ ID NO: 390005 - DNA, 30 bp, Artificial Sequence; identical to SEQ ID NO: 52938
  Description of Artificial Sequence: Synthetic oligonucleotide

SEQ ID NO: 390006 - DNA, 32 bp, Artificial Sequence; identical to SEQ ID NO: 52939
  Description of Artificial Sequence: Synthetic oligonucleotide

SEQ ID NO: 390007 - DNA, 31 bp, Artificial Sequence; identical to SEQ ID NO: 52940
  Description of Artificial Sequence: Synthetic oligonucleotide

SEQ ID NO: 390008 - DNA, 31 bp, Artificial Sequence; identical to SEQ ID NO: 52941
  Description of Artificial Sequence: Synthetic oligonucleotide

SEQ ID NO: 390009 - DNA, 30 bp, Artificial Sequence; identical to SEQ ID NO: 52942
  Description of Artificial Sequence: Synthetic oligonucleotide

SEQ ID NO: 390010 - DNA, 29 bp, Artificial Sequence
  Description of Artificial Sequence: Synthetic oligonucleotide
ccgtaatggagactggaccttccagatcc

SEQ ID NO: 390011 - DNA, 30 bp, Artificial Sequence; identical to SEQ ID NO: 52944
  Description of Artificial Sequence: Synthetic oligonucleotide

SEQ ID NO: 390012 - DNA, 30 bp, Artificial Sequence; identical to SEQ ID NO: 52945
  Description of Artificial Sequence: Synthetic oligonucleotide

SEQ ID NO: 390013 - DNA, 31 bp, Artificial Sequence; identical to SEQ ID NO: 52946
  Description of Artificial Sequence: Synthetic oligonucleotide

SEQ ID NO: 390014 - DNA, 30 bp, Artificial Sequence; identical to SEQ ID NO: 52947
  Description of Artificial Sequence: Synthetic oligonucleotide

SEQ ID NO: 390015 - DNA, 29 bp, Artificial Sequence
  Description of Artificial Sequence: Synthetic oligonucleotide
atggagactggaccttccagatcctggtg

SEQ ID NO: 390016 - DNA, 28 bp, Artificial Sequence
  Description of Artificial Sequence: Synthetic oligonucleotide
tggagactggaccttccagatcctggtg

SEQ ID NO: 390017 - DNA, 27 bp, Artificial Sequence
  Description of Artificial Sequence: Synthetic oligonucleotide
ggagactggaccttccagatcctggtg

SEQ ID NO: 390018 - DNA, 29 bp, Artificial Sequence
  Description of Artificial Sequence: Synthetic oligonucleotide
gagactggaccttccagatcctggtgatg

SEQ ID NO: 390019 - DNA, 29 bp, Artificial Sequence
  Description of Artificial Sequence: Synthetic oligonucleotide
agactggaccttccagatcctggtgatgc

SEQ ID NO: 390020 - DNA, 28 bp, Artificial Sequence
  Description of Artificial Sequence: Synthetic oligonucleotide
gactggaccttccagatcctggtgatgc

SEQ ID NO: 390021 - DNA, 29 bp, Artificial Sequence
  Description of Artificial Sequence: Synthetic oligonucleotide
actggaccttccagatcctggtgatgctg

SEQ ID NO: 390022 - DNA, 28 bp, Artificial Sequence
  Description of Artificial Sequence: Synthetic oligonucleotide
ctggaccttccagatcctggtgatgctg

SEQ ID NO: 390023 - DNA, 28 bp, Artificial Sequence
  Description of Artificial Sequence: Synthetic oligonucleotide
tggaccttccagatcctggtgatgctgg

SEQ ID NO: 390024 - DNA, 27 bp, Artificial Sequence
  Description of Artificial Sequence: Synthetic oligonucleotide
ggaccttccagatcctggtgatgctgg

SEQ ID NO: 390025 - DNA, 31 bp, Artificial Sequence; identical to SEQ ID NO: 52958
  Description of Artificial Sequence: Synthetic oligonucleotide

SEQ ID NO: 390026 - DNA, 32 bp, Artificial Sequence; identical to SEQ ID NO: 52959
  Description of Artificial Sequence: Synthetic oligonucleotide

SEQ ID NO: 390027 - DNA, 31 bp, Artificial Sequence; identical to SEQ ID NO: 52960
  Description of Artificial Sequence: Synthetic oligonucleotide

SEQ ID NO: 390028 - DNA, 31 bp, Artificial Sequence; identical to SEQ ID NO: 52961
  Description of Artificial Sequence: Synthetic oligonucleotide

SEQ ID NO: 390029 - DNA, 31 bp, Artificial Sequence; identical to SEQ ID NO: 52962
  Description of Artificial Sequence: Synthetic oligonucleotide

SEQ ID NO: 390030 - DNA, 30 bp, Artificial Sequence; identical to SEQ ID NO: 52963
  Description of Artificial Sequence: Synthetic oligonucleotide

SEQ ID NO: 390031 - DNA, 29 bp, Artificial Sequence
  Description of Artificial Sequence: Synthetic oligonucleotide
ccagatcctggtgatgctggaaatgaccc

SEQ ID NO: 390032 - DNA, 29 bp, Artificial Sequence
  Description of Artificial Sequence: Synthetic oligonucleotide
cagatcctggtgatgctggaaatgacccc

SEQ ID NO: 390033 - DNA, 29 bp, Artificial Sequence
  Description of Artificial Sequence: Synthetic oligonucleotide
agatcctggtgatgctggaaatgaccccc

SEQ ID NO: 390034 - DNA, 28 bp, Artificial Sequence
  Description of Artificial Sequence: Synthetic oligonucleotide
gatcctggtgatgctggaaatgaccccc

SEQ ID NO: 390035 - DNA, 28 bp, Artificial Sequence
  Description of Artificial Sequence: Synthetic oligonucleotide
atcctggtgatgctggaaatgacccccc

SEQ ID NO: 390036 - DNA, 27 bp, Artificial Sequence
  Description of Artificial Sequence: Synthetic oligonucleotide
tcctggtgatgctggaaatgacccccc

SEQ ID NO: 390037 - DNA, 27 bp, Artificial Sequence
  Description of Artificial Sequence: Synthetic oligonucleotide
cctggtgatgctggaaatgacccccca

SEQ ID NO: 390038 - DNA, 27 bp, Artificial Sequence
  Description of Artificial Sequence: Synthetic oligonucleotide
ctggtgatgctggaaatgaccccccag

SEQ ID NO: 390039 - DNA, 27 bp, Artificial Sequence
  Description of Artificial Sequence: Synthetic oligonucleotide
tggtgatgctggaaatgaccccccagc

SEQ ID NO: 390040 - DNA, 27 bp, Artificial Sequence
  Description of Artificial Sequence: Synthetic oligonucleotide
ggtgatgctggaaatgaccccccagca

SEQ ID NO: 390041 - DNA, 27 bp, Artificial Sequence
  Description of Artificial Sequence: Synthetic oligonucleotide
gtgatgctggaaatgaccccccagcag

SEQ ID NO: 390042 - DNA, 27 bp, Artificial Sequence
  Description of Artificial Sequence: Synthetic oligonucleotide
tgatgctggaaatgaccccccagcagg

SEQ ID NO: 390043 - DNA, 26 bp, Artificial Sequence
  Description of Artificial Sequence: Synthetic oligonucleotide
gatgctggaaatgaccccccagcagg

SEQ ID NO: 390044 - DNA, 27 bp, Artificial Sequence
  Description of Artificial Sequence: Synthetic oligonucleotide
atgctggaaatgaccccccagcaggga

SEQ ID NO: 390045 - DNA, 26 bp, Artificial Sequence
  Description of Artificial Sequence: Synthetic oligonucleotide
tgctggaaatgaccccccagcaggga

SEQ ID NO: 390046 - DNA, 25 bp, Artificial Sequence
  Description of Artificial Sequence: Synthetic oligonucleotide
gctggaaatgaccccccagcaggga

SEQ ID NO: 390047 - DNA, 26 bp, Artificial Sequence
  Description of Artificial Sequence: Synthetic oligonucleotide
ctggaaatgaccccccagcagggaga

SEQ ID NO: 390048 - DNA, 26 bp, Artificial Sequence
  Description of Artificial Sequence: Synthetic oligonucleotide
tggaaatgaccccccagcagggagac

SEQ ID NO: 390049 - DNA, 25 bp, Artificial Sequence
  Description of Artificial Sequence: Synthetic oligonucleotide
ggaaatgaccccccagcagggagac

SEQ ID NO: 390050 - DNA, 26 bp, Artificial Sequence
  Description of Artificial Sequence: Synthetic oligonucleotide
gaaatgaccccccagcagggagacgt

SEQ ID NO: 390051 - DNA, 27 bp, Artificial Sequence
  Description of Artificial Sequence: Synthetic oligonucleotide
aaatgaccccccagcagggagacgtct

SEQ ID NO: 390052 - DNA, 27 bp, Artificial Sequence
  Description of Artificial Sequence: Synthetic oligonucleotide
aatgaccccccagcagggagacgtcta

SEQ ID NO: 390053 - DNA, 26 bp, Artificial Sequence
  Description of Artificial Sequence: Synthetic oligonucleotide
atgaccccccagcagggagacgtcta

SEQ ID NO: 390054 - DNA, 25 bp, Artificial Sequence
  Description of Artificial Sequence: Synthetic oligonucleotide
tgaccccccagcagggagacgtcta

SEQ ID NO: 390055 - DNA, 24 bp, Artificial Sequence
  Description of Artificial Sequence: Synthetic oligonucleotide
gaccccccagcagggagacgtcta

SEQ ID NO: 390056 - DNA, 26 bp, Artificial Sequence
  Description of Artificial Sequence: Synthetic oligonucleotide
accccccagcagggagacgtctacat

SEQ ID NO: 390057 - DNA, 25 bp, Artificial Sequence
  Description of Artificial Sequence: Synthetic oligonucleotide
ccccccagcagggagacgtctacat

SEQ ID NO: 390058 - DNA, 26 bp, Artificial Sequence
  Description of Artificial Sequence: Synthetic oligonucleotide
cccccagcagggagacgtctacatct

SEQ ID NO: 390059 - DNA, 26 bp, Artificial Sequence
  Description of Artificial Sequence: Synthetic oligonucleotide
ccccagcagggagacgtctacatctg

SEQ ID NO: 390060 - DNA, 26 bp, Artificial Sequence
  Description of Artificial Sequence: Synthetic oligonucleotide
cccagcagggagacgtctacatctgc

SEQ ID NO: 390061 - DNA, 27 bp, Artificial Sequence
  Description of Artificial Sequence: Synthetic oligonucleotide
ccagcagggagacgtctacatctgcca

SEQ ID NO: 390062 - DNA, 28 bp, Artificial Sequence
  Description of Artificial Sequence: Synthetic oligonucleotide
cagcagggagacgtctacatctgccaag

SEQ ID NO: 390063 - DNA, 29 bp, Artificial Sequence
  Description of Artificial Sequence: Synthetic oligonucleotide
agcagggagacgtctacatctgccaagtg

SEQ ID NO: 390064 - DNA, 28 bp, Artificial Sequence
  Description of Artificial Sequence: Synthetic oligonucleotide
gcagggagacgtctacatctgccaagtg

SEQ ID NO: 390065 - DNA, 28 bp, Artificial Sequence
  Description of Artificial Sequence: Synthetic oligonucleotide
cagggagacgtctacatctgccaagtgg

SEQ ID NO: 390066 - DNA, 29 bp, Artificial Sequence
  Description of Artificial Sequence: Synthetic oligonucleotide
agggagacgtctacatctgccaagtggag

SEQ ID NO: 390067 - DNA, 28 bp, Artificial Sequence
  Description of Artificial Sequence: Synthetic oligonucleotide
gggagacgtctacatctgccaagtggag

SEQ ID NO: 390068 - DNA, 28 bp, Artificial Sequence
  Description of Artificial Sequence: Synthetic oligonucleotide
ggagacgtctacatctgccaagtggagc

SEQ ID NO: 390069 - DNA, 29 bp, Artificial Sequence
  Description of Artificial Sequence: Synthetic oligonucleotide
gagacgtctacatctgccaagtggagcac

SEQ ID NO: 390070 - DNA, 30 bp, Artificial Sequence; identical to SEQ ID NO: 53003
  Description of Artificial Sequence: Synthetic oligonucleotide

SEQ ID NO: 390071 - DNA, 29 bp, Artificial Sequence
  Description of Artificial Sequence: Synthetic oligonucleotide
gacgtctacatctgccaagtggagcacac

SEQ ID NO: 390072 - DNA, 29 bp, Artificial Sequence
  Description of Artificial Sequence: Synthetic oligonucleotide
acgtctacatctgccaagtggagcacacc

SEQ ID NO: 390073 - DNA, 28 bp, Artificial Sequence
  Description of Artificial Sequence: Synthetic oligonucleotide
cgtctacatctgccaagtggagcacacc

SEQ ID NO: 390074 - DNA, 29 bp, Artificial Sequence
  Description of Artificial Sequence: Synthetic oligonucleotide
gtctacatctgccaagtggagcacaccag

SEQ ID NO: 390075 - DNA, 29 bp, Artificial Sequence
  Description of Artificial Sequence: Synthetic oligonucleotide
tctacatctgccaagtggagcacaccagc

SEQ ID NO: 390076 - DNA, 28 bp, Artificial Sequence
  Description of Artificial Sequence: Synthetic oligonucleotide
ctacatctgccaagtggagcacaccagc

SEQ ID NO: 390077 - DNA, 28 bp, Artificial Sequence
  Description of Artificial Sequence: Synthetic oligonucleotide
tacatctgccaagtggagcacaccagcc

SEQ ID NO: 390078 - DNA, 27 bp, Artificial Sequence
  Description of Artificial Sequence: Synthetic oligonucleotide
acatctgccaagtggagcacaccagcc

SEQ ID NO: 390079 - DNA, 27 bp, Artificial Sequence
  Description of Artificial Sequence: Synthetic oligonucleotide
catctgccaagtggagcacaccagcct

SEQ ID NO: 390080 - DNA, 27 bp, Artificial Sequence
  Description of Artificial Sequence: Synthetic oligonucleotide
atctgccaagtggagcacaccagcctg

SEQ ID NO: 390081 - DNA, 26 bp, Artificial Sequence
  Description of Artificial Sequence: Synthetic oligonucleotide
tctgccaagtggagcacaccagcctg

SEQ ID NO: 390082 - DNA, 25 bp, Artificial Sequence
  Description of Artificial Sequence: Synthetic oligonucleotide
ctgccaagtggagcacaccagcctg

SEQ ID NO: 390083 - DNA, 26 bp, Artificial Sequence
  Description of Artificial Sequence: Synthetic oligonucleotide
tgccaagtggagcacaccagcctgga

SEQ ID NO: 390084 - DNA, 25 bp, Artificial Sequence
  Description of Artificial Sequence: Synthetic oligonucleotide
gccaagtggagcacaccagcctgga

SEQ ID NO: 390085 - DNA, 26 bp, Artificial Sequence
  Description of Artificial Sequence: Synthetic oligonucleotide
ccaagtggagcacaccagcctggaca

SEQ ID NO: 390086 - DNA, 27 bp, Artificial Sequence
  Description of Artificial Sequence: Synthetic oligonucleotide
caagtggagcacaccagcctggacagt

SEQ ID NO: 390087 - DNA, 27 bp, Artificial Sequence
  Description of Artificial Sequence: Synthetic oligonucleotide
aagtggagcacaccagcctggacagtc

SEQ ID NO: 390088 - DNA, 26 bp, Artificial Sequence
  Description of Artificial Sequence: Synthetic oligonucleotide
agtggagcacaccagcctggacagtc

SEQ ID NO: 390089 - DNA, 25 bp, Artificial Sequence
  Description of Artificial Sequence: Synthetic oligonucleotide
gtggagcacaccagcctggacagtc

SEQ ID NO: 390090 - DNA, 26 bp, Artificial Sequence
  Description of Artificial Sequence: Synthetic oligonucleotide
tggagcacaccagcctggacagtcct

SEQ ID NO: 390091 - DNA, 25 bp, Artificial Sequence
  Description of Artificial Sequence: Synthetic oligonucleotide
ggagcacaccagcctggacagtcct

SEQ ID NO: 390092 - DNA, 26 bp, Artificial Sequence
  Description of Artificial Sequence: Synthetic oligonucleotide
gagcacaccagcctggacagtcctgt

SEQ ID NO: 390093 - DNA, 27 bp, Artificial Sequence
  Description of Artificial Sequence: Synthetic oligonucleotide
agcacaccagcctggacagtcctgtca

SEQ ID NO: 390094 - DNA, 26 bp, Artificial Sequence
  Description of Artificial Sequence: Synthetic oligonucleotide
gcacaccagcctggacagtcctgtca

SEQ ID NO: 390095 - DNA, 26 bp, Artificial Sequence
  Description of Artificial Sequence: Synthetic oligonucleotide
cacaccagcctggacagtcctgtcac

SEQ ID NO: 390096 - DNA, 26 bp, Artificial Sequence
  Description of Artificial Sequence: Synthetic oligonucleotide
acaccagcctggacagtcctgtcacc

SEQ ID NO: 390097 - DNA, 25 bp, Artificial Sequence
  Description of Artificial Sequence: Synthetic oligonucleotide
caccagcctggacagtcctgtcacc

SEQ ID NO: 390098 - DNA, 26 bp, Artificial Sequence
  Description of Artificial Sequence: Synthetic oligonucleotide
accagcctggacagtcctgtcaccgt

SEQ ID NO: 390099 - DNA, 25 bp, Artificial Sequence
  Description of Artificial Sequence: Synthetic oligonucleotide
ccagcctggacagtcctgtcaccgt

SEQ ID NO: 390100 - DNA, 25 bp, Artificial Sequence
  Description of Artificial Sequence: Synthetic oligonucleotide
cagcctggacagtcctgtcaccgtg

SEQ ID NO: 390101 - DNA, 26 bp, Artificial Sequence
  Description of Artificial Sequence: Synthetic oligonucleotide
agcctggacagtcctgtcaccgtgga

SEQ ID NO: 390102 - DNA, 25 bp, Artificial Sequence
  Description of Artificial Sequence: Synthetic oligonucleotide
gcctggacagtcctgtcaccgtgga

SEQ ID NO: 390103 - DNA, 26 bp, Artificial Sequence
  Description of Artificial Sequence: Synthetic oligonucleotide
cctggacagtcctgtcaccgtggagt

SEQ ID NO: 390104 - DNA, 26 bp, Artificial Sequence
  Description of Artificial Sequence: Synthetic oligonucleotide
ctggacagtcctgtcaccgtggagtg

SEQ ID NO: 390105 - DNA, 27 bp, Artificial Sequence
  Description of Artificial Sequence: Synthetic oligonucleotide
tggacagtcctgtcaccgtggagtgga

SEQ ID NO: 390106 - DNA, 27 bp, Artificial Sequence
  Description of Artificial Sequence: Synthetic oligonucleotide
ggacagtcctgtcaccgtggagtggaa

SEQ ID NO: 390107 - DNA, 27 bp, Artificial Sequence
  Description of Artificial Sequence: Synthetic oligonucleotide
gacagtcctgtcaccgtggagtggaag

SEQ ID NO: 390108 - DNA, 27 bp, Artificial Sequence
  Description of Artificial Sequence: Synthetic oligonucleotide
acagtcctgtcaccgtggagtggaagg

SEQ ID NO: 390109 - DNA, 26 bp, Artificial Sequence
  Description of Artificial Sequence: Synthetic oligonucleotide
cagtcctgtcaccgtggagtggaagg

SEQ ID NO: 390110 - DNA, 27 bp, Artificial Sequence
  Description of Artificial Sequence: Synthetic oligonucleotide
agtcctgtcaccgtggagtggaaggca

SEQ ID NO: 390111 - DNA, 26 bp, Artificial Sequence
  Description of Artificial Sequence: Synthetic oligonucleotide
gtcctgtcaccgtggagtggaaggca

SEQ ID NO: 390112 - DNA, 27 bp, Artificial Sequence
  Description of Artificial Sequence: Synthetic oligonucleotide
tcctgtcaccgtggagtggaaggcaca

SEQ ID NO: 390113 - DNA, 26 bp, Artificial Sequence
  Description of Artificial Sequence: Synthetic oligonucleotide
cctgtcaccgtggagtggaaggcaca

SEQ ID NO: 390114 - DNA, 27 bp, Artificial Sequence
  Description of Artificial Sequence: Synthetic oligonucleotide
ctgtcaccgtggagtggaaggcacagt

SEQ ID NO: 390115 - DNA, 27 bp, Artificial Sequence
  Description of Artificial Sequence: Synthetic oligonucleotide
tgtcaccgtggagtggaaggcacagtc

SEQ ID NO: 390116 - DNA, 27 bp, Artificial Sequence
  Description of Artificial Sequence: Synthetic oligonucleotide
gtcaccgtggagtggaaggcacagtct

SEQ ID NO: 390117 - DNA, 27 bp, Artificial Sequence
  Description of Artificial Sequence: Synthetic oligonucleotide
tcaccgtggagtggaaggcacagtctg

SEQ ID NO: 390118 - DNA, 27 bp, Artificial Sequence
  Description of Artificial Sequence: Synthetic oligonucleotide
caccgtggagtggaaggcacagtctga

SEQ ID NO: 390119 - DNA, 29 bp, Artificial Sequence
  Description of Artificial Sequence: Synthetic oligonucleotide
accgtggagtggaaggcacagtctgattc

SEQ ID NO: 390120 - DNA, 28 bp, Artificial Sequence
  Description of Artificial Sequence: Synthetic oligonucleotide
ccgtggagtggaaggcacagtctgattc

SEQ ID NO: 390121 - DNA, 29 bp, Artificial Sequence
  Description of Artificial Sequence: Synthetic oligonucleotide
cgtggagtggaaggcacagtctgattctg

SEQ ID NO: 390122 - DNA, 29 bp, Artificial Sequence
  Description of Artificial Sequence: Synthetic oligonucleotide
gtggagtggaaggcacagtctgattctgc

SEQ ID NO: 390123 - DNA, 29 bp, Artificial Sequence
  Description of Artificial Sequence: Synthetic oligonucleotide
tggagtggaaggcacagtctgattctgcc

SEQ ID NO: 390124 - DNA, 28 bp, Artificial Sequence
  Description of Artificial Sequence: Synthetic oligonucleotide
ggagtggaaggcacagtctgattctgcc

SEQ ID NO: 390125 - DNA, 28 bp, Artificial Sequence
  Description of Artificial Sequence: Synthetic oligonucleotide
gagtggaaggcacagtctgattctgccc

SEQ ID NO: 390126 - DNA, 29 bp, Artificial Sequence
  Description of Artificial Sequence: Synthetic oligonucleotide
agtggaaggcacagtctgattctgcccag

SEQ ID NO: 390127 - DNA, 28 bp, Artificial Sequence
  Description of Artificial Sequence: Synthetic oligonucleotide
gtggaaggcacagtctgattctgcccag

SEQ ID NO: 390128 - DNA, 29 bp, Artificial Sequence
  Description of Artificial Sequence: Synthetic oligonucleotide
tggaaggcacagtctgattctgcccagag

SEQ ID NO: 390129 - DNA, 28 bp, Artificial Sequence
  Description of Artificial Sequence: Synthetic oligonucleotide
ggaaggcacagtctgattctgcccagag

SEQ ID NO: 390130 - DNA, 31 bp, Artificial Sequence; identical to SEQ ID NO: 53063
  Description of Artificial Sequence: Synthetic oligonucleotide

SEQ ID NO: 390131 - DNA, 32 bp, Artificial Sequence; identical to SEQ ID NO: 53064
  Description of Artificial Sequence: Synthetic oligonucleotide

SEQ ID NO: 390132 - DNA, 31 bp, Artificial Sequence; identical to SEQ ID NO: 53065
  Description of Artificial Sequence: Synthetic oligonucleotide

SEQ ID NO: 390133 - DNA, 30 bp, Artificial Sequence; identical to SEQ ID NO: 53066
  Description of Artificial Sequence: Synthetic oligonucleotide

SEQ ID NO: 390134 - DNA, 33 bp, Artificial Sequence; identical to SEQ ID NO: 53067
  Description of Artificial Sequence: Synthetic oligonucleotide

SEQ ID NO: 390135 - DNA, 34 bp, Artificial Sequence; identical to SEQ ID NO: 53068
  Description of Artificial Sequence: Synthetic oligonucleotide

SEQ ID NO: 390136 - DNA, 34 bp, Artificial Sequence; identical to SEQ ID NO: 53069
  Description of Artificial Sequence: Synthetic oligonucleotide

SEQ ID NO: 390137 - DNA, 33 bp, Artificial Sequence; identical to SEQ ID NO: 53070
  Description of Artificial Sequence: Synthetic oligonucleotide

SEQ ID NO: 390138 - DNA, 33 bp, Artificial Sequence; identical to SEQ ID NO: 53071
  Description of Artificial Sequence: Synthetic oligonucleotide

SEQ ID NO: 390139 - DNA, 32 bp, Artificial Sequence; identical to SEQ ID NO: 53072
  Description of Artificial Sequence: Synthetic oligonucleotide

SEQ ID NO: 390140 - DNA, 32 bp, Artificial Sequence; identical to SEQ ID NO: 53073
  Description of Artificial Sequence: Synthetic oligonucleotide

SEQ ID NO: 390141 - DNA, 31 bp, Artificial Sequence; identical to SEQ ID NO: 53074
  Description of Artificial Sequence: Synthetic oligonucleotide

SEQ ID NO: 390142 - DNA, 32 bp, Artificial Sequence; identical to SEQ ID NO: 53075
  Description of Artificial Sequence: Synthetic oligonucleotide

SEQ ID NO: 390143 - DNA, 31 bp, Artificial Sequence; identical to SEQ ID NO: 53076
  Description of Artificial Sequence: Synthetic oligonucleotide

SEQ ID NO: 390144 - DNA, 31 bp, Artificial Sequence; identical to SEQ ID NO: 53077
  Description of Artificial Sequence: Synthetic oligonucleotide

SEQ ID NO: 390145 - DNA, 30 bp, Artificial Sequence; identical to SEQ ID NO: 53078
  Description of Artificial Sequence: Synthetic oligonucleotide

SEQ ID NO: 390146 - DNA, 29 bp, Artificial Sequence
  Description of Artificial Sequence: Synthetic oligonucleotide
tctgcccagagtaagacattgacgggagc

SEQ ID NO: 390147 - DNA, 28 bp, Artificial Sequence
  Description of Artificial Sequence: Synthetic oligonucleotide
ctgcccagagtaagacattgacgggagc

SEQ ID NO: 390148 - DNA, 29 bp, Artificial Sequence
  Description of Artificial Sequence: Synthetic oligonucleotide
tgcccagagtaagacattgacgggagctg

SEQ ID NO: 390149 - DNA, 28 bp, Artificial Sequence
  Description of Artificial Sequence: Synthetic oligonucleotide
gcccagagtaagacattgacgggagctg

SEQ ID NO: 390150 - DNA, 28 bp, Artificial Sequence
  Description of Artificial Sequence: Synthetic oligonucleotide
cccagagtaagacattgacgggagctgg

SEQ ID NO: 390151 - DNA, 28 bp, Artificial Sequence
  Description of Artificial Sequence: Synthetic oligonucleotide
ccagagtaagacattgacgggagctggg

SEQ ID NO: 390152 - DNA, 28 bp, Artificial Sequence
  Description of Artificial Sequence: Synthetic oligonucleotide
cagagtaagacattgacgggagctgggg

SEQ ID NO: 390153 - DNA, 28 bp, Artificial Sequence
  Description of Artificial Sequence: Synthetic oligonucleotide
agagtaagacattgacgggagctggggg

SEQ ID NO: 390154 - DNA, 27 bp, Artificial Sequence
  Description of Artificial Sequence: Synthetic oligonucleotide
gagtaagacattgacgggagctggggg

SEQ ID NO: 390155 - DNA, 27 bp, Artificial Sequence
  Description of Artificial Sequence: Synthetic oligonucleotide
agtaagacattgacgggagctgggggc

SEQ ID NO: 390156 - DNA, 27 bp, Artificial Sequence
  Description of Artificial Sequence: Synthetic oligonucleotide
gtaagacattgacgggagctgggggct

SEQ ID NO: 390157 - DNA, 28 bp, Artificial Sequence
  Description of Artificial Sequence: Synthetic oligonucleotide
taagacattgacgggagctgggggcttc

SEQ ID NO: 390158 - DNA, 27 bp, Artificial Sequence
  Description of Artificial Sequence: Synthetic oligonucleotide
aagacattgacgggagctgggggcttc

SEQ ID NO: 390159 - DNA, 26 bp, Artificial Sequence
  Description of Artificial Sequence: Synthetic oligonucleotide
agacattgacgggagctgggggcttc

SEQ ID NO: 390160 - DNA, 25 bp, Artificial Sequence
  Description of Artificial Sequence: Synthetic oligonucleotide
gacattgacgggagctgggggcttc

SEQ ID NO: 390161 - DNA, 26 bp, Artificial Sequence
  Description of Artificial Sequence: Synthetic oligonucleotide
acattgacgggagctgggggcttcgt

SEQ ID NO: 390162 - DNA, 25 bp, Artificial Sequence
  Description of Artificial Sequence: Synthetic oligonucleotide
cattgacgggagctgggggcttcgt

SEQ ID NO: 390163 - DNA, 25 bp, Artificial Sequence
  Description of Artificial Sequence: Synthetic oligonucleotide
attgacgggagctgggggcttcgtg

SEQ ID NO: 390164 - DNA, 24 bp, Artificial Sequence
  Description of Artificial Sequence: Synthetic oligonucleotide
ttgacgggagctgggggcttcgtg

SEQ ID NO: 390165 - DNA, 23 bp, Artificial Sequence
  Description of Artificial Sequence: Synthetic oligonucleotide
tgacgggagctgggggcttcgtg

SEQ ID NO: 390166 - DNA, 22 bp, Artificial Sequence
  Description of Artificial Sequence: Synthetic oligonucleotide
gacgggagctgggggcttcgtg

SEQ ID NO: 390167 - DNA, 23 bp, Artificial Sequence
  Description of Artificial Sequence: Synthetic oligonucleotide
acgggagctgggggcttcgtgct

SEQ ID NO: 390168 - DNA, 22 bp, Artificial Sequence
  Description of Artificial Sequence: Synthetic oligonucleotide
cgggagctgggggcttcgtgct

SEQ ID NO: 390169 - DNA, 22 bp, Artificial Sequence
  Description of Artificial Sequence: Synthetic oligonucleotide
gggagctgggggcttcgtgctg

SEQ ID NO: 390170 - DNA, 22 bp, Artificial Sequence
  Description of Artificial Sequence: Synthetic oligonucleotide
ggagctgggggcttcgtgctgg

SEQ ID NO: 390171 - DNA, 22 bp, Artificial Sequence
  Description of Artificial Sequence: Synthetic oligonucleotide
gagctgggggcttcgtgctggg

SEQ ID NO: 390172 - DNA, 22 bp, Artificial Sequence
  Description of Artificial Sequence: Synthetic oligonucleotide
agctgggggcttcgtgctgggg

SEQ ID NO: 390173 - DNA, 21 bp, Artificial Sequence
  Description of Artificial Sequence: Synthetic oligonucleotide
gctgggggcttcgtgctgggg

SEQ ID NO: 390174 - DNA, 22 bp, Artificial Sequence
  Description of Artificial Sequence: Synthetic oligonucleotide
ctgggggcttcgtgctggggct

SEQ ID NO: 390175 - DNA, 24 bp, Artificial Sequence
  Description of Artificial Sequence: Synthetic oligonucleotide
tgggggcttcgtgctggggctcat

SEQ ID NO: 390176 - DNA, 23 bp, Artificial Sequence
  Description of Artificial Sequence: Synthetic oligonucleotide
gggggcttcgtgctggggctcat

SEQ ID NO: 390177 - DNA, 25 bp, Artificial Sequence
  Description of Artificial Sequence: Synthetic oligonucleotide
ggggcttcgtgctggggctcatcat

SEQ ID NO: 390178 - DNA, 26 bp, Artificial Sequence
  Description of Artificial Sequence: Synthetic oligonucleotide
gggcttcgtgctggggctcatcatct

SEQ ID NO: 390179 - DNA, 27 bp, Artificial Sequence
  Description of Artificial Sequence: Synthetic oligonucleotide
ggcttcgtgctggggctcatcatctgt

SEQ ID NO: 390180 - DNA, 27 bp, Artificial Sequence
  Description of Artificial Sequence: Synthetic oligonucleotide
gcttcgtgctggggctcatcatctgtg

SEQ ID NO: 390181 - DNA, 27 bp, Artificial Sequence
  Description of Artificial Sequence: Synthetic oligonucleotide
cttcgtgctggggctcatcatctgtgg

SEQ ID NO: 390182 - DNA, 28 bp, Artificial Sequence
  Description of Artificial Sequence: Synthetic oligonucleotide
ttcgtgctggggctcatcatctgtggag

SEQ ID NO: 390183 - DNA, 27 bp, Artificial Sequence
  Description of Artificial Sequence: Synthetic oligonucleotide
tcgtgctggggctcatcatctgtggag

SEQ ID NO: 390184 - DNA, 27 bp, Artificial Sequence
  Description of Artificial Sequence: Synthetic oligonucleotide
cgtgctggggctcatcatctgtggagt

SEQ ID NO: 390185 - DNA, 27 bp, Artificial Sequence
  Description of Artificial Sequence: Synthetic oligonucleotide
gtgctggggctcatcatctgtggagtg

SEQ ID NO: 390186 - DNA, 27 bp, Artificial Sequence
  Description of Artificial Sequence: Synthetic oligonucleotide
tgctggggctcatcatctgtggagtgg

SEQ ID NO: 390187 - DNA, 26 bp, Artificial Sequence
  Description of Artificial Sequence: Synthetic oligonucleotide
gctggggctcatcatctgtggagtgg

SEQ ID NO: 390188 - DNA, 26 bp, Artificial Sequence
  Description of Artificial Sequence: Synthetic oligonucleotide
ctggggctcatcatctgtggagtggg

SEQ ID NO: 390189 - DNA, 27 bp, Artificial Sequence
  Description of Artificial Sequence: Synthetic oligonucleotide
tggggctcatcatctgtggagtgggca

SEQ ID NO: 390190 - DNA, 27 bp, Artificial Sequence
  Description of Artificial Sequence: Synthetic oligonucleotide
ggggctcatcatctgtggagtgggcat

SEQ ID NO: 390191 - DNA, 27 bp, Artificial Sequence
  Description of Artificial Sequence: Synthetic oligonucleotide
gggctcatcatctgtggagtgggcatc

SEQ ID NO: 390192 - DNA, 29 bp, Artificial Sequence
  Description of Artificial Sequence: Synthetic oligonucleotide
ggctcatcatctgtggagtgggcatcttc

SEQ ID NO: 390193 - DNA, 31 bp, Artificial Sequence; identical to SEQ ID NO: 53126
  Description of Artificial Sequence: Synthetic oligonucleotide

SEQ ID NO: 390194 - DNA, 31 bp, Artificial Sequence; identical to SEQ ID NO: 53127
  Description of Artificial Sequence: Synthetic oligonucleotide

SEQ ID NO: 390195 - DNA, 32 bp, Artificial Sequence; identical to SEQ ID NO: 53128
  Description of Artificial Sequence: Synthetic oligonucleotide

SEQ ID NO: 390196 - DNA, 31 bp, Artificial Sequence; identical to SEQ ID NO: 53129
  Description of Artificial Sequence: Synthetic oligonucleotide

SEQ ID NO: 390197 - DNA, 32 bp, Artificial Sequence; identical to SEQ ID NO: 53130
  Description of Artificial Sequence: Synthetic oligonucleotide

SEQ ID NO: 390198 - DNA, 31 bp, Artificial Sequence; identical to SEQ ID NO: 53131
  Description of Artificial Sequence: Synthetic oligonucleotide

SEQ ID NO: 390199 - DNA, 30 bp, Artificial Sequence; identical to SEQ ID NO: 53132
  Description of Artificial Sequence: Synthetic oligonucleotide

SEQ ID NO: 390200 - DNA, 30 bp, Artificial Sequence; identical to SEQ ID NO: 53133
  Description of Artificial Sequence: Synthetic oligonucleotide

SEQ ID NO: 390201 - DNA, 29 bp, Artificial Sequence
  Description of Artificial Sequence: Synthetic oligonucleotide
tctgtggagtgggcatcttcatgcacagg

SEQ ID NO: 390202 - DNA, 28 bp, Artificial Sequence
  Description of Artificial Sequence: Synthetic oligonucleotide
ctgtggagtgggcatcttcatgcacagg

SEQ ID NO: 390203 - DNA, 29 bp, Artificial Sequence
  Description of Artificial Sequence: Synthetic oligonucleotide
tgtggagtgggcatcttcatgcacaggag

SEQ ID NO: 390204 - DNA, 28 bp, Artificial Sequence
  Description of Artificial Sequence: Synthetic oligonucleotide
gtggagtgggcatcttcatgcacaggag

SEQ ID NO: 390205 - DNA, 28 bp, Artificial Sequence
  Description of Artificial Sequence: Synthetic oligonucleotide
tggagtgggcatcttcatgcacaggagg

SEQ ID NO: 390206 - DNA, 27 bp, Artificial Sequence
  Description of Artificial Sequence: Synthetic oligonucleotide
ggagtgggcatcttcatgcacaggagg

SEQ ID NO: 390207 - DNA, 28 bp, Artificial Sequence
  Description of Artificial Sequence: Synthetic oligonucleotide
gagtgggcatcttcatgcacaggaggag

SEQ ID NO: 390208 - DNA, 28 bp, Artificial Sequence
  Description of Artificial Sequence: Synthetic oligonucleotide
agtgggcatcttcatgcacaggaggagc

SEQ ID NO: 390209 - DNA, 27 bp, Artificial Sequence
  Description of Artificial Sequence: Synthetic oligonucleotide
gtgggcatcttcatgcacaggaggagc

SEQ ID NO: 390210 - DNA, 29 bp, Artificial Sequence
  Description of Artificial Sequence: Synthetic oligonucleotide
tgggcatcttcatgcacaggaggagcaag

SEQ ID NO: 390211 - DNA, 28 bp, Artificial Sequence
  Description of Artificial Sequence: Synthetic oligonucleotide
gggcatcttcatgcacaggaggagcaag

SEQ ID NO: 390212 - DNA, 31 bp, Artificial Sequence; identical to SEQ ID NO: 53145
  Description of Artificial Sequence: Synthetic oligonucleotide

SEQ ID NO: 390213 - DNA, 33 bp, Artificial Sequence; identical to SEQ ID NO: 53146
  Description of Artificial Sequence: Synthetic oligonucleotide

SEQ ID NO: 390214 - DNA, 35 bp, Artificial Sequence; identical to SEQ ID NO: 53147
  Description of Artificial Sequence: Synthetic oligonucleotide

SEQ ID NO: 390215 - DNA, 35 bp, Artificial Sequence; identical to SEQ ID NO: 53148
  Description of Artificial Sequence: Synthetic oligonucleotide

SEQ ID NO: 390216 - DNA, 34 bp, Artificial Sequence; identical to SEQ ID NO: 53149
  Description of Artificial Sequence: Synthetic oligonucleotide

SEQ ID NO: 390217 - DNA, 33 bp, Artificial Sequence; identical to SEQ ID NO: 53150
  Description of Artificial Sequence: Synthetic oligonucleotide

SEQ ID NO: 390218 - DNA, 34 bp, Artificial Sequence; identical to SEQ ID NO: 53151
  Description of Artificial Sequence: Synthetic oligonucleotide

SEQ ID NO: 390219 - DNA, 33 bp, Artificial Sequence; identical to SEQ ID NO: 53152
  Description of Artificial Sequence: Synthetic oligonucleotide

SEQ ID NO: 390220 - DNA, 32 bp, Artificial Sequence; identical to SEQ ID NO: 53153
  Description of Artificial Sequence: Synthetic oligonucleotide

SEQ ID NO: 390221 - DNA, 32 bp, Artificial Sequence; identical to SEQ ID NO: 53154
  Description of Artificial Sequence: Synthetic oligonucleotide

SEQ ID NO: 390222 - DNA, 31 bp, Artificial Sequence; identical to SEQ ID NO: 53155
  Description of Artificial Sequence: Synthetic oligonucleotide

SEQ ID NO: 390223 - DNA, 30 bp, Artificial Sequence; identical to SEQ ID NO: 53156
  Description of Artificial Sequence: Synthetic oligonucleotide

SEQ ID NO: 390224 - DNA, 32 bp, Artificial Sequence; identical to SEQ ID NO: 53157
  Description of Artificial Sequence: Synthetic oligonucleotide

SEQ ID NO: 390225 - DNA, 33 bp, Artificial Sequence; identical to SEQ ID NO: 53158
  Description of Artificial Sequence: Synthetic oligonucleotide

SEQ ID NO: 390226 - DNA, 32 bp, Artificial Sequence; identical to SEQ ID NO: 53159
  Description of Artificial Sequence: Synthetic oligonucleotide

SEQ ID NO: 390227 - DNA, 32 bp, Artificial Sequence; identical to SEQ ID NO: 53160
  Description of Artificial Sequence: Synthetic oligonucleotide

SEQ ID NO: 390228 - DNA, 31 bp, Artificial Sequence; identical to SEQ ID NO: 53161
  Description of Artificial Sequence: Synthetic oligonucleotide

SEQ ID NO: 390229 - DNA, 23 bp, Artificial Sequence
  Description of Artificial Sequence: Synthetic oligonucleotide
cgcgcttcgacagcgacgtggga

SEQ ID NO: 390230 - DNA, 24 bp, Artificial Sequence
  Description of Artificial Sequence: Synthetic oligonucleotide
gcgcttcgacagcgacgtgggaga

SEQ ID NO: 390231 - DNA, 26 bp, Artificial Sequence
  Description of Artificial Sequence: Synthetic oligonucleotide
cgcttcgacagcgacgtgggagagtt

SEQ ID NO: 390232 - DNA, 26 bp, Artificial Sequence
  Description of Artificial Sequence: Synthetic oligonucleotide
gcttcgacagcgacgtgggagagttc

SEQ ID NO: 390233 - DNA, 26 bp, Artificial Sequence
  Description of Artificial Sequence: Synthetic oligonucleotide
cttcgacagcgacgtgggagagttcc

SEQ ID NO: 390234 - DNA, 26 bp, Artificial Sequence
  Description of Artificial Sequence: Synthetic oligonucleotide
ttcgacagcgacgtgggagagttccg

SEQ ID NO: 390235 - DNA, 25 bp, Artificial Sequence
  Description of Artificial Sequence: Synthetic oligonucleotide
tcgacagcgacgtgggagagttccg

SEQ ID NO: 390236 - DNA, 24 bp, Artificial Sequence
  Description of Artificial Sequence: Synthetic oligonucleotide
cgacagcgacgtgggagagttccg

SEQ ID NO: 390237 - DNA, 24 bp, Artificial Sequence
  Description of Artificial Sequence: Synthetic oligonucleotide
gacagcgacgtgggagagttccgg

SEQ ID NO: 390238 - DNA, 24 bp, Artificial Sequence
  Description of Artificial Sequence: Synthetic oligonucleotide
acagcgacgtgggagagttccggg

SEQ ID NO: 390239 - DNA, 23 bp, Artificial Sequence
  Description of Artificial Sequence: Synthetic oligonucleotide
cagcgacgtgggagagttccggg

SEQ ID NO: 390240 - DNA, 23 bp, Artificial Sequence
  Description of Artificial Sequence: Synthetic oligonucleotide
agcgacgtgggagagttccgggc

SEQ ID NO: 390241 - DNA, 22 bp, Artificial Sequence
  Description of Artificial Sequence: Synthetic oligonucleotide
gcgacgtgggagagttccgggc

SEQ ID NO: 390242 - DNA, 22 bp, Artificial Sequence
  Description of Artificial Sequence: Synthetic oligonucleotide
cgacgtgggagagttccgggcg

SEQ ID NO: 390243 - DNA, 23 bp, Artificial Sequence
  Description of Artificial Sequence: Synthetic oligonucleotide
gacgtgggagagttccgggcggt

SEQ ID NO: 390244 - DNA, 24 bp, Artificial Sequence
  Description of Artificial Sequence: Synthetic oligonucleotide
acgtgggagagttccgggcggtga

SEQ ID NO: 390245 - DNA, 23 bp, Artificial Sequence
  Description of Artificial Sequence: Synthetic oligonucleotide
cgtgggagagttccgggcggtga

SEQ ID NO: 390246 - DNA, 23 bp, Artificial Sequence
  Description of Artificial Sequence: Synthetic oligonucleotide
gtgggagagttccgggcggtgac

SEQ ID NO: 390247 - DNA, 23 bp, Artificial Sequence
  Description of Artificial Sequence: Synthetic oligonucleotide
tgggagagttccgggcggtgacg

SEQ ID NO: 390248 - DNA, 22 bp, Artificial Sequence
  Description of Artificial Sequence: Synthetic oligonucleotide
gggagagttccgggcggtgacg

SEQ ID NO: 390249 - DNA, 23 bp, Artificial Sequence
  Description of Artificial Sequence: Synthetic oligonucleotide
ggagagttccgggcggtgacgga

SEQ ID NO: 390250 - DNA, 23 bp, Artificial Sequence
  Description of Artificial Sequence: Synthetic oligonucleotide
gagagttccgggcggtgacggag

SEQ ID NO: 390251 - DNA, 24 bp, Artificial Sequence
  Description of Artificial Sequence: Synthetic oligonucleotide
agagttccgggcggtgacggagct

SEQ ID NO: 390252 - DNA, 31 bp, Artificial Sequence; identical to SEQ ID NO: 53185
  Description of Artificial Sequence: Synthetic oligonucleotide

SEQ ID NO: 390253 - DNA, 31 bp, Artificial Sequence; identical to SEQ ID NO: 53186
  Description of Artificial Sequence: Synthetic oligonucleotide

SEQ ID NO: 390254 - DNA, 32 bp, Artificial Sequence; identical to SEQ ID NO: 53187
  Description of Artificial Sequence: Synthetic oligonucleotide

SEQ ID NO: 390255 - DNA, 31 bp, Artificial Sequence; identical to SEQ ID NO: 53188
  Description of Artificial Sequence: Synthetic oligonucleotide

SEQ ID NO: 390256 - DNA, 31 bp, Artificial Sequence; identical to SEQ ID NO: 53189
  Description of Artificial Sequence: Synthetic oligonucleotide

SEQ ID NO: 390257 - DNA, 30 bp, Artificial Sequence; identical to SEQ ID NO: 53190
  Description of Artificial Sequence: Synthetic oligonucleotide

SEQ ID NO: 390258 - DNA, 29 bp, Artificial Sequence
  Description of Artificial Sequence: Synthetic oligonucleotide
ctggaacagccagaaggacatcttggagg

SEQ ID NO: 390259 - DNA, 30 bp, Artificial Sequence; identical to SEQ ID NO: 53192
  Description of Artificial Sequence: Synthetic oligonucleotide

SEQ ID NO: 390260 - DNA, 29 bp, Artificial Sequence
  Description of Artificial Sequence: Synthetic oligonucleotide
ggaacagccagaaggacatcttggaggag

SEQ ID NO: 390261 - DNA, 31 bp, Artificial Sequence; identical to SEQ ID NO: 53194
  Description of Artificial Sequence: Synthetic oligonucleotide

SEQ ID NO: 390262 - DNA, 31 bp, Artificial Sequence; identical to SEQ ID NO: 53195
  Description of Artificial Sequence: Synthetic oligonucleotide

SEQ ID NO: 390263 - DNA, 30 bp, Artificial Sequence; identical to SEQ ID NO: 53196
  Description of Artificial Sequence: Synthetic oligonucleotide

SEQ ID NO: 390264 - DNA, 29 bp, Artificial Sequence
  Description of Artificial Sequence: Synthetic oligonucleotide
cagccagaaggacatcttggaggagaagc

SEQ ID NO: 390265 - DNA, 29 bp, Artificial Sequence
  Description of Artificial Sequence: Synthetic oligonucleotide
agccagaaggacatcttggaggagaagcg

SEQ ID NO: 390266 - DNA, 28 bp, Artificial Sequence
  Description of Artificial Sequence: Synthetic oligonucleotide
gccagaaggacatcttggaggagaagcg

SEQ ID NO: 390267 - DNA, 28 bp, Artificial Sequence
  Description of Artificial Sequence: Synthetic oligonucleotide
ccagaaggacatcttggaggagaagcgg

SEQ ID NO: 390268 - DNA, 28 bp, Artificial Sequence
  Description of Artificial Sequence: Synthetic oligonucleotide
cagaaggacatcttggaggagaagcggg

SEQ ID NO: 390269 - DNA, 28 bp, Artificial Sequence
  Description of Artificial Sequence: Synthetic oligonucleotide
agaaggacatcttggaggagaagcgggc

SEQ ID NO: 390270 - DNA, 27 bp, Artificial Sequence
  Description of Artificial Sequence: Synthetic oligonucleotide
gaaggacatcttggaggagaagcgggc

SEQ ID NO: 390271 - DNA, 28 bp, Artificial Sequence
  Description of Artificial Sequence: Synthetic oligonucleotide
aaggacatcttggaggagaagcgggcag

SEQ ID NO: 390272 - DNA, 27 bp, Artificial Sequence
  Description of Artificial Sequence: Synthetic oligonucleotide
aggacatcttggaggagaagcgggcag

SEQ ID NO: 390273 - DNA, 27 bp, Artificial Sequence
  Description of Artificial Sequence: Synthetic oligonucleotide
ggacatcttggaggagaagcgggcagt

SEQ ID NO: 390274 - DNA, 27 bp, Artificial Sequence
  Description of Artificial Sequence: Synthetic oligonucleotide
gacatcttggaggagaagcgggcagtg

SEQ ID NO: 390275 - DNA, 27 bp, Artificial Sequence
  Description of Artificial Sequence: Synthetic oligonucleotide
acatcttggaggagaagcgggcagtgc

SEQ ID NO: 390276 - DNA, 26 bp, Artificial Sequence
  Description of Artificial Sequence: Synthetic oligonucleotide
catcttggaggagaagcgggcagtgc

SEQ ID NO: 390277 - DNA, 26 bp, Artificial Sequence
  Description of Artificial Sequence: Synthetic oligonucleotide
atcttggaggagaagcgggcagtgcc

SEQ ID NO: 390278 - DNA, 25 bp, Artificial Sequence
  Description of Artificial Sequence: Synthetic oligonucleotide
tcttggaggagaagcgggcagtgcc

SEQ ID NO: 390279 - DNA, 24 bp, Artificial Sequence
  Description of Artificial Sequence: Synthetic oligonucleotide
cttggaggagaagcgggcagtgcc

SEQ ID NO: 390280 - DNA, 24 bp, Artificial Sequence
  Description of Artificial Sequence: Synthetic oligonucleotide
ttggaggagaagcgggcagtgccg

SEQ ID NO: 390281 - DNA, 21 bp, Artificial Sequence
  Description of Artificial Sequence: Synthetic oligonucleotide
ccgtgaccctgcagcgccgag

SEQ ID NO: 390282 - DNA, 37 bp, Artificial Sequence
  Description of Artificial Sequence: Synthetic oligonucleotide
taatccctgtagatgggccagcagaatatttgagatc

SEQ ID NO: 390283 - DNA, 36 bp, Artificial Sequence
  Description of Artificial Sequence: Synthetic oligonucleotide
aatccctgtagatgggccagcagaatatttgagatc

SEQ ID NO: 390284 - DNA, 35 bp, Artificial Sequence
  Description of Artificial Sequence: Synthetic oligonucleotide
atccctgtagatgggccagcagaatatttgagatc

SEQ ID NO: 390285 - DNA, 34 bp, Artificial Sequence
  Description of Artificial Sequence: Synthetic oligonucleotide
tccctgtagatgggccagcagaatatttgagatc

SEQ ID NO: 390286 - DNA, 33 bp, Artificial Sequence
  Description of Artificial Sequence: Synthetic oligonucleotide
ccctgtagatgggccagcagaatatttgagatc

SEQ ID NO: 390287 - DNA, 34 bp, Artificial Sequence
  Description of Artificial Sequence: Synthetic oligonucleotide
cctgtagatgggccagcagaatatttgagatcac

SEQ ID NO: 390288 - DNA, 34 bp, Artificial Sequence
  Description of Artificial Sequence: Synthetic oligonucleotide
ctgtagatgggccagcagaatatttgagatcacc

SEQ ID NO: 390289 - DNA, 36 bp, Artificial Sequence
  Description of Artificial Sequence: Synthetic oligonucleotide
tgtagatgggccagcagaatatttgagatcaccttc

SEQ ID NO: 390290 - DNA, 35 bp, Artificial Sequence
  Description of Artificial Sequence: Synthetic oligonucleotide
gtagatgggccagcagaatatttgagatcaccttc

SEQ ID NO: 390291 - DNA, 36 bp, Artificial Sequence
  Description of Artificial Sequence: Synthetic oligonucleotide
tagatgggccagcagaatatttgagatcaccttcag

SEQ ID NO: 390292 - DNA, 35 bp, Artificial Sequence
  Description of Artificial Sequence: Synthetic oligonucleotide
agatgggccagcagaatatttgagatcaccttcag

SEQ ID NO: 390293 - DNA, 34 bp, Artificial Sequence
  Description of Artificial Sequence: Synthetic oligonucleotide
gatgggccagcagaatatttgagatcaccttcag

SEQ ID NO: 390294 - DNA, 35 bp, Artificial Sequence
  Description of Artificial Sequence: Synthetic oligonucleotide
atgggccagcagaatatttgagatcaccttcagag

SEQ ID NO: 390295 - DNA, 34 bp, Artificial Sequence
  Description of Artificial Sequence: Synthetic oligonucleotide
tgggccagcagaatatttgagatcaccttcagag

SEQ ID NO: 390296 - DNA, 33 bp, Artificial Sequence
  Description of Artificial Sequence: Synthetic oligonucleotide
gggccagcagaatatttgagatcaccttcagag

SEQ ID NO: 390297 - DNA, 33 bp, Artificial Sequence
  Description of Artificial Sequence: Synthetic oligonucleotide
ggccagcagaatatttgagatcaccttcagagc

SEQ ID NO: 390298 - DNA, 36 bp, Artificial Sequence
  Description of Artificial Sequence: Synthetic oligonucleotide
gccagcagaatatttgagatcaccttcagagcaaag

SEQ ID NO: 390299 - DNA, 40 bp, Artificial Sequence
  Description of Artificial Sequence: Synthetic oligonucleotide
ccagcagaatatttgagatcaccttcagagcaaagaaaac

SEQ ID NO: 390300 - DNA, 40 bp, Artificial Sequence
  Description of Artificial Sequence: Synthetic oligonucleotide
cagcagaatatttgagatcaccttcagagcaaagaaaacg

SEQ ID NO: 390301 - DNA, 40 bp, Artificial Sequence
  Description of Artificial Sequence: Synthetic oligonucleotide
agcagaatatttgagatcaccttcagagcaaagaaaacgc

SEQ ID NO: 390302 - DNA, 39 bp, Artificial Sequence
  Description of Artificial Sequence: Synthetic oligonucleotide
gcagaatatttgagatcaccttcagagcaaagaaaacgc

SEQ ID NO: 390303 - DNA, 44 bp, Artificial Sequence
  Description of Artificial Sequence: Synthetic oligonucleotide
cagaatatttgagatcaccttcagagcaaagaaaacgcataatc

SEQ ID NO: 390304 - DNA, 45 bp, Artificial Sequence
  Description of Artificial Sequence: Synthetic oligonucleotide
agaatatttgagatcaccttcagagcaaagaaaacgcataatctc

SEQ ID NO: 390305 - DNA, 44 bp, Artificial Sequence
  Description of Artificial Sequence: Synthetic oligonucleotide
gaatatttgagatcaccttcagagcaaagaaaacgcataatctc

SEQ ID NO: 390306 - DNA, 44 bp, Artificial Sequence
  Description of Artificial Sequence: Synthetic oligonucleotide
aatatttgagatcaccttcagagcaaagaaaacgcataatctcg

SEQ ID NO: 390307 - DNA, 43 bp, Artificial Sequence
  Description of Artificial Sequence: Synthetic oligonucleotide
atatttgagatcaccttcagagcaaagaaaacgcataatctcg

SEQ ID NO: 390308 - DNA, 42 bp, Artificial Sequence
  Description of Artificial Sequence: Synthetic oligonucleotide
tatttgagatcaccttcagagcaaagaaaacgcataatctcg

SEQ ID NO: 390309 - DNA, 41 bp, Artificial Sequence
  Description of Artificial Sequence: Synthetic oligonucleotide
atttgagatcaccttcagagcaaagaaaacgcataatctcg

SEQ ID NO: 390310 - DNA, 40 bp, Artificial Sequence
  Description of Artificial Sequence: Synthetic oligonucleotide
tttgagatcaccttcagagcaaagaaaacgcataatctcg

SEQ ID NO: 390311 - DNA, 39 bp, Artificial Sequence
  Description of Artificial Sequence: Synthetic oligonucleotide
ttgagatcaccttcagagcaaagaaaacgcataatctcg

SEQ ID NO: 390312 - DNA, 38 bp, Artificial Sequence
  Description of Artificial Sequence: Synthetic oligonucleotide
tgagatcaccttcagagcaaagaaaacgcataatctcg

SEQ ID NO: 390313 - DNA, 37 bp, Artificial Sequence
  Description of Artificial Sequence: Synthetic oligonucleotide
gagatcaccttcagagcaaagaaaacgcataatctcg

SEQ ID NO: 390314 - DNA, 37 bp, Artificial Sequence
  Description of Artificial Sequence: Synthetic oligonucleotide
agatcaccttcagagcaaagaaaacgcataatctcgc

SEQ ID NO: 390315 - DNA, 36 bp, Artificial Sequence
  Description of Artificial Sequence: Synthetic oligonucleotide
gatcaccttcagagcaaagaaaacgcataatctcgc

SEQ ID NO: 390316 - DNA, 36 bp, Artificial Sequence
  Description of Artificial Sequence: Synthetic oligonucleotide
atcaccttcagagcaaagaaaacgcataatctcgcc

SEQ ID NO: 390317 - DNA, 35 bp, Artificial Sequence
  Description of Artificial Sequence: Synthetic oligonucleotide
tcaccttcagagcaaagaaaacgcataatctcgcc

SEQ ID NO: 390318 - DNA, 34 bp, Artificial Sequence
  Description of Artificial Sequence: Synthetic oligonucleotide
caccttcagagcaaagaaaacgcataatctcgcc

SEQ ID NO: 390319 - DNA, 37 bp, Artificial Sequence
  Description of Artificial Sequence: Synthetic oligonucleotide
accttcagagcaaagaaaacgcataatctcgccaaac

SEQ ID NO: 390320 - DNA, 36 bp, Artificial Sequence
  Description of Artificial Sequence: Synthetic oligonucleotide
ccttcagagcaaagaaaacgcataatctcgccaaac

SEQ ID NO: 390321 - DNA, 38 bp, Artificial Sequence
  Description of Artificial Sequence: Synthetic oligonucleotide
cttcagagcaaagaaaacgcataatctcgccaaacatc

SEQ ID NO: 390322 - DNA, 40 bp, Artificial Sequence
  Description of Artificial Sequence: Synthetic oligonucleotide
ttcagagcaaagaaaacgcataatctcgccaaacatcatg

SEQ ID NO: 390323 - DNA, 39 bp, Artificial Sequence
  Description of Artificial Sequence: Synthetic oligonucleotide
tcagagcaaagaaaacgcataatctcgccaaacatcatg

SEQ ID NO: 390324 - DNA, 38 bp, Artificial Sequence
  Description of Artificial Sequence: Synthetic oligonucleotide
cagagcaaagaaaacgcataatctcgccaaacatcatg

SEQ ID NO: 390325 - DNA, 39 bp, Artificial Sequence
  Description of Artificial Sequence: Synthetic oligonucleotide
agagcaaagaaaacgcataatctcgccaaacatcatgac

SEQ ID NO: 390326 - DNA, 38 bp, Artificial Sequence
  Description of Artificial Sequence: Synthetic oligonucleotide
gagcaaagaaaacgcataatctcgccaaacatcatgac

SEQ ID NO: 390327 - DNA, 42 bp, Artificial Sequence
  Description of Artificial Sequence: Synthetic oligonucleotide
agcaaagaaaacgcataatctcgccaaacatcatgacttatc

SEQ ID NO: 390328 - DNA, 41 bp, Artificial Sequence
  Description of Artificial Sequence: Synthetic oligonucleotide
gcaaagaaaacgcataatctcgccaaacatcatgacttatc

SEQ ID NO: 390329 - DNA, 42 bp, Artificial Sequence
  Description of Artificial Sequence: Synthetic oligonucleotide
caaagaaaacgcataatctcgccaaacatcatgacttatctg

SEQ ID NO: 390330 - DNA, 43 bp, Artificial Sequence
  Description of Artificial Sequence: Synthetic oligonucleotide
aaagaaaacgcataatctcgccaaacatcatgacttatctgac

SEQ ID NO: 390331 - DNA, 42 bp, Artificial Sequence
  Description of Artificial Sequence: Synthetic oligonucleotide
aagaaaacgcataatctcgccaaacatcatgacttatctgac

SEQ ID NO: 390332 - DNA, 41 bp, Artificial Sequence
  Description of Artificial Sequence: Synthetic oligonucleotide
agaaaacgcataatctcgccaaacatcatgacttatctgac

SEQ ID NO: 390333 - DNA, 40 bp, Artificial Sequence
  Description of Artificial Sequence: Synthetic oligonucleotide
gaaaacgcataatctcgccaaacatcatgacttatctgac

SEQ ID NO: 390334 - DNA, 41 bp, Artificial Sequence
  Description of Artificial Sequence: Synthetic oligonucleotide
aaaacgcataatctcgccaaacatcatgacttatctgactg

SEQ ID NO: 390335 - DNA, 40 bp, Artificial Sequence
  Description of Artificial Sequence: Synthetic oligonucleotide
aaacgcataatctcgccaaacatcatgacttatctgactg

SEQ ID NO: 390336 - DNA, 39 bp, Artificial Sequence
  Description of Artificial Sequence: Synthetic oligonucleotide
aacgcataatctcgccaaacatcatgacttatctgactg

SEQ ID NO: 390337 - DNA, 38 bp, Artificial Sequence
  Description of Artificial Sequence: Synthetic oligonucleotide
acgcataatctcgccaaacatcatgacttatctgactg

SEQ ID NO: 390338 - DNA, 37 bp, Artificial Sequence
  Description of Artificial Sequence: Synthetic oligonucleotide
cgcataatctcgccaaacatcatgacttatctgactg

SEQ ID NO: 390339 - DNA, 37 bp, Artificial Sequence
  Description of Artificial Sequence: Synthetic oligonucleotide
gcataatctcgccaaacatcatgacttatctgactgg

SEQ ID NO: 390340 - DNA, 44 bp, Artificial Sequence
  Description of Artificial Sequence: Synthetic oligonucleotide
cataatctcgccaaacatcatgacttatctgactggttaaaatg

SEQ ID NO: 390341 - DNA, 45 bp, Artificial Sequence
  Description of Artificial Sequence: Synthetic oligonucleotide
ataatctcgccaaacatcatgacttatctgactggttaaaatgag

SEQ ID NO: 390342 - DNA, 44 bp, Artificial Sequence
  Description of Artificial Sequence: Synthetic oligonucleotide
taatctcgccaaacatcatgacttatctgactggttaaaatgag

SEQ ID NO: 390343 - DNA, 43 bp, Artificial Sequence
  Description of Artificial Sequence: Synthetic oligonucleotide
aatctcgccaaacatcatgacttatctgactggttaaaatgag

SEQ ID NO: 390344 - DNA, 42 bp, Artificial Sequence
  Description of Artificial Sequence: Synthetic oligonucleotide
atctcgccaaacatcatgacttatctgactggttaaaatgag

SEQ ID NO: 390345 - DNA, 41 bp, Artificial Sequence
  Description of Artificial Sequence: Synthetic oligonucleotide
tctcgccaaacatcatgacttatctgactggttaaaatgag

SEQ ID NO: 390346 - DNA, 40 bp, Artificial Sequence
  Description of Artificial Sequence: Synthetic oligonucleotide
ctcgccaaacatcatgacttatctgactggttaaaatgag

SEQ ID NO: 390347 - DNA, 43 bp, Artificial Sequence
  Description of Artificial Sequence: Synthetic oligonucleotide
tcgccaaacatcatgacttatctgactggttaaaatgagtatc

SEQ ID NO: 390348 - DNA, 42 bp, Artificial Sequence
  Description of Artificial Sequence: Synthetic oligonucleotide
cgccaaacatcatgacttatctgactggttaaaatgagtatc

SEQ ID NO: 390349 - DNA, 43 bp, Artificial Sequence
  Description of Artificial Sequence: Synthetic oligonucleotide
gccaaacatcatgacttatctgactggttaaaatgagtatcac

SEQ ID NO: 390350 - DNA, 44 bp, Artificial Sequence
  Description of Artificial Sequence: Synthetic oligonucleotide
ccaaacatcatgacttatctgactggttaaaatgagtatcactg

SEQ ID NO: 390351 - DNA, 45 bp, Artificial Sequence
  Description of Artificial Sequence: Synthetic oligonucleotide
caaacatcatgacttatctgactggttaaaatgagtatcactgtc

SEQ ID NO: 390352 - DNA, 48 bp, Artificial Sequence
  Description of Artificial Sequence: Synthetic oligonucleotide
aaacatcatgacttatctgactggttaaaatgagtatcactgtctttc

SEQ ID NO: 390353 - DNA, 47 bp, Artificial Sequence
  Description of Artificial Sequence: Synthetic oligonucleotide
aacatcatgacttatctgactggttaaaatgagtatcactgtctttc

SEQ ID NO: 390354 - DNA, 46 bp, Artificial Sequence
  Description of Artificial Sequence: Synthetic oligonucleotide
acatcatgacttatctgactggttaaaatgagtatcactgtctttc

SEQ ID NO: 390355 - DNA, 45 bp, Artificial Sequence
  Description of Artificial Sequence: Synthetic oligonucleotide
catcatgacttatctgactggttaaaatgagtatcactgtctttc

SEQ ID NO: 390356 - DNA, 45 bp, Artificial Sequence
  Description of Artificial Sequence: Synthetic oligonucleotide
atcatgacttatctgactggttaaaatgagtatcactgtctttcc

SEQ ID NO: 390357 - DNA, 44 bp, Artificial Sequence
  Description of Artificial Sequence: Synthetic oligonucleotide
tcatgacttatctgactggttaaaatgagtatcactgtctttcc

SEQ ID NO: 390358 - DNA, 43 bp, Artificial Sequence
  Description of Artificial Sequence: Synthetic oligonucleotide
catgacttatctgactggttaaaatgagtatcactgtctttcc

SEQ ID NO: 390359 - DNA, 44 bp, Artificial Sequence
  Description of Artificial Sequence: Synthetic oligonucleotide
atgacttatctgactggttaaaatgagtatcactgtctttcctc

SEQ ID NO: 390360 - DNA, 43 bp, Artificial Sequence
  Description of Artificial Sequence: Synthetic oligonucleotide
tgacttatctgactggttaaaatgagtatcactgtctttcctc

SEQ ID NO: 390361 - DNA, 42 bp, Artificial Sequence
  Description of Artificial Sequence: Synthetic oligonucleotide
gacttatctgactggttaaaatgagtatcactgtctttcctc

SEQ ID NO: 390362 - DNA, 42 bp, Artificial Sequence
  Description of Artificial Sequence: Synthetic oligonucleotide
acttatctgactggttaaaatgagtatcactgtctttcctcc

SEQ ID NO: 390363 - DNA, 41 bp, Artificial Sequence
  Description of Artificial Sequence: Synthetic oligonucleotide
cttatctgactggttaaaatgagtatcactgtctttcctcc

SEQ ID NO: 390364 - DNA, 41 bp, Artificial Sequence
  Description of Artificial Sequence: Synthetic oligonucleotide
ttatctgactggttaaaatgagtatcactgtctttcctccg

SEQ ID NO: 390365 - DNA, 40 bp, Artificial Sequence
  Description of Artificial Sequence: Synthetic oligonucleotide
tatctgactggttaaaatgagtatcactgtctttcctccg

SEQ ID NO: 390366 - DNA, 39 bp, Artificial Sequence
  Description of Artificial Sequence: Synthetic oligonucleotide
atctgactggttaaaatgagtatcactgtctttcctccg

SEQ ID NO: 390367 - DNA, 38 bp, Artificial Sequence
  Description of Artificial Sequence: Synthetic oligonucleotide
tctgactggttaaaatgagtatcactgtctttcctccg

SEQ ID NO: 390368 - DNA, 37 bp, Artificial Sequence
  Description of Artificial Sequence: Synthetic oligonucleotide
ctgactggttaaaatgagtatcactgtctttcctccg

SEQ ID NO: 390369 - DNA, 38 bp, Artificial Sequence
  Description of Artificial Sequence: Synthetic oligonucleotide
tgactggttaaaatgagtatcactgtctttcctccgtc

SEQ ID NO: 390370 - DNA, 37 bp, Artificial Sequence
  Description of Artificial Sequence: Synthetic oligonucleotide
gactggttaaaatgagtatcactgtctttcctccgtc

SEQ ID NO: 390371 - DNA, 39 bp, Artificial Sequence
  Description of Artificial Sequence: Synthetic oligonucleotide
actggttaaaatgagtatcactgtctttcctccgtcatc

SEQ ID NO: 390372 - DNA, 38 bp, Artificial Sequence
  Description of Artificial Sequence: Synthetic oligonucleotide
ctggttaaaatgagtatcactgtctttcctccgtcatc

SEQ ID NO: 390373 - DNA, 42 bp, Artificial Sequence
  Description of Artificial Sequence: Synthetic oligonucleotide
tggttaaaatgagtatcactgtctttcctccgtcatcttaag

SEQ ID NO: 390374 - DNA, 41 bp, Artificial Sequence
  Description of Artificial Sequence: Synthetic oligonucleotide
ggttaaaatgagtatcactgtctttcctccgtcatcttaag

SEQ ID NO: 390375 - DNA, 42 bp, Artificial Sequence
  Description of Artificial Sequence: Synthetic oligonucleotide
gttaaaatgagtatcactgtctttcctccgtcatcttaagtg

SEQ ID NO: 390376 - DNA, 42 bp, Artificial Sequence
  Description of Artificial Sequence: Synthetic oligonucleotide
ttaaaatgagtatcactgtctttcctccgtcatcttaagtgc

SEQ ID NO: 390377 - DNA, 41 bp, Artificial Sequence
  Description of Artificial Sequence: Synthetic oligonucleotide
taaaatgagtatcactgtctttcctccgtcatcttaagtgc

SEQ ID NO: 390378 - DNA, 40 bp, Artificial Sequence
  Description of Artificial Sequence: Synthetic oligonucleotide
aaaatgagtatcactgtctttcctccgtcatcttaagtgc

SEQ ID NO: 390379 - DNA, 39 bp, Artificial Sequence
  Description of Artificial Sequence: Synthetic oligonucleotide
aaatgagtatcactgtctttcctccgtcatcttaagtgc

SEQ ID NO: 390380 - DNA, 38 bp, Artificial Sequence
  Description of Artificial Sequence: Synthetic oligonucleotide
aatgagtatcactgtctttcctccgtcatcttaagtgc

SEQ ID NO: 390381 - DNA, 37 bp, Artificial Sequence
  Description of Artificial Sequence: Synthetic oligonucleotide
atgagtatcactgtctttcctccgtcatcttaagtgc

SEQ ID NO: 390382 - DNA, 36 bp, Artificial Sequence
  Description of Artificial Sequence: Synthetic oligonucleotide
tgagtatcactgtctttcctccgtcatcttaagtgc

SEQ ID NO: 390383 - DNA, 35 bp, Artificial Sequence
  Description of Artificial Sequence: Synthetic oligonucleotide
gagtatcactgtctttcctccgtcatcttaagtgc

SEQ ID NO: 390384 - DNA, 37 bp, Artificial Sequence
  Description of Artificial Sequence: Synthetic oligonucleotide
agtatcactgtctttcctccgtcatcttaagtgcatc

SEQ ID NO: 390385 - DNA, 36 bp, Artificial Sequence
  Description of Artificial Sequence: Synthetic oligonucleotide
gtatcactgtctttcctccgtcatcttaagtgcatc

SEQ ID NO: 390386 - DNA, 37 bp, Artificial Sequence
  Description of Artificial Sequence: Synthetic oligonucleotide
tatcactgtctttcctccgtcatcttaagtgcatcac

SEQ ID NO: 390387 - DNA, 36 bp, Artificial Sequence
  Description of Artificial Sequence: Synthetic oligonucleotide
atcactgtctttcctccgtcatcttaagtgcatcac

SEQ ID NO: 390388 - DNA, 35 bp, Artificial Sequence
  Description of Artificial Sequence: Synthetic oligonucleotide
tcactgtctttcctccgtcatcttaagtgcatcac

SEQ ID NO: 390389 - DNA, 34 bp, Artificial Sequence
  Description of Artificial Sequence: Synthetic oligonucleotide
cactgtctttcctccgtcatcttaagtgcatcac

SEQ ID NO: 390390 - DNA, 35 bp, Artificial Sequence
  Description of Artificial Sequence: Synthetic oligonucleotide
actgtctttcctccgtcatcttaagtgcatcacag

SEQ ID NO: 390391 - DNA, 34 bp, Artificial Sequence
  Description of Artificial Sequence: Synthetic oligonucleotide
ctgtctttcctccgtcatcttaagtgcatcacag

SEQ ID NO: 390392 - DNA, 34 bp, Artificial Sequence
  Description of Artificial Sequence: Synthetic oligonucleotide
tgtctttcctccgtcatcttaagtgcatcacagg

SEQ ID NO: 390393 - DNA, 33 bp, Artificial Sequence
  Description of Artificial Sequence: Synthetic oligonucleotide
gtctttcctccgtcatcttaagtgcatcacagg

SEQ ID NO: 390394 - DNA, 33 bp, Artificial Sequence
  Description of Artificial Sequence: Synthetic oligonucleotide
tctttcctccgtcatcttaagtgcatcacaggc

SEQ ID NO: 390395 - DNA, 32 bp, Artificial Sequence
  Description of Artificial Sequence: Synthetic oligonucleotide
ctttcctccgtcatcttaagtgcatcacaggc

SEQ ID NO: 390396 - DNA, 42 bp, Artificial Sequence
  Description of Artificial Sequence: Synthetic oligonucleotide
tttcctccgtcatcttaagtgcatcacaggctttatattttc

SEQ ID NO: 390397 - DNA, 41 bp, Artificial Sequence
  Description of Artificial Sequence: Synthetic oligonucleotide
ttcctccgtcatcttaagtgcatcacaggctttatattttc

SEQ ID NO: 390398 - DNA, 40 bp, Artificial Sequence
  Description of Artificial Sequence: Synthetic oligonucleotide
tcctccgtcatcttaagtgcatcacaggctttatattttc

SEQ ID NO: 390399 - DNA, 39 bp, Artificial Sequence
  Description of Artificial Sequence: Synthetic oligonucleotide
cctccgtcatcttaagtgcatcacaggctttatattttc

SEQ ID NO: 390400 - DNA, 40 bp, Artificial Sequence
  Description of Artificial Sequence: Synthetic oligonucleotide
ctccgtcatcttaagtgcatcacaggctttatattttcag

SEQ ID NO: 390401 - DNA, 41 bp, Artificial Sequence
  Description of Artificial Sequence: Synthetic oligonucleotide
tccgtcatcttaagtgcatcacaggctttatattttcagac

SEQ ID NO: 390402 - DNA, 40 bp, Artificial Sequence
  Description of Artificial Sequence: Synthetic oligonucleotide
ccgtcatcttaagtgcatcacaggctttatattttcagac

SEQ ID NO: 390403 - DNA, 40 bp, Artificial Sequence
  Description of Artificial Sequence: Synthetic oligonucleotide
cgtcatcttaagtgcatcacaggctttatattttcagacc

SEQ ID NO: 390404 - DNA, 43 bp, Artificial Sequence
  Description of Artificial Sequence: Synthetic oligonucleotide
gtcatcttaagtgcatcacaggctttatattttcagacctttc

SEQ ID NO: 390405 - DNA, 46 bp, Artificial Sequence
  Description of Artificial Sequence: Synthetic oligonucleotide
tcatcttaagtgcatcacaggctttatattttcagacctttcatac

SEQ ID NO: 390406 - DNA, 45 bp, Artificial Sequence
  Description of Artificial Sequence: Synthetic oligonucleotide
catcttaagtgcatcacaggctttatattttcagacctttcatac

SEQ ID NO: 390407 - DNA, 48 bp, Artificial Sequence
  Description of Artificial Sequence: Synthetic oligonucleotide
atcttaagtgcatcacaggctttatattttcagacctttcatactaac

SEQ ID NO: 390408 - DNA, 47 bp, Artificial Sequence
  Description of Artificial Sequence: Synthetic oligonucleotide
tcttaagtgcatcacaggctttatattttcagacctttcatactaac

SEQ ID NO: 390409 - DNA, 46 bp, Artificial Sequence
  Description of Artificial Sequence: Synthetic oligonucleotide
cttaagtgcatcacaggctttatattttcagacctttcatactaac

SEQ ID NO: 390410 - DNA, 49 bp, Artificial Sequence
  Description of Artificial Sequence: Synthetic oligonucleotide
ttaagtgcatcacaggctttatattttcagacctttcatactaactttc

SEQ ID NO: 390411 - DNA, 48 bp, Artificial Sequence
  Description of Artificial Sequence: Synthetic oligonucleotide
taagtgcatcacaggctttatattttcagacctttcatactaactttc

SEQ ID NO: 390412 - DNA, 47 bp, Artificial Sequence
  Description of Artificial Sequence: Synthetic oligonucleotide
aagtgcatcacaggctttatattttcagacctttcatactaactttc

SEQ ID NO: 390413 - DNA, 46 bp, Artificial Sequence
  Description of Artificial Sequence: Synthetic oligonucleotide
agtgcatcacaggctttatattttcagacctttcatactaactttc

SEQ ID NO: 390414 - DNA, 45 bp, Artificial Sequence
  Description of Artificial Sequence: Synthetic oligonucleotide
gtgcatcacaggctttatattttcagacctttcatactaactttc

SEQ ID NO: 390415 - DNA, 46 bp, Artificial Sequence
  Description of Artificial Sequence: Synthetic oligonucleotide
tgcatcacaggctttatattttcagacctttcatactaactttctg

SEQ ID NO: 390416 - DNA, 45 bp, Artificial Sequence
  Description of Artificial Sequence: Synthetic oligonucleotide
gcatcacaggctttatattttcagacctttcatactaactttctg

SEQ ID NO: 390417 - DNA, 45 bp, Artificial Sequence
  Description of Artificial Sequence: Synthetic oligonucleotide
catcacaggctttatattttcagacctttcatactaactttctgc

SEQ ID NO: 390418 - DNA, 45 bp, Artificial Sequence
  Description of Artificial Sequence: Synthetic oligonucleotide
atcacaggctttatattttcagacctttcatactaactttctgcc

SEQ ID NO: 390419 - DNA, 44 bp, Artificial Sequence
  Description of Artificial Sequence: Synthetic oligonucleotide
tcacaggctttatattttcagacctttcatactaactttctgcc

SEQ ID NO: 390420 - DNA, 43 bp, Artificial Sequence
  Description of Artificial Sequence: Synthetic oligonucleotide
cacaggctttatattttcagacctttcatactaactttctgcc

SEQ ID NO: 390421 - DNA, 45 bp, Artificial Sequence
  Description of Artificial Sequence: Synthetic oligonucleotide
acaggctttatattttcagacctttcatactaactttctgcctag

SEQ ID NO: 390422 - DNA, 44 bp, Artificial Sequence
  Description of Artificial Sequence: Synthetic oligonucleotide
caggctttatattttcagacctttcatactaactttctgcctag

SEQ ID NO: 390423 - DNA, 45 bp, Artificial Sequence
  Description of Artificial Sequence: Synthetic oligonucleotide
aggctttatattttcagacctttcatactaactttctgcctagtg

SEQ ID NO: 390424 - DNA, 44 bp, Artificial Sequence
  Description of Artificial Sequence: Synthetic oligonucleotide
ggctttatattttcagacctttcatactaactttctgcctagtg

SEQ ID NO: 390425 - DNA, 45 bp, Artificial Sequence
  Description of Artificial Sequence: Synthetic oligonucleotide
gctttatattttcagacctttcatactaactttctgcctagtgag

SEQ ID NO: 390426 - DNA, 45 bp, Artificial Sequence
  Description of Artificial Sequence: Synthetic oligonucleotide
ctttatattttcagacctttcatactaactttctgcctagtgagc

SEQ ID NO: 390427 - DNA, 48 bp, Artificial Sequence
  Description of Artificial Sequence: Synthetic oligonucleotide
tttatattttcagacctttcatactaactttctgcctagtgagcaatg

SEQ ID NO: 390428 - DNA, 47 bp, Artificial Sequence
  Description of Artificial Sequence: Synthetic oligonucleotide
ttatattttcagacctttcatactaactttctgcctagtgagcaatg

SEQ ID NO: 390429 - DNA, 46 bp, Artificial Sequence
  Description of Artificial Sequence: Synthetic oligonucleotide
tatattttcagacctttcatactaactttctgcctagtgagcaatg

SEQ ID NO: 390430 - DNA, 45 bp, Artificial Sequence
  Description of Artificial Sequence: Synthetic oligonucleotide
atattttcagacctttcatactaactttctgcctagtgagcaatg

SEQ ID NO: 390431 - DNA, 44 bp, Artificial Sequence
  Description of Artificial Sequence: Synthetic oligonucleotide
tattttcagacctttcatactaactttctgcctagtgagcaatg

SEQ ID NO: 390432 - DNA, 43 bp, Artificial Sequence
  Description of Artificial Sequence: Synthetic oligonucleotide
attttcagacctttcatactaactttctgcctagtgagcaatg

SEQ ID NO: 390433 - DNA, 42 bp, Artificial Sequence
  Description of Artificial Sequence: Synthetic oligonucleotide
ttttcagacctttcatactaactttctgcctagtgagcaatg

SEQ ID NO: 390434 - DNA, 41 bp, Artificial Sequence
  Description of Artificial Sequence: Synthetic oligonucleotide
tttcagacctttcatactaactttctgcctagtgagcaatg

SEQ ID NO: 390435 - DNA, 40 bp, Artificial Sequence
  Description of Artificial Sequence: Synthetic oligonucleotide
ttcagacctttcatactaactttctgcctagtgagcaatg

SEQ ID NO: 390436 - DNA, 39 bp, Artificial Sequence
  Description of Artificial Sequence: Synthetic oligonucleotide
tcagacctttcatactaactttctgcctagtgagcaatg

SEQ ID NO: 390437 - DNA, 38 bp, Artificial Sequence
  Description of Artificial Sequence: Synthetic oligonucleotide
cagacctttcatactaactttctgcctagtgagcaatg

SEQ ID NO: 390438 - DNA, 39 bp, Artificial Sequence
  Description of Artificial Sequence: Synthetic oligonucleotide
agacctttcatactaactttctgcctagtgagcaatgac

SEQ ID NO: 390439 - DNA, 38 bp, Artificial Sequence
  Description of Artificial Sequence: Synthetic oligonucleotide
gacctttcatactaactttctgcctagtgagcaatgac

SEQ ID NO: 390440 - DNA, 39 bp, Artificial Sequence
  Description of Artificial Sequence: Synthetic oligonucleotide
acctttcatactaactttctgcctagtgagcaatgactc

SEQ ID NO: 390441 - DNA, 38 bp, Artificial Sequence
  Description of Artificial Sequence: Synthetic oligonucleotide
cctttcatactaactttctgcctagtgagcaatgactc

SEQ ID NO: 390442 - DNA, 41 bp, Artificial Sequence
  Description of Artificial Sequence: Synthetic oligonucleotide
ctttcatactaactttctgcctagtgagcaatgactcatac

SEQ ID NO: 390443 - DNA, 44 bp, Artificial Sequence
  Description of Artificial Sequence: Synthetic oligonucleotide
tttcatactaactttctgcctagtgagcaatgactcatacaaag

SEQ ID NO: 390444 - DNA, 43 bp, Artificial Sequence
  Description of Artificial Sequence: Synthetic oligonucleotide
ttcatactaactttctgcctagtgagcaatgactcatacaaag

SEQ ID NO: 390445 - DNA, 42 bp, Artificial Sequence
  Description of Artificial Sequence: Synthetic oligonucleotide
tcatactaactttctgcctagtgagcaatgactcatacaaag

SEQ ID NO: 390446 - DNA, 41 bp, Artificial Sequence
  Description of Artificial Sequence: Synthetic oligonucleotide
catactaactttctgcctagtgagcaatgactcatacaaag

SEQ ID NO: 390447 - DNA, 41 bp, Artificial Sequence
  Description of Artificial Sequence: Synthetic oligonucleotide
atactaactttctgcctagtgagcaatgactcatacaaagc

SEQ ID NO: 390448 - DNA, 40 bp, Artificial Sequence
  Description of Artificial Sequence: Synthetic oligonucleotide
tactaactttctgcctagtgagcaatgactcatacaaagc

SEQ ID NO: 390449 - DNA, 39 bp, Artificial Sequence
  Description of Artificial Sequence: Synthetic oligonucleotide
actaactttctgcctagtgagcaatgactcatacaaagc

SEQ ID NO: 390450 - DNA, 38 bp, Artificial Sequence
  Description of Artificial Sequence: Synthetic oligonucleotide
ctaactttctgcctagtgagcaatgactcatacaaagc

SEQ ID NO: 390451 - DNA, 39 bp, Artificial Sequence
  Description of Artificial Sequence: Synthetic oligonucleotide
taactttctgcctagtgagcaatgactcatacaaagctc

SEQ ID NO: 390452 - DNA, 38 bp, Artificial Sequence
  Description of Artificial Sequence: Synthetic oligonucleotide
aactttctgcctagtgagcaatgactcatacaaagctc

SEQ ID NO: 390453 - DNA, 37 bp, Artificial Sequence
  Description of Artificial Sequence: Synthetic oligonucleotide
actttctgcctagtgagcaatgactcatacaaagctc

SEQ ID NO: 390454 - DNA, 36 bp, Artificial Sequence
  Description of Artificial Sequence: Synthetic oligonucleotide
ctttctgcctagtgagcaatgactcatacaaagctc

SEQ ID NO: 390455 - DNA, 37 bp, Artificial Sequence
  Description of Artificial Sequence: Synthetic oligonucleotide
tttctgcctagtgagcaatgactcatacaaagctcag

SEQ ID NO: 390456 - DNA, 36 bp, Artificial Sequence
  Description of Artificial Sequence: Synthetic oligonucleotide
ttctgcctagtgagcaatgactcatacaaagctcag

SEQ ID NO: 390457 - DNA, 35 bp, Artificial Sequence
  Description of Artificial Sequence: Synthetic oligonucleotide
tctgcctagtgagcaatgactcatacaaagctcag

SEQ ID NO: 390458 - DNA, 34 bp, Artificial Sequence
  Description of Artificial Sequence: Synthetic oligonucleotide
ctgcctagtgagcaatgactcatacaaagctcag

SEQ ID NO: 390459 - DNA, 35 bp, Artificial Sequence
  Description of Artificial Sequence: Synthetic oligonucleotide
tgcctagtgagcaatgactcatacaaagctcagtg

SEQ ID NO: 390460 - DNA, 34 bp, Artificial Sequence
  Description of Artificial Sequence: Synthetic oligonucleotide
gcctagtgagcaatgactcatacaaagctcagtg

SEQ ID NO: 390461 - DNA, 35 bp, Artificial Sequence
  Description of Artificial Sequence: Synthetic oligonucleotide
cctagtgagcaatgactcatacaaagctcagtgtc

SEQ ID NO: 390462 - DNA, 35 bp, Artificial Sequence
  Description of Artificial Sequence: Synthetic oligonucleotide
ctagtgagcaatgactcatacaaagctcagtgtcc

SEQ ID NO: 390463 - DNA, 38 bp, Artificial Sequence
  Description of Artificial Sequence: Synthetic oligonucleotide
tagtgagcaatgactcatacaaagctcagtgtccattg

SEQ ID NO: 390464 - DNA, 37 bp, Artificial Sequence
  Description of Artificial Sequence: Synthetic oligonucleotide
agtgagcaatgactcatacaaagctcagtgtccattg

SEQ ID NO: 390465 - DNA, 36 bp, Artificial Sequence
  Description of Artificial Sequence: Synthetic oligonucleotide
gtgagcaatgactcatacaaagctcagtgtccattg

SEQ ID NO: 390466 - DNA, 36 bp, Artificial Sequence
  Description of Artificial Sequence: Synthetic oligonucleotide
tgagcaatgactcatacaaagctcagtgtccattgg

SEQ ID NO: 390467 - DNA, 35 bp, Artificial Sequence
  Description of Artificial Sequence: Synthetic oligonucleotide
gagcaatgactcatacaaagctcagtgtccattgg

SEQ ID NO: 390468 - DNA, 37 bp, Artificial Sequence
  Description of Artificial Sequence: Synthetic oligonucleotide
agcaatgactcatacaaagctcagtgtccattggttc

SEQ ID NO: 390469 - DNA, 36 bp, Artificial Sequence
  Description of Artificial Sequence: Synthetic oligonucleotide
gcaatgactcatacaaagctcagtgtccattggttc

SEQ ID NO: 390470 - DNA, 40 bp, Artificial Sequence
  Description of Artificial Sequence: Synthetic oligonucleotide
caatgactcatacaaagctcagtgtccattggttcttttc

SEQ ID NO: 390471 - DNA, 41 bp, Artificial Sequence
  Description of Artificial Sequence: Synthetic oligonucleotide
aatgactcatacaaagctcagtgtccattggttcttttctc

SEQ ID NO: 390472 - DNA, 40 bp, Artificial Sequence
  Description of Artificial Sequence: Synthetic oligonucleotide
atgactcatacaaagctcagtgtccattggttcttttctc

SEQ ID NO: 390473 - DNA, 39 bp, Artificial Sequence
  Description of Artificial Sequence: Synthetic oligonucleotide
tgactcatacaaagctcagtgtccattggttcttttctc

SEQ ID NO: 390474 - DNA, 38 bp, Artificial Sequence
  Description of Artificial Sequence: Synthetic oligonucleotide
gactcatacaaagctcagtgtccattggttcttttctc

SEQ ID NO: 390475 - DNA, 39 bp, Artificial Sequence
  Description of Artificial Sequence: Synthetic oligonucleotide
actcatacaaagctcagtgtccattggttcttttctcag

SEQ ID NO: 390476 - DNA, 38 bp, Artificial Sequence
  Description of Artificial Sequence: Synthetic oligonucleotide
ctcatacaaagctcagtgtccattggttcttttctcag

SEQ ID NO: 390477 - DNA, 39 bp, Artificial Sequence
  Description of Artificial Sequence: Synthetic oligonucleotide
tcatacaaagctcagtgtccattggttcttttctcagac

SEQ ID NO: 390478 - DNA, 38 bp, Artificial Sequence
  Description of Artificial Sequence: Synthetic oligonucleotide
catacaaagctcagtgtccattggttcttttctcagac

SEQ ID NO: 390479 - DNA, 39 bp, Artificial Sequence
  Description of Artificial Sequence: Synthetic oligonucleotide
atacaaagctcagtgtccattggttcttttctcagactc

SEQ ID NO: 390480 - DNA, 38 bp, Artificial Sequence
  Description of Artificial Sequence: Synthetic oligonucleotide
tacaaagctcagtgtccattggttcttttctcagactc

SEQ ID NO: 390481 - DNA, 37 bp, Artificial Sequence
  Description of Artificial Sequence: Synthetic oligonucleotide
acaaagctcagtgtccattggttcttttctcagactc

SEQ ID NO: 390482 - DNA, 36 bp, Artificial Sequence
  Description of Artificial Sequence: Synthetic oligonucleotide
caaagctcagtgtccattggttcttttctcagactc

SEQ ID NO: 390483 - DNA, 37 bp, Artificial Sequence
  Description of Artificial Sequence: Synthetic oligonucleotide
aaagctcagtgtccattggttcttttctcagactctg

SEQ ID NO: 390484 - DNA, 36 bp, Artificial Sequence
  Description of Artificial Sequence: Synthetic oligonucleotide
aagctcagtgtccattggttcttttctcagactctg

SEQ ID NO: 390485 - DNA, 35 bp, Artificial Sequence
  Description of Artificial Sequence: Synthetic oligonucleotide
agctcagtgtccattggttcttttctcagactctg

SEQ ID NO: 390486 - DNA, 34 bp, Artificial Sequence
  Description of Artificial Sequence: Synthetic oligonucleotide
gctcagtgtccattggttcttttctcagactctg

SEQ ID NO: 390487 - DNA, 35 bp, Artificial Sequence
  Description of Artificial Sequence: Synthetic oligonucleotide
ctcagtgtccattggttcttttctcagactctgtc

SEQ ID NO: 390488 - DNA, 35 bp, Artificial Sequence
  Description of Artificial Sequence: Synthetic oligonucleotide
tcagtgtccattggttcttttctcagactctgtcc

SEQ ID NO: 390489 - DNA, 34 bp, Artificial Sequence
  Description of Artificial Sequence: Synthetic oligonucleotide
cagtgtccattggttcttttctcagactctgtcc

SEQ ID NO: 390490 - DNA, 37 bp, Artificial Sequence
  Description of Artificial Sequence: Synthetic oligonucleotide
agtgtccattggttcttttctcagactctgtccaatc

SEQ ID NO: 390491 - DNA, 36 bp, Artificial Sequence
  Description of Artificial Sequence: Synthetic oligonucleotide
gtgtccattggttcttttctcagactctgtccaatc

SEQ ID NO: 390492 - DNA, 36 bp, Artificial Sequence
  Description of Artificial Sequence: Synthetic oligonucleotide
tgtccattggttcttttctcagactctgtccaatcc

SEQ ID NO: 390493 - DNA, 35 bp, Artificial Sequence
  Description of Artificial Sequence: Synthetic oligonucleotide
gtccattggttcttttctcagactctgtccaatcc

SEQ ID NO: 390494 - DNA, 35 bp, Artificial Sequence
  Description of Artificial Sequence: Synthetic oligonucleotide
tccattggttcttttctcagactctgtccaatccc

SEQ ID NO: 390495 - DNA, 34 bp, Artificial Sequence
  Description of Artificial Sequence: Synthetic oligonucleotide
ccattggttcttttctcagactctgtccaatccc

SEQ ID NO: 390496 - DNA, 35 bp, Artificial Sequence
  Description of Artificial Sequence: Synthetic oligonucleotide
cattggttcttttctcagactctgtccaatcccag

SEQ ID NO: 390497 - DNA, 35 bp, Artificial Sequence
  Description of Artificial Sequence: Synthetic oligonucleotide
attggttcttttctcagactctgtccaatcccagg

SEQ ID NO: 390498 - DNA, 34 bp, Artificial Sequence
  Description of Artificial Sequence: Synthetic oligonucleotide
ttggttcttttctcagactctgtccaatcccagg

SEQ ID NO: 390499 - DNA, 33 bp, Artificial Sequence
  Description of Artificial Sequence: Synthetic oligonucleotide
tggttcttttctcagactctgtccaatcccagg

SEQ ID NO: 390500 - DNA, 32 bp, Artificial Sequence
  Description of Artificial Sequence: Synthetic oligonucleotide
ggttcttttctcagactctgtccaatcccagg

SEQ ID NO: 390501 - DNA, 32 bp, Artificial Sequence
  Description of Artificial Sequence: Synthetic oligonucleotide
gttcttttctcagactctgtccaatcccaggg

SEQ ID NO: 390502 - DNA, 33 bp, Artificial Sequence
  Description of Artificial Sequence: Synthetic oligonucleotide
ttcttttctcagactctgtccaatcccagggtc

SEQ ID NO: 390503 - DNA, 32 bp, Artificial Sequence
  Description of Artificial Sequence: Synthetic oligonucleotide
tcttttctcagactctgtccaatcccagggtc

SEQ ID NO: 390504 - DNA, 31 bp, Artificial Sequence
  Description of Artificial Sequence: Synthetic oligonucleotide
cttttctcagactctgtccaatcccagggtc

SEQ ID NO: 390505 - DNA, 32 bp, Artificial Sequence
  Description of Artificial Sequence: Synthetic oligonucleotide
ttttctcagactctgtccaatcccagggtcac

SEQ ID NO: 390506 - DNA, 31 bp, Artificial Sequence
  Description of Artificial Sequence: Synthetic oligonucleotide
tttctcagactctgtccaatcccagggtcac

SEQ ID NO: 390507 - DNA, 30 bp, Artificial Sequence
  Description of Artificial Sequence: Synthetic oligonucleotide
ttctcagactctgtccaatcccagggtcac

SEQ ID NO: 390508 - DNA, 29 bp, Artificial Sequence
  Description of Artificial Sequence: Synthetic oligonucleotide
tctcagactctgtccaatcccagggtcac

SEQ ID NO: 390509 - DNA, 28 bp, Artificial Sequence
  Description of Artificial Sequence: Synthetic oligonucleotide
ctcagactctgtccaatcccagggtcac

SEQ ID NO: 390510 - DNA, 29 bp, Artificial Sequence
  Description of Artificial Sequence: Synthetic oligonucleotide
tcagactctgtccaatcccagggtcacag

SEQ ID NO: 390511 - DNA, 28 bp, Artificial Sequence
  Description of Artificial Sequence: Synthetic oligonucleotide
cagactctgtccaatcccagggtcacag

SEQ ID NO: 390512 - DNA, 30 bp, Artificial Sequence
  Description of Artificial Sequence: Synthetic oligonucleotide
agactctgtccaatcccagggtcacagaag

SEQ ID NO: 390513 - DNA, 29 bp, Artificial Sequence
  Description of Artificial Sequence: Synthetic oligonucleotide
gactctgtccaatcccagggtcacagaag

SEQ ID NO: 390514 - DNA, 30 bp, Artificial Sequence
  Description of Artificial Sequence: Synthetic oligonucleotide
actctgtccaatcccagggtcacagaagac

SEQ ID NO: 390515 - DNA, 29 bp, Artificial Sequence
  Description of Artificial Sequence: Synthetic oligonucleotide
ctctgtccaatcccagggtcacagaagac

SEQ ID NO: 390516 - DNA, 31 bp, Artificial Sequence
  Description of Artificial Sequence: Synthetic oligonucleotide
tctgtccaatcccagggtcacagaagactac

SEQ ID NO: 390517 - DNA, 30 bp, Artificial Sequence
  Description of Artificial Sequence: Synthetic oligonucleotide
ctgtccaatcccagggtcacagaagactac

SEQ ID NO: 390518 - DNA, 32 bp, Artificial Sequence
  Description of Artificial Sequence: Synthetic oligonucleotide
tgtccaatcccagggtcacagaagactacttg

SEQ ID NO: 390519 - DNA, 31 bp, Artificial Sequence
  Description of Artificial Sequence: Synthetic oligonucleotide
gtccaatcccagggtcacagaagactacttg

SEQ ID NO: 390520 - DNA, 31 bp, Artificial Sequence
  Description of Artificial Sequence: Synthetic oligonucleotide
tccaatcccagggtcacagaagactacttgg

SEQ ID NO: 390521 - DNA, 30 bp, Artificial Sequence
  Description of Artificial Sequence: Synthetic oligonucleotide
ccaatcccagggtcacagaagactacttgg

SEQ ID NO: 390522 - DNA, 30 bp, Artificial Sequence
  Description of Artificial Sequence: Synthetic oligonucleotide
caatcccagggtcacagaagactacttggg

SEQ ID NO: 390523 - DNA, 32 bp, Artificial Sequence
  Description of Artificial Sequence: Synthetic oligonucleotide
aatcccagggtcacagaagactacttgggttc

SEQ ID NO: 390524 - DNA, 31 bp, Artificial Sequence
  Description of Artificial Sequence: Synthetic oligonucleotide
atcccagggtcacagaagactacttgggttc

SEQ ID NO: 390525 - DNA, 30 bp, Artificial Sequence
  Description of Artificial Sequence: Synthetic oligonucleotide
tcccagggtcacagaagactacttgggttc

SEQ ID NO: 390526 - DNA, 29 bp, Artificial Sequence
  Description of Artificial Sequence: Synthetic oligonucleotide
cccagggtcacagaagactacttgggttc

SEQ ID NO: 390527 - DNA, 31 bp, Artificial Sequence
  Description of Artificial Sequence: Synthetic oligonucleotide
ccagggtcacagaagactacttgggttcatg

SEQ ID NO: 390528 - DNA, 31 bp, Artificial Sequence
  Description of Artificial Sequence: Synthetic oligonucleotide
cagggtcacagaagactacttgggttcatgg

SEQ ID NO: 390529 - DNA, 32 bp, Artificial Sequence
  Description of Artificial Sequence: Synthetic oligonucleotide
agggtcacagaagactacttgggttcatggtc

SEQ ID NO: 390530 - DNA, 31 bp, Artificial Sequence
  Description of Artificial Sequence: Synthetic oligonucleotide
gggtcacagaagactacttgggttcatggtc

SEQ ID NO: 390531 - DNA, 32 bp, Artificial Sequence
  Description of Artificial Sequence: Synthetic oligonucleotide
ggtcacagaagactacttgggttcatggtctc

SEQ ID NO: 390532 - DNA, 40 bp, Artificial Sequence
  Description of Artificial Sequence: Synthetic oligonucleotide
gtcacagaagactacttgggttcatggtctctaatatttc

SEQ ID NO: 390533 - DNA, 43 bp, Artificial Sequence
  Description of Artificial Sequence: Synthetic oligonucleotide
tcacagaagactacttgggttcatggtctctaatatttcaaac

SEQ ID NO: 390534 - DNA, 42 bp, Artificial Sequence
  Description of Artificial Sequence: Synthetic oligonucleotide
cacagaagactacttgggttcatggtctctaatatttcaaac

SEQ ID NO: 390535 - DNA, 43 bp, Artificial Sequence
  Description of Artificial Sequence: Synthetic oligonucleotide
acagaagactacttgggttcatggtctctaatatttcaaacag

SEQ ID NO: 390536 - DNA, 42 bp, Artificial Sequence
  Description of Artificial Sequence: Synthetic oligonucleotide
cagaagactacttgggttcatggtctctaatatttcaaacag

SEQ ID NO: 390537 - DNA, 42 bp, Artificial Sequence
  Description of Artificial Sequence: Synthetic oligonucleotide
agaagactacttgggttcatggtctctaatatttcaaacagg

SEQ ID NO: 390538 - DNA, 41 bp, Artificial Sequence
  Description of Artificial Sequence: Synthetic oligonucleotide
gaagactacttgggttcatggtctctaatatttcaaacagg

SEQ ID NO: 390539 - DNA, 42 bp, Artificial Sequence
  Description of Artificial Sequence: Synthetic oligonucleotide
aagactacttgggttcatggtctctaatatttcaaacaggag

SEQ ID NO: 390540 - DNA, 41 bp, Artificial Sequence
  Description of Artificial Sequence: Synthetic oligonucleotide
agactacttgggttcatggtctctaatatttcaaacaggag

SEQ ID NO: 390541 - DNA, 40 bp, Artificial Sequence
  Description of Artificial Sequence: Synthetic oligonucleotide
gactacttgggttcatggtctctaatatttcaaacaggag

SEQ ID NO: 390542 - DNA, 40 bp, Artificial Sequence
  Description of Artificial Sequence: Synthetic oligonucleotide
actacttgggttcatggtctctaatatttcaaacaggagc

SEQ ID NO: 390543 - DNA, 39 bp, Artificial Sequence
  Description of Artificial Sequence: Synthetic oligonucleotide
ctacttgggttcatggtctctaatatttcaaacaggagc

SEQ ID NO: 390544 - DNA, 40 bp, Artificial Sequence
  Description of Artificial Sequence: Synthetic oligonucleotide
tacttgggttcatggtctctaatatttcaaacaggagctc

SEQ ID NO: 390545 - DNA, 39 bp, Artificial Sequence
  Description of Artificial Sequence: Synthetic oligonucleotide
acttgggttcatggtctctaatatttcaaacaggagctc

SEQ ID NO: 390546 - DNA, 38 bp, Artificial Sequence
  Description of Artificial Sequence: Synthetic oligonucleotide
cttgggttcatggtctctaatatttcaaacaggagctc

SEQ ID NO: 390547 - DNA, 38 bp, Artificial Sequence
  Description of Artificial Sequence: Synthetic oligonucleotide
ttgggttcatggtctctaatatttcaaacaggagctcc

SEQ ID NO: 390548 - DNA, 37 bp, Artificial Sequence
  Description of Artificial Sequence: Synthetic oligonucleotide
tgggttcatggtctctaatatttcaaacaggagctcc

SEQ ID NO: 390549 - DNA, 36 bp, Artificial Sequence
  Description of Artificial Sequence: Synthetic oligonucleotide
gggttcatggtctctaatatttcaaacaggagctcc

SEQ ID NO: 390550 - DNA, 36 bp, Artificial Sequence
  Description of Artificial Sequence: Synthetic oligonucleotide
ggttcatggtctctaatatttcaaacaggagctccc

SEQ ID NO: 390551 - DNA, 40 bp, Artificial Sequence
  Description of Artificial Sequence: Synthetic oligonucleotide
gttcatggtctctaatatttcaaacaggagctccctttag

SEQ ID NO: 390552 - DNA, 40 bp, Artificial Sequence
  Description of Artificial Sequence: Synthetic oligonucleotide
ttcatggtctctaatatttcaaacaggagctccctttagc

SEQ ID NO: 390553 - DNA, 39 bp, Artificial Sequence
  Description of Artificial Sequence: Synthetic oligonucleotide
tcatggtctctaatatttcaaacaggagctccctttagc

SEQ ID NO: 390554 - DNA, 38 bp, Artificial Sequence
  Description of Artificial Sequence: Synthetic oligonucleotide
catggtctctaatatttcaaacaggagctccctttagc

SEQ ID NO: 390555 - DNA, 38 bp, Artificial Sequence
  Description of Artificial Sequence: Synthetic oligonucleotide
atggtctctaatatttcaaacaggagctccctttagcg

SEQ ID NO: 390556 - DNA, 37 bp, Artificial Sequence
  Description of Artificial Sequence: Synthetic oligonucleotide
tggtctctaatatttcaaacaggagctccctttagcg

SEQ ID NO: 390557 - DNA, 36 bp, Artificial Sequence
  Description of Artificial Sequence: Synthetic oligonucleotide
ggtctctaatatttcaaacaggagctccctttagcg

SEQ ID NO: 390558 - DNA, 37 bp, Artificial Sequence
  Description of Artificial Sequence: Synthetic oligonucleotide
gtctctaatatttcaaacaggagctccctttagcgag

SEQ ID NO: 390559 - DNA, 38 bp, Artificial Sequence
  Description of Artificial Sequence: Synthetic oligonucleotide
tctctaatatttcaaacaggagctccctttagcgagtc

SEQ ID NO: 390560 - DNA, 37 bp, Artificial Sequence
  Description of Artificial Sequence: Synthetic oligonucleotide
ctctaatatttcaaacaggagctccctttagcgagtc

SEQ ID NO: 390561 - DNA, 37 bp, Artificial Sequence
  Description of Artificial Sequence: Synthetic oligonucleotide
tctaatatttcaaacaggagctccctttagcgagtcc

SEQ ID NO: 390562 - DNA, 36 bp, Artificial Sequence
  Description of Artificial Sequence: Synthetic oligonucleotide
ctaatatttcaaacaggagctccctttagcgagtcc

SEQ ID NO: 390563 - DNA, 38 bp, Artificial Sequence
  Description of Artificial Sequence: Synthetic oligonucleotide
taatatttcaaacaggagctccctttagcgagtccttc

SEQ ID NO: 390564 - DNA, 37 bp, Artificial Sequence
  Description of Artificial Sequence: Synthetic oligonucleotide
aatatttcaaacaggagctccctttagcgagtccttc

SEQ ID NO: 390565 - DNA, 36 bp, Artificial Sequence
  Description of Artificial Sequence: Synthetic oligonucleotide
atatttcaaacaggagctccctttagcgagtccttc

SEQ ID NO: 390566 - DNA, 35 bp, Artificial Sequence
  Description of Artificial Sequence: Synthetic oligonucleotide
tatttcaaacaggagctccctttagcgagtccttc

SEQ ID NO: 390567 - DNA, 34 bp, Artificial Sequence
  Description of Artificial Sequence: Synthetic oligonucleotide
atttcaaacaggagctccctttagcgagtccttc

SEQ ID NO: 390568 - DNA, 33 bp, Artificial Sequence
  Description of Artificial Sequence: Synthetic oligonucleotide
tttcaaacaggagctccctttagcgagtccttc

SEQ ID NO: 390569 - DNA, 32 bp, Artificial Sequence
  Description of Artificial Sequence: Synthetic oligonucleotide
ttcaaacaggagctccctttagcgagtccttc

SEQ ID NO: 390570 - DNA, 31 bp, Artificial Sequence
  Description of Artificial Sequence: Synthetic oligonucleotide
tcaaacaggagctccctttagcgagtccttc

SEQ ID NO: 390571 - DNA, 30 bp, Artificial Sequence
  Description of Artificial Sequence: Synthetic oligonucleotide
caaacaggagctccctttagcgagtccttc

SEQ ID NO: 390572 - DNA, 34 bp, Artificial Sequence
  Description of Artificial Sequence: Synthetic oligonucleotide
aaacaggagctccctttagcgagtccttcttttc

SEQ ID NO: 390573 - DNA, 33 bp, Artificial Sequence
  Description of Artificial Sequence: Synthetic oligonucleotide
aacaggagctccctttagcgagtccttcttttc

SEQ ID NO: 390574 - DNA, 32 bp, Artificial Sequence
  Description of Artificial Sequence: Synthetic oligonucleotide
acaggagctccctttagcgagtccttcttttc

SEQ ID NO: 390575 - DNA, 31 bp, Artificial Sequence
  Description of Artificial Sequence: Synthetic oligonucleotide
caggagctccctttagcgagtccttcttttc

SEQ ID NO: 390576 - DNA, 31 bp, Artificial Sequence
  Description of Artificial Sequence: Synthetic oligonucleotide
aggagctccctttagcgagtccttcttttcc

SEQ ID NO: 390577 - DNA, 30 bp, Artificial Sequence
  Description of Artificial Sequence: Synthetic oligonucleotide
ggagctccctttagcgagtccttcttttcc

SEQ ID NO: 390578 - DNA, 31 bp, Artificial Sequence
  Description of Artificial Sequence: Synthetic oligonucleotide
gagctccctttagcgagtccttcttttcctg

SEQ ID NO: 390579 - DNA, 32 bp, Artificial Sequence
  Description of Artificial Sequence: Synthetic oligonucleotide
agctccctttagcgagtccttcttttcctgac

SEQ ID NO: 390580 - DNA, 31 bp, Artificial Sequence
  Description of Artificial Sequence: Synthetic oligonucleotide
gctccctttagcgagtccttcttttcctgac

SEQ ID NO: 390581 - DNA, 32 bp, Artificial Sequence
  Description of Artificial Sequence: Synthetic oligonucleotide
ctccctttagcgagtccttcttttcctgactg

SEQ ID NO: 390582 - DNA, 32 bp, Artificial Sequence
  Description of Artificial Sequence: Synthetic oligonucleotide
tccctttagcgagtccttcttttcctgactgc

SEQ ID NO: 390583 - DNA, 31 bp, Artificial Sequence
  Description of Artificial Sequence: Synthetic oligonucleotide
ccctttagcgagtccttcttttcctgactgc

SEQ ID NO: 390584 - DNA, 32 bp, Artificial Sequence
  Description of Artificial Sequence: Synthetic oligonucleotide
cctttagcgagtccttcttttcctgactgcag

SEQ ID NO: 390585 - DNA, 32 bp, Artificial Sequence
  Description of Artificial Sequence: Synthetic oligonucleotide
ctttagcgagtccttcttttcctgactgcagc

SEQ ID NO: 390586 - DNA, 33 bp, Artificial Sequence
  Description of Artificial Sequence: Synthetic oligonucleotide
tttagcgagtccttcttttcctgactgcagctc

SEQ ID NO: 390587 - DNA, 32 bp, Artificial Sequence
  Description of Artificial Sequence: Synthetic oligonucleotide
ttagcgagtccttcttttcctgactgcagctc

SEQ ID NO: 390588 - DNA, 31 bp, Artificial Sequence
  Description of Artificial Sequence: Synthetic oligonucleotide
tagcgagtccttcttttcctgactgcagctc

SEQ ID NO: 390589 - DNA, 30 bp, Artificial Sequence
  Description of Artificial Sequence: Synthetic oligonucleotide
agcgagtccttcttttcctgactgcagctc

SEQ ID NO: 390590 - DNA, 29 bp, Artificial Sequence
  Description of Artificial Sequence: Synthetic oligonucleotide
gcgagtccttcttttcctgactgcagctc

SEQ ID NO: 390591 - DNA, 33 bp, Artificial Sequence
  Description of Artificial Sequence: Synthetic oligonucleotide
cgagtccttcttttcctgactgcagctcttttc

SEQ ID NO: 390592 - DNA, 38 bp, Artificial Sequence
  Description of Artificial Sequence: Synthetic oligonucleotide
gagtccttcttttcctgactgcagctcttttcattttg

SEQ ID NO: 390593 - DNA, 38 bp, Artificial Sequence
  Description of Artificial Sequence: Synthetic oligonucleotide
agtccttcttttcctgactgcagctcttttcattttgc

SEQ ID NO: 390594 - DNA, 37 bp, Artificial Sequence
  Description of Artificial Sequence: Synthetic oligonucleotide
gtccttcttttcctgactgcagctcttttcattttgc

SEQ ID NO: 390595 - DNA, 37 bp, Artificial Sequence
  Description of Artificial Sequence: Synthetic oligonucleotide
tccttcttttcctgactgcagctcttttcattttgcc

SEQ ID NO: 390596 - DNA, 36 bp, Artificial Sequence
  Description of Artificial Sequence: Synthetic oligonucleotide
ccttcttttcctgactgcagctcttttcattttgcc

SEQ ID NO: 390597 - DNA, 38 bp, Artificial Sequence
  Description of Artificial Sequence: Synthetic oligonucleotide
cttcttttcctgactgcagctcttttcattttgccatc

SEQ ID NO: 390598 - DNA, 38 bp, Artificial Sequence
  Description of Artificial Sequence: Synthetic oligonucleotide
ttcttttcctgactgcagctcttttcattttgccatcc

SEQ ID NO: 390599 - DNA, 37 bp, Artificial Sequence
  Description of Artificial Sequence: Synthetic oligonucleotide
tcttttcctgactgcagctcttttcattttgccatcc

SEQ ID NO: 390600 - DNA, 36 bp, Artificial Sequence
  Description of Artificial Sequence: Synthetic oligonucleotide
cttttcctgactgcagctcttttcattttgccatcc

SEQ ID NO: 390601 - DNA, 40 bp, Artificial Sequence
  Description of Artificial Sequence: Synthetic oligonucleotide
ttttcctgactgcagctcttttcattttgccatccttttc

SEQ ID NO: 390602 - DNA, 39 bp, Artificial Sequence
  Description of Artificial Sequence: Synthetic oligonucleotide
tttcctgactgcagctcttttcattttgccatccttttc

SEQ ID NO: 390603 - DNA, 38 bp, Artificial Sequence
  Description of Artificial Sequence: Synthetic oligonucleotide
ttcctgactgcagctcttttcattttgccatccttttc

SEQ ID NO: 390604 - DNA, 37 bp, Artificial Sequence
  Description of Artificial Sequence: Synthetic oligonucleotide
tcctgactgcagctcttttcattttgccatccttttc

SEQ ID NO: 390605 - DNA, 36 bp, Artificial Sequence
  Description of Artificial Sequence: Synthetic oligonucleotide
cctgactgcagctcttttcattttgccatccttttc

SEQ ID NO: 390606 - DNA, 36 bp, Artificial Sequence
  Description of Artificial Sequence: Synthetic oligonucleotide
ctgactgcagctcttttcattttgccatccttttcc

SEQ ID NO: 390607 - DNA, 37 bp, Artificial Sequence
  Description of Artificial Sequence: Synthetic oligonucleotide
tgactgcagctcttttcattttgccatccttttccag

SEQ ID NO: 390608 - DNA, 36 bp, Artificial Sequence
  Description of Artificial Sequence: Synthetic oligonucleotide
gactgcagctcttttcattttgccatccttttccag

SEQ ID NO: 390609 - DNA, 36 bp, Artificial Sequence
  Description of Artificial Sequence: Synthetic oligonucleotide
actgcagctcttttcattttgccatccttttccagc

SEQ ID NO: 390610 - DNA, 35 bp, Artificial Sequence
  Description of Artificial Sequence: Synthetic oligonucleotide
ctgcagctcttttcattttgccatccttttccagc

SEQ ID NO: 390611 - DNA, 36 bp, Artificial Sequence
  Description of Artificial Sequence: Synthetic oligonucleotide
tgcagctcttttcattttgccatccttttccagctc

SEQ ID NO: 390612 - DNA, 35 bp, Artificial Sequence
  Description of Artificial Sequence: Synthetic oligonucleotide
gcagctcttttcattttgccatccttttccagctc

SEQ ID NO: 390613 - DNA, 35 bp, Artificial Sequence
  Description of Artificial Sequence: Synthetic oligonucleotide
cagctcttttcattttgccatccttttccagctcc

SEQ ID NO: 390614 - DNA, 37 bp, Artificial Sequence
  Description of Artificial Sequence: Synthetic oligonucleotide
agctcttttcattttgccatccttttccagctccatg

SEQ ID NO: 390615 - DNA, 36 bp, Artificial Sequence
  Description of Artificial Sequence: Synthetic oligonucleotide
gctcttttcattttgccatccttttccagctccatg

SEQ ID NO: 390616 - DNA, 38 bp, Artificial Sequence
  Description of Artificial Sequence: Synthetic oligonucleotide
ctcttttcattttgccatccttttccagctccatgatg

SEQ ID NO: 390617 - DNA, 38 bp, Artificial Sequence
  Description of Artificial Sequence: Synthetic oligonucleotide
tcttttcattttgccatccttttccagctccatgatgg

SEQ ID NO: 390618 - DNA, 37 bp, Artificial Sequence
  Description of Artificial Sequence: Synthetic oligonucleotide
cttttcattttgccatccttttccagctccatgatgg

SEQ ID NO: 390619 - DNA, 39 bp, Artificial Sequence
  Description of Artificial Sequence: Synthetic oligonucleotide
ttttcattttgccatccttttccagctccatgatggttc

SEQ ID NO: 390620 - DNA, 38 bp, Artificial Sequence
  Description of Artificial Sequence: Synthetic oligonucleotide
tttcattttgccatccttttccagctccatgatggttc

SEQ ID NO: 390621 - DNA, 37 bp, Artificial Sequence
  Description of Artificial Sequence: Synthetic oligonucleotide
ttcattttgccatccttttccagctccatgatggttc

SEQ ID NO: 390622 - DNA, 36 bp, Artificial Sequence
  Description of Artificial Sequence: Synthetic oligonucleotide
tcattttgccatccttttccagctccatgatggttc

SEQ ID NO: 390623 - DNA, 35 bp, Artificial Sequence
  Description of Artificial Sequence: Synthetic oligonucleotide
cattttgccatccttttccagctccatgatggttc

SEQ ID NO: 390624 - DNA, 36 bp, Artificial Sequence
  Description of Artificial Sequence: Synthetic oligonucleotide
attttgccatccttttccagctccatgatggttctg

SEQ ID NO: 390625 - DNA, 35 bp, Artificial Sequence
  Description of Artificial Sequence: Synthetic oligonucleotide
ttttgccatccttttccagctccatgatggttctg

SEQ ID NO: 390626 - DNA, 34 bp, Artificial Sequence
  Description of Artificial Sequence: Synthetic oligonucleotide
tttgccatccttttccagctccatgatggttctg

SEQ ID NO: 390627 - DNA, 33 bp, Artificial Sequence
  Description of Artificial Sequence: Synthetic oligonucleotide
ttgccatccttttccagctccatgatggttctg

SEQ ID NO: 390628 - DNA, 32 bp, Artificial Sequence
  Description of Artificial Sequence: Synthetic oligonucleotide
tgccatccttttccagctccatgatggttctg

SEQ ID NO: 390629 - DNA, 31 bp, Artificial Sequence
  Description of Artificial Sequence: Synthetic oligonucleotide
gccatccttttccagctccatgatggttctg

SEQ ID NO: 390630 - DNA, 31 bp, Artificial Sequence
  Description of Artificial Sequence: Synthetic oligonucleotide
ccatccttttccagctccatgatggttctgc

SEQ ID NO: 390631 - DNA, 32 bp, Artificial Sequence
  Description of Artificial Sequence: Synthetic oligonucleotide
catccttttccagctccatgatggttctgcag

SEQ ID NO: 390632 - DNA, 32 bp, Artificial Sequence
  Description of Artificial Sequence: Synthetic oligonucleotide
atccttttccagctccatgatggttctgcagg

SEQ ID NO: 390633 - DNA, 31 bp, Artificial Sequence
  Description of Artificial Sequence: Synthetic oligonucleotide
tccttttccagctccatgatggttctgcagg

SEQ ID NO: 390634 - DNA, 30 bp, Artificial Sequence
  Description of Artificial Sequence: Synthetic oligonucleotide
ccttttccagctccatgatggttctgcagg

SEQ ID NO: 390635 - DNA, 33 bp, Artificial Sequence
  Description of Artificial Sequence: Synthetic oligonucleotide
cttttccagctccatgatggttctgcaggtttc

SEQ ID NO: 390636 - DNA, 34 bp, Artificial Sequence
  Description of Artificial Sequence: Synthetic oligonucleotide
ttttccagctccatgatggttctgcaggtttctg

SEQ ID NO: 390637 - DNA, 33 bp, Artificial Sequence
  Description of Artificial Sequence: Synthetic oligonucleotide
tttccagctccatgatggttctgcaggtttctg

SEQ ID NO: 390638 - DNA, 32 bp, Artificial Sequence
  Description of Artificial Sequence: Synthetic oligonucleotide
ttccagctccatgatggttctgcaggtttctg

SEQ ID NO: 390639 - DNA, 31 bp, Artificial Sequence
  Description of Artificial Sequence: Synthetic oligonucleotide
tccagctccatgatggttctgcaggtttctg

SEQ ID NO: 390640 - DNA, 30 bp, Artificial Sequence
  Description of Artificial Sequence: Synthetic oligonucleotide
ccagctccatgatggttctgcaggtttctg

SEQ ID NO: 390641 - DNA, 30 bp, Artificial Sequence
  Description of Artificial Sequence: Synthetic oligonucleotide
cagctccatgatggttctgcaggtttctgc

SEQ ID NO: 390642 - DNA, 30 bp, Artificial Sequence
  Description of Artificial Sequence: Synthetic oligonucleotide
agctccatgatggttctgcaggtttctgcg

SEQ ID NO: 390643 - DNA, 29 bp, Artificial Sequence
  Description of Artificial Sequence: Synthetic oligonucleotide
gctccatgatggttctgcaggtttctgcg

SEQ ID NO: 390644 - DNA, 29 bp, Artificial Sequence
  Description of Artificial Sequence: Synthetic oligonucleotide
ctccatgatggttctgcaggtttctgcgg

SEQ ID NO: 390645 - DNA, 29 bp, Artificial Sequence
  Description of Artificial Sequence: Synthetic oligonucleotide
tccatgatggttctgcaggtttctgcggc

SEQ ID NO: 390646 - DNA, 28 bp, Artificial Sequence
  Description of Artificial Sequence: Synthetic oligonucleotide
ccatgatggttctgcaggtttctgcggc

SEQ ID NO: 390647 - DNA, 28 bp, Artificial Sequence
  Description of Artificial Sequence: Synthetic oligonucleotide
catgatggttctgcaggtttctgcggcc

SEQ ID NO: 390648 - DNA, 27 bp, Artificial Sequence
  Description of Artificial Sequence: Synthetic oligonucleotide
agggcagggccactccagagaattacc

SEQ ID NO: 390649 - DNA, 27 bp, Artificial Sequence
  Description of Artificial Sequence: Synthetic oligonucleotide
gggcagggccactccagagaattacct

SEQ ID NO: 390650 - DNA, 30 bp, Artificial Sequence; identical to SEQ ID NO: 53217
  Description of Artificial Sequence: Synthetic oligonucleotide

SEQ ID NO: 390651 - DNA, 30 bp, Artificial Sequence; identical to SEQ ID NO: 53218
  Description of Artificial Sequence: Synthetic oligonucleotide

SEQ ID NO: 390652 - DNA, 31 bp, Artificial Sequence; identical to SEQ ID NO: 53219
  Description of Artificial Sequence: Synthetic oligonucleotide

SEQ ID NO: 390653 - DNA, 31 bp, Artificial Sequence; identical to SEQ ID NO: 53220
  Description of Artificial Sequence: Synthetic oligonucleotide

SEQ ID NO: 390654 - DNA, 30 bp, Artificial Sequence; identical to SEQ ID NO: 53221
  Description of Artificial Sequence: Synthetic oligonucleotide

SEQ ID NO: 390655 - DNA, 30 bp, Artificial Sequence; identical to SEQ ID NO: 53222
  Description of Artificial Sequence: Synthetic oligonucleotide

SEQ ID NO: 390656 - DNA, 31 bp, Artificial Sequence; identical to SEQ ID NO: 53223
  Description of Artificial Sequence: Synthetic oligonucleotide

SEQ ID NO: 390657 - DNA, 31 bp, Artificial Sequence; identical to SEQ ID NO: 53224
  Description of Artificial Sequence: Synthetic oligonucleotide

SEQ ID NO: 390658 - DNA, 31 bp, Artificial Sequence; identical to SEQ ID NO: 53225
  Description of Artificial Sequence: Synthetic oligonucleotide

SEQ ID NO: 390659 - DNA, 31 bp, Artificial Sequence; identical to SEQ ID NO: 53226
  Description of Artificial Sequence: Synthetic oligonucleotide

SEQ ID NO: 390660 - DNA, 30 bp, Artificial Sequence; identical to SEQ ID NO: 53227
  Description of Artificial Sequence: Synthetic oligonucleotide

SEQ ID NO: 390661 - DNA, 31 bp, Artificial Sequence; identical to SEQ ID NO: 53228
  Description of Artificial Sequence: Synthetic oligonucleotide

SEQ ID NO: 390662 - DNA, 30 bp, Artificial Sequence; identical to SEQ ID NO: 53229
  Description of Artificial Sequence: Synthetic oligonucleotide

SEQ ID NO: 390663 - DNA, 30 bp, Artificial Sequence; identical to SEQ ID NO: 53230
  Description of Artificial Sequence: Synthetic oligonucleotide

SEQ ID NO: 390664 - DNA, 33 bp, Artificial Sequence; identical to SEQ ID NO: 53231
  Description of Artificial Sequence: Synthetic oligonucleotide

SEQ ID NO: 390665 - DNA, 32 bp, Artificial Sequence; identical to SEQ ID NO: 53232
  Description of Artificial Sequence: Synthetic oligonucleotide

SEQ ID NO: 390666 - DNA, 32 bp, Artificial Sequence; identical to SEQ ID NO: 53233
  Description of Artificial Sequence: Synthetic oligonucleotide

SEQ ID NO: 390667 - DNA, 31 bp, Artificial Sequence; identical to SEQ ID NO: 53234
  Description of Artificial Sequence: Synthetic oligonucleotide

SEQ ID NO: 390668 - DNA, 33 bp, Artificial Sequence; identical to SEQ ID NO: 53235
  Description of Artificial Sequence: Synthetic oligonucleotide

SEQ ID NO: 390669 - DNA, 32 bp, Artificial Sequence; identical to SEQ ID NO: 53236
  Description of Artificial Sequence: Synthetic oligonucleotide

SEQ ID NO: 390670 - DNA, 31 bp, Artificial Sequence; identical to SEQ ID NO: 53237
  Description of Artificial Sequence: Synthetic oligonucleotide

SEQ ID NO: 390671 - DNA, 30 bp, Artificial Sequence; identical to SEQ ID NO: 53238
  Description of Artificial Sequence: Synthetic oligonucleotide

SEQ ID NO: 390672 - DNA, 29 bp, Artificial Sequence
  Description of Artificial Sequence: Synthetic oligonucleotide
accttttccagggacggcaggaatgctac

SEQ ID NO: 390673 - DNA, 28 bp, Artificial Sequence
  Description of Artificial Sequence: Synthetic oligonucleotide
ccttttccagggacggcaggaatgctac

SEQ ID NO: 390674 - DNA, 28 bp, Artificial Sequence
  Description of Artificial Sequence: Synthetic oligonucleotide
cttttccagggacggcaggaatgctacg

SEQ ID NO: 390675 - DNA, 28 bp, Artificial Sequence
  Description of Artificial Sequence: Synthetic oligonucleotide
ttttccagggacggcaggaatgctacgc

SEQ ID NO: 390676 - DNA, 27 bp, Artificial Sequence
  Description of Artificial Sequence: Synthetic oligonucleotide
tttccagggacggcaggaatgctacgc

SEQ ID NO: 390677 - DNA, 26 bp, Artificial Sequence
  Description of Artificial Sequence: Synthetic oligonucleotide
ttccagggacggcaggaatgctacgc

SEQ ID NO: 390678 - DNA, 25 bp, Artificial Sequence
  Description of Artificial Sequence: Synthetic oligonucleotide
tccagggacggcaggaatgctacgc

SEQ ID NO: 390679 - DNA, 32 bp, Artificial Sequence; identical to SEQ ID NO: 53246
  Description of Artificial Sequence: Synthetic oligonucleotide

SEQ ID NO: 390680 - DNA, 31 bp, Artificial Sequence; identical to SEQ ID NO: 53247
  Description of Artificial Sequence: Synthetic oligonucleotide

SEQ ID NO: 390681 - DNA, 31 bp, Artificial Sequence; identical to SEQ ID NO: 53248
  Description of Artificial Sequence: Synthetic oligonucleotide

SEQ ID NO: 390682 - DNA, 32 bp, Artificial Sequence; identical to SEQ ID NO: 53249
  Description of Artificial Sequence: Synthetic oligonucleotide

SEQ ID NO: 390683 - DNA, 31 bp, Artificial Sequence; identical to SEQ ID NO: 53250
  Description of Artificial Sequence: Synthetic oligonucleotide

SEQ ID NO: 390684 - DNA, 31 bp, Artificial Sequence; identical to SEQ ID NO: 53251
  Description of Artificial Sequence: Synthetic oligonucleotide

SEQ ID NO: 390685 - DNA, 30 bp, Artificial Sequence; identical to SEQ ID NO: 53252
  Description of Artificial Sequence: Synthetic oligonucleotide

SEQ ID NO: 390686 - DNA, 30 bp, Artificial Sequence; identical to SEQ ID NO: 53253
  Description of Artificial Sequence: Synthetic oligonucleotide

SEQ ID NO: 390687 - DNA, 29 bp, Artificial Sequence
  Description of Artificial Sequence: Synthetic oligonucleotide
tacatctacaaccgggaggagttcgtgcg

SEQ ID NO: 390688 - DNA, 28 bp, Artificial Sequence
  Description of Artificial Sequence: Synthetic oligonucleotide
acatctacaaccgggaggagttcgtgcg

SEQ ID NO: 390689 - DNA, 27 bp, Artificial Sequence
  Description of Artificial Sequence: Synthetic oligonucleotide
catctacaaccgggaggagttcgtgcg

SEQ ID NO: 390690 - DNA, 27 bp, Artificial Sequence
  Description of Artificial Sequence: Synthetic oligonucleotide
atctacaaccgggaggagttcgtgcgc

SEQ ID NO: 390691 - DNA, 27 bp, Artificial Sequence
  Description of Artificial Sequence: Synthetic oligonucleotide
tctacaaccgggaggagttcgtgcgct

SEQ ID NO: 390692 - DNA, 27 bp, Artificial Sequence
  Description of Artificial Sequence: Synthetic oligonucleotide
ctacaaccgggaggagttcgtgcgctt

SEQ ID NO: 390693 - DNA, 27 bp, Artificial Sequence
  Description of Artificial Sequence: Synthetic oligonucleotide
tacaaccgggaggagttcgtgcgcttc

SEQ ID NO: 390694 - DNA, 26 bp, Artificial Sequence
  Description of Artificial Sequence: Synthetic oligonucleotide
acaaccgggaggagttcgtgcgcttc

SEQ ID NO: 390695 - DNA, 25 bp, Artificial Sequence
  Description of Artificial Sequence: Synthetic oligonucleotide
caaccgggaggagttcgtgcgcttc

SEQ ID NO: 390696 - DNA, 26 bp, Artificial Sequence
  Description of Artificial Sequence: Synthetic oligonucleotide
aaccgggaggagttcgtgcgcttcga

SEQ ID NO: 390697 - DNA, 25 bp, Artificial Sequence
  Description of Artificial Sequence: Synthetic oligonucleotide
accgggaggagttcgtgcgcttcga

SEQ ID NO: 390698 - DNA, 24 bp, Artificial Sequence
  Description of Artificial Sequence: Synthetic oligonucleotide
ccgggaggagttcgtgcgcttcga

SEQ ID NO: 390699 - DNA, 25 bp, Artificial Sequence
  Description of Artificial Sequence: Synthetic oligonucleotide
cgggaggagttcgtgcgcttcgaca

SEQ ID NO: 390700 - DNA, 25 bp, Artificial Sequence
  Description of Artificial Sequence: Synthetic oligonucleotide
gggaggagttcgtgcgcttcgacag

SEQ ID NO: 390701 - DNA, 25 bp, Artificial Sequence
  Description of Artificial Sequence: Synthetic oligonucleotide
ggaggagttcgtgcgcttcgacagc

SEQ ID NO: 390702 - DNA, 26 bp, Artificial Sequence
  Description of Artificial Sequence: Synthetic oligonucleotide
gaggagttcgtgcgcttcgacagcga

SEQ ID NO: 390703 - DNA, 26 bp, Artificial Sequence
  Description of Artificial Sequence: Synthetic oligonucleotide
aggagttcgtgcgcttcgacagcgac

SEQ ID NO: 390704 - DNA, 25 bp, Artificial Sequence
  Description of Artificial Sequence: Synthetic oligonucleotide
ggagttcgtgcgcttcgacagcgac

SEQ ID NO: 390705 - DNA, 26 bp, Artificial Sequence
  Description of Artificial Sequence: Synthetic oligonucleotide
gagttcgtgcgcttcgacagcgacgt

SEQ ID NO: 390706 - DNA, 26 bp, Artificial Sequence
  Description of Artificial Sequence: Synthetic oligonucleotide
agttcgtgcgcttcgacagcgacgtg

SEQ ID NO: 390707 - DNA, 25 bp, Artificial Sequence
  Description of Artificial Sequence: Synthetic oligonucleotide
gttcgtgcgcttcgacagcgacgtg

SEQ ID NO: 390708 - DNA, 25 bp, Artificial Sequence
  Description of Artificial Sequence: Synthetic oligonucleotide
ttcgtgcgcttcgacagcgacgtgg

SEQ ID NO: 390709 - DNA, 24 bp, Artificial Sequence
  Description of Artificial Sequence: Synthetic oligonucleotide
tcgtgcgcttcgacagcgacgtgg

SEQ ID NO: 390710 - DNA, 23 bp, Artificial Sequence
  Description of Artificial Sequence: Synthetic oligonucleotide
cgtgcgcttcgacagcgacgtgg

SEQ ID NO: 390711 - DNA, 23 bp, Artificial Sequence
  Description of Artificial Sequence: Synthetic oligonucleotide
gtgcgcttcgacagcgacgtggg

SEQ ID NO: 390712 - DNA, 23 bp, Artificial Sequence
  Description of Artificial Sequence: Synthetic oligonucleotide
tgcgcttcgacagcgacgtgggg

SEQ ID NO: 390713 - DNA, 23 bp, Artificial Sequence
  Description of Artificial Sequence: Synthetic oligonucleotide
tgacggagctggggcggcctgat

SEQ ID NO: 390714 - DNA, 22 bp, Artificial Sequence
  Description of Artificial Sequence: Synthetic oligonucleotide
gacggagctggggcggcctgat

SEQ ID NO: 390715 - DNA, 23 bp, Artificial Sequence
  Description of Artificial Sequence: Synthetic oligonucleotide
acggagctggggcggcctgatga

SEQ ID NO: 390716 - DNA, 22 bp, Artificial Sequence
  Description of Artificial Sequence: Synthetic oligonucleotide
cggagctggggcggcctgatga

SEQ ID NO: 390717 - DNA, 22 bp, Artificial Sequence
  Description of Artificial Sequence: Synthetic oligonucleotide
ggagctggggcggcctgatgag

SEQ ID NO: 390718 - DNA, 23 bp, Artificial Sequence
  Description of Artificial Sequence: Synthetic oligonucleotide
gagctggggcggcctgatgagga

SEQ ID NO: 390719 - DNA, 25 bp, Artificial Sequence
  Description of Artificial Sequence: Synthetic oligonucleotide
agctggggcggcctgatgaggagta

SEQ ID NO: 390720 - DNA, 24 bp, Artificial Sequence
  Description of Artificial Sequence: Synthetic oligonucleotide
gctggggcggcctgatgaggagta

SEQ ID NO: 390721 - DNA, 25 bp, Artificial Sequence
  Description of Artificial Sequence: Synthetic oligonucleotide
ctggggcggcctgatgaggagtact

SEQ ID NO: 390722 - DNA, 25 bp, Artificial Sequence
  Description of Artificial Sequence: Synthetic oligonucleotide
tggggcggcctgatgaggagtactg

SEQ ID NO: 390723 - DNA, 24 bp, Artificial Sequence
  Description of Artificial Sequence: Synthetic oligonucleotide
ggggcggcctgatgaggagtactg

SEQ ID NO: 390724 - DNA, 26 bp, Artificial Sequence
  Description of Artificial Sequence: Synthetic oligonucleotide
gggcggcctgatgaggagtactggaa

SEQ ID NO: 390725 - DNA, 27 bp, Artificial Sequence
  Description of Artificial Sequence: Synthetic oligonucleotide
ggcggcctgatgaggagtactggaaca

SEQ ID NO: 390726 - DNA, 27 bp, Artificial Sequence
  Description of Artificial Sequence: Synthetic oligonucleotide
gcggcctgatgaggagtactggaacag

SEQ ID NO: 390727 - DNA, 27 bp, Artificial Sequence
  Description of Artificial Sequence: Synthetic oligonucleotide
cggcctgatgaggagtactggaacagc

SEQ ID NO: 390728 - DNA, 27 bp, Artificial Sequence
  Description of Artificial Sequence: Synthetic oligonucleotide
ggcctgatgaggagtactggaacagcc

SEQ ID NO: 390729 - DNA, 28 bp, Artificial Sequence
  Description of Artificial Sequence: Synthetic oligonucleotide
gcctgatgaggagtactggaacagccag

SEQ ID NO: 390730 - DNA, 30 bp, Artificial Sequence; identical to SEQ ID NO: 53297
  Description of Artificial Sequence: Synthetic oligonucleotide

SEQ ID NO: 390731 - DNA, 30 bp, Artificial Sequence; identical to SEQ ID NO: 53298
  Description of Artificial Sequence: Synthetic oligonucleotide

SEQ ID NO: 390732 - DNA, 31 bp, Artificial Sequence; identical to SEQ ID NO: 53299
  Description of Artificial Sequence: Synthetic oligonucleotide

SEQ ID NO: 390733 - DNA, 30 bp, Artificial Sequence; identical to SEQ ID NO: 53300
  Description of Artificial Sequence: Synthetic oligonucleotide

SEQ ID NO: 390734 - DNA, 32 bp, Artificial Sequence; identical to SEQ ID NO: 53301
  Description of Artificial Sequence: Synthetic oligonucleotide

SEQ ID NO: 390735 - DNA, 31 bp, Artificial Sequence; identical to SEQ ID NO: 53302
  Description of Artificial Sequence: Synthetic oligonucleotide

SEQ ID NO: 390736 - DNA, 30 bp, Artificial Sequence; identical to SEQ ID NO: 53303
  Description of Artificial Sequence: Synthetic oligonucleotide

SEQ ID NO: 390737 - DNA, 30 bp, Artificial Sequence; identical to SEQ ID NO: 53304
  Description of Artificial Sequence: Synthetic oligonucleotide

SEQ ID NO: 390738 - DNA, 28 bp, Artificial Sequence
  Description of Artificial Sequence: Synthetic oligonucleotide
aacagccagaaggacatcctggaggagg

SEQ ID NO: 390739 - DNA, 27 bp, Artificial Sequence
  Description of Artificial Sequence: Synthetic oligonucleotide
acagccagaaggacatcctggaggagg

SEQ ID NO: 390740 - DNA, 27 bp, Artificial Sequence
  Description of Artificial Sequence: Synthetic oligonucleotide
cagccagaaggacatcctggaggagga

SEQ ID NO: 390741 - DNA, 27 bp, Artificial Sequence
  Description of Artificial Sequence: Synthetic oligonucleotide
agccagaaggacatcctggaggaggag

SEQ ID NO: 390742 - DNA, 26 bp, Artificial Sequence
  Description of Artificial Sequence: Synthetic oligonucleotide
gccagaaggacatcctggaggaggag

SEQ ID NO: 390743 - DNA, 26 bp, Artificial Sequence
  Description of Artificial Sequence: Synthetic oligonucleotide
ccagaaggacatcctggaggaggagc

SEQ ID NO: 390744 - DNA, 26 bp, Artificial Sequence
  Description of Artificial Sequence: Synthetic oligonucleotide
cagaaggacatcctggaggaggagcg

SEQ ID NO: 390745 - DNA, 26 bp, Artificial Sequence
  Description of Artificial Sequence: Synthetic oligonucleotide
agaaggacatcctggaggaggagcgg

SEQ ID NO: 390746 - DNA, 25 bp, Artificial Sequence
  Description of Artificial Sequence: Synthetic oligonucleotide
gaaggacatcctggaggaggagcgg

SEQ ID NO: 390747 - DNA, 25 bp, Artificial Sequence
  Description of Artificial Sequence: Synthetic oligonucleotide
aaggacatcctggaggaggagcggg

SEQ ID NO: 390748 - DNA, 24 bp, Artificial Sequence
  Description of Artificial Sequence: Synthetic oligonucleotide
aggacatcctggaggaggagcggg

SEQ ID NO: 390749 - DNA, 23 bp, Artificial Sequence
  Description of Artificial Sequence: Synthetic oligonucleotide
ggacatcctggaggaggagcggg

SEQ ID NO: 390750 - DNA, 24 bp, Artificial Sequence
  Description of Artificial Sequence: Synthetic oligonucleotide
gacatcctggaggaggagcgggca

SEQ ID NO: 390751 - DNA, 25 bp, Artificial Sequence
  Description of Artificial Sequence: Synthetic oligonucleotide
acatcctggaggaggagcgggcagt

SEQ ID NO: 390752 - DNA, 24 bp, Artificial Sequence
  Description of Artificial Sequence: Synthetic oligonucleotide
catcctggaggaggagcgggcagt

SEQ ID NO: 390753 - DNA, 24 bp, Artificial Sequence
  Description of Artificial Sequence: Synthetic oligonucleotide
atcctggaggaggagcgggcagtg

SEQ ID NO: 390754 - DNA, 23 bp, Artificial Sequence
  Description of Artificial Sequence: Synthetic oligonucleotide
tcctggaggaggagcgggcagtg

SEQ ID NO: 390755 - DNA, 22 bp, Artificial Sequence
  Description of Artificial Sequence: Synthetic oligonucleotide
cctggaggaggagcgggcagtg

SEQ ID NO: 390756 - DNA, 22 bp, Artificial Sequence
  Description of Artificial Sequence: Synthetic oligonucleotide
ctggaggaggagcgggcagtgc

SEQ ID NO: 390757 - DNA, 22 bp, Artificial Sequence
  Description of Artificial Sequence: Synthetic oligonucleotide
tggaggaggagcgggcagtgcc

SEQ ID NO: 390758 - DNA, 21 bp, Artificial Sequence
  Description of Artificial Sequence: Synthetic oligonucleotide
ggaggaggagcgggcagtgcc

SEQ ID NO: 390759 - DNA, 21 bp, Artificial Sequence
  Description of Artificial Sequence: Synthetic oligonucleotide
gaggaggagcgggcagtgccg

SEQ ID NO: 390760 - DNA, 22 bp, Artificial Sequence
  Description of Artificial Sequence: Synthetic oligonucleotide
aggaggagcgggcagtgccgga

SEQ ID NO: 390761 - DNA, 21 bp, Artificial Sequence
  Description of Artificial Sequence: Synthetic oligonucleotide
ggaggagcgggcagtgccgga

SEQ ID NO: 390762 - DNA, 22 bp, Artificial Sequence
  Description of Artificial Sequence: Synthetic oligonucleotide
gaggagcgggcagtgccggaca

SEQ ID NO: 390763 - DNA, 22 bp, Artificial Sequence
  Description of Artificial Sequence: Synthetic oligonucleotide
aggagcgggcagtgccggacag

SEQ ID NO: 390764 - DNA, 21 bp, Artificial Sequence
  Description of Artificial Sequence: Synthetic oligonucleotide
ggagcgggcagtgccggacag

SEQ ID NO: 390765 - DNA, 23 bp, Artificial Sequence
  Description of Artificial Sequence: Synthetic oligonucleotide
gagcgggcagtgccggacaggat

SEQ ID NO: 390766 - DNA, 24 bp, Artificial Sequence
  Description of Artificial Sequence: Synthetic oligonucleotide
agcgggcagtgccggacaggatgt

SEQ ID NO: 390767 - DNA, 23 bp, Artificial Sequence
  Description of Artificial Sequence: Synthetic oligonucleotide
gcgggcagtgccggacaggatgt

SEQ ID NO: 390768 - DNA, 23 bp, Artificial Sequence
  Description of Artificial Sequence: Synthetic oligonucleotide
cgggcagtgccggacaggatgtg

SEQ ID NO: 390769 - DNA, 24 bp, Artificial Sequence
  Description of Artificial Sequence: Synthetic oligonucleotide
gggcagtgccggacaggatgtgca

SEQ ID NO: 390770 - DNA, 25 bp, Artificial Sequence
  Description of Artificial Sequence: Synthetic oligonucleotide
ggcagtgccggacaggatgtgcaga

SEQ ID NO: 390771 - DNA, 26 bp, Artificial Sequence
  Description of Artificial Sequence: Synthetic oligonucleotide
gcagtgccggacaggatgtgcagaca

SEQ ID NO: 390772 - DNA, 27 bp, Artificial Sequence
  Description of Artificial Sequence: Synthetic oligonucleotide
cagtgccggacaggatgtgcagacaca

SEQ ID NO: 390773 - DNA, 28 bp, Artificial Sequence
  Description of Artificial Sequence: Synthetic oligonucleotide
agtgccggacaggatgtgcagacacaac

SEQ ID NO: 390774 - DNA, 27 bp, Artificial Sequence
  Description of Artificial Sequence: Synthetic oligonucleotide
gtgccggacaggatgtgcagacacaac

SEQ ID NO: 390775 - DNA, 29 bp, Artificial Sequence
  Description of Artificial Sequence: Synthetic oligonucleotide
tgccggacaggatgtgcagacacaactac

SEQ ID NO: 390776 - DNA, 28 bp, Artificial Sequence
  Description of Artificial Sequence: Synthetic oligonucleotide
gccggacaggatgtgcagacacaactac

SEQ ID NO: 390777 - DNA, 28 bp, Artificial Sequence
  Description of Artificial Sequence: Synthetic oligonucleotide
ccggacaggatgtgcagacacaactacg

SEQ ID NO: 390778 - DNA, 29 bp, Artificial Sequence
  Description of Artificial Sequence: Synthetic oligonucleotide
cggacaggatgtgcagacacaactacgag

SEQ ID NO: 390779 - DNA, 29 bp, Artificial Sequence
  Description of Artificial Sequence: Synthetic oligonucleotide
ggacaggatgtgcagacacaactacgagc

SEQ ID NO: 390780 - DNA, 30 bp, Artificial Sequence; identical to SEQ ID NO: 53347
  Description of Artificial Sequence: Synthetic oligonucleotide

SEQ ID NO: 390781 - DNA, 30 bp, Artificial Sequence; identical to SEQ ID NO: 53348
  Description of Artificial Sequence: Synthetic oligonucleotide

SEQ ID NO: 390782 - DNA, 29 bp, Artificial Sequence
  Description of Artificial Sequence: Synthetic oligonucleotide
caggatgtgcagacacaactacgagctgg

SEQ ID NO: 390783 - DNA, 29 bp, Artificial Sequence
  Description of Artificial Sequence: Synthetic oligonucleotide
aggatgtgcagacacaactacgagctggg

SEQ ID NO: 390784 - DNA, 28 bp, Artificial Sequence
  Description of Artificial Sequence: Synthetic oligonucleotide
ggatgtgcagacacaactacgagctggg

SEQ ID NO: 390785 - DNA, 28 bp, Artificial Sequence
  Description of Artificial Sequence: Synthetic oligonucleotide
gatgtgcagacacaactacgagctgggc

SEQ ID NO: 390786 - DNA, 28 bp, Artificial Sequence
  Description of Artificial Sequence: Synthetic oligonucleotide
atgtgcagacacaactacgagctgggcg

SEQ ID NO: 390787 - DNA, 27 bp, Artificial Sequence
  Description of Artificial Sequence: Synthetic oligonucleotide
tgtgcagacacaactacgagctgggcg

SEQ ID NO: 390788 - DNA, 26 bp, Artificial Sequence
  Description of Artificial Sequence: Synthetic oligonucleotide
gtgcagacacaactacgagctgggcg

SEQ ID NO: 390789 - DNA, 26 bp, Artificial Sequence
  Description of Artificial Sequence: Synthetic oligonucleotide
tgcagacacaactacgagctgggcgg

SEQ ID NO: 390790 - DNA, 25 bp, Artificial Sequence
  Description of Artificial Sequence: Synthetic oligonucleotide
gcagacacaactacgagctgggcgg

SEQ ID NO: 390791 - DNA, 25 bp, Artificial Sequence
  Description of Artificial Sequence: Synthetic oligonucleotide
cagacacaactacgagctgggcggg

SEQ ID NO: 390792 - DNA, 25 bp, Artificial Sequence
  Description of Artificial Sequence: Synthetic oligonucleotide
agacacaactacgagctgggcgggc

SEQ ID NO: 390793 - DNA, 24 bp, Artificial Sequence
  Description of Artificial Sequence: Synthetic oligonucleotide
gacacaactacgagctgggcgggc

SEQ ID NO: 390794 - DNA, 24 bp, Artificial Sequence
  Description of Artificial Sequence: Synthetic oligonucleotide
acacaactacgagctgggcgggcc

SEQ ID NO: 390795 - DNA, 23 bp, Artificial Sequence
  Description of Artificial Sequence: Synthetic oligonucleotide
cacaactacgagctgggcgggcc

SEQ ID NO: 390796 - DNA, 25 bp, Artificial Sequence
  Description of Artificial Sequence: Synthetic oligonucleotide
acaactacgagctgggcgggcccat

SEQ ID NO: 390797 - DNA, 24 bp, Artificial Sequence
  Description of Artificial Sequence: Synthetic oligonucleotide
caactacgagctgggcgggcccat

SEQ ID NO: 390798 - DNA, 25 bp, Artificial Sequence
  Description of Artificial Sequence: Synthetic oligonucleotide
aactacgagctgggcgggcccatga

SEQ ID NO: 390799 - DNA, 24 bp, Artificial Sequence
  Description of Artificial Sequence: Synthetic oligonucleotide
actacgagctgggcgggcccatga

SEQ ID NO: 390800 - DNA, 23 bp, Artificial Sequence
  Description of Artificial Sequence: Synthetic oligonucleotide
ctacgagctgggcgggcccatga

SEQ ID NO: 390801 - DNA, 23 bp, Artificial Sequence
  Description of Artificial Sequence: Synthetic oligonucleotide
tacgagctgggcgggcccatgac

SEQ ID NO: 390802 - DNA, 22 bp, Artificial Sequence
  Description of Artificial Sequence: Synthetic oligonucleotide
acgagctgggcgggcccatgac

SEQ ID NO: 390803 - DNA, 21 bp, Artificial Sequence
  Description of Artificial Sequence: Synthetic oligonucleotide
cgagctgggcgggcccatgac

SEQ ID NO: 390804 - DNA, 21 bp, Artificial Sequence
  Description of Artificial Sequence: Synthetic oligonucleotide
gagctgggcgggcccatgacc

SEQ ID NO: 390805 - DNA, 22 bp, Artificial Sequence
  Description of Artificial Sequence: Synthetic oligonucleotide
agctgggcgggcccatgaccct

SEQ ID NO: 390806 - DNA, 21 bp, Artificial Sequence
  Description of Artificial Sequence: Synthetic oligonucleotide
gctgggcgggcccatgaccct

SEQ ID NO: 390807 - DNA, 21 bp, Artificial Sequence
  Description of Artificial Sequence: Synthetic oligonucleotide
ctgggcgggcccatgaccctg

SEQ ID NO: 390808 - DNA, 22 bp, Artificial Sequence
  Description of Artificial Sequence: Synthetic oligonucleotide
tgggcgggcccatgaccctgca

SEQ ID NO: 390809 - DNA, 21 bp, Artificial Sequence
  Description of Artificial Sequence: Synthetic oligonucleotide
gggcgggcccatgaccctgca

SEQ ID NO: 390810 - DNA, 21 bp, Artificial Sequence
  Description of Artificial Sequence: Synthetic oligonucleotide
ggcgggcccatgaccctgcag

SEQ ID NO: 390811 - DNA, 21 bp, Artificial Sequence
  Description of Artificial Sequence: Synthetic oligonucleotide
gcgggcccatgaccctgcagc

SEQ ID NO: 390812 - DNA, 21 bp, Artificial Sequence
  Description of Artificial Sequence: Synthetic oligonucleotide
cgggcccatgaccctgcagcg

SEQ ID NO: 390813 - DNA, 21 bp, Artificial Sequence
  Description of Artificial Sequence: Synthetic oligonucleotide
gggcccatgaccctgcagcgc

SEQ ID NO: 390814 - DNA, 21 bp, Artificial Sequence
  Description of Artificial Sequence: Synthetic oligonucleotide
ggcccatgaccctgcagcgcc

SEQ ID NO: 390815 - DNA, 22 bp, Artificial Sequence
  Description of Artificial Sequence: Synthetic oligonucleotide
gcccatgaccctgcagcgccga

SEQ ID NO: 390816 - DNA, 23 bp, Artificial Sequence
  Description of Artificial Sequence: Synthetic oligonucleotide
cccatgaccctgcagcgccgagt

SEQ ID NO: 390817 - DNA, 23 bp, Artificial Sequence
  Description of Artificial Sequence: Synthetic oligonucleotide
ccatgaccctgcagcgccgagtc

SEQ ID NO: 390818 - DNA, 24 bp, Artificial Sequence
  Description of Artificial Sequence: Synthetic oligonucleotide
catgaccctgcagcgccgagtcca

SEQ ID NO: 390819 - DNA, 24 bp, Artificial Sequence
  Description of Artificial Sequence: Synthetic oligonucleotide
atgaccctgcagcgccgagtccag

SEQ ID NO: 390820 - DNA, 23 bp, Artificial Sequence
  Description of Artificial Sequence: Synthetic oligonucleotide
cctgcagcgccgagtccagccta

SEQ ID NO: 390821 - DNA, 23 bp, Artificial Sequence
  Description of Artificial Sequence: Synthetic oligonucleotide
ctgcagcgccgagtccagcctag

SEQ ID NO: 390822 - DNA, 23 bp, Artificial Sequence
  Description of Artificial Sequence: Synthetic oligonucleotide
tgcagcgccgagtccagcctagg

SEQ ID NO: 390823 - DNA, 22 bp, Artificial Sequence
  Description of Artificial Sequence: Synthetic oligonucleotide
gcagcgccgagtccagcctagg

SEQ ID NO: 390824 - DNA, 23 bp, Artificial Sequence
  Description of Artificial Sequence: Synthetic oligonucleotide
cagcgccgagtccagcctagggt

SEQ ID NO: 390825 - DNA, 26 bp, Artificial Sequence
  Description of Artificial Sequence: Synthetic oligonucleotide
agcgccgagtccagcctagggtgaat

SEQ ID NO: 390826 - DNA, 25 bp, Artificial Sequence
  Description of Artificial Sequence: Synthetic oligonucleotide
gcgccgagtccagcctagggtgaat

SEQ ID NO: 390827 - DNA, 27 bp, Artificial Sequence
  Description of Artificial Sequence: Synthetic oligonucleotide
cgccgagtccagcctagggtgaatgtt

SEQ ID NO: 390828 - DNA, 28 bp, Artificial Sequence
  Description of Artificial Sequence: Synthetic oligonucleotide
gccgagtccagcctagggtgaatgtttc

SEQ ID NO: 390829 - DNA, 28 bp, Artificial Sequence
  Description of Artificial Sequence: Synthetic oligonucleotide
ccgagtccagcctagggtgaatgtttcc

SEQ ID NO: 390830 - DNA, 28 bp, Artificial Sequence
  Description of Artificial Sequence: Synthetic oligonucleotide
cgagtccagcctagggtgaatgtttccc

SEQ ID NO: 390831 - DNA, 28 bp, Artificial Sequence
  Description of Artificial Sequence: Synthetic oligonucleotide
gagtccagcctagggtgaatgtttcccc

SEQ ID NO: 390832 - DNA, 28 bp, Artificial Sequence
  Description of Artificial Sequence: Synthetic oligonucleotide
agtccagcctagggtgaatgtttccccc

SEQ ID NO: 390833 - DNA, 27 bp, Artificial Sequence
  Description of Artificial Sequence: Synthetic oligonucleotide
gtccagcctagggtgaatgtttccccc

SEQ ID NO: 390834 - DNA, 28 bp, Artificial Sequence
  Description of Artificial Sequence: Synthetic oligonucleotide
tccagcctagggtgaatgtttccccctc

SEQ ID NO: 390835 - DNA, 27 bp, Artificial Sequence
  Description of Artificial Sequence: Synthetic oligonucleotide
ccagcctagggtgaatgtttccccctc

SEQ ID NO: 390836 - DNA, 27 bp, Artificial Sequence
  Description of Artificial Sequence: Synthetic oligonucleotide
cagcctagggtgaatgtttccccctcc

SEQ ID NO: 390837 - DNA, 29 bp, Artificial Sequence
  Description of Artificial Sequence: Synthetic oligonucleotide
agcctagggtgaatgtttccccctccaag

SEQ ID NO: 390838 - DNA, 28 bp, Artificial Sequence
  Description of Artificial Sequence: Synthetic oligonucleotide
gcctagggtgaatgtttccccctccaag

SEQ ID NO: 390839 - DNA, 30 bp, Artificial Sequence; identical to SEQ ID NO: 53406
  Description of Artificial Sequence: Synthetic oligonucleotide

SEQ ID NO: 390840 - DNA, 30 bp, Artificial Sequence; identical to SEQ ID NO: 53407
  Description of Artificial Sequence: Synthetic oligonucleotide

SEQ ID NO: 390841 - DNA, 30 bp, Artificial Sequence; identical to SEQ ID NO: 53408
  Description of Artificial Sequence: Synthetic oligonucleotide

SEQ ID NO: 390842 - DNA, 29 bp, Artificial Sequence
  Description of Artificial Sequence: Synthetic oligonucleotide
agggtgaatgtttccccctccaagaaggg

SEQ ID NO: 390843 - DNA, 28 bp, Artificial Sequence
  Description of Artificial Sequence: Synthetic oligonucleotide
gggtgaatgtttccccctccaagaaggg

SEQ ID NO: 390844 - DNA, 28 bp, Artificial Sequence
  Description of Artificial Sequence: Synthetic oligonucleotide
ggtgaatgtttccccctccaagaagggg

SEQ ID NO: 390845 - DNA, 28 bp, Artificial Sequence
  Description of Artificial Sequence: Synthetic oligonucleotide
gtgaatgtttccccctccaagaaggggc

SEQ ID NO: 390846 - DNA, 28 bp, Artificial Sequence
  Description of Artificial Sequence: Synthetic oligonucleotide
tgaatgtttccccctccaagaaggggcc

SEQ ID NO: 390847 - DNA, 27 bp, Artificial Sequence
  Description of Artificial Sequence: Synthetic oligonucleotide
gaatgtttccccctccaagaaggggcc

SEQ ID NO: 390848 - DNA, 27 bp, Artificial Sequence
  Description of Artificial Sequence: Synthetic oligonucleotide
aatgtttccccctccaagaaggggccc

SEQ ID NO: 390849 - DNA, 27 bp, Artificial Sequence
  Description of Artificial Sequence: Synthetic oligonucleotide
atgtttccccctccaagaaggggccct

SEQ ID NO: 390850 - DNA, 27 bp, Artificial Sequence
  Description of Artificial Sequence: Synthetic oligonucleotide
tgtttccccctccaagaaggggccctt

SEQ ID NO: 390851 - DNA, 26 bp, Artificial Sequence
  Description of Artificial Sequence: Synthetic oligonucleotide
gtttccccctccaagaaggggccctt

SEQ ID NO: 390852 - DNA, 26 bp, Artificial Sequence
  Description of Artificial Sequence: Synthetic oligonucleotide
tttccccctccaagaaggggcccttg

SEQ ID NO: 390853 - DNA, 25 bp, Artificial Sequence
  Description of Artificial Sequence: Synthetic oligonucleotide
ttccccctccaagaaggggcccttg

SEQ ID NO: 390854 - DNA, 24 bp, Artificial Sequence
  Description of Artificial Sequence: Synthetic oligonucleotide
tccccctccaagaaggggcccttg

SEQ ID NO: 390855 - DNA, 23 bp, Artificial Sequence
  Description of Artificial Sequence: Synthetic oligonucleotide
ccccctccaagaaggggcccttg

SEQ ID NO: 390856 - DNA, 24 bp, Artificial Sequence
  Description of Artificial Sequence: Synthetic oligonucleotide
cccctccaagaaggggcccttgca

SEQ ID NO: 390857 - DNA, 24 bp, Artificial Sequence
  Description of Artificial Sequence: Synthetic oligonucleotide
ccctccaagaaggggcccttgcag

SEQ ID NO: 390858 - DNA, 25 bp, Artificial Sequence
  Description of Artificial Sequence: Synthetic oligonucleotide
cctccaagaaggggcccttgcagca

SEQ ID NO: 390859 - DNA, 25 bp, Artificial Sequence
  Description of Artificial Sequence: Synthetic oligonucleotide
ctccaagaaggggcccttgcagcac

SEQ ID NO: 390860 - DNA, 26 bp, Artificial Sequence
  Description of Artificial Sequence: Synthetic oligonucleotide
tccaagaaggggcccttgcagcacca

SEQ ID NO: 390861 - DNA, 25 bp, Artificial Sequence
  Description of Artificial Sequence: Synthetic oligonucleotide
ccaagaaggggcccttgcagcacca

SEQ ID NO: 390862 - DNA, 27 bp, Artificial Sequence
  Description of Artificial Sequence: Synthetic oligonucleotide
caagaaggggcccttgcagcaccacaa

SEQ ID NO: 390863 - DNA, 27 bp, Artificial Sequence
  Description of Artificial Sequence: Synthetic oligonucleotide
aagaaggggcccttgcagcaccacaac

SEQ ID NO: 390864 - DNA, 26 bp, Artificial Sequence
  Description of Artificial Sequence: Synthetic oligonucleotide
agaaggggcccttgcagcaccacaac

SEQ ID NO: 390865 - DNA, 25 bp, Artificial Sequence
  Description of Artificial Sequence: Synthetic oligonucleotide
gaaggggcccttgcagcaccacaac

SEQ ID NO: 390866 - DNA, 26 bp, Artificial Sequence
  Description of Artificial Sequence: Synthetic oligonucleotide
aaggggcccttgcagcaccacaacct

SEQ ID NO: 390867 - DNA, 25 bp, Artificial Sequence
  Description of Artificial Sequence: Synthetic oligonucleotide
aggggcccttgcagcaccacaacct

SEQ ID NO: 390868 - DNA, 24 bp, Artificial Sequence
  Description of Artificial Sequence: Synthetic oligonucleotide
ggggcccttgcagcaccacaacct

SEQ ID NO: 390869 - DNA, 24 bp, Artificial Sequence
  Description of Artificial Sequence: Synthetic oligonucleotide
gggcccttgcagcaccacaacctg

SEQ ID NO: 390870 - DNA, 26 bp, Artificial Sequence
  Description of Artificial Sequence: Synthetic oligonucleotide
ggcccttgcagcaccacaacctgctt

SEQ ID NO: 390871 - DNA, 27 bp, Artificial Sequence
  Description of Artificial Sequence: Synthetic oligonucleotide
gcccttgcagcaccacaacctgcttgt

SEQ ID NO: 390872 - DNA, 27 bp, Artificial Sequence
  Description of Artificial Sequence: Synthetic oligonucleotide
cccttgcagcaccacaacctgcttgtc

SEQ ID NO: 390873 - DNA, 28 bp, Artificial Sequence
  Description of Artificial Sequence: Synthetic oligonucleotide
ccttgcagcaccacaacctgcttgtctg

SEQ ID NO: 390874 - DNA, 28 bp, Artificial Sequence
  Description of Artificial Sequence: Synthetic oligonucleotide
cttgcagcaccacaacctgcttgtctgc

SEQ ID NO: 390875 - DNA, 28 bp, Artificial Sequence
  Description of Artificial Sequence: Synthetic oligonucleotide
ttgcagcaccacaacctgcttgtctgcc

SEQ ID NO: 390876 - DNA, 27 bp, Artificial Sequence
  Description of Artificial Sequence: Synthetic oligonucleotide
cacaacctgcttgtctgccacgtgacg

SEQ ID NO: 390877 - DNA, 27 bp, Artificial Sequence
  Description of Artificial Sequence: Synthetic oligonucleotide
acaacctgcttgtctgccacgtgacgg

SEQ ID NO: 390878 - DNA, 27 bp, Artificial Sequence
  Description of Artificial Sequence: Synthetic oligonucleotide
caacctgcttgtctgccacgtgacgga

SEQ ID NO: 390879 - DNA, 30 bp, Artificial Sequence; identical to SEQ ID NO: 53446
  Description of Artificial Sequence: Synthetic oligonucleotide

SEQ ID NO: 390880 - DNA, 29 bp, Artificial Sequence
  Description of Artificial Sequence: Synthetic oligonucleotide
acctgcttgtctgccacgtgacggatttc

SEQ ID NO: 390881 - DNA, 28 bp, Artificial Sequence
  Description of Artificial Sequence: Synthetic oligonucleotide
cctgcttgtctgccacgtgacggatttc

SEQ ID NO: 390882 - DNA, 30 bp, Artificial Sequence; identical to SEQ ID NO: 53449
  Description of Artificial Sequence: Synthetic oligonucleotide

SEQ ID NO: 390883 - DNA, 30 bp, Artificial Sequence; identical to SEQ ID NO: 53450
  Description of Artificial Sequence: Synthetic oligonucleotide

SEQ ID NO: 390884 - DNA, 29 bp, Artificial Sequence
  Description of Artificial Sequence: Synthetic oligonucleotide
gcttgtctgccacgtgacggatttctacc

SEQ ID NO: 390885 - DNA, 29 bp, Artificial Sequence
  Description of Artificial Sequence: Synthetic oligonucleotide
cttgtctgccacgtgacggatttctaccc

SEQ ID NO: 390886 - DNA, 30 bp, Artificial Sequence; identical to SEQ ID NO: 53453
  Description of Artificial Sequence: Synthetic oligonucleotide

SEQ ID NO: 390887 - DNA, 29 bp, Artificial Sequence
  Description of Artificial Sequence: Synthetic oligonucleotide
tgtctgccacgtgacggatttctacccag

SEQ ID NO: 390888 - DNA, 28 bp, Artificial Sequence
  Description of Artificial Sequence: Synthetic oligonucleotide
gtctgccacgtgacggatttctacccag

SEQ ID NO: 390889 - DNA, 28 bp, Artificial Sequence
  Description of Artificial Sequence: Synthetic oligonucleotide
tctgccacgtgacggatttctacccagg

SEQ ID NO: 390890 - DNA, 27 bp, Artificial Sequence
  Description of Artificial Sequence: Synthetic oligonucleotide
ctgccacgtgacggatttctacccagg

SEQ ID NO: 390891 - DNA, 27 bp, Artificial Sequence
  Description of Artificial Sequence: Synthetic oligonucleotide
tgccacgtgacggatttctacccaggc

SEQ ID NO: 390892 - DNA, 27 bp, Artificial Sequence
  Description of Artificial Sequence: Synthetic oligonucleotide
gccacgtgacggatttctacccaggca

SEQ ID NO: 390893 - DNA, 27 bp, Artificial Sequence
  Description of Artificial Sequence: Synthetic oligonucleotide
ccacgtgacggatttctacccaggcag

SEQ ID NO: 390894 - DNA, 27 bp, Artificial Sequence
  Description of Artificial Sequence: Synthetic oligonucleotide
cacgtgacggatttctacccaggcagc

SEQ ID NO: 390895 - DNA, 30 bp, Artificial Sequence; identical to SEQ ID NO: 53462
  Description of Artificial Sequence: Synthetic oligonucleotide

SEQ ID NO: 390896 - DNA, 29 bp, Artificial Sequence
  Description of Artificial Sequence: Synthetic oligonucleotide
cgtgacggatttctacccaggcagcattc

SEQ ID NO: 390897 - DNA, 31 bp, Artificial Sequence; identical to SEQ ID NO: 53464
  Description of Artificial Sequence: Synthetic oligonucleotide

SEQ ID NO: 390898 - DNA, 32 bp, Artificial Sequence; identical to SEQ ID NO: 53465
  Description of Artificial Sequence: Synthetic oligonucleotide

SEQ ID NO: 390899 - DNA, 31 bp, Artificial Sequence; identical to SEQ ID NO: 53466
  Description of Artificial Sequence: Synthetic oligonucleotide

SEQ ID NO: 390900 - DNA, 31 bp, Artificial Sequence; identical to SEQ ID NO: 53467
  Description of Artificial Sequence: Synthetic oligonucleotide

SEQ ID NO: 390901 - DNA, 30 bp, Artificial Sequence; identical to SEQ ID NO: 53468
  Description of Artificial Sequence: Synthetic oligonucleotide

SEQ ID NO: 390902 - DNA, 30 bp, Artificial Sequence; identical to SEQ ID NO: 53469
  Description of Artificial Sequence: Synthetic oligonucleotide

SEQ ID NO: 390903 - DNA, 27 bp, Artificial Sequence
  Description of Artificial Sequence: Synthetic oligonucleotide
ctggaaatgaccccccagcagggagat

SEQ ID NO: 390904 - DNA, 27 bp, Artificial Sequence
  Description of Artificial Sequence: Synthetic oligonucleotide
tggaaatgaccccccagcagggagatg

SEQ ID NO: 390905 - DNA, 27 bp, Artificial Sequence
  Description of Artificial Sequence: Synthetic oligonucleotide
ggaaatgaccccccagcagggagatgt

SEQ ID NO: 390906 - DNA, 27 bp, Artificial Sequence
  Description of Artificial Sequence: Synthetic oligonucleotide
gaaatgaccccccagcagggagatgtc

SEQ ID NO: 390907 - DNA, 29 bp, Artificial Sequence
  Description of Artificial Sequence: Synthetic oligonucleotide
aaatgaccccccagcagggagatgtctac

SEQ ID NO: 390908 - DNA, 28 bp, Artificial Sequence
  Description of Artificial Sequence: Synthetic oligonucleotide
aatgaccccccagcagggagatgtctac

SEQ ID NO: 390909 - DNA, 27 bp, Artificial Sequence
  Description of Artificial Sequence: Synthetic oligonucleotide
atgaccccccagcagggagatgtctac

SEQ ID NO: 390910 - DNA, 27 bp, Artificial Sequence
  Description of Artificial Sequence: Synthetic oligonucleotide
tgaccccccagcagggagatgtctaca

SEQ ID NO: 390911 - DNA, 26 bp, Artificial Sequence
  Description of Artificial Sequence: Synthetic oligonucleotide
gaccccccagcagggagatgtctaca

SEQ ID NO: 390912 - DNA, 26 bp, Artificial Sequence
  Description of Artificial Sequence: Synthetic oligonucleotide
accccccagcagggagatgtctacac

SEQ ID NO: 390913 - DNA, 25 bp, Artificial Sequence
  Description of Artificial Sequence: Synthetic oligonucleotide
ccccccagcagggagatgtctacac

SEQ ID NO: 390914 - DNA, 26 bp, Artificial Sequence
  Description of Artificial Sequence: Synthetic oligonucleotide
cccccagcagggagatgtctacacct

SEQ ID NO: 390915 - DNA, 26 bp, Artificial Sequence
  Description of Artificial Sequence: Synthetic oligonucleotide
ccccagcagggagatgtctacacctg

SEQ ID NO: 390916 - DNA, 26 bp, Artificial Sequence
  Description of Artificial Sequence: Synthetic oligonucleotide
cccagcagggagatgtctacacctgc

SEQ ID NO: 390917 - DNA, 27 bp, Artificial Sequence
  Description of Artificial Sequence: Synthetic oligonucleotide
ccagcagggagatgtctacacctgcca

SEQ ID NO: 390918 - DNA, 28 bp, Artificial Sequence
  Description of Artificial Sequence: Synthetic oligonucleotide
cagcagggagatgtctacacctgccaag

SEQ ID NO: 390919 - DNA, 29 bp, Artificial Sequence
  Description of Artificial Sequence: Synthetic oligonucleotide
agcagggagatgtctacacctgccaagtg

SEQ ID NO: 390920 - DNA, 28 bp, Artificial Sequence
  Description of Artificial Sequence: Synthetic oligonucleotide
gcagggagatgtctacacctgccaagtg

SEQ ID NO: 390921 - DNA, 28 bp, Artificial Sequence
  Description of Artificial Sequence: Synthetic oligonucleotide
cagggagatgtctacacctgccaagtgg

SEQ ID NO: 390922 - DNA, 29 bp, Artificial Sequence
  Description of Artificial Sequence: Synthetic oligonucleotide
agggagatgtctacacctgccaagtggag

SEQ ID NO: 390923 - DNA, 28 bp, Artificial Sequence
  Description of Artificial Sequence: Synthetic oligonucleotide
gggagatgtctacacctgccaagtggag

SEQ ID NO: 390924 - DNA, 28 bp, Artificial Sequence
  Description of Artificial Sequence: Synthetic oligonucleotide
ggagatgtctacacctgccaagtggagc

SEQ ID NO: 390925 - DNA, 29 bp, Artificial Sequence
  Description of Artificial Sequence: Synthetic oligonucleotide
gagatgtctacacctgccaagtggagcac

SEQ ID NO: 390926 - DNA, 30 bp, Artificial Sequence; identical to SEQ ID NO: 53493
  Description of Artificial Sequence: Synthetic oligonucleotide

SEQ ID NO: 390927 - DNA, 29 bp, Artificial Sequence
  Description of Artificial Sequence: Synthetic oligonucleotide
gatgtctacacctgccaagtggagcacac

SEQ ID NO: 390928 - DNA, 29 bp, Artificial Sequence
  Description of Artificial Sequence: Synthetic oligonucleotide
atgtctacacctgccaagtggagcacacc

SEQ ID NO: 390929 - DNA, 28 bp, Artificial Sequence
  Description of Artificial Sequence: Synthetic oligonucleotide
tgtctacacctgccaagtggagcacacc

SEQ ID NO: 390930 - DNA, 27 bp, Artificial Sequence
  Description of Artificial Sequence: Synthetic oligonucleotide
gtctacacctgccaagtggagcacacc

SEQ ID NO: 390931 - DNA, 28 bp, Artificial Sequence
  Description of Artificial Sequence: Synthetic oligonucleotide
tctacacctgccaagtggagcacaccag

SEQ ID NO: 390932 - DNA, 27 bp, Artificial Sequence
  Description of Artificial Sequence: Synthetic oligonucleotide
ctacacctgccaagtggagcacaccag

SEQ ID NO: 390933 - DNA, 27 bp, Artificial Sequence
  Description of Artificial Sequence: Synthetic oligonucleotide
tacacctgccaagtggagcacaccagc

SEQ ID NO: 390934 - DNA, 26 bp, Artificial Sequence
  Description of Artificial Sequence: Synthetic oligonucleotide
acacctgccaagtggagcacaccagc

SEQ ID NO: 390935 - DNA, 25 bp, Artificial Sequence
  Description of Artificial Sequence: Synthetic oligonucleotide
cacctgccaagtggagcacaccagc

SEQ ID NO: 390936 - DNA, 26 bp, Artificial Sequence
  Description of Artificial Sequence: Synthetic oligonucleotide
acctgccaagtggagcacaccagcct

SEQ ID NO: 390937 - DNA, 25 bp, Artificial Sequence
  Description of Artificial Sequence: Synthetic oligonucleotide
cctgccaagtggagcacaccagcct

SEQ ID NO: 390938 - DNA, 27 bp, Artificial Sequence
  Description of Artificial Sequence: Synthetic oligonucleotide
tgccaagtggagcacaccagcctggat

SEQ ID NO: 390939 - DNA, 27 bp, Artificial Sequence
  Description of Artificial Sequence: Synthetic oligonucleotide
gccaagtggagcacaccagcctggata

SEQ ID NO: 390940 - DNA, 27 bp, Artificial Sequence
  Description of Artificial Sequence: Synthetic oligonucleotide
ccaagtggagcacaccagcctggatag

SEQ ID NO: 390941 - DNA, 28 bp, Artificial Sequence
  Description of Artificial Sequence: Synthetic oligonucleotide
caagtggagcacaccagcctggatagtc

SEQ ID NO: 390942 - DNA, 28 bp, Artificial Sequence
  Description of Artificial Sequence: Synthetic oligonucleotide
aagtggagcacaccagcctggatagtcc

SEQ ID NO: 390943 - DNA, 27 bp, Artificial Sequence
  Description of Artificial Sequence: Synthetic oligonucleotide
agtggagcacaccagcctggatagtcc

SEQ ID NO: 390944 - DNA, 27 bp, Artificial Sequence
  Description of Artificial Sequence: Synthetic oligonucleotide
gtggagcacaccagcctggatagtcct

SEQ ID NO: 390945 - DNA, 27 bp, Artificial Sequence
  Description of Artificial Sequence: Synthetic oligonucleotide
tggagcacaccagcctggatagtcctg

SEQ ID NO: 390946 - DNA, 27 bp, Artificial Sequence
  Description of Artificial Sequence: Synthetic oligonucleotide
ggagcacaccagcctggatagtcctgt

SEQ ID NO: 390947 - DNA, 27 bp, Artificial Sequence
  Description of Artificial Sequence: Synthetic oligonucleotide
gagcacaccagcctggatagtcctgtc

SEQ ID NO: 390948 - DNA, 28 bp, Artificial Sequence
  Description of Artificial Sequence: Synthetic oligonucleotide
agcacaccagcctggatagtcctgtcac

SEQ ID NO: 390949 - DNA, 27 bp, Artificial Sequence
  Description of Artificial Sequence: Synthetic oligonucleotide
gcacaccagcctggatagtcctgtcac

SEQ ID NO: 390950 - DNA, 27 bp, Artificial Sequence
  Description of Artificial Sequence: Synthetic oligonucleotide
cacaccagcctggatagtcctgtcacc

SEQ ID NO: 390951 - DNA, 27 bp, Artificial Sequence
  Description of Artificial Sequence: Synthetic oligonucleotide
acaccagcctggatagtcctgtcaccg

SEQ ID NO: 390952 - DNA, 27 bp, Artificial Sequence
  Description of Artificial Sequence: Synthetic oligonucleotide
caccagcctggatagtcctgtcaccgt

SEQ ID NO: 390953 - DNA, 27 bp, Artificial Sequence
  Description of Artificial Sequence: Synthetic oligonucleotide
accagcctggatagtcctgtcaccgtg

SEQ ID NO: 390954 - DNA, 26 bp, Artificial Sequence
  Description of Artificial Sequence: Synthetic oligonucleotide
ccagcctggatagtcctgtcaccgtg

SEQ ID NO: 390955 - DNA, 27 bp, Artificial Sequence
  Description of Artificial Sequence: Synthetic oligonucleotide
cagcctggatagtcctgtcaccgtgga

SEQ ID NO: 390956 - DNA, 27 bp, Artificial Sequence
  Description of Artificial Sequence: Synthetic oligonucleotide
agcctggatagtcctgtcaccgtggag

SEQ ID NO: 390957 - DNA, 27 bp, Artificial Sequence
  Description of Artificial Sequence: Synthetic oligonucleotide
gcctggatagtcctgtcaccgtggagt

SEQ ID NO: 390958 - DNA, 27 bp, Artificial Sequence
  Description of Artificial Sequence: Synthetic oligonucleotide
cctggatagtcctgtcaccgtggagtg

SEQ ID NO: 390959 - DNA, 27 bp, Artificial Sequence
  Description of Artificial Sequence: Synthetic oligonucleotide
ctggatagtcctgtcaccgtggagtgg

SEQ ID NO: 390960 - DNA, 29 bp, Artificial Sequence
  Description of Artificial Sequence: Synthetic oligonucleotide
tggatagtcctgtcaccgtggagtggaag

SEQ ID NO: 390961 - DNA, 28 bp, Artificial Sequence
  Description of Artificial Sequence: Synthetic oligonucleotide
ggatagtcctgtcaccgtggagtggaag

SEQ ID NO: 390962 - DNA, 28 bp, Artificial Sequence
  Description of Artificial Sequence: Synthetic oligonucleotide
gatagtcctgtcaccgtggagtggaagg

SEQ ID NO: 390963 - DNA, 28 bp, Artificial Sequence
  Description of Artificial Sequence: Synthetic oligonucleotide
atagtcctgtcaccgtggagtggaaggc

SEQ ID NO: 390964 - DNA, 27 bp, Artificial Sequence
  Description of Artificial Sequence: Synthetic oligonucleotide
tagtcctgtcaccgtggagtggaaggc

SEQ ID NO: 390965 - DNA, 28 bp, Artificial Sequence
  Description of Artificial Sequence: Synthetic oligonucleotide
agtggaaggcacagtctgattctgcccg

SEQ ID NO: 390966 - DNA, 27 bp, Artificial Sequence
  Description of Artificial Sequence: Synthetic oligonucleotide
gtggaaggcacagtctgattctgcccg

SEQ ID NO: 390967 - DNA, 27 bp, Artificial Sequence
  Description of Artificial Sequence: Synthetic oligonucleotide
tggaaggcacagtctgattctgcccgg

SEQ ID NO: 390968 - DNA, 27 bp, Artificial Sequence
  Description of Artificial Sequence: Synthetic oligonucleotide
ggaaggcacagtctgattctgcccgga

SEQ ID NO: 390969 - DNA, 27 bp, Artificial Sequence
  Description of Artificial Sequence: Synthetic oligonucleotide
gaaggcacagtctgattctgcccggag

SEQ ID NO: 390970 - DNA, 30 bp, Artificial Sequence; identical to SEQ ID NO: 53537
  Description of Artificial Sequence: Synthetic oligonucleotide

SEQ ID NO: 390971 - DNA, 29 bp, Artificial Sequence
  Description of Artificial Sequence: Synthetic oligonucleotide
aggcacagtctgattctgcccggagtaag

SEQ ID NO: 390972 - DNA, 28 bp, Artificial Sequence
  Description of Artificial Sequence: Synthetic oligonucleotide
ggcacagtctgattctgcccggagtaag

SEQ ID NO: 390973 - DNA, 29 bp, Artificial Sequence
  Description of Artificial Sequence: Synthetic oligonucleotide
gcacagtctgattctgcccggagtaagac

SEQ ID NO: 390974 - DNA, 32 bp, Artificial Sequence; identical to SEQ ID NO: 53541
  Description of Artificial Sequence: Synthetic oligonucleotide

SEQ ID NO: 390975 - DNA, 33 bp, Artificial Sequence; identical to SEQ ID NO: 53542
  Description of Artificial Sequence: Synthetic oligonucleotide

SEQ ID NO: 390976 - DNA, 32 bp, Artificial Sequence; identical to SEQ ID NO: 53543
  Description of Artificial Sequence: Synthetic oligonucleotide

SEQ ID NO: 390977 - DNA, 32 bp, Artificial Sequence; identical to SEQ ID NO: 53544
  Description of Artificial Sequence: Synthetic oligonucleotide

SEQ ID NO: 390978 - DNA, 31 bp, Artificial Sequence; identical to SEQ ID NO: 53545
  Description of Artificial Sequence: Synthetic oligonucleotide

SEQ ID NO: 390979 - DNA, 31 bp, Artificial Sequence; identical to SEQ ID NO: 53546
  Description of Artificial Sequence: Synthetic oligonucleotide

SEQ ID NO: 390980 - DNA, 30 bp, Artificial Sequence; identical to SEQ ID NO: 53547
  Description of Artificial Sequence: Synthetic oligonucleotide

SEQ ID NO: 390981 - DNA, 30 bp, Artificial Sequence; identical to SEQ ID NO: 53548
  Description of Artificial Sequence: Synthetic oligonucleotide

SEQ ID NO: 390982 - DNA, 29 bp, Artificial Sequence
  Description of Artificial Sequence: Synthetic oligonucleotide
gattctgcccggagtaagacattgacggg

SEQ ID NO: 390983 - DNA, 30 bp, Artificial Sequence; identical to SEQ ID NO: 53550
  Description of Artificial Sequence: Synthetic oligonucleotide

SEQ ID NO: 390984 - DNA, 29 bp, Artificial Sequence
  Description of Artificial Sequence: Synthetic oligonucleotide
ttctgcccggagtaagacattgacgggag

SEQ ID NO: 390985 - DNA, 28 bp, Artificial Sequence
  Description of Artificial Sequence: Synthetic oligonucleotide
tctgcccggagtaagacattgacgggag

SEQ ID NO: 390986 - DNA, 27 bp, Artificial Sequence
  Description of Artificial Sequence: Synthetic oligonucleotide
ctgcccggagtaagacattgacgggag

SEQ ID NO: 390987 - DNA, 27 bp, Artificial Sequence
  Description of Artificial Sequence: Synthetic oligonucleotide
tgcccggagtaagacattgacgggagc

SEQ ID NO: 390988 - DNA, 27 bp, Artificial Sequence
  Description of Artificial Sequence: Synthetic oligonucleotide
gcccggagtaagacattgacgggagct

SEQ ID NO: 390989 - DNA, 27 bp, Artificial Sequence
  Description of Artificial Sequence: Synthetic oligonucleotide
cccggagtaagacattgacgggagctg

SEQ ID NO: 390990 - DNA, 27 bp, Artificial Sequence
  Description of Artificial Sequence: Synthetic oligonucleotide
ccggagtaagacattgacgggagctgg

SEQ ID NO: 390991 - DNA, 27 bp, Artificial Sequence
  Description of Artificial Sequence: Synthetic oligonucleotide
cggagtaagacattgacgggagctggg

SEQ ID NO: 390992 - DNA, 27 bp, Artificial Sequence
  Description of Artificial Sequence: Synthetic oligonucleotide
ggagtaagacattgacgggagctgggg

SEQ ID NO: 390993 - DNA, 22 bp, Artificial Sequence
  Description of Artificial Sequence: Synthetic oligonucleotide
tgacggagctggggcggcctga

SEQ ID NO: 390994 - DNA, 21 bp, Artificial Sequence
  Description of Artificial Sequence: Synthetic oligonucleotide
gacggagctggggcggcctga

SEQ ID NO: 390995 - DNA, 21 bp, Artificial Sequence
  Description of Artificial Sequence: Synthetic oligonucleotide
acggagctggggcggcctgac

SEQ ID NO: 390996 - DNA, 20 bp, Artificial Sequence
  Description of Artificial Sequence: Synthetic oligonucleotide
cggagctggggcggcctgac

SEQ ID NO: 390997 - DNA, 21 bp, Artificial Sequence
  Description of Artificial Sequence: Synthetic oligonucleotide
ggagctggggcggcctgacga

SEQ ID NO: 390998 - DNA, 21 bp, Artificial Sequence
  Description of Artificial Sequence: Synthetic oligonucleotide
gagctggggcggcctgacgag

SEQ ID NO: 390999 - DNA, 22 bp, Artificial Sequence
  Description of Artificial Sequence: Synthetic oligonucleotide
agctggggcggcctgacgagga

SEQ ID NO: 391000 - DNA, 21 bp, Artificial Sequence
  Description of Artificial Sequence: Synthetic oligonucleotide
gctggggcggcctgacgagga

SEQ ID NO: 391001 - DNA, 23 bp, Artificial Sequence
  Description of Artificial Sequence: Synthetic oligonucleotide
ctggggcggcctgacgaggagta

SEQ ID NO: 391002 - DNA, 24 bp, Artificial Sequence
  Description of Artificial Sequence: Synthetic oligonucleotide
tggggcggcctgacgaggagtact

SEQ ID NO: 391003 - DNA, 23 bp, Artificial Sequence
  Description of Artificial Sequence: Synthetic oligonucleotide
ggggcggcctgacgaggagtact

SEQ ID NO: 391004 - DNA, 23 bp, Artificial Sequence
  Description of Artificial Sequence: Synthetic oligonucleotide
gggcggcctgacgaggagtactg

SEQ ID NO: 391005 - DNA, 25 bp, Artificial Sequence
  Description of Artificial Sequence: Synthetic oligonucleotide
ggcggcctgacgaggagtactggaa

SEQ ID NO: 391006 - DNA, 26 bp, Artificial Sequence
  Description of Artificial Sequence: Synthetic oligonucleotide
gcggcctgacgaggagtactggaaca

SEQ ID NO: 391007 - DNA, 26 bp, Artificial Sequence
  Description of Artificial Sequence: Synthetic oligonucleotide
cggcctgacgaggagtactggaacag

SEQ ID NO: 391008 - DNA, 26 bp, Artificial Sequence
  Description of Artificial Sequence: Synthetic oligonucleotide
ggcctgacgaggagtactggaacagc

SEQ ID NO: 391009 - DNA, 27 bp, Artificial Sequence
  Description of Artificial Sequence: Synthetic oligonucleotide
gcctgacgaggagtactggaacagcca

SEQ ID NO: 391010 - DNA, 27 bp, Artificial Sequence
  Description of Artificial Sequence: Synthetic oligonucleotide
cctgacgaggagtactggaacagccag

SEQ ID NO: 391011 - DNA, 29 bp, Artificial Sequence
  Description of Artificial Sequence: Synthetic oligonucleotide
ctgacgaggagtactggaacagccagaag

SEQ ID NO: 391012 - DNA, 29 bp, Artificial Sequence
  Description of Artificial Sequence: Synthetic oligonucleotide
tgacgaggagtactggaacagccagaagg

SEQ ID NO: 391013 - DNA, 28 bp, Artificial Sequence
  Description of Artificial Sequence: Synthetic oligonucleotide
gacgaggagtactggaacagccagaagg

SEQ ID NO: 391014 - DNA, 29 bp, Artificial Sequence
  Description of Artificial Sequence: Synthetic oligonucleotide
acgaggagtactggaacagccagaaggac

SEQ ID NO: 391015 - DNA, 28 bp, Artificial Sequence
  Description of Artificial Sequence: Synthetic oligonucleotide
cgaggagtactggaacagccagaaggac

SEQ ID NO: 391016 - DNA, 22 bp, Artificial Sequence
  Description of Artificial Sequence: Synthetic oligonucleotide
cccatgaccctgcagcgccgag

SEQ ID NO: 391017 - DNA, 26 bp, Artificial Sequence
  Description of Artificial Sequence: Synthetic oligonucleotide
acatcctggaggaggagcgggcagtt

SEQ ID NO: 391018 - DNA, 25 bp, Artificial Sequence
  Description of Artificial Sequence: Synthetic oligonucleotide
catcctggaggaggagcgggcagtt

SEQ ID NO: 391019 - DNA, 25 bp, Artificial Sequence
  Description of Artificial Sequence: Synthetic oligonucleotide
atcctggaggaggagcgggcagttc

SEQ ID NO: 391020 - DNA, 24 bp, Artificial Sequence
  Description of Artificial Sequence: Synthetic oligonucleotide
tcctggaggaggagcgggcagttc

SEQ ID NO: 391021 - DNA, 23 bp, Artificial Sequence
  Description of Artificial Sequence: Synthetic oligonucleotide
cctggaggaggagcgggcagttc

SEQ ID NO: 391022 - DNA, 23 bp, Artificial Sequence
  Description of Artificial Sequence: Synthetic oligonucleotide
ctggaggaggagcgggcagttcc

SEQ ID NO: 391023 - DNA, 23 bp, Artificial Sequence
  Description of Artificial Sequence: Synthetic oligonucleotide
tggaggaggagcgggcagttccg

SEQ ID NO: 391024 - DNA, 22 bp, Artificial Sequence
  Description of Artificial Sequence: Synthetic oligonucleotide
ggaggaggagcgggcagttccg

SEQ ID NO: 391025 - DNA, 23 bp, Artificial Sequence
  Description of Artificial Sequence: Synthetic oligonucleotide
gaggaggagcgggcagttccgga

SEQ ID NO: 391026 - DNA, 24 bp, Artificial Sequence
  Description of Artificial Sequence: Synthetic oligonucleotide
aggaggagcgggcagttccggaca

SEQ ID NO: 391027 - DNA, 23 bp, Artificial Sequence
  Description of Artificial Sequence: Synthetic oligonucleotide
ggaggagcgggcagttccggaca

SEQ ID NO: 391028 - DNA, 23 bp, Artificial Sequence
  Description of Artificial Sequence: Synthetic oligonucleotide
gaggagcgggcagttccggacag

SEQ ID NO: 391029 - DNA, 25 bp, Artificial Sequence
  Description of Artificial Sequence: Synthetic oligonucleotide
aggagcgggcagttccggacaggat

SEQ ID NO: 391030 - DNA, 24 bp, Artificial Sequence
  Description of Artificial Sequence: Synthetic oligonucleotide
ggagcgggcagttccggacaggat

SEQ ID NO: 391031 - DNA, 25 bp, Artificial Sequence
  Description of Artificial Sequence: Synthetic oligonucleotide
gagcgggcagttccggacaggatgt

SEQ ID NO: 391032 - DNA, 25 bp, Artificial Sequence
  Description of Artificial Sequence: Synthetic oligonucleotide
agcgggcagttccggacaggatgtg

SEQ ID NO: 391033 - DNA, 24 bp, Artificial Sequence
  Description of Artificial Sequence: Synthetic oligonucleotide
gcgggcagttccggacaggatgtg

SEQ ID NO: 391034 - DNA, 25 bp, Artificial Sequence
  Description of Artificial Sequence: Synthetic oligonucleotide
cgggcagttccggacaggatgtgca

SEQ ID NO: 391035 - DNA, 26 bp, Artificial Sequence
  Description of Artificial Sequence: Synthetic oligonucleotide
gggcagttccggacaggatgtgcaga

SEQ ID NO: 391036 - DNA, 27 bp, Artificial Sequence
  Description of Artificial Sequence: Synthetic oligonucleotide
ggcagttccggacaggatgtgcagaca

SEQ ID NO: 391037 - DNA, 27 bp, Artificial Sequence
  Description of Artificial Sequence: Synthetic oligonucleotide
gcagttccggacaggatgtgcagacac

SEQ ID NO: 391038 - DNA, 29 bp, Artificial Sequence
  Description of Artificial Sequence: Synthetic oligonucleotide
cagttccggacaggatgtgcagacacaac

SEQ ID NO: 391039 - DNA, 31 bp, Artificial Sequence; identical to SEQ ID NO: 53606
  Description of Artificial Sequence: Synthetic oligonucleotide

SEQ ID NO: 391040 - DNA, 30 bp, Artificial Sequence; identical to SEQ ID NO: 53607
  Description of Artificial Sequence: Synthetic oligonucleotide

SEQ ID NO: 391041 - DNA, 30 bp, Artificial Sequence; identical to SEQ ID NO: 53608
  Description of Artificial Sequence: Synthetic oligonucleotide

SEQ ID NO: 391042 - DNA, 29 bp, Artificial Sequence
  Description of Artificial Sequence: Synthetic oligonucleotide
tccggacaggatgtgcagacacaactacg

SEQ ID NO: 391043 - DNA, 32 bp, Artificial Sequence; identical to SEQ ID NO: 53610
  Description of Artificial Sequence: Synthetic oligonucleotide

SEQ ID NO: 391044 - DNA, 33 bp, Artificial Sequence; identical to SEQ ID NO: 53611
  Description of Artificial Sequence: Synthetic oligonucleotide

SEQ ID NO: 391045 - DNA, 32 bp, Artificial Sequence; identical to SEQ ID NO: 53612
  Description of Artificial Sequence: Synthetic oligonucleotide

SEQ ID NO: 391046 - DNA, 31 bp, Artificial Sequence; identical to SEQ ID NO: 53613
  Description of Artificial Sequence: Synthetic oligonucleotide

SEQ ID NO: 391047 - DNA, 33 bp, Artificial Sequence; identical to SEQ ID NO: 53614
  Description of Artificial Sequence: Synthetic oligonucleotide

SEQ ID NO: 391048 - DNA, 33 bp, Artificial Sequence; identical to SEQ ID NO: 53615
  Description of Artificial Sequence: Synthetic oligonucleotide

SEQ ID NO: 391049 - DNA, 32 bp, Artificial Sequence; identical to SEQ ID NO: 53616
  Description of Artificial Sequence: Synthetic oligonucleotide

SEQ ID NO: 391050 - DNA, 33 bp, Artificial Sequence; identical to SEQ ID NO: 53617
  Description of Artificial Sequence: Synthetic oligonucleotide

SEQ ID NO: 391051 - DNA, 33 bp, Artificial Sequence; identical to SEQ ID NO: 53618
  Description of Artificial Sequence: Synthetic oligonucleotide

SEQ ID NO: 391052 - DNA, 32 bp, Artificial Sequence; identical to SEQ ID NO: 53619
  Description of Artificial Sequence: Synthetic oligonucleotide

SEQ ID NO: 391053 - DNA, 32 bp, Artificial Sequence; identical to SEQ ID NO: 53620
  Description of Artificial Sequence: Synthetic oligonucleotide

SEQ ID NO: 391054 - DNA, 31 bp, Artificial Sequence; identical to SEQ ID NO: 53621
  Description of Artificial Sequence: Synthetic oligonucleotide

SEQ ID NO: 391055 - DNA, 31 bp, Artificial Sequence; identical to SEQ ID NO: 53622
  Description of Artificial Sequence: Synthetic oligonucleotide

SEQ ID NO: 391056 - DNA, 30 bp, Artificial Sequence; identical to SEQ ID NO: 53623
  Description of Artificial Sequence: Synthetic oligonucleotide

SEQ ID NO: 391057 - DNA, 29 bp, Artificial Sequence
  Description of Artificial Sequence: Synthetic oligonucleotide
acatctacaaccgggaagagttcgtgcgc

SEQ ID NO: 391058 - DNA, 28 bp, Artificial Sequence
  Description of Artificial Sequence: Synthetic oligonucleotide
catctacaaccgggaagagttcgtgcgc

SEQ ID NO: 391059 - DNA, 30 bp, Artificial Sequence; identical to SEQ ID NO: 53626
  Description of Artificial Sequence: Synthetic oligonucleotide

SEQ ID NO: 391060 - DNA, 29 bp, Artificial Sequence
  Description of Artificial Sequence: Synthetic oligonucleotide
tctacaaccgggaagagttcgtgcgcttc

SEQ ID NO: 391061 - DNA, 28 bp, Artificial Sequence
  Description of Artificial Sequence: Synthetic oligonucleotide
ctacaaccgggaagagttcgtgcgcttc

SEQ ID NO: 391062 - DNA, 28 bp, Artificial Sequence
  Description of Artificial Sequence: Synthetic oligonucleotide
tacaaccgggaagagttcgtgcgcttcg

SEQ ID NO: 391063 - DNA, 27 bp, Artificial Sequence
  Description of Artificial Sequence: Synthetic oligonucleotide
acaaccgggaagagttcgtgcgcttcg

SEQ ID NO: 391064 - DNA, 27 bp, Artificial Sequence
  Description of Artificial Sequence: Synthetic oligonucleotide
caaccgggaagagttcgtgcgcttcga

SEQ ID NO: 391065 - DNA, 27 bp, Artificial Sequence
  Description of Artificial Sequence: Synthetic oligonucleotide
aaccgggaagagttcgtgcgcttcgac

SEQ ID NO: 391066 - DNA, 27 bp, Artificial Sequence
  Description of Artificial Sequence: Synthetic oligonucleotide
accgggaagagttcgtgcgcttcgaca

SEQ ID NO: 391067 - DNA, 26 bp, Artificial Sequence
  Description of Artificial Sequence: Synthetic oligonucleotide
ccgggaagagttcgtgcgcttcgaca

SEQ ID NO: 391068 - DNA, 26 bp, Artificial Sequence
  Description of Artificial Sequence: Synthetic oligonucleotide
cgggaagagttcgtgcgcttcgacag

SEQ ID NO: 391069 - DNA, 26 bp, Artificial Sequence
  Description of Artificial Sequence: Synthetic oligonucleotide
gggaagagttcgtgcgcttcgacagc

SEQ ID NO: 391070 - DNA, 27 bp, Artificial Sequence
  Description of Artificial Sequence: Synthetic oligonucleotide
ggaagagttcgtgcgcttcgacagcga

SEQ ID NO: 391071 - DNA, 27 bp, Artificial Sequence
  Description of Artificial Sequence: Synthetic oligonucleotide
gaagagttcgtgcgcttcgacagcgac

SEQ ID NO: 391072 - DNA, 27 bp, Artificial Sequence
  Description of Artificial Sequence: Synthetic oligonucleotide
aagagttcgtgcgcttcgacagcgacg

SEQ ID NO: 391073 - DNA, 27 bp, Artificial Sequence
  Description of Artificial Sequence: Synthetic oligonucleotide
agagttcgtgcgcttcgacagcgacgt

SEQ ID NO: 391074 - DNA, 33 bp, Artificial Sequence; identical to SEQ ID NO: 53641
  Description of Artificial Sequence: Synthetic oligonucleotide

SEQ ID NO: 391075 - DNA, 32 bp, Artificial Sequence; identical to SEQ ID NO: 53642
  Description of Artificial Sequence: Synthetic oligonucleotide

SEQ ID NO: 391076 - DNA, 33 bp, Artificial Sequence; identical to SEQ ID NO: 53643
  Description of Artificial Sequence: Synthetic oligonucleotide

SEQ ID NO: 391077 - DNA, 33 bp, Artificial Sequence; identical to SEQ ID NO: 53644
  Description of Artificial Sequence: Synthetic oligonucleotide

SEQ ID NO: 391078 - DNA, 32 bp, Artificial Sequence; identical to SEQ ID NO: 53645
  Description of Artificial Sequence: Synthetic oligonucleotide

SEQ ID NO: 391079 - DNA, 32 bp, Artificial Sequence; identical to SEQ ID NO: 53646
  Description of Artificial Sequence: Synthetic oligonucleotide

SEQ ID NO: 391080 - DNA, 31 bp, Artificial Sequence; identical to SEQ ID NO: 53647
  Description of Artificial Sequence: Synthetic oligonucleotide

SEQ ID NO: 391081 - DNA, 31 bp, Artificial Sequence; identical to SEQ ID NO: 53648
  Description of Artificial Sequence: Synthetic oligonucleotide

SEQ ID NO: 391082 - DNA, 30 bp, Artificial Sequence; identical to SEQ ID NO: 53649
  Description of Artificial Sequence: Synthetic oligonucleotide

SEQ ID NO: 391083 - DNA, 29 bp, Artificial Sequence
  Description of Artificial Sequence: Synthetic oligonucleotide
acatctacaaccgggaggagtttgtgcgc

SEQ ID NO: 391084 - DNA, 28 bp, Artificial Sequence
  Description of Artificial Sequence: Synthetic oligonucleotide
catctacaaccgggaggagtttgtgcgc

SEQ ID NO: 391085 - DNA, 30 bp, Artificial Sequence; identical to SEQ ID NO: 53652
  Description of Artificial Sequence: Synthetic oligonucleotide

SEQ ID NO: 391086 - DNA, 29 bp, Artificial Sequence
  Description of Artificial Sequence: Synthetic oligonucleotide
tctacaaccgggaggagtttgtgcgcttc

SEQ ID NO: 391087 - DNA, 28 bp, Artificial Sequence
  Description of Artificial Sequence: Synthetic oligonucleotide
ctacaaccgggaggagtttgtgcgcttc

SEQ ID NO: 391088 - DNA, 28 bp, Artificial Sequence
  Description of Artificial Sequence: Synthetic oligonucleotide
tacaaccgggaggagtttgtgcgcttcg

SEQ ID NO: 391089 - DNA, 27 bp, Artificial Sequence
  Description of Artificial Sequence: Synthetic oligonucleotide
acaaccgggaggagtttgtgcgcttcg

SEQ ID NO: 391090 - DNA, 27 bp, Artificial Sequence
  Description of Artificial Sequence: Synthetic oligonucleotide
caaccgggaggagtttgtgcgcttcga

SEQ ID NO: 391091 - DNA, 27 bp, Artificial Sequence
  Description of Artificial Sequence: Synthetic oligonucleotide
aaccgggaggagtttgtgcgcttcgac

SEQ ID NO: 391092 - DNA, 27 bp, Artificial Sequence
  Description of Artificial Sequence: Synthetic oligonucleotide
accgggaggagtttgtgcgcttcgaca

SEQ ID NO: 391093 - DNA, 26 bp, Artificial Sequence
  Description of Artificial Sequence: Synthetic oligonucleotide
ccgggaggagtttgtgcgcttcgaca

SEQ ID NO: 391094 - DNA, 26 bp, Artificial Sequence
  Description of Artificial Sequence: Synthetic oligonucleotide
cgggaggagtttgtgcgcttcgacag

SEQ ID NO: 391095 - DNA, 26 bp, Artificial Sequence
  Description of Artificial Sequence: Synthetic oligonucleotide
gggaggagtttgtgcgcttcgacagc

SEQ ID NO: 391096 - DNA, 27 bp, Artificial Sequence
  Description of Artificial Sequence: Synthetic oligonucleotide
ggaggagtttgtgcgcttcgacagcga

SEQ ID NO: 391097 - DNA, 27 bp, Artificial Sequence
  Description of Artificial Sequence: Synthetic oligonucleotide
gaggagtttgtgcgcttcgacagcgac

SEQ ID NO: 391098 - DNA, 27 bp, Artificial Sequence
  Description of Artificial Sequence: Synthetic oligonucleotide
aggagtttgtgcgcttcgacagcgacg

SEQ ID NO: 391099 - DNA, 27 bp, Artificial Sequence
  Description of Artificial Sequence: Synthetic oligonucleotide
ggagtttgtgcgcttcgacagcgacgt

SEQ ID NO: 391100 - DNA, 27 bp, Artificial Sequence
  Description of Artificial Sequence: Synthetic oligonucleotide
gagtttgtgcgcttcgacagcgacgtg

SEQ ID NO: 391101 - DNA, 27 bp, Artificial Sequence
  Description of Artificial Sequence: Synthetic oligonucleotide
agtttgtgcgcttcgacagcgacgtgg

SEQ ID NO: 391102 - DNA, 26 bp, Artificial Sequence
  Description of Artificial Sequence: Synthetic oligonucleotide
gtttgtgcgcttcgacagcgacgtgg

SEQ ID NO: 391103 - DNA, 26 bp, Artificial Sequence
  Description of Artificial Sequence: Synthetic oligonucleotide
tttgtgcgcttcgacagcgacgtggg

SEQ ID NO: 391104 - DNA, 25 bp, Artificial Sequence
  Description of Artificial Sequence: Synthetic oligonucleotide
ttgtgcgcttcgacagcgacgtggg

SEQ ID NO: 391105 - DNA, 24 bp, Artificial Sequence
  Description of Artificial Sequence: Synthetic oligonucleotide
tgtgcgcttcgacagcgacgtggg

SEQ ID NO: 391106 - DNA, 24 bp, Artificial Sequence
  Description of Artificial Sequence: Synthetic oligonucleotide
acggagctggggcggcctgatgaa

SEQ ID NO: 391107 - DNA, 23 bp, Artificial Sequence
  Description of Artificial Sequence: Synthetic oligonucleotide
cggagctggggcggcctgatgaa

SEQ ID NO: 391108 - DNA, 24 bp, Artificial Sequence
  Description of Artificial Sequence: Synthetic oligonucleotide
ggagctggggcggcctgatgaaga

SEQ ID NO: 391109 - DNA, 26 bp, Artificial Sequence
  Description of Artificial Sequence: Synthetic oligonucleotide
gagctggggcggcctgatgaagagta

SEQ ID NO: 391110 - DNA, 27 bp, Artificial Sequence
  Description of Artificial Sequence: Synthetic oligonucleotide
agctggggcggcctgatgaagagtact

SEQ ID NO: 391111 - DNA, 26 bp, Artificial Sequence
  Description of Artificial Sequence: Synthetic oligonucleotide
gctggggcggcctgatgaagagtact

SEQ ID NO: 391112 - DNA, 26 bp, Artificial Sequence
  Description of Artificial Sequence: Synthetic oligonucleotide
ctggggcggcctgatgaagagtactg

SEQ ID NO: 391113 - DNA, 27 bp, Artificial Sequence
  Description of Artificial Sequence: Synthetic oligonucleotide
tggggcggcctgatgaagagtactgga

SEQ ID NO: 391114 - DNA, 27 bp, Artificial Sequence
  Description of Artificial Sequence: Synthetic oligonucleotide
ggggcggcctgatgaagagtactggaa

SEQ ID NO: 391115 - DNA, 27 bp, Artificial Sequence
  Description of Artificial Sequence: Synthetic oligonucleotide
gggcggcctgatgaagagtactggaac

SEQ ID NO: 391116 - DNA, 28 bp, Artificial Sequence
  Description of Artificial Sequence: Synthetic oligonucleotide
ggcggcctgatgaagagtactggaacag

SEQ ID NO: 391117 - DNA, 28 bp, Artificial Sequence
  Description of Artificial Sequence: Synthetic oligonucleotide
gcggcctgatgaagagtactggaacagc

SEQ ID NO: 391118 - DNA, 28 bp, Artificial Sequence
  Description of Artificial Sequence: Synthetic oligonucleotide
cggcctgatgaagagtactggaacagcc

SEQ ID NO: 391119 - DNA, 29 bp, Artificial Sequence
  Description of Artificial Sequence: Synthetic oligonucleotide
ggcctgatgaagagtactggaacagccag

SEQ ID NO: 391120 - DNA, 31 bp, Artificial Sequence; identical to SEQ ID NO: 53687
  Description of Artificial Sequence: Synthetic oligonucleotide

SEQ ID NO: 391121 - DNA, 31 bp, Artificial Sequence; identical to SEQ ID NO: 53688
  Description of Artificial Sequence: Synthetic oligonucleotide

SEQ ID NO: 391122 - DNA, 32 bp, Artificial Sequence; identical to SEQ ID NO: 53689
  Description of Artificial Sequence: Synthetic oligonucleotide

SEQ ID NO: 391123 - DNA, 34 bp, Artificial Sequence; identical to SEQ ID NO: 53690
  Description of Artificial Sequence: Synthetic oligonucleotide

SEQ ID NO: 391124 - DNA, 33 bp, Artificial Sequence; identical to SEQ ID NO: 53691
  Description of Artificial Sequence: Synthetic oligonucleotide

SEQ ID NO: 391125 - DNA, 33 bp, Artificial Sequence; identical to SEQ ID NO: 53692
  Description of Artificial Sequence: Synthetic oligonucleotide

SEQ ID NO: 391126 - DNA, 32 bp, Artificial Sequence; identical to SEQ ID NO: 53693
  Description of Artificial Sequence: Synthetic oligonucleotide

SEQ ID NO: 391127 - DNA, 31 bp, Artificial Sequence; identical to SEQ ID NO: 53694
  Description of Artificial Sequence: Synthetic oligonucleotide

SEQ ID NO: 391128 - DNA, 32 bp, Artificial Sequence; identical to SEQ ID NO: 53695
  Description of Artificial Sequence: Synthetic oligonucleotide

SEQ ID NO: 391129 - DNA, 31 bp, Artificial Sequence; identical to SEQ ID NO: 53696
  Description of Artificial Sequence: Synthetic oligonucleotide

SEQ ID NO: 391130 - DNA, 30 bp, Artificial Sequence; identical to SEQ ID NO: 53697
  Description of Artificial Sequence: Synthetic oligonucleotide

SEQ ID NO: 391131 - DNA, 29 bp, Artificial Sequence
  Description of Artificial Sequence: Synthetic oligonucleotide
ggagagatacatctacaaccgggaggagc

SEQ ID NO: 391132 - DNA, 30 bp, Artificial Sequence; identical to SEQ ID NO: 53699
  Description of Artificial Sequence: Synthetic oligonucleotide

SEQ ID NO: 391133 - DNA, 30 bp, Artificial Sequence; identical to SEQ ID NO: 53700
  Description of Artificial Sequence: Synthetic oligonucleotide

SEQ ID NO: 391134 - DNA, 29 bp, Artificial Sequence
  Description of Artificial Sequence: Synthetic oligonucleotide
gagatacatctacaaccgggaggagctcg

SEQ ID NO: 391135 - DNA, 30 bp, Artificial Sequence; identical to SEQ ID NO: 53702
  Description of Artificial Sequence: Synthetic oligonucleotide

SEQ ID NO: 391136 - DNA, 29 bp, Artificial Sequence
  Description of Artificial Sequence: Synthetic oligonucleotide
gatacatctacaaccgggaggagctcgtg

SEQ ID NO: 391137 - DNA, 29 bp, Artificial Sequence
  Description of Artificial Sequence: Synthetic oligonucleotide
atacatctacaaccgggaggagctcgtgc

SEQ ID NO: 391138 - DNA, 28 bp, Artificial Sequence
  Description of Artificial Sequence: Synthetic oligonucleotide
tacatctacaaccgggaggagctcgtgc

SEQ ID NO: 391139 - DNA, 27 bp, Artificial Sequence
  Description of Artificial Sequence: Synthetic oligonucleotide
acatctacaaccgggaggagctcgtgc

SEQ ID NO: 391140 - DNA, 26 bp, Artificial Sequence
  Description of Artificial Sequence: Synthetic oligonucleotide
catctacaaccgggaggagctcgtgc

SEQ ID NO: 391141 - DNA, 26 bp, Artificial Sequence
  Description of Artificial Sequence: Synthetic oligonucleotide
atctacaaccgggaggagctcgtgcg

SEQ ID NO: 391142 - DNA, 25 bp, Artificial Sequence
  Description of Artificial Sequence: Synthetic oligonucleotide
tctacaaccgggaggagctcgtgcg

SEQ ID NO: 391143 - DNA, 24 bp, Artificial Sequence
  Description of Artificial Sequence: Synthetic oligonucleotide
ctacaaccgggaggagctcgtgcg

SEQ ID NO: 391144 - DNA, 26 bp, Artificial Sequence
  Description of Artificial Sequence: Synthetic oligonucleotide
tacaaccgggaggagctcgtgcgctt

SEQ ID NO: 391145 - DNA, 25 bp, Artificial Sequence
  Description of Artificial Sequence: Synthetic oligonucleotide
acaaccgggaggagctcgtgcgctt

SEQ ID NO: 391146 - DNA, 24 bp, Artificial Sequence
  Description of Artificial Sequence: Synthetic oligonucleotide
caaccgggaggagctcgtgcgctt

SEQ ID NO: 391147 - DNA, 24 bp, Artificial Sequence
  Description of Artificial Sequence: Synthetic oligonucleotide
aaccgggaggagctcgtgcgcttc

SEQ ID NO: 391148 - DNA, 23 bp, Artificial Sequence
  Description of Artificial Sequence: Synthetic oligonucleotide
accgggaggagctcgtgcgcttc

SEQ ID NO: 391149 - DNA, 22 bp, Artificial Sequence
  Description of Artificial Sequence: Synthetic oligonucleotide
ccgggaggagctcgtgcgcttc

SEQ ID NO: 391150 - DNA, 23 bp, Artificial Sequence
  Description of Artificial Sequence: Synthetic oligonucleotide
cgggaggagctcgtgcgcttcga

SEQ ID NO: 391151 - DNA, 24 bp, Artificial Sequence
  Description of Artificial Sequence: Synthetic oligonucleotide
gggaggagctcgtgcgcttcgaca

SEQ ID NO: 391152 - DNA, 24 bp, Artificial Sequence
  Description of Artificial Sequence: Synthetic oligonucleotide
ggaggagctcgtgcgcttcgacag

SEQ ID NO: 391153 - DNA, 24 bp, Artificial Sequence
  Description of Artificial Sequence: Synthetic oligonucleotide
gaggagctcgtgcgcttcgacagc

SEQ ID NO: 391154 - DNA, 25 bp, Artificial Sequence
  Description of Artificial Sequence: Synthetic oligonucleotide
aggagctcgtgcgcttcgacagcga

SEQ ID NO: 391155 - DNA, 24 bp, Artificial Sequence
  Description of Artificial Sequence: Synthetic oligonucleotide
ggagctcgtgcgcttcgacagcga

SEQ ID NO: 391156 - DNA, 24 bp, Artificial Sequence
  Description of Artificial Sequence: Synthetic oligonucleotide
gagctcgtgcgcttcgacagcgac

SEQ ID NO: 391157 - DNA, 25 bp, Artificial Sequence
  Description of Artificial Sequence: Synthetic oligonucleotide
agctcgtgcgcttcgacagcgacgt

SEQ ID NO: 391158 - DNA, 24 bp, Artificial Sequence
  Description of Artificial Sequence: Synthetic oligonucleotide
gctcgtgcgcttcgacagcgacgt

SEQ ID NO: 391159 - DNA, 24 bp, Artificial Sequence
  Description of Artificial Sequence: Synthetic oligonucleotide
ctcgtgcgcttcgacagcgacgtg

SEQ ID NO: 391160 - DNA, 21 bp, Artificial Sequence
  Description of Artificial Sequence: Synthetic oligonucleotide
acggagctggggcggcctgag

SEQ ID NO: 391161 - DNA, 20 bp, Artificial Sequence
  Description of Artificial Sequence: Synthetic oligonucleotide
cggagctggggcggcctgag

SEQ ID NO: 391162 - DNA, 20 bp, Artificial Sequence
  Description of Artificial Sequence: Synthetic oligonucleotide
ggagctggggcggcctgagg

SEQ ID NO: 391163 - DNA, 20 bp, Artificial Sequence
  Description of Artificial Sequence: Synthetic oligonucleotide
gagctggggcggcctgaggc

SEQ ID NO: 391164 - DNA, 20 bp, Artificial Sequence
  Description of Artificial Sequence: Synthetic oligonucleotide
agctggggcggcctgaggcg

SEQ ID NO: 391165 - DNA, 20 bp, Artificial Sequence
  Description of Artificial Sequence: Synthetic oligonucleotide
gctggggcggcctgaggcgt

SEQ ID NO: 391166 - DNA, 20 bp, Artificial Sequence
  Description of Artificial Sequence: Synthetic oligonucleotide
ctggggcggcctgaggcgga

SEQ ID NO: 391167 - DNA, 22 bp, Artificial Sequence
  Description of Artificial Sequence: Synthetic oligonucleotide
tggggcggcctgaggcggagta

SEQ ID NO: 391168 - DNA, 21 bp, Artificial Sequence
  Description of Artificial Sequence: Synthetic oligonucleotide
ggggcggcctgaggcggagta

SEQ ID NO: 391169 - DNA, 22 bp, Artificial Sequence
  Description of Artificial Sequence: Synthetic oligonucleotide
gggcggcctgaggcggagtact

SEQ ID NO: 391170 - DNA, 22 bp, Artificial Sequence
  Description of Artificial Sequence: Synthetic oligonucleotide
ggcggcctgaggcggagtactg

SEQ ID NO: 391171 - DNA, 24 bp, Artificial Sequence
  Description of Artificial Sequence: Synthetic oligonucleotide
gcggcctgaggcggagtactggaa

SEQ ID NO: 391172 - DNA, 25 bp, Artificial Sequence
  Description of Artificial Sequence: Synthetic oligonucleotide
cggcctgaggcggagtactggaaca

SEQ ID NO: 391173 - DNA, 25 bp, Artificial Sequence
  Description of Artificial Sequence: Synthetic oligonucleotide
ggcctgaggcggagtactggaacag

SEQ ID NO: 391174 - DNA, 25 bp, Artificial Sequence
  Description of Artificial Sequence: Synthetic oligonucleotide
gcctgaggcggagtactggaacagc

SEQ ID NO: 391175 - DNA, 26 bp, Artificial Sequence
  Description of Artificial Sequence: Synthetic oligonucleotide
cctgaggcggagtactggaacagcca

SEQ ID NO: 391176 - DNA, 27 bp, Artificial Sequence
  Description of Artificial Sequence: Synthetic oligonucleotide
ctgaggcggagtactggaacagccaga

SEQ ID NO: 391177 - DNA, 28 bp, Artificial Sequence
  Description of Artificial Sequence: Synthetic oligonucleotide
tgaggcggagtactggaacagccagaag

SEQ ID NO: 391178 - DNA, 27 bp, Artificial Sequence
  Description of Artificial Sequence: Synthetic oligonucleotide
gaggcggagtactggaacagccagaag

SEQ ID NO: 391179 - DNA, 27 bp, Artificial Sequence
  Description of Artificial Sequence: Synthetic oligonucleotide
aggcggagtactggaacagccagaagg

SEQ ID NO: 391180 - DNA, 27 bp, Artificial Sequence
  Description of Artificial Sequence: Synthetic oligonucleotide
ggcggagtactggaacagccagaagga

SEQ ID NO: 391181 - DNA, 44 bp, Artificial Sequence
  Description of Artificial Sequence: Synthetic oligonucleotide
aatatttgagatcaccttcagagcaaagaaaacgcataatctcc

SEQ ID NO: 391182 - DNA, 43 bp, Artificial Sequence
  Description of Artificial Sequence: Synthetic oligonucleotide
atatttgagatcaccttcagagcaaagaaaacgcataatctcc

SEQ ID NO: 391183 - DNA, 42 bp, Artificial Sequence
  Description of Artificial Sequence: Synthetic oligonucleotide
tatttgagatcaccttcagagcaaagaaaacgcataatctcc

SEQ ID NO: 391184 - DNA, 41 bp, Artificial Sequence
  Description of Artificial Sequence: Synthetic oligonucleotide
atttgagatcaccttcagagcaaagaaaacgcataatctcc

SEQ ID NO: 391185 - DNA, 40 bp, Artificial Sequence
  Description of Artificial Sequence: Synthetic oligonucleotide
tttgagatcaccttcagagcaaagaaaacgcataatctcc

SEQ ID NO: 391186 - DNA, 39 bp, Artificial Sequence
  Description of Artificial Sequence: Synthetic oligonucleotide
ttgagatcaccttcagagcaaagaaaacgcataatctcc

SEQ ID NO: 391187 - DNA, 38 bp, Artificial Sequence
  Description of Artificial Sequence: Synthetic oligonucleotide
tgagatcaccttcagagcaaagaaaacgcataatctcc

SEQ ID NO: 391188 - DNA, 37 bp, Artificial Sequence
  Description of Artificial Sequence: Synthetic oligonucleotide
gagatcaccttcagagcaaagaaaacgcataatctcc

SEQ ID NO: 391189 - DNA, 37 bp, Artificial Sequence
  Description of Artificial Sequence: Synthetic oligonucleotide
agatcaccttcagagcaaagaaaacgcataatctccc

SEQ ID NO: 391190 - DNA, 36 bp, Artificial Sequence
  Description of Artificial Sequence: Synthetic oligonucleotide
gatcaccttcagagcaaagaaaacgcataatctccc

SEQ ID NO: 391191 - DNA, 36 bp, Artificial Sequence
  Description of Artificial Sequence: Synthetic oligonucleotide
atcaccttcagagcaaagaaaacgcataatctcccc

SEQ ID NO: 391192 - DNA, 35 bp, Artificial Sequence
  Description of Artificial Sequence: Synthetic oligonucleotide
tcaccttcagagcaaagaaaacgcataatctcccc

SEQ ID NO: 391193 - DNA, 34 bp, Artificial Sequence
  Description of Artificial Sequence: Synthetic oligonucleotide
caccttcagagcaaagaaaacgcataatctcccc

SEQ ID NO: 391194 - DNA, 37 bp, Artificial Sequence
  Description of Artificial Sequence: Synthetic oligonucleotide
accttcagagcaaagaaaacgcataatctccccaaac

SEQ ID NO: 391195 - DNA, 36 bp, Artificial Sequence
  Description of Artificial Sequence: Synthetic oligonucleotide
ccttcagagcaaagaaaacgcataatctccccaaac

SEQ ID NO: 391196 - DNA, 38 bp, Artificial Sequence
  Description of Artificial Sequence: Synthetic oligonucleotide
cttcagagcaaagaaaacgcataatctccccaaacatc

SEQ ID NO: 391197 - DNA, 40 bp, Artificial Sequence
  Description of Artificial Sequence: Synthetic oligonucleotide
ttcagagcaaagaaaacgcataatctccccaaacatcatg

SEQ ID NO: 391198 - DNA, 39 bp, Artificial Sequence
  Description of Artificial Sequence: Synthetic oligonucleotide
tcagagcaaagaaaacgcataatctccccaaacatcatg

SEQ ID NO: 391199 - DNA, 38 bp, Artificial Sequence
  Description of Artificial Sequence: Synthetic oligonucleotide
cagagcaaagaaaacgcataatctccccaaacatcatg

SEQ ID NO: 391200 - DNA, 39 bp, Artificial Sequence
  Description of Artificial Sequence: Synthetic oligonucleotide
agagcaaagaaaacgcataatctccccaaacatcatgac

SEQ ID NO: 391201 - DNA, 38 bp, Artificial Sequence
  Description of Artificial Sequence: Synthetic oligonucleotide
gagcaaagaaaacgcataatctccccaaacatcatgac

SEQ ID NO: 391202 - DNA, 42 bp, Artificial Sequence
  Description of Artificial Sequence: Synthetic oligonucleotide
agcaaagaaaacgcataatctccccaaacatcatgacttatc

SEQ ID NO: 391203 - DNA, 41 bp, Artificial Sequence
  Description of Artificial Sequence: Synthetic oligonucleotide
gcaaagaaaacgcataatctccccaaacatcatgacttatc

SEQ ID NO: 391204 - DNA, 42 bp, Artificial Sequence
  Description of Artificial Sequence: Synthetic oligonucleotide
caaagaaaacgcataatctccccaaacatcatgacttatctg

SEQ ID NO: 391205 - DNA, 43 bp, Artificial Sequence
  Description of Artificial Sequence: Synthetic oligonucleotide
aaagaaaacgcataatctccccaaacatcatgacttatctgac

SEQ ID NO: 391206 - DNA, 42 bp, Artificial Sequence
  Description of Artificial Sequence: Synthetic oligonucleotide
aagaaaacgcataatctccccaaacatcatgacttatctgac

SEQ ID NO: 391207 - DNA, 41 bp, Artificial Sequence
  Description of Artificial Sequence: Synthetic oligonucleotide
agaaaacgcataatctccccaaacatcatgacttatctgac

SEQ ID NO: 391208 - DNA, 40 bp, Artificial Sequence
  Description of Artificial Sequence: Synthetic oligonucleotide
gaaaacgcataatctccccaaacatcatgacttatctgac

SEQ ID NO: 391209 - DNA, 41 bp, Artificial Sequence
  Description of Artificial Sequence: Synthetic oligonucleotide
aaaacgcataatctccccaaacatcatgacttatctgactg

SEQ ID NO: 391210 - DNA, 40 bp, Artificial Sequence
  Description of Artificial Sequence: Synthetic oligonucleotide
aaacgcataatctccccaaacatcatgacttatctgactg

SEQ ID NO: 391211 - DNA, 39 bp, Artificial Sequence
  Description of Artificial Sequence: Synthetic oligonucleotide
aacgcataatctccccaaacatcatgacttatctgactg

SEQ ID NO: 391212 - DNA, 38 bp, Artificial Sequence
  Description of Artificial Sequence: Synthetic oligonucleotide
acgcataatctccccaaacatcatgacttatctgactg

SEQ ID NO: 391213 - DNA, 37 bp, Artificial Sequence
  Description of Artificial Sequence: Synthetic oligonucleotide
cgcataatctccccaaacatcatgacttatctgactg

SEQ ID NO: 391214 - DNA, 37 bp, Artificial Sequence
  Description of Artificial Sequence: Synthetic oligonucleotide
gcataatctccccaaacatcatgacttatctgactgg

SEQ ID NO: 391215 - DNA, 44 bp, Artificial Sequence
  Description of Artificial Sequence: Synthetic oligonucleotide
cataatctccccaaacatcatgacttatctgactggttaaaatg

SEQ ID NO: 391216 - DNA, 45 bp, Artificial Sequence
  Description of Artificial Sequence: Synthetic oligonucleotide
ataatctccccaaacatcatgacttatctgactggttaaaatgag

SEQ ID NO: 391217 - DNA, 44 bp, Artificial Sequence
  Description of Artificial Sequence: Synthetic oligonucleotide
taatctccccaaacatcatgacttatctgactggttaaaatgag

SEQ ID NO: 391218 - DNA, 43 bp, Artificial Sequence
  Description of Artificial Sequence: Synthetic oligonucleotide
aatctccccaaacatcatgacttatctgactggttaaaatgag

SEQ ID NO: 391219 - DNA, 42 bp, Artificial Sequence
  Description of Artificial Sequence: Synthetic oligonucleotide
atctccccaaacatcatgacttatctgactggttaaaatgag

SEQ ID NO: 391220 - DNA, 41 bp, Artificial Sequence
  Description of Artificial Sequence: Synthetic oligonucleotide
tctccccaaacatcatgacttatctgactggttaaaatgag

SEQ ID NO: 391221 - DNA, 40 bp, Artificial Sequence
  Description of Artificial Sequence: Synthetic oligonucleotide
ctccccaaacatcatgacttatctgactggttaaaatgag

SEQ ID NO: 391222 - DNA, 43 bp, Artificial Sequence
  Description of Artificial Sequence: Synthetic oligonucleotide
tccccaaacatcatgacttatctgactggttaaaatgagtatc

SEQ ID NO: 391223 - DNA, 42 bp, Artificial Sequence
  Description of Artificial Sequence: Synthetic oligonucleotide
ccccaaacatcatgacttatctgactggttaaaatgagtatc

SEQ ID NO: 391224 - DNA, 43 bp, Artificial Sequence
  Description of Artificial Sequence: Synthetic oligonucleotide
cccaaacatcatgacttatctgactggttaaaatgagtatcac

SEQ ID NO: 391225 - DNA, 32 bp, Artificial Sequence; identical to SEQ ID NO: 53748
  Description of Artificial Sequence: Synthetic oligonucleotide

SEQ ID NO: 391226 - DNA, 32 bp, Artificial Sequence; identical to SEQ ID NO: 53749
  Description of Artificial Sequence: Synthetic oligonucleotide

SEQ ID NO: 391227 - DNA, 32 bp, Artificial Sequence; identical to SEQ ID NO: 53750
  Description of Artificial Sequence: Synthetic oligonucleotide

SEQ ID NO: 391228 - DNA, 32 bp, Artificial Sequence; identical to SEQ ID NO: 53751
  Description of Artificial Sequence: Synthetic oligonucleotide

SEQ ID NO: 391229 - DNA, 33 bp, Artificial Sequence; identical to SEQ ID NO: 53752
  Description of Artificial Sequence: Synthetic oligonucleotide

SEQ ID NO: 391230 - DNA, 32 bp, Artificial Sequence; identical to SEQ ID NO: 53753
  Description of Artificial Sequence: Synthetic oligonucleotide

SEQ ID NO: 391231 - DNA, 32 bp, Artificial Sequence; identical to SEQ ID NO: 53754
  Description of Artificial Sequence: Synthetic oligonucleotide

SEQ ID NO: 391232 - DNA, 31 bp, Artificial Sequence; identical to SEQ ID NO: 53755
  Description of Artificial Sequence: Synthetic oligonucleotide

SEQ ID NO: 391233 - DNA, 34 bp, Artificial Sequence; identical to SEQ ID NO: 53756
  Description of Artificial Sequence: Synthetic oligonucleotide

SEQ ID NO: 391234 - DNA, 34 bp, Artificial Sequence; identical to SEQ ID NO: 53757
  Description of Artificial Sequence: Synthetic oligonucleotide

SEQ ID NO: 391235 - DNA, 33 bp, Artificial Sequence; identical to SEQ ID NO: 53758
  Description of Artificial Sequence: Synthetic oligonucleotide

SEQ ID NO: 391236 - DNA, 35 bp, Artificial Sequence; identical to SEQ ID NO: 53759
  Description of Artificial Sequence: Synthetic oligonucleotide

SEQ ID NO: 391237 - DNA, 34 bp, Artificial Sequence; identical to SEQ ID NO: 53760
  Description of Artificial Sequence: Synthetic oligonucleotide

SEQ ID NO: 391238 - DNA, 34 bp, Artificial Sequence; identical to SEQ ID NO: 53761
  Description of Artificial Sequence: Synthetic oligonucleotide

SEQ ID NO: 391239 - DNA, 33 bp, Artificial Sequence; identical to SEQ ID NO: 53762
  Description of Artificial Sequence: Synthetic oligonucleotide

SEQ ID NO: 391240 - DNA, 32 bp, Artificial Sequence; identical to SEQ ID NO: 53763
  Description of Artificial Sequence: Synthetic oligonucleotide

SEQ ID NO: 391241 - DNA, 31 bp, Artificial Sequence; identical to SEQ ID NO: 53764
  Description of Artificial Sequence: Synthetic oligonucleotide

SEQ ID NO: 391242 - DNA, 30 bp, Artificial Sequence; identical to SEQ ID NO: 53765
  Description of Artificial Sequence: Synthetic oligonucleotide

SEQ ID NO: 391243 - DNA, 29 bp, Artificial Sequence
  Description of Artificial Sequence: Synthetic oligonucleotide
cgtgtaccagttacggcaggaatgctacg

SEQ ID NO: 391244 - DNA, 29 bp, Artificial Sequence
  Description of Artificial Sequence: Synthetic oligonucleotide
gtgtaccagttacggcaggaatgctacgc

SEQ ID NO: 391245 - DNA, 29 bp, Artificial Sequence
  Description of Artificial Sequence: Synthetic oligonucleotide
tgtaccagttacggcaggaatgctacgcg

SEQ ID NO: 391246 - DNA, 28 bp, Artificial Sequence
  Description of Artificial Sequence: Synthetic oligonucleotide
gtaccagttacggcaggaatgctacgcg

SEQ ID NO: 391247 - DNA, 34 bp, Artificial Sequence; identical to SEQ ID NO: 53770
  Description of Artificial Sequence: Synthetic oligonucleotide

SEQ ID NO: 391248 - DNA, 33 bp, Artificial Sequence; identical to SEQ ID NO: 53771
  Description of Artificial Sequence: Synthetic oligonucleotide

SEQ ID NO: 391249 - DNA, 32 bp, Artificial Sequence; identical to SEQ ID NO: 53772
  Description of Artificial Sequence: Synthetic oligonucleotide

SEQ ID NO: 391250 - DNA, 32 bp, Artificial Sequence; identical to SEQ ID NO: 53773
  Description of Artificial Sequence: Synthetic oligonucleotide

SEQ ID NO: 391251 - DNA, 32 bp, Artificial Sequence; identical to SEQ ID NO: 53774
  Description of Artificial Sequence: Synthetic oligonucleotide

SEQ ID NO: 391252 - DNA, 31 bp, Artificial Sequence; identical to SEQ ID NO: 53775
  Description of Artificial Sequence: Synthetic oligonucleotide

SEQ ID NO: 391253 - DNA, 32 bp, Artificial Sequence; identical to SEQ ID NO: 53776
  Description of Artificial Sequence: Synthetic oligonucleotide

SEQ ID NO: 391254 - DNA, 31 bp, Artificial Sequence; identical to SEQ ID NO: 53777
  Description of Artificial Sequence: Synthetic oligonucleotide

SEQ ID NO: 391255 - DNA, 25 bp, Artificial Sequence
  Description of Artificial Sequence: Synthetic oligonucleotide
agctggggcggcctgatgaggacta

SEQ ID NO: 391256 - DNA, 24 bp, Artificial Sequence
  Description of Artificial Sequence: Synthetic oligonucleotide
gctggggcggcctgatgaggacta

SEQ ID NO: 391257 - DNA, 25 bp, Artificial Sequence
  Description of Artificial Sequence: Synthetic oligonucleotide
ctggggcggcctgatgaggactact

SEQ ID NO: 391258 - DNA, 25 bp, Artificial Sequence
  Description of Artificial Sequence: Synthetic oligonucleotide
tggggcggcctgatgaggactactg

SEQ ID NO: 391259 - DNA, 24 bp, Artificial Sequence
  Description of Artificial Sequence: Synthetic oligonucleotide
ggggcggcctgatgaggactactg

SEQ ID NO: 391260 - DNA, 26 bp, Artificial Sequence
  Description of Artificial Sequence: Synthetic oligonucleotide
gggcggcctgatgaggactactggaa

SEQ ID NO: 391261 - DNA, 27 bp, Artificial Sequence
  Description of Artificial Sequence: Synthetic oligonucleotide
ggcggcctgatgaggactactggaaca

SEQ ID NO: 391262 - DNA, 27 bp, Artificial Sequence
  Description of Artificial Sequence: Synthetic oligonucleotide
gcggcctgatgaggactactggaacag

SEQ ID NO: 391263 - DNA, 27 bp, Artificial Sequence
  Description of Artificial Sequence: Synthetic oligonucleotide
cggcctgatgaggactactggaacagc

SEQ ID NO: 391264 - DNA, 27 bp, Artificial Sequence
  Description of Artificial Sequence: Synthetic oligonucleotide
ggcctgatgaggactactggaacagcc

SEQ ID NO: 391265 - DNA, 28 bp, Artificial Sequence
  Description of Artificial Sequence: Synthetic oligonucleotide
gcctgatgaggactactggaacagccag

SEQ ID NO: 391266 - DNA, 30 bp, Artificial Sequence; identical to SEQ ID NO: 53789
  Description of Artificial Sequence: Synthetic oligonucleotide

SEQ ID NO: 391267 - DNA, 30 bp, Artificial Sequence; identical to SEQ ID NO: 53790
  Description of Artificial Sequence: Synthetic oligonucleotide

SEQ ID NO: 391268 - DNA, 31 bp, Artificial Sequence; identical to SEQ ID NO: 53791
  Description of Artificial Sequence: Synthetic oligonucleotide

SEQ ID NO: 391269 - DNA, 30 bp, Artificial Sequence; identical to SEQ ID NO: 53792
  Description of Artificial Sequence: Synthetic oligonucleotide

SEQ ID NO: 391270 - DNA, 30 bp, Artificial Sequence; identical to SEQ ID NO: 53793
  Description of Artificial Sequence: Synthetic oligonucleotide

SEQ ID NO: 391271 - DNA, 29 bp, Artificial Sequence
  Description of Artificial Sequence: Synthetic oligonucleotide
tgaggactactggaacagccagaaggacc

SEQ ID NO: 391272 - DNA, 28 bp, Artificial Sequence
  Description of Artificial Sequence: Synthetic oligonucleotide
gaggactactggaacagccagaaggacc

SEQ ID NO: 391273 - DNA, 29 bp, Artificial Sequence
  Description of Artificial Sequence: Synthetic oligonucleotide
aggactactggaacagccagaaggacctc

SEQ ID NO: 391274 - DNA, 28 bp, Artificial Sequence
  Description of Artificial Sequence: Synthetic oligonucleotide
ggactactggaacagccagaaggacctc

SEQ ID NO: 391275 - DNA, 28 bp, Artificial Sequence
  Description of Artificial Sequence: Synthetic oligonucleotide
gactactggaacagccagaaggacctcc

SEQ ID NO: 391276 - DNA, 29 bp, Artificial Sequence
  Description of Artificial Sequence: Synthetic oligonucleotide
actactggaacagccagaaggacctcctg

SEQ ID NO: 391277 - DNA, 28 bp, Artificial Sequence
  Description of Artificial Sequence: Synthetic oligonucleotide
ctactggaacagccagaaggacctcctg

SEQ ID NO: 391278 - DNA, 28 bp, Artificial Sequence
  Description of Artificial Sequence: Synthetic oligonucleotide
tactggaacagccagaaggacctcctgg

SEQ ID NO: 391279 - DNA, 27 bp, Artificial Sequence
  Description of Artificial Sequence: Synthetic oligonucleotide
actggaacagccagaaggacctcctgg

SEQ ID NO: 391280 - DNA, 27 bp, Artificial Sequence
  Description of Artificial Sequence: Synthetic oligonucleotide
ctggaacagccagaaggacctcctgga

SEQ ID NO: 391281 - DNA, 27 bp, Artificial Sequence
  Description of Artificial Sequence: Synthetic oligonucleotide
tggaacagccagaaggacctcctggag

SEQ ID NO: 391282 - DNA, 26 bp, Artificial Sequence
  Description of Artificial Sequence: Synthetic oligonucleotide
ggaacagccagaaggacctcctggag

SEQ ID NO: 391283 - DNA, 27 bp, Artificial Sequence
  Description of Artificial Sequence: Synthetic oligonucleotide
gaacagccagaaggacctcctggagga

SEQ ID NO: 391284 - DNA, 27 bp, Artificial Sequence
  Description of Artificial Sequence: Synthetic oligonucleotide
aacagccagaaggacctcctggaggag

SEQ ID NO: 391285 - DNA, 27 bp, Artificial Sequence
  Description of Artificial Sequence: Synthetic oligonucleotide
acagccagaaggacctcctggaggaga

SEQ ID NO: 391286 - DNA, 27 bp, Artificial Sequence
  Description of Artificial Sequence: Synthetic oligonucleotide
cagccagaaggacctcctggaggagaa

SEQ ID NO: 391287 - DNA, 27 bp, Artificial Sequence
  Description of Artificial Sequence: Synthetic oligonucleotide
agccagaaggacctcctggaggagaag

SEQ ID NO: 391288 - DNA, 26 bp, Artificial Sequence
  Description of Artificial Sequence: Synthetic oligonucleotide
gccagaaggacctcctggaggagaag

SEQ ID NO: 391289 - DNA, 26 bp, Artificial Sequence
  Description of Artificial Sequence: Synthetic oligonucleotide
ccagaaggacctcctggaggagaagc

SEQ ID NO: 391290 - DNA, 26 bp, Artificial Sequence
  Description of Artificial Sequence: Synthetic oligonucleotide
cagaaggacctcctggaggagaagcg

SEQ ID NO: 391291 - DNA, 26 bp, Artificial Sequence
  Description of Artificial Sequence: Synthetic oligonucleotide
agaaggacctcctggaggagaagcgg

SEQ ID NO: 391292 - DNA, 25 bp, Artificial Sequence
  Description of Artificial Sequence: Synthetic oligonucleotide
gaaggacctcctggaggagaagcgg

SEQ ID NO: 391293 - DNA, 25 bp, Artificial Sequence
  Description of Artificial Sequence: Synthetic oligonucleotide
aaggacctcctggaggagaagcggg

SEQ ID NO: 391294 - DNA, 24 bp, Artificial Sequence
  Description of Artificial Sequence: Synthetic oligonucleotide
aggacctcctggaggagaagcggg

SEQ ID NO: 391295 - DNA, 23 bp, Artificial Sequence
  Description of Artificial Sequence: Synthetic oligonucleotide
ggacctcctggaggagaagcggg

SEQ ID NO: 391296 - DNA, 24 bp, Artificial Sequence
  Description of Artificial Sequence: Synthetic oligonucleotide
gacctcctggaggagaagcgggca

SEQ ID NO: 391297 - DNA, 25 bp, Artificial Sequence
  Description of Artificial Sequence: Synthetic oligonucleotide
acctcctggaggagaagcgggcagt

SEQ ID NO: 391298 - DNA, 24 bp, Artificial Sequence
  Description of Artificial Sequence: Synthetic oligonucleotide
cctcctggaggagaagcgggcagt

SEQ ID NO: 391299 - DNA, 24 bp, Artificial Sequence
  Description of Artificial Sequence: Synthetic oligonucleotide
ctcctggaggagaagcgggcagtg

SEQ ID NO: 391300 - DNA, 24 bp, Artificial Sequence
  Description of Artificial Sequence: Synthetic oligonucleotide
gagctggacgaggccgtgacccta

SEQ ID NO: 391301 - DNA, 25 bp, Artificial Sequence
  Description of Artificial Sequence: Synthetic oligonucleotide
agctggacgaggccgtgaccctaca

SEQ ID NO: 391302 - DNA, 24 bp, Artificial Sequence
  Description of Artificial Sequence: Synthetic oligonucleotide
gctggacgaggccgtgaccctaca

SEQ ID NO: 391303 - DNA, 24 bp, Artificial Sequence
  Description of Artificial Sequence: Synthetic oligonucleotide
ctggacgaggccgtgaccctacag

SEQ ID NO: 391304 - DNA, 24 bp, Artificial Sequence
  Description of Artificial Sequence: Synthetic oligonucleotide
tggacgaggccgtgaccctacagc

SEQ ID NO: 391305 - DNA, 23 bp, Artificial Sequence
  Description of Artificial Sequence: Synthetic oligonucleotide
ggacgaggccgtgaccctacagc

SEQ ID NO: 391306 - DNA, 23 bp, Artificial Sequence
  Description of Artificial Sequence: Synthetic oligonucleotide
gacgaggccgtgaccctacagcg

SEQ ID NO: 391307 - DNA, 23 bp, Artificial Sequence
  Description of Artificial Sequence: Synthetic oligonucleotide
acgaggccgtgaccctacagcgc

SEQ ID NO: 391308 - DNA, 22 bp, Artificial Sequence
  Description of Artificial Sequence: Synthetic oligonucleotide
cgaggccgtgaccctacagcgc

SEQ ID NO: 391309 - DNA, 22 bp, Artificial Sequence
  Description of Artificial Sequence: Synthetic oligonucleotide
gaggccgtgaccctacagcgcc

SEQ ID NO: 391310 - DNA, 23 bp, Artificial Sequence
  Description of Artificial Sequence: Synthetic oligonucleotide
aggccgtgaccctacagcgccga

SEQ ID NO: 391311 - DNA, 22 bp, Artificial Sequence
  Description of Artificial Sequence: Synthetic oligonucleotide
ggccgtgaccctacagcgccga

SEQ ID NO: 391312 - DNA, 22 bp, Artificial Sequence
  Description of Artificial Sequence: Synthetic oligonucleotide
gccgtgaccctacagcgccgag

SEQ ID NO: 391313 - DNA, 31 bp, Artificial Sequence; identical to SEQ ID NO: 53836
  Description of Artificial Sequence: Synthetic oligonucleotide

SEQ ID NO: 391314 - DNA, 30 bp, Artificial Sequence; identical to SEQ ID NO: 53837
  Description of Artificial Sequence: Synthetic oligonucleotide

SEQ ID NO: 391315 - DNA, 30 bp, Artificial Sequence; identical to SEQ ID NO: 53838
  Description of Artificial Sequence: Synthetic oligonucleotide

SEQ ID NO: 391316 - DNA, 29 bp, Artificial Sequence
  Description of Artificial Sequence: Synthetic oligonucleotide
gatacatctacaaccgggaggagttcgcg

SEQ ID NO: 391317 - DNA, 29 bp, Artificial Sequence
  Description of Artificial Sequence: Synthetic oligonucleotide
atacatctacaaccgggaggagttcgcgc

SEQ ID NO: 391318 - DNA, 28 bp, Artificial Sequence
  Description of Artificial Sequence: Synthetic oligonucleotide
tacatctacaaccgggaggagttcgcgc

SEQ ID NO: 391319 - DNA, 27 bp, Artificial Sequence
  Description of Artificial Sequence: Synthetic oligonucleotide
acatctacaaccgggaggagttcgcgc

SEQ ID NO: 391320 - DNA, 26 bp, Artificial Sequence
  Description of Artificial Sequence: Synthetic oligonucleotide
catctacaaccgggaggagttcgcgc

SEQ ID NO: 391321 - DNA, 26 bp, Artificial Sequence
  Description of Artificial Sequence: Synthetic oligonucleotide
atctacaaccgggaggagttcgcgcg

SEQ ID NO: 391322 - DNA, 25 bp, Artificial Sequence
  Description of Artificial Sequence: Synthetic oligonucleotide
tctacaaccgggaggagttcgcgcg

SEQ ID NO: 391323 - DNA, 24 bp, Artificial Sequence
  Description of Artificial Sequence: Synthetic oligonucleotide
ctacaaccgggaggagttcgcgcg

SEQ ID NO: 391324 - DNA, 26 bp, Artificial Sequence
  Description of Artificial Sequence: Synthetic oligonucleotide
tacaaccgggaggagttcgcgcgctt

SEQ ID NO: 391325 - DNA, 25 bp, Artificial Sequence
  Description of Artificial Sequence: Synthetic oligonucleotide
acaaccgggaggagttcgcgcgctt

SEQ ID NO: 391326 - DNA, 24 bp, Artificial Sequence
  Description of Artificial Sequence: Synthetic oligonucleotide
caaccgggaggagttcgcgcgctt

SEQ ID NO: 391327 - DNA, 24 bp, Artificial Sequence
  Description of Artificial Sequence: Synthetic oligonucleotide
aaccgggaggagttcgcgcgcttc

SEQ ID NO: 391328 - DNA, 23 bp, Artificial Sequence
  Description of Artificial Sequence: Synthetic oligonucleotide
accgggaggagttcgcgcgcttc

SEQ ID NO: 391329 - DNA, 22 bp, Artificial Sequence
  Description of Artificial Sequence: Synthetic oligonucleotide
ccgggaggagttcgcgcgcttc

SEQ ID NO: 391330 - DNA, 23 bp, Artificial Sequence
  Description of Artificial Sequence: Synthetic oligonucleotide
cgggaggagttcgcgcgcttcga

SEQ ID NO: 391331 - DNA, 24 bp, Artificial Sequence
  Description of Artificial Sequence: Synthetic oligonucleotide
gggaggagttcgcgcgcttcgaca

SEQ ID NO: 391332 - DNA, 24 bp, Artificial Sequence
  Description of Artificial Sequence: Synthetic oligonucleotide
ggaggagttcgcgcgcttcgacag

SEQ ID NO: 391333 - DNA, 24 bp, Artificial Sequence
  Description of Artificial Sequence: Synthetic oligonucleotide
gaggagttcgcgcgcttcgacagc

SEQ ID NO: 391334 - DNA, 25 bp, Artificial Sequence
  Description of Artificial Sequence: Synthetic oligonucleotide
aggagttcgcgcgcttcgacagcga

SEQ ID NO: 391335 - DNA, 24 bp, Artificial Sequence
  Description of Artificial Sequence: Synthetic oligonucleotide
ggagttcgcgcgcttcgacagcga

SEQ ID NO: 391336 - DNA, 24 bp, Artificial Sequence
  Description of Artificial Sequence: Synthetic oligonucleotide
gagttcgcgcgcttcgacagcgac

SEQ ID NO: 391337 - DNA, 25 bp, Artificial Sequence
  Description of Artificial Sequence: Synthetic oligonucleotide
agttcgcgcgcttcgacagcgacgt

SEQ ID NO: 391338 - DNA, 24 bp, Artificial Sequence
  Description of Artificial Sequence: Synthetic oligonucleotide
gttcgcgcgcttcgacagcgacgt

SEQ ID NO: 391339 - DNA, 24 bp, Artificial Sequence
  Description of Artificial Sequence: Synthetic oligonucleotide
ttcgcgcgcttcgacagcgacgtg

SEQ ID NO: 391340 - DNA, 23 bp, Artificial Sequence
  Description of Artificial Sequence: Synthetic oligonucleotide
tcgcgcgcttcgacagcgacgtg

SEQ ID NO: 391341 - DNA, 25 bp, Artificial Sequence
  Description of Artificial Sequence: Synthetic oligonucleotide
agaagcgggcagtgccggacaggat

SEQ ID NO: 391342 - DNA, 24 bp, Artificial Sequence
  Description of Artificial Sequence: Synthetic oligonucleotide
gaagcgggcagtgccggacaggat

SEQ ID NO: 391343 - DNA, 25 bp, Artificial Sequence
  Description of Artificial Sequence: Synthetic oligonucleotide
aagcgggcagtgccggacaggatgt

SEQ ID NO: 391344 - DNA, 28 bp, Artificial Sequence
  Description of Artificial Sequence: Synthetic oligonucleotide
cagaaggacatcctggaggagaagcgtg

SEQ ID NO: 391345 - DNA, 28 bp, Artificial Sequence
  Description of Artificial Sequence: Synthetic oligonucleotide
agaaggacatcctggaggagaagcgtgc

SEQ ID NO: 391346 - DNA, 27 bp, Artificial Sequence
  Description of Artificial Sequence: Synthetic oligonucleotide
gaaggacatcctggaggagaagcgtgc

SEQ ID NO: 391347 - DNA, 28 bp, Artificial Sequence
  Description of Artificial Sequence: Synthetic oligonucleotide
aaggacatcctggaggagaagcgtgcag

SEQ ID NO: 391348 - DNA, 27 bp, Artificial Sequence
  Description of Artificial Sequence: Synthetic oligonucleotide
aggacatcctggaggagaagcgtgcag

SEQ ID NO: 391349 - DNA, 27 bp, Artificial Sequence
  Description of Artificial Sequence: Synthetic oligonucleotide
ggacatcctggaggagaagcgtgcagt

SEQ ID NO: 391350 - DNA, 27 bp, Artificial Sequence
  Description of Artificial Sequence: Synthetic oligonucleotide
gacatcctggaggagaagcgtgcagtg

SEQ ID NO: 391351 - DNA, 27 bp, Artificial Sequence
  Description of Artificial Sequence: Synthetic oligonucleotide
acatcctggaggagaagcgtgcagtgc

SEQ ID NO: 391352 - DNA, 26 bp, Artificial Sequence
  Description of Artificial Sequence: Synthetic oligonucleotide
catcctggaggagaagcgtgcagtgc

SEQ ID NO: 391353 - DNA, 26 bp, Artificial Sequence
  Description of Artificial Sequence: Synthetic oligonucleotide
atcctggaggagaagcgtgcagtgcc

SEQ ID NO: 391354 - DNA, 25 bp, Artificial Sequence
  Description of Artificial Sequence: Synthetic oligonucleotide
tcctggaggagaagcgtgcagtgcc

SEQ ID NO: 391355 - DNA, 24 bp, Artificial Sequence
  Description of Artificial Sequence: Synthetic oligonucleotide
cctggaggagaagcgtgcagtgcc

SEQ ID NO: 391356 - DNA, 24 bp, Artificial Sequence
  Description of Artificial Sequence: Synthetic oligonucleotide
ctggaggagaagcgtgcagtgccg

SEQ ID NO: 391357 - DNA, 25 bp, Artificial Sequence
  Description of Artificial Sequence: Synthetic oligonucleotide
tggaggagaagcgtgcagtgccgga

SEQ ID NO: 391358 - DNA, 24 bp, Artificial Sequence
  Description of Artificial Sequence: Synthetic oligonucleotide
ggaggagaagcgtgcagtgccgga

SEQ ID NO: 391359 - DNA, 25 bp, Artificial Sequence
  Description of Artificial Sequence: Synthetic oligonucleotide
gaggagaagcgtgcagtgccggaca

SEQ ID NO: 391360 - DNA, 25 bp, Artificial Sequence
  Description of Artificial Sequence: Synthetic oligonucleotide
aggagaagcgtgcagtgccggacag

SEQ ID NO: 391361 - DNA, 24 bp, Artificial Sequence
  Description of Artificial Sequence: Synthetic oligonucleotide
ggagaagcgtgcagtgccggacag

SEQ ID NO: 391362 - DNA, 26 bp, Artificial Sequence
  Description of Artificial Sequence: Synthetic oligonucleotide
gagaagcgtgcagtgccggacaggat

SEQ ID NO: 391363 - DNA, 27 bp, Artificial Sequence
  Description of Artificial Sequence: Synthetic oligonucleotide
agaagcgtgcagtgccggacaggatgt

SEQ ID NO: 391364 - DNA, 26 bp, Artificial Sequence
  Description of Artificial Sequence: Synthetic oligonucleotide
gaagcgtgcagtgccggacaggatgt

SEQ ID NO: 391365 - DNA, 26 bp, Artificial Sequence
  Description of Artificial Sequence: Synthetic oligonucleotide
aagcgtgcagtgccggacaggatgtg

SEQ ID NO: 391366 - DNA, 25 bp, Artificial Sequence
  Description of Artificial Sequence: Synthetic oligonucleotide
agcgtgcagtgccggacaggatgtg

SEQ ID NO: 391367 - DNA, 24 bp, Artificial Sequence
  Description of Artificial Sequence: Synthetic oligonucleotide
gcgtgcagtgccggacaggatgtg

SEQ ID NO: 391368 - DNA, 25 bp, Artificial Sequence
  Description of Artificial Sequence: Synthetic oligonucleotide
cgtgcagtgccggacaggatgtgca

SEQ ID NO: 391369 - DNA, 26 bp, Artificial Sequence
  Description of Artificial Sequence: Synthetic oligonucleotide
gtgcagtgccggacaggatgtgcaga

SEQ ID NO: 391370 - DNA, 27 bp, Artificial Sequence
  Description of Artificial Sequence: Synthetic oligonucleotide
tgcagtgccggacaggatgtgcagaca

SEQ ID NO: 391371 - DNA, 27 bp, Artificial Sequence
  Description of Artificial Sequence: Synthetic oligonucleotide
acacctgccaagtggagcacaccagca

SEQ ID NO: 391372 - DNA, 27 bp, Artificial Sequence
  Description of Artificial Sequence: Synthetic oligonucleotide
cacctgccaagtggagcacaccagcat

SEQ ID NO: 391373 - DNA, 27 bp, Artificial Sequence
  Description of Artificial Sequence: Synthetic oligonucleotide
acctgccaagtggagcacaccagcatg

SEQ ID NO: 391374 - DNA, 26 bp, Artificial Sequence
  Description of Artificial Sequence: Synthetic oligonucleotide
cctgccaagtggagcacaccagcatg

SEQ ID NO: 391375 - DNA, 27 bp, Artificial Sequence
  Description of Artificial Sequence: Synthetic oligonucleotide
ctgccaagtggagcacaccagcatgga

SEQ ID NO: 391376 - DNA, 29 bp, Artificial Sequence
  Description of Artificial Sequence: Synthetic oligonucleotide
tgccaagtggagcacaccagcatggatag

SEQ ID NO: 391377 - DNA, 28 bp, Artificial Sequence
  Description of Artificial Sequence: Synthetic oligonucleotide
gccaagtggagcacaccagcatggatag

SEQ ID NO: 391378 - DNA, 29 bp, Artificial Sequence
  Description of Artificial Sequence: Synthetic oligonucleotide
ccaagtggagcacaccagcatggatagtc

SEQ ID NO: 391379 - DNA, 29 bp, Artificial Sequence
  Description of Artificial Sequence: Synthetic oligonucleotide
caagtggagcacaccagcatggatagtcc

SEQ ID NO: 391380 - DNA, 30 bp, Artificial Sequence; identical to SEQ ID NO: 53903
  Description of Artificial Sequence: Synthetic oligonucleotide

SEQ ID NO: 391381 - DNA, 29 bp, Artificial Sequence
  Description of Artificial Sequence: Synthetic oligonucleotide
agtggagcacaccagcatggatagtcctg

SEQ ID NO: 391382 - DNA, 28 bp, Artificial Sequence
  Description of Artificial Sequence: Synthetic oligonucleotide
gtggagcacaccagcatggatagtcctg

SEQ ID NO: 391383 - DNA, 29 bp, Artificial Sequence
  Description of Artificial Sequence: Synthetic oligonucleotide
tggagcacaccagcatggatagtcctgtc

SEQ ID NO: 391384 - DNA, 28 bp, Artificial Sequence
  Description of Artificial Sequence: Synthetic oligonucleotide
ggagcacaccagcatggatagtcctgtc

SEQ ID NO: 391385 - DNA, 29 bp, Artificial Sequence
  Description of Artificial Sequence: Synthetic oligonucleotide
gagcacaccagcatggatagtcctgtcac

SEQ ID NO: 391386 - DNA, 29 bp, Artificial Sequence
  Description of Artificial Sequence: Synthetic oligonucleotide
agcacaccagcatggatagtcctgtcacc

SEQ ID NO: 391387 - DNA, 28 bp, Artificial Sequence
  Description of Artificial Sequence: Synthetic oligonucleotide
gcacaccagcatggatagtcctgtcacc

SEQ ID NO: 391388 - DNA, 28 bp, Artificial Sequence
  Description of Artificial Sequence: Synthetic oligonucleotide
cacaccagcatggatagtcctgtcaccg

SEQ ID NO: 391389 - DNA, 29 bp, Artificial Sequence
  Description of Artificial Sequence: Synthetic oligonucleotide
acaccagcatggatagtcctgtcaccgtg

SEQ ID NO: 391390 - DNA, 28 bp, Artificial Sequence
  Description of Artificial Sequence: Synthetic oligonucleotide
caccagcatggatagtcctgtcaccgtg

SEQ ID NO: 391391 - DNA, 28 bp, Artificial Sequence
  Description of Artificial Sequence: Synthetic oligonucleotide
accagcatggatagtcctgtcaccgtgg

SEQ ID NO: 391392 - DNA, 27 bp, Artificial Sequence
  Description of Artificial Sequence: Synthetic oligonucleotide
ccagcatggatagtcctgtcaccgtgg

SEQ ID NO: 391393 - DNA, 28 bp, Artificial Sequence
  Description of Artificial Sequence: Synthetic oligonucleotide
cagcatggatagtcctgtcaccgtggag

SEQ ID NO: 391394 - DNA, 29 bp, Artificial Sequence
  Description of Artificial Sequence: Synthetic oligonucleotide
agcatggatagtcctgtcaccgtggagtg

SEQ ID NO: 391395 - DNA, 28 bp, Artificial Sequence
  Description of Artificial Sequence: Synthetic oligonucleotide
gcatggatagtcctgtcaccgtggagtg

SEQ ID NO: 391396 - DNA, 28 bp, Artificial Sequence
  Description of Artificial Sequence: Synthetic oligonucleotide
catggatagtcctgtcaccgtggagtgg

SEQ ID NO: 391397 - DNA, 30 bp, Artificial Sequence; identical to SEQ ID NO: 53920
  Description of Artificial Sequence: Synthetic oligonucleotide

SEQ ID NO: 391398 - DNA, 30 bp, Artificial Sequence; identical to SEQ ID NO: 53921
  Description of Artificial Sequence: Synthetic oligonucleotide

SEQ ID NO: 391399 - DNA, 29 bp, Artificial Sequence
  Description of Artificial Sequence: Synthetic oligonucleotide
ggatgtgcagacacaactacgagctggac

SEQ ID NO: 391400 - DNA, 29 bp, Artificial Sequence
  Description of Artificial Sequence: Synthetic oligonucleotide
gatgtgcagacacaactacgagctggacg

SEQ ID NO: 391401 - DNA, 30 bp, Artificial Sequence; identical to SEQ ID NO: 53924
  Description of Artificial Sequence: Synthetic oligonucleotide

SEQ ID NO: 391402 - DNA, 29 bp, Artificial Sequence
  Description of Artificial Sequence: Synthetic oligonucleotide
tgtgcagacacaactacgagctggacgag

SEQ ID NO: 391403 - DNA, 28 bp, Artificial Sequence
  Description of Artificial Sequence: Synthetic oligonucleotide
gtgcagacacaactacgagctggacgag

SEQ ID NO: 391404 - DNA, 27 bp, Artificial Sequence
  Description of Artificial Sequence: Synthetic oligonucleotide
agacattgacgggagctgggggcttca

SEQ ID NO: 391405 - DNA, 27 bp, Artificial Sequence
  Description of Artificial Sequence: Synthetic oligonucleotide
gacattgacgggagctgggggcttcat

SEQ ID NO: 391406 - DNA, 27 bp, Artificial Sequence
  Description of Artificial Sequence: Synthetic oligonucleotide
acattgacgggagctgggggcttcatg

SEQ ID NO: 391407 - DNA, 26 bp, Artificial Sequence
  Description of Artificial Sequence: Synthetic oligonucleotide
cattgacgggagctgggggcttcatg

SEQ ID NO: 391408 - DNA, 27 bp, Artificial Sequence
  Description of Artificial Sequence: Synthetic oligonucleotide
attgacgggagctgggggcttcatgct

SEQ ID NO: 391409 - DNA, 26 bp, Artificial Sequence
  Description of Artificial Sequence: Synthetic oligonucleotide
ttgacgggagctgggggcttcatgct

SEQ ID NO: 391410 - DNA, 25 bp, Artificial Sequence
  Description of Artificial Sequence: Synthetic oligonucleotide
tgacgggagctgggggcttcatgct

SEQ ID NO: 391411 - DNA, 24 bp, Artificial Sequence
  Description of Artificial Sequence: Synthetic oligonucleotide
gacgggagctgggggcttcatgct

SEQ ID NO: 391412 - DNA, 24 bp, Artificial Sequence
  Description of Artificial Sequence: Synthetic oligonucleotide
acgggagctgggggcttcatgctg

SEQ ID NO: 391413 - DNA, 23 bp, Artificial Sequence
  Description of Artificial Sequence: Synthetic oligonucleotide
cgggagctgggggcttcatgctg

SEQ ID NO: 391414 - DNA, 23 bp, Artificial Sequence
  Description of Artificial Sequence: Synthetic oligonucleotide
gggagctgggggcttcatgctgg

SEQ ID NO: 391415 - DNA, 23 bp, Artificial Sequence
  Description of Artificial Sequence: Synthetic oligonucleotide
ggagctgggggcttcatgctggg

SEQ ID NO: 391416 - DNA, 23 bp, Artificial Sequence
  Description of Artificial Sequence: Synthetic oligonucleotide
gagctgggggcttcatgctgggg

SEQ ID NO: 391417 - DNA, 24 bp, Artificial Sequence
  Description of Artificial Sequence: Synthetic oligonucleotide
agctgggggcttcatgctggggct

SEQ ID NO: 391418 - DNA, 23 bp, Artificial Sequence
  Description of Artificial Sequence: Synthetic oligonucleotide
gctgggggcttcatgctggggct

SEQ ID NO: 391419 - DNA, 25 bp, Artificial Sequence
  Description of Artificial Sequence: Synthetic oligonucleotide
ctgggggcttcatgctggggctcat

SEQ ID NO: 391420 - DNA, 27 bp, Artificial Sequence
  Description of Artificial Sequence: Synthetic oligonucleotide
tgggggcttcatgctggggctcatcat

SEQ ID NO: 391421 - DNA, 26 bp, Artificial Sequence
  Description of Artificial Sequence: Synthetic oligonucleotide
gggggcttcatgctggggctcatcat

SEQ ID NO: 391422 - DNA, 27 bp, Artificial Sequence
  Description of Artificial Sequence: Synthetic oligonucleotide
ggggcttcatgctggggctcatcatct

SEQ ID NO: 391423 - DNA, 27 bp, Artificial Sequence
  Description of Artificial Sequence: Synthetic oligonucleotide
gggcttcatgctggggctcatcatctg

SEQ ID NO: 391424 - DNA, 28 bp, Artificial Sequence
  Description of Artificial Sequence: Synthetic oligonucleotide
ggcttcatgctggggctcatcatctgtg

SEQ ID NO: 391425 - DNA, 28 bp, Artificial Sequence
  Description of Artificial Sequence: Synthetic oligonucleotide
gcttcatgctggggctcatcatctgtgg

SEQ ID NO: 391426 - DNA, 29 bp, Artificial Sequence
  Description of Artificial Sequence: Synthetic oligonucleotide
cttcatgctggggctcatcatctgtggag

SEQ ID NO: 391427 - DNA, 30 bp, Artificial Sequence; identical to SEQ ID NO: 53950
  Description of Artificial Sequence: Synthetic oligonucleotide

SEQ ID NO: 391428 - DNA, 29 bp, Artificial Sequence
  Description of Artificial Sequence: Synthetic oligonucleotide
tcatgctggggctcatcatctgtggagtg

SEQ ID NO: 391429 - DNA, 28 bp, Artificial Sequence
  Description of Artificial Sequence: Synthetic oligonucleotide
catgctggggctcatcatctgtggagtg

SEQ ID NO: 391430 - DNA, 28 bp, Artificial Sequence
  Description of Artificial Sequence: Synthetic oligonucleotide
atgctggggctcatcatctgtggagtgg

SEQ ID NO: 391431 - DNA, 27 bp, Artificial Sequence
  Description of Artificial Sequence: Synthetic oligonucleotide
gaccccccagcagggagatgtctacat

SEQ ID NO: 391432 - DNA, 27 bp, Artificial Sequence
  Description of Artificial Sequence: Synthetic oligonucleotide
accccccagcagggagatgtctacatc

SEQ ID NO: 391433 - DNA, 27 bp, Artificial Sequence
  Description of Artificial Sequence: Synthetic oligonucleotide
ccccccagcagggagatgtctacatct

SEQ ID NO: 391434 - DNA, 27 bp, Artificial Sequence
  Description of Artificial Sequence: Synthetic oligonucleotide
cccccagcagggagatgtctacatctg

SEQ ID NO: 391435 - DNA, 27 bp, Artificial Sequence
  Description of Artificial Sequence: Synthetic oligonucleotide
ccccagcagggagatgtctacatctgc

SEQ ID NO: 391436 - DNA, 27 bp, Artificial Sequence
  Description of Artificial Sequence: Synthetic oligonucleotide
cccagcagggagatgtctacatctgcc

SEQ ID NO: 391437 - DNA, 29 bp, Artificial Sequence
  Description of Artificial Sequence: Synthetic oligonucleotide
ccagcagggagatgtctacatctgccaag

SEQ ID NO: 391438 - DNA, 30 bp, Artificial Sequence; identical to SEQ ID NO: 53961
  Description of Artificial Sequence: Synthetic oligonucleotide

SEQ ID NO: 391439 - DNA, 30 bp, Artificial Sequence; identical to SEQ ID NO: 53962
  Description of Artificial Sequence: Synthetic oligonucleotide

SEQ ID NO: 391440 - DNA, 29 bp, Artificial Sequence
  Description of Artificial Sequence: Synthetic oligonucleotide
gcagggagatgtctacatctgccaagtgg

SEQ ID NO: 391441 - DNA, 30 bp, Artificial Sequence; identical to SEQ ID NO: 53964
  Description of Artificial Sequence: Synthetic oligonucleotide

SEQ ID NO: 391442 - DNA, 30 bp, Artificial Sequence; identical to SEQ ID NO: 53965
  Description of Artificial Sequence: Synthetic oligonucleotide

SEQ ID NO: 391443 - DNA, 29 bp, Artificial Sequence
  Description of Artificial Sequence: Synthetic oligonucleotide
gggagatgtctacatctgccaagtggagc

SEQ ID NO: 391444 - DNA, 30 bp, Artificial Sequence; identical to SEQ ID NO: 53967
  Description of Artificial Sequence: Synthetic oligonucleotide

SEQ ID NO: 391445 - DNA, 31 bp, Artificial Sequence; identical to SEQ ID NO: 53968
  Description of Artificial Sequence: Synthetic oligonucleotide

SEQ ID NO: 391446 - DNA, 31 bp, Artificial Sequence; identical to SEQ ID NO: 53969
  Description of Artificial Sequence: Synthetic oligonucleotide

SEQ ID NO: 391447 - DNA, 30 bp, Artificial Sequence; identical to SEQ ID NO: 53970
  Description of Artificial Sequence: Synthetic oligonucleotide

SEQ ID NO: 391448 - DNA, 31 bp, Artificial Sequence; identical to SEQ ID NO: 53971
  Description of Artificial Sequence: Synthetic oligonucleotide

SEQ ID NO: 391449 - DNA, 30 bp, Artificial Sequence; identical to SEQ ID NO: 53972
  Description of Artificial Sequence: Synthetic oligonucleotide

SEQ ID NO: 391450 - DNA, 26 bp, Artificial Sequence
  Description of Artificial Sequence: Synthetic oligonucleotide
acagccagaaggacctcctggaggag

SEQ ID NO: 391451 - DNA, 25 bp, Artificial Sequence
  Description of Artificial Sequence: Synthetic oligonucleotide
cagccagaaggacctcctggaggag

SEQ ID NO: 391452 - DNA, 26 bp, Artificial Sequence
  Description of Artificial Sequence: Synthetic oligonucleotide
agccagaaggacctcctggaggagga

SEQ ID NO: 391453 - DNA, 25 bp, Artificial Sequence
  Description of Artificial Sequence: Synthetic oligonucleotide
gccagaaggacctcctggaggagga

SEQ ID NO: 391454 - DNA, 25 bp, Artificial Sequence
  Description of Artificial Sequence: Synthetic oligonucleotide
ccagaaggacctcctggaggaggag

SEQ ID NO: 391455 - DNA, 25 bp, Artificial Sequence
  Description of Artificial Sequence: Synthetic oligonucleotide
cagaaggacctcctggaggaggagc

SEQ ID NO: 391456 - DNA, 25 bp, Artificial Sequence
  Description of Artificial Sequence: Synthetic oligonucleotide
agaaggacctcctggaggaggagcg

SEQ ID NO: 391457 - DNA, 24 bp, Artificial Sequence
  Description of Artificial Sequence: Synthetic oligonucleotide
gaaggacctcctggaggaggagcg

SEQ ID NO: 391458 - DNA, 24 bp, Artificial Sequence
  Description of Artificial Sequence: Synthetic oligonucleotide
aaggacctcctggaggaggagcgg

SEQ ID NO: 391459 - DNA, 23 bp, Artificial Sequence
  Description of Artificial Sequence: Synthetic oligonucleotide
aggacctcctggaggaggagcgg

SEQ ID NO: 391460 - DNA, 22 bp, Artificial Sequence
  Description of Artificial Sequence: Synthetic oligonucleotide
ggacctcctggaggaggagcgg

SEQ ID NO: 391461 - DNA, 22 bp, Artificial Sequence
  Description of Artificial Sequence: Synthetic oligonucleotide
gacctcctggaggaggagcggg

SEQ ID NO: 391462 - DNA, 23 bp, Artificial Sequence
  Description of Artificial Sequence: Synthetic oligonucleotide
acctcctggaggaggagcgggca

SEQ ID NO: 391463 - DNA, 22 bp, Artificial Sequence
  Description of Artificial Sequence: Synthetic oligonucleotide
cctcctggaggaggagcgggca

SEQ ID NO: 391464 - DNA, 23 bp, Artificial Sequence
  Description of Artificial Sequence: Synthetic oligonucleotide
ctcctggaggaggagcgggcagt

SEQ ID NO: 391465 - DNA, 21 bp, Artificial Sequence
  Description of Artificial Sequence: Synthetic oligonucleotide
gagcgggcagtgccggacagg

SEQ ID NO: 391466 - DNA, 27 bp, Artificial Sequence
  Description of Artificial Sequence: Synthetic oligonucleotide
gcagggccactccagagaattacgtgc

SEQ ID NO: 391467 - DNA, 28 bp, Artificial Sequence
  Description of Artificial Sequence: Synthetic oligonucleotide
cagggccactccagagaattacgtgcac

SEQ ID NO: 391468 - DNA, 28 bp, Artificial Sequence
  Description of Artificial Sequence: Synthetic oligonucleotide
agggccactccagagaattacgtgcacc

SEQ ID NO: 391469 - DNA, 27 bp, Artificial Sequence
  Description of Artificial Sequence: Synthetic oligonucleotide
gggccactccagagaattacgtgcacc

SEQ ID NO: 391470 - DNA, 28 bp, Artificial Sequence
  Description of Artificial Sequence: Synthetic oligonucleotide
ggccactccagagaattacgtgcaccag

SEQ ID NO: 391471 - DNA, 31 bp, Artificial Sequence; identical to SEQ ID NO: 53994
  Description of Artificial Sequence: Synthetic oligonucleotide

SEQ ID NO: 391472 - DNA, 31 bp, Artificial Sequence; identical to SEQ ID NO: 53995
  Description of Artificial Sequence: Synthetic oligonucleotide

SEQ ID NO: 391473 - DNA, 31 bp, Artificial Sequence; identical to SEQ ID NO: 53996
  Description of Artificial Sequence: Synthetic oligonucleotide

SEQ ID NO: 391474 - DNA, 31 bp, Artificial Sequence; identical to SEQ ID NO: 53997
  Description of Artificial Sequence: Synthetic oligonucleotide

SEQ ID NO: 391475 - DNA, 30 bp, Artificial Sequence; identical to SEQ ID NO: 53998
  Description of Artificial Sequence: Synthetic oligonucleotide

SEQ ID NO: 391476 - DNA, 31 bp, Artificial Sequence; identical to SEQ ID NO: 53999
  Description of Artificial Sequence: Synthetic oligonucleotide

SEQ ID NO: 391477 - DNA, 30 bp, Artificial Sequence; identical to SEQ ID NO: 54000
  Description of Artificial Sequence: Synthetic oligonucleotide

SEQ ID NO: 391478 - DNA, 30 bp, Artificial Sequence; identical to SEQ ID NO: 54001
  Description of Artificial Sequence: Synthetic oligonucleotide

SEQ ID NO: 391479 - DNA, 33 bp, Artificial Sequence; identical to SEQ ID NO: 54002
  Description of Artificial Sequence: Synthetic oligonucleotide

SEQ ID NO: 391480 - DNA, 32 bp, Artificial Sequence; identical to SEQ ID NO: 54003
  Description of Artificial Sequence: Synthetic oligonucleotide

SEQ ID NO: 391481 - DNA, 32 bp, Artificial Sequence; identical to SEQ ID NO: 54004
  Description of Artificial Sequence: Synthetic oligonucleotide

SEQ ID NO: 391482 - DNA, 31 bp, Artificial Sequence; identical to SEQ ID NO: 54005
  Description of Artificial Sequence: Synthetic oligonucleotide

SEQ ID NO: 391483 - DNA, 33 bp, Artificial Sequence; identical to SEQ ID NO: 54006
  Description of Artificial Sequence: Synthetic oligonucleotide

SEQ ID NO: 391484 - DNA, 32 bp, Artificial Sequence; identical to SEQ ID NO: 54007
  Description of Artificial Sequence: Synthetic oligonucleotide

SEQ ID NO: 391485 - DNA, 31 bp, Artificial Sequence; identical to SEQ ID NO: 54008
  Description of Artificial Sequence: Synthetic oligonucleotide

SEQ ID NO: 391486 - DNA, 30 bp, Artificial Sequence; identical to SEQ ID NO: 54009
  Description of Artificial Sequence: Synthetic oligonucleotide

SEQ ID NO: 391487 - DNA, 29 bp, Artificial Sequence
  Description of Artificial Sequence: Synthetic oligonucleotide
acgtgcaccagttacggcaggaatgctac

SEQ ID NO: 391488 - DNA, 28 bp, Artificial Sequence
  Description of Artificial Sequence: Synthetic oligonucleotide
cgtgcaccagttacggcaggaatgctac

SEQ ID NO: 391489 - DNA, 28 bp, Artificial Sequence
  Description of Artificial Sequence: Synthetic oligonucleotide
gtgcaccagttacggcaggaatgctacg

SEQ ID NO: 391490 - DNA, 28 bp, Artificial Sequence
  Description of Artificial Sequence: Synthetic oligonucleotide
tgcaccagttacggcaggaatgctacgc

SEQ ID NO: 391491 - DNA, 27 bp, Artificial Sequence
  Description of Artificial Sequence: Synthetic oligonucleotide
gcaccagttacggcaggaatgctacgc

SEQ ID NO: 391492 - DNA, 27 bp, Artificial Sequence
  Description of Artificial Sequence: Synthetic oligonucleotide
caccagttacggcaggaatgctacgcg

SEQ ID NO: 391493 - DNA, 32 bp, Artificial Sequence; identical to SEQ ID NO: 54016
  Description of Artificial Sequence: Synthetic oligonucleotide

SEQ ID NO: 391494 - DNA, 31 bp, Artificial Sequence; identical to SEQ ID NO: 54017
  Description of Artificial Sequence: Synthetic oligonucleotide

SEQ ID NO: 391495 - DNA, 30 bp, Artificial Sequence; identical to SEQ ID NO: 54018
  Description of Artificial Sequence: Synthetic oligonucleotide

SEQ ID NO: 391496 - DNA, 30 bp, Artificial Sequence; identical to SEQ ID NO: 54019
  Description of Artificial Sequence: Synthetic oligonucleotide

SEQ ID NO: 391497 - DNA, 29 bp, Artificial Sequence
  Description of Artificial Sequence: Synthetic oligonucleotide
ggactactggaacagccagaaggacatcc

SEQ ID NO: 391498 - DNA, 30 bp, Artificial Sequence; identical to SEQ ID NO: 54021
  Description of Artificial Sequence: Synthetic oligonucleotide

SEQ ID NO: 391499 - DNA, 30 bp, Artificial Sequence; identical to SEQ ID NO: 54022
  Description of Artificial Sequence: Synthetic oligonucleotide

SEQ ID NO: 391500 - DNA, 29 bp, Artificial Sequence
  Description of Artificial Sequence: Synthetic oligonucleotide
ctactggaacagccagaaggacatcctgg

SEQ ID NO: 391501 - DNA, 22 bp, Artificial Sequence
  Description of Artificial Sequence: Synthetic oligonucleotide
gcggcctgaggcggagtactgg

SEQ ID NO: 391502 - DNA, 23 bp, Artificial Sequence
  Description of Artificial Sequence: Synthetic oligonucleotide
cggcctgaggcggagtactggca

SEQ ID NO: 391503 - DNA, 24 bp, Artificial Sequence
  Description of Artificial Sequence: Synthetic oligonucleotide
ggcctgaggcggagtactggcaca

SEQ ID NO: 391504 - DNA, 24 bp, Artificial Sequence
  Description of Artificial Sequence: Synthetic oligonucleotide
gcctgaggcggagtactggcacag

SEQ ID NO: 391505 - DNA, 24 bp, Artificial Sequence
  Description of Artificial Sequence: Synthetic oligonucleotide
cctgaggcggagtactggcacagc

SEQ ID NO: 391506 - DNA, 25 bp, Artificial Sequence
  Description of Artificial Sequence: Synthetic oligonucleotide
ctgaggcggagtactggcacagcca

SEQ ID NO: 391507 - DNA, 27 bp, Artificial Sequence
  Description of Artificial Sequence: Synthetic oligonucleotide
tgaggcggagtactggcacagccagaa

SEQ ID NO: 391508 - DNA, 26 bp, Artificial Sequence
  Description of Artificial Sequence: Synthetic oligonucleotide
gaggcggagtactggcacagccagaa

SEQ ID NO: 391509 - DNA, 26 bp, Artificial Sequence
  Description of Artificial Sequence: Synthetic oligonucleotide
aggcggagtactggcacagccagaag

SEQ ID NO: 391510 - DNA, 25 bp, Artificial Sequence
  Description of Artificial Sequence: Synthetic oligonucleotide
ggcggagtactggcacagccagaag

SEQ ID NO: 391511 - DNA, 26 bp, Artificial Sequence
  Description of Artificial Sequence: Synthetic oligonucleotide
gcggagtactggcacagccagaagga

SEQ ID NO: 391512 - DNA, 27 bp, Artificial Sequence
  Description of Artificial Sequence: Synthetic oligonucleotide
cggagtactggcacagccagaaggaca

SEQ ID NO: 391513 - DNA, 28 bp, Artificial Sequence
  Description of Artificial Sequence: Synthetic oligonucleotide
ggagtactggcacagccagaaggacatc

SEQ ID NO: 391514 - DNA, 28 bp, Artificial Sequence
  Description of Artificial Sequence: Synthetic oligonucleotide
gagtactggcacagccagaaggacatcc

SEQ ID NO: 391515 - DNA, 29 bp, Artificial Sequence
  Description of Artificial Sequence: Synthetic oligonucleotide
agtactggcacagccagaaggacatcctg

SEQ ID NO: 391516 - DNA, 28 bp, Artificial Sequence
  Description of Artificial Sequence: Synthetic oligonucleotide
gtactggcacagccagaaggacatcctg

SEQ ID NO: 391517 - DNA, 28 bp, Artificial Sequence
  Description of Artificial Sequence: Synthetic oligonucleotide
tactggcacagccagaaggacatcctgg

SEQ ID NO: 391518 - DNA, 27 bp, Artificial Sequence
  Description of Artificial Sequence: Synthetic oligonucleotide
actggcacagccagaaggacatcctgg

SEQ ID NO: 391519 - DNA, 27 bp, Artificial Sequence
  Description of Artificial Sequence: Synthetic oligonucleotide
ctggcacagccagaaggacatcctgga

SEQ ID NO: 391520 - DNA, 27 bp, Artificial Sequence
  Description of Artificial Sequence: Synthetic oligonucleotide
tggcacagccagaaggacatcctggag

SEQ ID NO: 391521 - DNA, 26 bp, Artificial Sequence
  Description of Artificial Sequence: Synthetic oligonucleotide
ggcacagccagaaggacatcctggag

SEQ ID NO: 391522 - DNA, 27 bp, Artificial Sequence
  Description of Artificial Sequence: Synthetic oligonucleotide
gcacagccagaaggacatcctggagga

SEQ ID NO: 391523 - DNA, 27 bp, Artificial Sequence
  Description of Artificial Sequence: Synthetic oligonucleotide
cacagccagaaggacatcctggaggag

SEQ ID NO: 391524 - DNA, 27 bp, Artificial Sequence
  Description of Artificial Sequence: Synthetic oligonucleotide
cggagtactggaacagccagaaggacc

SEQ ID NO: 391525 - DNA, 28 bp, Artificial Sequence
  Description of Artificial Sequence: Synthetic oligonucleotide
ggagtactggaacagccagaaggacctc

SEQ ID NO: 391526 - DNA, 28 bp, Artificial Sequence
  Description of Artificial Sequence: Synthetic oligonucleotide
gagtactggaacagccagaaggacctcc

SEQ ID NO: 391527 - DNA, 29 bp, Artificial Sequence
  Description of Artificial Sequence: Synthetic oligonucleotide
agtactggaacagccagaaggacctcctg

SEQ ID NO: 391528 - DNA, 28 bp, Artificial Sequence
  Description of Artificial Sequence: Synthetic oligonucleotide
gtactggaacagccagaaggacctcctg

SEQ ID NO: 391529 - DNA, 25 bp, Artificial Sequence
  Description of Artificial Sequence: Synthetic oligonucleotide
gagcgggcagtgccggacaggatat

SEQ ID NO: 391530 - DNA, 25 bp, Artificial Sequence
  Description of Artificial Sequence: Synthetic oligonucleotide
agcgggcagtgccggacaggatatg

SEQ ID NO: 391531 - DNA, 24 bp, Artificial Sequence
  Description of Artificial Sequence: Synthetic oligonucleotide
gcgggcagtgccggacaggatatg

SEQ ID NO: 391532 - DNA, 25 bp, Artificial Sequence
  Description of Artificial Sequence: Synthetic oligonucleotide
cgggcagtgccggacaggatatgca

SEQ ID NO: 391533 - DNA, 26 bp, Artificial Sequence
  Description of Artificial Sequence: Synthetic oligonucleotide
gggcagtgccggacaggatatgcaga

SEQ ID NO: 391534 - DNA, 27 bp, Artificial Sequence
  Description of Artificial Sequence: Synthetic oligonucleotide
ggcagtgccggacaggatatgcagaca

SEQ ID NO: 391535 - DNA, 27 bp, Artificial Sequence
  Description of Artificial Sequence: Synthetic oligonucleotide
gcagtgccggacaggatatgcagacac

SEQ ID NO: 391536 - DNA, 29 bp, Artificial Sequence
  Description of Artificial Sequence: Synthetic oligonucleotide
cagtgccggacaggatatgcagacacaac

SEQ ID NO: 391537 - DNA, 31 bp, Artificial Sequence; identical to SEQ ID NO: 54060
  Description of Artificial Sequence: Synthetic oligonucleotide

SEQ ID NO: 391538 - DNA, 30 bp, Artificial Sequence; identical to SEQ ID NO: 54061
  Description of Artificial Sequence: Synthetic oligonucleotide

SEQ ID NO: 391539 - DNA, 30 bp, Artificial Sequence; identical to SEQ ID NO: 54062
  Description of Artificial Sequence: Synthetic oligonucleotide

SEQ ID NO: 391540 - DNA, 29 bp, Artificial Sequence
  Description of Artificial Sequence: Synthetic oligonucleotide
gccggacaggatatgcagacacaactacg

SEQ ID NO: 391541 - DNA, 30 bp, Artificial Sequence; identical to SEQ ID NO: 54064
  Description of Artificial Sequence: Synthetic oligonucleotide

SEQ ID NO: 391542 - DNA, 30 bp, Artificial Sequence; identical to SEQ ID NO: 54065
  Description of Artificial Sequence: Synthetic oligonucleotide

SEQ ID NO: 391543 - DNA, 31 bp, Artificial Sequence; identical to SEQ ID NO: 54066
  Description of Artificial Sequence: Synthetic oligonucleotide

SEQ ID NO: 391544 - DNA, 31 bp, Artificial Sequence; identical to SEQ ID NO: 54067
  Description of Artificial Sequence: Synthetic oligonucleotide

SEQ ID NO: 391545 - DNA, 32 bp, Artificial Sequence; identical to SEQ ID NO: 54068
  Description of Artificial Sequence: Synthetic oligonucleotide

SEQ ID NO: 391546 - DNA, 31 bp, Artificial Sequence; identical to SEQ ID NO: 54069
  Description of Artificial Sequence: Synthetic oligonucleotide

SEQ ID NO: 391547 - DNA, 31 bp, Artificial Sequence; identical to SEQ ID NO: 54070
  Description of Artificial Sequence: Synthetic oligonucleotide

SEQ ID NO: 391548 - DNA, 30 bp, Artificial Sequence; identical to SEQ ID NO: 54071
  Description of Artificial Sequence: Synthetic oligonucleotide

SEQ ID NO: 391549 - DNA, 31 bp, Artificial Sequence; identical to SEQ ID NO: 54072
  Description of Artificial Sequence: Synthetic oligonucleotide

SEQ ID NO: 391550 - DNA, 31 bp, Artificial Sequence; identical to SEQ ID NO: 54073
  Description of Artificial Sequence: Synthetic oligonucleotide

SEQ ID NO: 391551 - DNA, 29 bp, Artificial Sequence
  Description of Artificial Sequence: Synthetic oligonucleotide
atgatggttctgcaggtttctgcagcccc

SEQ ID NO: 391552 - DNA, 28 bp, Artificial Sequence
  Description of Artificial Sequence: Synthetic oligonucleotide
tgatggttctgcaggtttctgcagcccc

SEQ ID NO: 391553 - DNA, 27 bp, Artificial Sequence
  Description of Artificial Sequence: Synthetic oligonucleotide
gatggttctgcaggtttctgcagcccc

SEQ ID NO: 391554 - DNA, 27 bp, Artificial Sequence
  Description of Artificial Sequence: Synthetic oligonucleotide
atggttctgcaggtttctgcagccccc

SEQ ID NO: 391555 - DNA, 26 bp, Artificial Sequence
  Description of Artificial Sequence: Synthetic oligonucleotide
tggttctgcaggtttctgcagccccc

SEQ ID NO: 391556 - DNA, 25 bp, Artificial Sequence
  Description of Artificial Sequence: Synthetic oligonucleotide
ggttctgcaggtttctgcagccccc

SEQ ID NO: 391557 - DNA, 25 bp, Artificial Sequence
  Description of Artificial Sequence: Synthetic oligonucleotide
gttctgcaggtttctgcagcccccc

SEQ ID NO: 391558 - DNA, 25 bp, Artificial Sequence
  Description of Artificial Sequence: Synthetic oligonucleotide
ttctgcaggtttctgcagccccccg

SEQ ID NO: 391559 - DNA, 24 bp, Artificial Sequence
  Description of Artificial Sequence: Synthetic oligonucleotide
tctgcaggtttctgcagccccccg

SEQ ID NO: 391560 - DNA, 23 bp, Artificial Sequence
  Description of Artificial Sequence: Synthetic oligonucleotide
ctgcaggtttctgcagccccccg

SEQ ID NO: 391561 - DNA, 24 bp, Artificial Sequence
  Description of Artificial Sequence: Synthetic oligonucleotide
tgcaggtttctgcagccccccgga

SEQ ID NO: 391562 - DNA, 23 bp, Artificial Sequence
  Description of Artificial Sequence: Synthetic oligonucleotide
gcaggtttctgcagccccccgga

SEQ ID NO: 391563 - DNA, 24 bp, Artificial Sequence
  Description of Artificial Sequence: Synthetic oligonucleotide
caggtttctgcagccccccggaca

SEQ ID NO: 391564 - DNA, 25 bp, Artificial Sequence
  Description of Artificial Sequence: Synthetic oligonucleotide
aggtttctgcagccccccggacagt

SEQ ID NO: 391565 - DNA, 24 bp, Artificial Sequence
  Description of Artificial Sequence: Synthetic oligonucleotide
ggtttctgcagccccccggacagt

SEQ ID NO: 391566 - DNA, 24 bp, Artificial Sequence
  Description of Artificial Sequence: Synthetic oligonucleotide
gtttctgcagccccccggacagtg

SEQ ID NO: 391567 - DNA, 24 bp, Artificial Sequence
  Description of Artificial Sequence: Synthetic oligonucleotide
tttctgcagccccccggacagtgg

SEQ ID NO: 391568 - DNA, 23 bp, Artificial Sequence
  Description of Artificial Sequence: Synthetic oligonucleotide
ttctgcagccccccggacagtgg

SEQ ID NO: 391569 - DNA, 22 bp, Artificial Sequence
  Description of Artificial Sequence: Synthetic oligonucleotide
tctgcagccccccggacagtgg

SEQ ID NO: 391570 - DNA, 21 bp, Artificial Sequence
  Description of Artificial Sequence: Synthetic oligonucleotide
ctgcagccccccggacagtgg

SEQ ID NO: 391571 - DNA, 22 bp, Artificial Sequence
  Description of Artificial Sequence: Synthetic oligonucleotide
tgcagccccccggacagtggct

SEQ ID NO: 391572 - DNA, 21 bp, Artificial Sequence
  Description of Artificial Sequence: Synthetic oligonucleotide
gcagccccccggacagtggct

SEQ ID NO: 391573 - DNA, 22 bp, Artificial Sequence
  Description of Artificial Sequence: Synthetic oligonucleotide
cagccccccggacagtggctct

SEQ ID NO: 391574 - DNA, 24 bp, Artificial Sequence
  Description of Artificial Sequence: Synthetic oligonucleotide
agccccccggacagtggctctgat

SEQ ID NO: 391575 - DNA, 23 bp, Artificial Sequence
  Description of Artificial Sequence: Synthetic oligonucleotide
gccccccggacagtggctctgat

SEQ ID NO: 391576 - DNA, 23 bp, Artificial Sequence
  Description of Artificial Sequence: Synthetic oligonucleotide
ccccccggacagtggctctgatg

SEQ ID NO: 391577 - DNA, 23 bp, Artificial Sequence
  Description of Artificial Sequence: Synthetic oligonucleotide
cccccggacagtggctctgatgg

SEQ ID NO: 391578 - DNA, 23 bp, Artificial Sequence
  Description of Artificial Sequence: Synthetic oligonucleotide
ccccggacagtggctctgatggc

SEQ ID NO: 391579 - DNA, 26 bp, Artificial Sequence
  Description of Artificial Sequence: Synthetic oligonucleotide
cccggacagtggctctgatggcgtta

SEQ ID NO: 391580 - DNA, 27 bp, Artificial Sequence
  Description of Artificial Sequence: Synthetic oligonucleotide
ccggacagtggctctgatggcgttact

SEQ ID NO: 391581 - DNA, 27 bp, Artificial Sequence
  Description of Artificial Sequence: Synthetic oligonucleotide
cggacagtggctctgatggcgttactg

SEQ ID NO: 391582 - DNA, 29 bp, Artificial Sequence
  Description of Artificial Sequence: Synthetic oligonucleotide
ggacagtggctctgatggcgttactgatg

SEQ ID NO: 391583 - DNA, 29 bp, Artificial Sequence
  Description of Artificial Sequence: Synthetic oligonucleotide
gacagtggctctgatggcgttactgatgg

SEQ ID NO: 391584 - DNA, 30 bp, Artificial Sequence; identical to SEQ ID NO: 54107
  Description of Artificial Sequence: Synthetic oligonucleotide

SEQ ID NO: 391585 - DNA, 29 bp, Artificial Sequence
  Description of Artificial Sequence: Synthetic oligonucleotide
cagtggctctgatggcgttactgatggtg

SEQ ID NO: 391586 - DNA, 29 bp, Artificial Sequence
  Description of Artificial Sequence: Synthetic oligonucleotide
agtggctctgatggcgttactgatggtgc

SEQ ID NO: 391587 - DNA, 28 bp, Artificial Sequence
  Description of Artificial Sequence: Synthetic oligonucleotide
gtggctctgatggcgttactgatggtgc

SEQ ID NO: 391588 - DNA, 29 bp, Artificial Sequence
  Description of Artificial Sequence: Synthetic oligonucleotide
tggctctgatggcgttactgatggtgctg

SEQ ID NO: 391589 - DNA, 28 bp, Artificial Sequence
  Description of Artificial Sequence: Synthetic oligonucleotide
ggctctgatggcgttactgatggtgctg

SEQ ID NO: 391590 - DNA, 28 bp, Artificial Sequence
  Description of Artificial Sequence: Synthetic oligonucleotide
gctctgatggcgttactgatggtgctgc

SEQ ID NO: 391591 - DNA, 29 bp, Artificial Sequence
  Description of Artificial Sequence: Synthetic oligonucleotide
ctctgatggcgttactgatggtgctgctc

SEQ ID NO: 391592 - DNA, 30 bp, Artificial Sequence; identical to SEQ ID NO: 54115
  Description of Artificial Sequence: Synthetic oligonucleotide

SEQ ID NO: 391593 - DNA, 29 bp, Artificial Sequence
  Description of Artificial Sequence: Synthetic oligonucleotide
ctgatggcgttactgatggtgctgctcac

SEQ ID NO: 391594 - DNA, 31 bp, Artificial Sequence; identical to SEQ ID NO: 54117
  Description of Artificial Sequence: Synthetic oligonucleotide

SEQ ID NO: 391595 - DNA, 30 bp, Artificial Sequence; identical to SEQ ID NO: 54118
  Description of Artificial Sequence: Synthetic oligonucleotide

SEQ ID NO: 391596 - DNA, 31 bp, Artificial Sequence; identical to SEQ ID NO: 54119
  Description of Artificial Sequence: Synthetic oligonucleotide

SEQ ID NO: 391597 - DNA, 30 bp, Artificial Sequence; identical to SEQ ID NO: 54120
  Description of Artificial Sequence: Synthetic oligonucleotide

SEQ ID NO: 391598 - DNA, 31 bp, Artificial Sequence; identical to SEQ ID NO: 54121
  Description of Artificial Sequence: Synthetic oligonucleotide

SEQ ID NO: 391599 - DNA, 30 bp, Artificial Sequence; identical to SEQ ID NO: 54122
  Description of Artificial Sequence: Synthetic oligonucleotide

SEQ ID NO: 391600 - DNA, 30 bp, Artificial Sequence; identical to SEQ ID NO: 54123
  Description of Artificial Sequence: Synthetic oligonucleotide

SEQ ID NO: 391601 - DNA, 30 bp, Artificial Sequence; identical to SEQ ID NO: 54124
  Description of Artificial Sequence: Synthetic oligonucleotide

SEQ ID NO: 391602 - DNA, 31 bp, Artificial Sequence; identical to SEQ ID NO: 54125
  Description of Artificial Sequence: Synthetic oligonucleotide

SEQ ID NO: 391603 - DNA, 31 bp, Artificial Sequence; identical to SEQ ID NO: 54126
  Description of Artificial Sequence: Synthetic oligonucleotide

SEQ ID NO: 391604 - DNA, 30 bp, Artificial Sequence; identical to SEQ ID NO: 54127
  Description of Artificial Sequence: Synthetic oligonucleotide

SEQ ID NO: 391605 - DNA, 29 bp, Artificial Sequence
  Description of Artificial Sequence: Synthetic oligonucleotide
cctggagagatacatctacaacccggagg

SEQ ID NO: 391606 - DNA, 30 bp, Artificial Sequence; identical to SEQ ID NO: 54129
  Description of Artificial Sequence: Synthetic oligonucleotide

SEQ ID NO: 391607 - DNA, 32 bp, Artificial Sequence; identical to SEQ ID NO: 54130
  Description of Artificial Sequence: Synthetic oligonucleotide

SEQ ID NO: 391608 - DNA, 31 bp, Artificial Sequence; identical to SEQ ID NO: 54131
  Description of Artificial Sequence: Synthetic oligonucleotide

SEQ ID NO: 391609 - DNA, 31 bp, Artificial Sequence; identical to SEQ ID NO: 54132
  Description of Artificial Sequence: Synthetic oligonucleotide

SEQ ID NO: 391610 - DNA, 32 bp, Artificial Sequence; identical to SEQ ID NO: 54133
  Description of Artificial Sequence: Synthetic oligonucleotide

SEQ ID NO: 391611 - DNA, 31 bp, Artificial Sequence; identical to SEQ ID NO: 54134
  Description of Artificial Sequence: Synthetic oligonucleotide

SEQ ID NO: 391612 - DNA, 31 bp, Artificial Sequence; identical to SEQ ID NO: 54135
  Description of Artificial Sequence: Synthetic oligonucleotide

SEQ ID NO: 391613 - DNA, 30 bp, Artificial Sequence; identical to SEQ ID NO: 54136
  Description of Artificial Sequence: Synthetic oligonucleotide

SEQ ID NO: 391614 - DNA, 30 bp, Artificial Sequence; identical to SEQ ID NO: 54137
  Description of Artificial Sequence: Synthetic oligonucleotide

SEQ ID NO: 391615 - DNA, 29 bp, Artificial Sequence
  Description of Artificial Sequence: Synthetic oligonucleotide
tacatctacaacccggaggagttcgtgcg

SEQ ID NO: 391616 - DNA, 28 bp, Artificial Sequence
  Description of Artificial Sequence: Synthetic oligonucleotide
acatctacaacccggaggagttcgtgcg

SEQ ID NO: 391617 - DNA, 27 bp, Artificial Sequence
  Description of Artificial Sequence: Synthetic oligonucleotide
catctacaacccggaggagttcgtgcg

SEQ ID NO: 391618 - DNA, 27 bp, Artificial Sequence
  Description of Artificial Sequence: Synthetic oligonucleotide
atctacaacccggaggagttcgtgcgc

SEQ ID NO: 391619 - DNA, 27 bp, Artificial Sequence
  Description of Artificial Sequence: Synthetic oligonucleotide
tctacaacccggaggagttcgtgcgct

SEQ ID NO: 391620 - DNA, 27 bp, Artificial Sequence
  Description of Artificial Sequence: Synthetic oligonucleotide
ctacaacccggaggagttcgtgcgctt

SEQ ID NO: 391621 - DNA, 27 bp, Artificial Sequence
  Description of Artificial Sequence: Synthetic oligonucleotide
tacaacccggaggagttcgtgcgcttc

SEQ ID NO: 391622 - DNA, 26 bp, Artificial Sequence
  Description of Artificial Sequence: Synthetic oligonucleotide
acaacccggaggagttcgtgcgcttc

SEQ ID NO: 391623 - DNA, 25 bp, Artificial Sequence
  Description of Artificial Sequence: Synthetic oligonucleotide
caacccggaggagttcgtgcgcttc

SEQ ID NO: 391624 - DNA, 26 bp, Artificial Sequence
  Description of Artificial Sequence: Synthetic oligonucleotide
aacccggaggagttcgtgcgcttcga

SEQ ID NO: 391625 - DNA, 25 bp, Artificial Sequence
  Description of Artificial Sequence: Synthetic oligonucleotide
acccggaggagttcgtgcgcttcga

SEQ ID NO: 391626 - DNA, 24 bp, Artificial Sequence
  Description of Artificial Sequence: Synthetic oligonucleotide
cccggaggagttcgtgcgcttcga

SEQ ID NO: 391627 - DNA, 25 bp, Artificial Sequence
  Description of Artificial Sequence: Synthetic oligonucleotide
ccggaggagttcgtgcgcttcgaca

SEQ ID NO: 391628 - DNA, 25 bp, Artificial Sequence
  Description of Artificial Sequence: Synthetic oligonucleotide
cggaggagttcgtgcgcttcgacag

SEQ ID NO: 391629 - DNA, 29 bp, Artificial Sequence
  Description of Artificial Sequence: Synthetic oligonucleotide
cttttccagggacggcaggaatgctacac

SEQ ID NO: 391630 - DNA, 29 bp, Artificial Sequence
  Description of Artificial Sequence: Synthetic oligonucleotide
ttttccagggacggcaggaatgctacacg

SEQ ID NO: 391631 - DNA, 28 bp, Artificial Sequence
  Description of Artificial Sequence: Synthetic oligonucleotide
tttccagggacggcaggaatgctacacg

SEQ ID NO: 391632 - DNA, 27 bp, Artificial Sequence
  Description of Artificial Sequence: Synthetic oligonucleotide
ttccagggacggcaggaatgctacacg

SEQ ID NO: 391633 - DNA, 27 bp, Artificial Sequence
  Description of Artificial Sequence: Synthetic oligonucleotide
tccagggacggcaggaatgctacacgt

SEQ ID NO: 391634 - DNA, 27 bp, Artificial Sequence
  Description of Artificial Sequence: Synthetic oligonucleotide
ccagggacggcaggaatgctacacgtt

SEQ ID NO: 391635 - DNA, 31 bp, Artificial Sequence; identical to SEQ ID NO: 54158
  Description of Artificial Sequence: Synthetic oligonucleotide

SEQ ID NO: 391636 - DNA, 31 bp, Artificial Sequence; identical to SEQ ID NO: 54159
  Description of Artificial Sequence: Synthetic oligonucleotide

SEQ ID NO: 391637 - DNA, 30 bp, Artificial Sequence; identical to SEQ ID NO: 54160
  Description of Artificial Sequence: Synthetic oligonucleotide

SEQ ID NO: 391638 - DNA, 30 bp, Artificial Sequence; identical to SEQ ID NO: 54161
  Description of Artificial Sequence: Synthetic oligonucleotide

SEQ ID NO: 391639 - DNA, 31 bp, Artificial Sequence; identical to SEQ ID NO: 54162
  Description of Artificial Sequence: Synthetic oligonucleotide

SEQ ID NO: 391640 - DNA, 32 bp, Artificial Sequence; identical to SEQ ID NO: 54163
  Description of Artificial Sequence: Synthetic oligonucleotide

SEQ ID NO: 391641 - DNA, 31 bp, Artificial Sequence; identical to SEQ ID NO: 54164
  Description of Artificial Sequence: Synthetic oligonucleotide

SEQ ID NO: 391642 - DNA, 32 bp, Artificial Sequence; identical to SEQ ID NO: 54165
  Description of Artificial Sequence: Synthetic oligonucleotide

SEQ ID NO: 391643 - DNA, 32 bp, Artificial Sequence; identical to SEQ ID NO: 54166
  Description of Artificial Sequence: Synthetic oligonucleotide

SEQ ID NO: 391644 - DNA, 32 bp, Artificial Sequence; identical to SEQ ID NO: 54167
  Description of Artificial Sequence: Synthetic oligonucleotide

SEQ ID NO: 391645 - DNA, 32 bp, Artificial Sequence; identical to SEQ ID NO: 54168
  Description of Artificial Sequence: Synthetic oligonucleotide

SEQ ID NO: 391646 - DNA, 31 bp, Artificial Sequence; identical to SEQ ID NO: 54169
  Description of Artificial Sequence: Synthetic oligonucleotide

SEQ ID NO: 391647 - DNA, 33 bp, Artificial Sequence; identical to SEQ ID NO: 54170
  Description of Artificial Sequence: Synthetic oligonucleotide

SEQ ID NO: 391648 - DNA, 33 bp, Artificial Sequence; identical to SEQ ID NO: 54171
  Description of Artificial Sequence: Synthetic oligonucleotide

SEQ ID NO: 391649 - DNA, 32 bp, Artificial Sequence; identical to SEQ ID NO: 54172
  Description of Artificial Sequence: Synthetic oligonucleotide

SEQ ID NO: 391650 - DNA, 31 bp, Artificial Sequence; identical to SEQ ID NO: 54173
  Description of Artificial Sequence: Synthetic oligonucleotide

SEQ ID NO: 391651 - DNA, 30 bp, Artificial Sequence; identical to SEQ ID NO: 54174
  Description of Artificial Sequence: Synthetic oligonucleotide

SEQ ID NO: 391652 - DNA, 31 bp, Artificial Sequence; identical to SEQ ID NO: 54175
  Description of Artificial Sequence: Synthetic oligonucleotide

SEQ ID NO: 391653 - DNA, 31 bp, Artificial Sequence; identical to SEQ ID NO: 54176
  Description of Artificial Sequence: Synthetic oligonucleotide

SEQ ID NO: 391654 - DNA, 30 bp, Artificial Sequence; identical to SEQ ID NO: 54177
  Description of Artificial Sequence: Synthetic oligonucleotide

SEQ ID NO: 391655 - DNA, 29 bp, Artificial Sequence
  Description of Artificial Sequence: Synthetic oligonucleotide
cacgtttaatgggacacagcgcttcctgg

SEQ ID NO: 391656 - DNA, 30 bp, Artificial Sequence; identical to SEQ ID NO: 54179
  Description of Artificial Sequence: Synthetic oligonucleotide

SEQ ID NO: 391657 - DNA, 32 bp, Artificial Sequence; identical to SEQ ID NO: 54180
  Description of Artificial Sequence: Synthetic oligonucleotide

SEQ ID NO: 391658 - DNA, 31 bp, Artificial Sequence; identical to SEQ ID NO: 54181
  Description of Artificial Sequence: Synthetic oligonucleotide

SEQ ID NO: 391659 - DNA, 31 bp, Artificial Sequence; identical to SEQ ID NO: 54182
  Description of Artificial Sequence: Synthetic oligonucleotide

SEQ ID NO: 391660 - DNA, 31 bp, Artificial Sequence; identical to SEQ ID NO: 54183
  Description of Artificial Sequence: Synthetic oligonucleotide

SEQ ID NO: 391661 - DNA, 30 bp, Artificial Sequence; identical to SEQ ID NO: 54184
  Description of Artificial Sequence: Synthetic oligonucleotide

SEQ ID NO: 391662 - DNA, 30 bp, Artificial Sequence; identical to SEQ ID NO: 54185
  Description of Artificial Sequence: Synthetic oligonucleotide

SEQ ID NO: 391663 - DNA, 29 bp, Artificial Sequence
  Description of Artificial Sequence: Synthetic oligonucleotide
gatacatctacaacccggaggagtacgcg

SEQ ID NO: 391664 - DNA, 29 bp, Artificial Sequence
  Description of Artificial Sequence: Synthetic oligonucleotide
atacatctacaacccggaggagtacgcgc

SEQ ID NO: 391665 - DNA, 28 bp, Artificial Sequence
  Description of Artificial Sequence: Synthetic oligonucleotide
tacatctacaacccggaggagtacgcgc

SEQ ID NO: 391666 - DNA, 27 bp, Artificial Sequence
  Description of Artificial Sequence: Synthetic oligonucleotide
acatctacaacccggaggagtacgcgc

SEQ ID NO: 391667 - DNA, 26 bp, Artificial Sequence
  Description of Artificial Sequence: Synthetic oligonucleotide
catctacaacccggaggagtacgcgc

SEQ ID NO: 391668 - DNA, 26 bp, Artificial Sequence
  Description of Artificial Sequence: Synthetic oligonucleotide
atctacaacccggaggagtacgcgcg

SEQ ID NO: 391669 - DNA, 25 bp, Artificial Sequence
  Description of Artificial Sequence: Synthetic oligonucleotide
tctacaacccggaggagtacgcgcg

SEQ ID NO: 391670 - DNA, 24 bp, Artificial Sequence
  Description of Artificial Sequence: Synthetic oligonucleotide
ctacaacccggaggagtacgcgcg

SEQ ID NO: 391671 - DNA, 26 bp, Artificial Sequence
  Description of Artificial Sequence: Synthetic oligonucleotide
tacaacccggaggagtacgcgcgctt

SEQ ID NO: 391672 - DNA, 25 bp, Artificial Sequence
  Description of Artificial Sequence: Synthetic oligonucleotide
acaacccggaggagtacgcgcgctt

SEQ ID NO: 391673 - DNA, 24 bp, Artificial Sequence
  Description of Artificial Sequence: Synthetic oligonucleotide
caacccggaggagtacgcgcgctt

SEQ ID NO: 391674 - DNA, 24 bp, Artificial Sequence
  Description of Artificial Sequence: Synthetic oligonucleotide
aacccggaggagtacgcgcgcttc

SEQ ID NO: 391675 - DNA, 23 bp, Artificial Sequence
  Description of Artificial Sequence: Synthetic oligonucleotide
acccggaggagtacgcgcgcttc

SEQ ID NO: 391676 - DNA, 22 bp, Artificial Sequence
  Description of Artificial Sequence: Synthetic oligonucleotide
cccggaggagtacgcgcgcttc

SEQ ID NO: 391677 - DNA, 23 bp, Artificial Sequence
  Description of Artificial Sequence: Synthetic oligonucleotide
ccggaggagtacgcgcgcttcga

SEQ ID NO: 391678 - DNA, 24 bp, Artificial Sequence
  Description of Artificial Sequence: Synthetic oligonucleotide
cggaggagtacgcgcgcttcgaca

SEQ ID NO: 391679 - DNA, 32 bp, Artificial Sequence; identical to SEQ ID NO: 54202
  Description of Artificial Sequence: Synthetic oligonucleotide

SEQ ID NO: 391680 - DNA, 31 bp, Artificial Sequence; identical to SEQ ID NO: 54203
  Description of Artificial Sequence: Synthetic oligonucleotide

SEQ ID NO: 391681 - DNA, 31 bp, Artificial Sequence; identical to SEQ ID NO: 54204
  Description of Artificial Sequence: Synthetic oligonucleotide

SEQ ID NO: 391682 - DNA, 30 bp, Artificial Sequence; identical to SEQ ID NO: 54205
  Description of Artificial Sequence: Synthetic oligonucleotide

SEQ ID NO: 391683 - DNA, 31 bp, Artificial Sequence; identical to SEQ ID NO: 54206
  Description of Artificial Sequence: Synthetic oligonucleotide

SEQ ID NO: 391684 - DNA, 31 bp, Artificial Sequence; identical to SEQ ID NO: 54207
  Description of Artificial Sequence: Synthetic oligonucleotide

SEQ ID NO: 391685 - DNA, 31 bp, Artificial Sequence; identical to SEQ ID NO: 54208
  Description of Artificial Sequence: Synthetic oligonucleotide

SEQ ID NO: 391686 - DNA, 30 bp, Artificial Sequence; identical to SEQ ID NO: 54209
  Description of Artificial Sequence: Synthetic oligonucleotide

SEQ ID NO: 391687 - DNA, 29 bp, Artificial Sequence
  Description of Artificial Sequence: Synthetic oligonucleotide
tgcagacacaactacgagctgaacgaggc

SEQ ID NO: 391688 - DNA, 28 bp, Artificial Sequence
  Description of Artificial Sequence: Synthetic oligonucleotide
gcagacacaactacgagctgaacgaggc

SEQ ID NO: 391689 - DNA, 28 bp, Artificial Sequence
  Description of Artificial Sequence: Synthetic oligonucleotide
cagacacaactacgagctgaacgaggcc

SEQ ID NO: 391690 - DNA, 28 bp, Artificial Sequence
  Description of Artificial Sequence: Synthetic oligonucleotide
agacacaactacgagctgaacgaggccg

SEQ ID NO: 391691 - DNA, 27 bp, Artificial Sequence
  Description of Artificial Sequence: Synthetic oligonucleotide
gacacaactacgagctgaacgaggccg

SEQ ID NO: 391692 - DNA, 28 bp, Artificial Sequence
  Description of Artificial Sequence: Synthetic oligonucleotide
acacaactacgagctgaacgaggccgtg

SEQ ID NO: 391693 - DNA, 27 bp, Artificial Sequence
  Description of Artificial Sequence: Synthetic oligonucleotide
cacaactacgagctgaacgaggccgtg

SEQ ID NO: 391694 - DNA, 28 bp, Artificial Sequence
  Description of Artificial Sequence: Synthetic oligonucleotide
acaactacgagctgaacgaggccgtgac

SEQ ID NO: 391695 - DNA, 27 bp, Artificial Sequence
  Description of Artificial Sequence: Synthetic oligonucleotide
caactacgagctgaacgaggccgtgac

SEQ ID NO: 391696 - DNA, 27 bp, Artificial Sequence
  Description of Artificial Sequence: Synthetic oligonucleotide
aactacgagctgaacgaggccgtgacc

SEQ ID NO: 391697 - DNA, 26 bp, Artificial Sequence
  Description of Artificial Sequence: Synthetic oligonucleotide
actacgagctgaacgaggccgtgacc

SEQ ID NO: 391698 - DNA, 25 bp, Artificial Sequence
  Description of Artificial Sequence: Synthetic oligonucleotide
ctacgagctgaacgaggccgtgacc

SEQ ID NO: 391699 - DNA, 26 bp, Artificial Sequence
  Description of Artificial Sequence: Synthetic oligonucleotide
tacgagctgaacgaggccgtgaccct

SEQ ID NO: 391700 - DNA, 25 bp, Artificial Sequence
  Description of Artificial Sequence: Synthetic oligonucleotide
acgagctgaacgaggccgtgaccct

SEQ ID NO: 391701 - DNA, 24 bp, Artificial Sequence
  Description of Artificial Sequence: Synthetic oligonucleotide
cgagctgaacgaggccgtgaccct

SEQ ID NO: 391702 - DNA, 24 bp, Artificial Sequence
  Description of Artificial Sequence: Synthetic oligonucleotide
gagctgaacgaggccgtgaccctg

SEQ ID NO: 391703 - DNA, 25 bp, Artificial Sequence
  Description of Artificial Sequence: Synthetic oligonucleotide
agctgaacgaggccgtgaccctgca

SEQ ID NO: 391704 - DNA, 24 bp, Artificial Sequence
  Description of Artificial Sequence: Synthetic oligonucleotide
gctgaacgaggccgtgaccctgca

SEQ ID NO: 391705 - DNA, 24 bp, Artificial Sequence
  Description of Artificial Sequence: Synthetic oligonucleotide
ctgaacgaggccgtgaccctgcag

SEQ ID NO: 391706 - DNA, 24 bp, Artificial Sequence
  Description of Artificial Sequence: Synthetic oligonucleotide
tgaacgaggccgtgaccctgcagc

SEQ ID NO: 391707 - DNA, 23 bp, Artificial Sequence
  Description of Artificial Sequence: Synthetic oligonucleotide
gaacgaggccgtgaccctgcagc

SEQ ID NO: 391708 - DNA, 23 bp, Artificial Sequence
  Description of Artificial Sequence: Synthetic oligonucleotide
aacgaggccgtgaccctgcagcg

SEQ ID NO: 391709 - DNA, 30 bp, Artificial Sequence; identical to SEQ ID NO: 54232
  Description of Artificial Sequence: Synthetic oligonucleotide

SEQ ID NO: 391710 - DNA, 31 bp, Artificial Sequence; identical to SEQ ID NO: 54233
  Description of Artificial Sequence: Synthetic oligonucleotide

SEQ ID NO: 391711 - DNA, 31 bp, Artificial Sequence; identical to SEQ ID NO: 54234
  Description of Artificial Sequence: Synthetic oligonucleotide

SEQ ID NO: 391712 - DNA, 30 bp, Artificial Sequence; identical to SEQ ID NO: 54235
  Description of Artificial Sequence: Synthetic oligonucleotide

SEQ ID NO: 391713 - DNA, 29 bp, Artificial Sequence
  Description of Artificial Sequence: Synthetic oligonucleotide
cctggagagatacatctacaaccggcagg

SEQ ID NO: 391714 - DNA, 30 bp, Artificial Sequence; identical to SEQ ID NO: 54237
  Description of Artificial Sequence: Synthetic oligonucleotide

SEQ ID NO: 391715 - DNA, 32 bp, Artificial Sequence; identical to SEQ ID NO: 54238
  Description of Artificial Sequence: Synthetic oligonucleotide

SEQ ID NO: 391716 - DNA, 31 bp, Artificial Sequence; identical to SEQ ID NO: 54239
  Description of Artificial Sequence: Synthetic oligonucleotide

SEQ ID NO: 391717 - DNA, 31 bp, Artificial Sequence; identical to SEQ ID NO: 54240
  Description of Artificial Sequence: Synthetic oligonucleotide

SEQ ID NO: 391718 - DNA, 31 bp, Artificial Sequence; identical to SEQ ID NO: 54241
  Description of Artificial Sequence: Synthetic oligonucleotide

SEQ ID NO: 391719 - DNA, 30 bp, Artificial Sequence; identical to SEQ ID NO: 54242
  Description of Artificial Sequence: Synthetic oligonucleotide

SEQ ID NO: 391720 - DNA, 30 bp, Artificial Sequence; identical to SEQ ID NO: 54243
  Description of Artificial Sequence: Synthetic oligonucleotide

SEQ ID NO: 391721 - DNA, 29 bp, Artificial Sequence
  Description of Artificial Sequence: Synthetic oligonucleotide
gatacatctacaaccggcaggagtacgcg

SEQ ID NO: 391722 - DNA, 29 bp, Artificial Sequence
  Description of Artificial Sequence: Synthetic oligonucleotide
atacatctacaaccggcaggagtacgcgc

SEQ ID NO: 391723 - DNA, 28 bp, Artificial Sequence
  Description of Artificial Sequence: Synthetic oligonucleotide
tacatctacaaccggcaggagtacgcgc

SEQ ID NO: 391724 - DNA, 27 bp, Artificial Sequence
  Description of Artificial Sequence: Synthetic oligonucleotide
acatctacaaccggcaggagtacgcgc

SEQ ID NO: 391725 - DNA, 26 bp, Artificial Sequence
  Description of Artificial Sequence: Synthetic oligonucleotide
catctacaaccggcaggagtacgcgc

SEQ ID NO: 391726 - DNA, 26 bp, Artificial Sequence
  Description of Artificial Sequence: Synthetic oligonucleotide
atctacaaccggcaggagtacgcgcg

SEQ ID NO: 391727 - DNA, 25 bp, Artificial Sequence
  Description of Artificial Sequence: Synthetic oligonucleotide
tctacaaccggcaggagtacgcgcg

SEQ ID NO: 391728 - DNA, 24 bp, Artificial Sequence
  Description of Artificial Sequence: Synthetic oligonucleotide
ctacaaccggcaggagtacgcgcg

SEQ ID NO: 391729 - DNA, 26 bp, Artificial Sequence
  Description of Artificial Sequence: Synthetic oligonucleotide
tacaaccggcaggagtacgcgcgctt

SEQ ID NO: 391730 - DNA, 25 bp, Artificial Sequence
  Description of Artificial Sequence: Synthetic oligonucleotide
acaaccggcaggagtacgcgcgctt

SEQ ID NO: 391731 - DNA, 24 bp, Artificial Sequence
  Description of Artificial Sequence: Synthetic oligonucleotide
caaccggcaggagtacgcgcgctt

SEQ ID NO: 391732 - DNA, 24 bp, Artificial Sequence
  Description of Artificial Sequence: Synthetic oligonucleotide
aaccggcaggagtacgcgcgcttc

SEQ ID NO: 391733 - DNA, 23 bp, Artificial Sequence
  Description of Artificial Sequence: Synthetic oligonucleotide
accggcaggagtacgcgcgcttc

SEQ ID NO: 391734 - DNA, 22 bp, Artificial Sequence
  Description of Artificial Sequence: Synthetic oligonucleotide
ccggcaggagtacgcgcgcttc

SEQ ID NO: 391735 - DNA, 23 bp, Artificial Sequence
  Description of Artificial Sequence: Synthetic oligonucleotide
cggcaggagtacgcgcgcttcga

SEQ ID NO: 391736 - DNA, 24 bp, Artificial Sequence
  Description of Artificial Sequence: Synthetic oligonucleotide
ggcaggagtacgcgcgcttcgaca

SEQ ID NO: 391737 - DNA, 24 bp, Artificial Sequence
  Description of Artificial Sequence: Synthetic oligonucleotide
gcaggagtacgcgcgcttcgacag

SEQ ID NO: 391738 - DNA, 24 bp, Artificial Sequence
  Description of Artificial Sequence: Synthetic oligonucleotide
caggagtacgcgcgcttcgacagc

SEQ ID NO: 391739 - DNA, 26 bp, Artificial Sequence
  Description of Artificial Sequence: Synthetic oligonucleotide
cagccagaaggacctcctggaggaga

SEQ ID NO: 391740 - DNA, 26 bp, Artificial Sequence
  Description of Artificial Sequence: Synthetic oligonucleotide
agccagaaggacctcctggaggagag

SEQ ID NO: 391741 - DNA, 25 bp, Artificial Sequence
  Description of Artificial Sequence: Synthetic oligonucleotide
gccagaaggacctcctggaggagag

SEQ ID NO: 391742 - DNA, 25 bp, Artificial Sequence
  Description of Artificial Sequence: Synthetic oligonucleotide
ccagaaggacctcctggaggagagg

SEQ ID NO: 391743 - DNA, 25 bp, Artificial Sequence
  Description of Artificial Sequence: Synthetic oligonucleotide
cagaaggacctcctggaggagaggc

SEQ ID NO: 391744 - DNA, 25 bp, Artificial Sequence
  Description of Artificial Sequence: Synthetic oligonucleotide
agaaggacctcctggaggagaggcg

SEQ ID NO: 391745 - DNA, 24 bp, Artificial Sequence
  Description of Artificial Sequence: Synthetic oligonucleotide
gaaggacctcctggaggagaggcg

SEQ ID NO: 391746 - DNA, 24 bp, Artificial Sequence
  Description of Artificial Sequence: Synthetic oligonucleotide
aaggacctcctggaggagaggcgg

SEQ ID NO: 391747 - DNA, 23 bp, Artificial Sequence
  Description of Artificial Sequence: Synthetic oligonucleotide
aggacctcctggaggagaggcgg

SEQ ID NO: 391748 - DNA, 22 bp, Artificial Sequence
  Description of Artificial Sequence: Synthetic oligonucleotide
ggacctcctggaggagaggcgg

SEQ ID NO: 391749 - DNA, 22 bp, Artificial Sequence
  Description of Artificial Sequence: Synthetic oligonucleotide
gacctcctggaggagaggcggg

SEQ ID NO: 391750 - DNA, 23 bp, Artificial Sequence
  Description of Artificial Sequence: Synthetic oligonucleotide
acctcctggaggagaggcgggca

SEQ ID NO: 391751 - DNA, 22 bp, Artificial Sequence
  Description of Artificial Sequence: Synthetic oligonucleotide
cctcctggaggagaggcgggca

SEQ ID NO: 391752 - DNA, 23 bp, Artificial Sequence
  Description of Artificial Sequence: Synthetic oligonucleotide
ctcctggaggagaggcgggcagt

SEQ ID NO: 391753 - DNA, 23 bp, Artificial Sequence
  Description of Artificial Sequence: Synthetic oligonucleotide
tcctggaggagaggcgggcagtg

SEQ ID NO: 391754 - DNA, 22 bp, Artificial Sequence
  Description of Artificial Sequence: Synthetic oligonucleotide
cctggaggagaggcgggcagtg

SEQ ID NO: 391755 - DNA, 22 bp, Artificial Sequence
  Description of Artificial Sequence: Synthetic oligonucleotide
ctggaggagaggcgggcagtgc

SEQ ID NO: 391756 - DNA, 22 bp, Artificial Sequence
  Description of Artificial Sequence: Synthetic oligonucleotide
tggaggagaggcgggcagtgcc

SEQ ID NO: 391757 - DNA, 21 bp, Artificial Sequence
  Description of Artificial Sequence: Synthetic oligonucleotide
ggaggagaggcgggcagtgcc

SEQ ID NO: 391758 - DNA, 21 bp, Artificial Sequence
  Description of Artificial Sequence: Synthetic oligonucleotide
gaggagaggcgggcagtgccg

SEQ ID NO: 391759 - DNA, 22 bp, Artificial Sequence
  Description of Artificial Sequence: Synthetic oligonucleotide
aggagaggcgggcagtgccgga

SEQ ID NO: 391760 - DNA, 21 bp, Artificial Sequence
  Description of Artificial Sequence: Synthetic oligonucleotide
ggagaggcgggcagtgccgga

SEQ ID NO: 391761 - DNA, 22 bp, Artificial Sequence
  Description of Artificial Sequence: Synthetic oligonucleotide
gagaggcgggcagtgccggaca

SEQ ID NO: 391762 - DNA, 22 bp, Artificial Sequence
  Description of Artificial Sequence: Synthetic oligonucleotide
agaggcgggcagtgccggacag

SEQ ID NO: 391763 - DNA, 21 bp, Artificial Sequence
  Description of Artificial Sequence: Synthetic oligonucleotide
gaggcgggcagtgccggacag

SEQ ID NO: 391764 - DNA, 23 bp, Artificial Sequence
  Description of Artificial Sequence: Synthetic oligonucleotide
aggcgggcagtgccggacaggat

SEQ ID NO: 391765 - DNA, 22 bp, Artificial Sequence
  Description of Artificial Sequence: Synthetic oligonucleotide
ggcgggcagtgccggacaggat

SEQ ID NO: 391766 - DNA, 33 bp, Artificial Sequence; identical to SEQ ID NO: 54289
  Description of Artificial Sequence: Synthetic oligonucleotide

SEQ ID NO: 391767 - DNA, 32 bp, Artificial Sequence; identical to SEQ ID NO: 54290
  Description of Artificial Sequence: Synthetic oligonucleotide

SEQ ID NO: 391768 - DNA, 32 bp, Artificial Sequence; identical to SEQ ID NO: 54291
  Description of Artificial Sequence: Synthetic oligonucleotide

SEQ ID NO: 391769 - DNA, 31 bp, Artificial Sequence; identical to SEQ ID NO: 54292
  Description of Artificial Sequence: Synthetic oligonucleotide

SEQ ID NO: 391770 - DNA, 31 bp, Artificial Sequence; identical to SEQ ID NO: 54293
  Description of Artificial Sequence: Synthetic oligonucleotide

SEQ ID NO: 391771 - DNA, 32 bp, Artificial Sequence; identical to SEQ ID NO: 54294
  Description of Artificial Sequence: Synthetic oligonucleotide

SEQ ID NO: 391772 - DNA, 32 bp, Artificial Sequence; identical to SEQ ID NO: 54295
  Description of Artificial Sequence: Synthetic oligonucleotide

SEQ ID NO: 391773 - DNA, 33 bp, Artificial Sequence; identical to SEQ ID NO: 54296
  Description of Artificial Sequence: Synthetic oligonucleotide

SEQ ID NO: 391774 - DNA, 32 bp, Artificial Sequence; identical to SEQ ID NO: 54297
  Description of Artificial Sequence: Synthetic oligonucleotide

SEQ ID NO: 391775 - DNA, 31 bp, Artificial Sequence; identical to SEQ ID NO: 54298
  Description of Artificial Sequence: Synthetic oligonucleotide

SEQ ID NO: 391776 - DNA, 33 bp, Artificial Sequence; identical to SEQ ID NO: 54299
  Description of Artificial Sequence: Synthetic oligonucleotide

SEQ ID NO: 391777 - DNA, 33 bp, Artificial Sequence; identical to SEQ ID NO: 54300
  Description of Artificial Sequence: Synthetic oligonucleotide

SEQ ID NO: 391778 - DNA, 32 bp, Artificial Sequence; identical to SEQ ID NO: 54301
  Description of Artificial Sequence: Synthetic oligonucleotide

SEQ ID NO: 391779 - DNA, 32 bp, Artificial Sequence; identical to SEQ ID NO: 54302
  Description of Artificial Sequence: Synthetic oligonucleotide

SEQ ID NO: 391780 - DNA, 32 bp, Artificial Sequence; identical to SEQ ID NO: 54303
  Description of Artificial Sequence: Synthetic oligonucleotide

SEQ ID NO: 391781 - DNA, 31 bp, Artificial Sequence; identical to SEQ ID NO: 54304
  Description of Artificial Sequence: Synthetic oligonucleotide

SEQ ID NO: 391782 - DNA, 31 bp, Artificial Sequence; identical to SEQ ID NO: 54305
  Description of Artificial Sequence: Synthetic oligonucleotide

SEQ ID NO: 391783 - DNA, 30 bp, Artificial Sequence; identical to SEQ ID NO: 54306
  Description of Artificial Sequence: Synthetic oligonucleotide

SEQ ID NO: 391784 - DNA, 30 bp, Artificial Sequence; identical to SEQ ID NO: 54307
  Description of Artificial Sequence: Synthetic oligonucleotide

SEQ ID NO: 391785 - DNA, 29 bp, Artificial Sequence
  Description of Artificial Sequence: Synthetic oligonucleotide
tacatctacaacaggcaggagtacgcgcg

SEQ ID NO: 391786 - DNA, 28 bp, Artificial Sequence
  Description of Artificial Sequence: Synthetic oligonucleotide
acatctacaacaggcaggagtacgcgcg

SEQ ID NO: 391787 - DNA, 27 bp, Artificial Sequence
  Description of Artificial Sequence: Synthetic oligonucleotide
catctacaacaggcaggagtacgcgcg

SEQ ID NO: 391788 - DNA, 27 bp, Artificial Sequence
  Description of Artificial Sequence: Synthetic oligonucleotide
atctacaacaggcaggagtacgcgcgc

SEQ ID NO: 391789 - DNA, 27 bp, Artificial Sequence
  Description of Artificial Sequence: Synthetic oligonucleotide
tctacaacaggcaggagtacgcgcgct

SEQ ID NO: 391790 - DNA, 27 bp, Artificial Sequence
  Description of Artificial Sequence: Synthetic oligonucleotide
ctacaacaggcaggagtacgcgcgctt

SEQ ID NO: 391791 - DNA, 27 bp, Artificial Sequence
  Description of Artificial Sequence: Synthetic oligonucleotide
tacaacaggcaggagtacgcgcgcttc

SEQ ID NO: 391792 - DNA, 26 bp, Artificial Sequence
  Description of Artificial Sequence: Synthetic oligonucleotide
acaacaggcaggagtacgcgcgcttc

SEQ ID NO: 391793 - DNA, 25 bp, Artificial Sequence
  Description of Artificial Sequence: Synthetic oligonucleotide
caacaggcaggagtacgcgcgcttc

SEQ ID NO: 391794 - DNA, 26 bp, Artificial Sequence
  Description of Artificial Sequence: Synthetic oligonucleotide
aacaggcaggagtacgcgcgcttcga

SEQ ID NO: 391795 - DNA, 25 bp, Artificial Sequence
  Description of Artificial Sequence: Synthetic oligonucleotide
acaggcaggagtacgcgcgcttcga

SEQ ID NO: 391796 - DNA, 24 bp, Artificial Sequence
  Description of Artificial Sequence: Synthetic oligonucleotide
caggcaggagtacgcgcgcttcga

SEQ ID NO: 391797 - DNA, 25 bp, Artificial Sequence
  Description of Artificial Sequence: Synthetic oligonucleotide
aggcaggagtacgcgcgcttcgaca

SEQ ID NO: 391798 - DNA, 26 bp, Artificial Sequence
  Description of Artificial Sequence: Synthetic oligonucleotide
aaccgggaggagttcgcgcgcttcta

SEQ ID NO: 391799 - DNA, 25 bp, Artificial Sequence
  Description of Artificial Sequence: Synthetic oligonucleotide
accgggaggagttcgcgcgcttcta

SEQ ID NO: 391800 - DNA, 24 bp, Artificial Sequence
  Description of Artificial Sequence: Synthetic oligonucleotide
ccgggaggagttcgcgcgcttcta

SEQ ID NO: 391801 - DNA, 25 bp, Artificial Sequence
  Description of Artificial Sequence: Synthetic oligonucleotide
cgggaggagttcgcgcgcttctaca

SEQ ID NO: 391802 - DNA, 25 bp, Artificial Sequence
  Description of Artificial Sequence: Synthetic oligonucleotide
gggaggagttcgcgcgcttctacag

SEQ ID NO: 391803 - DNA, 25 bp, Artificial Sequence
  Description of Artificial Sequence: Synthetic oligonucleotide
ggaggagttcgcgcgcttctacagc

SEQ ID NO: 391804 - DNA, 26 bp, Artificial Sequence
  Description of Artificial Sequence: Synthetic oligonucleotide
gaggagttcgcgcgcttctacagcga

SEQ ID NO: 391805 - DNA, 26 bp, Artificial Sequence
  Description of Artificial Sequence: Synthetic oligonucleotide
aggagttcgcgcgcttctacagcgac

SEQ ID NO: 391806 - DNA, 25 bp, Artificial Sequence
  Description of Artificial Sequence: Synthetic oligonucleotide
ggagttcgcgcgcttctacagcgac

SEQ ID NO: 391807 - DNA, 26 bp, Artificial Sequence
  Description of Artificial Sequence: Synthetic oligonucleotide
gagttcgcgcgcttctacagcgacgt

SEQ ID NO: 391808 - DNA, 26 bp, Artificial Sequence
  Description of Artificial Sequence: Synthetic oligonucleotide
agttcgcgcgcttctacagcgacgtg

SEQ ID NO: 391809 - DNA, 25 bp, Artificial Sequence
  Description of Artificial Sequence: Synthetic oligonucleotide
gttcgcgcgcttctacagcgacgtg

SEQ ID NO: 391810 - DNA, 25 bp, Artificial Sequence
  Description of Artificial Sequence: Synthetic oligonucleotide
ttcgcgcgcttctacagcgacgtgg

SEQ ID NO: 391811 - DNA, 24 bp, Artificial Sequence
  Description of Artificial Sequence: Synthetic oligonucleotide
tcgcgcgcttctacagcgacgtgg

SEQ ID NO: 391812 - DNA, 23 bp, Artificial Sequence
  Description of Artificial Sequence: Synthetic oligonucleotide
cgcgcgcttctacagcgacgtgg

SEQ ID NO: 391813 - DNA, 23 bp, Artificial Sequence
  Description of Artificial Sequence: Synthetic oligonucleotide
gcgcgcttctacagcgacgtggg

SEQ ID NO: 391814 - DNA, 23 bp, Artificial Sequence
  Description of Artificial Sequence: Synthetic oligonucleotide
cgcgcttctacagcgacgtgggg

SEQ ID NO: 391815 - DNA, 24 bp, Artificial Sequence
  Description of Artificial Sequence: Synthetic oligonucleotide
gcgcttctacagcgacgtggggga

SEQ ID NO: 391816 - DNA, 26 bp, Artificial Sequence
  Description of Artificial Sequence: Synthetic oligonucleotide
cgcttctacagcgacgtgggggagtt

SEQ ID NO: 391817 - DNA, 26 bp, Artificial Sequence
  Description of Artificial Sequence: Synthetic oligonucleotide
gcttctacagcgacgtgggggagttc

SEQ ID NO: 391818 - DNA, 26 bp, Artificial Sequence
  Description of Artificial Sequence: Synthetic oligonucleotide
cttctacagcgacgtgggggagttcc

SEQ ID NO: 391819 - DNA, 26 bp, Artificial Sequence
  Description of Artificial Sequence: Synthetic oligonucleotide
ttctacagcgacgtgggggagttccg

SEQ ID NO: 391820 - DNA, 25 bp, Artificial Sequence
  Description of Artificial Sequence: Synthetic oligonucleotide
tctacagcgacgtgggggagttccg

SEQ ID NO: 391821 - DNA, 24 bp, Artificial Sequence
  Description of Artificial Sequence: Synthetic oligonucleotide
ctacagcgacgtgggggagttccg

SEQ ID NO: 391822 - DNA, 24 bp, Artificial Sequence
  Description of Artificial Sequence: Synthetic oligonucleotide
tacagcgacgtgggggagttccgg

SEQ ID NO: 391823 - DNA, 31 bp, Artificial Sequence; identical to SEQ ID NO: 54361
  Description of Artificial Sequence: Synthetic oligonucleotide

SEQ ID NO: 391824 - DNA, 30 bp, Artificial Sequence; identical to SEQ ID NO: 54362
  Description of Artificial Sequence: Synthetic oligonucleotide

SEQ ID NO: 391825 - DNA, 30 bp, Artificial Sequence; identical to SEQ ID NO: 54363
  Description of Artificial Sequence: Synthetic oligonucleotide

SEQ ID NO: 391826 - DNA, 29 bp, Artificial Sequence
  Description of Artificial Sequence: Synthetic oligonucleotide
attaccttttccagggacggcaggaaggc

SEQ ID NO: 391827 - DNA, 28 bp, Artificial Sequence
  Description of Artificial Sequence: Synthetic oligonucleotide
ttaccttttccagggacggcaggaaggc

SEQ ID NO: 391828 - DNA, 27 bp, Artificial Sequence
  Description of Artificial Sequence: Synthetic oligonucleotide
taccttttccagggacggcaggaaggc

SEQ ID NO: 391829 - DNA, 27 bp, Artificial Sequence
  Description of Artificial Sequence: Synthetic oligonucleotide
accttttccagggacggcaggaaggct

SEQ ID NO: 391830 - DNA, 27 bp, Artificial Sequence
  Description of Artificial Sequence: Synthetic oligonucleotide
ccttttccagggacggcaggaaggcta

SEQ ID NO: 391831 - DNA, 27 bp, Artificial Sequence
  Description of Artificial Sequence: Synthetic oligonucleotide
cttttccagggacggcaggaaggctac

SEQ ID NO: 391832 - DNA, 27 bp, Artificial Sequence
  Description of Artificial Sequence: Synthetic oligonucleotide
ttttccagggacggcaggaaggctacg

SEQ ID NO: 391833 - DNA, 26 bp, Artificial Sequence
  Description of Artificial Sequence: Synthetic oligonucleotide
tttccagggacggcaggaaggctacg

SEQ ID NO: 391834 - DNA, 25 bp, Artificial Sequence
  Description of Artificial Sequence: Synthetic oligonucleotide
ttccagggacggcaggaaggctacg

SEQ ID NO: 391835 - DNA, 24 bp, Artificial Sequence
  Description of Artificial Sequence: Synthetic oligonucleotide
tccagggacggcaggaaggctacg

SEQ ID NO: 391836 - DNA, 23 bp, Artificial Sequence
  Description of Artificial Sequence: Synthetic oligonucleotide
ccagggacggcaggaaggctacg

SEQ ID NO: 391837 - DNA, 23 bp, Artificial Sequence
  Description of Artificial Sequence: Synthetic oligonucleotide
cagggacggcaggaaggctacgc

SEQ ID NO: 391838 - DNA, 27 bp, Artificial Sequence
  Description of Artificial Sequence: Synthetic oligonucleotide
agggacggcaggaaggctacgcgttta

SEQ ID NO: 391839 - DNA, 27 bp, Artificial Sequence
  Description of Artificial Sequence: Synthetic oligonucleotide
gggacggcaggaaggctacgcgtttaa

SEQ ID NO: 391840 - DNA, 28 bp, Artificial Sequence
  Description of Artificial Sequence: Synthetic oligonucleotide
ggacggcaggaaggctacgcgtttaatg

SEQ ID NO: 391841 - DNA, 28 bp, Artificial Sequence
  Description of Artificial Sequence: Synthetic oligonucleotide
gacggcaggaaggctacgcgtttaatgg

SEQ ID NO: 391842 - DNA, 28 bp, Artificial Sequence
  Description of Artificial Sequence: Synthetic oligonucleotide
acggcaggaaggctacgcgtttaatggg

SEQ ID NO: 391843 - DNA, 27 bp, Artificial Sequence
  Description of Artificial Sequence: Synthetic oligonucleotide
cggcaggaaggctacgcgtttaatggg

SEQ ID NO: 391844 - DNA, 28 bp, Artificial Sequence
  Description of Artificial Sequence: Synthetic oligonucleotide
ggcaggaaggctacgcgtttaatgggac

SEQ ID NO: 391845 - DNA, 29 bp, Artificial Sequence
  Description of Artificial Sequence: Synthetic oligonucleotide
gcaggaaggctacgcgtttaatgggacac

SEQ ID NO: 391846 - DNA, 30 bp, Artificial Sequence; identical to SEQ ID NO: 54384
  Description of Artificial Sequence: Synthetic oligonucleotide

SEQ ID NO: 391847 - DNA, 30 bp, Artificial Sequence; identical to SEQ ID NO: 54385
  Description of Artificial Sequence: Synthetic oligonucleotide

SEQ ID NO: 391848 - DNA, 29 bp, Artificial Sequence
  Description of Artificial Sequence: Synthetic oligonucleotide
ggaaggctacgcgtttaatgggacacagc

SEQ ID NO: 391849 - DNA, 29 bp, Artificial Sequence
  Description of Artificial Sequence: Synthetic oligonucleotide
gaaggctacgcgtttaatgggacacagcg

SEQ ID NO: 391850 - DNA, 29 bp, Artificial Sequence
  Description of Artificial Sequence: Synthetic oligonucleotide
aaggctacgcgtttaatgggacacagcgc

SEQ ID NO: 391851 - DNA, 28 bp, Artificial Sequence
  Description of Artificial Sequence: Synthetic oligonucleotide
aggctacgcgtttaatgggacacagcgc

SEQ ID NO: 391852 - DNA, 27 bp, Artificial Sequence
  Description of Artificial Sequence: Synthetic oligonucleotide
ggctacgcgtttaatgggacacagcgc

SEQ ID NO: 391853 - DNA, 32 bp, Artificial Sequence; identical to SEQ ID NO: 54391
  Description of Artificial Sequence: Synthetic oligonucleotide

SEQ ID NO: 391854 - DNA, 31 bp, Artificial Sequence; identical to SEQ ID NO: 54392
  Description of Artificial Sequence: Synthetic oligonucleotide

SEQ ID NO: 391855 - DNA, 33 bp, Artificial Sequence; identical to SEQ ID NO: 54393
  Description of Artificial Sequence: Synthetic oligonucleotide

SEQ ID NO: 391856 - DNA, 32 bp, Artificial Sequence; identical to SEQ ID NO: 54394
  Description of Artificial Sequence: Synthetic oligonucleotide

SEQ ID NO: 391857 - DNA, 31 bp, Artificial Sequence; identical to SEQ ID NO: 54395
  Description of Artificial Sequence: Synthetic oligonucleotide

SEQ ID NO: 391858 - DNA, 30 bp, Artificial Sequence; identical to SEQ ID NO: 54396
  Description of Artificial Sequence: Synthetic oligonucleotide

SEQ ID NO: 391859 - DNA, 29 bp, Artificial Sequence
  Description of Artificial Sequence: Synthetic oligonucleotide
acgtgtaccagggatggcaggaatgctac

SEQ ID NO: 391860 - DNA, 28 bp, Artificial Sequence
  Description of Artificial Sequence: Synthetic oligonucleotide
cgtgtaccagggatggcaggaatgctac

SEQ ID NO: 391861 - DNA, 28 bp, Artificial Sequence
  Description of Artificial Sequence: Synthetic oligonucleotide
gtgtaccagggatggcaggaatgctacg

SEQ ID NO: 391862 - DNA, 28 bp, Artificial Sequence
  Description of Artificial Sequence: Synthetic oligonucleotide
tgtaccagggatggcaggaatgctacgc

SEQ ID NO: 391863 - DNA, 27 bp, Artificial Sequence
  Description of Artificial Sequence: Synthetic oligonucleotide
gtaccagggatggcaggaatgctacgc

SEQ ID NO: 391864 - DNA, 27 bp, Artificial Sequence
  Description of Artificial Sequence: Synthetic oligonucleotide
taccagggatggcaggaatgctacgcg

SEQ ID NO: 391865 - DNA, 27 bp, Artificial Sequence
  Description of Artificial Sequence: Synthetic oligonucleotide
accagggatggcaggaatgctacgcgt

SEQ ID NO: 391866 - DNA, 27 bp, Artificial Sequence
  Description of Artificial Sequence: Synthetic oligonucleotide
ccagggatggcaggaatgctacgcgtt

SEQ ID NO: 391867 - DNA, 31 bp, Artificial Sequence; identical to SEQ ID NO: 54405
  Description of Artificial Sequence: Synthetic oligonucleotide

SEQ ID NO: 391868 - DNA, 31 bp, Artificial Sequence; identical to SEQ ID NO: 54406
  Description of Artificial Sequence: Synthetic oligonucleotide

SEQ ID NO: 391869 - DNA, 30 bp, Artificial Sequence; identical to SEQ ID NO: 54407
  Description of Artificial Sequence: Synthetic oligonucleotide

SEQ ID NO: 391870 - DNA, 30 bp, Artificial Sequence; identical to SEQ ID NO: 54408
  Description of Artificial Sequence: Synthetic oligonucleotide

SEQ ID NO: 391871 - DNA, 31 bp, Artificial Sequence; identical to SEQ ID NO: 54409
  Description of Artificial Sequence: Synthetic oligonucleotide

SEQ ID NO: 391872 - DNA, 32 bp, Artificial Sequence; identical to SEQ ID NO: 54410
  Description of Artificial Sequence: Synthetic oligonucleotide

SEQ ID NO: 391873 - DNA, 31 bp, Artificial Sequence; identical to SEQ ID NO: 54411
  Description of Artificial Sequence: Synthetic oligonucleotide

SEQ ID NO: 391874 - DNA, 24 bp, Artificial Sequence
  Description of Artificial Sequence: Synthetic oligonucleotide
aagcgggcagtgccggacaggatg

SEQ ID NO: 391875 - DNA, 23 bp, Artificial Sequence
  Description of Artificial Sequence: Synthetic oligonucleotide
agcgggcagtgccggacaggatg

SEQ ID NO: 391876 - DNA, 22 bp, Artificial Sequence
  Description of Artificial Sequence: Synthetic oligonucleotide
gcgggcagtgccggacaggatg

SEQ ID NO: 391877 - DNA, 22 bp, Artificial Sequence
  Description of Artificial Sequence: Synthetic oligonucleotide
cgggcagtgccggacaggatgc

SEQ ID NO: 391878 - DNA, 22 bp, Artificial Sequence
  Description of Artificial Sequence: Synthetic oligonucleotide
gggcagtgccggacaggatgcg

SEQ ID NO: 391879 - DNA, 23 bp, Artificial Sequence
  Description of Artificial Sequence: Synthetic oligonucleotide
ggcagtgccggacaggatgcgca

SEQ ID NO: 391880 - DNA, 24 bp, Artificial Sequence
  Description of Artificial Sequence: Synthetic oligonucleotide
gcagtgccggacaggatgcgcaga

SEQ ID NO: 391881 - DNA, 25 bp, Artificial Sequence
  Description of Artificial Sequence: Synthetic oligonucleotide
cagtgccggacaggatgcgcagaca

SEQ ID NO: 391882 - DNA, 27 bp, Artificial Sequence
  Description of Artificial Sequence: Synthetic oligonucleotide
agtgccggacaggatgcgcagacacaa

SEQ ID NO: 391883 - DNA, 26 bp, Artificial Sequence
  Description of Artificial Sequence: Synthetic oligonucleotide
gtgccggacaggatgcgcagacacaa

SEQ ID NO: 391884 - DNA, 27 bp, Artificial Sequence
  Description of Artificial Sequence: Synthetic oligonucleotide
tgccggacaggatgcgcagacacaact

SEQ ID NO: 391885 - DNA, 27 bp, Artificial Sequence
  Description of Artificial Sequence: Synthetic oligonucleotide
gccggacaggatgcgcagacacaacta

SEQ ID NO: 391886 - DNA, 27 bp, Artificial Sequence
  Description of Artificial Sequence: Synthetic oligonucleotide
ccggacaggatgcgcagacacaactac

SEQ ID NO: 391887 - DNA, 27 bp, Artificial Sequence
  Description of Artificial Sequence: Synthetic oligonucleotide
cggacaggatgcgcagacacaactacg

SEQ ID NO: 391888 - DNA, 28 bp, Artificial Sequence
  Description of Artificial Sequence: Synthetic oligonucleotide
ggacaggatgcgcagacacaactacgag

SEQ ID NO: 391889 - DNA, 28 bp, Artificial Sequence
  Description of Artificial Sequence: Synthetic oligonucleotide
gacaggatgcgcagacacaactacgagc

SEQ ID NO: 391890 - DNA, 29 bp, Artificial Sequence
  Description of Artificial Sequence: Synthetic oligonucleotide
acaggatgcgcagacacaactacgagctg

SEQ ID NO: 391891 - DNA, 28 bp, Artificial Sequence
  Description of Artificial Sequence: Synthetic oligonucleotide
caggatgcgcagacacaactacgagctg

SEQ ID NO: 391892 - DNA, 28 bp, Artificial Sequence
  Description of Artificial Sequence: Synthetic oligonucleotide
aggatgcgcagacacaactacgagctgg

SEQ ID NO: 391893 - DNA, 27 bp, Artificial Sequence
  Description of Artificial Sequence: Synthetic oligonucleotide
ggatgcgcagacacaactacgagctgg

SEQ ID NO: 391894 - DNA, 27 bp, Artificial Sequence
  Description of Artificial Sequence: Synthetic oligonucleotide
gatgcgcagacacaactacgagctggg

SEQ ID NO: 391895 - DNA, 27 bp, Artificial Sequence
  Description of Artificial Sequence: Synthetic oligonucleotide
atgcgcagacacaactacgagctgggc

SEQ ID NO: 391896 - DNA, 26 bp, Artificial Sequence
  Description of Artificial Sequence: Synthetic oligonucleotide
tgcgcagacacaactacgagctgggc

SEQ ID NO: 391897 - DNA, 25 bp, Artificial Sequence
  Description of Artificial Sequence: Synthetic oligonucleotide
gcgcagacacaactacgagctgggc

SEQ ID NO: 391898 - DNA, 25 bp, Artificial Sequence
  Description of Artificial Sequence: Synthetic oligonucleotide
cgcagacacaactacgagctgggcg

SEQ ID NO: 391899 - DNA, 33 bp, Artificial Sequence
  Description of Artificial Sequence: Synthetic oligonucleotide
acagcgcttcctggagagatacatctacaactg

SEQ ID NO: 391900 - DNA, 32 bp, Artificial Sequence
  Description of Artificial Sequence: Synthetic oligonucleotide
cagcgcttcctggagagatacatctacaactg

SEQ ID NO: 391901 - DNA, 32 bp, Artificial Sequence
  Description of Artificial Sequence: Synthetic oligonucleotide
agcgcttcctggagagatacatctacaactgg

SEQ ID NO: 391902 - DNA, 31 bp, Artificial Sequence
  Description of Artificial Sequence: Synthetic oligonucleotide
gcgcttcctggagagatacatctacaactgg

SEQ ID NO: 391903 - DNA, 31 bp, Artificial Sequence
  Description of Artificial Sequence: Synthetic oligonucleotide
cgcttcctggagagatacatctacaactggg

SEQ ID NO: 391904 - DNA, 32 bp, Artificial Sequence
  Description of Artificial Sequence: Synthetic oligonucleotide
gcttcctggagagatacatctacaactgggag

SEQ ID NO: 391905 - DNA, 32 bp, Artificial Sequence
  Description of Artificial Sequence: Synthetic oligonucleotide
cttcctggagagatacatctacaactgggagg

SEQ ID NO: 391906 - DNA, 33 bp, Artificial Sequence
  Description of Artificial Sequence: Synthetic oligonucleotide
ttcctggagagatacatctacaactgggaggag

SEQ ID NO: 391907 - DNA, 32 bp, Artificial Sequence
  Description of Artificial Sequence: Synthetic oligonucleotide
tcctggagagatacatctacaactgggaggag

SEQ ID NO: 391908 - DNA, 31 bp, Artificial Sequence
  Description of Artificial Sequence: Synthetic oligonucleotide
cctggagagatacatctacaactgggaggag

SEQ ID NO: 391909 - DNA, 33 bp, Artificial Sequence
  Description of Artificial Sequence: Synthetic oligonucleotide
ctggagagatacatctacaactgggaggagttc

SEQ ID NO: 391910 - DNA, 33 bp, Artificial Sequence
  Description of Artificial Sequence: Synthetic oligonucleotide
tggagagatacatctacaactgggaggagttcg

SEQ ID NO: 391911 - DNA, 32 bp, Artificial Sequence
  Description of Artificial Sequence: Synthetic oligonucleotide
ggagagatacatctacaactgggaggagttcg

SEQ ID NO: 391912 - DNA, 33 bp, Artificial Sequence
  Description of Artificial Sequence: Synthetic oligonucleotide
gagagatacatctacaactgggaggagttcgtg

SEQ ID NO: 391913 - DNA, 33 bp, Artificial Sequence
  Description of Artificial Sequence: Synthetic oligonucleotide
agagatacatctacaactgggaggagttcgtgc

SEQ ID NO: 391914 - DNA, 32 bp, Artificial Sequence
  Description of Artificial Sequence: Synthetic oligonucleotide
gagatacatctacaactgggaggagttcgtgc

SEQ ID NO: 391915 - DNA, 32 bp, Artificial Sequence
  Description of Artificial Sequence: Synthetic oligonucleotide
agatacatctacaactgggaggagttcgtgcg

SEQ ID NO: 391916 - DNA, 31 bp, Artificial Sequence
  Description of Artificial Sequence: Synthetic oligonucleotide
gatacatctacaactgggaggagttcgtgcg

SEQ ID NO: 391917 - DNA, 31 bp, Artificial Sequence
  Description of Artificial Sequence: Synthetic oligonucleotide
atacatctacaactgggaggagttcgtgcgc

SEQ ID NO: 391918 - DNA, 30 bp, Artificial Sequence
  Description of Artificial Sequence: Synthetic oligonucleotide
tacatctacaactgggaggagttcgtgcgc

SEQ ID NO: 391919 - DNA, 29 bp, Artificial Sequence
  Description of Artificial Sequence: Synthetic oligonucleotide
acatctacaactgggaggagttcgtgcgc

SEQ ID NO: 391920 - DNA, 28 bp, Artificial Sequence
  Description of Artificial Sequence: Synthetic oligonucleotide
catctacaactgggaggagttcgtgcgc

SEQ ID NO: 391921 - DNA, 30 bp, Artificial Sequence
  Description of Artificial Sequence: Synthetic oligonucleotide
atctacaactgggaggagttcgtgcgcttc

SEQ ID NO: 391922 - DNA, 29 bp, Artificial Sequence
  Description of Artificial Sequence: Synthetic oligonucleotide
tctacaactgggaggagttcgtgcgcttc

SEQ ID NO: 391923 - DNA, 28 bp, Artificial Sequence
  Description of Artificial Sequence: Synthetic oligonucleotide
ctacaactgggaggagttcgtgcgcttc

SEQ ID NO: 391924 - DNA, 28 bp, Artificial Sequence
  Description of Artificial Sequence: Synthetic oligonucleotide
tacaactgggaggagttcgtgcgcttcg

SEQ ID NO: 391925 - DNA, 27 bp, Artificial Sequence
  Description of Artificial Sequence: Synthetic oligonucleotide
acaactgggaggagttcgtgcgcttcg

SEQ ID NO: 391926 - DNA, 27 bp, Artificial Sequence
  Description of Artificial Sequence: Synthetic oligonucleotide
caactgggaggagttcgtgcgcttcga

SEQ ID NO: 391927 - DNA, 27 bp, Artificial Sequence
  Description of Artificial Sequence: Synthetic oligonucleotide
aactgggaggagttcgtgcgcttcgac

SEQ ID NO: 391928 - DNA, 27 bp, Artificial Sequence
  Description of Artificial Sequence: Synthetic oligonucleotide
actgggaggagttcgtgcgcttcgaca

SEQ ID NO: 391929 - DNA, 26 bp, Artificial Sequence
  Description of Artificial Sequence: Synthetic oligonucleotide
ctgggaggagttcgtgcgcttcgaca

SEQ ID NO: 391930 - DNA, 26 bp, Artificial Sequence
  Description of Artificial Sequence: Synthetic oligonucleotide
tgggaggagttcgtgcgcttcgacag

SEQ ID NO: 391931 - DNA, 25 bp, Artificial Sequence
  Description of Artificial Sequence: Synthetic oligonucleotide
ggcagtgccggacaggatgtgcaca

SEQ ID NO: 391932 - DNA, 26 bp, Artificial Sequence
  Description of Artificial Sequence: Synthetic oligonucleotide
gcagtgccggacaggatgtgcacaca

SEQ ID NO: 391933 - DNA, 27 bp, Artificial Sequence
  Description of Artificial Sequence: Synthetic oligonucleotide
cagtgccggacaggatgtgcacacaca

SEQ ID NO: 391934 - DNA, 28 bp, Artificial Sequence
  Description of Artificial Sequence: Synthetic oligonucleotide
agtgccggacaggatgtgcacacacaac

SEQ ID NO: 391935 - DNA, 27 bp, Artificial Sequence
  Description of Artificial Sequence: Synthetic oligonucleotide
gtgccggacaggatgtgcacacacaac

SEQ ID NO: 391936 - DNA, 29 bp, Artificial Sequence
  Description of Artificial Sequence: Synthetic oligonucleotide
tgccggacaggatgtgcacacacaactac

SEQ ID NO: 391937 - DNA, 28 bp, Artificial Sequence
  Description of Artificial Sequence: Synthetic oligonucleotide
gccggacaggatgtgcacacacaactac

SEQ ID NO: 391938 - DNA, 28 bp, Artificial Sequence
  Description of Artificial Sequence: Synthetic oligonucleotide
ccggacaggatgtgcacacacaactacg

SEQ ID NO: 391939 - DNA, 29 bp, Artificial Sequence
  Description of Artificial Sequence: Synthetic oligonucleotide
cggacaggatgtgcacacacaactacgag

SEQ ID NO: 391940 - DNA, 29 bp, Artificial Sequence
  Description of Artificial Sequence: Synthetic oligonucleotide
ggacaggatgtgcacacacaactacgagc

SEQ ID NO: 391941 - DNA, 30 bp, Artificial Sequence
  Description of Artificial Sequence: Synthetic oligonucleotide
gacaggatgtgcacacacaactacgagctg

SEQ ID NO: 391942 - DNA, 30 bp, Artificial Sequence
  Description of Artificial Sequence: Synthetic oligonucleotide
acaggatgtgcacacacaactacgagctgg

SEQ ID NO: 391943 - DNA, 29 bp, Artificial Sequence
  Description of Artificial Sequence: Synthetic oligonucleotide
caggatgtgcacacacaactacgagctgg

SEQ ID NO: 391944 - DNA, 29 bp, Artificial Sequence
  Description of Artificial Sequence: Synthetic oligonucleotide
aggatgtgcacacacaactacgagctggg

SEQ ID NO: 391945 - DNA, 28 bp, Artificial Sequence
  Description of Artificial Sequence: Synthetic oligonucleotide
ggatgtgcacacacaactacgagctggg

SEQ ID NO: 391946 - DNA, 28 bp, Artificial Sequence
  Description of Artificial Sequence: Synthetic oligonucleotide
gatgtgcacacacaactacgagctgggc

SEQ ID NO: 391947 - DNA, 28 bp, Artificial Sequence
  Description of Artificial Sequence: Synthetic oligonucleotide
atgtgcacacacaactacgagctgggcg

SEQ ID NO: 391948 - DNA, 27 bp, Artificial Sequence
  Description of Artificial Sequence: Synthetic oligonucleotide
tgtgcacacacaactacgagctgggcg

SEQ ID NO: 391949 - DNA, 26 bp, Artificial Sequence
  Description of Artificial Sequence: Synthetic oligonucleotide
gtgcacacacaactacgagctgggcg

SEQ ID NO: 391950 - DNA, 26 bp, Artificial Sequence
  Description of Artificial Sequence: Synthetic oligonucleotide
tgcacacacaactacgagctgggcgg

SEQ ID NO: 391951 - DNA, 25 bp, Artificial Sequence
  Description of Artificial Sequence: Synthetic oligonucleotide
gcacacacaactacgagctgggcgg

SEQ ID NO: 391952 - DNA, 25 bp, Artificial Sequence
  Description of Artificial Sequence: Synthetic oligonucleotide
cacacacaactacgagctgggcggg

SEQ ID NO: 391953 - DNA, 25 bp, Artificial Sequence
  Description of Artificial Sequence: Synthetic oligonucleotide
acacacaactacgagctgggcgggc

SEQ ID NO: 391954 - DNA, 24 bp, Artificial Sequence
  Description of Artificial Sequence: Synthetic oligonucleotide
cacacaactacgagctgggcgggc

SEQ ID NO: 391955 - DNA, 30 bp, Artificial Sequence; identical to SEQ ID NO: 54437
  Description of Artificial Sequence: Synthetic oligonucleotide

SEQ ID NO: 391956 - DNA, 29 bp, Artificial Sequence
  Description of Artificial Sequence: Synthetic oligonucleotide
ggatgtgcagacacaactacgagctggtc

SEQ ID NO: 391957 - DNA, 29 bp, Artificial Sequence
  Description of Artificial Sequence: Synthetic oligonucleotide
gatgtgcagacacaactacgagctggtcg

SEQ ID NO: 391958 - DNA, 29 bp, Artificial Sequence
  Description of Artificial Sequence: Synthetic oligonucleotide
atgtgcagacacaactacgagctggtcgg

SEQ ID NO: 391959 - DNA, 28 bp, Artificial Sequence
  Description of Artificial Sequence: Synthetic oligonucleotide
tgtgcagacacaactacgagctggtcgg

SEQ ID NO: 391960 - DNA, 27 bp, Artificial Sequence
  Description of Artificial Sequence: Synthetic oligonucleotide
gtgcagacacaactacgagctggtcgg

SEQ ID NO: 391961 - DNA, 27 bp, Artificial Sequence
  Description of Artificial Sequence: Synthetic oligonucleotide
tgcagacacaactacgagctggtcggg

SEQ ID NO: 391962 - DNA, 26 bp, Artificial Sequence
  Description of Artificial Sequence: Synthetic oligonucleotide
gcagacacaactacgagctggtcggg

SEQ ID NO: 391963 - DNA, 26 bp, Artificial Sequence
  Description of Artificial Sequence: Synthetic oligonucleotide
cagacacaactacgagctggtcgggc

SEQ ID NO: 391964 - DNA, 26 bp, Artificial Sequence
  Description of Artificial Sequence: Synthetic oligonucleotide
agacacaactacgagctggtcgggcc

SEQ ID NO: 391965 - DNA, 25 bp, Artificial Sequence
  Description of Artificial Sequence: Synthetic oligonucleotide
gacacaactacgagctggtcgggcc

SEQ ID NO: 391966 - DNA, 27 bp, Artificial Sequence
  Description of Artificial Sequence: Synthetic oligonucleotide
acacaactacgagctggtcgggcccat

SEQ ID NO: 391967 - DNA, 26 bp, Artificial Sequence
  Description of Artificial Sequence: Synthetic oligonucleotide
cacaactacgagctggtcgggcccat

SEQ ID NO: 391968 - DNA, 27 bp, Artificial Sequence
  Description of Artificial Sequence: Synthetic oligonucleotide
acaactacgagctggtcgggcccatga

SEQ ID NO: 391969 - DNA, 26 bp, Artificial Sequence
  Description of Artificial Sequence: Synthetic oligonucleotide
caactacgagctggtcgggcccatga

SEQ ID NO: 391970 - DNA, 26 bp, Artificial Sequence
  Description of Artificial Sequence: Synthetic oligonucleotide
aactacgagctggtcgggcccatgac

SEQ ID NO: 391971 - DNA, 25 bp, Artificial Sequence
  Description of Artificial Sequence: Synthetic oligonucleotide
actacgagctggtcgggcccatgac

SEQ ID NO: 391972 - DNA, 24 bp, Artificial Sequence
  Description of Artificial Sequence: Synthetic oligonucleotide
ctacgagctggtcgggcccatgac

SEQ ID NO: 391973 - DNA, 24 bp, Artificial Sequence
  Description of Artificial Sequence: Synthetic oligonucleotide
tacgagctggtcgggcccatgacc

SEQ ID NO: 391974 - DNA, 23 bp, Artificial Sequence
  Description of Artificial Sequence: Synthetic oligonucleotide
acgagctggtcgggcccatgacc

SEQ ID NO: 391975 - DNA, 22 bp, Artificial Sequence
  Description of Artificial Sequence: Synthetic oligonucleotide
cgagctggtcgggcccatgacc

SEQ ID NO: 391976 - DNA, 23 bp, Artificial Sequence
  Description of Artificial Sequence: Synthetic oligonucleotide
gagctggtcgggcccatgaccct

SEQ ID NO: 391977 - DNA, 23 bp, Artificial Sequence
  Description of Artificial Sequence: Synthetic oligonucleotide
agctggtcgggcccatgaccctg

SEQ ID NO: 391978 - DNA, 22 bp, Artificial Sequence
  Description of Artificial Sequence: Synthetic oligonucleotide
gctggtcgggcccatgaccctg

SEQ ID NO: 391979 - DNA, 23 bp, Artificial Sequence
  Description of Artificial Sequence: Synthetic oligonucleotide
ctggtcgggcccatgaccctgca

SEQ ID NO: 391980 - DNA, 23 bp, Artificial Sequence
  Description of Artificial Sequence: Synthetic oligonucleotide
tggtcgggcccatgaccctgcag

SEQ ID NO: 391981 - DNA, 22 bp, Artificial Sequence
  Description of Artificial Sequence: Synthetic oligonucleotide
ggtcgggcccatgaccctgcag

SEQ ID NO: 391982 - DNA, 22 bp, Artificial Sequence
  Description of Artificial Sequence: Synthetic oligonucleotide
gtcgggcccatgaccctgcagc

SEQ ID NO: 391983 - DNA, 22 bp, Artificial Sequence
  Description of Artificial Sequence: Synthetic oligonucleotide
tcgggcccatgaccctgcagcg

SEQ ID NO: 391984 - DNA, 27 bp, Artificial Sequence
  Description of Artificial Sequence: Synthetic oligonucleotide
cacaccagcctggacagtcctgtcact

SEQ ID NO: 391985 - DNA, 27 bp, Artificial Sequence
  Description of Artificial Sequence: Synthetic oligonucleotide
acaccagcctggacagtcctgtcactg

SEQ ID NO: 391986 - DNA, 27 bp, Artificial Sequence
  Description of Artificial Sequence: Synthetic oligonucleotide
caccagcctggacagtcctgtcactgt

SEQ ID NO: 391987 - DNA, 27 bp, Artificial Sequence
  Description of Artificial Sequence: Synthetic oligonucleotide
accagcctggacagtcctgtcactgtg

SEQ ID NO: 391988 - DNA, 26 bp, Artificial Sequence
  Description of Artificial Sequence: Synthetic oligonucleotide
ccagcctggacagtcctgtcactgtg

SEQ ID NO: 391989 - DNA, 27 bp, Artificial Sequence
  Description of Artificial Sequence: Synthetic oligonucleotide
cagcctggacagtcctgtcactgtgga

SEQ ID NO: 391990 - DNA, 27 bp, Artificial Sequence
  Description of Artificial Sequence: Synthetic oligonucleotide
agcctggacagtcctgtcactgtggag

SEQ ID NO: 391991 - DNA, 27 bp, Artificial Sequence
  Description of Artificial Sequence: Synthetic oligonucleotide
gcctggacagtcctgtcactgtggagt

SEQ ID NO: 391992 - DNA, 27 bp, Artificial Sequence
  Description of Artificial Sequence: Synthetic oligonucleotide
cctggacagtcctgtcactgtggagtg

SEQ ID NO: 391993 - DNA, 27 bp, Artificial Sequence
  Description of Artificial Sequence: Synthetic oligonucleotide
ctggacagtcctgtcactgtggagtgg

SEQ ID NO: 391994 - DNA, 29 bp, Artificial Sequence
  Description of Artificial Sequence: Synthetic oligonucleotide
tggacagtcctgtcactgtggagtggaag

SEQ ID NO: 391995 - DNA, 28 bp, Artificial Sequence
  Description of Artificial Sequence: Synthetic oligonucleotide
ggacagtcctgtcactgtggagtggaag

SEQ ID NO: 391996 - DNA, 28 bp, Artificial Sequence
  Description of Artificial Sequence: Synthetic oligonucleotide
gacagtcctgtcactgtggagtggaagg

SEQ ID NO: 391997 - DNA, 28 bp, Artificial Sequence
  Description of Artificial Sequence: Synthetic oligonucleotide
acagtcctgtcactgtggagtggaaggc

SEQ ID NO: 391998 - DNA, 27 bp, Artificial Sequence
  Description of Artificial Sequence: Synthetic oligonucleotide
cagtcctgtcactgtggagtggaaggc

SEQ ID NO: 391999 - DNA, 28 bp, Artificial Sequence
  Description of Artificial Sequence: Synthetic oligonucleotide
agtcctgtcactgtggagtggaaggcac

SEQ ID NO: 392000 - DNA, 27 bp, Artificial Sequence
  Description of Artificial Sequence: Synthetic oligonucleotide
gtcctgtcactgtggagtggaaggcac

SEQ ID NO: 392001 - DNA, 28 bp, Artificial Sequence
  Description of Artificial Sequence: Synthetic oligonucleotide
tcctgtcactgtggagtggaaggcacag

SEQ ID NO: 392002 - DNA, 27 bp, Artificial Sequence
  Description of Artificial Sequence: Synthetic oligonucleotide
cctgtcactgtggagtggaaggcacag

SEQ ID NO: 392003 - DNA, 28 bp, Artificial Sequence
  Description of Artificial Sequence: Synthetic oligonucleotide
ctgtcactgtggagtggaaggcacagtc

SEQ ID NO: 392004 - DNA, 29 bp, Artificial Sequence
  Description of Artificial Sequence: Synthetic oligonucleotide
tgtcactgtggagtggaaggcacagtctg

SEQ ID NO: 392005 - DNA, 28 bp, Artificial Sequence
  Description of Artificial Sequence: Synthetic oligonucleotide
gtcactgtggagtggaaggcacagtctg

SEQ ID NO: 392006 - DNA, 31 bp, Artificial Sequence; identical to SEQ ID NO: 54488
  Description of Artificial Sequence: Synthetic oligonucleotide

SEQ ID NO: 392007 - DNA, 30 bp, Artificial Sequence; identical to SEQ ID NO: 54489
  Description of Artificial Sequence: Synthetic oligonucleotide

SEQ ID NO: 392008 - DNA, 31 bp, Artificial Sequence; identical to SEQ ID NO: 54490
  Description of Artificial Sequence: Synthetic oligonucleotide

SEQ ID NO: 392009 - DNA, 30 bp, Artificial Sequence; identical to SEQ ID NO: 54491
  Description of Artificial Sequence: Synthetic oligonucleotide

SEQ ID NO: 392010 - DNA, 30 bp, Artificial Sequence; identical to SEQ ID NO: 54492
  Description of Artificial Sequence: Synthetic oligonucleotide

SEQ ID NO: 392011 - DNA, 26 bp, Artificial Sequence
  Description of Artificial Sequence: Synthetic oligonucleotide
ggggctcatcatctgtggagtgggca

SEQ ID NO: 392012 - DNA, 26 bp, Artificial Sequence
  Description of Artificial Sequence: Synthetic oligonucleotide
gggctcatcatctgtggagtgggcac

SEQ ID NO: 392013 - DNA, 27 bp, Artificial Sequence
  Description of Artificial Sequence: Synthetic oligonucleotide
ggctcatcatctgtggagtgggcacct

SEQ ID NO: 392014 - DNA, 28 bp, Artificial Sequence
  Description of Artificial Sequence: Synthetic oligonucleotide
gctcatcatctgtggagtgggcaccttc

SEQ ID NO: 392015 - DNA, 30 bp, Artificial Sequence; identical to SEQ ID NO: 54497
  Description of Artificial Sequence: Synthetic oligonucleotide

SEQ ID NO: 392016 - DNA, 30 bp, Artificial Sequence; identical to SEQ ID NO: 54498
  Description of Artificial Sequence: Synthetic oligonucleotide

SEQ ID NO: 392017 - DNA, 29 bp, Artificial Sequence
  Description of Artificial Sequence: Synthetic oligonucleotide
catcatctgtggagtgggcaccttcatgc

SEQ ID NO: 392018 - DNA, 30 bp, Artificial Sequence; identical to SEQ ID NO: 54500
  Description of Artificial Sequence: Synthetic oligonucleotide

SEQ ID NO: 392019 - DNA, 29 bp, Artificial Sequence
  Description of Artificial Sequence: Synthetic oligonucleotide
tcatctgtggagtgggcaccttcatgcac

SEQ ID NO: 392020 - DNA, 28 bp, Artificial Sequence
  Description of Artificial Sequence: Synthetic oligonucleotide
catctgtggagtgggcaccttcatgcac

SEQ ID NO: 392021 - DNA, 29 bp, Artificial Sequence
  Description of Artificial Sequence: Synthetic oligonucleotide
atctgtggagtgggcaccttcatgcacag

SEQ ID NO: 392022 - DNA, 28 bp, Artificial Sequence
  Description of Artificial Sequence: Synthetic oligonucleotide
tctgtggagtgggcaccttcatgcacag

SEQ ID NO: 392023 - DNA, 27 bp, Artificial Sequence
  Description of Artificial Sequence: Synthetic oligonucleotide
ctgtggagtgggcaccttcatgcacag

SEQ ID NO: 392024 - DNA, 27 bp, Artificial Sequence
  Description of Artificial Sequence: Synthetic oligonucleotide
tgtggagtgggcaccttcatgcacagg

SEQ ID NO: 392025 - DNA, 27 bp, Artificial Sequence
  Description of Artificial Sequence: Synthetic oligonucleotide
gtggagtgggcaccttcatgcacagga

SEQ ID NO: 392026 - DNA, 27 bp, Artificial Sequence
  Description of Artificial Sequence: Synthetic oligonucleotide
tggagtgggcaccttcatgcacaggag

SEQ ID NO: 392027 - DNA, 26 bp, Artificial Sequence
  Description of Artificial Sequence: Synthetic oligonucleotide
ggagtgggcaccttcatgcacaggag

SEQ ID NO: 392028 - DNA, 27 bp, Artificial Sequence
  Description of Artificial Sequence: Synthetic oligonucleotide
gagtgggcaccttcatgcacaggagga

SEQ ID NO: 392029 - DNA, 27 bp, Artificial Sequence
  Description of Artificial Sequence: Synthetic oligonucleotide
agtgggcaccttcatgcacaggaggag

SEQ ID NO: 392030 - DNA, 26 bp, Artificial Sequence
  Description of Artificial Sequence: Synthetic oligonucleotide
gtgggcaccttcatgcacaggaggag

SEQ ID NO: 392031 - DNA, 27 bp, Artificial Sequence
  Description of Artificial Sequence: Synthetic oligonucleotide
tgggcaccttcatgcacaggaggagca

SEQ ID NO: 392032 - DNA, 27 bp, Artificial Sequence
  Description of Artificial Sequence: Synthetic oligonucleotide
gggcaccttcatgcacaggaggagcaa

SEQ ID NO: 392033 - DNA, 27 bp, Artificial Sequence
  Description of Artificial Sequence: Synthetic oligonucleotide
ggcaccttcatgcacaggaggagcaag

SEQ ID NO: 392034 - DNA, 30 bp, Artificial Sequence; identical to SEQ ID NO: 54516
  Description of Artificial Sequence: Synthetic oligonucleotide

SEQ ID NO: 392035 - DNA, 32 bp, Artificial Sequence; identical to SEQ ID NO: 54517
  Description of Artificial Sequence: Synthetic oligonucleotide

SEQ ID NO: 392036 - DNA, 34 bp, Artificial Sequence; identical to SEQ ID NO: 54518
  Description of Artificial Sequence: Synthetic oligonucleotide

SEQ ID NO: 392037 - DNA, 33 bp, Artificial Sequence; identical to SEQ ID NO: 54519
  Description of Artificial Sequence: Synthetic oligonucleotide

SEQ ID NO: 392038 - DNA, 23 bp, Artificial Sequence
  Description of Artificial Sequence: Synthetic oligonucleotide
acgaggccgtgaccctgcagcgt

SEQ ID NO: 392039 - DNA, 22 bp, Artificial Sequence
  Description of Artificial Sequence: Synthetic oligonucleotide
cgaggccgtgaccctgcagcgt

SEQ ID NO: 392040 - DNA, 22 bp, Artificial Sequence
  Description of Artificial Sequence: Synthetic oligonucleotide
gaggccgtgaccctgcagcgtc

SEQ ID NO: 392041 - DNA, 23 bp, Artificial Sequence
  Description of Artificial Sequence: Synthetic oligonucleotide
aggccgtgaccctgcagcgtcga

SEQ ID NO: 392042 - DNA, 30 bp, Artificial Sequence; identical to SEQ ID NO: 54524
  Description of Artificial Sequence: Synthetic oligonucleotide

SEQ ID NO: 392043 - DNA, 29 bp, Artificial Sequence
  Description of Artificial Sequence: Synthetic oligonucleotide
tgaggagtactggaacagccagaaggacc

SEQ ID NO: 392044 - DNA, 28 bp, Artificial Sequence
  Description of Artificial Sequence: Synthetic oligonucleotide
gaggagtactggaacagccagaaggacc

SEQ ID NO: 392045 - DNA, 29 bp, Artificial Sequence
  Description of Artificial Sequence: Synthetic oligonucleotide
aggagtactggaacagccagaaggacctc

SEQ ID NO: 392046 - DNA, 24 bp, Artificial Sequence
  Description of Artificial Sequence: Synthetic oligonucleotide
gagaagcgggcagtgccggacaga

SEQ ID NO: 392047 - DNA, 27 bp, Artificial Sequence
  Description of Artificial Sequence: Synthetic oligonucleotide
agaagcgggcagtgccggacagagtat

SEQ ID NO: 392048 - DNA, 26 bp, Artificial Sequence
  Description of Artificial Sequence: Synthetic oligonucleotide
gaagcgggcagtgccggacagagtat

SEQ ID NO: 392049 - DNA, 26 bp, Artificial Sequence
  Description of Artificial Sequence: Synthetic oligonucleotide
aagcgggcagtgccggacagagtatg

SEQ ID NO: 392050 - DNA, 25 bp, Artificial Sequence
  Description of Artificial Sequence: Synthetic oligonucleotide
agcgggcagtgccggacagagtatg

SEQ ID NO: 392051 - DNA, 24 bp, Artificial Sequence
  Description of Artificial Sequence: Synthetic oligonucleotide
gcgggcagtgccggacagagtatg

SEQ ID NO: 392052 - DNA, 25 bp, Artificial Sequence
  Description of Artificial Sequence: Synthetic oligonucleotide
cgggcagtgccggacagagtatgca

SEQ ID NO: 392053 - DNA, 26 bp, Artificial Sequence
  Description of Artificial Sequence: Synthetic oligonucleotide
gggcagtgccggacagagtatgcaga

SEQ ID NO: 392054 - DNA, 27 bp, Artificial Sequence
  Description of Artificial Sequence: Synthetic oligonucleotide
ggcagtgccggacagagtatgcagaca

SEQ ID NO: 392055 - DNA, 27 bp, Artificial Sequence
  Description of Artificial Sequence: Synthetic oligonucleotide
gcagtgccggacagagtatgcagacac

SEQ ID NO: 392056 - DNA, 29 bp, Artificial Sequence
  Description of Artificial Sequence: Synthetic oligonucleotide
cagtgccggacagagtatgcagacacaac

SEQ ID NO: 392057 - DNA, 31 bp, Artificial Sequence; identical to SEQ ID NO: 54539
  Description of Artificial Sequence: Synthetic oligonucleotide

SEQ ID NO: 392058 - DNA, 30 bp, Artificial Sequence; identical to SEQ ID NO: 54540
  Description of Artificial Sequence: Synthetic oligonucleotide

SEQ ID NO: 392059 - DNA, 30 bp, Artificial Sequence; identical to SEQ ID NO: 54541
  Description of Artificial Sequence: Synthetic oligonucleotide

SEQ ID NO: 392060 - DNA, 29 bp, Artificial Sequence
  Description of Artificial Sequence: Synthetic oligonucleotide
gccggacagagtatgcagacacaactacg

SEQ ID NO: 392061 - DNA, 30 bp, Artificial Sequence; identical to SEQ ID NO: 54543
  Description of Artificial Sequence: Synthetic oligonucleotide

SEQ ID NO: 392062 - DNA, 30 bp, Artificial Sequence; identical to SEQ ID NO: 54544
  Description of Artificial Sequence: Synthetic oligonucleotide

SEQ ID NO: 392063 - DNA, 31 bp, Artificial Sequence; identical to SEQ ID NO: 54545
  Description of Artificial Sequence: Synthetic oligonucleotide

SEQ ID NO: 392064 - DNA, 31 bp, Artificial Sequence; identical to SEQ ID NO: 54546
  Description of Artificial Sequence: Synthetic oligonucleotide

SEQ ID NO: 392065 - DNA, 32 bp, Artificial Sequence; identical to SEQ ID NO: 54547
  Description of Artificial Sequence: Synthetic oligonucleotide

SEQ ID NO: 392066 - DNA, 31 bp, Artificial Sequence; identical to SEQ ID NO: 54548
  Description of Artificial Sequence: Synthetic oligonucleotide

SEQ ID NO: 392067 - DNA, 31 bp, Artificial Sequence; identical to SEQ ID NO: 54549
  Description of Artificial Sequence: Synthetic oligonucleotide

SEQ ID NO: 392068 - DNA, 30 bp, Artificial Sequence; identical to SEQ ID NO: 54550
  Description of Artificial Sequence: Synthetic oligonucleotide

SEQ ID NO: 392069 - DNA, 31 bp, Artificial Sequence; identical to SEQ ID NO: 54551
  Description of Artificial Sequence: Synthetic oligonucleotide

SEQ ID NO: 392070 - DNA, 26 bp, Artificial Sequence
  Description of Artificial Sequence: Synthetic oligonucleotide
gacctcctggaggagaagcgggcatt

SEQ ID NO: 392071 - DNA, 26 bp, Artificial Sequence
  Description of Artificial Sequence: Synthetic oligonucleotide
acctcctggaggagaagcgggcattg

SEQ ID NO: 392072 - DNA, 25 bp, Artificial Sequence
  Description of Artificial Sequence: Synthetic oligonucleotide
cctcctggaggagaagcgggcattg

SEQ ID NO: 392073 - DNA, 25 bp, Artificial Sequence
  Description of Artificial Sequence: Synthetic oligonucleotide
ctcctggaggagaagcgggcattgc

SEQ ID NO: 392074 - DNA, 25 bp, Artificial Sequence
  Description of Artificial Sequence: Synthetic oligonucleotide
tcctggaggagaagcgggcattgcc

SEQ ID NO: 392075 - DNA, 24 bp, Artificial Sequence
  Description of Artificial Sequence: Synthetic oligonucleotide
cctggaggagaagcgggcattgcc

SEQ ID NO: 392076 - DNA, 24 bp, Artificial Sequence
  Description of Artificial Sequence: Synthetic oligonucleotide
ctggaggagaagcgggcattgccg

SEQ ID NO: 392077 - DNA, 25 bp, Artificial Sequence
  Description of Artificial Sequence: Synthetic oligonucleotide
tggaggagaagcgggcattgccgga

SEQ ID NO: 392078 - DNA, 24 bp, Artificial Sequence
  Description of Artificial Sequence: Synthetic oligonucleotide
ggaggagaagcgggcattgccgga

SEQ ID NO: 392079 - DNA, 25 bp, Artificial Sequence
  Description of Artificial Sequence: Synthetic oligonucleotide
gaggagaagcgggcattgccggaca

SEQ ID NO: 392080 - DNA, 25 bp, Artificial Sequence
  Description of Artificial Sequence: Synthetic oligonucleotide
aggagaagcgggcattgccggacag

SEQ ID NO: 392081 - DNA, 24 bp, Artificial Sequence
  Description of Artificial Sequence: Synthetic oligonucleotide
ggagaagcgggcattgccggacag

SEQ ID NO: 392082 - DNA, 26 bp, Artificial Sequence
  Description of Artificial Sequence: Synthetic oligonucleotide
gagaagcgggcattgccggacaggat

SEQ ID NO: 392083 - DNA, 27 bp, Artificial Sequence
  Description of Artificial Sequence: Synthetic oligonucleotide
agaagcgggcattgccggacaggatgt

SEQ ID NO: 392084 - DNA, 26 bp, Artificial Sequence
  Description of Artificial Sequence: Synthetic oligonucleotide
gaagcgggcattgccggacaggatgt

SEQ ID NO: 392085 - DNA, 26 bp, Artificial Sequence
  Description of Artificial Sequence: Synthetic oligonucleotide
aagcgggcattgccggacaggatgtg

SEQ ID NO: 392086 - DNA, 25 bp, Artificial Sequence
  Description of Artificial Sequence: Synthetic oligonucleotide
agcgggcattgccggacaggatgtg

SEQ ID NO: 392087 - DNA, 24 bp, Artificial Sequence
  Description of Artificial Sequence: Synthetic oligonucleotide
gcgggcattgccggacaggatgtg

SEQ ID NO: 392088 - DNA, 25 bp, Artificial Sequence
  Description of Artificial Sequence: Synthetic oligonucleotide
cgggcattgccggacaggatgtgca

SEQ ID NO: 392089 - DNA, 26 bp, Artificial Sequence
  Description of Artificial Sequence: Synthetic oligonucleotide
gggcattgccggacaggatgtgcaga

SEQ ID NO: 392090 - DNA, 27 bp, Artificial Sequence
  Description of Artificial Sequence: Synthetic oligonucleotide
ggcattgccggacaggatgtgcagaca

SEQ ID NO: 392091 - DNA, 27 bp, Artificial Sequence
  Description of Artificial Sequence: Synthetic oligonucleotide
gcattgccggacaggatgtgcagacac

SEQ ID NO: 392092 - DNA, 29 bp, Artificial Sequence
  Description of Artificial Sequence: Synthetic oligonucleotide
cattgccggacaggatgtgcagacacaac

SEQ ID NO: 392093 - DNA, 31 bp, Artificial Sequence; identical to SEQ ID NO: 54575
  Description of Artificial Sequence: Synthetic oligonucleotide

SEQ ID NO: 392094 - DNA, 30 bp, Artificial Sequence; identical to SEQ ID NO: 54576
  Description of Artificial Sequence: Synthetic oligonucleotide

SEQ ID NO: 392095 - DNA, 23 bp, Artificial Sequence
  Description of Artificial Sequence: Synthetic oligonucleotide
gagctggggcggcctgatgaggt

SEQ ID NO: 392096 - DNA, 25 bp, Artificial Sequence
  Description of Artificial Sequence: Synthetic oligonucleotide
agctggggcggcctgatgaggtgta

SEQ ID NO: 392097 - DNA, 24 bp, Artificial Sequence
  Description of Artificial Sequence: Synthetic oligonucleotide
gctggggcggcctgatgaggtgta

SEQ ID NO: 392098 - DNA, 25 bp, Artificial Sequence
  Description of Artificial Sequence: Synthetic oligonucleotide
ctggggcggcctgatgaggtgtact

SEQ ID NO: 392099 - DNA, 25 bp, Artificial Sequence
  Description of Artificial Sequence: Synthetic oligonucleotide
tggggcggcctgatgaggtgtactg

SEQ ID NO: 392100 - DNA, 24 bp, Artificial Sequence
  Description of Artificial Sequence: Synthetic oligonucleotide
ggggcggcctgatgaggtgtactg

SEQ ID NO: 392101 - DNA, 26 bp, Artificial Sequence
  Description of Artificial Sequence: Synthetic oligonucleotide
gggcggcctgatgaggtgtactggaa

SEQ ID NO: 392102 - DNA, 27 bp, Artificial Sequence
  Description of Artificial Sequence: Synthetic oligonucleotide
ggcggcctgatgaggtgtactggaaca

SEQ ID NO: 392103 - DNA, 27 bp, Artificial Sequence
  Description of Artificial Sequence: Synthetic oligonucleotide
gcggcctgatgaggtgtactggaacag

SEQ ID NO: 392104 - DNA, 27 bp, Artificial Sequence
  Description of Artificial Sequence: Synthetic oligonucleotide
cggcctgatgaggtgtactggaacagc

SEQ ID NO: 392105 - DNA, 27 bp, Artificial Sequence
  Description of Artificial Sequence: Synthetic oligonucleotide
ggcctgatgaggtgtactggaacagcc

SEQ ID NO: 392106 - DNA, 28 bp, Artificial Sequence
  Description of Artificial Sequence: Synthetic oligonucleotide
gcctgatgaggtgtactggaacagccag

SEQ ID NO: 392107 - DNA, 30 bp, Artificial Sequence; identical to SEQ ID NO: 54589
  Description of Artificial Sequence: Synthetic oligonucleotide

SEQ ID NO: 392108 - DNA, 30 bp, Artificial Sequence; identical to SEQ ID NO: 54590
  Description of Artificial Sequence: Synthetic oligonucleotide

SEQ ID NO: 392109 - DNA, 31 bp, Artificial Sequence; identical to SEQ ID NO: 54591
  Description of Artificial Sequence: Synthetic oligonucleotide

SEQ ID NO: 392110 - DNA, 30 bp, Artificial Sequence; identical to SEQ ID NO: 54592
  Description of Artificial Sequence: Synthetic oligonucleotide

SEQ ID NO: 392111 - DNA, 32 bp, Artificial Sequence; identical to SEQ ID NO: 54593
  Description of Artificial Sequence: Synthetic oligonucleotide

SEQ ID NO: 392112 - DNA, 31 bp, Artificial Sequence; identical to SEQ ID NO: 54594
  Description of Artificial Sequence: Synthetic oligonucleotide

SEQ ID NO: 392113 - DNA, 30 bp, Artificial Sequence; identical to SEQ ID NO: 54595
  Description of Artificial Sequence: Synthetic oligonucleotide

SEQ ID NO: 392114 - DNA, 30 bp, Artificial Sequence; identical to SEQ ID NO: 54596
  Description of Artificial Sequence: Synthetic oligonucleotide

SEQ ID NO: 392115 - DNA, 29 bp, Artificial Sequence
  Description of Artificial Sequence: Synthetic oligonucleotide
ggtgtactggaacagccagaaggacatcc

SEQ ID NO: 392116 - DNA, 30 bp, Artificial Sequence; identical to SEQ ID NO: 54598
  Description of Artificial Sequence: Synthetic oligonucleotide

SEQ ID NO: 392117 - DNA, 30 bp, Artificial Sequence; identical to SEQ ID NO: 54599
  Description of Artificial Sequence: Synthetic oligonucleotide

SEQ ID NO: 392118 - DNA, 35 bp, Artificial Sequence; identical to SEQ ID NO: 54600
  Description of Artificial Sequence: Synthetic oligonucleotide

SEQ ID NO: 392119 - DNA, 34 bp, Artificial Sequence; identical to SEQ ID NO: 54601
  Description of Artificial Sequence: Synthetic oligonucleotide

SEQ ID NO: 392120 - DNA, 34 bp, Artificial Sequence; identical to SEQ ID NO: 54602
  Description of Artificial Sequence: Synthetic oligonucleotide

SEQ ID NO: 392121 - DNA, 33 bp, Artificial Sequence; identical to SEQ ID NO: 54603
  Description of Artificial Sequence: Synthetic oligonucleotide

SEQ ID NO: 392122 - DNA, 32 bp, Artificial Sequence; identical to SEQ ID NO: 54604
  Description of Artificial Sequence: Synthetic oligonucleotide

SEQ ID NO: 392123 - DNA, 31 bp, Artificial Sequence; identical to SEQ ID NO: 54605
  Description of Artificial Sequence: Synthetic oligonucleotide

SEQ ID NO: 392124 - DNA, 30 bp, Artificial Sequence; identical to SEQ ID NO: 54606
  Description of Artificial Sequence: Synthetic oligonucleotide

SEQ ID NO: 392125 - DNA, 29 bp, Artificial Sequence
  Description of Artificial Sequence: Synthetic oligonucleotide
cgttcaccagttacggcaggaatgctacg

SEQ ID NO: 392126 - DNA, 29 bp, Artificial Sequence
  Description of Artificial Sequence: Synthetic oligonucleotide
gttcaccagttacggcaggaatgctacgc

SEQ ID NO: 392127 - DNA, 29 bp, Artificial Sequence
  Description of Artificial Sequence: Synthetic oligonucleotide
ttcaccagttacggcaggaatgctacgcg

SEQ ID NO: 392128 - DNA, 28 bp, Artificial Sequence
  Description of Artificial Sequence: Synthetic oligonucleotide
tcaccagttacggcaggaatgctacgcg

SEQ ID NO: 392129 - DNA, 24 bp, Artificial Sequence
  Description of Artificial Sequence: Synthetic oligonucleotide
tggacgaggccgtgaccctgcaga

SEQ ID NO: 392130 - DNA, 23 bp, Artificial Sequence
  Description of Artificial Sequence: Synthetic oligonucleotide
ggacgaggccgtgaccctgcaga

SEQ ID NO: 392131 - DNA, 23 bp, Artificial Sequence
  Description of Artificial Sequence: Synthetic oligonucleotide
gacgaggccgtgaccctgcagag

SEQ ID NO: 392132 - DNA, 23 bp, Artificial Sequence
  Description of Artificial Sequence: Synthetic oligonucleotide
acgaggccgtgaccctgcagagc

SEQ ID NO: 392133 - DNA, 22 bp, Artificial Sequence
  Description of Artificial Sequence: Synthetic oligonucleotide
cgaggccgtgaccctgcagagc

SEQ ID NO: 392134 - DNA, 22 bp, Artificial Sequence
  Description of Artificial Sequence: Synthetic oligonucleotide
gaggccgtgaccctgcagagcc

SEQ ID NO: 392135 - DNA, 23 bp, Artificial Sequence
  Description of Artificial Sequence: Synthetic oligonucleotide
aggccgtgaccctgcagagccga

SEQ ID NO: 392136 - DNA, 22 bp, Artificial Sequence
  Description of Artificial Sequence: Synthetic oligonucleotide
ggccgtgaccctgcagagccga

SEQ ID NO: 392137 - DNA, 23 bp, Artificial Sequence
  Description of Artificial Sequence: Synthetic oligonucleotide
gccgtgaccctgcagagccgagt

SEQ ID NO: 392138 - DNA, 23 bp, Artificial Sequence
  Description of Artificial Sequence: Synthetic oligonucleotide
ccgtgaccctgcagagccgagtc

SEQ ID NO: 392139 - DNA, 24 bp, Artificial Sequence
  Description of Artificial Sequence: Synthetic oligonucleotide
cgtgaccctgcagagccgagtcca

SEQ ID NO: 392140 - DNA, 24 bp, Artificial Sequence
  Description of Artificial Sequence: Synthetic oligonucleotide
gtgaccctgcagagccgagtccag

SEQ ID NO: 392141 - DNA, 24 bp, Artificial Sequence
  Description of Artificial Sequence: Synthetic oligonucleotide
tgaccctgcagagccgagtccagc

SEQ ID NO: 392142 - DNA, 23 bp, Artificial Sequence
  Description of Artificial Sequence: Synthetic oligonucleotide
gaccctgcagagccgagtccagc

SEQ ID NO: 392143 - DNA, 26 bp, Artificial Sequence
  Description of Artificial Sequence: Synthetic oligonucleotide
accctgcagagccgagtccagcctaa

SEQ ID NO: 392144 - DNA, 25 bp, Artificial Sequence
  Description of Artificial Sequence: Synthetic oligonucleotide
ccctgcagagccgagtccagcctaa

SEQ ID NO: 392145 - DNA, 25 bp, Artificial Sequence
  Description of Artificial Sequence: Synthetic oligonucleotide
cctgcagagccgagtccagcctaag

SEQ ID NO: 392146 - DNA, 26 bp, Artificial Sequence
  Description of Artificial Sequence: Synthetic oligonucleotide
ctgcagagccgagtccagcctaaggt

SEQ ID NO: 392147 - DNA, 27 bp, Artificial Sequence
  Description of Artificial Sequence: Synthetic oligonucleotide
tgcagagccgagtccagcctaaggtga

SEQ ID NO: 392148 - DNA, 27 bp, Artificial Sequence
  Description of Artificial Sequence: Synthetic oligonucleotide
gcagagccgagtccagcctaaggtgaa

SEQ ID NO: 392149 - DNA, 27 bp, Artificial Sequence
  Description of Artificial Sequence: Synthetic oligonucleotide
cagagccgagtccagcctaaggtgaac

SEQ ID NO: 392150 - DNA, 27 bp, Artificial Sequence
  Description of Artificial Sequence: Synthetic oligonucleotide
agagccgagtccagcctaaggtgaacg

SEQ ID NO: 392151 - DNA, 27 bp, Artificial Sequence
  Description of Artificial Sequence: Synthetic oligonucleotide
gagccgagtccagcctaaggtgaacgt

SEQ ID NO: 392152 - DNA, 29 bp, Artificial Sequence
  Description of Artificial Sequence: Synthetic oligonucleotide
agccgagtccagcctaaggtgaacgtttc

SEQ ID NO: 392153 - DNA, 28 bp, Artificial Sequence
  Description of Artificial Sequence: Synthetic oligonucleotide
cttttccagggacggcaggaatgctacc

SEQ ID NO: 392154 - DNA, 28 bp, Artificial Sequence
  Description of Artificial Sequence: Synthetic oligonucleotide
ttttccagggacggcaggaatgctaccc

SEQ ID NO: 392155 - DNA, 27 bp, Artificial Sequence
  Description of Artificial Sequence: Synthetic oligonucleotide
tttccagggacggcaggaatgctaccc

SEQ ID NO: 392156 - DNA, 26 bp, Artificial Sequence
  Description of Artificial Sequence: Synthetic oligonucleotide
ttccagggacggcaggaatgctaccc

SEQ ID NO: 392157 - DNA, 25 bp, Artificial Sequence
  Description of Artificial Sequence: Synthetic oligonucleotide
tccagggacggcaggaatgctaccc

SEQ ID NO: 392158 - DNA, 24 bp, Artificial Sequence
  Description of Artificial Sequence: Synthetic oligonucleotide
ccagggacggcaggaatgctaccc

SEQ ID NO: 392159 - DNA, 27 bp, Artificial Sequence
  Description of Artificial Sequence: Synthetic oligonucleotide
cagggacggcaggaatgctacccgttt

SEQ ID NO: 392160 - DNA, 30 bp, Artificial Sequence; identical to SEQ ID NO: 54642
  Description of Artificial Sequence: Synthetic oligonucleotide

SEQ ID NO: 392161 - DNA, 29 bp, Artificial Sequence
  Description of Artificial Sequence: Synthetic oligonucleotide
gggacggcaggaatgctacccgtttaatg

SEQ ID NO: 392162 - DNA, 29 bp, Artificial Sequence
  Description of Artificial Sequence: Synthetic oligonucleotide
ggacggcaggaatgctacccgtttaatgg

SEQ ID NO: 392163 - DNA, 29 bp, Artificial Sequence
  Description of Artificial Sequence: Synthetic oligonucleotide
gacggcaggaatgctacccgtttaatggg

SEQ ID NO: 392164 - DNA, 30 bp, Artificial Sequence; identical to SEQ ID NO: 54646
  Description of Artificial Sequence: Synthetic oligonucleotide

SEQ ID NO: 392165 - DNA, 29 bp, Artificial Sequence
  Description of Artificial Sequence: Synthetic oligonucleotide
cggcaggaatgctacccgtttaatgggac

SEQ ID NO: 392166 - DNA, 30 bp, Artificial Sequence; identical to SEQ ID NO: 54648
  Description of Artificial Sequence: Synthetic oligonucleotide

SEQ ID NO: 392167 - DNA, 31 bp, Artificial Sequence; identical to SEQ ID NO: 54649
  Description of Artificial Sequence: Synthetic oligonucleotide

SEQ ID NO: 392168 - DNA, 31 bp, Artificial Sequence; identical to SEQ ID NO: 54650
  Description of Artificial Sequence: Synthetic oligonucleotide

SEQ ID NO: 392169 - DNA, 31 bp, Artificial Sequence; identical to SEQ ID NO: 54651
  Description of Artificial Sequence: Synthetic oligonucleotide

SEQ ID NO: 392170 - DNA, 30 bp, Artificial Sequence; identical to SEQ ID NO: 54652
  Description of Artificial Sequence: Synthetic oligonucleotide

SEQ ID NO: 392171 - DNA, 30 bp, Artificial Sequence; identical to SEQ ID NO: 54653
  Description of Artificial Sequence: Synthetic oligonucleotide

SEQ ID NO: 392172 - DNA, 32 bp, Artificial Sequence; identical to SEQ ID NO: 54654
  Description of Artificial Sequence: Synthetic oligonucleotide

SEQ ID NO: 392173 - DNA, 31 bp, Artificial Sequence; identical to SEQ ID NO: 54655
  Description of Artificial Sequence: Synthetic oligonucleotide

SEQ ID NO: 392174 - DNA, 30 bp, Artificial Sequence; identical to SEQ ID NO: 54656
  Description of Artificial Sequence: Synthetic oligonucleotide

SEQ ID NO: 392175 - DNA, 29 bp, Artificial Sequence
  Description of Artificial Sequence: Synthetic oligonucleotide
gctacccgtttaatgggacacagcgcttc

SEQ ID NO: 392176 - DNA, 29 bp, Artificial Sequence
  Description of Artificial Sequence: Synthetic oligonucleotide
ctacccgtttaatgggacacagcgcttcc

SEQ ID NO: 392177 - DNA, 30 bp, Artificial Sequence; identical to SEQ ID NO: 54659
  Description of Artificial Sequence: Synthetic oligonucleotide

SEQ ID NO: 392178 - DNA, 29 bp, Artificial Sequence
  Description of Artificial Sequence: Synthetic oligonucleotide
acccgtttaatgggacacagcgcttcctg

SEQ ID NO: 392179 - DNA, 28 bp, Artificial Sequence
  Description of Artificial Sequence: Synthetic oligonucleotide
cccgtttaatgggacacagcgcttcctg

SEQ ID NO: 392180 - DNA, 28 bp, Artificial Sequence
  Description of Artificial Sequence: Synthetic oligonucleotide
ccgtttaatgggacacagcgcttcctgg

SEQ ID NO: 392181 - DNA, 32 bp, Artificial Sequence; identical to SEQ ID NO: 54663
  Description of Artificial Sequence: Synthetic oligonucleotide

SEQ ID NO: 392182 - DNA, 31 bp, Artificial Sequence; identical to SEQ ID NO: 54664
  Description of Artificial Sequence: Synthetic oligonucleotide

SEQ ID NO: 392183 - DNA, 30 bp, Artificial Sequence; identical to SEQ ID NO: 54665
  Description of Artificial Sequence: Synthetic oligonucleotide

SEQ ID NO: 392184 - DNA, 30 bp, Artificial Sequence; identical to SEQ ID NO: 54666
  Description of Artificial Sequence: Synthetic oligonucleotide

SEQ ID NO: 392185 - DNA, 29 bp, Artificial Sequence
  Description of Artificial Sequence: Synthetic oligonucleotide
ggagtactggaacagccagaaggacttcc

SEQ ID NO: 392186 - DNA, 30 bp, Artificial Sequence; identical to SEQ ID NO: 54668
  Description of Artificial Sequence: Synthetic oligonucleotide

SEQ ID NO: 392187 - DNA, 30 bp, Artificial Sequence; identical to SEQ ID NO: 54669
  Description of Artificial Sequence: Synthetic oligonucleotide

SEQ ID NO: 392188 - DNA, 29 bp, Artificial Sequence
  Description of Artificial Sequence: Synthetic oligonucleotide
gtactggaacagccagaaggacttcctgg

SEQ ID NO: 392189 - DNA, 30 bp, Artificial Sequence; identical to SEQ ID NO: 54671
  Description of Artificial Sequence: Synthetic oligonucleotide

SEQ ID NO: 392190 - DNA, 29 bp, Artificial Sequence
  Description of Artificial Sequence: Synthetic oligonucleotide
actggaacagccagaaggacttcctggag

SEQ ID NO: 392191 - DNA, 28 bp, Artificial Sequence
  Description of Artificial Sequence: Synthetic oligonucleotide
ctggaacagccagaaggacttcctggag

SEQ ID NO: 392192 - DNA, 28 bp, Artificial Sequence
  Description of Artificial Sequence: Synthetic oligonucleotide
tggaacagccagaaggacttcctggagg

SEQ ID NO: 392193 - DNA, 27 bp, Artificial Sequence
  Description of Artificial Sequence: Synthetic oligonucleotide
ggaacagccagaaggacttcctggagg

SEQ ID NO: 392194 - DNA, 28 bp, Artificial Sequence
  Description of Artificial Sequence: Synthetic oligonucleotide
gaacagccagaaggacttcctggaggag

SEQ ID NO: 392195 - DNA, 28 bp, Artificial Sequence
  Description of Artificial Sequence: Synthetic oligonucleotide
aacagccagaaggacttcctggaggagg

SEQ ID NO: 392196 - DNA, 27 bp, Artificial Sequence
  Description of Artificial Sequence: Synthetic oligonucleotide
acagccagaaggacttcctggaggagg

SEQ ID NO: 392197 - DNA, 27 bp, Artificial Sequence
  Description of Artificial Sequence: Synthetic oligonucleotide
cagccagaaggacttcctggaggagga

SEQ ID NO: 392198 - DNA, 27 bp, Artificial Sequence
  Description of Artificial Sequence: Synthetic oligonucleotide
agccagaaggacttcctggaggaggag

SEQ ID NO: 392199 - DNA, 26 bp, Artificial Sequence
  Description of Artificial Sequence: Synthetic oligonucleotide
gccagaaggacttcctggaggaggag

SEQ ID NO: 392200 - DNA, 26 bp, Artificial Sequence
  Description of Artificial Sequence: Synthetic oligonucleotide
ccagaaggacttcctggaggaggagc

SEQ ID NO: 392201 - DNA, 26 bp, Artificial Sequence
  Description of Artificial Sequence: Synthetic oligonucleotide
cagaaggacttcctggaggaggagcg

SEQ ID NO: 392202 - DNA, 26 bp, Artificial Sequence
  Description of Artificial Sequence: Synthetic oligonucleotide
agaaggacttcctggaggaggagcgg

SEQ ID NO: 392203 - DNA, 25 bp, Artificial Sequence
  Description of Artificial Sequence: Synthetic oligonucleotide
gaaggacttcctggaggaggagcgg

SEQ ID NO: 392204 - DNA, 25 bp, Artificial Sequence
  Description of Artificial Sequence: Synthetic oligonucleotide
aaggacttcctggaggaggagcggg

SEQ ID NO: 392205 - DNA, 24 bp, Artificial Sequence
  Description of Artificial Sequence: Synthetic oligonucleotide
aggacttcctggaggaggagcggg

SEQ ID NO: 392206 - DNA, 23 bp, Artificial Sequence
  Description of Artificial Sequence: Synthetic oligonucleotide
ggacttcctggaggaggagcggg

SEQ ID NO: 392207 - DNA, 24 bp, Artificial Sequence
  Description of Artificial Sequence: Synthetic oligonucleotide
gacttcctggaggaggagcgggca

SEQ ID NO: 392208 - DNA, 25 bp, Artificial Sequence
  Description of Artificial Sequence: Synthetic oligonucleotide
acttcctggaggaggagcgggcagt

SEQ ID NO: 392209 - DNA, 24 bp, Artificial Sequence
  Description of Artificial Sequence: Synthetic oligonucleotide
cttcctggaggaggagcgggcagt

SEQ ID NO: 392210 - DNA, 24 bp, Artificial Sequence
  Description of Artificial Sequence: Synthetic oligonucleotide
ttcctggaggaggagcgggcagtg

SEQ ID NO: 392211 - DNA, 24 bp, Artificial Sequence
  Description of Artificial Sequence: Synthetic oligonucleotide
aggaggagcgggcagtgccggata

SEQ ID NO: 392212 - DNA, 23 bp, Artificial Sequence
  Description of Artificial Sequence: Synthetic oligonucleotide
ggaggagcgggcagtgccggata

SEQ ID NO: 392213 - DNA, 23 bp, Artificial Sequence
  Description of Artificial Sequence: Synthetic oligonucleotide
gaggagcgggcagtgccggatag

SEQ ID NO: 392214 - DNA, 25 bp, Artificial Sequence
  Description of Artificial Sequence: Synthetic oligonucleotide
aggagcgggcagtgccggataggat

SEQ ID NO: 392215 - DNA, 24 bp, Artificial Sequence
  Description of Artificial Sequence: Synthetic oligonucleotide
ggagcgggcagtgccggataggat

SEQ ID NO: 392216 - DNA, 25 bp, Artificial Sequence
  Description of Artificial Sequence: Synthetic oligonucleotide
gagcgggcagtgccggataggatgt

SEQ ID NO: 392217 - DNA, 25 bp, Artificial Sequence
  Description of Artificial Sequence: Synthetic oligonucleotide
agcgggcagtgccggataggatgtg

SEQ ID NO: 392218 - DNA, 24 bp, Artificial Sequence
  Description of Artificial Sequence: Synthetic oligonucleotide
gcgggcagtgccggataggatgtg

SEQ ID NO: 392219 - DNA, 25 bp, Artificial Sequence
  Description of Artificial Sequence: Synthetic oligonucleotide
cgggcagtgccggataggatgtgca

SEQ ID NO: 392220 - DNA, 26 bp, Artificial Sequence
  Description of Artificial Sequence: Synthetic oligonucleotide
gggcagtgccggataggatgtgcaga

SEQ ID NO: 392221 - DNA, 27 bp, Artificial Sequence
  Description of Artificial Sequence: Synthetic oligonucleotide
ggcagtgccggataggatgtgcagaca

SEQ ID NO: 392222 - DNA, 27 bp, Artificial Sequence
  Description of Artificial Sequence: Synthetic oligonucleotide
gcagtgccggataggatgtgcagacac

SEQ ID NO: 392223 - DNA, 29 bp, Artificial Sequence
  Description of Artificial Sequence: Synthetic oligonucleotide
cagtgccggataggatgtgcagacacaac

SEQ ID NO: 392224 - DNA, 31 bp, Artificial Sequence; identical to SEQ ID NO: 54706
  Description of Artificial Sequence: Synthetic oligonucleotide

SEQ ID NO: 392225 - DNA, 30 bp, Artificial Sequence; identical to SEQ ID NO: 54707
  Description of Artificial Sequence: Synthetic oligonucleotide

SEQ ID NO: 392226 - DNA, 30 bp, Artificial Sequence; identical to SEQ ID NO: 54708
  Description of Artificial Sequence: Synthetic oligonucleotide

SEQ ID NO: 392227 - DNA, 29 bp, Artificial Sequence
  Description of Artificial Sequence: Synthetic oligonucleotide
gccggataggatgtgcagacacaactacg

SEQ ID NO: 392228 - DNA, 30 bp, Artificial Sequence; identical to SEQ ID NO: 54710
  Description of Artificial Sequence: Synthetic oligonucleotide

SEQ ID NO: 392229 - DNA, 30 bp, Artificial Sequence; identical to SEQ ID NO: 54711
  Description of Artificial Sequence: Synthetic oligonucleotide

SEQ ID NO: 392230 - DNA, 31 bp, Artificial Sequence; identical to SEQ ID NO: 54712
  Description of Artificial Sequence: Synthetic oligonucleotide

SEQ ID NO: 392231 - DNA, 31 bp, Artificial Sequence; identical to SEQ ID NO: 54713
  Description of Artificial Sequence: Synthetic oligonucleotide

SEQ ID NO: 392232 - DNA, 31 bp, Artificial Sequence; identical to SEQ ID NO: 54714
  Description of Artificial Sequence: Synthetic oligonucleotide

SEQ ID NO: 392233 - DNA, 30 bp, Artificial Sequence; identical to SEQ ID NO: 54715
  Description of Artificial Sequence: Synthetic oligonucleotide

SEQ ID NO: 392234 - DNA, 26 bp, Artificial Sequence
  Description of Artificial Sequence: Synthetic oligonucleotide
acacaactacgagctggacgaggccg

SEQ ID NO: 392235 - DNA, 32 bp, Artificial Sequence; identical to SEQ ID NO: 54717
  Description of Artificial Sequence: Synthetic oligonucleotide

SEQ ID NO: 392236 - DNA, 31 bp, Artificial Sequence; identical to SEQ ID NO: 54718
  Description of Artificial Sequence: Synthetic oligonucleotide

SEQ ID NO: 392237 - DNA, 30 bp, Artificial Sequence; identical to SEQ ID NO: 54719
  Description of Artificial Sequence: Synthetic oligonucleotide

SEQ ID NO: 392238 - DNA, 30 bp, Artificial Sequence; identical to SEQ ID NO: 54720
  Description of Artificial Sequence: Synthetic oligonucleotide

SEQ ID NO: 392239 - DNA, 29 bp, Artificial Sequence
  Description of Artificial Sequence: Synthetic oligonucleotide
ggagtactggaacagccagaaggacaacc

SEQ ID NO: 392240 - DNA, 30 bp, Artificial Sequence; identical to SEQ ID NO: 54722
  Description of Artificial Sequence: Synthetic oligonucleotide

SEQ ID NO: 392241 - DNA, 30 bp, Artificial Sequence; identical to SEQ ID NO: 54723
  Description of Artificial Sequence: Synthetic oligonucleotide

SEQ ID NO: 392242 - DNA, 29 bp, Artificial Sequence
  Description of Artificial Sequence: Synthetic oligonucleotide
gtactggaacagccagaaggacaacctgg

SEQ ID NO: 392243 - DNA, 30 bp, Artificial Sequence; identical to SEQ ID NO: 54725
  Description of Artificial Sequence: Synthetic oligonucleotide

SEQ ID NO: 392244 - DNA, 29 bp, Artificial Sequence
  Description of Artificial Sequence: Synthetic oligonucleotide
actggaacagccagaaggacaacctggag

SEQ ID NO: 392245 - DNA, 28 bp, Artificial Sequence
  Description of Artificial Sequence: Synthetic oligonucleotide
ctggaacagccagaaggacaacctggag

SEQ ID NO: 392246 - DNA, 28 bp, Artificial Sequence
  Description of Artificial Sequence: Synthetic oligonucleotide
tggaacagccagaaggacaacctggagg

SEQ ID NO: 392247 - DNA, 27 bp, Artificial Sequence
  Description of Artificial Sequence: Synthetic oligonucleotide
ggaacagccagaaggacaacctggagg

SEQ ID NO: 392248 - DNA, 28 bp, Artificial Sequence
  Description of Artificial Sequence: Synthetic oligonucleotide
gaacagccagaaggacaacctggaggag

SEQ ID NO: 392249 - DNA, 30 bp, Artificial Sequence; identical to SEQ ID NO: 54731
  Description of Artificial Sequence: Synthetic oligonucleotide

SEQ ID NO: 392250 - DNA, 29 bp, Artificial Sequence
  Description of Artificial Sequence: Synthetic oligonucleotide
acagccagaaggacaacctggaggagaag

SEQ ID NO: 392251 - DNA, 28 bp, Artificial Sequence
  Description of Artificial Sequence: Synthetic oligonucleotide
cagccagaaggacaacctggaggagaag

SEQ ID NO: 392252 - DNA, 28 bp, Artificial Sequence
  Description of Artificial Sequence: Synthetic oligonucleotide
agccagaaggacaacctggaggagaagc

SEQ ID NO: 392253 - DNA, 27 bp, Artificial Sequence
  Description of Artificial Sequence: Synthetic oligonucleotide
gccagaaggacaacctggaggagaagc

SEQ ID NO: 392254 - DNA, 27 bp, Artificial Sequence
  Description of Artificial Sequence: Synthetic oligonucleotide
ccagaaggacaacctggaggagaagcg

SEQ ID NO: 392255 - DNA, 27 bp, Artificial Sequence
  Description of Artificial Sequence: Synthetic oligonucleotide
cagaaggacaacctggaggagaagcgg

SEQ ID NO: 392256 - DNA, 27 bp, Artificial Sequence
  Description of Artificial Sequence: Synthetic oligonucleotide
agaaggacaacctggaggagaagcggg

SEQ ID NO: 392257 - DNA, 26 bp, Artificial Sequence
  Description of Artificial Sequence: Synthetic oligonucleotide
gaaggacaacctggaggagaagcggg

SEQ ID NO: 392258 - DNA, 27 bp, Artificial Sequence
  Description of Artificial Sequence: Synthetic oligonucleotide
aaggacaacctggaggagaagcgggca

SEQ ID NO: 392259 - DNA, 26 bp, Artificial Sequence
  Description of Artificial Sequence: Synthetic oligonucleotide
aggacaacctggaggagaagcgggca

SEQ ID NO: 392260 - DNA, 25 bp, Artificial Sequence
  Description of Artificial Sequence: Synthetic oligonucleotide
ggacaacctggaggagaagcgggca

SEQ ID NO: 392261 - DNA, 26 bp, Artificial Sequence
  Description of Artificial Sequence: Synthetic oligonucleotide
gacaacctggaggagaagcgggcagt

SEQ ID NO: 392262 - DNA, 26 bp, Artificial Sequence
  Description of Artificial Sequence: Synthetic oligonucleotide
acaacctggaggagaagcgggcagtg

SEQ ID NO: 392263 - DNA, 25 bp, Artificial Sequence
  Description of Artificial Sequence: Synthetic oligonucleotide
caacctggaggagaagcgggcagtg

SEQ ID NO: 392264 - DNA, 25 bp, Artificial Sequence
  Description of Artificial Sequence: Synthetic oligonucleotide
aacctggaggagaagcgggcagtgc

SEQ ID NO: 392265 - DNA, 24 bp, Artificial Sequence
  Description of Artificial Sequence: Synthetic oligonucleotide
acctggaggagaagcgggcagtgc

SEQ ID NO: 392266 - DNA, 33 bp, Artificial Sequence; identical to SEQ ID NO: 54782
  Description of Artificial Sequence: Synthetic oligonucleotide

SEQ ID NO: 392267 - DNA, 32 bp, Artificial Sequence; identical to SEQ ID NO: 54783
  Description of Artificial Sequence: Synthetic oligonucleotide

SEQ ID NO: 392268 - DNA, 31 bp, Artificial Sequence; identical to SEQ ID NO: 54784
  Description of Artificial Sequence: Synthetic oligonucleotide

SEQ ID NO: 392269 - DNA, 30 bp, Artificial Sequence; identical to SEQ ID NO: 54785
  Description of Artificial Sequence: Synthetic oligonucleotide

SEQ ID NO: 392270 - DNA, 29 bp, Artificial Sequence
  Description of Artificial Sequence: Synthetic oligonucleotide
acgtggaccagttacggcaggaatgctac

SEQ ID NO: 392271 - DNA, 28 bp, Artificial Sequence
  Description of Artificial Sequence: Synthetic oligonucleotide
cgtggaccagttacggcaggaatgctac

SEQ ID NO: 392272 - DNA, 28 bp, Artificial Sequence
  Description of Artificial Sequence: Synthetic oligonucleotide
gtggaccagttacggcaggaatgctacg

SEQ ID NO: 392273 - DNA, 28 bp, Artificial Sequence
  Description of Artificial Sequence: Synthetic oligonucleotide
tggaccagttacggcaggaatgctacgc

SEQ ID NO: 392274 - DNA, 27 bp, Artificial Sequence
  Description of Artificial Sequence: Synthetic oligonucleotide
ggaccagttacggcaggaatgctacgc

SEQ ID NO: 392275 - DNA, 27 bp, Artificial Sequence
  Description of Artificial Sequence: Synthetic oligonucleotide
gaccagttacggcaggaatgctacgcg

SEQ ID NO: 392276 - DNA, 29 bp, Artificial Sequence
  Description of Artificial Sequence: Synthetic oligonucleotide
agggtatgcagacacaactacgagctggg

SEQ ID NO: 392277 - DNA, 28 bp, Artificial Sequence
  Description of Artificial Sequence: Synthetic oligonucleotide
gggtatgcagacacaactacgagctggg

SEQ ID NO: 392278 - DNA, 28 bp, Artificial Sequence
  Description of Artificial Sequence: Synthetic oligonucleotide
ggtatgcagacacaactacgagctgggc

SEQ ID NO: 392279 - DNA, 28 bp, Artificial Sequence
  Description of Artificial Sequence: Synthetic oligonucleotide
gtatgcagacacaactacgagctgggcg

SEQ ID NO: 392280 - DNA, 28 bp, Artificial Sequence
  Description of Artificial Sequence: Synthetic oligonucleotide
tatgcagacacaactacgagctgggcgg

SEQ ID NO: 392281 - DNA, 27 bp, Artificial Sequence
  Description of Artificial Sequence: Synthetic oligonucleotide
atgcagacacaactacgagctgggcgg

SEQ ID NO: 392282 - DNA, 35 bp, Artificial Sequence; identical to SEQ ID NO: 54798
  Description of Artificial Sequence: Synthetic oligonucleotide

SEQ ID NO: 392283 - DNA, 34 bp, Artificial Sequence; identical to SEQ ID NO: 54799
  Description of Artificial Sequence: Synthetic oligonucleotide

SEQ ID NO: 392284 - DNA, 34 bp, Artificial Sequence; identical to SEQ ID NO: 54800
  Description of Artificial Sequence: Synthetic oligonucleotide

SEQ ID NO: 392285 - DNA, 33 bp, Artificial Sequence; identical to SEQ ID NO: 54801
  Description of Artificial Sequence: Synthetic oligonucleotide

SEQ ID NO: 392286 - DNA, 32 bp, Artificial Sequence; identical to SEQ ID NO: 54802
  Description of Artificial Sequence: Synthetic oligonucleotide

SEQ ID NO: 392287 - DNA, 31 bp, Artificial Sequence; identical to SEQ ID NO: 54803
  Description of Artificial Sequence: Synthetic oligonucleotide

SEQ ID NO: 392288 - DNA, 30 bp, Artificial Sequence; identical to SEQ ID NO: 54804
  Description of Artificial Sequence: Synthetic oligonucleotide

SEQ ID NO: 392289 - DNA, 29 bp, Artificial Sequence
  Description of Artificial Sequence: Synthetic oligonucleotide
ccttttccagggactgcaggaatgctacg

SEQ ID NO: 392290 - DNA, 29 bp, Artificial Sequence
  Description of Artificial Sequence: Synthetic oligonucleotide
cttttccagggactgcaggaatgctacgc

SEQ ID NO: 392291 - DNA, 29 bp, Artificial Sequence
  Description of Artificial Sequence: Synthetic oligonucleotide
ttttccagggactgcaggaatgctacgcg

SEQ ID NO: 392292 - DNA, 28 bp, Artificial Sequence
  Description of Artificial Sequence: Synthetic oligonucleotide
tttccagggactgcaggaatgctacgcg

SEQ ID NO: 392293 - DNA, 27 bp, Artificial Sequence
  Description of Artificial Sequence: Synthetic oligonucleotide
ttccagggactgcaggaatgctacgcg

SEQ ID NO: 392294 - DNA, 27 bp, Artificial Sequence
  Description of Artificial Sequence: Synthetic oligonucleotide
tccagggactgcaggaatgctacgcgt

SEQ ID NO: 392295 - DNA, 27 bp, Artificial Sequence
  Description of Artificial Sequence: Synthetic oligonucleotide
ccagggactgcaggaatgctacgcgtt

SEQ ID NO: 392296 - DNA, 31 bp, Artificial Sequence; identical to SEQ ID NO: 54812
  Description of Artificial Sequence: Synthetic oligonucleotide

SEQ ID NO: 392297 - DNA, 31 bp, Artificial Sequence; identical to SEQ ID NO: 54813
  Description of Artificial Sequence: Synthetic oligonucleotide

SEQ ID NO: 392298 - DNA, 30 bp, Artificial Sequence; identical to SEQ ID NO: 54814
  Description of Artificial Sequence: Synthetic oligonucleotide

SEQ ID NO: 392299 - DNA, 30 bp, Artificial Sequence; identical to SEQ ID NO: 54815
  Description of Artificial Sequence: Synthetic oligonucleotide

SEQ ID NO: 392300 - DNA, 31 bp, Artificial Sequence; identical to SEQ ID NO: 54816
  Description of Artificial Sequence: Synthetic oligonucleotide

SEQ ID NO: 392301 - DNA, 32 bp, Artificial Sequence; identical to SEQ ID NO: 54817
  Description of Artificial Sequence: Synthetic oligonucleotide

SEQ ID NO: 392302 - DNA, 31 bp, Artificial Sequence; identical to SEQ ID NO: 54818
  Description of Artificial Sequence: Synthetic oligonucleotide

SEQ ID NO: 392303 - DNA, 32 bp, Artificial Sequence; identical to SEQ ID NO: 54819
  Description of Artificial Sequence: Synthetic oligonucleotide

SEQ ID NO: 392304 - DNA, 25 bp, Artificial Sequence
  Description of Artificial Sequence: Synthetic oligonucleotide
tcctggaggagaagcgggcagtgct

SEQ ID NO: 392305 - DNA, 24 bp, Artificial Sequence
  Description of Artificial Sequence: Synthetic oligonucleotide
cctggaggagaagcgggcagtgct

SEQ ID NO: 392306 - DNA, 24 bp, Artificial Sequence
  Description of Artificial Sequence: Synthetic oligonucleotide
ctggaggagaagcgggcagtgctg

SEQ ID NO: 392307 - DNA, 25 bp, Artificial Sequence
  Description of Artificial Sequence: Synthetic oligonucleotide
tggaggagaagcgggcagtgctgga

SEQ ID NO: 392308 - DNA, 24 bp, Artificial Sequence
  Description of Artificial Sequence: Synthetic oligonucleotide
ggaggagaagcgggcagtgctgga

SEQ ID NO: 392309 - DNA, 25 bp, Artificial Sequence
  Description of Artificial Sequence: Synthetic oligonucleotide
gaggagaagcgggcagtgctggaca

SEQ ID NO: 392310 - DNA, 25 bp, Artificial Sequence
  Description of Artificial Sequence: Synthetic oligonucleotide
aggagaagcgggcagtgctggacag

SEQ ID NO: 392311 - DNA, 24 bp, Artificial Sequence
  Description of Artificial Sequence: Synthetic oligonucleotide
ggagaagcgggcagtgctggacag

SEQ ID NO: 392312 - DNA, 24 bp, Artificial Sequence
  Description of Artificial Sequence: Synthetic oligonucleotide
gagaagcgggcagtgctggacagg

SEQ ID NO: 392313 - DNA, 27 bp, Artificial Sequence
  Description of Artificial Sequence: Synthetic oligonucleotide
agaagcgggcagtgctggacagggtat

SEQ ID NO: 392314 - DNA, 26 bp, Artificial Sequence
  Description of Artificial Sequence: Synthetic oligonucleotide
gaagcgggcagtgctggacagggtat

SEQ ID NO: 392315 - DNA, 26 bp, Artificial Sequence
  Description of Artificial Sequence: Synthetic oligonucleotide
aagcgggcagtgctggacagggtatg

SEQ ID NO: 392316 - DNA, 25 bp, Artificial Sequence
  Description of Artificial Sequence: Synthetic oligonucleotide
agcgggcagtgctggacagggtatg

SEQ ID NO: 392317 - DNA, 24 bp, Artificial Sequence
  Description of Artificial Sequence: Synthetic oligonucleotide
gcgggcagtgctggacagggtatg

SEQ ID NO: 392318 - DNA, 25 bp, Artificial Sequence
  Description of Artificial Sequence: Synthetic oligonucleotide
cgggcagtgctggacagggtatgca

SEQ ID NO: 392319 - DNA, 26 bp, Artificial Sequence
  Description of Artificial Sequence: Synthetic oligonucleotide
gggcagtgctggacagggtatgcaga

SEQ ID NO: 392320 - DNA, 27 bp, Artificial Sequence
  Description of Artificial Sequence: Synthetic oligonucleotide
ggcagtgctggacagggtatgcagaca

SEQ ID NO: 392321 - DNA, 27 bp, Artificial Sequence
  Description of Artificial Sequence: Synthetic oligonucleotide
gcagtgctggacagggtatgcagacac

SEQ ID NO: 392322 - DNA, 29 bp, Artificial Sequence
  Description of Artificial Sequence: Synthetic oligonucleotide
cagtgctggacagggtatgcagacacaac

SEQ ID NO: 392323 - DNA, 31 bp, Artificial Sequence; identical to SEQ ID NO: 54839
  Description of Artificial Sequence: Synthetic oligonucleotide

SEQ ID NO: 392324 - DNA, 30 bp, Artificial Sequence; identical to SEQ ID NO: 54840
  Description of Artificial Sequence: Synthetic oligonucleotide

SEQ ID NO: 392325 - DNA, 30 bp, Artificial Sequence; identical to SEQ ID NO: 54841
  Description of Artificial Sequence: Synthetic oligonucleotide

SEQ ID NO: 392326 - DNA, 29 bp, Artificial Sequence
  Description of Artificial Sequence: Synthetic oligonucleotide
gctggacagggtatgcagacacaactacg

SEQ ID NO: 392327 - DNA, 30 bp, Artificial Sequence; identical to SEQ ID NO: 54843
  Description of Artificial Sequence: Synthetic oligonucleotide

SEQ ID NO: 392328 - DNA, 30 bp, Artificial Sequence; identical to SEQ ID NO: 54844
  Description of Artificial Sequence: Synthetic oligonucleotide

SEQ ID NO: 392329 - DNA, 22 bp, Artificial Sequence
  Description of Artificial Sequence: Synthetic oligonucleotide
gcgggcccatgaccctgcagca

SEQ ID NO: 392330 - DNA, 22 bp, Artificial Sequence
  Description of Artificial Sequence: Synthetic oligonucleotide
cgggcccatgaccctgcagcac

SEQ ID NO: 392331 - DNA, 22 bp, Artificial Sequence
  Description of Artificial Sequence: Synthetic oligonucleotide
gggcccatgaccctgcagcacc

SEQ ID NO: 392332 - DNA, 23 bp, Artificial Sequence
  Description of Artificial Sequence: Synthetic oligonucleotide
ggcccatgaccctgcagcaccga

SEQ ID NO: 392333 - DNA, 23 bp, Artificial Sequence
  Description of Artificial Sequence: Synthetic oligonucleotide
gcccatgaccctgcagcaccgag

SEQ ID NO: 392334 - DNA, 30 bp, Artificial Sequence; identical to SEQ ID NO: 54850
  Description of Artificial Sequence: Synthetic oligonucleotide

SEQ ID NO: 392335 - DNA, 29 bp, Artificial Sequence
  Description of Artificial Sequence: Synthetic oligonucleotide
acagccagaaggacttcctggaggagaag

SEQ ID NO: 392336 - DNA, 28 bp, Artificial Sequence
  Description of Artificial Sequence: Synthetic oligonucleotide
cagccagaaggacttcctggaggagaag

SEQ ID NO: 392337 - DNA, 28 bp, Artificial Sequence
  Description of Artificial Sequence: Synthetic oligonucleotide
agccagaaggacttcctggaggagaagc

SEQ ID NO: 392338 - DNA, 27 bp, Artificial Sequence
  Description of Artificial Sequence: Synthetic oligonucleotide
gccagaaggacttcctggaggagaagc

SEQ ID NO: 392339 - DNA, 27 bp, Artificial Sequence
  Description of Artificial Sequence: Synthetic oligonucleotide
ccagaaggacttcctggaggagaagcg

SEQ ID NO: 392340 - DNA, 27 bp, Artificial Sequence
  Description of Artificial Sequence: Synthetic oligonucleotide
cagaaggacttcctggaggagaagcgg

SEQ ID NO: 392341 - DNA, 27 bp, Artificial Sequence
  Description of Artificial Sequence: Synthetic oligonucleotide
agaaggacttcctggaggagaagcggg

SEQ ID NO: 392342 - DNA, 26 bp, Artificial Sequence
  Description of Artificial Sequence: Synthetic oligonucleotide
gaaggacttcctggaggagaagcggg

SEQ ID NO: 392343 - DNA, 27 bp, Artificial Sequence
  Description of Artificial Sequence: Synthetic oligonucleotide
aaggacttcctggaggagaagcgggca

SEQ ID NO: 392344 - DNA, 26 bp, Artificial Sequence
  Description of Artificial Sequence: Synthetic oligonucleotide
aggacttcctggaggagaagcgggca

SEQ ID NO: 392345 - DNA, 25 bp, Artificial Sequence
  Description of Artificial Sequence: Synthetic oligonucleotide
ggacttcctggaggagaagcgggca

SEQ ID NO: 392346 - DNA, 26 bp, Artificial Sequence
  Description of Artificial Sequence: Synthetic oligonucleotide
gacttcctggaggagaagcgggcagt

SEQ ID NO: 392347 - DNA, 26 bp, Artificial Sequence
  Description of Artificial Sequence: Synthetic oligonucleotide
acttcctggaggagaagcgggcagtg

SEQ ID NO: 392348 - DNA, 25 bp, Artificial Sequence
  Description of Artificial Sequence: Synthetic oligonucleotide
cttcctggaggagaagcgggcagtg

SEQ ID NO: 392349 - DNA, 25 bp, Artificial Sequence
  Description of Artificial Sequence: Synthetic oligonucleotide
ttcctggaggagaagcgggcagtgc

SEQ ID NO: 392350 - DNA, 21 bp, Artificial Sequence
  Description of Artificial Sequence: Synthetic oligonucleotide
ggagctggggcggcctgagga

SEQ ID NO: 392351 - DNA, 21 bp, Artificial Sequence
  Description of Artificial Sequence: Synthetic oligonucleotide
gagctggggcggcctgaggag

SEQ ID NO: 392352 - DNA, 22 bp, Artificial Sequence
  Description of Artificial Sequence: Synthetic oligonucleotide
agctggggcggcctgaggagga

SEQ ID NO: 392353 - DNA, 21 bp, Artificial Sequence
  Description of Artificial Sequence: Synthetic oligonucleotide
gctggggcggcctgaggagga

SEQ ID NO: 392354 - DNA, 23 bp, Artificial Sequence
  Description of Artificial Sequence: Synthetic oligonucleotide
ctggggcggcctgaggaggagta

SEQ ID NO: 392355 - DNA, 24 bp, Artificial Sequence
  Description of Artificial Sequence: Synthetic oligonucleotide
tggggcggcctgaggaggagtact

SEQ ID NO: 392356 - DNA, 23 bp, Artificial Sequence
  Description of Artificial Sequence: Synthetic oligonucleotide
ggggcggcctgaggaggagtact

SEQ ID NO: 392357 - DNA, 23 bp, Artificial Sequence
  Description of Artificial Sequence: Synthetic oligonucleotide
gggcggcctgaggaggagtactg

SEQ ID NO: 392358 - DNA, 25 bp, Artificial Sequence
  Description of Artificial Sequence: Synthetic oligonucleotide
ggcggcctgaggaggagtactggaa

SEQ ID NO: 392359 - DNA, 26 bp, Artificial Sequence
  Description of Artificial Sequence: Synthetic oligonucleotide
gcggcctgaggaggagtactggaaca

SEQ ID NO: 392360 - DNA, 26 bp, Artificial Sequence
  Description of Artificial Sequence: Synthetic oligonucleotide
cggcctgaggaggagtactggaacag

SEQ ID NO: 392361 - DNA, 26 bp, Artificial Sequence
  Description of Artificial Sequence: Synthetic oligonucleotide
ggcctgaggaggagtactggaacagc

SEQ ID NO: 392362 - DNA, 27 bp, Artificial Sequence
  Description of Artificial Sequence: Synthetic oligonucleotide
gcctgaggaggagtactggaacagcca

SEQ ID NO: 392363 - DNA, 27 bp, Artificial Sequence
  Description of Artificial Sequence: Synthetic oligonucleotide
cctgaggaggagtactggaacagccag

SEQ ID NO: 392364 - DNA, 29 bp, Artificial Sequence
  Description of Artificial Sequence: Synthetic oligonucleotide
ctgaggaggagtactggaacagccagaag

SEQ ID NO: 392365 - DNA, 29 bp, Artificial Sequence
  Description of Artificial Sequence: Synthetic oligonucleotide
tgaggaggagtactggaacagccagaagg

SEQ ID NO: 392366 - DNA, 28 bp, Artificial Sequence
  Description of Artificial Sequence: Synthetic oligonucleotide
gaggaggagtactggaacagccagaagg

SEQ ID NO: 392367 - DNA, 29 bp, Artificial Sequence
  Description of Artificial Sequence: Synthetic oligonucleotide
aggaggagtactggaacagccagaaggac

SEQ ID NO: 392368 - DNA, 28 bp, Artificial Sequence
  Description of Artificial Sequence: Synthetic oligonucleotide
ggaggagtactggaacagccagaaggac

SEQ ID NO: 392369 - DNA, 23 bp, Artificial Sequence
  Description of Artificial Sequence: Synthetic oligonucleotide
gacgaggccgtgaccctgcagca

SEQ ID NO: 392370 - DNA, 23 bp, Artificial Sequence
  Description of Artificial Sequence: Synthetic oligonucleotide
acgaggccgtgaccctgcagcac

SEQ ID NO: 392371 - DNA, 22 bp, Artificial Sequence
  Description of Artificial Sequence: Synthetic oligonucleotide
cgaggccgtgaccctgcagcac

SEQ ID NO: 392372 - DNA, 22 bp, Artificial Sequence
  Description of Artificial Sequence: Synthetic oligonucleotide
gaggccgtgaccctgcagcacc

SEQ ID NO: 392373 - DNA, 23 bp, Artificial Sequence
  Description of Artificial Sequence: Synthetic oligonucleotide
aggccgtgaccctgcagcaccga

SEQ ID NO: 392374 - DNA, 22 bp, Artificial Sequence
  Description of Artificial Sequence: Synthetic oligonucleotide
ggccgtgaccctgcagcaccga

SEQ ID NO: 392375 - DNA, 23 bp, Artificial Sequence
  Description of Artificial Sequence: Synthetic oligonucleotide
gccgtgaccctgcagcaccgagt

SEQ ID NO: 392376 - DNA, 23 bp, Artificial Sequence
  Description of Artificial Sequence: Synthetic oligonucleotide
ccgtgaccctgcagcaccgagtc

SEQ ID NO: 392377 - DNA, 24 bp, Artificial Sequence
  Description of Artificial Sequence: Synthetic oligonucleotide
cgtgaccctgcagcaccgagtcca

SEQ ID NO: 392378 - DNA, 24 bp, Artificial Sequence
  Description of Artificial Sequence: Synthetic oligonucleotide
gtgaccctgcagcaccgagtccag

SEQ ID NO: 392379 - DNA, 24 bp, Artificial Sequence
  Description of Artificial Sequence: Synthetic oligonucleotide
tgaccctgcagcaccgagtccagc

SEQ ID NO: 392380 - DNA, 23 bp, Artificial Sequence
  Description of Artificial Sequence: Synthetic oligonucleotide
gaccctgcagcaccgagtccagc

SEQ ID NO: 392381 - DNA, 26 bp, Artificial Sequence
  Description of Artificial Sequence: Synthetic oligonucleotide
accctgcagcaccgagtccagcctaa

SEQ ID NO: 392382 - DNA, 25 bp, Artificial Sequence
  Description of Artificial Sequence: Synthetic oligonucleotide
ccctgcagcaccgagtccagcctaa

SEQ ID NO: 392383 - DNA, 25 bp, Artificial Sequence
  Description of Artificial Sequence: Synthetic oligonucleotide
cctgcagcaccgagtccagcctaag

SEQ ID NO: 392384 - DNA, 26 bp, Artificial Sequence
  Description of Artificial Sequence: Synthetic oligonucleotide
ctgcagcaccgagtccagcctaaggt

SEQ ID NO: 392385 - DNA, 27 bp, Artificial Sequence
  Description of Artificial Sequence: Synthetic oligonucleotide
tgcagcaccgagtccagcctaaggtga

SEQ ID NO: 392386 - DNA, 27 bp, Artificial Sequence
  Description of Artificial Sequence: Synthetic oligonucleotide
gcagcaccgagtccagcctaaggtgaa

SEQ ID NO: 392387 - DNA, 27 bp, Artificial Sequence
  Description of Artificial Sequence: Synthetic oligonucleotide
cagcaccgagtccagcctaaggtgaac

SEQ ID NO: 392388 - DNA, 27 bp, Artificial Sequence
  Description of Artificial Sequence: Synthetic oligonucleotide
agcaccgagtccagcctaaggtgaacg

SEQ ID NO: 392389 - DNA, 27 bp, Artificial Sequence
  Description of Artificial Sequence: Synthetic oligonucleotide
gcaccgagtccagcctaaggtgaacgt

SEQ ID NO: 392390 - DNA, 29 bp, Artificial Sequence
  Description of Artificial Sequence: Synthetic oligonucleotide
caccgagtccagcctaaggtgaacgtttc

SEQ ID NO: 392391 - DNA, 29 bp, Artificial Sequence
  Description of Artificial Sequence: Synthetic oligonucleotide
accgagtccagcctaaggtgaacgtttcc

SEQ ID NO: 392392 - DNA, 29 bp, Artificial Sequence
  Description of Artificial Sequence: Synthetic oligonucleotide
agccagaaggacatcctggaggagaagtg

SEQ ID NO: 392393 - DNA, 28 bp, Artificial Sequence
  Description of Artificial Sequence: Synthetic oligonucleotide
gccagaaggacatcctggaggagaagtg

SEQ ID NO: 392394 - DNA, 28 bp, Artificial Sequence
  Description of Artificial Sequence: Synthetic oligonucleotide
ccagaaggacatcctggaggagaagtgg

SEQ ID NO: 392395 - DNA, 28 bp, Artificial Sequence
  Description of Artificial Sequence: Synthetic oligonucleotide
cagaaggacatcctggaggagaagtggg

SEQ ID NO: 392396 - DNA, 28 bp, Artificial Sequence
  Description of Artificial Sequence: Synthetic oligonucleotide
agaaggacatcctggaggagaagtgggc

SEQ ID NO: 392397 - DNA, 27 bp, Artificial Sequence
  Description of Artificial Sequence: Synthetic oligonucleotide
gaaggacatcctggaggagaagtgggc

SEQ ID NO: 392398 - DNA, 28 bp, Artificial Sequence
  Description of Artificial Sequence: Synthetic oligonucleotide
aaggacatcctggaggagaagtgggcag

SEQ ID NO: 392399 - DNA, 27 bp, Artificial Sequence
  Description of Artificial Sequence: Synthetic oligonucleotide
aggacatcctggaggagaagtgggcag

SEQ ID NO: 392400 - DNA, 27 bp, Artificial Sequence
  Description of Artificial Sequence: Synthetic oligonucleotide
ggacatcctggaggagaagtgggcagt

SEQ ID NO: 392401 - DNA, 27 bp, Artificial Sequence
  Description of Artificial Sequence: Synthetic oligonucleotide
gacatcctggaggagaagtgggcagtg

SEQ ID NO: 392402 - DNA, 27 bp, Artificial Sequence
  Description of Artificial Sequence: Synthetic oligonucleotide
acatcctggaggagaagtgggcagtgc

SEQ ID NO: 392403 - DNA, 26 bp, Artificial Sequence
  Description of Artificial Sequence: Synthetic oligonucleotide
catcctggaggagaagtgggcagtgc

SEQ ID NO: 392404 - DNA, 26 bp, Artificial Sequence
  Description of Artificial Sequence: Synthetic oligonucleotide
atcctggaggagaagtgggcagtgcc

SEQ ID NO: 392405 - DNA, 25 bp, Artificial Sequence
  Description of Artificial Sequence: Synthetic oligonucleotide
tcctggaggagaagtgggcagtgcc

SEQ ID NO: 392406 - DNA, 24 bp, Artificial Sequence
  Description of Artificial Sequence: Synthetic oligonucleotide
cctggaggagaagtgggcagtgcc

SEQ ID NO: 392407 - DNA, 24 bp, Artificial Sequence
  Description of Artificial Sequence: Synthetic oligonucleotide
ctggaggagaagtgggcagtgccg

SEQ ID NO: 392408 - DNA, 25 bp, Artificial Sequence
  Description of Artificial Sequence: Synthetic oligonucleotide
tggaggagaagtgggcagtgccgga

SEQ ID NO: 392409 - DNA, 24 bp, Artificial Sequence
  Description of Artificial Sequence: Synthetic oligonucleotide
ggaggagaagtgggcagtgccgga

SEQ ID NO: 392410 - DNA, 25 bp, Artificial Sequence
  Description of Artificial Sequence: Synthetic oligonucleotide
gaggagaagtgggcagtgccggaca

SEQ ID NO: 392411 - DNA, 25 bp, Artificial Sequence
  Description of Artificial Sequence: Synthetic oligonucleotide
aggagaagtgggcagtgccggacag

SEQ ID NO: 392412 - DNA, 24 bp, Artificial Sequence
  Description of Artificial Sequence: Synthetic oligonucleotide
ggagaagtgggcagtgccggacag

SEQ ID NO: 392413 - DNA, 26 bp, Artificial Sequence
  Description of Artificial Sequence: Synthetic oligonucleotide
gagaagtgggcagtgccggacaggat

SEQ ID NO: 392414 - DNA, 27 bp, Artificial Sequence
  Description of Artificial Sequence: Synthetic oligonucleotide
agaagtgggcagtgccggacaggatgt

SEQ ID NO: 392415 - DNA, 26 bp, Artificial Sequence
  Description of Artificial Sequence: Synthetic oligonucleotide
gaagtgggcagtgccggacaggatgt

SEQ ID NO: 392416 - DNA, 26 bp, Artificial Sequence
  Description of Artificial Sequence: Synthetic oligonucleotide
aagtgggcagtgccggacaggatgtg

SEQ ID NO: 392417 - DNA, 25 bp, Artificial Sequence
  Description of Artificial Sequence: Synthetic oligonucleotide
agtgggcagtgccggacaggatgtg

SEQ ID NO: 392418 - DNA, 24 bp, Artificial Sequence
  Description of Artificial Sequence: Synthetic oligonucleotide
gtgggcagtgccggacaggatgtg

SEQ ID NO: 392419 - DNA, 25 bp, Artificial Sequence
  Description of Artificial Sequence: Synthetic oligonucleotide
tgggcagtgccggacaggatgtgca

SEQ ID NO: 392420 - DNA, 27 bp, Artificial Sequence
  Description of Artificial Sequence: Synthetic oligonucleotide
ctgcggagtactggaacagccagaagc

SEQ ID NO: 392421 - DNA, 28 bp, Artificial Sequence
  Description of Artificial Sequence: Synthetic oligonucleotide
tgcggagtactggaacagccagaagcac

SEQ ID NO: 392422 - DNA, 27 bp, Artificial Sequence
  Description of Artificial Sequence: Synthetic oligonucleotide
gcggagtactggaacagccagaagcac

SEQ ID NO: 392423 - DNA, 29 bp, Artificial Sequence
  Description of Artificial Sequence: Synthetic oligonucleotide
cggagtactggaacagccagaagcacatc

SEQ ID NO: 392424 - DNA, 29 bp, Artificial Sequence
  Description of Artificial Sequence: Synthetic oligonucleotide
ggagtactggaacagccagaagcacatcc

SEQ ID NO: 392425 - DNA, 30 bp, Artificial Sequence; identical to SEQ ID NO: 54941
  Description of Artificial Sequence: Synthetic oligonucleotide

SEQ ID NO: 392426 - DNA, 30 bp, Artificial Sequence; identical to SEQ ID NO: 54942
  Description of Artificial Sequence: Synthetic oligonucleotide

SEQ ID NO: 392427 - DNA, 29 bp, Artificial Sequence
  Description of Artificial Sequence: Synthetic oligonucleotide
gtactggaacagccagaagcacatcctgg

SEQ ID NO: 392428 - DNA, 30 bp, Artificial Sequence; identical to SEQ ID NO: 54944
  Description of Artificial Sequence: Synthetic oligonucleotide

SEQ ID NO: 392429 - DNA, 29 bp, Artificial Sequence
  Description of Artificial Sequence: Synthetic oligonucleotide
actggaacagccagaagcacatcctggag

SEQ ID NO: 392430 - DNA, 28 bp, Artificial Sequence
  Description of Artificial Sequence: Synthetic oligonucleotide
ctggaacagccagaagcacatcctggag

SEQ ID NO: 392431 - DNA, 28 bp, Artificial Sequence
  Description of Artificial Sequence: Synthetic oligonucleotide
tggaacagccagaagcacatcctggagg

SEQ ID NO: 392432 - DNA, 27 bp, Artificial Sequence
  Description of Artificial Sequence: Synthetic oligonucleotide
ggaacagccagaagcacatcctggagg

SEQ ID NO: 392433 - DNA, 28 bp, Artificial Sequence
  Description of Artificial Sequence: Synthetic oligonucleotide
gaacagccagaagcacatcctggaggag

SEQ ID NO: 392434 - DNA, 30 bp, Artificial Sequence; identical to SEQ ID NO: 54950
  Description of Artificial Sequence: Synthetic oligonucleotide

SEQ ID NO: 392435 - DNA, 29 bp, Artificial Sequence
  Description of Artificial Sequence: Synthetic oligonucleotide
acagccagaagcacatcctggaggagaag

SEQ ID NO: 392436 - DNA, 28 bp, Artificial Sequence
  Description of Artificial Sequence: Synthetic oligonucleotide
cagccagaagcacatcctggaggagaag

SEQ ID NO: 392437 - DNA, 28 bp, Artificial Sequence
  Description of Artificial Sequence: Synthetic oligonucleotide
agccagaagcacatcctggaggagaagc

SEQ ID NO: 392438 - DNA, 27 bp, Artificial Sequence
  Description of Artificial Sequence: Synthetic oligonucleotide
gccagaagcacatcctggaggagaagc

SEQ ID NO: 392439 - DNA, 27 bp, Artificial Sequence
  Description of Artificial Sequence: Synthetic oligonucleotide
ccagaagcacatcctggaggagaagcg

SEQ ID NO: 392440 - DNA, 27 bp, Artificial Sequence
  Description of Artificial Sequence: Synthetic oligonucleotide
cagaagcacatcctggaggagaagcgg

SEQ ID NO: 392441 - DNA, 27 bp, Artificial Sequence
  Description of Artificial Sequence: Synthetic oligonucleotide
agaagcacatcctggaggagaagcggg

SEQ ID NO: 392442 - DNA, 26 bp, Artificial Sequence
  Description of Artificial Sequence: Synthetic oligonucleotide
gaagcacatcctggaggagaagcggg

SEQ ID NO: 392443 - DNA, 27 bp, Artificial Sequence
  Description of Artificial Sequence: Synthetic oligonucleotide
aagcacatcctggaggagaagcgggca

SEQ ID NO: 392444 - DNA, 26 bp, Artificial Sequence
  Description of Artificial Sequence: Synthetic oligonucleotide
agcacatcctggaggagaagcgggca

SEQ ID NO: 392445 - DNA, 25 bp, Artificial Sequence
  Description of Artificial Sequence: Synthetic oligonucleotide
gcacatcctggaggagaagcgggca

SEQ ID NO: 392446 - DNA, 26 bp, Artificial Sequence
  Description of Artificial Sequence: Synthetic oligonucleotide
cacatcctggaggagaagcgggcagt

SEQ ID NO: 392447 - DNA, 25 bp, Artificial Sequence
  Description of Artificial Sequence: Synthetic oligonucleotide
ctcgtgcgcttcgacagcgacgtgt

SEQ ID NO: 392448 - DNA, 25 bp, Artificial Sequence
  Description of Artificial Sequence: Synthetic oligonucleotide
tcgtgcgcttcgacagcgacgtgtg

SEQ ID NO: 392449 - DNA, 24 bp, Artificial Sequence
  Description of Artificial Sequence: Synthetic oligonucleotide
cgtgcgcttcgacagcgacgtgtg

SEQ ID NO: 392450 - DNA, 24 bp, Artificial Sequence
  Description of Artificial Sequence: Synthetic oligonucleotide
gtgcgcttcgacagcgacgtgtgg

SEQ ID NO: 392451 - DNA, 25 bp, Artificial Sequence
  Description of Artificial Sequence: Synthetic oligonucleotide
tgcgcttcgacagcgacgtgtggga

SEQ ID NO: 392452 - DNA, 24 bp, Artificial Sequence
  Description of Artificial Sequence: Synthetic oligonucleotide
gcgcttcgacagcgacgtgtggga

SEQ ID NO: 392453 - DNA, 26 bp, Artificial Sequence
  Description of Artificial Sequence: Synthetic oligonucleotide
cgcttcgacagcgacgtgtgggagtt

SEQ ID NO: 392454 - DNA, 26 bp, Artificial Sequence
  Description of Artificial Sequence: Synthetic oligonucleotide
gcttcgacagcgacgtgtgggagttc

SEQ ID NO: 392455 - DNA, 26 bp, Artificial Sequence
  Description of Artificial Sequence: Synthetic oligonucleotide
cttcgacagcgacgtgtgggagttcc

SEQ ID NO: 392456 - DNA, 26 bp, Artificial Sequence
  Description of Artificial Sequence: Synthetic oligonucleotide
ttcgacagcgacgtgtgggagttccg

SEQ ID NO: 392457 - DNA, 25 bp, Artificial Sequence
  Description of Artificial Sequence: Synthetic oligonucleotide
tcgacagcgacgtgtgggagttccg

SEQ ID NO: 392458 - DNA, 24 bp, Artificial Sequence
  Description of Artificial Sequence: Synthetic oligonucleotide
cgacagcgacgtgtgggagttccg

SEQ ID NO: 392459 - DNA, 24 bp, Artificial Sequence
  Description of Artificial Sequence: Synthetic oligonucleotide
gacagcgacgtgtgggagttccgg

SEQ ID NO: 392460 - DNA, 24 bp, Artificial Sequence
  Description of Artificial Sequence: Synthetic oligonucleotide
acagcgacgtgtgggagttccggg

SEQ ID NO: 392461 - DNA, 23 bp, Artificial Sequence
  Description of Artificial Sequence: Synthetic oligonucleotide
cagcgacgtgtgggagttccggg

SEQ ID NO: 392462 - DNA, 23 bp, Artificial Sequence
  Description of Artificial Sequence: Synthetic oligonucleotide
agcgacgtgtgggagttccgggc

SEQ ID NO: 392463 - DNA, 22 bp, Artificial Sequence
  Description of Artificial Sequence: Synthetic oligonucleotide
gcgacgtgtgggagttccgggc

SEQ ID NO: 392464 - DNA, 22 bp, Artificial Sequence
  Description of Artificial Sequence: Synthetic oligonucleotide
cgacgtgtgggagttccgggcg

SEQ ID NO: 392465 - DNA, 23 bp, Artificial Sequence
  Description of Artificial Sequence: Synthetic oligonucleotide
gacgtgtgggagttccgggcggt

SEQ ID NO: 392466 - DNA, 24 bp, Artificial Sequence
  Description of Artificial Sequence: Synthetic oligonucleotide
acgtgtgggagttccgggcggtga

SEQ ID NO: 392467 - DNA, 23 bp, Artificial Sequence
  Description of Artificial Sequence: Synthetic oligonucleotide
cgtgtgggagttccgggcggtga

SEQ ID NO: 392468 - DNA, 23 bp, Artificial Sequence
  Description of Artificial Sequence: Synthetic oligonucleotide
gtgtgggagttccgggcggtgac

SEQ ID NO: 392469 - DNA, 23 bp, Artificial Sequence
  Description of Artificial Sequence: Synthetic oligonucleotide
tgtgggagttccgggcggtgacg

SEQ ID NO: 392470 - DNA, 22 bp, Artificial Sequence
  Description of Artificial Sequence: Synthetic oligonucleotide
gtgggagttccgggcggtgacg

SEQ ID NO: 392471 - DNA, 23 bp, Artificial Sequence
  Description of Artificial Sequence: Synthetic oligonucleotide
tgggagttccgggcggtgacgga

SEQ ID NO: 392472 - DNA, 31 bp, Artificial Sequence; identical to SEQ ID NO: 54988
  Description of Artificial Sequence: Synthetic oligonucleotide

SEQ ID NO: 392473 - DNA, 30 bp, Artificial Sequence; identical to SEQ ID NO: 54989
  Description of Artificial Sequence: Synthetic oligonucleotide

SEQ ID NO: 392474 - DNA, 29 bp, Artificial Sequence
  Description of Artificial Sequence: Synthetic oligonucleotide
taatgggacacagcgcttcctggagagag

SEQ ID NO: 392475 - DNA, 28 bp, Artificial Sequence
  Description of Artificial Sequence: Synthetic oligonucleotide
aatgggacacagcgcttcctggagagag

SEQ ID NO: 392476 - DNA, 27 bp, Artificial Sequence
  Description of Artificial Sequence: Synthetic oligonucleotide
atgggacacagcgcttcctggagagag

SEQ ID NO: 392477 - DNA, 27 bp, Artificial Sequence
  Description of Artificial Sequence: Synthetic oligonucleotide
tgggacacagcgcttcctggagagaga

SEQ ID NO: 392478 - DNA, 26 bp, Artificial Sequence
  Description of Artificial Sequence: Synthetic oligonucleotide
gggacacagcgcttcctggagagaga

SEQ ID NO: 392479 - DNA, 27 bp, Artificial Sequence
  Description of Artificial Sequence: Synthetic oligonucleotide
ggacacagcgcttcctggagagagaca

SEQ ID NO: 392480 - DNA, 28 bp, Artificial Sequence
  Description of Artificial Sequence: Synthetic oligonucleotide
gacacagcgcttcctggagagagacatc

SEQ ID NO: 392481 - DNA, 30 bp, Artificial Sequence; identical to SEQ ID NO: 54997
  Description of Artificial Sequence: Synthetic oligonucleotide

SEQ ID NO: 392482 - DNA, 29 bp, Artificial Sequence
  Description of Artificial Sequence: Synthetic oligonucleotide
cacagcgcttcctggagagagacatctac

SEQ ID NO: 392483 - DNA, 31 bp, Artificial Sequence; identical to SEQ ID NO: 54999
  Description of Artificial Sequence: Synthetic oligonucleotide

SEQ ID NO: 392484 - DNA, 30 bp, Artificial Sequence; identical to SEQ ID NO: 55000
  Description of Artificial Sequence: Synthetic oligonucleotide

SEQ ID NO: 392485 - DNA, 30 bp, Artificial Sequence; identical to SEQ ID NO: 55001
  Description of Artificial Sequence: Synthetic oligonucleotide

SEQ ID NO: 392486 - DNA, 29 bp, Artificial Sequence
  Description of Artificial Sequence: Synthetic oligonucleotide
gcgcttcctggagagagacatctacaacc

SEQ ID NO: 392487 - DNA, 29 bp, Artificial Sequence
  Description of Artificial Sequence: Synthetic oligonucleotide
cgcttcctggagagagacatctacaaccg

SEQ ID NO: 392488 - DNA, 29 bp, Artificial Sequence
  Description of Artificial Sequence: Synthetic oligonucleotide
gcttcctggagagagacatctacaaccgg

SEQ ID NO: 392489 - DNA, 29 bp, Artificial Sequence
  Description of Artificial Sequence: Synthetic oligonucleotide
cttcctggagagagacatctacaaccggg

SEQ ID NO: 392490 - DNA, 30 bp, Artificial Sequence; identical to SEQ ID NO: 55006
  Description of Artificial Sequence: Synthetic oligonucleotide

SEQ ID NO: 392491 - DNA, 29 bp, Artificial Sequence
  Description of Artificial Sequence: Synthetic oligonucleotide
tcctggagagagacatctacaaccgggag

SEQ ID NO: 392492 - DNA, 28 bp, Artificial Sequence
  Description of Artificial Sequence: Synthetic oligonucleotide
cctggagagagacatctacaaccgggag

SEQ ID NO: 392493 - DNA, 28 bp, Artificial Sequence
  Description of Artificial Sequence: Synthetic oligonucleotide
ctggagagagacatctacaaccgggagg

SEQ ID NO: 392494 - DNA, 29 bp, Artificial Sequence
  Description of Artificial Sequence: Synthetic oligonucleotide
tggagagagacatctacaaccgggaggag

SEQ ID NO: 392495 - DNA, 28 bp, Artificial Sequence
  Description of Artificial Sequence: Synthetic oligonucleotide
ggagagagacatctacaaccgggaggag

SEQ ID NO: 392496 - DNA, 30 bp, Artificial Sequence; identical to SEQ ID NO: 55012
  Description of Artificial Sequence: Synthetic oligonucleotide

SEQ ID NO: 392497 - DNA, 30 bp, Artificial Sequence; identical to SEQ ID NO: 55013
  Description of Artificial Sequence: Synthetic oligonucleotide

SEQ ID NO: 392498 - DNA, 29 bp, Artificial Sequence
  Description of Artificial Sequence: Synthetic oligonucleotide
gagagacatctacaaccgggaggagttcg

SEQ ID NO: 392499 - DNA, 29 bp, Artificial Sequence
  Description of Artificial Sequence: Synthetic oligonucleotide
agagacatctacaaccgggaggagttcgc

SEQ ID NO: 392500 - DNA, 28 bp, Artificial Sequence
  Description of Artificial Sequence: Synthetic oligonucleotide
gagacatctacaaccgggaggagttcgc

SEQ ID NO: 392501 - DNA, 28 bp, Artificial Sequence
  Description of Artificial Sequence: Synthetic oligonucleotide
agacatctacaaccgggaggagttcgcg

SEQ ID NO: 392502 - DNA, 27 bp, Artificial Sequence
  Description of Artificial Sequence: Synthetic oligonucleotide
gacatctacaaccgggaggagttcgcg

SEQ ID NO: 392503 - DNA, 31 bp, Artificial Sequence; identical to SEQ ID NO: 55019
  Description of Artificial Sequence: Synthetic oligonucleotide

SEQ ID NO: 392504 - DNA, 30 bp, Artificial Sequence; identical to SEQ ID NO: 55020
  Description of Artificial Sequence: Synthetic oligonucleotide

SEQ ID NO: 392505 - DNA, 29 bp, Artificial Sequence
  Description of Artificial Sequence: Synthetic oligonucleotide
gatcctaaacaaagctctgctgctggggg

SEQ ID NO: 392506 - DNA, 29 bp, Artificial Sequence
  Description of Artificial Sequence: Synthetic oligonucleotide
atcctaaacaaagctctgctgctgggggc

SEQ ID NO: 392507 - DNA, 28 bp, Artificial Sequence
  Description of Artificial Sequence: Synthetic oligonucleotide
tcctaaacaaagctctgctgctgggggc

SEQ ID NO: 392508 - DNA, 27 bp, Artificial Sequence
  Description of Artificial Sequence: Synthetic oligonucleotide
cctaaacaaagctctgctgctgggggc

SEQ ID NO: 392509 - DNA, 27 bp, Artificial Sequence
  Description of Artificial Sequence: Synthetic oligonucleotide
ctaaacaaagctctgctgctgggggcc

SEQ ID NO: 392510 - DNA, 27 bp, Artificial Sequence
  Description of Artificial Sequence: Synthetic oligonucleotide
taaacaaagctctgctgctgggggccc

SEQ ID NO: 392511 - DNA, 27 bp, Artificial Sequence
  Description of Artificial Sequence: Synthetic oligonucleotide
aaacaaagctctgctgctgggggccct

SEQ ID NO: 392512 - DNA, 26 bp, Artificial Sequence
  Description of Artificial Sequence: Synthetic oligonucleotide
aacaaagctctgctgctgggggccct

SEQ ID NO: 392513 - DNA, 25 bp, Artificial Sequence
  Description of Artificial Sequence: Synthetic oligonucleotide
acaaagctctgctgctgggggccct

SEQ ID NO: 392514 - DNA, 24 bp, Artificial Sequence
  Description of Artificial Sequence: Synthetic oligonucleotide
caaagctctgctgctgggggccct

SEQ ID NO: 392515 - DNA, 24 bp, Artificial Sequence
  Description of Artificial Sequence: Synthetic oligonucleotide
aaagctctgctgctgggggccctc

SEQ ID NO: 392516 - DNA, 23 bp, Artificial Sequence
  Description of Artificial Sequence: Synthetic oligonucleotide
aagctctgctgctgggggccctc

SEQ ID NO: 392517 - DNA, 22 bp, Artificial Sequence
  Description of Artificial Sequence: Synthetic oligonucleotide
agctctgctgctgggggccctc

SEQ ID NO: 392518 - DNA, 21 bp, Artificial Sequence
  Description of Artificial Sequence: Synthetic oligonucleotide
gctctgctgctgggggccctc

SEQ ID NO: 392519 - DNA, 21 bp, Artificial Sequence
  Description of Artificial Sequence: Synthetic oligonucleotide
ctctgctgctgggggccctcg

SEQ ID NO: 392520 - DNA, 22 bp, Artificial Sequence
  Description of Artificial Sequence: Synthetic oligonucleotide
tctgctgctgggggccctcgct

SEQ ID NO: 392521 - DNA, 21 bp, Artificial Sequence
  Description of Artificial Sequence: Synthetic oligonucleotide
ctgctgctgggggccctcgct

SEQ ID NO: 392522 - DNA, 22 bp, Artificial Sequence
  Description of Artificial Sequence: Synthetic oligonucleotide
tgctgctgggggccctcgctct

SEQ ID NO: 392523 - DNA, 21 bp, Artificial Sequence
  Description of Artificial Sequence: Synthetic oligonucleotide
gctgctgggggccctcgctct

SEQ ID NO: 392524 - DNA, 22 bp, Artificial Sequence
  Description of Artificial Sequence: Synthetic oligonucleotide
ctgctgggggccctcgctctga

SEQ ID NO: 392525 - DNA, 22 bp, Artificial Sequence
  Description of Artificial Sequence: Synthetic oligonucleotide
tgctgggggccctcgctctgac

SEQ ID NO: 392526 - DNA, 21 bp, Artificial Sequence
  Description of Artificial Sequence: Synthetic oligonucleotide
gctgggggccctcgctctgac

SEQ ID NO: 392527 - DNA, 22 bp, Artificial Sequence
  Description of Artificial Sequence: Synthetic oligonucleotide
ctgggggccctcgctctgacca

SEQ ID NO: 392528 - DNA, 22 bp, Artificial Sequence
  Description of Artificial Sequence: Synthetic oligonucleotide
tgggggccctcgctctgaccac

SEQ ID NO: 392529 - DNA, 21 bp, Artificial Sequence
  Description of Artificial Sequence: Synthetic oligonucleotide
gggggccctcgctctgaccac

SEQ ID NO: 392530 - DNA, 21 bp, Artificial Sequence
  Description of Artificial Sequence: Synthetic oligonucleotide
ggggccctcgctctgaccacc

SEQ ID NO: 392531 - DNA, 22 bp, Artificial Sequence
  Description of Artificial Sequence: Synthetic oligonucleotide
gggccctcgctctgaccaccgt

SEQ ID NO: 392532 - DNA, 24 bp, Artificial Sequence
  Description of Artificial Sequence: Synthetic oligonucleotide
ggccctcgctctgaccaccgtgat

SEQ ID NO: 392533 - DNA, 25 bp, Artificial Sequence
  Description of Artificial Sequence: Synthetic oligonucleotide
gccctcgctctgaccaccgtgatga

SEQ ID NO: 392534 - DNA, 25 bp, Artificial Sequence
  Description of Artificial Sequence: Synthetic oligonucleotide
ccctcgctctgaccaccgtgatgag

SEQ ID NO: 392535 - DNA, 25 bp, Artificial Sequence
  Description of Artificial Sequence: Synthetic oligonucleotide
cctcgctctgaccaccgtgatgagc

SEQ ID NO: 392536 - DNA, 25 bp, Artificial Sequence
  Description of Artificial Sequence: Synthetic oligonucleotide
ctcgctctgaccaccgtgatgagcc

SEQ ID NO: 392537 - DNA, 25 bp, Artificial Sequence
  Description of Artificial Sequence: Synthetic oligonucleotide
tcgctctgaccaccgtgatgagccc

SEQ ID NO: 392538 - DNA, 24 bp, Artificial Sequence
  Description of Artificial Sequence: Synthetic oligonucleotide
cgctctgaccaccgtgatgagccc

SEQ ID NO: 392539 - DNA, 25 bp, Artificial Sequence
  Description of Artificial Sequence: Synthetic oligonucleotide
gctctgaccaccgtgatgagcccct

SEQ ID NO: 392540 - DNA, 26 bp, Artificial Sequence
  Description of Artificial Sequence: Synthetic oligonucleotide
ctctgaccaccgtgatgagcccctgt

SEQ ID NO: 392541 - DNA, 26 bp, Artificial Sequence
  Description of Artificial Sequence: Synthetic oligonucleotide
tctgaccaccgtgatgagcccctgtg

SEQ ID NO: 392542 - DNA, 25 bp, Artificial Sequence
  Description of Artificial Sequence: Synthetic oligonucleotide
ctgaccaccgtgatgagcccctgtg

SEQ ID NO: 392543 - DNA, 26 bp, Artificial Sequence
  Description of Artificial Sequence: Synthetic oligonucleotide
tgaccaccgtgatgagcccctgtgga

SEQ ID NO: 392544 - DNA, 25 bp, Artificial Sequence
  Description of Artificial Sequence: Synthetic oligonucleotide
gaccaccgtgatgagcccctgtgga

SEQ ID NO: 392545 - DNA, 25 bp, Artificial Sequence
  Description of Artificial Sequence: Synthetic oligonucleotide
accaccgtgatgagcccctgtggag

SEQ ID NO: 392546 - DNA, 24 bp, Artificial Sequence
  Description of Artificial Sequence: Synthetic oligonucleotide
ccaccgtgatgagcccctgtggag

SEQ ID NO: 392547 - DNA, 25 bp, Artificial Sequence
  Description of Artificial Sequence: Synthetic oligonucleotide
caccgtgatgagcccctgtggaggt

SEQ ID NO: 392548 - DNA, 27 bp, Artificial Sequence
  Description of Artificial Sequence: Synthetic oligonucleotide
accgtgatgagcccctgtggaggtgaa

SEQ ID NO: 392549 - DNA, 26 bp, Artificial Sequence
  Description of Artificial Sequence: Synthetic oligonucleotide
ccgtgatgagcccctgtggaggtgaa

SEQ ID NO: 392550 - DNA, 27 bp, Artificial Sequence
  Description of Artificial Sequence: Synthetic oligonucleotide
cgtgatgagcccctgtggaggtgaaga

SEQ ID NO: 392551 - DNA, 27 bp, Artificial Sequence
  Description of Artificial Sequence: Synthetic oligonucleotide
gtgatgagcccctgtggaggtgaagac

SEQ ID NO: 392552 - DNA, 30 bp, Artificial Sequence; identical to SEQ ID NO: 55068
  Description of Artificial Sequence: Synthetic oligonucleotide

SEQ ID NO: 392553 - DNA, 29 bp, Artificial Sequence
  Description of Artificial Sequence: Synthetic oligonucleotide
gatgagcccctgtggaggtgaagacattg

SEQ ID NO: 392554 - DNA, 30 bp, Artificial Sequence; identical to SEQ ID NO: 55070
  Description of Artificial Sequence: Synthetic oligonucleotide

SEQ ID NO: 392555 - DNA, 29 bp, Artificial Sequence
  Description of Artificial Sequence: Synthetic oligonucleotide
tgagcccctgtggaggtgaagacattgtg

SEQ ID NO: 392556 - DNA, 28 bp, Artificial Sequence
  Description of Artificial Sequence: Synthetic oligonucleotide
gagcccctgtggaggtgaagacattgtg

SEQ ID NO: 392557 - DNA, 28 bp, Artificial Sequence
  Description of Artificial Sequence: Synthetic oligonucleotide
agcccctgtggaggtgaagacattgtgg

SEQ ID NO: 392558 - DNA, 27 bp, Artificial Sequence
  Description of Artificial Sequence: Synthetic oligonucleotide
gcccctgtggaggtgaagacattgtgg

SEQ ID NO: 392559 - DNA, 27 bp, Artificial Sequence
  Description of Artificial Sequence: Synthetic oligonucleotide
cccctgtggaggtgaagacattgtggc

SEQ ID NO: 392560 - DNA, 28 bp, Artificial Sequence
  Description of Artificial Sequence: Synthetic oligonucleotide
ccctgtggaggtgaagacattgtggctg

SEQ ID NO: 392561 - DNA, 29 bp, Artificial Sequence
  Description of Artificial Sequence: Synthetic oligonucleotide
cctgtggaggtgaagacattgtggctgac

SEQ ID NO: 392562 - DNA, 29 bp, Artificial Sequence
  Description of Artificial Sequence: Synthetic oligonucleotide
ctgtggaggtgaagacattgtggctgacc

SEQ ID NO: 392563 - DNA, 30 bp, Artificial Sequence; identical to SEQ ID NO: 55079
  Description of Artificial Sequence: Synthetic oligonucleotide

SEQ ID NO: 392564 - DNA, 29 bp, Artificial Sequence
  Description of Artificial Sequence: Synthetic oligonucleotide
gtggaggtgaagacattgtggctgaccac

SEQ ID NO: 392565 - DNA, 29 bp, Artificial Sequence
  Description of Artificial Sequence: Synthetic oligonucleotide
tggaggtgaagacattgtggctgaccacg

SEQ ID NO: 392566 - DNA, 28 bp, Artificial Sequence
  Description of Artificial Sequence: Synthetic oligonucleotide
ggaggtgaagacattgtggctgaccacg

SEQ ID NO: 392567 - DNA, 30 bp, Artificial Sequence; identical to SEQ ID NO: 55083
  Description of Artificial Sequence: Synthetic oligonucleotide

SEQ ID NO: 392568 - DNA, 30 bp, Artificial Sequence; identical to SEQ ID NO: 55084
  Description of Artificial Sequence: Synthetic oligonucleotide

SEQ ID NO: 392569 - DNA, 29 bp, Artificial Sequence
  Description of Artificial Sequence: Synthetic oligonucleotide
ggtgaagacattgtggctgaccacgttgc

SEQ ID NO: 392570 - DNA, 29 bp, Artificial Sequence
  Description of Artificial Sequence: Synthetic oligonucleotide
gtgaagacattgtggctgaccacgttgcc

SEQ ID NO: 392571 - DNA, 30 bp, Artificial Sequence; identical to SEQ ID NO: 55087
  Description of Artificial Sequence: Synthetic oligonucleotide

SEQ ID NO: 392572 - DNA, 29 bp, Artificial Sequence
  Description of Artificial Sequence: Synthetic oligonucleotide
gaagacattgtggctgaccacgttgcctc

SEQ ID NO: 392573 - DNA, 31 bp, Artificial Sequence; identical to SEQ ID NO: 55089
  Description of Artificial Sequence: Synthetic oligonucleotide

SEQ ID NO: 392574 - DNA, 30 bp, Artificial Sequence; identical to SEQ ID NO: 55090
  Description of Artificial Sequence: Synthetic oligonucleotide

SEQ ID NO: 392575 - DNA, 29 bp, Artificial Sequence
  Description of Artificial Sequence: Synthetic oligonucleotide
gacattgtggctgaccacgttgcctcttg

SEQ ID NO: 392576 - DNA, 30 bp, Artificial Sequence; identical to SEQ ID NO: 55092
  Description of Artificial Sequence: Synthetic oligonucleotide

SEQ ID NO: 392577 - DNA, 29 bp, Artificial Sequence
  Description of Artificial Sequence: Synthetic oligonucleotide
cattgtggctgaccacgttgcctcttgtg

SEQ ID NO: 392578 - DNA, 29 bp, Artificial Sequence
  Description of Artificial Sequence: Synthetic oligonucleotide
attgtggctgaccacgttgcctcttgtgg

SEQ ID NO: 392579 - DNA, 28 bp, Artificial Sequence
  Description of Artificial Sequence: Synthetic oligonucleotide
ttgtggctgaccacgttgcctcttgtgg

SEQ ID NO: 392580 - DNA, 27 bp, Artificial Sequence
  Description of Artificial Sequence: Synthetic oligonucleotide
tgtggctgaccacgttgcctcttgtgg

SEQ ID NO: 392581 - DNA, 27 bp, Artificial Sequence
  Description of Artificial Sequence: Synthetic oligonucleotide
gtggctgaccacgttgcctcttgtggt

SEQ ID NO: 392582 - DNA, 27 bp, Artificial Sequence
  Description of Artificial Sequence: Synthetic oligonucleotide
tggctgaccacgttgcctcttgtggtg

SEQ ID NO: 392583 - DNA, 27 bp, Artificial Sequence
  Description of Artificial Sequence: Synthetic oligonucleotide
ggctgaccacgttgcctcttgtggtgt

SEQ ID NO: 392584 - DNA, 30 bp, Artificial Sequence; identical to SEQ ID NO: 55100
  Description of Artificial Sequence: Synthetic oligonucleotide

SEQ ID NO: 392585 - DNA, 32 bp, Artificial Sequence; identical to SEQ ID NO: 55101
  Description of Artificial Sequence: Synthetic oligonucleotide

SEQ ID NO: 392586 - DNA, 34 bp, Artificial Sequence; identical to SEQ ID NO: 55102
  Description of Artificial Sequence: Synthetic oligonucleotide

SEQ ID NO: 392587 - DNA, 33 bp, Artificial Sequence; identical to SEQ ID NO: 55103
  Description of Artificial Sequence: Synthetic oligonucleotide

SEQ ID NO: 392588 - DNA, 33 bp, Artificial Sequence; identical to SEQ ID NO: 55104
  Description of Artificial Sequence: Synthetic oligonucleotide

SEQ ID NO: 392589 - DNA, 32 bp, Artificial Sequence; identical to SEQ ID NO: 55105
  Description of Artificial Sequence: Synthetic oligonucleotide

SEQ ID NO: 392590 - DNA, 33 bp, Artificial Sequence; identical to SEQ ID NO: 55106
  Description of Artificial Sequence: Synthetic oligonucleotide

SEQ ID NO: 392591 - DNA, 38 bp, Artificial Sequence; identical to SEQ ID NO: 55107
  Description of Artificial Sequence: Synthetic oligonucleotide

SEQ ID NO: 392592 - DNA, 37 bp, Artificial Sequence; identical to SEQ ID NO: 55108
  Description of Artificial Sequence: Synthetic oligonucleotide

SEQ ID NO: 392593 - DNA, 37 bp, Artificial Sequence; identical to SEQ ID NO: 55109
  Description of Artificial Sequence: Synthetic oligonucleotide

SEQ ID NO: 392594 - DNA, 37 bp, Artificial Sequence; identical to SEQ ID NO: 55110
  Description of Artificial Sequence: Synthetic oligonucleotide

SEQ ID NO: 392595 - DNA, 36 bp, Artificial Sequence; identical to SEQ ID NO: 55111
  Description of Artificial Sequence: Synthetic oligonucleotide

SEQ ID NO: 392596 - DNA, 35 bp, Artificial Sequence; identical to SEQ ID NO: 55112
  Description of Artificial Sequence: Synthetic oligonucleotide

SEQ ID NO: 392597 - DNA, 36 bp, Artificial Sequence; identical to SEQ ID NO: 55113
  Description of Artificial Sequence: Synthetic oligonucleotide

SEQ ID NO: 392598 - DNA, 36 bp, Artificial Sequence; identical to SEQ ID NO: 55114
  Description of Artificial Sequence: Synthetic oligonucleotide

SEQ ID NO: 392599 - DNA, 36 bp, Artificial Sequence; identical to SEQ ID NO: 55115
  Description of Artificial Sequence: Synthetic oligonucleotide

SEQ ID NO: 392600 - DNA, 35 bp, Artificial Sequence; identical to SEQ ID NO: 55116
  Description of Artificial Sequence: Synthetic oligonucleotide

SEQ ID NO: 392601 - DNA, 36 bp, Artificial Sequence; identical to SEQ ID NO: 55117
  Description of Artificial Sequence: Synthetic oligonucleotide

SEQ ID NO: 392602 - DNA, 35 bp, Artificial Sequence; identical to SEQ ID NO: 55118
  Description of Artificial Sequence: Synthetic oligonucleotide

SEQ ID NO: 392603 - DNA, 34 bp, Artificial Sequence; identical to SEQ ID NO: 55119
  Description of Artificial Sequence: Synthetic oligonucleotide

SEQ ID NO: 392604 - DNA, 35 bp, Artificial Sequence; identical to SEQ ID NO: 55120
  Description of Artificial Sequence: Synthetic oligonucleotide

SEQ ID NO: 392605 - DNA, 34 bp, Artificial Sequence; identical to SEQ ID NO: 55121
  Description of Artificial Sequence: Synthetic oligonucleotide

SEQ ID NO: 392606 - DNA, 34 bp, Artificial Sequence; identical to SEQ ID NO: 55122
  Description of Artificial Sequence: Synthetic oligonucleotide

SEQ ID NO: 392607 - DNA, 34 bp, Artificial Sequence; identical to SEQ ID NO: 55123
  Description of Artificial Sequence: Synthetic oligonucleotide

SEQ ID NO: 392608 - DNA, 33 bp, Artificial Sequence; identical to SEQ ID NO: 55124
  Description of Artificial Sequence: Synthetic oligonucleotide

SEQ ID NO: 392609 - DNA, 33 bp, Artificial Sequence; identical to SEQ ID NO: 55125
  Description of Artificial Sequence: Synthetic oligonucleotide

SEQ ID NO: 392610 - DNA, 32 bp, Artificial Sequence; identical to SEQ ID NO: 55126
  Description of Artificial Sequence: Synthetic oligonucleotide

SEQ ID NO: 392611 - DNA, 31 bp, Artificial Sequence; identical to SEQ ID NO: 55127
  Description of Artificial Sequence: Synthetic oligonucleotide

SEQ ID NO: 392612 - DNA, 30 bp, Artificial Sequence; identical to SEQ ID NO: 55128
  Description of Artificial Sequence: Synthetic oligonucleotide

SEQ ID NO: 392613 - DNA, 29 bp, Artificial Sequence
  Description of Artificial Sequence: Synthetic oligonucleotide
cttgtaccagttttacggtccctctggcc

SEQ ID NO: 392614 - DNA, 30 bp, Artificial Sequence; identical to SEQ ID NO: 55130
  Description of Artificial Sequence: Synthetic oligonucleotide

SEQ ID NO: 392615 - DNA, 29 bp, Artificial Sequence
  Description of Artificial Sequence: Synthetic oligonucleotide
tgtaccagttttacggtccctctggccag

SEQ ID NO: 392616 - DNA, 28 bp, Artificial Sequence
  Description of Artificial Sequence: Synthetic oligonucleotide
gtaccagttttacggtccctctggccag

SEQ ID NO: 392617 - DNA, 30 bp, Artificial Sequence; identical to SEQ ID NO: 55133
  Description of Artificial Sequence: Synthetic oligonucleotide

SEQ ID NO: 392618 - DNA, 29 bp, Artificial Sequence
  Description of Artificial Sequence: Synthetic oligonucleotide
accagttttacggtccctctggccagtac

SEQ ID NO: 392619 - DNA, 28 bp, Artificial Sequence
  Description of Artificial Sequence: Synthetic oligonucleotide
ccagttttacggtccctctggccagtac

SEQ ID NO: 392620 - DNA, 29 bp, Artificial Sequence
  Description of Artificial Sequence: Synthetic oligonucleotide
cagttttacggtccctctggccagtacac

SEQ ID NO: 392621 - DNA, 29 bp, Artificial Sequence
  Description of Artificial Sequence: Synthetic oligonucleotide
agttttacggtccctctggccagtacacc

SEQ ID NO: 392622 - DNA, 28 bp, Artificial Sequence
  Description of Artificial Sequence: Synthetic oligonucleotide
gttttacggtccctctggccagtacacc

SEQ ID NO: 392623 - DNA, 28 bp, Artificial Sequence
  Description of Artificial Sequence: Synthetic oligonucleotide
ttttacggtccctctggccagtacaccc

SEQ ID NO: 392624 - DNA, 27 bp, Artificial Sequence
  Description of Artificial Sequence: Synthetic oligonucleotide
tttacggtccctctggccagtacaccc

SEQ ID NO: 392625 - DNA, 27 bp, Artificial Sequence
  Description of Artificial Sequence: Synthetic oligonucleotide
ttacggtccctctggccagtacaccca

SEQ ID NO: 392626 - DNA, 27 bp, Artificial Sequence
  Description of Artificial Sequence: Synthetic oligonucleotide
tacggtccctctggccagtacacccat

SEQ ID NO: 392627 - DNA, 26 bp, Artificial Sequence
  Description of Artificial Sequence: Synthetic oligonucleotide
acggtccctctggccagtacacccat

SEQ ID NO: 392628 - DNA, 25 bp, Artificial Sequence
  Description of Artificial Sequence: Synthetic oligonucleotide
cggtccctctggccagtacacccat

SEQ ID NO: 392629 - DNA, 27 bp, Artificial Sequence
  Description of Artificial Sequence: Synthetic oligonucleotide
ggtccctctggccagtacacccatgaa

SEQ ID NO: 392630 - DNA, 30 bp, Artificial Sequence; identical to SEQ ID NO: 55146
  Description of Artificial Sequence: Synthetic oligonucleotide

SEQ ID NO: 392631 - DNA, 32 bp, Artificial Sequence; identical to SEQ ID NO: 55147
  Description of Artificial Sequence: Synthetic oligonucleotide

SEQ ID NO: 392632 - DNA, 31 bp, Artificial Sequence; identical to SEQ ID NO: 55148
  Description of Artificial Sequence: Synthetic oligonucleotide

SEQ ID NO: 392633 - DNA, 31 bp, Artificial Sequence; identical to SEQ ID NO: 55149
  Description of Artificial Sequence: Synthetic oligonucleotide

SEQ ID NO: 392634 - DNA, 32 bp, Artificial Sequence; identical to SEQ ID NO: 55150
  Description of Artificial Sequence: Synthetic oligonucleotide

SEQ ID NO: 392635 - DNA, 34 bp, Artificial Sequence; identical to SEQ ID NO: 55151
  Description of Artificial Sequence: Synthetic oligonucleotide

SEQ ID NO: 392636 - DNA, 33 bp, Artificial Sequence; identical to SEQ ID NO: 55152
  Description of Artificial Sequence: Synthetic oligonucleotide

SEQ ID NO: 392637 - DNA, 34 bp, Artificial Sequence; identical to SEQ ID NO: 55153
  Description of Artificial Sequence: Synthetic oligonucleotide

SEQ ID NO: 392638 - DNA, 33 bp, Artificial Sequence; identical to SEQ ID NO: 55154
  Description of Artificial Sequence: Synthetic oligonucleotide

SEQ ID NO: 392639 - DNA, 33 bp, Artificial Sequence; identical to SEQ ID NO: 55155
  Description of Artificial Sequence: Synthetic oligonucleotide

SEQ ID NO: 392640 - DNA, 34 bp, Artificial Sequence; identical to SEQ ID NO: 55156
  Description of Artificial Sequence: Synthetic oligonucleotide

SEQ ID NO: 392641 - DNA, 36 bp, Artificial Sequence; identical to SEQ ID NO: 55157
  Description of Artificial Sequence: Synthetic oligonucleotide

SEQ ID NO: 392642 - DNA, 38 bp, Artificial Sequence; identical to SEQ ID NO: 55158
  Description of Artificial Sequence: Synthetic oligonucleotide

SEQ ID NO: 392643 - DNA, 37 bp, Artificial Sequence; identical to SEQ ID NO: 55159
  Description of Artificial Sequence: Synthetic oligonucleotide

SEQ ID NO: 392644 - DNA, 37 bp, Artificial Sequence; identical to SEQ ID NO: 55160
  Description of Artificial Sequence: Synthetic oligonucleotide

SEQ ID NO: 392645 - DNA, 36 bp, Artificial Sequence; identical to SEQ ID NO: 55161
  Description of Artificial Sequence: Synthetic oligonucleotide

SEQ ID NO: 392646 - DNA, 35 bp, Artificial Sequence; identical to SEQ ID NO: 55162
  Description of Artificial Sequence: Synthetic oligonucleotide

SEQ ID NO: 392647 - DNA, 36 bp, Artificial Sequence; identical to SEQ ID NO: 55163
  Description of Artificial Sequence: Synthetic oligonucleotide

SEQ ID NO: 392648 - DNA, 35 bp, Artificial Sequence; identical to SEQ ID NO: 55164
  Description of Artificial Sequence: Synthetic oligonucleotide

SEQ ID NO: 392649 - DNA, 35 bp, Artificial Sequence; identical to SEQ ID NO: 55165
  Description of Artificial Sequence: Synthetic oligonucleotide

SEQ ID NO: 392650 - DNA, 36 bp, Artificial Sequence; identical to SEQ ID NO: 55166
  Description of Artificial Sequence: Synthetic oligonucleotide

SEQ ID NO: 392651 - DNA, 36 bp, Artificial Sequence; identical to SEQ ID NO: 55167
  Description of Artificial Sequence: Synthetic oligonucleotide

SEQ ID NO: 392652 - DNA, 35 bp, Artificial Sequence; identical to SEQ ID NO: 55168
  Description of Artificial Sequence: Synthetic oligonucleotide

SEQ ID NO: 392653 - DNA, 34 bp, Artificial Sequence; identical to SEQ ID NO: 55169
  Description of Artificial Sequence: Synthetic oligonucleotide

SEQ ID NO: 392654 - DNA, 35 bp, Artificial Sequence; identical to SEQ ID NO: 55170
  Description of Artificial Sequence: Synthetic oligonucleotide

SEQ ID NO: 392655 - DNA, 34 bp, Artificial Sequence; identical to SEQ ID NO: 55171
  Description of Artificial Sequence: Synthetic oligonucleotide

SEQ ID NO: 392656 - DNA, 33 bp, Artificial Sequence; identical to SEQ ID NO: 55172
  Description of Artificial Sequence: Synthetic oligonucleotide

SEQ ID NO: 392657 - DNA, 32 bp, Artificial Sequence; identical to SEQ ID NO: 55173
  Description of Artificial Sequence: Synthetic oligonucleotide

SEQ ID NO: 392658 - DNA, 31 bp, Artificial Sequence; identical to SEQ ID NO: 55174
  Description of Artificial Sequence: Synthetic oligonucleotide

SEQ ID NO: 392659 - DNA, 30 bp, Artificial Sequence; identical to SEQ ID NO: 55175
  Description of Artificial Sequence: Synthetic oligonucleotide

SEQ ID NO: 392660 - DNA, 30 bp, Artificial Sequence; identical to SEQ ID NO: 55176
  Description of Artificial Sequence: Synthetic oligonucleotide

SEQ ID NO: 392661 - DNA, 29 bp, Artificial Sequence
  Description of Artificial Sequence: Synthetic oligonucleotide
tggagatgaggagttctacgtggacctgg

SEQ ID NO: 392662 - DNA, 28 bp, Artificial Sequence
  Description of Artificial Sequence: Synthetic oligonucleotide
ggagatgaggagttctacgtggacctgg

SEQ ID NO: 392663 - DNA, 29 bp, Artificial Sequence
  Description of Artificial Sequence: Synthetic oligonucleotide
gagatgaggagttctacgtggacctggag

SEQ ID NO: 392664 - DNA, 30 bp, Artificial Sequence; identical to SEQ ID NO: 55180
  Description of Artificial Sequence: Synthetic oligonucleotide

SEQ ID NO: 392665 - DNA, 29 bp, Artificial Sequence
  Description of Artificial Sequence: Synthetic oligonucleotide
gatgaggagttctacgtggacctggagag

SEQ ID NO: 392666 - DNA, 29 bp, Artificial Sequence
  Description of Artificial Sequence: Synthetic oligonucleotide
atgaggagttctacgtggacctggagagg

SEQ ID NO: 392667 - DNA, 28 bp, Artificial Sequence
  Description of Artificial Sequence: Synthetic oligonucleotide
tgaggagttctacgtggacctggagagg

SEQ ID NO: 392668 - DNA, 27 bp, Artificial Sequence
  Description of Artificial Sequence: Synthetic oligonucleotide
gaggagttctacgtggacctggagagg

SEQ ID NO: 392669 - DNA, 29 bp, Artificial Sequence
  Description of Artificial Sequence: Synthetic oligonucleotide
aggagttctacgtggacctggagaggaag

SEQ ID NO: 392670 - DNA, 28 bp, Artificial Sequence
  Description of Artificial Sequence: Synthetic oligonucleotide
ggagttctacgtggacctggagaggaag

SEQ ID NO: 392671 - DNA, 28 bp, Artificial Sequence
  Description of Artificial Sequence: Synthetic oligonucleotide
gagttctacgtggacctggagaggaagg

SEQ ID NO: 392672 - DNA, 29 bp, Artificial Sequence
  Description of Artificial Sequence: Synthetic oligonucleotide
agttctacgtggacctggagaggaaggag

SEQ ID NO: 392673 - DNA, 28 bp, Artificial Sequence
  Description of Artificial Sequence: Synthetic oligonucleotide
gttctacgtggacctggagaggaaggag

SEQ ID NO: 392674 - DNA, 29 bp, Artificial Sequence
  Description of Artificial Sequence: Synthetic oligonucleotide
ttctacgtggacctggagaggaaggagac

SEQ ID NO: 392675 - DNA, 28 bp, Artificial Sequence
  Description of Artificial Sequence: Synthetic oligonucleotide
tctacgtggacctggagaggaaggagac

SEQ ID NO: 392676 - DNA, 27 bp, Artificial Sequence
  Description of Artificial Sequence: Synthetic oligonucleotide
ctacgtggacctggagaggaaggagac

SEQ ID NO: 392677 - DNA, 28 bp, Artificial Sequence
  Description of Artificial Sequence: Synthetic oligonucleotide
tacgtggacctggagaggaaggagactg

SEQ ID NO: 392678 - DNA, 27 bp, Artificial Sequence
  Description of Artificial Sequence: Synthetic oligonucleotide
acgtggacctggagaggaaggagactg

SEQ ID NO: 392679 - DNA, 26 bp, Artificial Sequence
  Description of Artificial Sequence: Synthetic oligonucleotide
cgtggacctggagaggaaggagactg

SEQ ID NO: 392680 - DNA, 26 bp, Artificial Sequence
  Description of Artificial Sequence: Synthetic oligonucleotide
gtggacctggagaggaaggagactgc

SEQ ID NO: 392681 - DNA, 27 bp, Artificial Sequence
  Description of Artificial Sequence: Synthetic oligonucleotide
tggacctggagaggaaggagactgcct

SEQ ID NO: 392682 - DNA, 26 bp, Artificial Sequence
  Description of Artificial Sequence: Synthetic oligonucleotide
ggacctggagaggaaggagactgcct

SEQ ID NO: 392683 - DNA, 26 bp, Artificial Sequence
  Description of Artificial Sequence: Synthetic oligonucleotide
gacctggagaggaaggagactgcctg

SEQ ID NO: 392684 - DNA, 26 bp, Artificial Sequence
  Description of Artificial Sequence: Synthetic oligonucleotide
acctggagaggaaggagactgcctgg

SEQ ID NO: 392685 - DNA, 25 bp, Artificial Sequence
  Description of Artificial Sequence: Synthetic oligonucleotide
cctggagaggaaggagactgcctgg

SEQ ID NO: 392686 - DNA, 25 bp, Artificial Sequence
  Description of Artificial Sequence: Synthetic oligonucleotide
ctggagaggaaggagactgcctggc

SEQ ID NO: 392687 - DNA, 25 bp, Artificial Sequence
  Description of Artificial Sequence: Synthetic oligonucleotide
tggagaggaaggagactgcctggcg

SEQ ID NO: 392688 - DNA, 24 bp, Artificial Sequence
  Description of Artificial Sequence: Synthetic oligonucleotide
ggagaggaaggagactgcctggcg

SEQ ID NO: 392689 - DNA, 25 bp, Artificial Sequence
  Description of Artificial Sequence: Synthetic oligonucleotide
gagaggaaggagactgcctggcggt

SEQ ID NO: 392690 - DNA, 25 bp, Artificial Sequence
  Description of Artificial Sequence: Synthetic oligonucleotide
agaggaaggagactgcctggcggtg

SEQ ID NO: 392691 - DNA, 24 bp, Artificial Sequence
  Description of Artificial Sequence: Synthetic oligonucleotide
gaggaaggagactgcctggcggtg

SEQ ID NO: 392692 - DNA, 24 bp, Artificial Sequence
  Description of Artificial Sequence: Synthetic oligonucleotide
aggaaggagactgcctggcggtgg

SEQ ID NO: 392693 - DNA, 23 bp, Artificial Sequence
  Description of Artificial Sequence: Synthetic oligonucleotide
ggaaggagactgcctggcggtgg

SEQ ID NO: 392694 - DNA, 23 bp, Artificial Sequence
  Description of Artificial Sequence: Synthetic oligonucleotide
gaaggagactgcctggcggtggc

SEQ ID NO: 392695 - DNA, 24 bp, Artificial Sequence
  Description of Artificial Sequence: Synthetic oligonucleotide
aaggagactgcctggcggtggcct

SEQ ID NO: 392696 - DNA, 23 bp, Artificial Sequence
  Description of Artificial Sequence: Synthetic oligonucleotide
aggagactgcctggcggtggcct

SEQ ID NO: 392697 - DNA, 22 bp, Artificial Sequence
  Description of Artificial Sequence: Synthetic oligonucleotide
ggagactgcctggcggtggcct

SEQ ID NO: 392698 - DNA, 23 bp, Artificial Sequence
  Description of Artificial Sequence: Synthetic oligonucleotide
gagactgcctggcggtggcctga

SEQ ID NO: 392699 - DNA, 25 bp, Artificial Sequence
  Description of Artificial Sequence: Synthetic oligonucleotide
agactgcctggcggtggcctgagtt

SEQ ID NO: 392700 - DNA, 24 bp, Artificial Sequence
  Description of Artificial Sequence: Synthetic oligonucleotide
gactgcctggcggtggcctgagtt

SEQ ID NO: 392701 - DNA, 25 bp, Artificial Sequence
  Description of Artificial Sequence: Synthetic oligonucleotide
actgcctggcggtggcctgagttca

SEQ ID NO: 392702 - DNA, 24 bp, Artificial Sequence
  Description of Artificial Sequence: Synthetic oligonucleotide
ctgcctggcggtggcctgagttca

SEQ ID NO: 392703 - DNA, 24 bp, Artificial Sequence
  Description of Artificial Sequence: Synthetic oligonucleotide
tgcctggcggtggcctgagttcag

SEQ ID NO: 392704 - DNA, 23 bp, Artificial Sequence
  Description of Artificial Sequence: Synthetic oligonucleotide
gcctggcggtggcctgagttcag

SEQ ID NO: 392705 - DNA, 27 bp, Artificial Sequence
  Description of Artificial Sequence: Synthetic oligonucleotide
cctggcggtggcctgagttcagcaaat

SEQ ID NO: 392706 - DNA, 29 bp, Artificial Sequence
  Description of Artificial Sequence: Synthetic oligonucleotide
ctggcggtggcctgagttcagcaaatttg

SEQ ID NO: 392707 - DNA, 29 bp, Artificial Sequence
  Description of Artificial Sequence: Synthetic oligonucleotide
tggcggtggcctgagttcagcaaatttgg

SEQ ID NO: 392708 - DNA, 28 bp, Artificial Sequence
  Description of Artificial Sequence: Synthetic oligonucleotide
ggcggtggcctgagttcagcaaatttgg

SEQ ID NO: 392709 - DNA, 29 bp, Artificial Sequence
  Description of Artificial Sequence: Synthetic oligonucleotide
gcggtggcctgagttcagcaaatttggag

SEQ ID NO: 392710 - DNA, 29 bp, Artificial Sequence
  Description of Artificial Sequence: Synthetic oligonucleotide
cggtggcctgagttcagcaaatttggagg

SEQ ID NO: 392711 - DNA, 33 bp, Artificial Sequence; identical to SEQ ID NO: 55227
  Description of Artificial Sequence: Synthetic oligonucleotide

SEQ ID NO: 392712 - DNA, 34 bp, Artificial Sequence; identical to SEQ ID NO: 55228
  Description of Artificial Sequence: Synthetic oligonucleotide

SEQ ID NO: 392713 - DNA, 34 bp, Artificial Sequence; identical to SEQ ID NO: 55229
  Description of Artificial Sequence: Synthetic oligonucleotide

SEQ ID NO: 392714 - DNA, 33 bp, Artificial Sequence; identical to SEQ ID NO: 55230
  Description of Artificial Sequence: Synthetic oligonucleotide

SEQ ID NO: 392715 - DNA, 33 bp, Artificial Sequence; identical to SEQ ID NO: 55231
  Description of Artificial Sequence: Synthetic oligonucleotide

SEQ ID NO: 392716 - DNA, 33 bp, Artificial Sequence; identical to SEQ ID NO: 55232
  Description of Artificial Sequence: Synthetic oligonucleotide

SEQ ID NO: 392717 - DNA, 33 bp, Artificial Sequence; identical to SEQ ID NO: 55233
  Description of Artificial Sequence: Synthetic oligonucleotide

SEQ ID NO: 392718 - DNA, 34 bp, Artificial Sequence; identical to SEQ ID NO: 55234
  Description of Artificial Sequence: Synthetic oligonucleotide

SEQ ID NO: 392719 - DNA, 33 bp, Artificial Sequence; identical to SEQ ID NO: 55235
  Description of Artificial Sequence: Synthetic oligonucleotide

SEQ ID NO: 392720 - DNA, 33 bp, Artificial Sequence; identical to SEQ ID NO: 55236
  Description of Artificial Sequence: Synthetic oligonucleotide

SEQ ID NO: 392721 - DNA, 32 bp, Artificial Sequence; identical to SEQ ID NO: 55237
  Description of Artificial Sequence: Synthetic oligonucleotide

SEQ ID NO: 392722 - DNA, 32 bp, Artificial Sequence; identical to SEQ ID NO: 55238
  Description of Artificial Sequence: Synthetic oligonucleotide

SEQ ID NO: 392723 - DNA, 31 bp, Artificial Sequence; identical to SEQ ID NO: 55239
  Description of Artificial Sequence: Synthetic oligonucleotide

SEQ ID NO: 392724 - DNA, 30 bp, Artificial Sequence; identical to SEQ ID NO: 55240
  Description of Artificial Sequence: Synthetic oligonucleotide

SEQ ID NO: 392725 - DNA, 31 bp, Artificial Sequence; identical to SEQ ID NO: 55241
  Description of Artificial Sequence: Synthetic oligonucleotide

SEQ ID NO: 392726 - DNA, 30 bp, Artificial Sequence; identical to SEQ ID NO: 55242
  Description of Artificial Sequence: Synthetic oligonucleotide

SEQ ID NO: 392727 - DNA, 30 bp, Artificial Sequence; identical to SEQ ID NO: 55243
  Description of Artificial Sequence: Synthetic oligonucleotide

SEQ ID NO: 392728 - DNA, 31 bp, Artificial Sequence; identical to SEQ ID NO: 55244
  Description of Artificial Sequence: Synthetic oligonucleotide

SEQ ID NO: 392729 - DNA, 30 bp, Artificial Sequence; identical to SEQ ID NO: 55245
  Description of Artificial Sequence: Synthetic oligonucleotide

SEQ ID NO: 392730 - DNA, 29 bp, Artificial Sequence
  Description of Artificial Sequence: Synthetic oligonucleotide
atttggaggttttgacccgcagggtgcac

SEQ ID NO: 392731 - DNA, 28 bp, Artificial Sequence
  Description of Artificial Sequence: Synthetic oligonucleotide
tttggaggttttgacccgcagggtgcac

SEQ ID NO: 392732 - DNA, 27 bp, Artificial Sequence
  Description of Artificial Sequence: Synthetic oligonucleotide
ttggaggttttgacccgcagggtgcac

SEQ ID NO: 392733 - DNA, 27 bp, Artificial Sequence
  Description of Artificial Sequence: Synthetic oligonucleotide
tggaggttttgacccgcagggtgcact

SEQ ID NO: 392734 - DNA, 26 bp, Artificial Sequence
  Description of Artificial Sequence: Synthetic oligonucleotide
ggaggttttgacccgcagggtgcact

SEQ ID NO: 392735 - DNA, 27 bp, Artificial Sequence
  Description of Artificial Sequence: Synthetic oligonucleotide
gaggttttgacccgcagggtgcactga

SEQ ID NO: 392736 - DNA, 27 bp, Artificial Sequence
  Description of Artificial Sequence: Synthetic oligonucleotide
aggttttgacccgcagggtgcactgag

SEQ ID NO: 392737 - DNA, 27 bp, Artificial Sequence
  Description of Artificial Sequence: Synthetic oligonucleotide
ggttttgacccgcagggtgcactgaga

SEQ ID NO: 392738 - DNA, 29 bp, Artificial Sequence
  Description of Artificial Sequence: Synthetic oligonucleotide
gttttgacccgcagggtgcactgagaaac

SEQ ID NO: 392739 - DNA, 31 bp, Artificial Sequence; identical to SEQ ID NO: 55255
  Description of Artificial Sequence: Synthetic oligonucleotide

SEQ ID NO: 392740 - DNA, 30 bp, Artificial Sequence; identical to SEQ ID NO: 55256
  Description of Artificial Sequence: Synthetic oligonucleotide

SEQ ID NO: 392741 - DNA, 29 bp, Artificial Sequence
  Description of Artificial Sequence: Synthetic oligonucleotide
ttgacccgcagggtgcactgagaaacatg

SEQ ID NO: 392742 - DNA, 28 bp, Artificial Sequence
  Description of Artificial Sequence: Synthetic oligonucleotide
tgacccgcagggtgcactgagaaacatg

SEQ ID NO: 392743 - DNA, 27 bp, Artificial Sequence
  Description of Artificial Sequence: Synthetic oligonucleotide
gacccgcagggtgcactgagaaacatg

SEQ ID NO: 392744 - DNA, 27 bp, Artificial Sequence
  Description of Artificial Sequence: Synthetic oligonucleotide
acccgcagggtgcactgagaaacatgg

SEQ ID NO: 392745 - DNA, 26 bp, Artificial Sequence
  Description of Artificial Sequence: Synthetic oligonucleotide
cccgcagggtgcactgagaaacatgg

SEQ ID NO: 392746 - DNA, 27 bp, Artificial Sequence
  Description of Artificial Sequence: Synthetic oligonucleotide
ccgcagggtgcactgagaaacatggct

SEQ ID NO: 392747 - DNA, 27 bp, Artificial Sequence
  Description of Artificial Sequence: Synthetic oligonucleotide
cgcagggtgcactgagaaacatggctg

SEQ ID NO: 392748 - DNA, 28 bp, Artificial Sequence
  Description of Artificial Sequence: Synthetic oligonucleotide
gcagggtgcactgagaaacatggctgtg

SEQ ID NO: 392749 - DNA, 28 bp, Artificial Sequence
  Description of Artificial Sequence: Synthetic oligonucleotide
cagggtgcactgagaaacatggctgtgg

SEQ ID NO: 392750 - DNA, 28 bp, Artificial Sequence
  Description of Artificial Sequence: Synthetic oligonucleotide
agggtgcactgagaaacatggctgtggc

SEQ ID NO: 392751 - DNA, 27 bp, Artificial Sequence
  Description of Artificial Sequence: Synthetic oligonucleotide
gggtgcactgagaaacatggctgtggc

SEQ ID NO: 392752 - DNA, 31 bp, Artificial Sequence; identical to SEQ ID NO: 55268
  Description of Artificial Sequence: Synthetic oligonucleotide

SEQ ID NO: 392753 - DNA, 32 bp, Artificial Sequence; identical to SEQ ID NO: 55269
  Description of Artificial Sequence: Synthetic oligonucleotide

SEQ ID NO: 392754 - DNA, 34 bp, Artificial Sequence; identical to SEQ ID NO: 55270
  Description of Artificial Sequence: Synthetic oligonucleotide

SEQ ID NO: 392755 - DNA, 33 bp, Artificial Sequence; identical to SEQ ID NO: 55271
  Description of Artificial Sequence: Synthetic oligonucleotide

SEQ ID NO: 392756 - DNA, 35 bp, Artificial Sequence; identical to SEQ ID NO: 55272
  Description of Artificial Sequence: Synthetic oligonucleotide

SEQ ID NO: 392757 - DNA, 37 bp, Artificial Sequence; identical to SEQ ID NO: 55273
  Description of Artificial Sequence: Synthetic oligonucleotide

SEQ ID NO: 392758 - DNA, 36 bp, Artificial Sequence; identical to SEQ ID NO: 55274
  Description of Artificial Sequence: Synthetic oligonucleotide

SEQ ID NO: 392759 - DNA, 38 bp, Artificial Sequence; identical to SEQ ID NO: 55275
  Description of Artificial Sequence: Synthetic oligonucleotide

SEQ ID NO: 392760 - DNA, 37 bp, Artificial Sequence; identical to SEQ ID NO: 55276
  Description of Artificial Sequence: Synthetic oligonucleotide

SEQ ID NO: 392761 - DNA, 39 bp, Artificial Sequence; identical to SEQ ID NO: 55277
  Description of Artificial Sequence: Synthetic oligonucleotide

SEQ ID NO: 392762 - DNA, 38 bp, Artificial Sequence; identical to SEQ ID NO: 55278
  Description of Artificial Sequence: Synthetic oligonucleotide

SEQ ID NO: 392763 - DNA, 44 bp, Artificial Sequence; identical to SEQ ID NO: 55279
  Description of Artificial Sequence: Synthetic oligonucleotide

SEQ ID NO: 392764 - DNA, 43 bp, Artificial Sequence; identical to SEQ ID NO: 55280
  Description of Artificial Sequence: Synthetic oligonucleotide

SEQ ID NO: 392765 - DNA, 42 bp, Artificial Sequence; identical to SEQ ID NO: 55281
  Description of Artificial Sequence: Synthetic oligonucleotide

SEQ ID NO: 392766 - DNA, 41 bp, Artificial Sequence; identical to SEQ ID NO: 55282
  Description of Artificial Sequence: Synthetic oligonucleotide

SEQ ID NO: 392767 - DNA, 41 bp, Artificial Sequence; identical to SEQ ID NO: 55283
  Description of Artificial Sequence: Synthetic oligonucleotide

SEQ ID NO: 392768 - DNA, 40 bp, Artificial Sequence; identical to SEQ ID NO: 55284
  Description of Artificial Sequence: Synthetic oligonucleotide

SEQ ID NO: 392769 - DNA, 39 bp, Artificial Sequence; identical to SEQ ID NO: 55285
  Description of Artificial Sequence: Synthetic oligonucleotide

SEQ ID NO: 392770 - DNA, 39 bp, Artificial Sequence; identical to SEQ ID NO: 55286
  Description of Artificial Sequence: Synthetic oligonucleotide

SEQ ID NO: 392771 - DNA, 41 bp, Artificial Sequence; identical to SEQ ID NO: 55287
  Description of Artificial Sequence: Synthetic oligonucleotide

SEQ ID NO: 392772 - DNA, 43 bp, Artificial Sequence; identical to SEQ ID NO: 55288
  Description of Artificial Sequence: Synthetic oligonucleotide

SEQ ID NO: 392773 - DNA, 42 bp, Artificial Sequence; identical to SEQ ID NO: 55289
  Description of Artificial Sequence: Synthetic oligonucleotide

SEQ ID NO: 392774 - DNA, 43 bp, Artificial Sequence; identical to SEQ ID NO: 55290
  Description of Artificial Sequence: Synthetic oligonucleotide

SEQ ID NO: 392775 - DNA, 42 bp, Artificial Sequence; identical to SEQ ID NO: 55291
  Description of Artificial Sequence: Synthetic oligonucleotide

SEQ ID NO: 392776 - DNA, 44 bp, Artificial Sequence; identical to SEQ ID NO: 55292
  Description of Artificial Sequence: Synthetic oligonucleotide

SEQ ID NO: 392777 - DNA, 44 bp, Artificial Sequence; identical to SEQ ID NO: 55293
  Description of Artificial Sequence: Synthetic oligonucleotide

SEQ ID NO: 392778 - DNA, 44 bp, Artificial Sequence; identical to SEQ ID NO: 55294
  Description of Artificial Sequence: Synthetic oligonucleotide

SEQ ID NO: 392779 - DNA, 43 bp, Artificial Sequence; identical to SEQ ID NO: 55295
  Description of Artificial Sequence: Synthetic oligonucleotide

SEQ ID NO: 392780 - DNA, 42 bp, Artificial Sequence; identical to SEQ ID NO: 55296
  Description of Artificial Sequence: Synthetic oligonucleotide

SEQ ID NO: 392781 - DNA, 41 bp, Artificial Sequence; identical to SEQ ID NO: 55297
  Description of Artificial Sequence: Synthetic oligonucleotide

SEQ ID NO: 392782 - DNA, 40 bp, Artificial Sequence; identical to SEQ ID NO: 55298
  Description of Artificial Sequence: Synthetic oligonucleotide

SEQ ID NO: 392783 - DNA, 40 bp, Artificial Sequence; identical to SEQ ID NO: 55299
  Description of Artificial Sequence: Synthetic oligonucleotide

SEQ ID NO: 392784 - DNA, 39 bp, Artificial Sequence; identical to SEQ ID NO: 55300
  Description of Artificial Sequence: Synthetic oligonucleotide

SEQ ID NO: 392785 - DNA, 40 bp, Artificial Sequence; identical to SEQ ID NO: 55301
  Description of Artificial Sequence: Synthetic oligonucleotide

SEQ ID NO: 392786 - DNA, 39 bp, Artificial Sequence; identical to SEQ ID NO: 55302
  Description of Artificial Sequence: Synthetic oligonucleotide

SEQ ID NO: 392787 - DNA, 38 bp, Artificial Sequence; identical to SEQ ID NO: 55303
  Description of Artificial Sequence: Synthetic oligonucleotide

SEQ ID NO: 392788 - DNA, 38 bp, Artificial Sequence; identical to SEQ ID NO: 55304
  Description of Artificial Sequence: Synthetic oligonucleotide

SEQ ID NO: 392789 - DNA, 37 bp, Artificial Sequence; identical to SEQ ID NO: 55305
  Description of Artificial Sequence: Synthetic oligonucleotide

SEQ ID NO: 392790 - DNA, 36 bp, Artificial Sequence; identical to SEQ ID NO: 55306
  Description of Artificial Sequence: Synthetic oligonucleotide

SEQ ID NO: 392791 - DNA, 38 bp, Artificial Sequence; identical to SEQ ID NO: 55307
  Description of Artificial Sequence: Synthetic oligonucleotide

SEQ ID NO: 392792 - DNA, 37 bp, Artificial Sequence; identical to SEQ ID NO: 55308
  Description of Artificial Sequence: Synthetic oligonucleotide

SEQ ID NO: 392793 - DNA, 36 bp, Artificial Sequence; identical to SEQ ID NO: 55309
  Description of Artificial Sequence: Synthetic oligonucleotide

SEQ ID NO: 392794 - DNA, 36 bp, Artificial Sequence; identical to SEQ ID NO: 55310
  Description of Artificial Sequence: Synthetic oligonucleotide

SEQ ID NO: 392795 - DNA, 35 bp, Artificial Sequence; identical to SEQ ID NO: 55311
  Description of Artificial Sequence: Synthetic oligonucleotide

SEQ ID NO: 392796 - DNA, 34 bp, Artificial Sequence; identical to SEQ ID NO: 55312
  Description of Artificial Sequence: Synthetic oligonucleotide

SEQ ID NO: 392797 - DNA, 37 bp, Artificial Sequence; identical to SEQ ID NO: 55313
  Description of Artificial Sequence: Synthetic oligonucleotide

SEQ ID NO: 392798 - DNA, 36 bp, Artificial Sequence; identical to SEQ ID NO: 55314
  Description of Artificial Sequence: Synthetic oligonucleotide

SEQ ID NO: 392799 - DNA, 35 bp, Artificial Sequence; identical to SEQ ID NO: 55315
  Description of Artificial Sequence: Synthetic oligonucleotide

SEQ ID NO: 392800 - DNA, 36 bp, Artificial Sequence; identical to SEQ ID NO: 55316
  Description of Artificial Sequence: Synthetic oligonucleotide

SEQ ID NO: 392801 - DNA, 35 bp, Artificial Sequence; identical to SEQ ID NO: 55317
  Description of Artificial Sequence: Synthetic oligonucleotide

SEQ ID NO: 392802 - DNA, 34 bp, Artificial Sequence; identical to SEQ ID NO: 55318
  Description of Artificial Sequence: Synthetic oligonucleotide

SEQ ID NO: 392803 - DNA, 33 bp, Artificial Sequence; identical to SEQ ID NO: 55319
  Description of Artificial Sequence: Synthetic oligonucleotide

SEQ ID NO: 392804 - DNA, 32 bp, Artificial Sequence; identical to SEQ ID NO: 55320
  Description of Artificial Sequence: Synthetic oligonucleotide

SEQ ID NO: 392805 - DNA, 31 bp, Artificial Sequence; identical to SEQ ID NO: 55321
  Description of Artificial Sequence: Synthetic oligonucleotide

SEQ ID NO: 392806 - DNA, 30 bp, Artificial Sequence; identical to SEQ ID NO: 55322
  Description of Artificial Sequence: Synthetic oligonucleotide

SEQ ID NO: 392807 - DNA, 30 bp, Artificial Sequence; identical to SEQ ID NO: 55323
  Description of Artificial Sequence: Synthetic oligonucleotide

SEQ ID NO: 392808 - DNA, 32 bp, Artificial Sequence; identical to SEQ ID NO: 55324
  Description of Artificial Sequence: Synthetic oligonucleotide

SEQ ID NO: 392809 - DNA, 32 bp, Artificial Sequence; identical to SEQ ID NO: 55325
  Description of Artificial Sequence: Synthetic oligonucleotide

SEQ ID NO: 392810 - DNA, 31 bp, Artificial Sequence; identical to SEQ ID NO: 55326
  Description of Artificial Sequence: Synthetic oligonucleotide

SEQ ID NO: 392811 - DNA, 30 bp, Artificial Sequence; identical to SEQ ID NO: 55327
  Description of Artificial Sequence: Synthetic oligonucleotide

SEQ ID NO: 392812 - DNA, 31 bp, Artificial Sequence; identical to SEQ ID NO: 55328
  Description of Artificial Sequence: Synthetic oligonucleotide

SEQ ID NO: 392813 - DNA, 30 bp, Artificial Sequence; identical to SEQ ID NO: 55329
  Description of Artificial Sequence: Synthetic oligonucleotide

SEQ ID NO: 392814 - DNA, 29 bp, Artificial Sequence
  Description of Artificial Sequence: Synthetic oligonucleotide
ctctaccgctgctaccaatgaggttcctg

SEQ ID NO: 392815 - DNA, 30 bp, Artificial Sequence; identical to SEQ ID NO: 55331
  Description of Artificial Sequence: Synthetic oligonucleotide

SEQ ID NO: 392816 - DNA, 29 bp, Artificial Sequence
  Description of Artificial Sequence: Synthetic oligonucleotide
ctaccgctgctaccaatgaggttcctgag

SEQ ID NO: 392817 - DNA, 29 bp, Artificial Sequence
  Description of Artificial Sequence: Synthetic oligonucleotide
taccgctgctaccaatgaggttcctgagg

SEQ ID NO: 392818 - DNA, 28 bp, Artificial Sequence
  Description of Artificial Sequence: Synthetic oligonucleotide
accgctgctaccaatgaggttcctgagg

SEQ ID NO: 392819 - DNA, 27 bp, Artificial Sequence
  Description of Artificial Sequence: Synthetic oligonucleotide
ccgctgctaccaatgaggttcctgagg

SEQ ID NO: 392820 - DNA, 28 bp, Artificial Sequence
  Description of Artificial Sequence: Synthetic oligonucleotide
cgctgctaccaatgaggttcctgaggtc

SEQ ID NO: 392821 - DNA, 29 bp, Artificial Sequence
  Description of Artificial Sequence: Synthetic oligonucleotide
gctgctaccaatgaggttcctgaggtcac

SEQ ID NO: 392822 - DNA, 30 bp, Artificial Sequence; identical to SEQ ID NO: 55338
  Description of Artificial Sequence: Synthetic oligonucleotide

SEQ ID NO: 392823 - DNA, 31 bp, Artificial Sequence; identical to SEQ ID NO: 55339
  Description of Artificial Sequence: Synthetic oligonucleotide

SEQ ID NO: 392824 - DNA, 30 bp, Artificial Sequence; identical to SEQ ID NO: 55340
  Description of Artificial Sequence: Synthetic oligonucleotide

SEQ ID NO: 392825 - DNA, 34 bp, Artificial Sequence; identical to SEQ ID NO: 55341
  Description of Artificial Sequence: Synthetic oligonucleotide

SEQ ID NO: 392826 - DNA, 34 bp, Artificial Sequence; identical to SEQ ID NO: 55342
  Description of Artificial Sequence: Synthetic oligonucleotide

SEQ ID NO: 392827 - DNA, 33 bp, Artificial Sequence; identical to SEQ ID NO: 55343
  Description of Artificial Sequence: Synthetic oligonucleotide

SEQ ID NO: 392828 - DNA, 32 bp, Artificial Sequence; identical to SEQ ID NO: 55344
  Description of Artificial Sequence: Synthetic oligonucleotide

SEQ ID NO: 392829 - DNA, 34 bp, Artificial Sequence; identical to SEQ ID NO: 55345
  Description of Artificial Sequence: Synthetic oligonucleotide

SEQ ID NO: 392830 - DNA, 35 bp, Artificial Sequence; identical to SEQ ID NO: 55346
  Description of Artificial Sequence: Synthetic oligonucleotide

SEQ ID NO: 392831 - DNA, 34 bp, Artificial Sequence; identical to SEQ ID NO: 55347
  Description of Artificial Sequence: Synthetic oligonucleotide

SEQ ID NO: 392832 - DNA, 33 bp, Artificial Sequence; identical to SEQ ID NO: 55348
  Description of Artificial Sequence: Synthetic oligonucleotide

SEQ ID NO: 392833 - DNA, 32 bp, Artificial Sequence; identical to SEQ ID NO: 55349
  Description of Artificial Sequence: Synthetic oligonucleotide

SEQ ID NO: 392834 - DNA, 33 bp, Artificial Sequence; identical to SEQ ID NO: 55350
  Description of Artificial Sequence: Synthetic oligonucleotide

SEQ ID NO: 392835 - DNA, 32 bp, Artificial Sequence; identical to SEQ ID NO: 55351
  Description of Artificial Sequence: Synthetic oligonucleotide

SEQ ID NO: 392836 - DNA, 32 bp, Artificial Sequence; identical to SEQ ID NO: 55352
  Description of Artificial Sequence: Synthetic oligonucleotide

SEQ ID NO: 392837 - DNA, 32 bp, Artificial Sequence; identical to SEQ ID NO: 55353
  Description of Artificial Sequence: Synthetic oligonucleotide

SEQ ID NO: 392838 - DNA, 31 bp, Artificial Sequence; identical to SEQ ID NO: 55354
  Description of Artificial Sequence: Synthetic oligonucleotide

SEQ ID NO: 392839 - DNA, 30 bp, Artificial Sequence; identical to SEQ ID NO: 55355
  Description of Artificial Sequence: Synthetic oligonucleotide

SEQ ID NO: 392840 - DNA, 30 bp, Artificial Sequence; identical to SEQ ID NO: 55356
  Description of Artificial Sequence: Synthetic oligonucleotide

SEQ ID NO: 392841 - DNA, 31 bp, Artificial Sequence; identical to SEQ ID NO: 55357
  Description of Artificial Sequence: Synthetic oligonucleotide

SEQ ID NO: 392842 - DNA, 30 bp, Artificial Sequence; identical to SEQ ID NO: 55358
  Description of Artificial Sequence: Synthetic oligonucleotide

SEQ ID NO: 392843 - DNA, 31 bp, Artificial Sequence; identical to SEQ ID NO: 55359
  Description of Artificial Sequence: Synthetic oligonucleotide

SEQ ID NO: 392844 - DNA, 30 bp, Artificial Sequence; identical to SEQ ID NO: 55360
  Description of Artificial Sequence: Synthetic oligonucleotide

SEQ ID NO: 392845 - DNA, 31 bp, Artificial Sequence; identical to SEQ ID NO: 55361
  Description of Artificial Sequence: Synthetic oligonucleotide

SEQ ID NO: 392846 - DNA, 32 bp, Artificial Sequence; identical to SEQ ID NO: 55362
  Description of Artificial Sequence: Synthetic oligonucleotide

SEQ ID NO: 392847 - DNA, 31 bp, Artificial Sequence; identical to SEQ ID NO: 55363
  Description of Artificial Sequence: Synthetic oligonucleotide

SEQ ID NO: 392848 - DNA, 31 bp, Artificial Sequence; identical to SEQ ID NO: 55364
  Description of Artificial Sequence: Synthetic oligonucleotide

SEQ ID NO: 392849 - DNA, 30 bp, Artificial Sequence; identical to SEQ ID NO: 55365
  Description of Artificial Sequence: Synthetic oligonucleotide

SEQ ID NO: 392850 - DNA, 30 bp, Artificial Sequence; identical to SEQ ID NO: 55366
  Description of Artificial Sequence: Synthetic oligonucleotide

SEQ ID NO: 392851 - DNA, 29 bp, Artificial Sequence
  Description of Artificial Sequence: Synthetic oligonucleotide
gtgttttccaagtctcccgtgacactggg

SEQ ID NO: 392852 - DNA, 30 bp, Artificial Sequence; identical to SEQ ID NO: 55368
  Description of Artificial Sequence: Synthetic oligonucleotide

SEQ ID NO: 392853 - DNA, 29 bp, Artificial Sequence
  Description of Artificial Sequence: Synthetic oligonucleotide
gttttccaagtctcccgtgacactgggtc

SEQ ID NO: 392854 - DNA, 30 bp, Artificial Sequence; identical to SEQ ID NO: 55370
  Description of Artificial Sequence: Synthetic oligonucleotide

SEQ ID NO: 392855 - DNA, 29 bp, Artificial Sequence
  Description of Artificial Sequence: Synthetic oligonucleotide
tttccaagtctcccgtgacactgggtcag

SEQ ID NO: 392856 - DNA, 28 bp, Artificial Sequence
  Description of Artificial Sequence: Synthetic oligonucleotide
ttccaagtctcccgtgacactgggtcag

SEQ ID NO: 392857 - DNA, 27 bp, Artificial Sequence
  Description of Artificial Sequence: Synthetic oligonucleotide
tccaagtctcccgtgacactgggtcag

SEQ ID NO: 392858 - DNA, 26 bp, Artificial Sequence
  Description of Artificial Sequence: Synthetic oligonucleotide
ccaagtctcccgtgacactgggtcag

SEQ ID NO: 392859 - DNA, 26 bp, Artificial Sequence
  Description of Artificial Sequence: Synthetic oligonucleotide
caagtctcccgtgacactgggtcagc

SEQ ID NO: 392860 - DNA, 26 bp, Artificial Sequence
  Description of Artificial Sequence: Synthetic oligonucleotide
aagtctcccgtgacactgggtcagcc

SEQ ID NO: 392861 - DNA, 25 bp, Artificial Sequence
  Description of Artificial Sequence: Synthetic oligonucleotide
agtctcccgtgacactgggtcagcc

SEQ ID NO: 392862 - DNA, 24 bp, Artificial Sequence
  Description of Artificial Sequence: Synthetic oligonucleotide
gtctcccgtgacactgggtcagcc

SEQ ID NO: 392863 - DNA, 26 bp, Artificial Sequence
  Description of Artificial Sequence: Synthetic oligonucleotide
tctcccgtgacactgggtcagcccaa

SEQ ID NO: 392864 - DNA, 25 bp, Artificial Sequence
  Description of Artificial Sequence: Synthetic oligonucleotide
ctcccgtgacactgggtcagcccaa

SEQ ID NO: 392865 - DNA, 26 bp, Artificial Sequence
  Description of Artificial Sequence: Synthetic oligonucleotide
tcccgtgacactgggtcagcccaaca

SEQ ID NO: 392866 - DNA, 25 bp, Artificial Sequence
  Description of Artificial Sequence: Synthetic oligonucleotide
cccgtgacactgggtcagcccaaca

SEQ ID NO: 392867 - DNA, 25 bp, Artificial Sequence
  Description of Artificial Sequence: Synthetic oligonucleotide
ccgtgacactgggtcagcccaacac

SEQ ID NO: 392868 - DNA, 25 bp, Artificial Sequence
  Description of Artificial Sequence: Synthetic oligonucleotide
cgtgacactgggtcagcccaacacc

SEQ ID NO: 392869 - DNA, 26 bp, Artificial Sequence
  Description of Artificial Sequence: Synthetic oligonucleotide
gtgacactgggtcagcccaacaccct

SEQ ID NO: 392870 - DNA, 27 bp, Artificial Sequence
  Description of Artificial Sequence: Synthetic oligonucleotide
tgacactgggtcagcccaacaccctca

SEQ ID NO: 392871 - DNA, 27 bp, Artificial Sequence
  Description of Artificial Sequence: Synthetic oligonucleotide
gacactgggtcagcccaacaccctcat

SEQ ID NO: 392872 - DNA, 29 bp, Artificial Sequence
  Description of Artificial Sequence: Synthetic oligonucleotide
acactgggtcagcccaacaccctcatttg

SEQ ID NO: 392873 - DNA, 28 bp, Artificial Sequence
  Description of Artificial Sequence: Synthetic oligonucleotide
cactgggtcagcccaacaccctcatttg

SEQ ID NO: 392874 - DNA, 29 bp, Artificial Sequence
  Description of Artificial Sequence: Synthetic oligonucleotide
actgggtcagcccaacaccctcatttgtc

SEQ ID NO: 392875 - DNA, 28 bp, Artificial Sequence
  Description of Artificial Sequence: Synthetic oligonucleotide
ctgggtcagcccaacaccctcatttgtc

SEQ ID NO: 392876 - DNA, 30 bp, Artificial Sequence; identical to SEQ ID NO: 55392
  Description of Artificial Sequence: Synthetic oligonucleotide

SEQ ID NO: 392877 - DNA, 29 bp, Artificial Sequence
  Description of Artificial Sequence: Synthetic oligonucleotide
gggtcagcccaacaccctcatttgtcttg

SEQ ID NO: 392878 - DNA, 30 bp, Artificial Sequence; identical to SEQ ID NO: 55394
  Description of Artificial Sequence: Synthetic oligonucleotide

SEQ ID NO: 392879 - DNA, 30 bp, Artificial Sequence; identical to SEQ ID NO: 55395
  Description of Artificial Sequence: Synthetic oligonucleotide

SEQ ID NO: 392880 - DNA, 31 bp, Artificial Sequence; identical to SEQ ID NO: 55396
  Description of Artificial Sequence: Synthetic oligonucleotide

SEQ ID NO: 392881 - DNA, 30 bp, Artificial Sequence; identical to SEQ ID NO: 55397
  Description of Artificial Sequence: Synthetic oligonucleotide

SEQ ID NO: 392882 - DNA, 32 bp, Artificial Sequence; identical to SEQ ID NO: 55398
  Description of Artificial Sequence: Synthetic oligonucleotide

SEQ ID NO: 392883 - DNA, 31 bp, Artificial Sequence; identical to SEQ ID NO: 55399
  Description of Artificial Sequence: Synthetic oligonucleotide

SEQ ID NO: 392884 - DNA, 33 bp, Artificial Sequence; identical to SEQ ID NO: 55400
  Description of Artificial Sequence: Synthetic oligonucleotide

SEQ ID NO: 392885 - DNA, 36 bp, Artificial Sequence; identical to SEQ ID NO: 55401
  Description of Artificial Sequence: Synthetic oligonucleotide

SEQ ID NO: 392886 - DNA, 36 bp, Artificial Sequence; identical to SEQ ID NO: 55402
  Description of Artificial Sequence: Synthetic oligonucleotide

SEQ ID NO: 392887 - DNA, 37 bp, Artificial Sequence; identical to SEQ ID NO: 55403
  Description of Artificial Sequence: Synthetic oligonucleotide

SEQ ID NO: 392888 - DNA, 36 bp, Artificial Sequence; identical to SEQ ID NO: 55404
  Description of Artificial Sequence: Synthetic oligonucleotide

SEQ ID NO: 392889 - DNA, 35 bp, Artificial Sequence; identical to SEQ ID NO: 55405
  Description of Artificial Sequence: Synthetic oligonucleotide

SEQ ID NO: 392890 - DNA, 35 bp, Artificial Sequence; identical to SEQ ID NO: 55406
  Description of Artificial Sequence: Synthetic oligonucleotide

SEQ ID NO: 392891 - DNA, 34 bp, Artificial Sequence; identical to SEQ ID NO: 55407
  Description of Artificial Sequence: Synthetic oligonucleotide

SEQ ID NO: 392892 - DNA, 35 bp, Artificial Sequence; identical to SEQ ID NO: 55408
  Description of Artificial Sequence: Synthetic oligonucleotide

SEQ ID NO: 392893 - DNA, 36 bp, Artificial Sequence; identical to SEQ ID NO: 55409
  Description of Artificial Sequence: Synthetic oligonucleotide

SEQ ID NO: 392894 - DNA, 36 bp, Artificial Sequence; identical to SEQ ID NO: 55410
  Description of Artificial Sequence: Synthetic oligonucleotide

SEQ ID NO: 392895 - DNA, 35 bp, Artificial Sequence; identical to SEQ ID NO: 55411
  Description of Artificial Sequence: Synthetic oligonucleotide

SEQ ID NO: 392896 - DNA, 36 bp, Artificial Sequence; identical to SEQ ID NO: 55412
  Description of Artificial Sequence: Synthetic oligonucleotide

SEQ ID NO: 392897 - DNA, 35 bp, Artificial Sequence; identical to SEQ ID NO: 55413
  Description of Artificial Sequence: Synthetic oligonucleotide

SEQ ID NO: 392898 - DNA, 34 bp, Artificial Sequence; identical to SEQ ID NO: 55414
  Description of Artificial Sequence: Synthetic oligonucleotide

SEQ ID NO: 392899 - DNA, 33 bp, Artificial Sequence; identical to SEQ ID NO: 55415
  Description of Artificial Sequence: Synthetic oligonucleotide

SEQ ID NO: 392900 - DNA, 32 bp, Artificial Sequence; identical to SEQ ID NO: 55416
  Description of Artificial Sequence: Synthetic oligonucleotide

SEQ ID NO: 392901 - DNA, 34 bp, Artificial Sequence; identical to SEQ ID NO: 55417
  Description of Artificial Sequence: Synthetic oligonucleotide

SEQ ID NO: 392902 - DNA, 33 bp, Artificial Sequence; identical to SEQ ID NO: 55418
  Description of Artificial Sequence: Synthetic oligonucleotide

SEQ ID NO: 392903 - DNA, 35 bp, Artificial Sequence; identical to SEQ ID NO: 55419
  Description of Artificial Sequence: Synthetic oligonucleotide

SEQ ID NO: 392904 - DNA, 34 bp, Artificial Sequence; identical to SEQ ID NO: 55420
  Description of Artificial Sequence: Synthetic oligonucleotide

SEQ ID NO: 392905 - DNA, 33 bp, Artificial Sequence; identical to SEQ ID NO: 55421
  Description of Artificial Sequence: Synthetic oligonucleotide

SEQ ID NO: 392906 - DNA, 34 bp, Artificial Sequence; identical to SEQ ID NO: 55422
  Description of Artificial Sequence: Synthetic oligonucleotide

SEQ ID NO: 392907 - DNA, 33 bp, Artificial Sequence; identical to SEQ ID NO: 55423
  Description of Artificial Sequence: Synthetic oligonucleotide

SEQ ID NO: 392908 - DNA, 35 bp, Artificial Sequence; identical to SEQ ID NO: 55424
  Description of Artificial Sequence: Synthetic oligonucleotide

SEQ ID NO: 392909 - DNA, 35 bp, Artificial Sequence; identical to SEQ ID NO: 55425
  Description of Artificial Sequence: Synthetic oligonucleotide

SEQ ID NO: 392910 - DNA, 34 bp, Artificial Sequence; identical to SEQ ID NO: 55426
  Description of Artificial Sequence: Synthetic oligonucleotide

SEQ ID NO: 392911 - DNA, 34 bp, Artificial Sequence; identical to SEQ ID NO: 55427
  Description of Artificial Sequence: Synthetic oligonucleotide

SEQ ID NO: 392912 - DNA, 33 bp, Artificial Sequence; identical to SEQ ID NO: 55428
  Description of Artificial Sequence: Synthetic oligonucleotide

SEQ ID NO: 392913 - DNA, 32 bp, Artificial Sequence; identical to SEQ ID NO: 55429
  Description of Artificial Sequence: Synthetic oligonucleotide

SEQ ID NO: 392914 - DNA, 33 bp, Artificial Sequence; identical to SEQ ID NO: 55430
  Description of Artificial Sequence: Synthetic oligonucleotide

SEQ ID NO: 392915 - DNA, 32 bp, Artificial Sequence; identical to SEQ ID NO: 55431
  Description of Artificial Sequence: Synthetic oligonucleotide

SEQ ID NO: 392916 - DNA, 31 bp, Artificial Sequence; identical to SEQ ID NO: 55432
  Description of Artificial Sequence: Synthetic oligonucleotide

SEQ ID NO: 392917 - DNA, 32 bp, Artificial Sequence; identical to SEQ ID NO: 55433
  Description of Artificial Sequence: Synthetic oligonucleotide

SEQ ID NO: 392918 - DNA, 31 bp, Artificial Sequence; identical to SEQ ID NO: 55434
  Description of Artificial Sequence: Synthetic oligonucleotide

SEQ ID NO: 392919 - DNA, 30 bp, Artificial Sequence; identical to SEQ ID NO: 55435
  Description of Artificial Sequence: Synthetic oligonucleotide

SEQ ID NO: 392920 - DNA, 29 bp, Artificial Sequence
  Description of Artificial Sequence: Synthetic oligonucleotide
cctcctgtggtcaacatcacatggctgag

SEQ ID NO: 392921 - DNA, 29 bp, Artificial Sequence
  Description of Artificial Sequence: Synthetic oligonucleotide
ctcctgtggtcaacatcacatggctgagc

SEQ ID NO: 392922 - DNA, 32 bp, Artificial Sequence; identical to SEQ ID NO: 55438
  Description of Artificial Sequence: Synthetic oligonucleotide

SEQ ID NO: 392923 - DNA, 31 bp, Artificial Sequence; identical to SEQ ID NO: 55439
  Description of Artificial Sequence: Synthetic oligonucleotide

SEQ ID NO: 392924 - DNA, 31 bp, Artificial Sequence; identical to SEQ ID NO: 55440
  Description of Artificial Sequence: Synthetic oligonucleotide

SEQ ID NO: 392925 - DNA, 31 bp, Artificial Sequence; identical to SEQ ID NO: 55441
  Description of Artificial Sequence: Synthetic oligonucleotide

SEQ ID NO: 392926 - DNA, 30 bp, Artificial Sequence; identical to SEQ ID NO: 55442
  Description of Artificial Sequence: Synthetic oligonucleotide

SEQ ID NO: 392927 - DNA, 30 bp, Artificial Sequence; identical to SEQ ID NO: 55443
  Description of Artificial Sequence: Synthetic oligonucleotide

SEQ ID NO: 392928 - DNA, 29 bp, Artificial Sequence
  Description of Artificial Sequence: Synthetic oligonucleotide
ggtcaacatcacatggctgagcaatgggc

SEQ ID NO: 392929 - DNA, 30 bp, Artificial Sequence; identical to SEQ ID NO: 55445
  Description of Artificial Sequence: Synthetic oligonucleotide

SEQ ID NO: 392930 - DNA, 31 bp, Artificial Sequence; identical to SEQ ID NO: 55446
  Description of Artificial Sequence: Synthetic oligonucleotide

SEQ ID NO: 392931 - DNA, 30 bp, Artificial Sequence; identical to SEQ ID NO: 55447
  Description of Artificial Sequence: Synthetic oligonucleotide

SEQ ID NO: 392932 - DNA, 31 bp, Artificial Sequence; identical to SEQ ID NO: 55448
  Description of Artificial Sequence: Synthetic oligonucleotide

SEQ ID NO: 392933 - DNA, 30 bp, Artificial Sequence; identical to SEQ ID NO: 55449
  Description of Artificial Sequence: Synthetic oligonucleotide

SEQ ID NO: 392934 - DNA, 29 bp, Artificial Sequence
  Description of Artificial Sequence: Synthetic oligonucleotide
catcacatggctgagcaatgggcagtcag

SEQ ID NO: 392935 - DNA, 30 bp, Artificial Sequence; identical to SEQ ID NO: 55451
  Description of Artificial Sequence: Synthetic oligonucleotide

SEQ ID NO: 392936 - DNA, 29 bp, Artificial Sequence
  Description of Artificial Sequence: Synthetic oligonucleotide
tcacatggctgagcaatgggcagtcagtc

SEQ ID NO: 392937 - DNA, 28 bp, Artificial Sequence
  Description of Artificial Sequence: Synthetic oligonucleotide
cacatggctgagcaatgggcagtcagtc

SEQ ID NO: 392938 - DNA, 29 bp, Artificial Sequence
  Description of Artificial Sequence: Synthetic oligonucleotide
acatggctgagcaatgggcagtcagtcac

SEQ ID NO: 392939 - DNA, 28 bp, Artificial Sequence
  Description of Artificial Sequence: Synthetic oligonucleotide
catggctgagcaatgggcagtcagtcac

SEQ ID NO: 392940 - DNA, 29 bp, Artificial Sequence
  Description of Artificial Sequence: Synthetic oligonucleotide
atggctgagcaatgggcagtcagtcacag

SEQ ID NO: 392941 - DNA, 28 bp, Artificial Sequence
  Description of Artificial Sequence: Synthetic oligonucleotide
tggctgagcaatgggcagtcagtcacag

SEQ ID NO: 392942 - DNA, 27 bp, Artificial Sequence
  Description of Artificial Sequence: Synthetic oligonucleotide
ggctgagcaatgggcagtcagtcacag

SEQ ID NO: 392943 - DNA, 29 bp, Artificial Sequence
  Description of Artificial Sequence: Synthetic oligonucleotide
gctgagcaatgggcagtcagtcacagaag

SEQ ID NO: 392944 - DNA, 29 bp, Artificial Sequence
  Description of Artificial Sequence: Synthetic oligonucleotide
ctgagcaatgggcagtcagtcacagaagg

SEQ ID NO: 392945 - DNA, 30 bp, Artificial Sequence; identical to SEQ ID NO: 55461
  Description of Artificial Sequence: Synthetic oligonucleotide

SEQ ID NO: 392946 - DNA, 29 bp, Artificial Sequence
  Description of Artificial Sequence: Synthetic oligonucleotide
gagcaatgggcagtcagtcacagaaggtg

SEQ ID NO: 392947 - DNA, 32 bp, Artificial Sequence; identical to SEQ ID NO: 55463
  Description of Artificial Sequence: Synthetic oligonucleotide

SEQ ID NO: 392948 - DNA, 31 bp, Artificial Sequence; identical to SEQ ID NO: 55464
  Description of Artificial Sequence: Synthetic oligonucleotide

SEQ ID NO: 392949 - DNA, 32 bp, Artificial Sequence; identical to SEQ ID NO: 55465
  Description of Artificial Sequence: Synthetic oligonucleotide

SEQ ID NO: 392950 - DNA, 33 bp, Artificial Sequence; identical to SEQ ID NO: 55466
  Description of Artificial Sequence: Synthetic oligonucleotide

SEQ ID NO: 392951 - DNA, 32 bp, Artificial Sequence; identical to SEQ ID NO: 55467
  Description of Artificial Sequence: Synthetic oligonucleotide

SEQ ID NO: 392952 - DNA, 31 bp, Artificial Sequence; identical to SEQ ID NO: 55468
  Description of Artificial Sequence: Synthetic oligonucleotide

SEQ ID NO: 392953 - DNA, 30 bp, Artificial Sequence; identical to SEQ ID NO: 55469
  Description of Artificial Sequence: Synthetic oligonucleotide

SEQ ID NO: 392954 - DNA, 31 bp, Artificial Sequence; identical to SEQ ID NO: 55470
  Description of Artificial Sequence: Synthetic oligonucleotide

SEQ ID NO: 392955 - DNA, 31 bp, Artificial Sequence; identical to SEQ ID NO: 55471
  Description of Artificial Sequence: Synthetic oligonucleotide

SEQ ID NO: 392956 - DNA, 32 bp, Artificial Sequence; identical to SEQ ID NO: 55472
  Description of Artificial Sequence: Synthetic oligonucleotide

SEQ ID NO: 392957 - DNA, 32 bp, Artificial Sequence; identical to SEQ ID NO: 55473
  Description of Artificial Sequence: Synthetic oligonucleotide

SEQ ID NO: 392958 - DNA, 31 bp, Artificial Sequence; identical to SEQ ID NO: 55474
  Description of Artificial Sequence: Synthetic oligonucleotide

SEQ ID NO: 392959 - DNA, 33 bp, Artificial Sequence; identical to SEQ ID NO: 55475
  Description of Artificial Sequence: Synthetic oligonucleotide

SEQ ID NO: 392960 - DNA, 32 bp, Artificial Sequence; identical to SEQ ID NO: 55476
  Description of Artificial Sequence: Synthetic oligonucleotide

SEQ ID NO: 392961 - DNA, 32 bp, Artificial Sequence; identical to SEQ ID NO: 55477
  Description of Artificial Sequence: Synthetic oligonucleotide

SEQ ID NO: 392962 - DNA, 31 bp, Artificial Sequence; identical to SEQ ID NO: 55478
  Description of Artificial Sequence: Synthetic oligonucleotide

SEQ ID NO: 392963 - DNA, 32 bp, Artificial Sequence; identical to SEQ ID NO: 55479
  Description of Artificial Sequence: Synthetic oligonucleotide

SEQ ID NO: 392964 - DNA, 31 bp, Artificial Sequence; identical to SEQ ID NO: 55480
  Description of Artificial Sequence: Synthetic oligonucleotide

SEQ ID NO: 392965 - DNA, 32 bp, Artificial Sequence; identical to SEQ ID NO: 55481
  Description of Artificial Sequence: Synthetic oligonucleotide

SEQ ID NO: 392966 - DNA, 31 bp, Artificial Sequence; identical to SEQ ID NO: 55482
  Description of Artificial Sequence: Synthetic oligonucleotide

SEQ ID NO: 392967 - DNA, 31 bp, Artificial Sequence; identical to SEQ ID NO: 55483
  Description of Artificial Sequence: Synthetic oligonucleotide

SEQ ID NO: 392968 - DNA, 30 bp, Artificial Sequence; identical to SEQ ID NO: 55484
  Description of Artificial Sequence: Synthetic oligonucleotide

SEQ ID NO: 392969 - DNA, 32 bp, Artificial Sequence; identical to SEQ ID NO: 55485
  Description of Artificial Sequence: Synthetic oligonucleotide

SEQ ID NO: 392970 - DNA, 31 bp, Artificial Sequence; identical to SEQ ID NO: 55486
  Description of Artificial Sequence: Synthetic oligonucleotide

SEQ ID NO: 392971 - DNA, 30 bp, Artificial Sequence; identical to SEQ ID NO: 55487
  Description of Artificial Sequence: Synthetic oligonucleotide

SEQ ID NO: 392972 - DNA, 31 bp, Artificial Sequence; identical to SEQ ID NO: 55488
  Description of Artificial Sequence: Synthetic oligonucleotide

SEQ ID NO: 392973 - DNA, 32 bp, Artificial Sequence; identical to SEQ ID NO: 55489
  Description of Artificial Sequence: Synthetic oligonucleotide

SEQ ID NO: 392974 - DNA, 31 bp, Artificial Sequence; identical to SEQ ID NO: 55490
  Description of Artificial Sequence: Synthetic oligonucleotide

SEQ ID NO: 392975 - DNA, 33 bp, Artificial Sequence; identical to SEQ ID NO: 55491
  Description of Artificial Sequence: Synthetic oligonucleotide

SEQ ID NO: 392976 - DNA, 32 bp, Artificial Sequence; identical to SEQ ID NO: 55492
  Description of Artificial Sequence: Synthetic oligonucleotide

SEQ ID NO: 392977 - DNA, 31 bp, Artificial Sequence; identical to SEQ ID NO: 55493
  Description of Artificial Sequence: Synthetic oligonucleotide

SEQ ID NO: 392978 - DNA, 30 bp, Artificial Sequence; identical to SEQ ID NO: 55494
  Description of Artificial Sequence: Synthetic oligonucleotide

SEQ ID NO: 392979 - DNA, 33 bp, Artificial Sequence; identical to SEQ ID NO: 55495
  Description of Artificial Sequence: Synthetic oligonucleotide

SEQ ID NO: 392980 - DNA, 32 bp, Artificial Sequence; identical to SEQ ID NO: 55496
  Description of Artificial Sequence: Synthetic oligonucleotide

SEQ ID NO: 392981 - DNA, 32 bp, Artificial Sequence; identical to SEQ ID NO: 55497
  Description of Artificial Sequence: Synthetic oligonucleotide

SEQ ID NO: 392982 - DNA, 31 bp, Artificial Sequence; identical to SEQ ID NO: 55498
  Description of Artificial Sequence: Synthetic oligonucleotide

SEQ ID NO: 392983 - DNA, 33 bp, Artificial Sequence; identical to SEQ ID NO: 55499
  Description of Artificial Sequence: Synthetic oligonucleotide

SEQ ID NO: 392984 - DNA, 32 bp, Artificial Sequence; identical to SEQ ID NO: 55500
  Description of Artificial Sequence: Synthetic oligonucleotide

SEQ ID NO: 392985 - DNA, 34 bp, Artificial Sequence; identical to SEQ ID NO: 55501
  Description of Artificial Sequence: Synthetic oligonucleotide

SEQ ID NO: 392986 - DNA, 36 bp, Artificial Sequence; identical to SEQ ID NO: 55502
  Description of Artificial Sequence: Synthetic oligonucleotide

SEQ ID NO: 392987 - DNA, 35 bp, Artificial Sequence; identical to SEQ ID NO: 55503
  Description of Artificial Sequence: Synthetic oligonucleotide

SEQ ID NO: 392988 - DNA, 37 bp, Artificial Sequence; identical to SEQ ID NO: 55504
  Description of Artificial Sequence: Synthetic oligonucleotide

SEQ ID NO: 392989 - DNA, 38 bp, Artificial Sequence; identical to SEQ ID NO: 55505
  Description of Artificial Sequence: Synthetic oligonucleotide

SEQ ID NO: 392990 - DNA, 37 bp, Artificial Sequence; identical to SEQ ID NO: 55506
  Description of Artificial Sequence: Synthetic oligonucleotide

SEQ ID NO: 392991 - DNA, 36 bp, Artificial Sequence; identical to SEQ ID NO: 55507
  Description of Artificial Sequence: Synthetic oligonucleotide

SEQ ID NO: 392992 - DNA, 39 bp, Artificial Sequence; identical to SEQ ID NO: 55508
  Description of Artificial Sequence: Synthetic oligonucleotide

SEQ ID NO: 392993 - DNA, 39 bp, Artificial Sequence; identical to SEQ ID NO: 55509
  Description of Artificial Sequence: Synthetic oligonucleotide

SEQ ID NO: 392994 - DNA, 38 bp, Artificial Sequence; identical to SEQ ID NO: 55510
  Description of Artificial Sequence: Synthetic oligonucleotide

SEQ ID NO: 392995 - DNA, 39 bp, Artificial Sequence; identical to SEQ ID NO: 55511
  Description of Artificial Sequence: Synthetic oligonucleotide

SEQ ID NO: 392996 - DNA, 38 bp, Artificial Sequence; identical to SEQ ID NO: 55512
  Description of Artificial Sequence: Synthetic oligonucleotide

SEQ ID NO: 392997 - DNA, 39 bp, Artificial Sequence; identical to SEQ ID NO: 55513
  Description of Artificial Sequence: Synthetic oligonucleotide

SEQ ID NO: 392998 - DNA, 39 bp, Artificial Sequence; identical to SEQ ID NO: 55514
  Description of Artificial Sequence: Synthetic oligonucleotide

SEQ ID NO: 392999 - DNA, 38 bp, Artificial Sequence; identical to SEQ ID NO: 55515
  Description of Artificial Sequence: Synthetic oligonucleotide

SEQ ID NO: 393000 - DNA, 37 bp, Artificial Sequence; identical to SEQ ID NO: 55516
  Description of Artificial Sequence: Synthetic oligonucleotide

SEQ ID NO: 393001 - DNA, 39 bp, Artificial Sequence; identical to SEQ ID NO: 55517
  Description of Artificial Sequence: Synthetic oligonucleotide

SEQ ID NO: 393002 - DNA, 38 bp, Artificial Sequence; identical to SEQ ID NO: 55518
  Description of Artificial Sequence: Synthetic oligonucleotide

SEQ ID NO: 393003 - DNA, 38 bp, Artificial Sequence; identical to SEQ ID NO: 55519
  Description of Artificial Sequence: Synthetic oligonucleotide

SEQ ID NO: 393004 - DNA, 37 bp, Artificial Sequence; identical to SEQ ID NO: 55520
  Description of Artificial Sequence: Synthetic oligonucleotide

SEQ ID NO: 393005 - DNA, 38 bp, Artificial Sequence; identical to SEQ ID NO: 55521
  Description of Artificial Sequence: Synthetic oligonucleotide

SEQ ID NO: 393006 - DNA, 37 bp, Artificial Sequence; identical to SEQ ID NO: 55522
  Description of Artificial Sequence: Synthetic oligonucleotide

SEQ ID NO: 393007 - DNA, 36 bp, Artificial Sequence; identical to SEQ ID NO: 55523
  Description of Artificial Sequence: Synthetic oligonucleotide

SEQ ID NO: 393008 - DNA, 36 bp, Artificial Sequence; identical to SEQ ID NO: 55524
  Description of Artificial Sequence: Synthetic oligonucleotide

SEQ ID NO: 393009 - DNA, 35 bp, Artificial Sequence; identical to SEQ ID NO: 55525
  Description of Artificial Sequence: Synthetic oligonucleotide

SEQ ID NO: 393010 - DNA, 34 bp, Artificial Sequence; identical to SEQ ID NO: 55526
  Description of Artificial Sequence: Synthetic oligonucleotide

SEQ ID NO: 393011 - DNA, 33 bp, Artificial Sequence; identical to SEQ ID NO: 55527
  Description of Artificial Sequence: Synthetic oligonucleotide

SEQ ID NO: 393012 - DNA, 33 bp, Artificial Sequence; identical to SEQ ID NO: 55528
  Description of Artificial Sequence: Synthetic oligonucleotide

SEQ ID NO: 393013 - DNA, 35 bp, Artificial Sequence; identical to SEQ ID NO: 55529
  Description of Artificial Sequence: Synthetic oligonucleotide

SEQ ID NO: 393014 - DNA, 34 bp, Artificial Sequence; identical to SEQ ID NO: 55530
  Description of Artificial Sequence: Synthetic oligonucleotide

SEQ ID NO: 393015 - DNA, 33 bp, Artificial Sequence; identical to SEQ ID NO: 55531
  Description of Artificial Sequence: Synthetic oligonucleotide

SEQ ID NO: 393016 - DNA, 34 bp, Artificial Sequence; identical to SEQ ID NO: 55532
  Description of Artificial Sequence: Synthetic oligonucleotide

SEQ ID NO: 393017 - DNA, 33 bp, Artificial Sequence; identical to SEQ ID NO: 55533
  Description of Artificial Sequence: Synthetic oligonucleotide

SEQ ID NO: 393018 - DNA, 32 bp, Artificial Sequence; identical to SEQ ID NO: 55534
  Description of Artificial Sequence: Synthetic oligonucleotide

SEQ ID NO: 393019 - DNA, 32 bp, Artificial Sequence; identical to SEQ ID NO: 55535
  Description of Artificial Sequence: Synthetic oligonucleotide

SEQ ID NO: 393020 - DNA, 31 bp, Artificial Sequence; identical to SEQ ID NO: 55536
  Description of Artificial Sequence: Synthetic oligonucleotide

SEQ ID NO: 393021 - DNA, 30 bp, Artificial Sequence; identical to SEQ ID NO: 55537
  Description of Artificial Sequence: Synthetic oligonucleotide

SEQ ID NO: 393022 - DNA, 31 bp, Artificial Sequence; identical to SEQ ID NO: 55538
  Description of Artificial Sequence: Synthetic oligonucleotide

SEQ ID NO: 393023 - DNA, 30 bp, Artificial Sequence; identical to SEQ ID NO: 55539
  Description of Artificial Sequence: Synthetic oligonucleotide

SEQ ID NO: 393024 - DNA, 29 bp, Artificial Sequence
  Description of Artificial Sequence: Synthetic oligonucleotide
cagttacctcaccttcctcccttctgctg

SEQ ID NO: 393025 - DNA, 31 bp, Artificial Sequence; identical to SEQ ID NO: 55541
  Description of Artificial Sequence: Synthetic oligonucleotide

SEQ ID NO: 393026 - DNA, 30 bp, Artificial Sequence; identical to SEQ ID NO: 55542
  Description of Artificial Sequence: Synthetic oligonucleotide

SEQ ID NO: 393027 - DNA, 31 bp, Artificial Sequence; identical to SEQ ID NO: 55543
  Description of Artificial Sequence: Synthetic oligonucleotide

SEQ ID NO: 393028 - DNA, 30 bp, Artificial Sequence; identical to SEQ ID NO: 55544
  Description of Artificial Sequence: Synthetic oligonucleotide

SEQ ID NO: 393029 - DNA, 29 bp, Artificial Sequence
  Description of Artificial Sequence: Synthetic oligonucleotide
acctcaccttcctcccttctgctgatgag

SEQ ID NO: 393030 - DNA, 28 bp, Artificial Sequence
  Description of Artificial Sequence: Synthetic oligonucleotide
cctcaccttcctcccttctgctgatgag

SEQ ID NO: 393031 - DNA, 34 bp, Artificial Sequence; identical to SEQ ID NO: 55547
  Description of Artificial Sequence: Synthetic oligonucleotide

SEQ ID NO: 393032 - DNA, 35 bp, Artificial Sequence; identical to SEQ ID NO: 55548
  Description of Artificial Sequence: Synthetic oligonucleotide

SEQ ID NO: 393033 - DNA, 34 bp, Artificial Sequence; identical to SEQ ID NO: 55549
  Description of Artificial Sequence: Synthetic oligonucleotide

SEQ ID NO: 393034 - DNA, 35 bp, Artificial Sequence; identical to SEQ ID NO: 55550
  Description of Artificial Sequence: Synthetic oligonucleotide

SEQ ID NO: 393035 - DNA, 34 bp, Artificial Sequence; identical to SEQ ID NO: 55551
  Description of Artificial Sequence: Synthetic oligonucleotide

SEQ ID NO: 393036 - DNA, 34 bp, Artificial Sequence; identical to SEQ ID NO: 55552
  Description of Artificial Sequence: Synthetic oligonucleotide

SEQ ID NO: 393037 - DNA, 36 bp, Artificial Sequence; identical to SEQ ID NO: 55553
  Description of Artificial Sequence: Synthetic oligonucleotide

SEQ ID NO: 393038 - DNA, 35 bp, Artificial Sequence; identical to SEQ ID NO: 55554
  Description of Artificial Sequence: Synthetic oligonucleotide

SEQ ID NO: 393039 - DNA, 34 bp, Artificial Sequence; identical to SEQ ID NO: 55555
  Description of Artificial Sequence: Synthetic oligonucleotide

SEQ ID NO: 393040 - DNA, 34 bp, Artificial Sequence; identical to SEQ ID NO: 55556
  Description of Artificial Sequence: Synthetic oligonucleotide

SEQ ID NO: 393041 - DNA, 35 bp, Artificial Sequence; identical to SEQ ID NO: 55557
  Description of Artificial Sequence: Synthetic oligonucleotide

SEQ ID NO: 393042 - DNA, 34 bp, Artificial Sequence; identical to SEQ ID NO: 55558
  Description of Artificial Sequence: Synthetic oligonucleotide

SEQ ID NO: 393043 - DNA, 34 bp, Artificial Sequence; identical to SEQ ID NO: 55559
  Description of Artificial Sequence: Synthetic oligonucleotide

SEQ ID NO: 393044 - DNA, 35 bp, Artificial Sequence; identical to SEQ ID NO: 55560
  Description of Artificial Sequence: Synthetic oligonucleotide

SEQ ID NO: 393045 - DNA, 35 bp, Artificial Sequence; identical to SEQ ID NO: 55561
  Description of Artificial Sequence: Synthetic oligonucleotide

SEQ ID NO: 393046 - DNA, 34 bp, Artificial Sequence; identical to SEQ ID NO: 55562
  Description of Artificial Sequence: Synthetic oligonucleotide

SEQ ID NO: 393047 - DNA, 33 bp, Artificial Sequence; identical to SEQ ID NO: 55563
  Description of Artificial Sequence: Synthetic oligonucleotide

SEQ ID NO: 393048 - DNA, 34 bp, Artificial Sequence; identical to SEQ ID NO: 55564
  Description of Artificial Sequence: Synthetic oligonucleotide

SEQ ID NO: 393049 - DNA, 33 bp, Artificial Sequence; identical to SEQ ID NO: 55565
  Description of Artificial Sequence: Synthetic oligonucleotide

SEQ ID NO: 393050 - DNA, 34 bp, Artificial Sequence; identical to SEQ ID NO: 55566
  Description of Artificial Sequence: Synthetic oligonucleotide

SEQ ID NO: 393051 - DNA, 34 bp, Artificial Sequence; identical to SEQ ID NO: 55567
  Description of Artificial Sequence: Synthetic oligonucleotide

SEQ ID NO: 393052 - DNA, 33 bp, Artificial Sequence; identical to SEQ ID NO: 55568
  Description of Artificial Sequence: Synthetic oligonucleotide

SEQ ID NO: 393053 - DNA, 33 bp, Artificial Sequence; identical to SEQ ID NO: 55569
  Description of Artificial Sequence: Synthetic oligonucleotide

SEQ ID NO: 393054 - DNA, 32 bp, Artificial Sequence; identical to SEQ ID NO: 55570
  Description of Artificial Sequence: Synthetic oligonucleotide

SEQ ID NO: 393055 - DNA, 31 bp, Artificial Sequence; identical to SEQ ID NO: 55571
  Description of Artificial Sequence: Synthetic oligonucleotide

SEQ ID NO: 393056 - DNA, 31 bp, Artificial Sequence; identical to SEQ ID NO: 55572
  Description of Artificial Sequence: Synthetic oligonucleotide

SEQ ID NO: 393057 - DNA, 30 bp, Artificial Sequence; identical to SEQ ID NO: 55573
  Description of Artificial Sequence: Synthetic oligonucleotide

SEQ ID NO: 393058 - DNA, 30 bp, Artificial Sequence; identical to SEQ ID NO: 55574
  Description of Artificial Sequence: Synthetic oligonucleotide

SEQ ID NO: 393059 - DNA, 29 bp, Artificial Sequence
  Description of Artificial Sequence: Synthetic oligonucleotide
tttatgactgcaaggtggagcactggggc

SEQ ID NO: 393060 - DNA, 28 bp, Artificial Sequence
  Description of Artificial Sequence: Synthetic oligonucleotide
ttatgactgcaaggtggagcactggggc

SEQ ID NO: 393061 - DNA, 27 bp, Artificial Sequence
  Description of Artificial Sequence: Synthetic oligonucleotide
tatgactgcaaggtggagcactggggc

SEQ ID NO: 393062 - DNA, 26 bp, Artificial Sequence
  Description of Artificial Sequence: Synthetic oligonucleotide
atgactgcaaggtggagcactggggc

SEQ ID NO: 393063 - DNA, 25 bp, Artificial Sequence
  Description of Artificial Sequence: Synthetic oligonucleotide
tgactgcaaggtggagcactggggc

SEQ ID NO: 393064 - DNA, 24 bp, Artificial Sequence
  Description of Artificial Sequence: Synthetic oligonucleotide
gactgcaaggtggagcactggggc

SEQ ID NO: 393065 - DNA, 25 bp, Artificial Sequence
  Description of Artificial Sequence: Synthetic oligonucleotide
actgcaaggtggagcactggggcct

SEQ ID NO: 393066 - DNA, 24 bp, Artificial Sequence
  Description of Artificial Sequence: Synthetic oligonucleotide
ctgcaaggtggagcactggggcct

SEQ ID NO: 393067 - DNA, 24 bp, Artificial Sequence
  Description of Artificial Sequence: Synthetic oligonucleotide
tgcaaggtggagcactggggcctg

SEQ ID NO: 393068 - DNA, 23 bp, Artificial Sequence
  Description of Artificial Sequence: Synthetic oligonucleotide
gcaaggtggagcactggggcctg

SEQ ID NO: 393069 - DNA, 24 bp, Artificial Sequence
  Description of Artificial Sequence: Synthetic oligonucleotide
caaggtggagcactggggcctgga

SEQ ID NO: 393070 - DNA, 24 bp, Artificial Sequence
  Description of Artificial Sequence: Synthetic oligonucleotide
aaggtggagcactggggcctggac

SEQ ID NO: 393071 - DNA, 23 bp, Artificial Sequence
  Description of Artificial Sequence: Synthetic oligonucleotide
aggtggagcactggggcctggac

SEQ ID NO: 393072 - DNA, 22 bp, Artificial Sequence
  Description of Artificial Sequence: Synthetic oligonucleotide
ggtggagcactggggcctggac

SEQ ID NO: 393073 - DNA, 23 bp, Artificial Sequence
  Description of Artificial Sequence: Synthetic oligonucleotide
gtggagcactggggcctggacca

SEQ ID NO: 393074 - DNA, 23 bp, Artificial Sequence
  Description of Artificial Sequence: Synthetic oligonucleotide
tggagcactggggcctggaccag

SEQ ID NO: 393075 - DNA, 22 bp, Artificial Sequence
  Description of Artificial Sequence: Synthetic oligonucleotide
ggagcactggggcctggaccag

SEQ ID NO: 393076 - DNA, 22 bp, Artificial Sequence
  Description of Artificial Sequence: Synthetic oligonucleotide
gagcactggggcctggaccagc

SEQ ID NO: 393077 - DNA, 23 bp, Artificial Sequence
  Description of Artificial Sequence: Synthetic oligonucleotide
agcactggggcctggaccagcct

SEQ ID NO: 393078 - DNA, 22 bp, Artificial Sequence
  Description of Artificial Sequence: Synthetic oligonucleotide
gcactggggcctggaccagcct

SEQ ID NO: 393079 - DNA, 24 bp, Artificial Sequence
  Description of Artificial Sequence: Synthetic oligonucleotide
cactggggcctggaccagcctctt

SEQ ID NO: 393080 - DNA, 25 bp, Artificial Sequence
  Description of Artificial Sequence: Synthetic oligonucleotide
actggggcctggaccagcctcttct

SEQ ID NO: 393081 - DNA, 24 bp, Artificial Sequence
  Description of Artificial Sequence: Synthetic oligonucleotide
ctggggcctggaccagcctcttct

SEQ ID NO: 393082 - DNA, 27 bp, Artificial Sequence
  Description of Artificial Sequence: Synthetic oligonucleotide
tggggcctggaccagcctcttctgaaa

SEQ ID NO: 393083 - DNA, 26 bp, Artificial Sequence
  Description of Artificial Sequence: Synthetic oligonucleotide
ggggcctggaccagcctcttctgaaa

SEQ ID NO: 393084 - DNA, 27 bp, Artificial Sequence
  Description of Artificial Sequence: Synthetic oligonucleotide
gggcctggaccagcctcttctgaaaca

SEQ ID NO: 393085 - DNA, 27 bp, Artificial Sequence
  Description of Artificial Sequence: Synthetic oligonucleotide
ggcctggaccagcctcttctgaaacac

SEQ ID NO: 393086 - DNA, 28 bp, Artificial Sequence
  Description of Artificial Sequence: Synthetic oligonucleotide
gcctggaccagcctcttctgaaacactg

SEQ ID NO: 393087 - DNA, 28 bp, Artificial Sequence
  Description of Artificial Sequence: Synthetic oligonucleotide
cctggaccagcctcttctgaaacactgg

SEQ ID NO: 393088 - DNA, 28 bp, Artificial Sequence
  Description of Artificial Sequence: Synthetic oligonucleotide
ctggaccagcctcttctgaaacactggg

SEQ ID NO: 393089 - DNA, 29 bp, Artificial Sequence
  Description of Artificial Sequence: Synthetic oligonucleotide
tggaccagcctcttctgaaacactgggag

SEQ ID NO: 393090 - DNA, 28 bp, Artificial Sequence
  Description of Artificial Sequence: Synthetic oligonucleotide
ggaccagcctcttctgaaacactgggag

SEQ ID NO: 393091 - DNA, 28 bp, Artificial Sequence
  Description of Artificial Sequence: Synthetic oligonucleotide
gaccagcctcttctgaaacactgggagc

SEQ ID NO: 393092 - DNA, 28 bp, Artificial Sequence
  Description of Artificial Sequence: Synthetic oligonucleotide
accagcctcttctgaaacactgggagcc

SEQ ID NO: 393093 - DNA, 27 bp, Artificial Sequence
  Description of Artificial Sequence: Synthetic oligonucleotide
ccagcctcttctgaaacactgggagcc

SEQ ID NO: 393094 - DNA, 28 bp, Artificial Sequence
  Description of Artificial Sequence: Synthetic oligonucleotide
cagcctcttctgaaacactgggagcctg

SEQ ID NO: 393095 - DNA, 29 bp, Artificial Sequence
  Description of Artificial Sequence: Synthetic oligonucleotide
agcctcttctgaaacactgggagcctgag

SEQ ID NO: 393096 - DNA, 28 bp, Artificial Sequence
  Description of Artificial Sequence: Synthetic oligonucleotide
gcctcttctgaaacactgggagcctgag

SEQ ID NO: 393097 - DNA, 31 bp, Artificial Sequence; identical to SEQ ID NO: 55613
  Description of Artificial Sequence: Synthetic oligonucleotide

SEQ ID NO: 393098 - DNA, 31 bp, Artificial Sequence; identical to SEQ ID NO: 55614
  Description of Artificial Sequence: Synthetic oligonucleotide

SEQ ID NO: 393099 - DNA, 32 bp, Artificial Sequence; identical to SEQ ID NO: 55615
  Description of Artificial Sequence: Synthetic oligonucleotide

SEQ ID NO: 393100 - DNA, 31 bp, Artificial Sequence; identical to SEQ ID NO: 55616
  Description of Artificial Sequence: Synthetic oligonucleotide

SEQ ID NO: 393101 - DNA, 31 bp, Artificial Sequence; identical to SEQ ID NO: 55617
  Description of Artificial Sequence: Synthetic oligonucleotide

SEQ ID NO: 393102 - DNA, 30 bp, Artificial Sequence; identical to SEQ ID NO: 55618
  Description of Artificial Sequence: Synthetic oligonucleotide

SEQ ID NO: 393103 - DNA, 29 bp, Artificial Sequence
  Description of Artificial Sequence: Synthetic oligonucleotide
ctgaaacactgggagcctgagattccagc

SEQ ID NO: 393104 - DNA, 29 bp, Artificial Sequence
  Description of Artificial Sequence: Synthetic oligonucleotide
tgaaacactgggagcctgagattccagcc

SEQ ID NO: 393105 - DNA, 28 bp, Artificial Sequence
  Description of Artificial Sequence: Synthetic oligonucleotide
gaaacactgggagcctgagattccagcc

SEQ ID NO: 393106 - DNA, 28 bp, Artificial Sequence
  Description of Artificial Sequence: Synthetic oligonucleotide
aaacactgggagcctgagattccagccc

SEQ ID NO: 393107 - DNA, 27 bp, Artificial Sequence
  Description of Artificial Sequence: Synthetic oligonucleotide
aacactgggagcctgagattccagccc

SEQ ID NO: 393108 - DNA, 26 bp, Artificial Sequence
  Description of Artificial Sequence: Synthetic oligonucleotide
acactgggagcctgagattccagccc

SEQ ID NO: 393109 - DNA, 25 bp, Artificial Sequence
  Description of Artificial Sequence: Synthetic oligonucleotide
cactgggagcctgagattccagccc

SEQ ID NO: 393110 - DNA, 27 bp, Artificial Sequence
  Description of Artificial Sequence: Synthetic oligonucleotide
actgggagcctgagattccagccccta

SEQ ID NO: 393111 - DNA, 27 bp, Artificial Sequence
  Description of Artificial Sequence: Synthetic oligonucleotide
ctgggagcctgagattccagcccctat

SEQ ID NO: 393112 - DNA, 27 bp, Artificial Sequence
  Description of Artificial Sequence: Synthetic oligonucleotide
tgggagcctgagattccagcccctatg

SEQ ID NO: 393113 - DNA, 27 bp, Artificial Sequence
  Description of Artificial Sequence: Synthetic oligonucleotide
gggagcctgagattccagcccctatgt

SEQ ID NO: 393114 - DNA, 27 bp, Artificial Sequence
  Description of Artificial Sequence: Synthetic oligonucleotide
ggagcctgagattccagcccctatgtc

SEQ ID NO: 393115 - DNA, 28 bp, Artificial Sequence
  Description of Artificial Sequence: Synthetic oligonucleotide
gagcctgagattccagcccctatgtcag

SEQ ID NO: 393116 - DNA, 29 bp, Artificial Sequence
  Description of Artificial Sequence: Synthetic oligonucleotide
agcctgagattccagcccctatgtcagag

SEQ ID NO: 393117 - DNA, 28 bp, Artificial Sequence
  Description of Artificial Sequence: Synthetic oligonucleotide
gcctgagattccagcccctatgtcagag

SEQ ID NO: 393118 - DNA, 28 bp, Artificial Sequence
  Description of Artificial Sequence: Synthetic oligonucleotide
cctgagattccagcccctatgtcagagc

SEQ ID NO: 393119 - DNA, 29 bp, Artificial Sequence
  Description of Artificial Sequence: Synthetic oligonucleotide
ctgagattccagcccctatgtcagagctc

SEQ ID NO: 393120 - DNA, 30 bp, Artificial Sequence; identical to SEQ ID NO: 55636
  Description of Artificial Sequence: Synthetic oligonucleotide

SEQ ID NO: 393121 - DNA, 29 bp, Artificial Sequence
  Description of Artificial Sequence: Synthetic oligonucleotide
gagattccagcccctatgtcagagctcac

SEQ ID NO: 393122 - DNA, 30 bp, Artificial Sequence; identical to SEQ ID NO: 55638
  Description of Artificial Sequence: Synthetic oligonucleotide

SEQ ID NO: 393123 - DNA, 29 bp, Artificial Sequence
  Description of Artificial Sequence: Synthetic oligonucleotide
gattccagcccctatgtcagagctcacag

SEQ ID NO: 393124 - DNA, 30 bp, Artificial Sequence; identical to SEQ ID NO: 55640
  Description of Artificial Sequence: Synthetic oligonucleotide

SEQ ID NO: 393125 - DNA, 29 bp, Artificial Sequence
  Description of Artificial Sequence: Synthetic oligonucleotide
ttccagcccctatgtcagagctcacagag

SEQ ID NO: 393126 - DNA, 28 bp, Artificial Sequence
  Description of Artificial Sequence: Synthetic oligonucleotide
tccagcccctatgtcagagctcacagag

SEQ ID NO: 393127 - DNA, 27 bp, Artificial Sequence
  Description of Artificial Sequence: Synthetic oligonucleotide
ccagcccctatgtcagagctcacagag

SEQ ID NO: 393128 - DNA, 28 bp, Artificial Sequence
  Description of Artificial Sequence: Synthetic oligonucleotide
cagcccctatgtcagagctcacagagac

SEQ ID NO: 393129 - DNA, 29 bp, Artificial Sequence
  Description of Artificial Sequence: Synthetic oligonucleotide
agcccctatgtcagagctcacagagactg

SEQ ID NO: 393130 - DNA, 28 bp, Artificial Sequence
  Description of Artificial Sequence: Synthetic oligonucleotide
gcccctatgtcagagctcacagagactg

SEQ ID NO: 393131 - DNA, 29 bp, Artificial Sequence
  Description of Artificial Sequence: Synthetic oligonucleotide
cccctatgtcagagctcacagagactgtg

SEQ ID NO: 393132 - DNA, 29 bp, Artificial Sequence
  Description of Artificial Sequence: Synthetic oligonucleotide
ccctatgtcagagctcacagagactgtgg

SEQ ID NO: 393133 - DNA, 30 bp, Artificial Sequence; identical to SEQ ID NO: 55649
  Description of Artificial Sequence: Synthetic oligonucleotide

SEQ ID NO: 393134 - DNA, 31 bp, Artificial Sequence; identical to SEQ ID NO: 55650
  Description of Artificial Sequence: Synthetic oligonucleotide

SEQ ID NO: 393135 - DNA, 31 bp, Artificial Sequence; identical to SEQ ID NO: 55651
  Description of Artificial Sequence: Synthetic oligonucleotide

SEQ ID NO: 393136 - DNA, 30 bp, Artificial Sequence; identical to SEQ ID NO: 55652
  Description of Artificial Sequence: Synthetic oligonucleotide

SEQ ID NO: 393137 - DNA, 29 bp, Artificial Sequence
  Description of Artificial Sequence: Synthetic oligonucleotide
tgtcagagctcacagagactgtggtctgc

SEQ ID NO: 393138 - DNA, 28 bp, Artificial Sequence
  Description of Artificial Sequence: Synthetic oligonucleotide
gtcagagctcacagagactgtggtctgc

SEQ ID NO: 393139 - DNA, 28 bp, Artificial Sequence
  Description of Artificial Sequence: Synthetic oligonucleotide
tcagagctcacagagactgtggtctgcg

SEQ ID NO: 393140 - DNA, 27 bp, Artificial Sequence
  Description of Artificial Sequence: Synthetic oligonucleotide
cagagctcacagagactgtggtctgcg

SEQ ID NO: 393141 - DNA, 27 bp, Artificial Sequence
  Description of Artificial Sequence: Synthetic oligonucleotide
agagctcacagagactgtggtctgcgc

SEQ ID NO: 393142 - DNA, 26 bp, Artificial Sequence
  Description of Artificial Sequence: Synthetic oligonucleotide
gagctcacagagactgtggtctgcgc

SEQ ID NO: 393143 - DNA, 26 bp, Artificial Sequence
  Description of Artificial Sequence: Synthetic oligonucleotide
agctcacagagactgtggtctgcgcc

SEQ ID NO: 393144 - DNA, 25 bp, Artificial Sequence
  Description of Artificial Sequence: Synthetic oligonucleotide
gctcacagagactgtggtctgcgcc

SEQ ID NO: 393145 - DNA, 26 bp, Artificial Sequence
  Description of Artificial Sequence: Synthetic oligonucleotide
ctcacagagactgtggtctgcgccct

SEQ ID NO: 393146 - DNA, 26 bp, Artificial Sequence
  Description of Artificial Sequence: Synthetic oligonucleotide
tcacagagactgtggtctgcgccctg

SEQ ID NO: 393147 - DNA, 25 bp, Artificial Sequence
  Description of Artificial Sequence: Synthetic oligonucleotide
cacagagactgtggtctgcgccctg

SEQ ID NO: 393148 - DNA, 25 bp, Artificial Sequence
  Description of Artificial Sequence: Synthetic oligonucleotide
acagagactgtggtctgcgccctgg

SEQ ID NO: 393149 - DNA, 24 bp, Artificial Sequence
  Description of Artificial Sequence: Synthetic oligonucleotide
cagagactgtggtctgcgccctgg

SEQ ID NO: 393150 - DNA, 24 bp, Artificial Sequence
  Description of Artificial Sequence: Synthetic oligonucleotide
agagactgtggtctgcgccctggg

SEQ ID NO: 393151 - DNA, 23 bp, Artificial Sequence
  Description of Artificial Sequence: Synthetic oligonucleotide
gagactgtggtctgcgccctggg

SEQ ID NO: 393152 - DNA, 25 bp, Artificial Sequence
  Description of Artificial Sequence: Synthetic oligonucleotide
agactgtggtctgcgccctggggtt

SEQ ID NO: 393153 - DNA, 24 bp, Artificial Sequence
  Description of Artificial Sequence: Synthetic oligonucleotide
gactgtggtctgcgccctggggtt

SEQ ID NO: 393154 - DNA, 25 bp, Artificial Sequence
  Description of Artificial Sequence: Synthetic oligonucleotide
actgtggtctgcgccctggggttgt

SEQ ID NO: 393155 - DNA, 24 bp, Artificial Sequence
  Description of Artificial Sequence: Synthetic oligonucleotide
ctgtggtctgcgccctggggttgt

SEQ ID NO: 393156 - DNA, 25 bp, Artificial Sequence
  Description of Artificial Sequence: Synthetic oligonucleotide
tgtggtctgcgccctggggttgtct

SEQ ID NO: 393157 - DNA, 24 bp, Artificial Sequence
  Description of Artificial Sequence: Synthetic oligonucleotide
gtggtctgcgccctggggttgtct

SEQ ID NO: 393158 - DNA, 25 bp, Artificial Sequence
  Description of Artificial Sequence: Synthetic oligonucleotide
tggtctgcgccctggggttgtctgt

SEQ ID NO: 393159 - DNA, 24 bp, Artificial Sequence
  Description of Artificial Sequence: Synthetic oligonucleotide
ggtctgcgccctggggttgtctgt

SEQ ID NO: 393160 - DNA, 24 bp, Artificial Sequence
  Description of Artificial Sequence: Synthetic oligonucleotide
gtctgcgccctggggttgtctgtg

SEQ ID NO: 393161 - DNA, 24 bp, Artificial Sequence
  Description of Artificial Sequence: Synthetic oligonucleotide
tctgcgccctggggttgtctgtgg

SEQ ID NO: 393162 - DNA, 23 bp, Artificial Sequence
  Description of Artificial Sequence: Synthetic oligonucleotide
ctgcgccctggggttgtctgtgg

SEQ ID NO: 393163 - DNA, 23 bp, Artificial Sequence
  Description of Artificial Sequence: Synthetic oligonucleotide
tgcgccctggggttgtctgtggg

SEQ ID NO: 393164 - DNA, 22 bp, Artificial Sequence
  Description of Artificial Sequence: Synthetic oligonucleotide
gcgccctggggttgtctgtggg

SEQ ID NO: 393165 - DNA, 22 bp, Artificial Sequence
  Description of Artificial Sequence: Synthetic oligonucleotide
cgccctggggttgtctgtgggc

SEQ ID NO: 393166 - DNA, 23 bp, Artificial Sequence
  Description of Artificial Sequence: Synthetic oligonucleotide
gccctggggttgtctgtgggcct

SEQ ID NO: 393167 - DNA, 23 bp, Artificial Sequence
  Description of Artificial Sequence: Synthetic oligonucleotide
ccctggggttgtctgtgggcctc

SEQ ID NO: 393168 - DNA, 24 bp, Artificial Sequence
  Description of Artificial Sequence: Synthetic oligonucleotide
cctggggttgtctgtgggcctcgt

SEQ ID NO: 393169 - DNA, 24 bp, Artificial Sequence
  Description of Artificial Sequence: Synthetic oligonucleotide
ctggggttgtctgtgggcctcgtg

SEQ ID NO: 393170 - DNA, 24 bp, Artificial Sequence
  Description of Artificial Sequence: Synthetic oligonucleotide
tggggttgtctgtgggcctcgtgg

SEQ ID NO: 393171 - DNA, 23 bp, Artificial Sequence
  Description of Artificial Sequence: Synthetic oligonucleotide
ggggttgtctgtgggcctcgtgg

SEQ ID NO: 393172 - DNA, 23 bp, Artificial Sequence
  Description of Artificial Sequence: Synthetic oligonucleotide
gggttgtctgtgggcctcgtggg

SEQ ID NO: 393173 - DNA, 26 bp, Artificial Sequence
  Description of Artificial Sequence: Synthetic oligonucleotide
ggttgtctgtgggcctcgtgggcatt

SEQ ID NO: 393174 - DNA, 27 bp, Artificial Sequence
  Description of Artificial Sequence: Synthetic oligonucleotide
gttgtctgtgggcctcgtgggcattgt

SEQ ID NO: 393175 - DNA, 27 bp, Artificial Sequence
  Description of Artificial Sequence: Synthetic oligonucleotide
ttgtctgtgggcctcgtgggcattgtg

SEQ ID NO: 393176 - DNA, 26 bp, Artificial Sequence
  Description of Artificial Sequence: Synthetic oligonucleotide
tgtctgtgggcctcgtgggcattgtg

SEQ ID NO: 393177 - DNA, 25 bp, Artificial Sequence
  Description of Artificial Sequence: Synthetic oligonucleotide
gtctgtgggcctcgtgggcattgtg

SEQ ID NO: 393178 - DNA, 26 bp, Artificial Sequence
  Description of Artificial Sequence: Synthetic oligonucleotide
tctgtgggcctcgtgggcattgtggt

SEQ ID NO: 393179 - DNA, 25 bp, Artificial Sequence
  Description of Artificial Sequence: Synthetic oligonucleotide
ctgtgggcctcgtgggcattgtggt

SEQ ID NO: 393180 - DNA, 25 bp, Artificial Sequence
  Description of Artificial Sequence: Synthetic oligonucleotide
tgtgggcctcgtgggcattgtggtg

SEQ ID NO: 393181 - DNA, 24 bp, Artificial Sequence
  Description of Artificial Sequence: Synthetic oligonucleotide
gtgggcctcgtgggcattgtggtg

SEQ ID NO: 393182 - DNA, 24 bp, Artificial Sequence
  Description of Artificial Sequence: Synthetic oligonucleotide
tgggcctcgtgggcattgtggtgg

SEQ ID NO: 393183 - DNA, 23 bp, Artificial Sequence
  Description of Artificial Sequence: Synthetic oligonucleotide
gggcctcgtgggcattgtggtgg

SEQ ID NO: 393184 - DNA, 23 bp, Artificial Sequence
  Description of Artificial Sequence: Synthetic oligonucleotide
ggcctcgtgggcattgtggtggg

SEQ ID NO: 393185 - DNA, 24 bp, Artificial Sequence
  Description of Artificial Sequence: Synthetic oligonucleotide
gcctcgtgggcattgtggtgggca

SEQ ID NO: 393186 - DNA, 25 bp, Artificial Sequence
  Description of Artificial Sequence: Synthetic oligonucleotide
cctcgtgggcattgtggtgggcact

SEQ ID NO: 393187 - DNA, 26 bp, Artificial Sequence
  Description of Artificial Sequence: Synthetic oligonucleotide
ctcgtgggcattgtggtgggcactgt

SEQ ID NO: 393188 - DNA, 27 bp, Artificial Sequence
  Description of Artificial Sequence: Synthetic oligonucleotide
tcgtgggcattgtggtgggcactgtct

SEQ ID NO: 393189 - DNA, 27 bp, Artificial Sequence
  Description of Artificial Sequence: Synthetic oligonucleotide
cgtgggcattgtggtgggcactgtctt

SEQ ID NO: 393190 - DNA, 27 bp, Artificial Sequence
  Description of Artificial Sequence: Synthetic oligonucleotide
gtgggcattgtggtgggcactgtcttc

SEQ ID NO: 393191 - DNA, 29 bp, Artificial Sequence
  Description of Artificial Sequence: Synthetic oligonucleotide
tgggcattgtggtgggcactgtcttcatc

SEQ ID NO: 393192 - DNA, 28 bp, Artificial Sequence
  Description of Artificial Sequence: Synthetic oligonucleotide
gggcattgtggtgggcactgtcttcatc

SEQ ID NO: 393193 - DNA, 30 bp, Artificial Sequence; identical to SEQ ID NO: 55709
  Description of Artificial Sequence: Synthetic oligonucleotide

SEQ ID NO: 393194 - DNA, 30 bp, Artificial Sequence; identical to SEQ ID NO: 55710
  Description of Artificial Sequence: Synthetic oligonucleotide

SEQ ID NO: 393195 - DNA, 32 bp, Artificial Sequence; identical to SEQ ID NO: 55711
  Description of Artificial Sequence: Synthetic oligonucleotide

SEQ ID NO: 393196 - DNA, 32 bp, Artificial Sequence; identical to SEQ ID NO: 55712
  Description of Artificial Sequence: Synthetic oligonucleotide

SEQ ID NO: 393197 - DNA, 31 bp, Artificial Sequence; identical to SEQ ID NO: 55713
  Description of Artificial Sequence: Synthetic oligonucleotide

SEQ ID NO: 393198 - DNA, 30 bp, Artificial Sequence; identical to SEQ ID NO: 55714
  Description of Artificial Sequence: Synthetic oligonucleotide

SEQ ID NO: 393199 - DNA, 29 bp, Artificial Sequence
  Description of Artificial Sequence: Synthetic oligonucleotide
gtggtgggcactgtcttcatcatccaagg

SEQ ID NO: 393200 - DNA, 29 bp, Artificial Sequence
  Description of Artificial Sequence: Synthetic oligonucleotide
tggtgggcactgtcttcatcatccaaggc

SEQ ID NO: 393201 - DNA, 28 bp, Artificial Sequence
  Description of Artificial Sequence: Synthetic oligonucleotide
ggtgggcactgtcttcatcatccaaggc

SEQ ID NO: 393202 - DNA, 28 bp, Artificial Sequence
  Description of Artificial Sequence: Synthetic oligonucleotide
gtgggcactgtcttcatcatccaaggcc

SEQ ID NO: 393203 - DNA, 29 bp, Artificial Sequence
  Description of Artificial Sequence: Synthetic oligonucleotide
tgggcactgtcttcatcatccaaggcctg

SEQ ID NO: 393204 - DNA, 28 bp, Artificial Sequence
  Description of Artificial Sequence: Synthetic oligonucleotide
gggcactgtcttcatcatccaaggcctg

SEQ ID NO: 393205 - DNA, 28 bp, Artificial Sequence
  Description of Artificial Sequence: Synthetic oligonucleotide
ggcactgtcttcatcatccaaggcctgc

SEQ ID NO: 393206 - DNA, 28 bp, Artificial Sequence
  Description of Artificial Sequence: Synthetic oligonucleotide
gcactgtcttcatcatccaaggcctgcg

SEQ ID NO: 393207 - DNA, 30 bp, Artificial Sequence; identical to SEQ ID NO: 55723
  Description of Artificial Sequence: Synthetic oligonucleotide

SEQ ID NO: 393208 - DNA, 31 bp, Artificial Sequence; identical to SEQ ID NO: 55724
  Description of Artificial Sequence: Synthetic oligonucleotide

SEQ ID NO: 393209 - DNA, 30 bp, Artificial Sequence; identical to SEQ ID NO: 55725
  Description of Artificial Sequence: Synthetic oligonucleotide

SEQ ID NO: 393210 - DNA, 32 bp, Artificial Sequence; identical to SEQ ID NO: 55726
  Description of Artificial Sequence: Synthetic oligonucleotide

SEQ ID NO: 393211 - DNA, 31 bp, Artificial Sequence; identical to SEQ ID NO: 55727
  Description of Artificial Sequence: Synthetic oligonucleotide

SEQ ID NO: 393212 - DNA, 31 bp, Artificial Sequence; identical to SEQ ID NO: 55728
  Description of Artificial Sequence: Synthetic oligonucleotide

SEQ ID NO: 393213 - DNA, 30 bp, Artificial Sequence; identical to SEQ ID NO: 55729
  Description of Artificial Sequence: Synthetic oligonucleotide

SEQ ID NO: 393214 - DNA, 31 bp, Artificial Sequence; identical to SEQ ID NO: 55730
  Description of Artificial Sequence: Synthetic oligonucleotide

SEQ ID NO: 393215 - DNA, 30 bp, Artificial Sequence; identical to SEQ ID NO: 55731
  Description of Artificial Sequence: Synthetic oligonucleotide

SEQ ID NO: 393216 - DNA, 29 bp, Artificial Sequence
  Description of Artificial Sequence: Synthetic oligonucleotide
catcatccaaggcctgcgttcagttggtg

SEQ ID NO: 393217 - DNA, 29 bp, Artificial Sequence
  Description of Artificial Sequence: Synthetic oligonucleotide
atcatccaaggcctgcgttcagttggtgc

SEQ ID NO: 393218 - DNA, 28 bp, Artificial Sequence
  Description of Artificial Sequence: Synthetic oligonucleotide
tcatccaaggcctgcgttcagttggtgc

SEQ ID NO: 393219 - DNA, 27 bp, Artificial Sequence
  Description of Artificial Sequence: Synthetic oligonucleotide
catccaaggcctgcgttcagttggtgc

SEQ ID NO: 393220 - DNA, 29 bp, Artificial Sequence
  Description of Artificial Sequence: Synthetic oligonucleotide
atccaaggcctgcgttcagttggtgcttc

SEQ ID NO: 393221 - DNA, 28 bp, Artificial Sequence
  Description of Artificial Sequence: Synthetic oligonucleotide
tccaaggcctgcgttcagttggtgcttc

SEQ ID NO: 393222 - DNA, 27 bp, Artificial Sequence
  Description of Artificial Sequence: Synthetic oligonucleotide
ccaaggcctgcgttcagttggtgcttc

SEQ ID NO: 393223 - DNA, 27 bp, Artificial Sequence
  Description of Artificial Sequence: Synthetic oligonucleotide
caaggcctgcgttcagttggtgcttcc

SEQ ID NO: 393224 - DNA, 28 bp, Artificial Sequence
  Description of Artificial Sequence: Synthetic oligonucleotide
aaggcctgcgttcagttggtgcttccag

SEQ ID NO: 393225 - DNA, 27 bp, Artificial Sequence
  Description of Artificial Sequence: Synthetic oligonucleotide
aggcctgcgttcagttggtgcttccag

SEQ ID NO: 393226 - DNA, 27 bp, Artificial Sequence
  Description of Artificial Sequence: Synthetic oligonucleotide
ggcctgcgttcagttggtgcttccaga

SEQ ID NO: 393227 - DNA, 27 bp, Artificial Sequence
  Description of Artificial Sequence: Synthetic oligonucleotide
gcctgcgttcagttggtgcttccagac

SEQ ID NO: 393228 - DNA, 28 bp, Artificial Sequence
  Description of Artificial Sequence: Synthetic oligonucleotide
cctgcgttcagttggtgcttccagacac

SEQ ID NO: 393229 - DNA, 28 bp, Artificial Sequence
  Description of Artificial Sequence: Synthetic oligonucleotide
ctgcgttcagttggtgcttccagacacc

SEQ ID NO: 393230 - DNA, 30 bp, Artificial Sequence; identical to SEQ ID NO: 55746
  Description of Artificial Sequence: Synthetic oligonucleotide

SEQ ID NO: 393231 - DNA, 29 bp, Artificial Sequence
  Description of Artificial Sequence: Synthetic oligonucleotide
gcgttcagttggtgcttccagacaccaag

SEQ ID NO: 393232 - DNA, 29 bp, Artificial Sequence
  Description of Artificial Sequence: Synthetic oligonucleotide
cgttcagttggtgcttccagacaccaagg

SEQ ID NO: 393233 - DNA, 29 bp, Artificial Sequence
  Description of Artificial Sequence: Synthetic oligonucleotide
gttcagttggtgcttccagacaccaaggg

SEQ ID NO: 393234 - DNA, 29 bp, Artificial Sequence
  Description of Artificial Sequence: Synthetic oligonucleotide
ttcagttggtgcttccagacaccaagggc

SEQ ID NO: 393235 - DNA, 28 bp, Artificial Sequence
  Description of Artificial Sequence: Synthetic oligonucleotide
tcagttggtgcttccagacaccaagggc

SEQ ID NO: 393236 - DNA, 27 bp, Artificial Sequence
  Description of Artificial Sequence: Synthetic oligonucleotide
cagttggtgcttccagacaccaagggc

SEQ ID NO: 393237 - DNA, 27 bp, Artificial Sequence
  Description of Artificial Sequence: Synthetic oligonucleotide
agttggtgcttccagacaccaagggcc

SEQ ID NO: 393238 - DNA, 27 bp, Artificial Sequence
  Description of Artificial Sequence: Synthetic oligonucleotide
gttggtgcttccagacaccaagggcca

SEQ ID NO: 393239 - DNA, 29 bp, Artificial Sequence
  Description of Artificial Sequence: Synthetic oligonucleotide
ttggtgcttccagacaccaagggccattg

SEQ ID NO: 393240 - DNA, 28 bp, Artificial Sequence
  Description of Artificial Sequence: Synthetic oligonucleotide
tggtgcttccagacaccaagggccattg

SEQ ID NO: 393241 - DNA, 27 bp, Artificial Sequence
  Description of Artificial Sequence: Synthetic oligonucleotide
ggtgcttccagacaccaagggccattg

SEQ ID NO: 393242 - DNA, 28 bp, Artificial Sequence
  Description of Artificial Sequence: Synthetic oligonucleotide
gtgcttccagacaccaagggccattgtg

SEQ ID NO: 393243 - DNA, 38 bp, Artificial Sequence
  Description of Artificial Sequence: Synthetic oligonucleotide
aaaaattcctggaggttgtaagccagaacatcctgaag

SEQ ID NO: 393244 - DNA, 37 bp, Artificial Sequence
  Description of Artificial Sequence: Synthetic oligonucleotide
aaaattcctggaggttgtaagccagaacatcctgaag

SEQ ID NO: 393245 - DNA, 36 bp, Artificial Sequence
  Description of Artificial Sequence: Synthetic oligonucleotide
aaattcctggaggttgtaagccagaacatcctgaag

SEQ ID NO: 393246 - DNA, 35 bp, Artificial Sequence
  Description of Artificial Sequence: Synthetic oligonucleotide
aattcctggaggttgtaagccagaacatcctgaag

SEQ ID NO: 393247 - DNA, 34 bp, Artificial Sequence
  Description of Artificial Sequence: Synthetic oligonucleotide
attcctggaggttgtaagccagaacatcctgaag

SEQ ID NO: 393248 - DNA, 33 bp, Artificial Sequence
  Description of Artificial Sequence: Synthetic oligonucleotide
ttcctggaggttgtaagccagaacatcctgaag

SEQ ID NO: 393249 - DNA, 32 bp, Artificial Sequence
  Description of Artificial Sequence: Synthetic oligonucleotide
tcctggaggttgtaagccagaacatcctgaag

SEQ ID NO: 393250 - DNA, 31 bp, Artificial Sequence
  Description of Artificial Sequence: Synthetic oligonucleotide
cctggaggttgtaagccagaacatcctgaag

SEQ ID NO: 393251 - DNA, 31 bp, Artificial Sequence
  Description of Artificial Sequence: Synthetic oligonucleotide
ctggaggttgtaagccagaacatcctgaagg

SEQ ID NO: 393252 - DNA, 33 bp, Artificial Sequence
  Description of Artificial Sequence: Synthetic oligonucleotide
tggaggttgtaagccagaacatcctgaaggatg

SEQ ID NO: 393253 - DNA, 32 bp, Artificial Sequence
  Description of Artificial Sequence: Synthetic oligonucleotide
ggaggttgtaagccagaacatcctgaaggatg

SEQ ID NO: 393254 - DNA, 32 bp, Artificial Sequence
  Description of Artificial Sequence: Synthetic oligonucleotide
gaggttgtaagccagaacatcctgaaggatgc

SEQ ID NO: 393255 - DNA, 32 bp, Artificial Sequence
  Description of Artificial Sequence: Synthetic oligonucleotide
aggttgtaagccagaacatcctgaaggatgcc

SEQ ID NO: 393256 - DNA, 31 bp, Artificial Sequence
  Description of Artificial Sequence: Synthetic oligonucleotide
ggttgtaagccagaacatcctgaaggatgcc

SEQ ID NO: 393257 - DNA, 31 bp, Artificial Sequence
  Description of Artificial Sequence: Synthetic oligonucleotide
gttgtaagccagaacatcctgaaggatgccg

SEQ ID NO: 393258 - DNA, 36 bp, Artificial Sequence
  Description of Artificial Sequence: Synthetic oligonucleotide
ttgtaagccagaacatcctgaaggatgccgtataac

SEQ ID NO: 393259 - DNA, 35 bp, Artificial Sequence
  Description of Artificial Sequence: Synthetic oligonucleotide
tgtaagccagaacatcctgaaggatgccgtataac

SEQ ID NO: 393260 - DNA, 34 bp, Artificial Sequence
  Description of Artificial Sequence: Synthetic oligonucleotide
gtaagccagaacatcctgaaggatgccgtataac

SEQ ID NO: 393261 - DNA, 35 bp, Artificial Sequence
  Description of Artificial Sequence: Synthetic oligonucleotide
taagccagaacatcctgaaggatgccgtataactg

SEQ ID NO: 393262 - DNA, 34 bp, Artificial Sequence
  Description of Artificial Sequence: Synthetic oligonucleotide
aagccagaacatcctgaaggatgccgtataactg

SEQ ID NO: 393263 - DNA, 33 bp, Artificial Sequence
  Description of Artificial Sequence: Synthetic oligonucleotide
agccagaacatcctgaaggatgccgtataactg

SEQ ID NO: 393264 - DNA, 32 bp, Artificial Sequence
  Description of Artificial Sequence: Synthetic oligonucleotide
gccagaacatcctgaaggatgccgtataactg

SEQ ID NO: 393265 - DNA, 34 bp, Artificial Sequence
  Description of Artificial Sequence: Synthetic oligonucleotide
ccagaacatcctgaaggatgccgtataactgatg

SEQ ID NO: 393266 - DNA, 35 bp, Artificial Sequence
  Description of Artificial Sequence: Synthetic oligonucleotide
cagaacatcctgaaggatgccgtataactgatgac

SEQ ID NO: 393267 - DNA, 35 bp, Artificial Sequence
  Description of Artificial Sequence: Synthetic oligonucleotide
agaacatcctgaaggatgccgtataactgatgacc

SEQ ID NO: 393268 - DNA, 34 bp, Artificial Sequence
  Description of Artificial Sequence: Synthetic oligonucleotide
gaacatcctgaaggatgccgtataactgatgacc

SEQ ID NO: 393269 - DNA, 35 bp, Artificial Sequence
  Description of Artificial Sequence: Synthetic oligonucleotide
aacatcctgaaggatgccgtataactgatgacctc

SEQ ID NO: 393270 - DNA, 34 bp, Artificial Sequence
  Description of Artificial Sequence: Synthetic oligonucleotide
acatcctgaaggatgccgtataactgatgacctc

SEQ ID NO: 393271 - DNA, 33 bp, Artificial Sequence
  Description of Artificial Sequence: Synthetic oligonucleotide
catcctgaaggatgccgtataactgatgacctc

SEQ ID NO: 393272 - DNA, 35 bp, Artificial Sequence
  Description of Artificial Sequence: Synthetic oligonucleotide
atcctgaaggatgccgtataactgatgacctcatc

SEQ ID NO: 393273 - DNA, 34 bp, Artificial Sequence
  Description of Artificial Sequence: Synthetic oligonucleotide
tcctgaaggatgccgtataactgatgacctcatc

SEQ ID NO: 393274 - DNA, 33 bp, Artificial Sequence
  Description of Artificial Sequence: Synthetic oligonucleotide
cctgaaggatgccgtataactgatgacctcatc

SEQ ID NO: 393275 - DNA, 36 bp, Artificial Sequence
  Description of Artificial Sequence: Synthetic oligonucleotide
ctgaaggatgccgtataactgatgacctcatctatc

SEQ ID NO: 393276 - DNA, 36 bp, Artificial Sequence
  Description of Artificial Sequence: Synthetic oligonucleotide
tgaaggatgccgtataactgatgacctcatctatcc

SEQ ID NO: 393277 - DNA, 35 bp, Artificial Sequence
  Description of Artificial Sequence: Synthetic oligonucleotide
gaaggatgccgtataactgatgacctcatctatcc

SEQ ID NO: 393278 - DNA, 36 bp, Artificial Sequence
  Description of Artificial Sequence: Synthetic oligonucleotide
aaggatgccgtataactgatgacctcatctatccac

SEQ ID NO: 393279 - DNA, 35 bp, Artificial Sequence
  Description of Artificial Sequence: Synthetic oligonucleotide
aggatgccgtataactgatgacctcatctatccac

SEQ ID NO: 393280 - DNA, 34 bp, Artificial Sequence
  Description of Artificial Sequence: Synthetic oligonucleotide
ggatgccgtataactgatgacctcatctatccac

SEQ ID NO: 393281 - DNA, 34 bp, Artificial Sequence
  Description of Artificial Sequence: Synthetic oligonucleotide
gatgccgtataactgatgacctcatctatccacg

SEQ ID NO: 393282 - DNA, 35 bp, Artificial Sequence
  Description of Artificial Sequence: Synthetic oligonucleotide
atgccgtataactgatgacctcatctatccacgag

SEQ ID NO: 393283 - DNA, 34 bp, Artificial Sequence
  Description of Artificial Sequence: Synthetic oligonucleotide
tgccgtataactgatgacctcatctatccacgag

SEQ ID NO: 393284 - DNA, 33 bp, Artificial Sequence
  Description of Artificial Sequence: Synthetic oligonucleotide
gccgtataactgatgacctcatctatccacgag

SEQ ID NO: 393285 - DNA, 33 bp, Artificial Sequence
  Description of Artificial Sequence: Synthetic oligonucleotide
ccgtataactgatgacctcatctatccacgagg

SEQ ID NO: 393286 - DNA, 33 bp, Artificial Sequence
  Description of Artificial Sequence: Synthetic oligonucleotide
cgtataactgatgacctcatctatccacgaggc

SEQ ID NO: 393287 - DNA, 34 bp, Artificial Sequence
  Description of Artificial Sequence: Synthetic oligonucleotide
gtataactgatgacctcatctatccacgaggctg

SEQ ID NO: 393288 - DNA, 34 bp, Artificial Sequence
  Description of Artificial Sequence: Synthetic oligonucleotide
tataactgatgacctcatctatccacgaggctgc

SEQ ID NO: 393289 - DNA, 33 bp, Artificial Sequence
  Description of Artificial Sequence: Synthetic oligonucleotide
ataactgatgacctcatctatccacgaggctgc

SEQ ID NO: 393290 - DNA, 32 bp, Artificial Sequence
  Description of Artificial Sequence: Synthetic oligonucleotide
taactgatgacctcatctatccacgaggctgc

SEQ ID NO: 393291 - DNA, 31 bp, Artificial Sequence
  Description of Artificial Sequence: Synthetic oligonucleotide
aactgatgacctcatctatccacgaggctgc

SEQ ID NO: 393292 - DNA, 30 bp, Artificial Sequence
  Description of Artificial Sequence: Synthetic oligonucleotide
actgatgacctcatctatccacgaggctgc

SEQ ID NO: 393293 - DNA, 29 bp, Artificial Sequence
  Description of Artificial Sequence: Synthetic oligonucleotide
ctgatgacctcatctatccacgaggctgc

SEQ ID NO: 393294 - DNA, 30 bp, Artificial Sequence
  Description of Artificial Sequence: Synthetic oligonucleotide
tgatgacctcatctatccacgaggctgctc

SEQ ID NO: 393295 - DNA, 29 bp, Artificial Sequence
  Description of Artificial Sequence: Synthetic oligonucleotide
gatgacctcatctatccacgaggctgctc

SEQ ID NO: 393296 - DNA, 30 bp, Artificial Sequence
  Description of Artificial Sequence: Synthetic oligonucleotide
atgacctcatctatccacgaggctgctcag

SEQ ID NO: 393297 - DNA, 29 bp, Artificial Sequence
  Description of Artificial Sequence: Synthetic oligonucleotide
tgacctcatctatccacgaggctgctcag

SEQ ID NO: 393298 - DNA, 28 bp, Artificial Sequence
  Description of Artificial Sequence: Synthetic oligonucleotide
gacctcatctatccacgaggctgctcag

SEQ ID NO: 393299 - DNA, 32 bp, Artificial Sequence
  Description of Artificial Sequence: Synthetic oligonucleotide
acctcatctatccacgaggctgctcagaaatg

SEQ ID NO: 393300 - DNA, 31 bp, Artificial Sequence
  Description of Artificial Sequence: Synthetic oligonucleotide
cctcatctatccacgaggctgctcagaaatg

SEQ ID NO: 393301 - DNA, 31 bp, Artificial Sequence
  Description of Artificial Sequence: Synthetic oligonucleotide
ctcatctatccacgaggctgctcagaaatgc

SEQ ID NO: 393302 - DNA, 31 bp, Artificial Sequence
  Description of Artificial Sequence: Synthetic oligonucleotide
tcatctatccacgaggctgctcagaaatgcc

SEQ ID NO: 393303 - DNA, 30 bp, Artificial Sequence
  Description of Artificial Sequence: Synthetic oligonucleotide
catctatccacgaggctgctcagaaatgcc

SEQ ID NO: 393304 - DNA, 30 bp, Artificial Sequence
  Description of Artificial Sequence: Synthetic oligonucleotide
atctatccacgaggctgctcagaaatgccc

SEQ ID NO: 393305 - DNA, 29 bp, Artificial Sequence
  Description of Artificial Sequence: Synthetic oligonucleotide
tctatccacgaggctgctcagaaatgccc

SEQ ID NO: 393306 - DNA, 28 bp, Artificial Sequence
  Description of Artificial Sequence: Synthetic oligonucleotide
ctatccacgaggctgctcagaaatgccc

SEQ ID NO: 393307 - DNA, 29 bp, Artificial Sequence
  Description of Artificial Sequence: Synthetic oligonucleotide
tatccacgaggctgctcagaaatgcccac

SEQ ID NO: 393308 - DNA, 28 bp, Artificial Sequence
  Description of Artificial Sequence: Synthetic oligonucleotide
atccacgaggctgctcagaaatgcccac

SEQ ID NO: 393309 - DNA, 27 bp, Artificial Sequence
  Description of Artificial Sequence: Synthetic oligonucleotide
tccacgaggctgctcagaaatgcccac

SEQ ID NO: 393310 - DNA, 26 bp, Artificial Sequence
  Description of Artificial Sequence: Synthetic oligonucleotide
ccacgaggctgctcagaaatgcccac

SEQ ID NO: 393311 - DNA, 26 bp, Artificial Sequence
  Description of Artificial Sequence: Synthetic oligonucleotide
cacgaggctgctcagaaatgcccacc

SEQ ID NO: 393312 - DNA, 26 bp, Artificial Sequence
  Description of Artificial Sequence: Synthetic oligonucleotide
acgaggctgctcagaaatgcccaccc

SEQ ID NO: 393313 - DNA, 25 bp, Artificial Sequence
  Description of Artificial Sequence: Synthetic oligonucleotide
cgaggctgctcagaaatgcccaccc

SEQ ID NO: 393314 - DNA, 26 bp, Artificial Sequence
  Description of Artificial Sequence: Synthetic oligonucleotide
gaggctgctcagaaatgcccacccct

SEQ ID NO: 393315 - DNA, 26 bp, Artificial Sequence
  Description of Artificial Sequence: Synthetic oligonucleotide
aggctgctcagaaatgcccacccctg

SEQ ID NO: 393316 - DNA, 25 bp, Artificial Sequence
  Description of Artificial Sequence: Synthetic oligonucleotide
ggctgctcagaaatgcccacccctg

SEQ ID NO: 393317 - DNA, 25 bp, Artificial Sequence
  Description of Artificial Sequence: Synthetic oligonucleotide
gctgctcagaaatgcccacccctgg

SEQ ID NO: 393318 - DNA, 25 bp, Artificial Sequence
  Description of Artificial Sequence: Synthetic oligonucleotide
ctgctcagaaatgcccacccctggc

SEQ ID NO: 393319 - DNA, 26 bp, Artificial Sequence
  Description of Artificial Sequence: Synthetic oligonucleotide
tgctcagaaatgcccacccctggcca

SEQ ID NO: 393320 - DNA, 25 bp, Artificial Sequence
  Description of Artificial Sequence: Synthetic oligonucleotide
gctcagaaatgcccacccctggcca

SEQ ID NO: 393321 - DNA, 25 bp, Artificial Sequence
  Description of Artificial Sequence: Synthetic oligonucleotide
ctcagaaatgcccacccctggccag

SEQ ID NO: 393322 - DNA, 25 bp, Artificial Sequence
  Description of Artificial Sequence: Synthetic oligonucleotide
tcagaaatgcccacccctggccagg

SEQ ID NO: 393323 - DNA, 24 bp, Artificial Sequence
  Description of Artificial Sequence: Synthetic oligonucleotide
cagaaatgcccacccctggccagg

SEQ ID NO: 393324 - DNA, 25 bp, Artificial Sequence
  Description of Artificial Sequence: Synthetic oligonucleotide
agaaatgcccacccctggccaggca

SEQ ID NO: 393325 - DNA, 24 bp, Artificial Sequence
  Description of Artificial Sequence: Synthetic oligonucleotide
gaaatgcccacccctggccaggca

SEQ ID NO: 393326 - DNA, 24 bp, Artificial Sequence
  Description of Artificial Sequence: Synthetic oligonucleotide
aaatgcccacccctggccaggcac

SEQ ID NO: 393327 - DNA, 23 bp, Artificial Sequence
  Description of Artificial Sequence: Synthetic oligonucleotide
aatgcccacccctggccaggcac

SEQ ID NO: 393328 - DNA, 22 bp, Artificial Sequence
  Description of Artificial Sequence: Synthetic oligonucleotide
atgcccacccctggccaggcac

SEQ ID NO: 393329 - DNA, 21 bp, Artificial Sequence
  Description of Artificial Sequence: Synthetic oligonucleotide
tgcccacccctggccaggcac

SEQ ID NO: 393330 - DNA, 20 bp, Artificial Sequence
  Description of Artificial Sequence: Synthetic oligonucleotide
gcccacccctggccaggcac

SEQ ID NO: 393331 - DNA, 20 bp, Artificial Sequence
  Description of Artificial Sequence: Synthetic oligonucleotide
cccacccctggccaggcacg

SEQ ID NO: 393332 - DNA, 21 bp, Artificial Sequence
  Description of Artificial Sequence: Synthetic oligonucleotide
ccacccctggccaggcacggt

SEQ ID NO: 393333 - DNA, 21 bp, Artificial Sequence
  Description of Artificial Sequence: Synthetic oligonucleotide
cacccctggccaggcacggtg

SEQ ID NO: 393334 - DNA, 21 bp, Artificial Sequence
  Description of Artificial Sequence: Synthetic oligonucleotide
acccctggccaggcacggtgg

SEQ ID NO: 393335 - DNA, 20 bp, Artificial Sequence
  Description of Artificial Sequence: Synthetic oligonucleotide
cccctggccaggcacggtgg

SEQ ID NO: 393336 - DNA, 21 bp, Artificial Sequence
  Description of Artificial Sequence: Synthetic oligonucleotide
ccctggccaggcacggtggct

SEQ ID NO: 393337 - DNA, 23 bp, Artificial Sequence
  Description of Artificial Sequence: Synthetic oligonucleotide
cctggccaggcacggtggctcat

SEQ ID NO: 393338 - DNA, 23 bp, Artificial Sequence
  Description of Artificial Sequence: Synthetic oligonucleotide
ctggccaggcacggtggctcatg

SEQ ID NO: 393339 - DNA, 23 bp, Artificial Sequence
  Description of Artificial Sequence: Synthetic oligonucleotide
tggccaggcacggtggctcatgc

SEQ ID NO: 393340 - DNA, 22 bp, Artificial Sequence
  Description of Artificial Sequence: Synthetic oligonucleotide
ggccaggcacggtggctcatgc

SEQ ID NO: 393341 - DNA, 23 bp, Artificial Sequence
  Description of Artificial Sequence: Synthetic oligonucleotide
gccaggcacggtggctcatgcct

SEQ ID NO: 393342 - DNA, 27 bp, Artificial Sequence
  Description of Artificial Sequence: Synthetic oligonucleotide
ccaggcacggtggctcatgcctgtaat

SEQ ID NO: 393343 - DNA, 27 bp, Artificial Sequence
  Description of Artificial Sequence: Synthetic oligonucleotide
caggcacggtggctcatgcctgtaatc

SEQ ID NO: 393344 - DNA, 28 bp, Artificial Sequence
  Description of Artificial Sequence: Synthetic oligonucleotide
aggcacggtggctcatgcctgtaatctg

SEQ ID NO: 393345 - DNA, 27 bp, Artificial Sequence
  Description of Artificial Sequence: Synthetic oligonucleotide
ggcacggtggctcatgcctgtaatctg

SEQ ID NO: 393346 - DNA, 28 bp, Artificial Sequence
  Description of Artificial Sequence: Synthetic oligonucleotide
gcacggtggctcatgcctgtaatctgag

SEQ ID NO: 393347 - DNA, 28 bp, Artificial Sequence
  Description of Artificial Sequence: Synthetic oligonucleotide
cacggtggctcatgcctgtaatctgagc

SEQ ID NO: 393348 - DNA, 29 bp, Artificial Sequence
  Description of Artificial Sequence: Synthetic oligonucleotide
acggtggctcatgcctgtaatctgagcac

SEQ ID NO: 393349 - DNA, 28 bp, Artificial Sequence
  Description of Artificial Sequence: Synthetic oligonucleotide
cggtggctcatgcctgtaatctgagcac

SEQ ID NO: 393350 - DNA, 31 bp, Artificial Sequence
  Description of Artificial Sequence: Synthetic oligonucleotide
ggtggctcatgcctgtaatctgagcactttg

SEQ ID NO: 393351 - DNA, 31 bp, Artificial Sequence
  Description of Artificial Sequence: Synthetic oligonucleotide
gtggctcatgcctgtaatctgagcactttgg

SEQ ID NO: 393352 - DNA, 31 bp, Artificial Sequence
  Description of Artificial Sequence: Synthetic oligonucleotide
tggctcatgcctgtaatctgagcactttggg

SEQ ID NO: 393353 - DNA, 30 bp, Artificial Sequence
  Description of Artificial Sequence: Synthetic oligonucleotide
ggctcatgcctgtaatctgagcactttggg

SEQ ID NO: 393354 - DNA, 31 bp, Artificial Sequence
  Description of Artificial Sequence: Synthetic oligonucleotide
gctcatgcctgtaatctgagcactttgggag

SEQ ID NO: 393355 - DNA, 31 bp, Artificial Sequence
  Description of Artificial Sequence: Synthetic oligonucleotide
ctcatgcctgtaatctgagcactttgggagg

SEQ ID NO: 393356 - DNA, 31 bp, Artificial Sequence
  Description of Artificial Sequence: Synthetic oligonucleotide
tcatgcctgtaatctgagcactttgggaggc

SEQ ID NO: 393357 - DNA, 30 bp, Artificial Sequence
  Description of Artificial Sequence: Synthetic oligonucleotide
catgcctgtaatctgagcactttgggaggc

SEQ ID NO: 393358 - DNA, 31 bp, Artificial Sequence
  Description of Artificial Sequence: Synthetic oligonucleotide
atgcctgtaatctgagcactttgggaggctg

SEQ ID NO: 393359 - DNA, 30 bp, Artificial Sequence
  Description of Artificial Sequence: Synthetic oligonucleotide
tgcctgtaatctgagcactttgggaggctg

SEQ ID NO: 393360 - DNA, 29 bp, Artificial Sequence
  Description of Artificial Sequence: Synthetic oligonucleotide
gcctgtaatctgagcactttgggaggctg

SEQ ID NO: 393361 - DNA, 30 bp, Artificial Sequence
  Description of Artificial Sequence: Synthetic oligonucleotide
cctgtaatctgagcactttgggaggctgag

SEQ ID NO: 393362 - DNA, 31 bp, Artificial Sequence
  Description of Artificial Sequence: Synthetic oligonucleotide
ctgtaatctgagcactttgggaggctgagac

SEQ ID NO: 393363 - DNA, 31 bp, Artificial Sequence
  Description of Artificial Sequence: Synthetic oligonucleotide
tgtaatctgagcactttgggaggctgagacg

SEQ ID NO: 393364 - DNA, 30 bp, Artificial Sequence
  Description of Artificial Sequence: Synthetic oligonucleotide
gtaatctgagcactttgggaggctgagacg

SEQ ID NO: 393365 - DNA, 30 bp, Artificial Sequence
  Description of Artificial Sequence: Synthetic oligonucleotide
taatctgagcactttgggaggctgagacgg

SEQ ID NO: 393366 - DNA, 29 bp, Artificial Sequence
  Description of Artificial Sequence: Synthetic oligonucleotide
aatctgagcactttgggaggctgagacgg

SEQ ID NO: 393367 - DNA, 28 bp, Artificial Sequence
  Description of Artificial Sequence: Synthetic oligonucleotide
atctgagcactttgggaggctgagacgg

SEQ ID NO: 393368 - DNA, 27 bp, Artificial Sequence
  Description of Artificial Sequence: Synthetic oligonucleotide
tctgagcactttgggaggctgagacgg

SEQ ID NO: 393369 - DNA, 26 bp, Artificial Sequence
  Description of Artificial Sequence: Synthetic oligonucleotide
ctgagcactttgggaggctgagacgg

SEQ ID NO: 393370 - DNA, 26 bp, Artificial Sequence
  Description of Artificial Sequence: Synthetic oligonucleotide
tgagcactttgggaggctgagacggg

SEQ ID NO: 393371 - DNA, 25 bp, Artificial Sequence
  Description of Artificial Sequence: Synthetic oligonucleotide
gagcactttgggaggctgagacggg

SEQ ID NO: 393372 - DNA, 26 bp, Artificial Sequence
  Description of Artificial Sequence: Synthetic oligonucleotide
agcactttgggaggctgagacgggca

SEQ ID NO: 393373 - DNA, 25 bp, Artificial Sequence
  Description of Artificial Sequence: Synthetic oligonucleotide
gcactttgggaggctgagacgggca

SEQ ID NO: 393374 - DNA, 27 bp, Artificial Sequence
  Description of Artificial Sequence: Synthetic oligonucleotide
cactttgggaggctgagacgggcagat

SEQ ID NO: 393375 - DNA, 27 bp, Artificial Sequence
  Description of Artificial Sequence: Synthetic oligonucleotide
actttgggaggctgagacgggcagatc

SEQ ID NO: 393376 - DNA, 27 bp, Artificial Sequence
  Description of Artificial Sequence: Synthetic oligonucleotide
ctttgggaggctgagacgggcagatca

SEQ ID NO: 393377 - DNA, 28 bp, Artificial Sequence
  Description of Artificial Sequence: Synthetic oligonucleotide
tttgggaggctgagacgggcagatcatg

SEQ ID NO: 393378 - DNA, 27 bp, Artificial Sequence
  Description of Artificial Sequence: Synthetic oligonucleotide
ttgggaggctgagacgggcagatcatg

SEQ ID NO: 393379 - DNA, 27 bp, Artificial Sequence
  Description of Artificial Sequence: Synthetic oligonucleotide
tgggaggctgagacgggcagatcatga

SEQ ID NO: 393380 - DNA, 26 bp, Artificial Sequence
  Description of Artificial Sequence: Synthetic oligonucleotide
gggaggctgagacgggcagatcatga

SEQ ID NO: 393381 - DNA, 26 bp, Artificial Sequence
  Description of Artificial Sequence: Synthetic oligonucleotide
ggaggctgagacgggcagatcatgag

SEQ ID NO: 393382 - DNA, 27 bp, Artificial Sequence
  Description of Artificial Sequence: Synthetic oligonucleotide
gaggctgagacgggcagatcatgaggt

SEQ ID NO: 393383 - DNA, 27 bp, Artificial Sequence
  Description of Artificial Sequence: Synthetic oligonucleotide
aggctgagacgggcagatcatgaggtc

SEQ ID NO: 393384 - DNA, 27 bp, Artificial Sequence
  Description of Artificial Sequence: Synthetic oligonucleotide
ggctgagacgggcagatcatgaggtca

SEQ ID NO: 393385 - DNA, 27 bp, Artificial Sequence
  Description of Artificial Sequence: Synthetic oligonucleotide
gctgagacgggcagatcatgaggtcag

SEQ ID NO: 393386 - DNA, 27 bp, Artificial Sequence
  Description of Artificial Sequence: Synthetic oligonucleotide
ctgagacgggcagatcatgaggtcagg

SEQ ID NO: 393387 - DNA, 28 bp, Artificial Sequence
  Description of Artificial Sequence: Synthetic oligonucleotide
tgagacgggcagatcatgaggtcaggag

SEQ ID NO: 393388 - DNA, 27 bp, Artificial Sequence
  Description of Artificial Sequence: Synthetic oligonucleotide
gagacgggcagatcatgaggtcaggag

SEQ ID NO: 393389 - DNA, 29 bp, Artificial Sequence
  Description of Artificial Sequence: Synthetic oligonucleotide
agacgggcagatcatgaggtcaggagttc

SEQ ID NO: 393390 - DNA, 28 bp, Artificial Sequence
  Description of Artificial Sequence: Synthetic oligonucleotide
gacgggcagatcatgaggtcaggagttc

SEQ ID NO: 393391 - DNA, 30 bp, Artificial Sequence
  Description of Artificial Sequence: Synthetic oligonucleotide
acgggcagatcatgaggtcaggagttcaag

SEQ ID NO: 393392 - DNA, 29 bp, Artificial Sequence
  Description of Artificial Sequence: Synthetic oligonucleotide
cgggcagatcatgaggtcaggagttcaag

SEQ ID NO: 393393 - DNA, 30 bp, Artificial Sequence
  Description of Artificial Sequence: Synthetic oligonucleotide
gggcagatcatgaggtcaggagttcaagac

SEQ ID NO: 393394 - DNA, 30 bp, Artificial Sequence
  Description of Artificial Sequence: Synthetic oligonucleotide
ggcagatcatgaggtcaggagttcaagacc

SEQ ID NO: 393395 - DNA, 31 bp, Artificial Sequence
  Description of Artificial Sequence: Synthetic oligonucleotide
gcagatcatgaggtcaggagttcaagaccag

SEQ ID NO: 393396 - DNA, 31 bp, Artificial Sequence
  Description of Artificial Sequence: Synthetic oligonucleotide
cagatcatgaggtcaggagttcaagaccagc

SEQ ID NO: 393397 - DNA, 31 bp, Artificial Sequence
  Description of Artificial Sequence: Synthetic oligonucleotide
agatcatgaggtcaggagttcaagaccagcg

SEQ ID NO: 393398 - DNA, 30 bp, Artificial Sequence
  Description of Artificial Sequence: Synthetic oligonucleotide
gatcatgaggtcaggagttcaagaccagcg

SEQ ID NO: 393399 - DNA, 31 bp, Artificial Sequence
  Description of Artificial Sequence: Synthetic oligonucleotide
atcatgaggtcaggagttcaagaccagcgtg

SEQ ID NO: 393400 - DNA, 30 bp, Artificial Sequence
  Description of Artificial Sequence: Synthetic oligonucleotide
tcatgaggtcaggagttcaagaccagcgtg

SEQ ID NO: 393401 - DNA, 29 bp, Artificial Sequence
  Description of Artificial Sequence: Synthetic oligonucleotide
catgaggtcaggagttcaagaccagcgtg

SEQ ID NO: 393402 - DNA, 29 bp, Artificial Sequence
  Description of Artificial Sequence: Synthetic oligonucleotide
atgaggtcaggagttcaagaccagcgtgg

SEQ ID NO: 393403 - DNA, 28 bp, Artificial Sequence
  Description of Artificial Sequence: Synthetic oligonucleotide
tgaggtcaggagttcaagaccagcgtgg

SEQ ID NO: 393404 - DNA, 27 bp, Artificial Sequence
  Description of Artificial Sequence: Synthetic oligonucleotide
gaggtcaggagttcaagaccagcgtgg

SEQ ID NO: 393405 - DNA, 27 bp, Artificial Sequence
  Description of Artificial Sequence: Synthetic oligonucleotide
aggtcaggagttcaagaccagcgtggc

SEQ ID NO: 393406 - DNA, 26 bp, Artificial Sequence
  Description of Artificial Sequence: Synthetic oligonucleotide
ggtcaggagttcaagaccagcgtggc

SEQ ID NO: 393407 - DNA, 27 bp, Artificial Sequence
  Description of Artificial Sequence: Synthetic oligonucleotide
gtcaggagttcaagaccagcgtggcca

SEQ ID NO: 393408 - DNA, 28 bp, Artificial Sequence
  Description of Artificial Sequence: Synthetic oligonucleotide
tcaggagttcaagaccagcgtggccaac

SEQ ID NO: 393409 - DNA, 27 bp, Artificial Sequence
  Description of Artificial Sequence: Synthetic oligonucleotide
caggagttcaagaccagcgtggccaac

SEQ ID NO: 393410 - DNA, 30 bp, Artificial Sequence
  Description of Artificial Sequence: Synthetic oligonucleotide
aggagttcaagaccagcgtggccaacatag

SEQ ID NO: 393411 - DNA, 29 bp, Artificial Sequence
  Description of Artificial Sequence: Synthetic oligonucleotide
ggagttcaagaccagcgtggccaacatag

SEQ ID NO: 393412 - DNA, 30 bp, Artificial Sequence
  Description of Artificial Sequence: Synthetic oligonucleotide
gagttcaagaccagcgtggccaacatagtg

SEQ ID NO: 393413 - DNA, 33 bp, Artificial Sequence
  Description of Artificial Sequence: Synthetic oligonucleotide
agttcaagaccagcgtggccaacatagtgaaac

SEQ ID NO: 393414 - DNA, 32 bp, Artificial Sequence
  Description of Artificial Sequence: Synthetic oligonucleotide
gttcaagaccagcgtggccaacatagtgaaac

SEQ ID NO: 393415 - DNA, 32 bp, Artificial Sequence
  Description of Artificial Sequence: Synthetic oligonucleotide
ttcaagaccagcgtggccaacatagtgaaacc

SEQ ID NO: 393416 - DNA, 31 bp, Artificial Sequence
  Description of Artificial Sequence: Synthetic oligonucleotide
tcaagaccagcgtggccaacatagtgaaacc

SEQ ID NO: 393417 - DNA, 30 bp, Artificial Sequence
  Description of Artificial Sequence: Synthetic oligonucleotide
caagaccagcgtggccaacatagtgaaacc

SEQ ID NO: 393418 - DNA, 30 bp, Artificial Sequence
  Description of Artificial Sequence: Synthetic oligonucleotide
aagaccagcgtggccaacatagtgaaaccc

SEQ ID NO: 393419 - DNA, 29 bp, Artificial Sequence
  Description of Artificial Sequence: Synthetic oligonucleotide
agaccagcgtggccaacatagtgaaaccc

SEQ ID NO: 393420 - DNA, 28 bp, Artificial Sequence
  Description of Artificial Sequence: Synthetic oligonucleotide
gaccagcgtggccaacatagtgaaaccc

SEQ ID NO: 393421 - DNA, 28 bp, Artificial Sequence
  Description of Artificial Sequence: Synthetic oligonucleotide
accagcgtggccaacatagtgaaacccc

SEQ ID NO: 393422 - DNA, 27 bp, Artificial Sequence
  Description of Artificial Sequence: Synthetic oligonucleotide
ccagcgtggccaacatagtgaaacccc

SEQ ID NO: 393423 - DNA, 27 bp, Artificial Sequence
  Description of Artificial Sequence: Synthetic oligonucleotide
cagcgtggccaacatagtgaaaccccg

SEQ ID NO: 393424 - DNA, 28 bp, Artificial Sequence
  Description of Artificial Sequence: Synthetic oligonucleotide
agcgtggccaacatagtgaaaccccgtc

SEQ ID NO: 393425 - DNA, 27 bp, Artificial Sequence
  Description of Artificial Sequence: Synthetic oligonucleotide
gcgtggccaacatagtgaaaccccgtc

SEQ ID NO: 393426 - DNA, 28 bp, Artificial Sequence
  Description of Artificial Sequence: Synthetic oligonucleotide
cgtggccaacatagtgaaaccccgtctc

SEQ ID NO: 393427 - DNA, 30 bp, Artificial Sequence
  Description of Artificial Sequence: Synthetic oligonucleotide
gtggccaacatagtgaaaccccgtctctac

SEQ ID NO: 393428 - DNA, 38 bp, Artificial Sequence
  Description of Artificial Sequence: Synthetic oligonucleotide
tggccaacatagtgaaaccccgtctctactaaaaatac

SEQ ID NO: 393429 - DNA, 37 bp, Artificial Sequence
  Description of Artificial Sequence: Synthetic oligonucleotide
ggccaacatagtgaaaccccgtctctactaaaaatac

SEQ ID NO: 393430 - DNA, 45 bp, Artificial Sequence
  Description of Artificial Sequence: Synthetic oligonucleotide
gccaacatagtgaaaccccgtctctactaaaaatacaaaaattag

SEQ ID NO: 393431 - DNA, 45 bp, Artificial Sequence
  Description of Artificial Sequence: Synthetic oligonucleotide
ccaacatagtgaaaccccgtctctactaaaaatacaaaaattagc

SEQ ID NO: 393432 - DNA, 46 bp, Artificial Sequence
  Description of Artificial Sequence: Synthetic oligonucleotide
caacatagtgaaaccccgtctctactaaaaatacaaaaattagctg

SEQ ID NO: 393433 - DNA, 46 bp, Artificial Sequence
  Description of Artificial Sequence: Synthetic oligonucleotide
aacatagtgaaaccccgtctctactaaaaatacaaaaattagctgg

SEQ ID NO: 393434 - DNA, 45 bp, Artificial Sequence
  Description of Artificial Sequence: Synthetic oligonucleotide
acatagtgaaaccccgtctctactaaaaatacaaaaattagctgg

SEQ ID NO: 393435 - DNA, 44 bp, Artificial Sequence
  Description of Artificial Sequence: Synthetic oligonucleotide
catagtgaaaccccgtctctactaaaaatacaaaaattagctgg

SEQ ID NO: 393436 - DNA, 44 bp, Artificial Sequence
  Description of Artificial Sequence: Synthetic oligonucleotide
atagtgaaaccccgtctctactaaaaatacaaaaattagctggg

SEQ ID NO: 393437 - DNA, 43 bp, Artificial Sequence
  Description of Artificial Sequence: Synthetic oligonucleotide
tagtgaaaccccgtctctactaaaaatacaaaaattagctggg

SEQ ID NO: 393438 - DNA, 42 bp, Artificial Sequence
  Description of Artificial Sequence: Synthetic oligonucleotide
agtgaaaccccgtctctactaaaaatacaaaaattagctggg

SEQ ID NO: 393439 - DNA, 41 bp, Artificial Sequence
  Description of Artificial Sequence: Synthetic oligonucleotide
gtgaaaccccgtctctactaaaaatacaaaaattagctggg

SEQ ID NO: 393440 - DNA, 41 bp, Artificial Sequence
  Description of Artificial Sequence: Synthetic oligonucleotide
tgaaaccccgtctctactaaaaatacaaaaattagctgggc

SEQ ID NO: 393441 - DNA, 40 bp, Artificial Sequence
  Description of Artificial Sequence: Synthetic oligonucleotide
gaaaccccgtctctactaaaaatacaaaaattagctgggc

SEQ ID NO: 393442 - DNA, 40 bp, Artificial Sequence
  Description of Artificial Sequence: Synthetic oligonucleotide
aaaccccgtctctactaaaaatacaaaaattagctgggcg

SEQ ID NO: 393443 - DNA, 39 bp, Artificial Sequence
  Description of Artificial Sequence: Synthetic oligonucleotide
aaccccgtctctactaaaaatacaaaaattagctgggcg

SEQ ID NO: 393444 - DNA, 38 bp, Artificial Sequence
  Description of Artificial Sequence: Synthetic oligonucleotide
accccgtctctactaaaaatacaaaaattagctgggcg

SEQ ID NO: 393445 - DNA, 37 bp, Artificial Sequence
  Description of Artificial Sequence: Synthetic oligonucleotide
ccccgtctctactaaaaatacaaaaattagctgggcg

SEQ ID NO: 393446 - DNA, 38 bp, Artificial Sequence
  Description of Artificial Sequence: Synthetic oligonucleotide
cccgtctctactaaaaatacaaaaattagctgggcgtg

SEQ ID NO: 393447 - DNA, 38 bp, Artificial Sequence
  Description of Artificial Sequence: Synthetic oligonucleotide
ccgtctctactaaaaatacaaaaattagctgggcgtgg

SEQ ID NO: 393448 - DNA, 39 bp, Artificial Sequence
  Description of Artificial Sequence: Synthetic oligonucleotide
cgtctctactaaaaatacaaaaattagctgggcgtggtg

SEQ ID NO: 393449 - DNA, 39 bp, Artificial Sequence
  Description of Artificial Sequence: Synthetic oligonucleotide
gtctctactaaaaatacaaaaattagctgggcgtggtgg

SEQ ID NO: 393450 - DNA, 39 bp, Artificial Sequence
  Description of Artificial Sequence: Synthetic oligonucleotide
tctctactaaaaatacaaaaattagctgggcgtggtggc

SEQ ID NO: 393451 - DNA, 38 bp, Artificial Sequence
  Description of Artificial Sequence: Synthetic oligonucleotide
ctctactaaaaatacaaaaattagctgggcgtggtggc

SEQ ID NO: 393452 - DNA, 39 bp, Artificial Sequence
  Description of Artificial Sequence: Synthetic oligonucleotide
tctactaaaaatacaaaaattagctgggcgtggtggcag

SEQ ID NO: 393453 - DNA, 38 bp, Artificial Sequence
  Description of Artificial Sequence: Synthetic oligonucleotide
ctactaaaaatacaaaaattagctgggcgtggtggcag

SEQ ID NO: 393454 - DNA, 38 bp, Artificial Sequence
  Description of Artificial Sequence: Synthetic oligonucleotide
tactaaaaatacaaaaattagctgggcgtggtggcagg

SEQ ID NO: 393455 - DNA, 37 bp, Artificial Sequence
  Description of Artificial Sequence: Synthetic oligonucleotide
actaaaaatacaaaaattagctgggcgtggtggcagg

SEQ ID NO: 393456 - DNA, 36 bp, Artificial Sequence
  Description of Artificial Sequence: Synthetic oligonucleotide
ctaaaaatacaaaaattagctgggcgtggtggcagg

SEQ ID NO: 393457 - DNA, 37 bp, Artificial Sequence
  Description of Artificial Sequence: Synthetic oligonucleotide
taaaaatacaaaaattagctgggcgtggtggcaggtg

SEQ ID NO: 393458 - DNA, 36 bp, Artificial Sequence
  Description of Artificial Sequence: Synthetic oligonucleotide
aaaaatacaaaaattagctgggcgtggtggcaggtg

SEQ ID NO: 393459 - DNA, 35 bp, Artificial Sequence
  Description of Artificial Sequence: Synthetic oligonucleotide
aaaatacaaaaattagctgggcgtggtggcaggtg

SEQ ID NO: 393460 - DNA, 34 bp, Artificial Sequence
  Description of Artificial Sequence: Synthetic oligonucleotide
aaatacaaaaattagctgggcgtggtggcaggtg

SEQ ID NO: 393461 - DNA, 33 bp, Artificial Sequence
  Description of Artificial Sequence: Synthetic oligonucleotide
aatacaaaaattagctgggcgtggtggcaggtg

SEQ ID NO: 393462 - DNA, 32 bp, Artificial Sequence
  Description of Artificial Sequence: Synthetic oligonucleotide
atacaaaaattagctgggcgtggtggcaggtg

SEQ ID NO: 393463 - DNA, 31 bp, Artificial Sequence
  Description of Artificial Sequence: Synthetic oligonucleotide
tacaaaaattagctgggcgtggtggcaggtg

SEQ ID NO: 393464 - DNA, 30 bp, Artificial Sequence
  Description of Artificial Sequence: Synthetic oligonucleotide
acaaaaattagctgggcgtggtggcaggtg

SEQ ID NO: 393465 - DNA, 29 bp, Artificial Sequence
  Description of Artificial Sequence: Synthetic oligonucleotide
caaaaattagctgggcgtggtggcaggtg

SEQ ID NO: 393466 - DNA, 29 bp, Artificial Sequence
  Description of Artificial Sequence: Synthetic oligonucleotide
aaaaattagctgggcgtggtggcaggtgc

SEQ ID NO: 393467 - DNA, 28 bp, Artificial Sequence
  Description of Artificial Sequence: Synthetic oligonucleotide
aaaattagctgggcgtggtggcaggtgc

SEQ ID NO: 393468 - DNA, 27 bp, Artificial Sequence
  Description of Artificial Sequence: Synthetic oligonucleotide
aaattagctgggcgtggtggcaggtgc

SEQ ID NO: 393469 - DNA, 26 bp, Artificial Sequence
  Description of Artificial Sequence: Synthetic oligonucleotide
aattagctgggcgtggtggcaggtgc

SEQ ID NO: 393470 - DNA, 25 bp, Artificial Sequence
  Description of Artificial Sequence: Synthetic oligonucleotide
attagctgggcgtggtggcaggtgc

SEQ ID NO: 393471 - DNA, 24 bp, Artificial Sequence
  Description of Artificial Sequence: Synthetic oligonucleotide
ttagctgggcgtggtggcaggtgc

SEQ ID NO: 393472 - DNA, 23 bp, Artificial Sequence
  Description of Artificial Sequence: Synthetic oligonucleotide
tagctgggcgtggtggcaggtgc

SEQ ID NO: 393473 - DNA, 22 bp, Artificial Sequence
  Description of Artificial Sequence: Synthetic oligonucleotide
agctgggcgtggtggcaggtgc

SEQ ID NO: 393474 - DNA, 21 bp, Artificial Sequence
  Description of Artificial Sequence: Synthetic oligonucleotide
gctgggcgtggtggcaggtgc

SEQ ID NO: 393475 - DNA, 22 bp, Artificial Sequence
  Description of Artificial Sequence: Synthetic oligonucleotide
ctgggcgtggtggcaggtgcct

SEQ ID NO: 393476 - DNA, 24 bp, Artificial Sequence
  Description of Artificial Sequence: Synthetic oligonucleotide
tgggcgtggtggcaggtgcctgta

SEQ ID NO: 393477 - DNA, 23 bp, Artificial Sequence
  Description of Artificial Sequence: Synthetic oligonucleotide
gggcgtggtggcaggtgcctgta

SEQ ID NO: 393478 - DNA, 24 bp, Artificial Sequence
  Description of Artificial Sequence: Synthetic oligonucleotide
ggcgtggtggcaggtgcctgtagt

SEQ ID NO: 393479 - DNA, 24 bp, Artificial Sequence
  Description of Artificial Sequence: Synthetic oligonucleotide
gcgtggtggcaggtgcctgtagtc

SEQ ID NO: 393480 - DNA, 24 bp, Artificial Sequence
  Description of Artificial Sequence: Synthetic oligonucleotide
cgtggtggcaggtgcctgtagtcc

SEQ ID NO: 393481 - DNA, 25 bp, Artificial Sequence
  Description of Artificial Sequence: Synthetic oligonucleotide
gtggtggcaggtgcctgtagtccca

SEQ ID NO: 393482 - DNA, 25 bp, Artificial Sequence
  Description of Artificial Sequence: Synthetic oligonucleotide
tggtggcaggtgcctgtagtcccag

SEQ ID NO: 393483 - DNA, 24 bp, Artificial Sequence
  Description of Artificial Sequence: Synthetic oligonucleotide
ggtggcaggtgcctgtagtcccag

SEQ ID NO: 393484 - DNA, 26 bp, Artificial Sequence
  Description of Artificial Sequence: Synthetic oligonucleotide
gtggcaggtgcctgtagtcccagcta

SEQ ID NO: 393485 - DNA, 27 bp, Artificial Sequence
  Description of Artificial Sequence: Synthetic oligonucleotide
tggcaggtgcctgtagtcccagctact

SEQ ID NO: 393486 - DNA, 27 bp, Artificial Sequence
  Description of Artificial Sequence: Synthetic oligonucleotide
ggcaggtgcctgtagtcccagctactt

SEQ ID NO: 393487 - DNA, 27 bp, Artificial Sequence
  Description of Artificial Sequence: Synthetic oligonucleotide
gcaggtgcctgtagtcccagctacttg

SEQ ID NO: 393488 - DNA, 27 bp, Artificial Sequence
  Description of Artificial Sequence: Synthetic oligonucleotide
caggtgcctgtagtcccagctacttgg

SEQ ID NO: 393489 - DNA, 27 bp, Artificial Sequence
  Description of Artificial Sequence: Synthetic oligonucleotide
aggtgcctgtagtcccagctacttggg

SEQ ID NO: 393490 - DNA, 27 bp, Artificial Sequence
  Description of Artificial Sequence: Synthetic oligonucleotide
ggtgcctgtagtcccagctacttggga

SEQ ID NO: 393491 - DNA, 27 bp, Artificial Sequence
  Description of Artificial Sequence: Synthetic oligonucleotide
gtgcctgtagtcccagctacttgggag

SEQ ID NO: 393492 - DNA, 27 bp, Artificial Sequence
  Description of Artificial Sequence: Synthetic oligonucleotide
tgcctgtagtcccagctacttgggagg

SEQ ID NO: 393493 - DNA, 26 bp, Artificial Sequence
  Description of Artificial Sequence: Synthetic oligonucleotide
gcctgtagtcccagctacttgggagg

SEQ ID NO: 393494 - DNA, 27 bp, Artificial Sequence
  Description of Artificial Sequence: Synthetic oligonucleotide
cctgtagtcccagctacttgggagggt

SEQ ID NO: 393495 - DNA, 27 bp, Artificial Sequence
  Description of Artificial Sequence: Synthetic oligonucleotide
ctgtagtcccagctacttgggagggtg

SEQ ID NO: 393496 - DNA, 28 bp, Artificial Sequence
  Description of Artificial Sequence: Synthetic oligonucleotide
tgtagtcccagctacttgggagggtgag

SEQ ID NO: 393497 - DNA, 27 bp, Artificial Sequence
  Description of Artificial Sequence: Synthetic oligonucleotide
gtagtcccagctacttgggagggtgag

SEQ ID NO: 393498 - DNA, 27 bp, Artificial Sequence
  Description of Artificial Sequence: Synthetic oligonucleotide
tagtcccagctacttgggagggtgagg

SEQ ID NO: 393499 - DNA, 26 bp, Artificial Sequence
  Description of Artificial Sequence: Synthetic oligonucleotide
agtcccagctacttgggagggtgagg

SEQ ID NO: 393500 - DNA, 25 bp, Artificial Sequence
  Description of Artificial Sequence: Synthetic oligonucleotide
gtcccagctacttgggagggtgagg

SEQ ID NO: 393501 - DNA, 26 bp, Artificial Sequence
  Description of Artificial Sequence: Synthetic oligonucleotide
tcccagctacttgggagggtgaggga

SEQ ID NO: 393502 - DNA, 25 bp, Artificial Sequence
  Description of Artificial Sequence: Synthetic oligonucleotide
cccagctacttgggagggtgaggga

SEQ ID NO: 393503 - DNA, 25 bp, Artificial Sequence
  Description of Artificial Sequence: Synthetic oligonucleotide
ccagctacttgggagggtgagggag

SEQ ID NO: 393504 - DNA, 26 bp, Artificial Sequence
  Description of Artificial Sequence: Synthetic oligonucleotide
cagctacttgggagggtgagggagga

SEQ ID NO: 393505 - DNA, 27 bp, Artificial Sequence
  Description of Artificial Sequence: Synthetic oligonucleotide
agctacttgggagggtgagggaggaga

SEQ ID NO: 393506 - DNA, 27 bp, Artificial Sequence
  Description of Artificial Sequence: Synthetic oligonucleotide
gctacttgggagggtgagggaggagaa

SEQ ID NO: 393507 - DNA, 28 bp, Artificial Sequence
  Description of Artificial Sequence: Synthetic oligonucleotide
ctacttgggagggtgagggaggagaatc

SEQ ID NO: 393508 - DNA, 28 bp, Artificial Sequence
  Description of Artificial Sequence: Synthetic oligonucleotide
tacttgggagggtgagggaggagaatcg

SEQ ID NO: 393509 - DNA, 27 bp, Artificial Sequence
  Description of Artificial Sequence: Synthetic oligonucleotide
acttgggagggtgagggaggagaatcg

SEQ ID NO: 393510 - DNA, 26 bp, Artificial Sequence
  Description of Artificial Sequence: Synthetic oligonucleotide
cttgggagggtgagggaggagaatcg

SEQ ID NO: 393511 - DNA, 27 bp, Artificial Sequence
  Description of Artificial Sequence: Synthetic oligonucleotide
ttgggagggtgagggaggagaatcgct

SEQ ID NO: 393512 - DNA, 27 bp, Artificial Sequence
  Description of Artificial Sequence: Synthetic oligonucleotide
tgggagggtgagggaggagaatcgctt

SEQ ID NO: 393513 - DNA, 26 bp, Artificial Sequence
  Description of Artificial Sequence: Synthetic oligonucleotide
gggagggtgagggaggagaatcgctt

SEQ ID NO: 393514 - DNA, 27 bp, Artificial Sequence
  Description of Artificial Sequence: Synthetic oligonucleotide
ggagggtgagggaggagaatcgcttga

SEQ ID NO: 393515 - DNA, 29 bp, Artificial Sequence
  Description of Artificial Sequence: Synthetic oligonucleotide
gagggtgagggaggagaatcgcttgaatc

SEQ ID NO: 393516 - DNA, 29 bp, Artificial Sequence
  Description of Artificial Sequence: Synthetic oligonucleotide
agggtgagggaggagaatcgcttgaatcc

SEQ ID NO: 393517 - DNA, 28 bp, Artificial Sequence
  Description of Artificial Sequence: Synthetic oligonucleotide
gggtgagggaggagaatcgcttgaatcc

SEQ ID NO: 393518 - DNA, 28 bp, Artificial Sequence
  Description of Artificial Sequence: Synthetic oligonucleotide
ggtgagggaggagaatcgcttgaatccg

SEQ ID NO: 393519 - DNA, 28 bp, Artificial Sequence
  Description of Artificial Sequence: Synthetic oligonucleotide
gtgagggaggagaatcgcttgaatccgg

SEQ ID NO: 393520 - DNA, 28 bp, Artificial Sequence
  Description of Artificial Sequence: Synthetic oligonucleotide
tgagggaggagaatcgcttgaatccggg

SEQ ID NO: 393521 - DNA, 27 bp, Artificial Sequence
  Description of Artificial Sequence: Synthetic oligonucleotide
gagggaggagaatcgcttgaatccggg

SEQ ID NO: 393522 - DNA, 28 bp, Artificial Sequence
  Description of Artificial Sequence: Synthetic oligonucleotide
agggaggagaatcgcttgaatccgggag

SEQ ID NO: 393523 - DNA, 27 bp, Artificial Sequence
  Description of Artificial Sequence: Synthetic oligonucleotide
gggaggagaatcgcttgaatccgggag

SEQ ID NO: 393524 - DNA, 27 bp, Artificial Sequence
  Description of Artificial Sequence: Synthetic oligonucleotide
ggaggagaatcgcttgaatccgggagg

SEQ ID NO: 393525 - DNA, 27 bp, Artificial Sequence
  Description of Artificial Sequence: Synthetic oligonucleotide
gaggagaatcgcttgaatccgggaggc

SEQ ID NO: 393526 - DNA, 30 bp, Artificial Sequence
  Description of Artificial Sequence: Synthetic oligonucleotide
aggagaatcgcttgaatccgggaggcaaag

SEQ ID NO: 393527 - DNA, 29 bp, Artificial Sequence
  Description of Artificial Sequence: Synthetic oligonucleotide
ggagaatcgcttgaatccgggaggcaaag

SEQ ID NO: 393528 - DNA, 29 bp, Artificial Sequence
  Description of Artificial Sequence: Synthetic oligonucleotide
gagaatcgcttgaatccgggaggcaaagg

SEQ ID NO: 393529 - DNA, 31 bp, Artificial Sequence
  Description of Artificial Sequence: Synthetic oligonucleotide
agaatcgcttgaatccgggaggcaaaggttg

SEQ ID NO: 393530 - DNA, 30 bp, Artificial Sequence
  Description of Artificial Sequence: Synthetic oligonucleotide
gaatcgcttgaatccgggaggcaaaggttg

SEQ ID NO: 393531 - DNA, 30 bp, Artificial Sequence
  Description of Artificial Sequence: Synthetic oligonucleotide
aatcgcttgaatccgggaggcaaaggttgc

SEQ ID NO: 393532 - DNA, 29 bp, Artificial Sequence
  Description of Artificial Sequence: Synthetic oligonucleotide
atcgcttgaatccgggaggcaaaggttgc

SEQ ID NO: 393533 - DNA, 28 bp, Artificial Sequence
  Description of Artificial Sequence: Synthetic oligonucleotide
tcgcttgaatccgggaggcaaaggttgc

SEQ ID NO: 393534 - DNA, 27 bp, Artificial Sequence
  Description of Artificial Sequence: Synthetic oligonucleotide
cgcttgaatccgggaggcaaaggttgc

SEQ ID NO: 393535 - DNA, 28 bp, Artificial Sequence
  Description of Artificial Sequence: Synthetic oligonucleotide
gcttgaatccgggaggcaaaggttgcag

SEQ ID NO: 393536 - DNA, 29 bp, Artificial Sequence
  Description of Artificial Sequence: Synthetic oligonucleotide
cttgaatccgggaggcaaaggttgcagtg

SEQ ID NO: 393537 - DNA, 30 bp, Artificial Sequence
  Description of Artificial Sequence: Synthetic oligonucleotide
ttgaatccgggaggcaaaggttgcagtgag

SEQ ID NO: 393538 - DNA, 29 bp, Artificial Sequence
  Description of Artificial Sequence: Synthetic oligonucleotide
tgaatccgggaggcaaaggttgcagtgag

SEQ ID NO: 393539 - DNA, 28 bp, Artificial Sequence
  Description of Artificial Sequence: Synthetic oligonucleotide
gaatccgggaggcaaaggttgcagtgag

SEQ ID NO: 393540 - DNA, 28 bp, Artificial Sequence
  Description of Artificial Sequence: Synthetic oligonucleotide
aatccgggaggcaaaggttgcagtgagc

SEQ ID NO: 393541 - DNA, 27 bp, Artificial Sequence
  Description of Artificial Sequence: Synthetic oligonucleotide
atccgggaggcaaaggttgcagtgagc

SEQ ID NO: 393542 - DNA, 26 bp, Artificial Sequence
  Description of Artificial Sequence: Synthetic oligonucleotide
tccgggaggcaaaggttgcagtgagc

SEQ ID NO: 393543 - DNA, 25 bp, Artificial Sequence
  Description of Artificial Sequence: Synthetic oligonucleotide
ccgggaggcaaaggttgcagtgagc

SEQ ID NO: 393544 - DNA, 25 bp, Artificial Sequence
  Description of Artificial Sequence: Synthetic oligonucleotide
cgggaggcaaaggttgcagtgagcc

SEQ ID NO: 393545 - DNA, 26 bp, Artificial Sequence
  Description of Artificial Sequence: Synthetic oligonucleotide
gggaggcaaaggttgcagtgagccga

SEQ ID NO: 393546 - DNA, 27 bp, Artificial Sequence
  Description of Artificial Sequence: Synthetic oligonucleotide
ggaggcaaaggttgcagtgagccgaga

SEQ ID NO: 393547 - DNA, 27 bp, Artificial Sequence
  Description of Artificial Sequence: Synthetic oligonucleotide
gaggcaaaggttgcagtgagccgagac

SEQ ID NO: 393548 - DNA, 27 bp, Artificial Sequence
  Description of Artificial Sequence: Synthetic oligonucleotide
aggcaaaggttgcagtgagccgagacc

SEQ ID NO: 393549 - DNA, 27 bp, Artificial Sequence
  Description of Artificial Sequence: Synthetic oligonucleotide
ggcaaaggttgcagtgagccgagacct

SEQ ID NO: 393550 - DNA, 28 bp, Artificial Sequence
  Description of Artificial Sequence: Synthetic oligonucleotide
gcaaaggttgcagtgagccgagaccttg

SEQ ID NO: 393551 - DNA, 28 bp, Artificial Sequence
  Description of Artificial Sequence: Synthetic oligonucleotide
caaaggttgcagtgagccgagaccttgc

SEQ ID NO: 393552 - DNA, 28 bp, Artificial Sequence
  Description of Artificial Sequence: Synthetic oligonucleotide
aaaggttgcagtgagccgagaccttgcc

SEQ ID NO: 393553 - DNA, 27 bp, Artificial Sequence
  Description of Artificial Sequence: Synthetic oligonucleotide
aaggttgcagtgagccgagaccttgcc

SEQ ID NO: 393554 - DNA, 27 bp, Artificial Sequence
  Description of Artificial Sequence: Synthetic oligonucleotide
aggttgcagtgagccgagaccttgcca

SEQ ID NO: 393555 - DNA, 27 bp, Artificial Sequence
  Description of Artificial Sequence: Synthetic oligonucleotide
ggttgcagtgagccgagaccttgccat

SEQ ID NO: 393556 - DNA, 28 bp, Artificial Sequence
  Description of Artificial Sequence: Synthetic oligonucleotide
gttgcagtgagccgagaccttgccattg

SEQ ID NO: 393557 - DNA, 30 bp, Artificial Sequence
  Description of Artificial Sequence: Synthetic oligonucleotide
ttgcagtgagccgagaccttgccattgtac

SEQ ID NO: 393558 - DNA, 29 bp, Artificial Sequence
  Description of Artificial Sequence: Synthetic oligonucleotide
tgcagtgagccgagaccttgccattgtac

SEQ ID NO: 393559 - DNA, 28 bp, Artificial Sequence
  Description of Artificial Sequence: Synthetic oligonucleotide
gcagtgagccgagaccttgccattgtac

SEQ ID NO: 393560 - DNA, 28 bp, Artificial Sequence
  Description of Artificial Sequence: Synthetic oligonucleotide
cagtgagccgagaccttgccattgtacc

SEQ ID NO: 393561 - DNA, 29 bp, Artificial Sequence
  Description of Artificial Sequence: Synthetic oligonucleotide
agtgagccgagaccttgccattgtacctc

SEQ ID NO: 393562 - DNA, 28 bp, Artificial Sequence
  Description of Artificial Sequence: Synthetic oligonucleotide
gtgagccgagaccttgccattgtacctc

SEQ ID NO: 393563 - DNA, 29 bp, Artificial Sequence
  Description of Artificial Sequence: Synthetic oligonucleotide
tgagccgagaccttgccattgtacctcag

SEQ ID NO: 393564 - DNA, 28 bp, Artificial Sequence
  Description of Artificial Sequence: Synthetic oligonucleotide
gagccgagaccttgccattgtacctcag

SEQ ID NO: 393565 - DNA, 28 bp, Artificial Sequence
  Description of Artificial Sequence: Synthetic oligonucleotide
agccgagaccttgccattgtacctcagc

SEQ ID NO: 393566 - DNA, 27 bp, Artificial Sequence
  Description of Artificial Sequence: Synthetic oligonucleotide
gccgagaccttgccattgtacctcagc

SEQ ID NO: 393567 - DNA, 27 bp, Artificial Sequence
  Description of Artificial Sequence: Synthetic oligonucleotide
ccgagaccttgccattgtacctcagcc

SEQ ID NO: 393568 - DNA, 28 bp, Artificial Sequence
  Description of Artificial Sequence: Synthetic oligonucleotide
cgagaccttgccattgtacctcagcctg

SEQ ID NO: 393569 - DNA, 28 bp, Artificial Sequence
  Description of Artificial Sequence: Synthetic oligonucleotide
gagaccttgccattgtacctcagcctgg

SEQ ID NO: 393570 - DNA, 28 bp, Artificial Sequence
  Description of Artificial Sequence: Synthetic oligonucleotide
agaccttgccattgtacctcagcctggg

SEQ ID NO: 393571 - DNA, 27 bp, Artificial Sequence
  Description of Artificial Sequence: Synthetic oligonucleotide
gaccttgccattgtacctcagcctggg

SEQ ID NO: 393572 - DNA, 28 bp, Artificial Sequence
  Description of Artificial Sequence: Synthetic oligonucleotide
accttgccattgtacctcagcctgggtg

SEQ ID NO: 393573 - DNA, 27 bp, Artificial Sequence
  Description of Artificial Sequence: Synthetic oligonucleotide
ccttgccattgtacctcagcctgggtg

SEQ ID NO: 393574 - DNA, 28 bp, Artificial Sequence
  Description of Artificial Sequence: Synthetic oligonucleotide
cttgccattgtacctcagcctgggtgac

SEQ ID NO: 393575 - DNA, 29 bp, Artificial Sequence
  Description of Artificial Sequence: Synthetic oligonucleotide
ttgccattgtacctcagcctgggtgacag

SEQ ID NO: 393576 - DNA, 28 bp, Artificial Sequence
  Description of Artificial Sequence: Synthetic oligonucleotide
tgccattgtacctcagcctgggtgacag

SEQ ID NO: 393577 - DNA, 27 bp, Artificial Sequence
  Description of Artificial Sequence: Synthetic oligonucleotide
gccattgtacctcagcctgggtgacag

SEQ ID NO: 393578 - DNA, 28 bp, Artificial Sequence
  Description of Artificial Sequence: Synthetic oligonucleotide
ccattgtacctcagcctgggtgacagag

SEQ ID NO: 393579 - DNA, 31 bp, Artificial Sequence
  Description of Artificial Sequence: Synthetic oligonucleotide
cattgtacctcagcctgggtgacagagtaag

SEQ ID NO: 393580 - DNA, 32 bp, Artificial Sequence
  Description of Artificial Sequence: Synthetic oligonucleotide
attgtacctcagcctgggtgacagagtaagac

SEQ ID NO: 393581 - DNA, 31 bp, Artificial Sequence
  Description of Artificial Sequence: Synthetic oligonucleotide
ttgtacctcagcctgggtgacagagtaagac

SEQ ID NO: 393582 - DNA, 30 bp, Artificial Sequence
  Description of Artificial Sequence: Synthetic oligonucleotide
tgtacctcagcctgggtgacagagtaagac

SEQ ID NO: 393583 - DNA, 29 bp, Artificial Sequence
  Description of Artificial Sequence: Synthetic oligonucleotide
gtacctcagcctgggtgacagagtaagac

SEQ ID NO: 393584 - DNA, 31 bp, Artificial Sequence
  Description of Artificial Sequence: Synthetic oligonucleotide
tacctcagcctgggtgacagagtaagactac

SEQ ID NO: 393585 - DNA, 30 bp, Artificial Sequence
  Description of Artificial Sequence: Synthetic oligonucleotide
acctcagcctgggtgacagagtaagactac

SEQ ID NO: 393586 - DNA, 29 bp, Artificial Sequence
  Description of Artificial Sequence: Synthetic oligonucleotide
cctcagcctgggtgacagagtaagactac

SEQ ID NO: 393587 - DNA, 29 bp, Artificial Sequence
  Description of Artificial Sequence: Synthetic oligonucleotide
ctcagcctgggtgacagagtaagactacg

SEQ ID NO: 393588 - DNA, 30 bp, Artificial Sequence
  Description of Artificial Sequence: Synthetic oligonucleotide
tcagcctgggtgacagagtaagactacgtc

SEQ ID NO: 393589 - DNA, 29 bp, Artificial Sequence
  Description of Artificial Sequence: Synthetic oligonucleotide
cagcctgggtgacagagtaagactacgtc

SEQ ID NO: 393590 - DNA, 30 bp, Artificial Sequence
  Description of Artificial Sequence: Synthetic oligonucleotide
agcctgggtgacagagtaagactacgtctc

SEQ ID NO: 393591 - DNA, 29 bp, Artificial Sequence
  Description of Artificial Sequence: Synthetic oligonucleotide
gcctgggtgacagagtaagactacgtctc

SEQ ID NO: 393592 - DNA, 34 bp, Artificial Sequence
  Description of Artificial Sequence: Synthetic oligonucleotide
cctgggtgacagagtaagactacgtctcaaaaag

SEQ ID NO: 393593 - DNA, 37 bp, Artificial Sequence
  Description of Artificial Sequence: Synthetic oligonucleotide
ctgggtgacagagtaagactacgtctcaaaaagaaag

SEQ ID NO: 393594 - DNA, 42 bp, Artificial Sequence
  Description of Artificial Sequence: Synthetic oligonucleotide
tgggtgacagagtaagactacgtctcaaaaagaaagaaaaag

SEQ ID NO: 393595 - DNA, 41 bp, Artificial Sequence
  Description of Artificial Sequence: Synthetic oligonucleotide
gggtgacagagtaagactacgtctcaaaaagaaagaaaaag

SEQ ID NO: 393596 - DNA, 45 bp, Artificial Sequence
  Description of Artificial Sequence: Synthetic oligonucleotide
ggtgacagagtaagactacgtctcaaaaagaaagaaaaagaaaag

SEQ ID NO: 393597 - DNA, 50 bp, Artificial Sequence
  Description of Artificial Sequence: Synthetic oligonucleotide
gtgacagagtaagactacgtctcaaaaagaaagaaaaagaaaagaaaaag

SEQ ID NO: 393598 - DNA, 59 bp, Artificial Sequence
  Description of Artificial Sequence: Synthetic oligonucleotide
tgacagagtaagactacgtctcaaaaagaaagaaaaagaaaagaaaaagaaaaaaaaag

SEQ ID NO: 393599 - DNA, 58 bp, Artificial Sequence
  Description of Artificial Sequence: Synthetic oligonucleotide
gacagagtaagactacgtctcaaaaagaaagaaaaagaaaagaaaaagaaaaaaaaag

SEQ ID NO: 393600 - DNA, 60 bp, Artificial Sequence
  Description of Artificial Sequence: Synthetic oligonucleotide
acagagtaagactacgtctcaaaaagaaagaaaaagaaaagaaaaagaaaaaaaaagaaa

SEQ ID NO: 393601 - DNA, 60 bp, Artificial Sequence
  Description of Artificial Sequence: Synthetic oligonucleotide
cagagtaagactacgtctcaaaaagaaagaaaaagaaaagaaaaagaaaaaaaaagaaaa

SEQ ID NO: 393602 - DNA, 60 bp, Artificial Sequence
  Description of Artificial Sequence: Synthetic oligonucleotide
agagtaagactacgtctcaaaaagaaagaaaaagaaaagaaaaagaaaaaaaaagaaaaa

SEQ ID NO: 393603 - DNA, 60 bp, Artificial Sequence
  Description of Artificial Sequence: Synthetic oligonucleotide
gagtaagactacgtctcaaaaagaaagaaaaagaaaagaaaaagaaaaaaaaagaaaaac

SEQ ID NO: 393604 - DNA, 60 bp, Artificial Sequence
  Description of Artificial Sequence: Synthetic oligonucleotide
agtaagactacgtctcaaaaagaaagaaaaagaaaagaaaaagaaaaaaaaagaaaaaca

SEQ ID NO: 393605 - DNA, 60 bp, Artificial Sequence
  Description of Artificial Sequence: Synthetic oligonucleotide
gtaagactacgtctcaaaaagaaagaaaaagaaaagaaaaagaaaaaaaaagaaaaacac

SEQ ID NO: 393606 - DNA, 60 bp, Artificial Sequence
  Description of Artificial Sequence: Synthetic oligonucleotide
taagactacgtctcaaaaagaaagaaaaagaaaagaaaaagaaaaaaaaagaaaaacacc

SEQ ID NO: 393607 - DNA, 60 bp, Artificial Sequence
  Description of Artificial Sequence: Synthetic oligonucleotide
aagactacgtctcaaaaagaaagaaaaagaaaagaaaaagaaaaaaaaagaaaaacaccc

SEQ ID NO: 393608 - DNA, 59 bp, Artificial Sequence
  Description of Artificial Sequence: Synthetic oligonucleotide
agactacgtctcaaaaagaaagaaaaagaaaagaaaaagaaaaaaaaagaaaaacaccc

SEQ ID NO: 393609 - DNA, 58 bp, Artificial Sequence
  Description of Artificial Sequence: Synthetic oligonucleotide
gactacgtctcaaaaagaaagaaaaagaaaagaaaaagaaaaaaaaagaaaaacaccc

SEQ ID NO: 393610 - DNA, 60 bp, Artificial Sequence
  Description of Artificial Sequence: Synthetic oligonucleotide
actacgtctcaaaaagaaagaaaaagaaaagaaaaagaaaaaaaaagaaaaacacccatc

SEQ ID NO: 393611 - DNA, 59 bp, Artificial Sequence
  Description of Artificial Sequence: Synthetic oligonucleotide
ctacgtctcaaaaagaaagaaaaagaaaagaaaaagaaaaaaaaagaaaaacacccatc

SEQ ID NO: 393612 - DNA, 59 bp, Artificial Sequence
  Description of Artificial Sequence: Synthetic oligonucleotide
tacgtctcaaaaagaaagaaaaagaaaagaaaaagaaaaaaaaagaaaaacacccatcc

SEQ ID NO: 393613 - DNA, 58 bp, Artificial Sequence
  Description of Artificial Sequence: Synthetic oligonucleotide
acgtctcaaaaagaaagaaaaagaaaagaaaaagaaaaaaaaagaaaaacacccatcc

SEQ ID NO: 393614 - DNA, 57 bp, Artificial Sequence
  Description of Artificial Sequence: Synthetic oligonucleotide
cgtctcaaaaagaaagaaaaagaaaagaaaaagaaaaaaaaagaaaaacacccatcc

SEQ ID NO: 393615 - DNA, 57 bp, Artificial Sequence
  Description of Artificial Sequence: Synthetic oligonucleotide
gtctcaaaaagaaagaaaaagaaaagaaaaagaaaaaaaaagaaaaacacccatccc

SEQ ID NO: 393616 - DNA, 58 bp, Artificial Sequence
  Description of Artificial Sequence: Synthetic oligonucleotide
tctcaaaaagaaagaaaaagaaaagaaaaagaaaaaaaaagaaaaacacccatccctc

SEQ ID NO: 393617 - DNA, 57 bp, Artificial Sequence
  Description of Artificial Sequence: Synthetic oligonucleotide
ctcaaaaagaaagaaaaagaaaagaaaaagaaaaaaaaagaaaaacacccatccctc

SEQ ID NO: 393618 - DNA, 59 bp, Artificial Sequence
  Description of Artificial Sequence: Synthetic oligonucleotide
tcaaaaagaaagaaaaagaaaagaaaaagaaaaaaaaagaaaaacacccatccctcttg

SEQ ID NO: 393619 - DNA, 58 bp, Artificial Sequence
  Description of Artificial Sequence: Synthetic oligonucleotide
caaaaagaaagaaaaagaaaagaaaaagaaaaaaaaagaaaaacacccatccctcttg

SEQ ID NO: 393620 - DNA, 58 bp, Artificial Sequence
  Description of Artificial Sequence: Synthetic oligonucleotide
aaaaagaaagaaaaagaaaagaaaaagaaaaaaaaagaaaaacacccatccctcttgc

SEQ ID NO: 393621 - DNA, 57 bp, Artificial Sequence
  Description of Artificial Sequence: Synthetic oligonucleotide
aaaagaaagaaaaagaaaagaaaaagaaaaaaaaagaaaaacacccatccctcttgc

SEQ ID NO: 393622 - DNA, 56 bp, Artificial Sequence
  Description of Artificial Sequence: Synthetic oligonucleotide
aaagaaagaaaaagaaaagaaaaagaaaaaaaaagaaaaacacccatccctcttgc

SEQ ID NO: 393623 - DNA, 55 bp, Artificial Sequence
  Description of Artificial Sequence: Synthetic oligonucleotide
aagaaagaaaaagaaaagaaaaagaaaaaaaaagaaaaacacccatccctcttgc

SEQ ID NO: 393624 - DNA, 54 bp, Artificial Sequence
  Description of Artificial Sequence: Synthetic oligonucleotide
agaaagaaaaagaaaagaaaaagaaaaaaaaagaaaaacacccatccctcttgc

SEQ ID NO: 393625 - DNA, 53 bp, Artificial Sequence
  Description of Artificial Sequence: Synthetic oligonucleotide
gaaagaaaaagaaaagaaaaagaaaaaaaaagaaaaacacccatccctcttgc

SEQ ID NO: 393626 - DNA, 53 bp, Artificial Sequence
  Description of Artificial Sequence: Synthetic oligonucleotide
aaagaaaaagaaaagaaaaagaaaaaaaaagaaaaacacccatccctcttgcg

SEQ ID NO: 393627 - DNA, 52 bp, Artificial Sequence
  Description of Artificial Sequence: Synthetic oligonucleotide
aagaaaaagaaaagaaaaagaaaaaaaaagaaaaacacccatccctcttgcg

SEQ ID NO: 393628 - DNA, 51 bp, Artificial Sequence
  Description of Artificial Sequence: Synthetic oligonucleotide
agaaaaagaaaagaaaaagaaaaaaaaagaaaaacacccatccctcttgcg

SEQ ID NO: 393629 - DNA, 50 bp, Artificial Sequence
  Description of Artificial Sequence: Synthetic oligonucleotide
gaaaaagaaaagaaaaagaaaaaaaaagaaaaacacccatccctcttgcg

SEQ ID NO: 393630 - DNA, 51 bp, Artificial Sequence
  Description of Artificial Sequence: Synthetic oligonucleotide
aaaaagaaaagaaaaagaaaaaaaaagaaaaacacccatccctcttgcgac

SEQ ID NO: 393631 - DNA, 50 bp, Artificial Sequence
  Description of Artificial Sequence: Synthetic oligonucleotide
aaaagaaaagaaaaagaaaaaaaaagaaaaacacccatccctcttgcgac

SEQ ID NO: 393632 - DNA, 49 bp, Artificial Sequence
  Description of Artificial Sequence: Synthetic oligonucleotide
aaagaaaagaaaaagaaaaaaaaagaaaaacacccatccctcttgcgac

SEQ ID NO: 393633 - DNA, 48 bp, Artificial Sequence
  Description of Artificial Sequence: Synthetic oligonucleotide
aagaaaagaaaaagaaaaaaaaagaaaaacacccatccctcttgcgac

SEQ ID NO: 393634 - DNA, 47 bp, Artificial Sequence
  Description of Artificial Sequence: Synthetic oligonucleotide
agaaaagaaaaagaaaaaaaaagaaaaacacccatccctcttgcgac

SEQ ID NO: 393635 - DNA, 46 bp, Artificial Sequence
  Description of Artificial Sequence: Synthetic oligonucleotide
gaaaagaaaaagaaaaaaaaagaaaaacacccatccctcttgcgac

SEQ ID NO: 393636 - DNA, 47 bp, Artificial Sequence
  Description of Artificial Sequence: Synthetic oligonucleotide
aaaagaaaaagaaaaaaaaagaaaaacacccatccctcttgcgactg

SEQ ID NO: 393637 - DNA, 46 bp, Artificial Sequence
  Description of Artificial Sequence: Synthetic oligonucleotide
aaagaaaaagaaaaaaaaagaaaaacacccatccctcttgcgactg

SEQ ID NO: 393638 - DNA, 45 bp, Artificial Sequence
  Description of Artificial Sequence: Synthetic oligonucleotide
aagaaaaagaaaaaaaaagaaaaacacccatccctcttgcgactg

SEQ ID NO: 393639 - DNA, 44 bp, Artificial Sequence
  Description of Artificial Sequence: Synthetic oligonucleotide
agaaaaagaaaaaaaaagaaaaacacccatccctcttgcgactg

SEQ ID NO: 393640 - DNA, 43 bp, Artificial Sequence
  Description of Artificial Sequence: Synthetic oligonucleotide
gaaaaagaaaaaaaaagaaaaacacccatccctcttgcgactg

SEQ ID NO: 393641 - DNA, 43 bp, Artificial Sequence
  Description of Artificial Sequence: Synthetic oligonucleotide
aaaaagaaaaaaaaagaaaaacacccatccctcttgcgactgg

SEQ ID NO: 393642 - DNA, 42 bp, Artificial Sequence
  Description of Artificial Sequence: Synthetic oligonucleotide
aaaagaaaaaaaaagaaaaacacccatccctcttgcgactgg

SEQ ID NO: 393643 - DNA, 41 bp, Artificial Sequence
  Description of Artificial Sequence: Synthetic oligonucleotide
aaagaaaaaaaaagaaaaacacccatccctcttgcgactgg

SEQ ID NO: 393644 - DNA, 40 bp, Artificial Sequence
  Description of Artificial Sequence: Synthetic oligonucleotide
aagaaaaaaaaagaaaaacacccatccctcttgcgactgg

SEQ ID NO: 393645 - DNA, 39 bp, Artificial Sequence
  Description of Artificial Sequence: Synthetic oligonucleotide
agaaaaaaaaagaaaaacacccatccctcttgcgactgg

SEQ ID NO: 393646 - DNA, 38 bp, Artificial Sequence
  Description of Artificial Sequence: Synthetic oligonucleotide
gaaaaaaaaagaaaaacacccatccctcttgcgactgg

SEQ ID NO: 393647 - DNA, 38 bp, Artificial Sequence
  Description of Artificial Sequence: Synthetic oligonucleotide
aaaaaaaaagaaaaacacccatccctcttgcgactggc

SEQ ID NO: 393648 - DNA, 37 bp, Artificial Sequence
  Description of Artificial Sequence: Synthetic oligonucleotide
aaaaaaaagaaaaacacccatccctcttgcgactggc

SEQ ID NO: 393649 - DNA, 36 bp, Artificial Sequence
  Description of Artificial Sequence: Synthetic oligonucleotide
aaaaaaagaaaaacacccatccctcttgcgactggc

SEQ ID NO: 393650 - DNA, 35 bp, Artificial Sequence
  Description of Artificial Sequence: Synthetic oligonucleotide
aaaaaagaaaaacacccatccctcttgcgactggc

SEQ ID NO: 393651 - DNA, 34 bp, Artificial Sequence
  Description of Artificial Sequence: Synthetic oligonucleotide
aaaaagaaaaacacccatccctcttgcgactggc

SEQ ID NO: 393652 - DNA, 33 bp, Artificial Sequence
  Description of Artificial Sequence: Synthetic oligonucleotide
aaaagaaaaacacccatccctcttgcgactggc

SEQ ID NO: 393653 - DNA, 32 bp, Artificial Sequence
  Description of Artificial Sequence: Synthetic oligonucleotide
aaagaaaaacacccatccctcttgcgactggc

SEQ ID NO: 393654 - DNA, 31 bp, Artificial Sequence
  Description of Artificial Sequence: Synthetic oligonucleotide
aagaaaaacacccatccctcttgcgactggc

SEQ ID NO: 393655 - DNA, 30 bp, Artificial Sequence
  Description of Artificial Sequence: Synthetic oligonucleotide
agaaaaacacccatccctcttgcgactggc

SEQ ID NO: 393656 - DNA, 29 bp, Artificial Sequence
  Description of Artificial Sequence: Synthetic oligonucleotide
gaaaaacacccatccctcttgcgactggc

SEQ ID NO: 393657 - DNA, 30 bp, Artificial Sequence
  Description of Artificial Sequence: Synthetic oligonucleotide
aaaaacacccatccctcttgcgactggcag

SEQ ID NO: 393658 - DNA, 29 bp, Artificial Sequence
  Description of Artificial Sequence: Synthetic oligonucleotide
aaaacacccatccctcttgcgactggcag

SEQ ID NO: 393659 - DNA, 28 bp, Artificial Sequence
  Description of Artificial Sequence: Synthetic oligonucleotide
aaacacccatccctcttgcgactggcag

SEQ ID NO: 393660 - DNA, 27 bp, Artificial Sequence
  Description of Artificial Sequence: Synthetic oligonucleotide
aacacccatccctcttgcgactggcag

SEQ ID NO: 393661 - DNA, 27 bp, Artificial Sequence
  Description of Artificial Sequence: Synthetic oligonucleotide
acacccatccctcttgcgactggcaga

SEQ ID NO: 393662 - DNA, 26 bp, Artificial Sequence
  Description of Artificial Sequence: Synthetic oligonucleotide
cacccatccctcttgcgactggcaga

SEQ ID NO: 393663 - DNA, 27 bp, Artificial Sequence
  Description of Artificial Sequence: Synthetic oligonucleotide
acccatccctcttgcgactggcagaca

SEQ ID NO: 393664 - DNA, 27 bp, Artificial Sequence
  Description of Artificial Sequence: Synthetic oligonucleotide
cccatccctcttgcgactggcagacat

SEQ ID NO: 393665 - DNA, 27 bp, Artificial Sequence
  Description of Artificial Sequence: Synthetic oligonucleotide
ccatccctcttgcgactggcagacatg

SEQ ID NO: 393666 - DNA, 27 bp, Artificial Sequence
  Description of Artificial Sequence: Synthetic oligonucleotide
catccctcttgcgactggcagacatgc

SEQ ID NO: 393667 - DNA, 28 bp, Artificial Sequence
  Description of Artificial Sequence: Synthetic oligonucleotide
atccctcttgcgactggcagacatgcac

SEQ ID NO: 393668 - DNA, 27 bp, Artificial Sequence
  Description of Artificial Sequence: Synthetic oligonucleotide
tccctcttgcgactggcagacatgcac

SEQ ID NO: 393669 - DNA, 27 bp, Artificial Sequence
  Description of Artificial Sequence: Synthetic oligonucleotide
ccctcttgcgactggcagacatgcaca

SEQ ID NO: 393670 - DNA, 27 bp, Artificial Sequence
  Description of Artificial Sequence: Synthetic oligonucleotide
cctcttgcgactggcagacatgcacac

SEQ ID NO: 393671 - DNA, 28 bp, Artificial Sequence
  Description of Artificial Sequence: Synthetic oligonucleotide
ctcttgcgactggcagacatgcacacac

SEQ ID NO: 393672 - DNA, 28 bp, Artificial Sequence
  Description of Artificial Sequence: Synthetic oligonucleotide
tcttgcgactggcagacatgcacacacc

SEQ ID NO: 393673 - DNA, 27 bp, Artificial Sequence
  Description of Artificial Sequence: Synthetic oligonucleotide
cttgcgactggcagacatgcacacacc

SEQ ID NO: 393674 - DNA, 28 bp, Artificial Sequence
  Description of Artificial Sequence: Synthetic oligonucleotide
ttgcgactggcagacatgcacacaccag

SEQ ID NO: 393675 - DNA, 27 bp, Artificial Sequence
  Description of Artificial Sequence: Synthetic oligonucleotide
tgcgactggcagacatgcacacaccag

SEQ ID NO: 393676 - DNA, 27 bp, Artificial Sequence
  Description of Artificial Sequence: Synthetic oligonucleotide
gcgactggcagacatgcacacaccaga

SEQ ID NO: 393677 - DNA, 27 bp, Artificial Sequence
  Description of Artificial Sequence: Synthetic oligonucleotide
cgactggcagacatgcacacaccagag

SEQ ID NO: 393678 - DNA, 29 bp, Artificial Sequence
  Description of Artificial Sequence: Synthetic oligonucleotide
gactggcagacatgcacacaccagagaag

SEQ ID NO: 393679 - DNA, 32 bp, Artificial Sequence
  Description of Artificial Sequence: Synthetic oligonucleotide
actggcagacatgcacacaccagagaagattc

SEQ ID NO: 393680 - DNA, 31 bp, Artificial Sequence
  Description of Artificial Sequence: Synthetic oligonucleotide
ctggcagacatgcacacaccagagaagattc

SEQ ID NO: 393681 - DNA, 31 bp, Artificial Sequence
  Description of Artificial Sequence: Synthetic oligonucleotide
tggcagacatgcacacaccagagaagattcc

SEQ ID NO: 393682 - DNA, 30 bp, Artificial Sequence
  Description of Artificial Sequence: Synthetic oligonucleotide
ggcagacatgcacacaccagagaagattcc

SEQ ID NO: 393683 - DNA, 34 bp, Artificial Sequence
  Description of Artificial Sequence: Synthetic oligonucleotide
gcagacatgcacacaccagagaagattccaattg

SEQ ID NO: 393684 - DNA, 35 bp, Artificial Sequence
  Description of Artificial Sequence: Synthetic oligonucleotide
cagacatgcacacaccagagaagattccaattgag

SEQ ID NO: 393685 - DNA, 36 bp, Artificial Sequence
  Description of Artificial Sequence: Synthetic oligonucleotide
agacatgcacacaccagagaagattccaattgagtg

SEQ ID NO: 393686 - DNA, 35 bp, Artificial Sequence
  Description of Artificial Sequence: Synthetic oligonucleotide
gacatgcacacaccagagaagattccaattgagtg

SEQ ID NO: 393687 - DNA, 36 bp, Artificial Sequence
  Description of Artificial Sequence: Synthetic oligonucleotide
acatgcacacaccagagaagattccaattgagtgtc

SEQ ID NO: 393688 - DNA, 35 bp, Artificial Sequence
  Description of Artificial Sequence: Synthetic oligonucleotide
catgcacacaccagagaagattccaattgagtgtc

SEQ ID NO: 393689 - DNA, 35 bp, Artificial Sequence
  Description of Artificial Sequence: Synthetic oligonucleotide
atgcacacaccagagaagattccaattgagtgtcc

SEQ ID NO: 393690 - DNA, 34 bp, Artificial Sequence
  Description of Artificial Sequence: Synthetic oligonucleotide
tgcacacaccagagaagattccaattgagtgtcc

SEQ ID NO: 393691 - DNA, 33 bp, Artificial Sequence
  Description of Artificial Sequence: Synthetic oligonucleotide
gcacacaccagagaagattccaattgagtgtcc

SEQ ID NO: 393692 - DNA, 34 bp, Artificial Sequence
  Description of Artificial Sequence: Synthetic oligonucleotide
cacacaccagagaagattccaattgagtgtcctc

SEQ ID NO: 393693 - DNA, 34 bp, Artificial Sequence
  Description of Artificial Sequence: Synthetic oligonucleotide
acacaccagagaagattccaattgagtgtcctcc

SEQ ID NO: 393694 - DNA, 33 bp, Artificial Sequence
  Description of Artificial Sequence: Synthetic oligonucleotide
cacaccagagaagattccaattgagtgtcctcc

SEQ ID NO: 393695 - DNA, 33 bp, Artificial Sequence
  Description of Artificial Sequence: Synthetic oligonucleotide
acaccagagaagattccaattgagtgtcctccc

SEQ ID NO: 393696 - DNA, 32 bp, Artificial Sequence
  Description of Artificial Sequence: Synthetic oligonucleotide
caccagagaagattccaattgagtgtcctccc

SEQ ID NO: 393697 - DNA, 38 bp, Artificial Sequence
  Description of Artificial Sequence: Synthetic oligonucleotide
accagagaagattccaattgagtgtcctccctttattc

SEQ ID NO: 393698 - DNA, 37 bp, Artificial Sequence
  Description of Artificial Sequence: Synthetic oligonucleotide
ccagagaagattccaattgagtgtcctccctttattc

SEQ ID NO: 393699 - DNA, 40 bp, Artificial Sequence
  Description of Artificial Sequence: Synthetic oligonucleotide
cagagaagattccaattgagtgtcctccctttattcatag

SEQ ID NO: 393700 - DNA, 42 bp, Artificial Sequence
  Description of Artificial Sequence: Synthetic oligonucleotide
agagaagattccaattgagtgtcctccctttattcatagaac

SEQ ID NO: 393701 - DNA, 41 bp, Artificial Sequence
  Description of Artificial Sequence: Synthetic oligonucleotide
gagaagattccaattgagtgtcctccctttattcatagaac

SEQ ID NO: 393702 - DNA, 45 bp, Artificial Sequence
  Description of Artificial Sequence: Synthetic oligonucleotide
agaagattccaattgagtgtcctccctttattcatagaacaattc

SEQ ID NO: 393703 - DNA, 44 bp, Artificial Sequence
  Description of Artificial Sequence: Synthetic oligonucleotide
gaagattccaattgagtgtcctccctttattcatagaacaattc

SEQ ID NO: 393704 - DNA, 44 bp, Artificial Sequence
  Description of Artificial Sequence: Synthetic oligonucleotide
aagattccaattgagtgtcctccctttattcatagaacaattcc

SEQ ID NO: 393705 - DNA, 43 bp, Artificial Sequence
  Description of Artificial Sequence: Synthetic oligonucleotide
agattccaattgagtgtcctccctttattcatagaacaattcc

SEQ ID NO: 393706 - DNA, 42 bp, Artificial Sequence
  Description of Artificial Sequence: Synthetic oligonucleotide
gattccaattgagtgtcctccctttattcatagaacaattcc

SEQ ID NO: 393707 - DNA, 43 bp, Artificial Sequence
  Description of Artificial Sequence: Synthetic oligonucleotide
attccaattgagtgtcctccctttattcatagaacaattcctc

SEQ ID NO: 393708 - DNA, 42 bp, Artificial Sequence
  Description of Artificial Sequence: Synthetic oligonucleotide
ttccaattgagtgtcctccctttattcatagaacaattcctc

SEQ ID NO: 393709 - DNA, 41 bp, Artificial Sequence
  Description of Artificial Sequence: Synthetic oligonucleotide
tccaattgagtgtcctccctttattcatagaacaattcctc

SEQ ID NO: 393710 - DNA, 40 bp, Artificial Sequence
  Description of Artificial Sequence: Synthetic oligonucleotide
ccaattgagtgtcctccctttattcatagaacaattcctc

SEQ ID NO: 393711 - DNA, 42 bp, Artificial Sequence
  Description of Artificial Sequence: Synthetic oligonucleotide
caattgagtgtcctccctttattcatagaacaattcctcaag

SEQ ID NO: 393712 - DNA, 43 bp, Artificial Sequence
  Description of Artificial Sequence: Synthetic oligonucleotide
aattgagtgtcctccctttattcatagaacaattcctcaagtc

SEQ ID NO: 393713 - DNA, 42 bp, Artificial Sequence
  Description of Artificial Sequence: Synthetic oligonucleotide
attgagtgtcctccctttattcatagaacaattcctcaagtc

SEQ ID NO: 393714 - DNA, 41 bp, Artificial Sequence
  Description of Artificial Sequence: Synthetic oligonucleotide
ttgagtgtcctccctttattcatagaacaattcctcaagtc

SEQ ID NO: 393715 - DNA, 40 bp, Artificial Sequence
  Description of Artificial Sequence: Synthetic oligonucleotide
tgagtgtcctccctttattcatagaacaattcctcaagtc

SEQ ID NO: 393716 - DNA, 39 bp, Artificial Sequence
  Description of Artificial Sequence: Synthetic oligonucleotide
gagtgtcctccctttattcatagaacaattcctcaagtc

SEQ ID NO: 393717 - DNA, 39 bp, Artificial Sequence
  Description of Artificial Sequence: Synthetic oligonucleotide
agtgtcctccctttattcatagaacaattcctcaagtcc

SEQ ID NO: 393718 - DNA, 38 bp, Artificial Sequence
  Description of Artificial Sequence: Synthetic oligonucleotide
gtgtcctccctttattcatagaacaattcctcaagtcc

SEQ ID NO: 393719 - DNA, 39 bp, Artificial Sequence
  Description of Artificial Sequence: Synthetic oligonucleotide
tgtcctccctttattcatagaacaattcctcaagtccac

SEQ ID NO: 393720 - DNA, 38 bp, Artificial Sequence
  Description of Artificial Sequence: Synthetic oligonucleotide
gtcctccctttattcatagaacaattcctcaagtccac

SEQ ID NO: 393721 - DNA, 39 bp, Artificial Sequence
  Description of Artificial Sequence: Synthetic oligonucleotide
tcctccctttattcatagaacaattcctcaagtccactc

SEQ ID NO: 393722 - DNA, 38 bp, Artificial Sequence
  Description of Artificial Sequence: Synthetic oligonucleotide
cctccctttattcatagaacaattcctcaagtccactc

SEQ ID NO: 393723 - DNA, 39 bp, Artificial Sequence
  Description of Artificial Sequence: Synthetic oligonucleotide
ctccctttattcatagaacaattcctcaagtccactctg

SEQ ID NO: 393724 - DNA, 40 bp, Artificial Sequence
  Description of Artificial Sequence: Synthetic oligonucleotide
tccctttattcatagaacaattcctcaagtccactctgag

SEQ ID NO: 393725 - DNA, 39 bp, Artificial Sequence
  Description of Artificial Sequence: Synthetic oligonucleotide
ccctttattcatagaacaattcctcaagtccactctgag

SEQ ID NO: 393726 - DNA, 41 bp, Artificial Sequence
  Description of Artificial Sequence: Synthetic oligonucleotide
cctttattcatagaacaattcctcaagtccactctgagtag

SEQ ID NO: 393727 - DNA, 42 bp, Artificial Sequence
  Description of Artificial Sequence: Synthetic oligonucleotide
ctttattcatagaacaattcctcaagtccactctgagtagag

SEQ ID NO: 393728 - DNA, 42 bp, Artificial Sequence
  Description of Artificial Sequence: Synthetic oligonucleotide
tttattcatagaacaattcctcaagtccactctgagtagagg

SEQ ID NO: 393729 - DNA, 41 bp, Artificial Sequence
  Description of Artificial Sequence: Synthetic oligonucleotide
ttattcatagaacaattcctcaagtccactctgagtagagg

SEQ ID NO: 393730 - DNA, 40 bp, Artificial Sequence
  Description of Artificial Sequence: Synthetic oligonucleotide
tattcatagaacaattcctcaagtccactctgagtagagg

SEQ ID NO: 393731 - DNA, 39 bp, Artificial Sequence
  Description of Artificial Sequence: Synthetic oligonucleotide
attcatagaacaattcctcaagtccactctgagtagagg

SEQ ID NO: 393732 - DNA, 38 bp, Artificial Sequence
  Description of Artificial Sequence: Synthetic oligonucleotide
ttcatagaacaattcctcaagtccactctgagtagagg

SEQ ID NO: 393733 - DNA, 37 bp, Artificial Sequence
  Description of Artificial Sequence: Synthetic oligonucleotide
tcatagaacaattcctcaagtccactctgagtagagg

SEQ ID NO: 393734 - DNA, 36 bp, Artificial Sequence
  Description of Artificial Sequence: Synthetic oligonucleotide
catagaacaattcctcaagtccactctgagtagagg

SEQ ID NO: 393735 - DNA, 36 bp, Artificial Sequence
  Description of Artificial Sequence: Synthetic oligonucleotide
atagaacaattcctcaagtccactctgagtagaggc

SEQ ID NO: 393736 - DNA, 35 bp, Artificial Sequence
  Description of Artificial Sequence: Synthetic oligonucleotide
tagaacaattcctcaagtccactctgagtagaggc

SEQ ID NO: 393737 - DNA, 34 bp, Artificial Sequence
  Description of Artificial Sequence: Synthetic oligonucleotide
agaacaattcctcaagtccactctgagtagaggc

SEQ ID NO: 393738 - DNA, 33 bp, Artificial Sequence
  Description of Artificial Sequence: Synthetic oligonucleotide
gaacaattcctcaagtccactctgagtagaggc

SEQ ID NO: 393739 - DNA, 34 bp, Artificial Sequence
  Description of Artificial Sequence: Synthetic oligonucleotide
aacaattcctcaagtccactctgagtagaggctg

SEQ ID NO: 393740 - DNA, 33 bp, Artificial Sequence
  Description of Artificial Sequence: Synthetic oligonucleotide
acaattcctcaagtccactctgagtagaggctg

SEQ ID NO: 393741 - DNA, 32 bp, Artificial Sequence
  Description of Artificial Sequence: Synthetic oligonucleotide
caattcctcaagtccactctgagtagaggctg

SEQ ID NO: 393742 - DNA, 32 bp, Artificial Sequence
  Description of Artificial Sequence: Synthetic oligonucleotide
aattcctcaagtccactctgagtagaggctgc

SEQ ID NO: 393743 - DNA, 31 bp, Artificial Sequence
  Description of Artificial Sequence: Synthetic oligonucleotide
attcctcaagtccactctgagtagaggctgc

SEQ ID NO: 393744 - DNA, 30 bp, Artificial Sequence
  Description of Artificial Sequence: Synthetic oligonucleotide
ttcctcaagtccactctgagtagaggctgc

SEQ ID NO: 393745 - DNA, 29 bp, Artificial Sequence
  Description of Artificial Sequence: Synthetic oligonucleotide
tcctcaagtccactctgagtagaggctgc

SEQ ID NO: 393746 - DNA, 28 bp, Artificial Sequence
  Description of Artificial Sequence: Synthetic oligonucleotide
cctcaagtccactctgagtagaggctgc

SEQ ID NO: 393747 - DNA, 30 bp, Artificial Sequence
  Description of Artificial Sequence: Synthetic oligonucleotide
ctcaagtccactctgagtagaggctgcatc

SEQ ID NO: 393748 - DNA, 31 bp, Artificial Sequence
  Description of Artificial Sequence: Synthetic oligonucleotide
tcaagtccactctgagtagaggctgcatcac

SEQ ID NO: 393749 - DNA, 30 bp, Artificial Sequence
  Description of Artificial Sequence: Synthetic oligonucleotide
caagtccactctgagtagaggctgcatcac

SEQ ID NO: 393750 - DNA, 32 bp, Artificial Sequence
  Description of Artificial Sequence: Synthetic oligonucleotide
aagtccactctgagtagaggctgcatcacaag

SEQ ID NO: 393751 - DNA, 31 bp, Artificial Sequence
  Description of Artificial Sequence: Synthetic oligonucleotide
agtccactctgagtagaggctgcatcacaag

SEQ ID NO: 393752 - DNA, 30 bp, Artificial Sequence
  Description of Artificial Sequence: Synthetic oligonucleotide
gtccactctgagtagaggctgcatcacaag

SEQ ID NO: 393753 - DNA, 30 bp, Artificial Sequence
  Description of Artificial Sequence: Synthetic oligonucleotide
tccactctgagtagaggctgcatcacaagg

SEQ ID NO: 393754 - DNA, 29 bp, Artificial Sequence
  Description of Artificial Sequence: Synthetic oligonucleotide
ccactctgagtagaggctgcatcacaagg

SEQ ID NO: 393755 - DNA, 29 bp, Artificial Sequence
  Description of Artificial Sequence: Synthetic oligonucleotide
cactctgagtagaggctgcatcacaaggg

SEQ ID NO: 393756 - DNA, 29 bp, Artificial Sequence
  Description of Artificial Sequence: Synthetic oligonucleotide
actctgagtagaggctgcatcacaagggg

SEQ ID NO: 393757 - DNA, 28 bp, Artificial Sequence
  Description of Artificial Sequence: Synthetic oligonucleotide
ctctgagtagaggctgcatcacaagggg

SEQ ID NO: 393758 - DNA, 31 bp, Artificial Sequence
  Description of Artificial Sequence: Synthetic oligonucleotide
tctgagtagaggctgcatcacaaggggattg

SEQ ID NO: 393759 - DNA, 30 bp, Artificial Sequence
  Description of Artificial Sequence: Synthetic oligonucleotide
ctgagtagaggctgcatcacaaggggattg

SEQ ID NO: 393760 - DNA, 30 bp, Artificial Sequence
  Description of Artificial Sequence: Synthetic oligonucleotide
tgagtagaggctgcatcacaaggggattgc

SEQ ID NO: 393761 - DNA, 29 bp, Artificial Sequence
  Description of Artificial Sequence: Synthetic oligonucleotide
gagtagaggctgcatcacaaggggattgc

SEQ ID NO: 393762 - DNA, 29 bp, Artificial Sequence
  Description of Artificial Sequence: Synthetic oligonucleotide
agtagaggctgcatcacaaggggattgcc

SEQ ID NO: 393763 - DNA, 28 bp, Artificial Sequence
  Description of Artificial Sequence: Synthetic oligonucleotide
gtagaggctgcatcacaaggggattgcc

SEQ ID NO: 393764 - DNA, 28 bp, Artificial Sequence
  Description of Artificial Sequence: Synthetic oligonucleotide
tagaggctgcatcacaaggggattgccc

SEQ ID NO: 393765 - DNA, 27 bp, Artificial Sequence
  Description of Artificial Sequence: Synthetic oligonucleotide
agaggctgcatcacaaggggattgccc

SEQ ID NO: 393766 - DNA, 26 bp, Artificial Sequence
  Description of Artificial Sequence: Synthetic oligonucleotide
gaggctgcatcacaaggggattgccc

SEQ ID NO: 393767 - DNA, 26 bp, Artificial Sequence
  Description of Artificial Sequence: Synthetic oligonucleotide
aggctgcatcacaaggggattgcccc

SEQ ID NO: 393768 - DNA, 25 bp, Artificial Sequence
  Description of Artificial Sequence: Synthetic oligonucleotide
ggctgcatcacaaggggattgcccc

SEQ ID NO: 393769 - DNA, 26 bp, Artificial Sequence
  Description of Artificial Sequence: Synthetic oligonucleotide
gctgcatcacaaggggattgccccgt

SEQ ID NO: 393770 - DNA, 27 bp, Artificial Sequence
  Description of Artificial Sequence: Synthetic oligonucleotide
ctgcatcacaaggggattgccccgtct

SEQ ID NO: 393771 - DNA, 27 bp, Artificial Sequence
  Description of Artificial Sequence: Synthetic oligonucleotide
tgcatcacaaggggattgccccgtctc

SEQ ID NO: 393772 - DNA, 26 bp, Artificial Sequence
  Description of Artificial Sequence: Synthetic oligonucleotide
gcatcacaaggggattgccccgtctc

SEQ ID NO: 393773 - DNA, 27 bp, Artificial Sequence
  Description of Artificial Sequence: Synthetic oligonucleotide
catcacaaggggattgccccgtctcct

SEQ ID NO: 393774 - DNA, 28 bp, Artificial Sequence
  Description of Artificial Sequence: Synthetic oligonucleotide
atcacaaggggattgccccgtctccttc

SEQ ID NO: 393775 - DNA, 27 bp, Artificial Sequence
  Description of Artificial Sequence: Synthetic oligonucleotide
tcacaaggggattgccccgtctccttc

SEQ ID NO: 393776 - DNA, 26 bp, Artificial Sequence
  Description of Artificial Sequence: Synthetic oligonucleotide
cacaaggggattgccccgtctccttc

SEQ ID NO: 393777 - DNA, 27 bp, Artificial Sequence
  Description of Artificial Sequence: Synthetic oligonucleotide
acaaggggattgccccgtctccttcca

SEQ ID NO: 393778 - DNA, 26 bp, Artificial Sequence
  Description of Artificial Sequence: Synthetic oligonucleotide
caaggggattgccccgtctccttcca

SEQ ID NO: 393779 - DNA, 26 bp, Artificial Sequence
  Description of Artificial Sequence: Synthetic oligonucleotide
aaggggattgccccgtctccttccag

SEQ ID NO: 393780 - DNA, 25 bp, Artificial Sequence
  Description of Artificial Sequence: Synthetic oligonucleotide
aggggattgccccgtctccttccag

SEQ ID NO: 393781 - DNA, 24 bp, Artificial Sequence
  Description of Artificial Sequence: Synthetic oligonucleotide
ggggattgccccgtctccttccag

SEQ ID NO: 393782 - DNA, 24 bp, Artificial Sequence
  Description of Artificial Sequence: Synthetic oligonucleotide
gggattgccccgtctccttccagg

SEQ ID NO: 393783 - DNA, 24 bp, Artificial Sequence
  Description of Artificial Sequence: Synthetic oligonucleotide
ggattgccccgtctccttccaggg

SEQ ID NO: 393784 - DNA, 25 bp, Artificial Sequence
  Description of Artificial Sequence: Synthetic oligonucleotide
gattgccccgtctccttccagggct

SEQ ID NO: 393785 - DNA, 27 bp, Artificial Sequence
  Description of Artificial Sequence: Synthetic oligonucleotide
attgccccgtctccttccagggctctt

SEQ ID NO: 393786 - DNA, 27 bp, Artificial Sequence
  Description of Artificial Sequence: Synthetic oligonucleotide
ttgccccgtctccttccagggctctta

SEQ ID NO: 393787 - DNA, 27 bp, Artificial Sequence
  Description of Artificial Sequence: Synthetic oligonucleotide
tgccccgtctccttccagggctcttaa

SEQ ID NO: 393788 - DNA, 27 bp, Artificial Sequence
  Description of Artificial Sequence: Synthetic oligonucleotide
gccccgtctccttccagggctcttaat

SEQ ID NO: 393789 - DNA, 28 bp, Artificial Sequence
  Description of Artificial Sequence: Synthetic oligonucleotide
ccccgtctccttccagggctcttaatac

SEQ ID NO: 393790 - DNA, 31 bp, Artificial Sequence
  Description of Artificial Sequence: Synthetic oligonucleotide
cccgtctccttccagggctcttaatacaaac

SEQ ID NO: 393791 - DNA, 32 bp, Artificial Sequence
  Description of Artificial Sequence: Synthetic oligonucleotide
ccgtctccttccagggctcttaatacaaactc

SEQ ID NO: 393792 - DNA, 34 bp, Artificial Sequence
  Description of Artificial Sequence: Synthetic oligonucleotide
cgtctccttccagggctcttaatacaaactcttc

SEQ ID NO: 393793 - DNA, 36 bp, Artificial Sequence
  Description of Artificial Sequence: Synthetic oligonucleotide
gtctccttccagggctcttaatacaaactcttcaac

SEQ ID NO: 393794 - DNA, 38 bp, Artificial Sequence
  Description of Artificial Sequence: Synthetic oligonucleotide
tctccttccagggctcttaatacaaactcttcaactag

SEQ ID NO: 393795 - DNA, 37 bp, Artificial Sequence
  Description of Artificial Sequence: Synthetic oligonucleotide
ctccttccagggctcttaatacaaactcttcaactag

SEQ ID NO: 393796 - DNA, 40 bp, Artificial Sequence
  Description of Artificial Sequence: Synthetic oligonucleotide
tccttccagggctcttaatacaaactcttcaactagtaac

SEQ ID NO: 393797 - DNA, 39 bp, Artificial Sequence
  Description of Artificial Sequence: Synthetic oligonucleotide
ccttccagggctcttaatacaaactcttcaactagtaac

SEQ ID NO: 393798 - DNA, 40 bp, Artificial Sequence
  Description of Artificial Sequence: Synthetic oligonucleotide
cttccagggctcttaatacaaactcttcaactagtaactg

SEQ ID NO: 393799 - DNA, 41 bp, Artificial Sequence
  Description of Artificial Sequence: Synthetic oligonucleotide
ttccagggctcttaatacaaactcttcaactagtaactgag

SEQ ID NO: 393800 - DNA, 40 bp, Artificial Sequence
  Description of Artificial Sequence: Synthetic oligonucleotide
tccagggctcttaatacaaactcttcaactagtaactgag

SEQ ID NO: 393801 - DNA, 39 bp, Artificial Sequence
  Description of Artificial Sequence: Synthetic oligonucleotide
ccagggctcttaatacaaactcttcaactagtaactgag

SEQ ID NO: 393802 - DNA, 41 bp, Artificial Sequence
  Description of Artificial Sequence: Synthetic oligonucleotide
cagggctcttaatacaaactcttcaactagtaactgagatg

SEQ ID NO: 393803 - DNA, 42 bp, Artificial Sequence
  Description of Artificial Sequence: Synthetic oligonucleotide
agggctcttaatacaaactcttcaactagtaactgagatgtc

SEQ ID NO: 393804 - DNA, 41 bp, Artificial Sequence
  Description of Artificial Sequence: Synthetic oligonucleotide
gggctcttaatacaaactcttcaactagtaactgagatgtc

SEQ ID NO: 393805 - DNA, 42 bp, Artificial Sequence
  Description of Artificial Sequence: Synthetic oligonucleotide
ggctcttaatacaaactcttcaactagtaactgagatgtcac

SEQ ID NO: 393806 - DNA, 42 bp, Artificial Sequence
  Description of Artificial Sequence: Synthetic oligonucleotide
gctcttaatacaaactcttcaactagtaactgagatgtcacc

SEQ ID NO: 393807 - DNA, 45 bp, Artificial Sequence
  Description of Artificial Sequence: Synthetic oligonucleotide
ctcttaatacaaactcttcaactagtaactgagatgtcaccatag

SEQ ID NO: 393808 - DNA, 45 bp, Artificial Sequence
  Description of Artificial Sequence: Synthetic oligonucleotide
tcttaatacaaactcttcaactagtaactgagatgtcaccatagg

SEQ ID NO: 393809 - DNA, 44 bp, Artificial Sequence
  Description of Artificial Sequence: Synthetic oligonucleotide
cttaatacaaactcttcaactagtaactgagatgtcaccatagg

SEQ ID NO: 393810 - DNA, 44 bp, Artificial Sequence
  Description of Artificial Sequence: Synthetic oligonucleotide
ttaatacaaactcttcaactagtaactgagatgtcaccataggg

SEQ ID NO: 393811 - DNA, 43 bp, Artificial Sequence
  Description of Artificial Sequence: Synthetic oligonucleotide
taatacaaactcttcaactagtaactgagatgtcaccataggg

SEQ ID NO: 393812 - DNA, 42 bp, Artificial Sequence
  Description of Artificial Sequence: Synthetic oligonucleotide
aatacaaactcttcaactagtaactgagatgtcaccataggg

SEQ ID NO: 393813 - DNA, 41 bp, Artificial Sequence
  Description of Artificial Sequence: Synthetic oligonucleotide
atacaaactcttcaactagtaactgagatgtcaccataggg

SEQ ID NO: 393814 - DNA, 40 bp, Artificial Sequence
  Description of Artificial Sequence: Synthetic oligonucleotide
tacaaactcttcaactagtaactgagatgtcaccataggg

SEQ ID NO: 393815 - DNA, 39 bp, Artificial Sequence
  Description of Artificial Sequence: Synthetic oligonucleotide
acaaactcttcaactagtaactgagatgtcaccataggg

SEQ ID NO: 393816 - DNA, 38 bp, Artificial Sequence
  Description of Artificial Sequence: Synthetic oligonucleotide
caaactcttcaactagtaactgagatgtcaccataggg

SEQ ID NO: 393817 - DNA, 38 bp, Artificial Sequence
  Description of Artificial Sequence: Synthetic oligonucleotide
aaactcttcaactagtaactgagatgtcaccatagggg

SEQ ID NO: 393818 - DNA, 37 bp, Artificial Sequence
  Description of Artificial Sequence: Synthetic oligonucleotide
aactcttcaactagtaactgagatgtcaccatagggg

SEQ ID NO: 393819 - DNA, 36 bp, Artificial Sequence
  Description of Artificial Sequence: Synthetic oligonucleotide
actcttcaactagtaactgagatgtcaccatagggg

SEQ ID NO: 393820 - DNA, 35 bp, Artificial Sequence
  Description of Artificial Sequence: Synthetic oligonucleotide
ctcttcaactagtaactgagatgtcaccatagggg

SEQ ID NO: 393821 - DNA, 41 bp, Artificial Sequence
  Description of Artificial Sequence: Synthetic oligonucleotide
tcttcaactagtaactgagatgtcaccataggggatttttc

SEQ ID NO: 393822 - DNA, 40 bp, Artificial Sequence
  Description of Artificial Sequence: Synthetic oligonucleotide
cttcaactagtaactgagatgtcaccataggggatttttc

SEQ ID NO: 393823 - DNA, 45 bp, Artificial Sequence
  Description of Artificial Sequence: Synthetic oligonucleotide
ttcaactagtaactgagatgtcaccataggggatttttctaattg

SEQ ID NO: 393824 - DNA, 44 bp, Artificial Sequence
  Description of Artificial Sequence: Synthetic oligonucleotide
tcaactagtaactgagatgtcaccataggggatttttctaattg

SEQ ID NO: 393825 - DNA, 43 bp, Artificial Sequence
  Description of Artificial Sequence: Synthetic oligonucleotide
caactagtaactgagatgtcaccataggggatttttctaattg

SEQ ID NO: 393826 - DNA, 43 bp, Artificial Sequence
  Description of Artificial Sequence: Synthetic oligonucleotide
aactagtaactgagatgtcaccataggggatttttctaattgg

SEQ ID NO: 393827 - DNA, 42 bp, Artificial Sequence
  Description of Artificial Sequence: Synthetic oligonucleotide
actagtaactgagatgtcaccataggggatttttctaattgg

SEQ ID NO: 393828 - DNA, 41 bp, Artificial Sequence
  Description of Artificial Sequence: Synthetic oligonucleotide
ctagtaactgagatgtcaccataggggatttttctaattgg

SEQ ID NO: 393829 - DNA, 41 bp, Artificial Sequence
  Description of Artificial Sequence: Synthetic oligonucleotide
tagtaactgagatgtcaccataggggatttttctaattggc

SEQ ID NO: 393830 - DNA, 40 bp, Artificial Sequence
  Description of Artificial Sequence: Synthetic oligonucleotide
agtaactgagatgtcaccataggggatttttctaattggc

SEQ ID NO: 393831 - DNA, 39 bp, Artificial Sequence
  Description of Artificial Sequence: Synthetic oligonucleotide
gtaactgagatgtcaccataggggatttttctaattggc

SEQ ID NO: 393832 - DNA, 39 bp, Artificial Sequence
  Description of Artificial Sequence: Synthetic oligonucleotide
taactgagatgtcaccataggggatttttctaattggcc

SEQ ID NO: 393833 - DNA, 38 bp, Artificial Sequence
  Description of Artificial Sequence: Synthetic oligonucleotide
aactgagatgtcaccataggggatttttctaattggcc

SEQ ID NO: 393834 - DNA, 37 bp, Artificial Sequence
  Description of Artificial Sequence: Synthetic oligonucleotide
actgagatgtcaccataggggatttttctaattggcc

SEQ ID NO: 393835 - DNA, 36 bp, Artificial Sequence
  Description of Artificial Sequence: Synthetic oligonucleotide
ctgagatgtcaccataggggatttttctaattggcc

SEQ ID NO: 393836 - DNA, 40 bp, Artificial Sequence
  Description of Artificial Sequence: Synthetic oligonucleotide
tgagatgtcaccataggggatttttctaattggccaaaac

SEQ ID NO: 393837 - DNA, 39 bp, Artificial Sequence
  Description of Artificial Sequence: Synthetic oligonucleotide
gagatgtcaccataggggatttttctaattggccaaaac

SEQ ID NO: 393838 - DNA, 39 bp, Artificial Sequence
  Description of Artificial Sequence: Synthetic oligonucleotide
agatgtcaccataggggatttttctaattggccaaaacc

SEQ ID NO: 393839 - DNA, 38 bp, Artificial Sequence
  Description of Artificial Sequence: Synthetic oligonucleotide
gatgtcaccataggggatttttctaattggccaaaacc

SEQ ID NO: 393840 - DNA, 39 bp, Artificial Sequence
  Description of Artificial Sequence: Synthetic oligonucleotide
atgtcaccataggggatttttctaattggccaaaacctg

SEQ ID NO: 393841 - DNA, 38 bp, Artificial Sequence
  Description of Artificial Sequence: Synthetic oligonucleotide
tgtcaccataggggatttttctaattggccaaaacctg

SEQ ID NO: 393842 - DNA, 37 bp, Artificial Sequence
  Description of Artificial Sequence: Synthetic oligonucleotide
gtcaccataggggatttttctaattggccaaaacctg

SEQ ID NO: 393843 - DNA, 38 bp, Artificial Sequence
  Description of Artificial Sequence: Synthetic oligonucleotide
tcaccataggggatttttctaattggccaaaacctgac

SEQ ID NO: 393844 - DNA, 37 bp, Artificial Sequence
  Description of Artificial Sequence: Synthetic oligonucleotide
caccataggggatttttctaattggccaaaacctgac

SEQ ID NO: 393845 - DNA, 39 bp, Artificial Sequence
  Description of Artificial Sequence: Synthetic oligonucleotide
accataggggatttttctaattggccaaaacctgacttg

SEQ ID NO: 393846 - DNA, 38 bp, Artificial Sequence
  Description of Artificial Sequence: Synthetic oligonucleotide
ccataggggatttttctaattggccaaaacctgacttg

SEQ ID NO: 393847 - DNA, 38 bp, Artificial Sequence
  Description of Artificial Sequence: Synthetic oligonucleotide
cataggggatttttctaattggccaaaacctgacttgg

SEQ ID NO: 393848 - DNA, 38 bp, Artificial Sequence
  Description of Artificial Sequence: Synthetic oligonucleotide
ataggggatttttctaattggccaaaacctgacttggc

SEQ ID NO: 393849 - DNA, 37 bp, Artificial Sequence
  Description of Artificial Sequence: Synthetic oligonucleotide
taggggatttttctaattggccaaaacctgacttggc

SEQ ID NO: 393850 - DNA, 36 bp, Artificial Sequence
  Description of Artificial Sequence: Synthetic oligonucleotide
aggggatttttctaattggccaaaacctgacttggc

SEQ ID NO: 393851 - DNA, 35 bp, Artificial Sequence
  Description of Artificial Sequence: Synthetic oligonucleotide
ggggatttttctaattggccaaaacctgacttggc

SEQ ID NO: 393852 - DNA, 36 bp, Artificial Sequence
  Description of Artificial Sequence: Synthetic oligonucleotide
gggatttttctaattggccaaaacctgacttggcag

SEQ ID NO: 393853 - DNA, 36 bp, Artificial Sequence
  Description of Artificial Sequence: Synthetic oligonucleotide
ggatttttctaattggccaaaacctgacttggcagg

SEQ ID NO: 393854 - DNA, 36 bp, Artificial Sequence
  Description of Artificial Sequence: Synthetic oligonucleotide
gatttttctaattggccaaaacctgacttggcaggg

SEQ ID NO: 393855 - DNA, 39 bp, Artificial Sequence
  Description of Artificial Sequence: Synthetic oligonucleotide
atttttctaattggccaaaacctgacttggcagggtttg

SEQ ID NO: 393856 - DNA, 38 bp, Artificial Sequence
  Description of Artificial Sequence: Synthetic oligonucleotide
tttttctaattggccaaaacctgacttggcagggtttg

SEQ ID NO: 393857 - DNA, 37 bp, Artificial Sequence
  Description of Artificial Sequence: Synthetic oligonucleotide
ttttctaattggccaaaacctgacttggcagggtttg

SEQ ID NO: 393858 - DNA, 36 bp, Artificial Sequence
  Description of Artificial Sequence: Synthetic oligonucleotide
tttctaattggccaaaacctgacttggcagggtttg

SEQ ID NO: 393859 - DNA, 35 bp, Artificial Sequence
  Description of Artificial Sequence: Synthetic oligonucleotide
ttctaattggccaaaacctgacttggcagggtttg

SEQ ID NO: 393860 - DNA, 34 bp, Artificial Sequence
  Description of Artificial Sequence: Synthetic oligonucleotide
tctaattggccaaaacctgacttggcagggtttg

SEQ ID NO: 393861 - DNA, 33 bp, Artificial Sequence
  Description of Artificial Sequence: Synthetic oligonucleotide
ctaattggccaaaacctgacttggcagggtttg

SEQ ID NO: 393862 - DNA, 33 bp, Artificial Sequence
  Description of Artificial Sequence: Synthetic oligonucleotide
taattggccaaaacctgacttggcagggtttgg

SEQ ID NO: 393863 - DNA, 32 bp, Artificial Sequence
  Description of Artificial Sequence: Synthetic oligonucleotide
aattggccaaaacctgacttggcagggtttgg

SEQ ID NO: 393864 - DNA, 31 bp, Artificial Sequence
  Description of Artificial Sequence: Synthetic oligonucleotide
attggccaaaacctgacttggcagggtttgg

SEQ ID NO: 393865 - DNA, 30 bp, Artificial Sequence
  Description of Artificial Sequence: Synthetic oligonucleotide
ttggccaaaacctgacttggcagggtttgg

SEQ ID NO: 393866 - DNA, 29 bp, Artificial Sequence
  Description of Artificial Sequence: Synthetic oligonucleotide
tggccaaaacctgacttggcagggtttgg

SEQ ID NO: 393867 - DNA, 28 bp, Artificial Sequence
  Description of Artificial Sequence: Synthetic oligonucleotide
ggccaaaacctgacttggcagggtttgg

SEQ ID NO: 393868 - DNA, 31 bp, Artificial Sequence
  Description of Artificial Sequence: Synthetic oligonucleotide
gccaaaacctgacttggcagggtttggtttg

SEQ ID NO: 393869 - DNA, 31 bp, Artificial Sequence
  Description of Artificial Sequence: Synthetic oligonucleotide
ccaaaacctgacttggcagggtttggtttgg

SEQ ID NO: 393870 - DNA, 31 bp, Artificial Sequence
  Description of Artificial Sequence: Synthetic oligonucleotide
caaaacctgacttggcagggtttggtttggg

SEQ ID NO: 393871 - DNA, 32 bp, Artificial Sequence
  Description of Artificial Sequence: Synthetic oligonucleotide
aaaacctgacttggcagggtttggtttgggtg

SEQ ID NO: 393872 - DNA, 31 bp, Artificial Sequence
  Description of Artificial Sequence: Synthetic oligonucleotide
aaacctgacttggcagggtttggtttgggtg

SEQ ID NO: 393873 - DNA, 30 bp, Artificial Sequence
  Description of Artificial Sequence: Synthetic oligonucleotide
aacctgacttggcagggtttggtttgggtg

SEQ ID NO: 393874 - DNA, 29 bp, Artificial Sequence
  Description of Artificial Sequence: Synthetic oligonucleotide
acctgacttggcagggtttggtttgggtg

SEQ ID NO: 393875 - DNA, 28 bp, Artificial Sequence
  Description of Artificial Sequence: Synthetic oligonucleotide
cctgacttggcagggtttggtttgggtg

SEQ ID NO: 393876 - DNA, 29 bp, Artificial Sequence
  Description of Artificial Sequence: Synthetic oligonucleotide
ctgacttggcagggtttggtttgggtgtc

SEQ ID NO: 393877 - DNA, 31 bp, Artificial Sequence
  Description of Artificial Sequence: Synthetic oligonucleotide
tgacttggcagggtttggtttgggtgtcttc

SEQ ID NO: 393878 - DNA, 30 bp, Artificial Sequence
  Description of Artificial Sequence: Synthetic oligonucleotide
gacttggcagggtttggtttgggtgtcttc

SEQ ID NO: 393879 - DNA, 31 bp, Artificial Sequence
  Description of Artificial Sequence: Synthetic oligonucleotide
acttggcagggtttggtttgggtgtcttcag

SEQ ID NO: 393880 - DNA, 30 bp, Artificial Sequence
  Description of Artificial Sequence: Synthetic oligonucleotide
cttggcagggtttggtttgggtgtcttcag

SEQ ID NO: 393881 - DNA, 34 bp, Artificial Sequence
  Description of Artificial Sequence: Synthetic oligonucleotide
ttggcagggtttggtttgggtgtcttcagatttc

SEQ ID NO: 393882 - DNA, 33 bp, Artificial Sequence
  Description of Artificial Sequence: Synthetic oligonucleotide
tggcagggtttggtttgggtgtcttcagatttc

SEQ ID NO: 393883 - DNA, 32 bp, Artificial Sequence
  Description of Artificial Sequence: Synthetic oligonucleotide
ggcagggtttggtttgggtgtcttcagatttc

SEQ ID NO: 393884 - DNA, 32 bp, Artificial Sequence
  Description of Artificial Sequence: Synthetic oligonucleotide
gcagggtttggtttgggtgtcttcagatttcc

SEQ ID NO: 393885 - DNA, 34 bp, Artificial Sequence
  Description of Artificial Sequence: Synthetic oligonucleotide
cagggtttggtttgggtgtcttcagatttccttg

SEQ ID NO: 393886 - DNA, 35 bp, Artificial Sequence
  Description of Artificial Sequence: Synthetic oligonucleotide
agggtttggtttgggtgtcttcagatttccttgtc

SEQ ID NO: 393887 - DNA, 34 bp, Artificial Sequence
  Description of Artificial Sequence: Synthetic oligonucleotide
gggtttggtttgggtgtcttcagatttccttgtc

SEQ ID NO: 393888 - DNA, 36 bp, Artificial Sequence
  Description of Artificial Sequence: Synthetic oligonucleotide
ggtttggtttgggtgtcttcagatttccttgtcttg

SEQ ID NO: 393889 - DNA, 37 bp, Artificial Sequence
  Description of Artificial Sequence: Synthetic oligonucleotide
gtttggtttgggtgtcttcagatttccttgtcttgag

SEQ ID NO: 393890 - DNA, 37 bp, Artificial Sequence
  Description of Artificial Sequence: Synthetic oligonucleotide
tttggtttgggtgtcttcagatttccttgtcttgagg

SEQ ID NO: 393891 - DNA, 36 bp, Artificial Sequence
  Description of Artificial Sequence: Synthetic oligonucleotide
ttggtttgggtgtcttcagatttccttgtcttgagg

SEQ ID NO: 393892 - DNA, 35 bp, Artificial Sequence
  Description of Artificial Sequence: Synthetic oligonucleotide
tggtttgggtgtcttcagatttccttgtcttgagg

SEQ ID NO: 393893 - DNA, 34 bp, Artificial Sequence
  Description of Artificial Sequence: Synthetic oligonucleotide
ggtttgggtgtcttcagatttccttgtcttgagg

SEQ ID NO: 393894 - DNA, 35 bp, Artificial Sequence
  Description of Artificial Sequence: Synthetic oligonucleotide
gtttgggtgtcttcagatttccttgtcttgaggtc

SEQ ID NO: 393895 - DNA, 35 bp, Artificial Sequence
  Description of Artificial Sequence: Synthetic oligonucleotide
tttgggtgtcttcagatttccttgtcttgaggtcc

SEQ ID NO: 393896 - DNA, 34 bp, Artificial Sequence
  Description of Artificial Sequence: Synthetic oligonucleotide
ttgggtgtcttcagatttccttgtcttgaggtcc

SEQ ID NO: 393897 - DNA, 33 bp, Artificial Sequence
  Description of Artificial Sequence: Synthetic oligonucleotide
tgggtgtcttcagatttccttgtcttgaggtcc

SEQ ID NO: 393898 - DNA, 32 bp, Artificial Sequence
  Description of Artificial Sequence: Synthetic oligonucleotide
gggtgtcttcagatttccttgtcttgaggtcc

SEQ ID NO: 393899 - DNA, 33 bp, Artificial Sequence
  Description of Artificial Sequence: Synthetic oligonucleotide
ggtgtcttcagatttccttgtcttgaggtcctc

SEQ ID NO: 393900 - DNA, 34 bp, Artificial Sequence
  Description of Artificial Sequence: Synthetic oligonucleotide
gtgtcttcagatttccttgtcttgaggtcctcac

SEQ ID NO: 393901 - DNA, 39 bp, Artificial Sequence
  Description of Artificial Sequence: Synthetic oligonucleotide
tgtcttcagatttccttgtcttgaggtcctcacaattac

SEQ ID NO: 393902 - DNA, 38 bp, Artificial Sequence
  Description of Artificial Sequence: Synthetic oligonucleotide
gtcttcagatttccttgtcttgaggtcctcacaattac

SEQ ID NO: 393903 - DNA, 39 bp, Artificial Sequence
  Description of Artificial Sequence: Synthetic oligonucleotide
tcttcagatttccttgtcttgaggtcctcacaattactc

SEQ ID NO: 393904 - DNA, 38 bp, Artificial Sequence
  Description of Artificial Sequence: Synthetic oligonucleotide
cttcagatttccttgtcttgaggtcctcacaattactc

SEQ ID NO: 393905 - DNA, 40 bp, Artificial Sequence
  Description of Artificial Sequence: Synthetic oligonucleotide
ttcagatttccttgtcttgaggtcctcacaattactctac

SEQ ID NO: 393906 - DNA, 39 bp, Artificial Sequence
  Description of Artificial Sequence: Synthetic oligonucleotide
tcagatttccttgtcttgaggtcctcacaattactctac

SEQ ID NO: 393907 - DNA, 38 bp, Artificial Sequence
  Description of Artificial Sequence: Synthetic oligonucleotide
cagatttccttgtcttgaggtcctcacaattactctac

SEQ ID NO: 393908 - DNA, 39 bp, Artificial Sequence
  Description of Artificial Sequence: Synthetic oligonucleotide
agatttccttgtcttgaggtcctcacaattactctacag

SEQ ID NO: 393909 - DNA, 38 bp, Artificial Sequence
  Description of Artificial Sequence: Synthetic oligonucleotide
gatttccttgtcttgaggtcctcacaattactctacag

SEQ ID NO: 393910 - DNA, 38 bp, Artificial Sequence
  Description of Artificial Sequence: Synthetic oligonucleotide
atttccttgtcttgaggtcctcacaattactctacagc

SEQ ID NO: 393911 - DNA, 37 bp, Artificial Sequence
  Description of Artificial Sequence: Synthetic oligonucleotide
tttccttgtcttgaggtcctcacaattactctacagc

SEQ ID NO: 393912 - DNA, 36 bp, Artificial Sequence
  Description of Artificial Sequence: Synthetic oligonucleotide
ttccttgtcttgaggtcctcacaattactctacagc

SEQ ID NO: 393913 - DNA, 35 bp, Artificial Sequence
  Description of Artificial Sequence: Synthetic oligonucleotide
tccttgtcttgaggtcctcacaattactctacagc

SEQ ID NO: 393914 - DNA, 34 bp, Artificial Sequence
  Description of Artificial Sequence: Synthetic oligonucleotide
ccttgtcttgaggtcctcacaattactctacagc

SEQ ID NO: 393915 - DNA, 35 bp, Artificial Sequence
  Description of Artificial Sequence: Synthetic oligonucleotide
cttgtcttgaggtcctcacaattactctacagctc

SEQ ID NO: 393916 - DNA, 36 bp, Artificial Sequence
  Description of Artificial Sequence: Synthetic oligonucleotide
ttgtcttgaggtcctcacaattactctacagctcag

SEQ ID NO: 393917 - DNA, 35 bp, Artificial Sequence
  Description of Artificial Sequence: Synthetic oligonucleotide
tgtcttgaggtcctcacaattactctacagctcag

SEQ ID NO: 393918 - DNA, 34 bp, Artificial Sequence
  Description of Artificial Sequence: Synthetic oligonucleotide
gtcttgaggtcctcacaattactctacagctcag

SEQ ID NO: 393919 - DNA, 36 bp, Artificial Sequence
  Description of Artificial Sequence: Synthetic oligonucleotide
tcttgaggtcctcacaattactctacagctcagaac

SEQ ID NO: 393920 - DNA, 35 bp, Artificial Sequence
  Description of Artificial Sequence: Synthetic oligonucleotide
cttgaggtcctcacaattactctacagctcagaac

SEQ ID NO: 393921 - DNA, 36 bp, Artificial Sequence
  Description of Artificial Sequence: Synthetic oligonucleotide
ttgaggtcctcacaattactctacagctcagaacac

SEQ ID NO: 393922 - DNA, 35 bp, Artificial Sequence
  Description of Artificial Sequence: Synthetic oligonucleotide
tgaggtcctcacaattactctacagctcagaacac

SEQ ID NO: 393923 - DNA, 34 bp, Artificial Sequence
  Description of Artificial Sequence: Synthetic oligonucleotide
gaggtcctcacaattactctacagctcagaacac

SEQ ID NO: 393924 - DNA, 34 bp, Artificial Sequence
  Description of Artificial Sequence: Synthetic oligonucleotide
aggtcctcacaattactctacagctcagaacacc

SEQ ID NO: 393925 - DNA, 33 bp, Artificial Sequence
  Description of Artificial Sequence: Synthetic oligonucleotide
ggtcctcacaattactctacagctcagaacacc

SEQ ID NO: 393926 - DNA, 35 bp, Artificial Sequence
  Description of Artificial Sequence: Synthetic oligonucleotide
gtcctcacaattactctacagctcagaacaccaac

SEQ ID NO: 393927 - DNA, 36 bp, Artificial Sequence
  Description of Artificial Sequence: Synthetic oligonucleotide
tcctcacaattactctacagctcagaacaccaactg

SEQ ID NO: 393928 - DNA, 35 bp, Artificial Sequence
  Description of Artificial Sequence: Synthetic oligonucleotide
cctcacaattactctacagctcagaacaccaactg

SEQ ID NO: 393929 - DNA, 35 bp, Artificial Sequence
  Description of Artificial Sequence: Synthetic oligonucleotide
ctcacaattactctacagctcagaacaccaactgc

SEQ ID NO: 393930 - DNA, 36 bp, Artificial Sequence
  Description of Artificial Sequence: Synthetic oligonucleotide
tcacaattactctacagctcagaacaccaactgctg

SEQ ID NO: 393931 - DNA, 35 bp, Artificial Sequence
  Description of Artificial Sequence: Synthetic oligonucleotide
cacaattactctacagctcagaacaccaactgctg

SEQ ID NO: 393932 - DNA, 36 bp, Artificial Sequence
  Description of Artificial Sequence: Synthetic oligonucleotide
acaattactctacagctcagaacaccaactgctgag

SEQ ID NO: 393933 - DNA, 35 bp, Artificial Sequence
  Description of Artificial Sequence: Synthetic oligonucleotide
caattactctacagctcagaacaccaactgctgag

SEQ ID NO: 393934 - DNA, 35 bp, Artificial Sequence
  Description of Artificial Sequence: Synthetic oligonucleotide
aattactctacagctcagaacaccaactgctgagg

SEQ ID NO: 393935 - DNA, 34 bp, Artificial Sequence
  Description of Artificial Sequence: Synthetic oligonucleotide
attactctacagctcagaacaccaactgctgagg

SEQ ID NO: 393936 - DNA, 33 bp, Artificial Sequence
  Description of Artificial Sequence: Synthetic oligonucleotide
ttactctacagctcagaacaccaactgctgagg

SEQ ID NO: 393937 - DNA, 32 bp, Artificial Sequence
  Description of Artificial Sequence: Synthetic oligonucleotide
tactctacagctcagaacaccaactgctgagg

SEQ ID NO: 393938 - DNA, 31 bp, Artificial Sequence
  Description of Artificial Sequence: Synthetic oligonucleotide
actctacagctcagaacaccaactgctgagg

SEQ ID NO: 393939 - DNA, 30 bp, Artificial Sequence
  Description of Artificial Sequence: Synthetic oligonucleotide
ctctacagctcagaacaccaactgctgagg

SEQ ID NO: 393940 - DNA, 30 bp, Artificial Sequence
  Description of Artificial Sequence: Synthetic oligonucleotide
tctacagctcagaacaccaactgctgaggc

SEQ ID NO: 393941 - DNA, 29 bp, Artificial Sequence
  Description of Artificial Sequence: Synthetic oligonucleotide
ctacagctcagaacaccaactgctgaggc

SEQ ID NO: 393942 - DNA, 30 bp, Artificial Sequence
  Description of Artificial Sequence: Synthetic oligonucleotide
tacagctcagaacaccaactgctgaggctg

SEQ ID NO: 393943 - DNA, 29 bp, Artificial Sequence
  Description of Artificial Sequence: Synthetic oligonucleotide
acagctcagaacaccaactgctgaggctg

SEQ ID NO: 393944 - DNA, 28 bp, Artificial Sequence
  Description of Artificial Sequence: Synthetic oligonucleotide
cagctcagaacaccaactgctgaggctg

SEQ ID NO: 393945 - DNA, 28 bp, Artificial Sequence
  Description of Artificial Sequence: Synthetic oligonucleotide
agctcagaacaccaactgctgaggctgc

SEQ ID NO: 393946 - DNA, 27 bp, Artificial Sequence
  Description of Artificial Sequence: Synthetic oligonucleotide
gctcagaacaccaactgctgaggctgc

SEQ ID NO: 393947 - DNA, 27 bp, Artificial Sequence
  Description of Artificial Sequence: Synthetic oligonucleotide
ctcagaacaccaactgctgaggctgcc

SEQ ID NO: 393948 - DNA, 29 bp, Artificial Sequence
  Description of Artificial Sequence: Synthetic oligonucleotide
tcagaacaccaactgctgaggctgccttg

SEQ ID NO: 393949 - DNA, 28 bp, Artificial Sequence
  Description of Artificial Sequence: Synthetic oligonucleotide
cagaacaccaactgctgaggctgccttg

SEQ ID NO: 393950 - DNA, 28 bp, Artificial Sequence
  Description of Artificial Sequence: Synthetic oligonucleotide
agaacaccaactgctgaggctgccttgg

SEQ ID NO: 393951 - DNA, 27 bp, Artificial Sequence
  Description of Artificial Sequence: Synthetic oligonucleotide
gaacaccaactgctgaggctgccttgg

SEQ ID NO: 393952 - DNA, 27 bp, Artificial Sequence
  Description of Artificial Sequence: Synthetic oligonucleotide
aacaccaactgctgaggctgccttggg

SEQ ID NO: 393953 - DNA, 27 bp, Artificial Sequence
  Description of Artificial Sequence: Synthetic oligonucleotide
acaccaactgctgaggctgccttggga

SEQ ID NO: 393954 - DNA, 27 bp, Artificial Sequence
  Description of Artificial Sequence: Synthetic oligonucleotide
caccaactgctgaggctgccttgggaa

SEQ ID NO: 393955 - DNA, 27 bp, Artificial Sequence
  Description of Artificial Sequence: Synthetic oligonucleotide
accaactgctgaggctgccttgggaag

SEQ ID NO: 393956 - DNA, 27 bp, Artificial Sequence
  Description of Artificial Sequence: Synthetic oligonucleotide
ccaactgctgaggctgccttgggaaga

SEQ ID NO: 393957 - DNA, 27 bp, Artificial Sequence
  Description of Artificial Sequence: Synthetic oligonucleotide
caactgctgaggctgccttgggaagag

SEQ ID NO: 393958 - DNA, 27 bp, Artificial Sequence
  Description of Artificial Sequence: Synthetic oligonucleotide
aactgctgaggctgccttgggaagagg

SEQ ID NO: 393959 - DNA, 27 bp, Artificial Sequence
  Description of Artificial Sequence: Synthetic oligonucleotide
actgctgaggctgccttgggaagagga

SEQ ID NO: 393960 - DNA, 27 bp, Artificial Sequence
  Description of Artificial Sequence: Synthetic oligonucleotide
ctgctgaggctgccttgggaagaggat

SEQ ID NO: 393961 - DNA, 27 bp, Artificial Sequence
  Description of Artificial Sequence: Synthetic oligonucleotide
tgctgaggctgccttgggaagaggatg

SEQ ID NO: 393962 - DNA, 27 bp, Artificial Sequence
  Description of Artificial Sequence: Synthetic oligonucleotide
gctgaggctgccttgggaagaggatga

SEQ ID NO: 393963 - DNA, 28 bp, Artificial Sequence
  Description of Artificial Sequence: Synthetic oligonucleotide
ctgaggctgccttgggaagaggatgatc

SEQ ID NO: 393964 - DNA, 28 bp, Artificial Sequence
  Description of Artificial Sequence: Synthetic oligonucleotide
tgaggctgccttgggaagaggatgatcc

SEQ ID NO: 393965 - DNA, 27 bp, Artificial Sequence
  Description of Artificial Sequence: Synthetic oligonucleotide
gaggctgccttgggaagaggatgatcc

SEQ ID NO: 393966 - DNA, 31 bp, Artificial Sequence
  Description of Artificial Sequence: Synthetic oligonucleotide
aggctgccttgggaagaggatgatcctaaac

SEQ ID NO: 393967 - DNA, 30 bp, Artificial Sequence
  Description of Artificial Sequence: Synthetic oligonucleotide
ggctgccttgggaagaggatgatcctaaac

SEQ ID NO: 393968 - DNA, 33 bp, Artificial Sequence
  Description of Artificial Sequence: Synthetic oligonucleotide
gctgccttgggaagaggatgatcctaaacaaag

SEQ ID NO: 393969 - DNA, 33 bp, Artificial Sequence
  Description of Artificial Sequence: Synthetic oligonucleotide
ctgccttgggaagaggatgatcctaaacaaagc

SEQ ID NO: 393970 - DNA, 34 bp, Artificial Sequence
  Description of Artificial Sequence: Synthetic oligonucleotide
tgccttgggaagaggatgatcctaaacaaagctc

SEQ ID NO: 393971 - DNA, 33 bp, Artificial Sequence
  Description of Artificial Sequence: Synthetic oligonucleotide
gccttgggaagaggatgatcctaaacaaagctc

SEQ ID NO: 393972 - DNA, 34 bp, Artificial Sequence
  Description of Artificial Sequence: Synthetic oligonucleotide
ccttgggaagaggatgatcctaaacaaagctctg

SEQ ID NO: 393973 - DNA, 34 bp, Artificial Sequence
  Description of Artificial Sequence: Synthetic oligonucleotide
cttgggaagaggatgatcctaaacaaagctctgc

SEQ ID NO: 393974 - DNA, 35 bp, Artificial Sequence
  Description of Artificial Sequence: Synthetic oligonucleotide
ttgggaagaggatgatcctaaacaaagctctgctg

SEQ ID NO: 393975 - DNA, 34 bp, Artificial Sequence
  Description of Artificial Sequence: Synthetic oligonucleotide
tgggaagaggatgatcctaaacaaagctctgctg

SEQ ID NO: 393976 - DNA, 33 bp, Artificial Sequence
  Description of Artificial Sequence: Synthetic oligonucleotide
gggaagaggatgatcctaaacaaagctctgctg

SEQ ID NO: 393977 - DNA, 33 bp, Artificial Sequence
  Description of Artificial Sequence: Synthetic oligonucleotide
ggaagaggatgatcctaaacaaagctctgctgc

SEQ ID NO: 393978 - DNA, 34 bp, Artificial Sequence
  Description of Artificial Sequence: Synthetic oligonucleotide
gaagaggatgatcctaaacaaagctctgctgctg

SEQ ID NO: 393979 - DNA, 34 bp, Artificial Sequence
  Description of Artificial Sequence: Synthetic oligonucleotide
aagaggatgatcctaaacaaagctctgctgctgg

SEQ ID NO: 393980 - DNA, 33 bp, Artificial Sequence
  Description of Artificial Sequence: Synthetic oligonucleotide
agaggatgatcctaaacaaagctctgctgctgg

SEQ ID NO: 393981 - DNA, 32 bp, Artificial Sequence
  Description of Artificial Sequence: Synthetic oligonucleotide
gaggatgatcctaaacaaagctctgctgctgg

SEQ ID NO: 393982 - DNA, 32 bp, Artificial Sequence
  Description of Artificial Sequence: Synthetic oligonucleotide
aggatgatcctaaacaaagctctgctgctggg

SEQ ID NO: 393983 - DNA, 31 bp, Artificial Sequence
  Description of Artificial Sequence: Synthetic oligonucleotide
ggatgatcctaaacaaagctctgctgctggg

SEQ ID NO: 393984 - DNA, 31 bp, Artificial Sequence
  Description of Artificial Sequence: Synthetic oligonucleotide
gatgatcctaaacaaagctctgctgctgggg

SEQ ID NO: 393985 - DNA, 29 bp, Artificial Sequence
  Description of Artificial Sequence: Synthetic oligonucleotide
tgcgttcagttggtgcttccagacaccag

SEQ ID NO: 393986 - DNA, 28 bp, Artificial Sequence
  Description of Artificial Sequence: Synthetic oligonucleotide
gcgttcagttggtgcttccagacaccag

SEQ ID NO: 393987 - DNA, 28 bp, Artificial Sequence
  Description of Artificial Sequence: Synthetic oligonucleotide
cgttcagttggtgcttccagacaccagg

SEQ ID NO: 393988 - DNA, 28 bp, Artificial Sequence
  Description of Artificial Sequence: Synthetic oligonucleotide
gttcagttggtgcttccagacaccaggg

SEQ ID NO: 393989 - DNA, 28 bp, Artificial Sequence
  Description of Artificial Sequence: Synthetic oligonucleotide
ttcagttggtgcttccagacaccagggg

SEQ ID NO: 393990 - DNA, 27 bp, Artificial Sequence
  Description of Artificial Sequence: Synthetic oligonucleotide
tcagttggtgcttccagacaccagggg

SEQ ID NO: 393991 - DNA, 26 bp, Artificial Sequence
  Description of Artificial Sequence: Synthetic oligonucleotide
cagttggtgcttccagacaccagggg

SEQ ID NO: 393992 - DNA, 26 bp, Artificial Sequence
  Description of Artificial Sequence: Synthetic oligonucleotide
agttggtgcttccagacaccaggggc

SEQ ID NO: 393993 - DNA, 25 bp, Artificial Sequence
  Description of Artificial Sequence: Synthetic oligonucleotide
gttggtgcttccagacaccaggggc

SEQ ID NO: 393994 - DNA, 27 bp, Artificial Sequence
  Description of Artificial Sequence: Synthetic oligonucleotide
ttggtgcttccagacaccaggggccat

SEQ ID NO: 393995 - DNA, 27 bp, Artificial Sequence
  Description of Artificial Sequence: Synthetic oligonucleotide
tggtgcttccagacaccaggggccatt

SEQ ID NO: 393996 - DNA, 26 bp, Artificial Sequence
  Description of Artificial Sequence: Synthetic oligonucleotide
ggtgcttccagacaccaggggccatt

SEQ ID NO: 393997 - DNA, 27 bp, Artificial Sequence
  Description of Artificial Sequence: Synthetic oligonucleotide
gtgcttccagacaccaggggccattgt

SEQ ID NO: 393998 - DNA, 27 bp, Artificial Sequence
  Description of Artificial Sequence: Synthetic oligonucleotide
tgcttccagacaccaggggccattgtg

SEQ ID NO: 393999 - DNA, 27 bp, Artificial Sequence
  Description of Artificial Sequence: Synthetic oligonucleotide
gcttccagacaccaggggccattgtga

SEQ ID NO: 394000 - DNA, 24 bp, Artificial Sequence
  Description of Artificial Sequence: Synthetic oligonucleotide
agaaatgcccacccctggccaggc

SEQ ID NO: 394001 - DNA, 23 bp, Artificial Sequence
  Description of Artificial Sequence: Synthetic oligonucleotide
gaaatgcccacccctggccaggc

SEQ ID NO: 394002 - DNA, 23 bp, Artificial Sequence
  Description of Artificial Sequence: Synthetic oligonucleotide
aaatgcccacccctggccaggcg

SEQ ID NO: 394003 - DNA, 22 bp, Artificial Sequence
  Description of Artificial Sequence: Synthetic oligonucleotide
aatgcccacccctggccaggcg

SEQ ID NO: 394004 - DNA, 21 bp, Artificial Sequence
  Description of Artificial Sequence: Synthetic oligonucleotide
atgcccacccctggccaggcg

SEQ ID NO: 394005 - DNA, 20 bp, Artificial Sequence
  Description of Artificial Sequence: Synthetic oligonucleotide
tgcccacccctggccaggcg

SEQ ID NO: 394006 - DNA, 20 bp, Artificial Sequence
  Description of Artificial Sequence: Synthetic oligonucleotide
gcccacccctggccaggcgt

SEQ ID NO: 394007 - DNA, 20 bp, Artificial Sequence
  Description of Artificial Sequence: Synthetic oligonucleotide
cccacccctggccaggcgct

SEQ ID NO: 394008 - DNA, 20 bp, Artificial Sequence
  Description of Artificial Sequence: Synthetic oligonucleotide
ccacccctggccaggcgcgt

SEQ ID NO: 394009 - DNA, 20 bp, Artificial Sequence
  Description of Artificial Sequence: Synthetic oligonucleotide
cacccctggccaggcgcggt

SEQ ID NO: 394010 - DNA, 20 bp, Artificial Sequence
  Description of Artificial Sequence: Synthetic oligonucleotide
acccctggccaggcgcggtg

SEQ ID NO: 394011 - DNA, 20 bp, Artificial Sequence
  Description of Artificial Sequence: Synthetic oligonucleotide
cccctggccaggcgcggtgt

SEQ ID NO: 394012 - DNA, 20 bp, Artificial Sequence
  Description of Artificial Sequence: Synthetic oligonucleotide
ccctggccaggcgcggtggt

SEQ ID NO: 394013 - DNA, 20 bp, Artificial Sequence
  Description of Artificial Sequence: Synthetic oligonucleotide
cctggccaggcgcggtggct

SEQ ID NO: 394014 - DNA, 22 bp, Artificial Sequence
  Description of Artificial Sequence: Synthetic oligonucleotide
ctggccaggcgcggtggctcat

SEQ ID NO: 394015 - DNA, 22 bp, Artificial Sequence
  Description of Artificial Sequence: Synthetic oligonucleotide
tggccaggcgcggtggctcatg

SEQ ID NO: 394016 - DNA, 21 bp, Artificial Sequence
  Description of Artificial Sequence: Synthetic oligonucleotide
ggccaggcgcggtggctcatg

SEQ ID NO: 394017 - DNA, 21 bp, Artificial Sequence
  Description of Artificial Sequence: Synthetic oligonucleotide
gccaggcgcggtggctcatgc

SEQ ID NO: 394018 - DNA, 22 bp, Artificial Sequence
  Description of Artificial Sequence: Synthetic oligonucleotide
ccaggcgcggtggctcatgcct

SEQ ID NO: 394019 - DNA, 26 bp, Artificial Sequence
  Description of Artificial Sequence: Synthetic oligonucleotide
caggcgcggtggctcatgcctgtaat

SEQ ID NO: 394020 - DNA, 27 bp, Artificial Sequence
  Description of Artificial Sequence: Synthetic oligonucleotide
aggcgcggtggctcatgcctgtaatct

SEQ ID NO: 394021 - DNA, 26 bp, Artificial Sequence
  Description of Artificial Sequence: Synthetic oligonucleotide
ggcgcggtggctcatgcctgtaatct

SEQ ID NO: 394022 - DNA, 27 bp, Artificial Sequence
  Description of Artificial Sequence: Synthetic oligonucleotide
gcgcggtggctcatgcctgtaatctga

SEQ ID NO: 394023 - DNA, 27 bp, Artificial Sequence
  Description of Artificial Sequence: Synthetic oligonucleotide
cgcggtggctcatgcctgtaatctgag

SEQ ID NO: 394024 - DNA, 29 bp, Artificial Sequence
  Description of Artificial Sequence: Synthetic oligonucleotide
gcggtggctcatgcctgtaatctgagtac

SEQ ID NO: 394025 - DNA, 32 bp, Artificial Sequence
  Description of Artificial Sequence: Synthetic oligonucleotide
cggtggctcatgcctgtaatctgagtactttg

SEQ ID NO: 394026 - DNA, 32 bp, Artificial Sequence
  Description of Artificial Sequence: Synthetic oligonucleotide
ggtggctcatgcctgtaatctgagtactttgg

SEQ ID NO: 394027 - DNA, 32 bp, Artificial Sequence
  Description of Artificial Sequence: Synthetic oligonucleotide
gtggctcatgcctgtaatctgagtactttggg

SEQ ID NO: 394028 - DNA, 33 bp, Artificial Sequence
  Description of Artificial Sequence: Synthetic oligonucleotide
tggctcatgcctgtaatctgagtactttgggag

SEQ ID NO: 394029 - DNA, 32 bp, Artificial Sequence
  Description of Artificial Sequence: Synthetic oligonucleotide
ggctcatgcctgtaatctgagtactttgggag

SEQ ID NO: 394030 - DNA, 32 bp, Artificial Sequence
  Description of Artificial Sequence: Synthetic oligonucleotide
gctcatgcctgtaatctgagtactttgggagg

SEQ ID NO: 394031 - DNA, 32 bp, Artificial Sequence
  Description of Artificial Sequence: Synthetic oligonucleotide
ctcatgcctgtaatctgagtactttgggaggc

SEQ ID NO: 394032 - DNA, 33 bp, Artificial Sequence
  Description of Artificial Sequence: Synthetic oligonucleotide
tcatgcctgtaatctgagtactttgggaggctg

SEQ ID NO: 394033 - DNA, 32 bp, Artificial Sequence
  Description of Artificial Sequence: Synthetic oligonucleotide
catgcctgtaatctgagtactttgggaggctg

SEQ ID NO: 394034 - DNA, 33 bp, Artificial Sequence
  Description of Artificial Sequence: Synthetic oligonucleotide
atgcctgtaatctgagtactttgggaggctgag

SEQ ID NO: 394035 - DNA, 32 bp, Artificial Sequence
  Description of Artificial Sequence: Synthetic oligonucleotide
tgcctgtaatctgagtactttgggaggctgag

SEQ ID NO: 394036 - DNA, 31 bp, Artificial Sequence
  Description of Artificial Sequence: Synthetic oligonucleotide
gcctgtaatctgagtactttgggaggctgag

SEQ ID NO: 394037 - DNA, 32 bp, Artificial Sequence
  Description of Artificial Sequence: Synthetic oligonucleotide
cctgtaatctgagtactttgggaggctgagac

SEQ ID NO: 394038 - DNA, 32 bp, Artificial Sequence
  Description of Artificial Sequence: Synthetic oligonucleotide
ctgtaatctgagtactttgggaggctgagacg

SEQ ID NO: 394039 - DNA, 32 bp, Artificial Sequence
  Description of Artificial Sequence: Synthetic oligonucleotide
tgtaatctgagtactttgggaggctgagacgg

SEQ ID NO: 394040 - DNA, 31 bp, Artificial Sequence
  Description of Artificial Sequence: Synthetic oligonucleotide
gtaatctgagtactttgggaggctgagacgg

SEQ ID NO: 394041 - DNA, 31 bp, Artificial Sequence
  Description of Artificial Sequence: Synthetic oligonucleotide
taatctgagtactttgggaggctgagacggg

SEQ ID NO: 394042 - DNA, 30 bp, Artificial Sequence
  Description of Artificial Sequence: Synthetic oligonucleotide
aatctgagtactttgggaggctgagacggg

SEQ ID NO: 394043 - DNA, 29 bp, Artificial Sequence
  Description of Artificial Sequence: Synthetic oligonucleotide
atctgagtactttgggaggctgagacggg

SEQ ID NO: 394044 - DNA, 28 bp, Artificial Sequence
  Description of Artificial Sequence: Synthetic oligonucleotide
tctgagtactttgggaggctgagacggg

SEQ ID NO: 394045 - DNA, 27 bp, Artificial Sequence
  Description of Artificial Sequence: Synthetic oligonucleotide
ctgagtactttgggaggctgagacggg

SEQ ID NO: 394046 - DNA, 27 bp, Artificial Sequence
  Description of Artificial Sequence: Synthetic oligonucleotide
tgagtactttgggaggctgagacgggc

SEQ ID NO: 394047 - DNA, 27 bp, Artificial Sequence
  Description of Artificial Sequence: Synthetic oligonucleotide
gagtactttgggaggctgagacgggca

SEQ ID NO: 394048 - DNA, 27 bp, Artificial Sequence
  Description of Artificial Sequence: Synthetic oligonucleotide
agtactttgggaggctgagacgggcag

SEQ ID NO: 394049 - DNA, 27 bp, Artificial Sequence
  Description of Artificial Sequence: Synthetic oligonucleotide
gtactttgggaggctgagacgggcaga

SEQ ID NO: 394050 - DNA, 28 bp, Artificial Sequence
  Description of Artificial Sequence: Synthetic oligonucleotide
tactttgggaggctgagacgggcagatc

SEQ ID NO: 394051 - DNA, 22 bp, Artificial Sequence
  Description of Artificial Sequence: Synthetic oligonucleotide
tgggcgtggtggcaggtgcctg

SEQ ID NO: 394052 - DNA, 21 bp, Artificial Sequence
  Description of Artificial Sequence: Synthetic oligonucleotide
gggcgtggtggcaggtgcctg

SEQ ID NO: 394053 - DNA, 22 bp, Artificial Sequence
  Description of Artificial Sequence: Synthetic oligonucleotide
ggcgtggtggcaggtgcctgca

SEQ ID NO: 394054 - DNA, 23 bp, Artificial Sequence
  Description of Artificial Sequence: Synthetic oligonucleotide
gcgtggtggcaggtgcctgcagt

SEQ ID NO: 394055 - DNA, 23 bp, Artificial Sequence
  Description of Artificial Sequence: Synthetic oligonucleotide
cgtggtggcaggtgcctgcagtc

SEQ ID NO: 394056 - DNA, 23 bp, Artificial Sequence
  Description of Artificial Sequence: Synthetic oligonucleotide
gtggtggcaggtgcctgcagtcc

SEQ ID NO: 394057 - DNA, 24 bp, Artificial Sequence
  Description of Artificial Sequence: Synthetic oligonucleotide
tggtggcaggtgcctgcagtccca

SEQ ID NO: 394058 - DNA, 23 bp, Artificial Sequence
  Description of Artificial Sequence: Synthetic oligonucleotide
ggtggcaggtgcctgcagtccca

SEQ ID NO: 394059 - DNA, 23 bp, Artificial Sequence
  Description of Artificial Sequence: Synthetic oligonucleotide
gtggcaggtgcctgcagtcccag

SEQ ID NO: 394060 - DNA, 25 bp, Artificial Sequence
  Description of Artificial Sequence: Synthetic oligonucleotide
tggcaggtgcctgcagtcccagcta

SEQ ID NO: 394061 - DNA, 24 bp, Artificial Sequence
  Description of Artificial Sequence: Synthetic oligonucleotide
ggcaggtgcctgcagtcccagcta

SEQ ID NO: 394062 - DNA, 26 bp, Artificial Sequence
  Description of Artificial Sequence: Synthetic oligonucleotide
gcaggtgcctgcagtcccagctactt

SEQ ID NO: 394063 - DNA, 26 bp, Artificial Sequence
  Description of Artificial Sequence: Synthetic oligonucleotide
caggtgcctgcagtcccagctacttg

SEQ ID NO: 394064 - DNA, 26 bp, Artificial Sequence
  Description of Artificial Sequence: Synthetic oligonucleotide
aggtgcctgcagtcccagctacttgg

SEQ ID NO: 394065 - DNA, 25 bp, Artificial Sequence
  Description of Artificial Sequence: Synthetic oligonucleotide
ggtgcctgcagtcccagctacttgg

SEQ ID NO: 394066 - DNA, 26 bp, Artificial Sequence
  Description of Artificial Sequence: Synthetic oligonucleotide
gtgcctgcagtcccagctacttggga

SEQ ID NO: 394067 - DNA, 26 bp, Artificial Sequence
  Description of Artificial Sequence: Synthetic oligonucleotide
tgcctgcagtcccagctacttgggag

SEQ ID NO: 394068 - DNA, 25 bp, Artificial Sequence
  Description of Artificial Sequence: Synthetic oligonucleotide
gcctgcagtcccagctacttgggag

SEQ ID NO: 394069 - DNA, 25 bp, Artificial Sequence
  Description of Artificial Sequence: Synthetic oligonucleotide
cctgcagtcccagctacttgggagg

SEQ ID NO: 394070 - DNA, 26 bp, Artificial Sequence
  Description of Artificial Sequence: Synthetic oligonucleotide
ctgcagtcccagctacttgggagggt

SEQ ID NO: 394071 - DNA, 27 bp, Artificial Sequence
  Description of Artificial Sequence: Synthetic oligonucleotide
tgcagtcccagctacttgggagggtga

SEQ ID NO: 394072 - DNA, 26 bp, Artificial Sequence
  Description of Artificial Sequence: Synthetic oligonucleotide
gcagtcccagctacttgggagggtga

SEQ ID NO: 394073 - DNA, 26 bp, Artificial Sequence
  Description of Artificial Sequence: Synthetic oligonucleotide
cagtcccagctacttgggagggtgag

SEQ ID NO: 394074 - DNA, 29 bp, Artificial Sequence
  Description of Artificial Sequence: Synthetic oligonucleotide
cattgtacctcagcctgggtgacagagtg

SEQ ID NO: 394075 - DNA, 30 bp, Artificial Sequence
  Description of Artificial Sequence: Synthetic oligonucleotide
attgtacctcagcctgggtgacagagtgag

SEQ ID NO: 394076 - DNA, 29 bp, Artificial Sequence
  Description of Artificial Sequence: Synthetic oligonucleotide
ttgtacctcagcctgggtgacagagtgag

SEQ ID NO: 394077 - DNA, 28 bp, Artificial Sequence
  Description of Artificial Sequence: Synthetic oligonucleotide
tgtacctcagcctgggtgacagagtgag

SEQ ID NO: 394078 - DNA, 27 bp, Artificial Sequence
  Description of Artificial Sequence: Synthetic oligonucleotide
gtacctcagcctgggtgacagagtgag

SEQ ID NO: 394079 - DNA, 28 bp, Artificial Sequence
  Description of Artificial Sequence: Synthetic oligonucleotide
tacctcagcctgggtgacagagtgagac

SEQ ID NO: 394080 - DNA, 27 bp, Artificial Sequence
  Description of Artificial Sequence: Synthetic oligonucleotide
acctcagcctgggtgacagagtgagac

SEQ ID NO: 394081 - DNA, 27 bp, Artificial Sequence
  Description of Artificial Sequence: Synthetic oligonucleotide
cctcagcctgggtgacagagtgagact

SEQ ID NO: 394082 - DNA, 28 bp, Artificial Sequence
  Description of Artificial Sequence: Synthetic oligonucleotide
ctcagcctgggtgacagagtgagactac

SEQ ID NO: 394083 - DNA, 28 bp, Artificial Sequence
  Description of Artificial Sequence: Synthetic oligonucleotide
tcagcctgggtgacagagtgagactacg

SEQ ID NO: 394084 - DNA, 27 bp, Artificial Sequence
  Description of Artificial Sequence: Synthetic oligonucleotide
cagcctgggtgacagagtgagactacg

SEQ ID NO: 394085 - DNA, 28 bp, Artificial Sequence
  Description of Artificial Sequence: Synthetic oligonucleotide
agcctgggtgacagagtgagactacgtc

SEQ ID NO: 394086 - DNA, 27 bp, Artificial Sequence
  Description of Artificial Sequence: Synthetic oligonucleotide
gcctgggtgacagagtgagactacgtc

SEQ ID NO: 394087 - DNA, 28 bp, Artificial Sequence
  Description of Artificial Sequence: Synthetic oligonucleotide
cctgggtgacagagtgagactacgtctc

SEQ ID NO: 394088 - DNA, 37 bp, Artificial Sequence
  Description of Artificial Sequence: Synthetic oligonucleotide
ctgggtgacagagtgagactacgtctcaaaaaaaaag

SEQ ID NO: 394089 - DNA, 42 bp, Artificial Sequence
  Description of Artificial Sequence: Synthetic oligonucleotide
tgggtgacagagtgagactacgtctcaaaaaaaaagaaaaag

SEQ ID NO: 394090 - DNA, 41 bp, Artificial Sequence
  Description of Artificial Sequence: Synthetic oligonucleotide
gggtgacagagtgagactacgtctcaaaaaaaaagaaaaag

SEQ ID NO: 394091 - DNA, 45 bp, Artificial Sequence
  Description of Artificial Sequence: Synthetic oligonucleotide
ggtgacagagtgagactacgtctcaaaaaaaaagaaaaagaaaag

SEQ ID NO: 394092 - DNA, 50 bp, Artificial Sequence
  Description of Artificial Sequence: Synthetic oligonucleotide
gtgacagagtgagactacgtctcaaaaaaaaagaaaaagaaaagaaaaag

SEQ ID NO: 394093 - DNA, 50 bp, Artificial Sequence
  Description of Artificial Sequence: Synthetic oligonucleotide
tgacagagtgagactacgtctcaaaaaaaaagaaaaagaaaagaaaaagg

SEQ ID NO: 394094 - DNA, 49 bp, Artificial Sequence
  Description of Artificial Sequence: Synthetic oligonucleotide
gacagagtgagactacgtctcaaaaaaaaagaaaaagaaaagaaaaagg

SEQ ID NO: 394095 - DNA, 57 bp, Artificial Sequence
  Description of Artificial Sequence: Synthetic oligonucleotide
acagagtgagactacgtctcaaaaaaaaagaaaaagaaaagaaaaaggaaaaaaaag

SEQ ID NO: 394096 - DNA, 56 bp, Artificial Sequence
  Description of Artificial Sequence: Synthetic oligonucleotide
cagagtgagactacgtctcaaaaaaaaagaaaaagaaaagaaaaaggaaaaaaaag

SEQ ID NO: 394097 - DNA, 60 bp, Artificial Sequence
  Description of Artificial Sequence: Synthetic oligonucleotide
agagtgagactacgtctcaaaaaaaaagaaaaagaaaagaaaaaggaaaaaaaagaaaaa

SEQ ID NO: 394098 - DNA, 60 bp, Artificial Sequence
  Description of Artificial Sequence: Synthetic oligonucleotide
gagtgagactacgtctcaaaaaaaaagaaaaagaaaagaaaaaggaaaaaaaagaaaaac

SEQ ID NO: 394099 - DNA, 60 bp, Artificial Sequence
  Description of Artificial Sequence: Synthetic oligonucleotide
agtgagactacgtctcaaaaaaaaagaaaaagaaaagaaaaaggaaaaaaaagaaaaaca

SEQ ID NO: 394100 - DNA, 60 bp, Artificial Sequence
  Description of Artificial Sequence: Synthetic oligonucleotide
gtgagactacgtctcaaaaaaaaagaaaaagaaaagaaaaaggaaaaaaaagaaaaacac

SEQ ID NO: 394101 - DNA, 60 bp, Artificial Sequence
  Description of Artificial Sequence: Synthetic oligonucleotide
tgagactacgtctcaaaaaaaaagaaaaagaaaagaaaaaggaaaaaaaagaaaaacacc

SEQ ID NO: 394102 - DNA, 59 bp, Artificial Sequence
  Description of Artificial Sequence: Synthetic oligonucleotide
gagactacgtctcaaaaaaaaagaaaaagaaaagaaaaaggaaaaaaaagaaaaacacc

SEQ ID NO: 394103 - DNA, 59 bp, Artificial Sequence
  Description of Artificial Sequence: Synthetic oligonucleotide
agactacgtctcaaaaaaaaagaaaaagaaaagaaaaaggaaaaaaaagaaaaacaccc

SEQ ID NO: 394104 - DNA, 58 bp, Artificial Sequence
  Description of Artificial Sequence: Synthetic oligonucleotide
gactacgtctcaaaaaaaaagaaaaagaaaagaaaaaggaaaaaaaagaaaaacaccc

SEQ ID NO: 394105 - DNA, 60 bp, Artificial Sequence
  Description of Artificial Sequence: Synthetic oligonucleotide
actacgtctcaaaaaaaaagaaaaagaaaagaaaaaggaaaaaaaagaaaaacacccatc

SEQ ID NO: 394106 - DNA, 59 bp, Artificial Sequence
  Description of Artificial Sequence: Synthetic oligonucleotide
ctacgtctcaaaaaaaaagaaaaagaaaagaaaaaggaaaaaaaagaaaaacacccatc

SEQ ID NO: 394107 - DNA, 59 bp, Artificial Sequence
  Description of Artificial Sequence: Synthetic oligonucleotide
tacgtctcaaaaaaaaagaaaaagaaaagaaaaaggaaaaaaaagaaaaacacccatcc

SEQ ID NO: 394108 - DNA, 58 bp, Artificial Sequence
  Description of Artificial Sequence: Synthetic oligonucleotide
acgtctcaaaaaaaaagaaaaagaaaagaaaaaggaaaaaaaagaaaaacacccatcc

SEQ ID NO: 394109 - DNA, 57 bp, Artificial Sequence
  Description of Artificial Sequence: Synthetic oligonucleotide
cgtctcaaaaaaaaagaaaaagaaaagaaaaaggaaaaaaaagaaaaacacccatcc

SEQ ID NO: 394110 - DNA, 57 bp, Artificial Sequence
  Description of Artificial Sequence: Synthetic oligonucleotide
gtctcaaaaaaaaagaaaaagaaaagaaaaaggaaaaaaaagaaaaacacccatccc

SEQ ID NO: 394111 - DNA, 58 bp, Artificial Sequence
  Description of Artificial Sequence: Synthetic oligonucleotide
tctcaaaaaaaaagaaaaagaaaagaaaaaggaaaaaaaagaaaaacacccatccctc

SEQ ID NO: 394112 - DNA, 57 bp, Artificial Sequence
  Description of Artificial Sequence: Synthetic oligonucleotide
ctcaaaaaaaaagaaaaagaaaagaaaaaggaaaaaaaagaaaaacacccatccctc

SEQ ID NO: 394113 - DNA, 59 bp, Artificial Sequence
  Description of Artificial Sequence: Synthetic oligonucleotide
tcaaaaaaaaagaaaaagaaaagaaaaaggaaaaaaaagaaaaacacccatccctcttg

SEQ ID NO: 394114 - DNA, 58 bp, Artificial Sequence
  Description of Artificial Sequence: Synthetic oligonucleotide
caaaaaaaaagaaaaagaaaagaaaaaggaaaaaaaagaaaaacacccatccctcttg

SEQ ID NO: 394115 - DNA, 58 bp, Artificial Sequence
  Description of Artificial Sequence: Synthetic oligonucleotide
aaaaaaaaagaaaaagaaaagaaaaaggaaaaaaaagaaaaacacccatccctcttgc

SEQ ID NO: 394116 - DNA, 57 bp, Artificial Sequence
  Description of Artificial Sequence: Synthetic oligonucleotide
aaaaaaaagaaaaagaaaagaaaaaggaaaaaaaagaaaaacacccatccctcttgc

SEQ ID NO: 394117 - DNA, 56 bp, Artificial Sequence
  Description of Artificial Sequence: Synthetic oligonucleotide
aaaaaaagaaaaagaaaagaaaaaggaaaaaaaagaaaaacacccatccctcttgc

SEQ ID NO: 394118 - DNA, 55 bp, Artificial Sequence
  Description of Artificial Sequence: Synthetic oligonucleotide
aaaaaagaaaaagaaaagaaaaaggaaaaaaaagaaaaacacccatccctcttgc

SEQ ID NO: 394119 - DNA, 54 bp, Artificial Sequence
  Description of Artificial Sequence: Synthetic oligonucleotide
aaaaagaaaaagaaaagaaaaaggaaaaaaaagaaaaacacccatccctcttgc

SEQ ID NO: 394120 - DNA, 53 bp, Artificial Sequence
  Description of Artificial Sequence: Synthetic oligonucleotide
aaaagaaaaagaaaagaaaaaggaaaaaaaagaaaaacacccatccctcttgc

SEQ ID NO: 394121 - DNA, 52 bp, Artificial Sequence
  Description of Artificial Sequence: Synthetic oligonucleotide
aaagaaaaagaaaagaaaaaggaaaaaaaagaaaaacacccatccctcttgc

SEQ ID NO: 394122 - DNA, 51 bp, Artificial Sequence
  Description of Artificial Sequence: Synthetic oligonucleotide
aagaaaaagaaaagaaaaaggaaaaaaaagaaaaacacccatccctcttgc

SEQ ID NO: 394123 - DNA, 50 bp, Artificial Sequence
  Description of Artificial Sequence: Synthetic oligonucleotide
agaaaaagaaaagaaaaaggaaaaaaaagaaaaacacccatccctcttgc

SEQ ID NO: 394124 - DNA, 49 bp, Artificial Sequence
  Description of Artificial Sequence: Synthetic oligonucleotide
gaaaaagaaaagaaaaaggaaaaaaaagaaaaacacccatccctcttgc

SEQ ID NO: 394125 - DNA, 49 bp, Artificial Sequence
  Description of Artificial Sequence: Synthetic oligonucleotide
aaaaagaaaagaaaaaggaaaaaaaagaaaaacacccatccctcttgcg

SEQ ID NO: 394126 - DNA, 48 bp, Artificial Sequence
  Description of Artificial Sequence: Synthetic oligonucleotide
aaaagaaaagaaaaaggaaaaaaaagaaaaacacccatccctcttgcg

SEQ ID NO: 394127 - DNA, 47 bp, Artificial Sequence
  Description of Artificial Sequence: Synthetic oligonucleotide
aaagaaaagaaaaaggaaaaaaaagaaaaacacccatccctcttgcg

SEQ ID NO: 394128 - DNA, 46 bp, Artificial Sequence
  Description of Artificial Sequence: Synthetic oligonucleotide
aagaaaagaaaaaggaaaaaaaagaaaaacacccatccctcttgcg

SEQ ID NO: 394129 - DNA, 45 bp, Artificial Sequence
  Description of Artificial Sequence: Synthetic oligonucleotide
agaaaagaaaaaggaaaaaaaagaaaaacacccatccctcttgcg

SEQ ID NO: 394130 - DNA, 44 bp, Artificial Sequence
  Description of Artificial Sequence: Synthetic oligonucleotide
gaaaagaaaaaggaaaaaaaagaaaaacacccatccctcttgcg

SEQ ID NO: 394131 - DNA, 45 bp, Artificial Sequence
  Description of Artificial Sequence: Synthetic oligonucleotide
aaaagaaaaaggaaaaaaaagaaaaacacccatccctcttgcgac

SEQ ID NO: 394132 - DNA, 44 bp, Artificial Sequence
  Description of Artificial Sequence: Synthetic oligonucleotide
aaagaaaaaggaaaaaaaagaaaaacacccatccctcttgcgac

SEQ ID NO: 394133 - DNA, 43 bp, Artificial Sequence
  Description of Artificial Sequence: Synthetic oligonucleotide
aagaaaaaggaaaaaaaagaaaaacacccatccctcttgcgac

SEQ ID NO: 394134 - DNA, 42 bp, Artificial Sequence
  Description of Artificial Sequence: Synthetic oligonucleotide
agaaaaaggaaaaaaaagaaaaacacccatccctcttgcgac

SEQ ID NO: 394135 - DNA, 41 bp, Artificial Sequence
  Description of Artificial Sequence: Synthetic oligonucleotide
gaaaaaggaaaaaaaagaaaaacacccatccctcttgcgac

SEQ ID NO: 394136 - DNA, 42 bp, Artificial Sequence
  Description of Artificial Sequence: Synthetic oligonucleotide
aaaaaggaaaaaaaagaaaaacacccatccctcttgcgactg

SEQ ID NO: 394137 - DNA, 41 bp, Artificial Sequence
  Description of Artificial Sequence: Synthetic oligonucleotide
aaaaggaaaaaaaagaaaaacacccatccctcttgcgactg

SEQ ID NO: 394138 - DNA, 40 bp, Artificial Sequence
  Description of Artificial Sequence: Synthetic oligonucleotide
aaaggaaaaaaaagaaaaacacccatccctcttgcgactg

SEQ ID NO: 394139 - DNA, 39 bp, Artificial Sequence
  Description of Artificial Sequence: Synthetic oligonucleotide
aaggaaaaaaaagaaaaacacccatccctcttgcgactg

SEQ ID NO: 394140 - DNA, 38 bp, Artificial Sequence
  Description of Artificial Sequence: Synthetic oligonucleotide
aggaaaaaaaagaaaaacacccatccctcttgcgactg

SEQ ID NO: 394141 - DNA, 37 bp, Artificial Sequence
  Description of Artificial Sequence: Synthetic oligonucleotide
ggaaaaaaaagaaaaacacccatccctcttgcgactg

SEQ ID NO: 394142 - DNA, 37 bp, Artificial Sequence
  Description of Artificial Sequence: Synthetic oligonucleotide
gaaaaaaaagaaaaacacccatccctcttgcgactgg

SEQ ID NO: 394143 - DNA, 38 bp, Artificial Sequence
  Description of Artificial Sequence: Synthetic oligonucleotide
gcagacatgcacacaccagagaagattccaatttaatg

SEQ ID NO: 394144 - DNA, 39 bp, Artificial Sequence
  Description of Artificial Sequence: Synthetic oligonucleotide
cagacatgcacacaccagagaagattccaatttaatgtc

SEQ ID NO: 394145 - DNA, 39 bp, Artificial Sequence
  Description of Artificial Sequence: Synthetic oligonucleotide
agacatgcacacaccagagaagattccaatttaatgtcc

SEQ ID NO: 394146 - DNA, 38 bp, Artificial Sequence
  Description of Artificial Sequence: Synthetic oligonucleotide
gacatgcacacaccagagaagattccaatttaatgtcc

SEQ ID NO: 394147 - DNA, 39 bp, Artificial Sequence
  Description of Artificial Sequence: Synthetic oligonucleotide
acatgcacacaccagagaagattccaatttaatgtcctc

SEQ ID NO: 394148 - DNA, 38 bp, Artificial Sequence
  Description of Artificial Sequence: Synthetic oligonucleotide
catgcacacaccagagaagattccaatttaatgtcctc

SEQ ID NO: 394149 - DNA, 38 bp, Artificial Sequence
  Description of Artificial Sequence: Synthetic oligonucleotide
atgcacacaccagagaagattccaatttaatgtcctcc

SEQ ID NO: 394150 - DNA, 37 bp, Artificial Sequence
  Description of Artificial Sequence: Synthetic oligonucleotide
tgcacacaccagagaagattccaatttaatgtcctcc

SEQ ID NO: 394151 - DNA, 36 bp, Artificial Sequence
  Description of Artificial Sequence: Synthetic oligonucleotide
gcacacaccagagaagattccaatttaatgtcctcc

SEQ ID NO: 394152 - DNA, 36 bp, Artificial Sequence
  Description of Artificial Sequence: Synthetic oligonucleotide
cacacaccagagaagattccaatttaatgtcctccc

SEQ ID NO: 394153 - DNA, 42 bp, Artificial Sequence
  Description of Artificial Sequence: Synthetic oligonucleotide
acacaccagagaagattccaatttaatgtcctccctttattc

SEQ ID NO: 394154 - DNA, 41 bp, Artificial Sequence
  Description of Artificial Sequence: Synthetic oligonucleotide
cacaccagagaagattccaatttaatgtcctccctttattc

SEQ ID NO: 394155 - DNA, 44 bp, Artificial Sequence
  Description of Artificial Sequence: Synthetic oligonucleotide
acaccagagaagattccaatttaatgtcctccctttattcatag

SEQ ID NO: 394156 - DNA, 43 bp, Artificial Sequence
  Description of Artificial Sequence: Synthetic oligonucleotide
caccagagaagattccaatttaatgtcctccctttattcatag

SEQ ID NO: 394157 - DNA, 45 bp, Artificial Sequence
  Description of Artificial Sequence: Synthetic oligonucleotide
accagagaagattccaatttaatgtcctccctttattcatagaac

SEQ ID NO: 394158 - DNA, 44 bp, Artificial Sequence
  Description of Artificial Sequence: Synthetic oligonucleotide
ccagagaagattccaatttaatgtcctccctttattcatagaac

SEQ ID NO: 394159 - DNA, 48 bp, Artificial Sequence
  Description of Artificial Sequence: Synthetic oligonucleotide
cagagaagattccaatttaatgtcctccctttattcatagaacaattc

SEQ ID NO: 394160 - DNA, 48 bp, Artificial Sequence
  Description of Artificial Sequence: Synthetic oligonucleotide
agagaagattccaatttaatgtcctccctttattcatagaacaattcc

SEQ ID NO: 394161 - DNA, 47 bp, Artificial Sequence
  Description of Artificial Sequence: Synthetic oligonucleotide
gagaagattccaatttaatgtcctccctttattcatagaacaattcc

SEQ ID NO: 394162 - DNA, 48 bp, Artificial Sequence
  Description of Artificial Sequence: Synthetic oligonucleotide
agaagattccaatttaatgtcctccctttattcatagaacaattcctc

SEQ ID NO: 394163 - DNA, 47 bp, Artificial Sequence
  Description of Artificial Sequence: Synthetic oligonucleotide
gaagattccaatttaatgtcctccctttattcatagaacaattcctc

SEQ ID NO: 394164 - DNA, 49 bp, Artificial Sequence
  Description of Artificial Sequence: Synthetic oligonucleotide
aagattccaatttaatgtcctccctttattcatagaacaattcctcaag

SEQ ID NO: 394165 - DNA, 48 bp, Artificial Sequence
  Description of Artificial Sequence: Synthetic oligonucleotide
agattccaatttaatgtcctccctttattcatagaacaattcctcaag

SEQ ID NO: 394166 - DNA, 47 bp, Artificial Sequence
  Description of Artificial Sequence: Synthetic oligonucleotide
gattccaatttaatgtcctccctttattcatagaacaattcctcaag

SEQ ID NO: 394167 - DNA, 48 bp, Artificial Sequence
  Description of Artificial Sequence: Synthetic oligonucleotide
attccaatttaatgtcctccctttattcatagaacaattcctcaagtc

SEQ ID NO: 394168 - DNA, 47 bp, Artificial Sequence
  Description of Artificial Sequence: Synthetic oligonucleotide
ttccaatttaatgtcctccctttattcatagaacaattcctcaagtc

SEQ ID NO: 394169 - DNA, 46 bp, Artificial Sequence
  Description of Artificial Sequence: Synthetic oligonucleotide
tccaatttaatgtcctccctttattcatagaacaattcctcaagtc

SEQ ID NO: 394170 - DNA, 45 bp, Artificial Sequence
  Description of Artificial Sequence: Synthetic oligonucleotide
ccaatttaatgtcctccctttattcatagaacaattcctcaagtc

SEQ ID NO: 394171 - DNA, 45 bp, Artificial Sequence
  Description of Artificial Sequence: Synthetic oligonucleotide
caatttaatgtcctccctttattcatagaacaattcctcaagtcc

SEQ ID NO: 394172 - DNA, 46 bp, Artificial Sequence
  Description of Artificial Sequence: Synthetic oligonucleotide
aatttaatgtcctccctttattcatagaacaattcctcaagtccac

SEQ ID NO: 394173 - DNA, 45 bp, Artificial Sequence
  Description of Artificial Sequence: Synthetic oligonucleotide
atttaatgtcctccctttattcatagaacaattcctcaagtccac

SEQ ID NO: 394174 - DNA, 44 bp, Artificial Sequence
  Description of Artificial Sequence: Synthetic oligonucleotide
tttaatgtcctccctttattcatagaacaattcctcaagtccac

SEQ ID NO: 394175 - DNA, 43 bp, Artificial Sequence
  Description of Artificial Sequence: Synthetic oligonucleotide
ttaatgtcctccctttattcatagaacaattcctcaagtccac

SEQ ID NO: 394176 - DNA, 42 bp, Artificial Sequence
  Description of Artificial Sequence: Synthetic oligonucleotide
taatgtcctccctttattcatagaacaattcctcaagtccac

SEQ ID NO: 394177 - DNA, 41 bp, Artificial Sequence
  Description of Artificial Sequence: Synthetic oligonucleotide
aatgtcctccctttattcatagaacaattcctcaagtccac

SEQ ID NO: 394178 - DNA, 40 bp, Artificial Sequence
  Description of Artificial Sequence: Synthetic oligonucleotide
atgtcctccctttattcatagaacaattcctcaagtccac

SEQ ID NO: 394179 - DNA, 33 bp, Artificial Sequence; identical to SEQ ID NO: 55774
  Description of Artificial Sequence: Synthetic oligonucleotide

SEQ ID NO: 394180 - DNA, 34 bp, Artificial Sequence; identical to SEQ ID NO: 55775
  Description of Artificial Sequence: Synthetic oligonucleotide

SEQ ID NO: 394181 - DNA, 36 bp, Artificial Sequence; identical to SEQ ID NO: 55776
  Description of Artificial Sequence: Synthetic oligonucleotide

SEQ ID NO: 394182 - DNA, 38 bp, Artificial Sequence; identical to SEQ ID NO: 55777
  Description of Artificial Sequence: Synthetic oligonucleotide

SEQ ID NO: 394183 - DNA, 37 bp, Artificial Sequence; identical to SEQ ID NO: 55778
  Description of Artificial Sequence: Synthetic oligonucleotide

SEQ ID NO: 394184 - DNA, 37 bp, Artificial Sequence; identical to SEQ ID NO: 55779
  Description of Artificial Sequence: Synthetic oligonucleotide

SEQ ID NO: 394185 - DNA, 36 bp, Artificial Sequence; identical to SEQ ID NO: 55780
  Description of Artificial Sequence: Synthetic oligonucleotide

SEQ ID NO: 394186 - DNA, 35 bp, Artificial Sequence; identical to SEQ ID NO: 55781
  Description of Artificial Sequence: Synthetic oligonucleotide

SEQ ID NO: 394187 - DNA, 36 bp, Artificial Sequence; identical to SEQ ID NO: 55782
  Description of Artificial Sequence: Synthetic oligonucleotide

SEQ ID NO: 394188 - DNA, 35 bp, Artificial Sequence; identical to SEQ ID NO: 55783
  Description of Artificial Sequence: Synthetic oligonucleotide

SEQ ID NO: 394189 - DNA, 35 bp, Artificial Sequence; identical to SEQ ID NO: 55784
  Description of Artificial Sequence: Synthetic oligonucleotide

SEQ ID NO: 394190 - DNA, 36 bp, Artificial Sequence; identical to SEQ ID NO: 55785
  Description of Artificial Sequence: Synthetic oligonucleotide

SEQ ID NO: 394191 - DNA, 36 bp, Artificial Sequence; identical to SEQ ID NO: 55786
  Description of Artificial Sequence: Synthetic oligonucleotide

SEQ ID NO: 394192 - DNA, 35 bp, Artificial Sequence; identical to SEQ ID NO: 55787
  Description of Artificial Sequence: Synthetic oligonucleotide

SEQ ID NO: 394193 - DNA, 34 bp, Artificial Sequence; identical to SEQ ID NO: 55788
  Description of Artificial Sequence: Synthetic oligonucleotide

SEQ ID NO: 394194 - DNA, 35 bp, Artificial Sequence; identical to SEQ ID NO: 55789
  Description of Artificial Sequence: Synthetic oligonucleotide

SEQ ID NO: 394195 - DNA, 34 bp, Artificial Sequence; identical to SEQ ID NO: 55790
  Description of Artificial Sequence: Synthetic oligonucleotide

SEQ ID NO: 394196 - DNA, 33 bp, Artificial Sequence; identical to SEQ ID NO: 55791
  Description of Artificial Sequence: Synthetic oligonucleotide

SEQ ID NO: 394197 - DNA, 32 bp, Artificial Sequence; identical to SEQ ID NO: 55792
  Description of Artificial Sequence: Synthetic oligonucleotide

SEQ ID NO: 394198 - DNA, 31 bp, Artificial Sequence; identical to SEQ ID NO: 55793
  Description of Artificial Sequence: Synthetic oligonucleotide

SEQ ID NO: 394199 - DNA, 30 bp, Artificial Sequence; identical to SEQ ID NO: 55794
  Description of Artificial Sequence: Synthetic oligonucleotide

SEQ ID NO: 394200 - DNA, 30 bp, Artificial Sequence; identical to SEQ ID NO: 55795
  Description of Artificial Sequence: Synthetic oligonucleotide

SEQ ID NO: 394201 - DNA, 29 bp, Artificial Sequence
  Description of Artificial Sequence: Synthetic oligonucleotide
tggagatgagcagttctacgtggacctgg

SEQ ID NO: 394202 - DNA, 28 bp, Artificial Sequence
  Description of Artificial Sequence: Synthetic oligonucleotide
ggagatgagcagttctacgtggacctgg

SEQ ID NO: 394203 - DNA, 29 bp, Artificial Sequence
  Description of Artificial Sequence: Synthetic oligonucleotide
gagatgagcagttctacgtggacctggag

SEQ ID NO: 394204 - DNA, 30 bp, Artificial Sequence; identical to SEQ ID NO: 55799
  Description of Artificial Sequence: Synthetic oligonucleotide

SEQ ID NO: 394205 - DNA, 29 bp, Artificial Sequence
  Description of Artificial Sequence: Synthetic oligonucleotide
gatgagcagttctacgtggacctggagag

SEQ ID NO: 394206 - DNA, 29 bp, Artificial Sequence
  Description of Artificial Sequence: Synthetic oligonucleotide
atgagcagttctacgtggacctggagagg

SEQ ID NO: 394207 - DNA, 28 bp, Artificial Sequence
  Description of Artificial Sequence: Synthetic oligonucleotide
tgagcagttctacgtggacctggagagg

SEQ ID NO: 394208 - DNA, 27 bp, Artificial Sequence
  Description of Artificial Sequence: Synthetic oligonucleotide
gagcagttctacgtggacctggagagg

SEQ ID NO: 394209 - DNA, 29 bp, Artificial Sequence
  Description of Artificial Sequence: Synthetic oligonucleotide
agcagttctacgtggacctggagaggaag

SEQ ID NO: 394210 - DNA, 28 bp, Artificial Sequence
  Description of Artificial Sequence: Synthetic oligonucleotide
gcagttctacgtggacctggagaggaag

SEQ ID NO: 394211 - DNA, 28 bp, Artificial Sequence
  Description of Artificial Sequence: Synthetic oligonucleotide
cagttctacgtggacctggagaggaagg

SEQ ID NO: 394212 - DNA, 32 bp, Artificial Sequence; identical to SEQ ID NO: 55807
  Description of Artificial Sequence: Synthetic oligonucleotide

SEQ ID NO: 394213 - DNA, 31 bp, Artificial Sequence; identical to SEQ ID NO: 55808
  Description of Artificial Sequence: Synthetic oligonucleotide

SEQ ID NO: 394214 - DNA, 30 bp, Artificial Sequence; identical to SEQ ID NO: 55809
  Description of Artificial Sequence: Synthetic oligonucleotide

SEQ ID NO: 394215 - DNA, 29 bp, Artificial Sequence
  Description of Artificial Sequence: Synthetic oligonucleotide
gtcagagctcacagagactgtggtctgtg

SEQ ID NO: 394216 - DNA, 29 bp, Artificial Sequence
  Description of Artificial Sequence: Synthetic oligonucleotide
tcagagctcacagagactgtggtctgtgc

SEQ ID NO: 394217 - DNA, 28 bp, Artificial Sequence
  Description of Artificial Sequence: Synthetic oligonucleotide
cagagctcacagagactgtggtctgtgc

SEQ ID NO: 394218 - DNA, 28 bp, Artificial Sequence
  Description of Artificial Sequence: Synthetic oligonucleotide
agagctcacagagactgtggtctgtgcc

SEQ ID NO: 394219 - DNA, 27 bp, Artificial Sequence
  Description of Artificial Sequence: Synthetic oligonucleotide
gagctcacagagactgtggtctgtgcc

SEQ ID NO: 394220 - DNA, 27 bp, Artificial Sequence
  Description of Artificial Sequence: Synthetic oligonucleotide
agctcacagagactgtggtctgtgccc

SEQ ID NO: 394221 - DNA, 27 bp, Artificial Sequence
  Description of Artificial Sequence: Synthetic oligonucleotide
gctcacagagactgtggtctgtgccct

SEQ ID NO: 394222 - DNA, 27 bp, Artificial Sequence
  Description of Artificial Sequence: Synthetic oligonucleotide
ctcacagagactgtggtctgtgccctg

SEQ ID NO: 394223 - DNA, 27 bp, Artificial Sequence
  Description of Artificial Sequence: Synthetic oligonucleotide
tcacagagactgtggtctgtgccctgg

SEQ ID NO: 394224 - DNA, 26 bp, Artificial Sequence
  Description of Artificial Sequence: Synthetic oligonucleotide
cacagagactgtggtctgtgccctgg

SEQ ID NO: 394225 - DNA, 26 bp, Artificial Sequence
  Description of Artificial Sequence: Synthetic oligonucleotide
acagagactgtggtctgtgccctggg

SEQ ID NO: 394226 - DNA, 25 bp, Artificial Sequence
  Description of Artificial Sequence: Synthetic oligonucleotide
cagagactgtggtctgtgccctggg

SEQ ID NO: 394227 - DNA, 27 bp, Artificial Sequence
  Description of Artificial Sequence: Synthetic oligonucleotide
agagactgtggtctgtgccctggggtt

SEQ ID NO: 394228 - DNA, 26 bp, Artificial Sequence
  Description of Artificial Sequence: Synthetic oligonucleotide
gagactgtggtctgtgccctggggtt

SEQ ID NO: 394229 - DNA, 27 bp, Artificial Sequence
  Description of Artificial Sequence: Synthetic oligonucleotide
agactgtggtctgtgccctggggttgt

SEQ ID NO: 394230 - DNA, 26 bp, Artificial Sequence
  Description of Artificial Sequence: Synthetic oligonucleotide
gactgtggtctgtgccctggggttgt

SEQ ID NO: 394231 - DNA, 27 bp, Artificial Sequence
  Description of Artificial Sequence: Synthetic oligonucleotide
actgtggtctgtgccctggggttgtct

SEQ ID NO: 394232 - DNA, 26 bp, Artificial Sequence
  Description of Artificial Sequence: Synthetic oligonucleotide
ctgtggtctgtgccctggggttgtct

SEQ ID NO: 394233 - DNA, 27 bp, Artificial Sequence
  Description of Artificial Sequence: Synthetic oligonucleotide
tgtggtctgtgccctggggttgtctgt

SEQ ID NO: 394234 - DNA, 26 bp, Artificial Sequence
  Description of Artificial Sequence: Synthetic oligonucleotide
gtggtctgtgccctggggttgtctgt

SEQ ID NO: 394235 - DNA, 26 bp, Artificial Sequence
  Description of Artificial Sequence: Synthetic oligonucleotide
tggtctgtgccctggggttgtctgtg

SEQ ID NO: 394236 - DNA, 25 bp, Artificial Sequence
  Description of Artificial Sequence: Synthetic oligonucleotide
ggtctgtgccctggggttgtctgtg

SEQ ID NO: 394237 - DNA, 25 bp, Artificial Sequence
  Description of Artificial Sequence: Synthetic oligonucleotide
gtctgtgccctggggttgtctgtgg

SEQ ID NO: 394238 - DNA, 25 bp, Artificial Sequence
  Description of Artificial Sequence: Synthetic oligonucleotide
tctgtgccctggggttgtctgtggg

SEQ ID NO: 394239 - DNA, 24 bp, Artificial Sequence
  Description of Artificial Sequence: Synthetic oligonucleotide
ctgtgccctggggttgtctgtggg

SEQ ID NO: 394240 - DNA, 24 bp, Artificial Sequence
  Description of Artificial Sequence: Synthetic oligonucleotide
tgtgccctggggttgtctgtgggc

SEQ ID NO: 394241 - DNA, 23 bp, Artificial Sequence
  Description of Artificial Sequence: Synthetic oligonucleotide
gtgccctggggttgtctgtgggc

SEQ ID NO: 394242 - DNA, 24 bp, Artificial Sequence
  Description of Artificial Sequence: Synthetic oligonucleotide
tgccctggggttgtctgtgggcct

SEQ ID NO: 394243 - DNA, 25 bp, Artificial Sequence
  Description of Artificial Sequence: Synthetic oligonucleotide
ccctggggttgtctgtgggcctcat

SEQ ID NO: 394244 - DNA, 25 bp, Artificial Sequence
  Description of Artificial Sequence: Synthetic oligonucleotide
cctggggttgtctgtgggcctcatg

SEQ ID NO: 394245 - DNA, 25 bp, Artificial Sequence
  Description of Artificial Sequence: Synthetic oligonucleotide
ctggggttgtctgtgggcctcatgg

SEQ ID NO: 394246 - DNA, 25 bp, Artificial Sequence
  Description of Artificial Sequence: Synthetic oligonucleotide
tggggttgtctgtgggcctcatggg

SEQ ID NO: 394247 - DNA, 24 bp, Artificial Sequence
  Description of Artificial Sequence: Synthetic oligonucleotide
ggggttgtctgtgggcctcatggg

SEQ ID NO: 394248 - DNA, 27 bp, Artificial Sequence
  Description of Artificial Sequence: Synthetic oligonucleotide
gggttgtctgtgggcctcatgggcatt

SEQ ID NO: 394249 - DNA, 27 bp, Artificial Sequence
  Description of Artificial Sequence: Synthetic oligonucleotide
ggttgtctgtgggcctcatgggcattg

SEQ ID NO: 394250 - DNA, 28 bp, Artificial Sequence
  Description of Artificial Sequence: Synthetic oligonucleotide
gttgtctgtgggcctcatgggcattgtg

SEQ ID NO: 394251 - DNA, 28 bp, Artificial Sequence
  Description of Artificial Sequence: Synthetic oligonucleotide
ttgtctgtgggcctcatgggcattgtgg

SEQ ID NO: 394252 - DNA, 27 bp, Artificial Sequence
  Description of Artificial Sequence: Synthetic oligonucleotide
tgtctgtgggcctcatgggcattgtgg

SEQ ID NO: 394253 - DNA, 27 bp, Artificial Sequence
  Description of Artificial Sequence: Synthetic oligonucleotide
gtctgtgggcctcatgggcattgtggt

SEQ ID NO: 394254 - DNA, 27 bp, Artificial Sequence
  Description of Artificial Sequence: Synthetic oligonucleotide
tctgtgggcctcatgggcattgtggtg

SEQ ID NO: 394255 - DNA, 26 bp, Artificial Sequence
  Description of Artificial Sequence: Synthetic oligonucleotide
ctgtgggcctcatgggcattgtggtg

SEQ ID NO: 394256 - DNA, 26 bp, Artificial Sequence
  Description of Artificial Sequence: Synthetic oligonucleotide
tgtgggcctcatgggcattgtggtgg

SEQ ID NO: 394257 - DNA, 25 bp, Artificial Sequence
  Description of Artificial Sequence: Synthetic oligonucleotide
gtgggcctcatgggcattgtggtgg

SEQ ID NO: 394258 - DNA, 25 bp, Artificial Sequence
  Description of Artificial Sequence: Synthetic oligonucleotide
tgggcctcatgggcattgtggtggg

SEQ ID NO: 394259 - DNA, 24 bp, Artificial Sequence
  Description of Artificial Sequence: Synthetic oligonucleotide
gggcctcatgggcattgtggtggg

SEQ ID NO: 394260 - DNA, 25 bp, Artificial Sequence
  Description of Artificial Sequence: Synthetic oligonucleotide
ggcctcatgggcattgtggtgggca

SEQ ID NO: 394261 - DNA, 26 bp, Artificial Sequence
  Description of Artificial Sequence: Synthetic oligonucleotide
gcctcatgggcattgtggtgggcact

SEQ ID NO: 394262 - DNA, 27 bp, Artificial Sequence
  Description of Artificial Sequence: Synthetic oligonucleotide
cctcatgggcattgtggtgggcactgt

SEQ ID NO: 394263 - DNA, 27 bp, Artificial Sequence
  Description of Artificial Sequence: Synthetic oligonucleotide
ctcatgggcattgtggtgggcactgtc

SEQ ID NO: 394264 - DNA, 29 bp, Artificial Sequence
  Description of Artificial Sequence: Synthetic oligonucleotide
tcatgggcattgtggtgggcactgtcttc

SEQ ID NO: 394265 - DNA, 28 bp, Artificial Sequence
  Description of Artificial Sequence: Synthetic oligonucleotide
catgggcattgtggtgggcactgtcttc

SEQ ID NO: 394266 - DNA, 30 bp, Artificial Sequence; identical to SEQ ID NO: 55861
  Description of Artificial Sequence: Synthetic oligonucleotide

SEQ ID NO: 394267 - DNA, 27 bp, Artificial Sequence
  Description of Artificial Sequence: Synthetic oligonucleotide
gcggtggctcatgcctgtaatctgagc

SEQ ID NO: 394268 - DNA, 29 bp, Artificial Sequence
  Description of Artificial Sequence: Synthetic oligonucleotide
agtgagccgagaccttgccattgtaccac

SEQ ID NO: 394269 - DNA, 28 bp, Artificial Sequence
  Description of Artificial Sequence: Synthetic oligonucleotide
gtgagccgagaccttgccattgtaccac

SEQ ID NO: 394270 - DNA, 29 bp, Artificial Sequence
  Description of Artificial Sequence: Synthetic oligonucleotide
tgagccgagaccttgccattgtaccacag

SEQ ID NO: 394271 - DNA, 28 bp, Artificial Sequence
  Description of Artificial Sequence: Synthetic oligonucleotide
gagccgagaccttgccattgtaccacag

SEQ ID NO: 394272 - DNA, 28 bp, Artificial Sequence
  Description of Artificial Sequence: Synthetic oligonucleotide
agccgagaccttgccattgtaccacagc

SEQ ID NO: 394273 - DNA, 27 bp, Artificial Sequence
  Description of Artificial Sequence: Synthetic oligonucleotide
gccgagaccttgccattgtaccacagc

SEQ ID NO: 394274 - DNA, 27 bp, Artificial Sequence
  Description of Artificial Sequence: Synthetic oligonucleotide
ccgagaccttgccattgtaccacagcc

SEQ ID NO: 394275 - DNA, 28 bp, Artificial Sequence
  Description of Artificial Sequence: Synthetic oligonucleotide
cgagaccttgccattgtaccacagcctg

SEQ ID NO: 394276 - DNA, 28 bp, Artificial Sequence
  Description of Artificial Sequence: Synthetic oligonucleotide
gagaccttgccattgtaccacagcctgg

SEQ ID NO: 394277 - DNA, 28 bp, Artificial Sequence
  Description of Artificial Sequence: Synthetic oligonucleotide
agaccttgccattgtaccacagcctggg

SEQ ID NO: 394278 - DNA, 27 bp, Artificial Sequence
  Description of Artificial Sequence: Synthetic oligonucleotide
gaccttgccattgtaccacagcctggg

SEQ ID NO: 394279 - DNA, 28 bp, Artificial Sequence
  Description of Artificial Sequence: Synthetic oligonucleotide
accttgccattgtaccacagcctgggtg

SEQ ID NO: 394280 - DNA, 27 bp, Artificial Sequence
  Description of Artificial Sequence: Synthetic oligonucleotide
ccttgccattgtaccacagcctgggtg

SEQ ID NO: 394281 - DNA, 28 bp, Artificial Sequence
  Description of Artificial Sequence: Synthetic oligonucleotide
cttgccattgtaccacagcctgggtgac

SEQ ID NO: 394282 - DNA, 29 bp, Artificial Sequence
  Description of Artificial Sequence: Synthetic oligonucleotide
ttgccattgtaccacagcctgggtgacag

SEQ ID NO: 394283 - DNA, 28 bp, Artificial Sequence
  Description of Artificial Sequence: Synthetic oligonucleotide
tgccattgtaccacagcctgggtgacag

SEQ ID NO: 394284 - DNA, 27 bp, Artificial Sequence
  Description of Artificial Sequence: Synthetic oligonucleotide
gccattgtaccacagcctgggtgacag

SEQ ID NO: 394285 - DNA, 28 bp, Artificial Sequence
  Description of Artificial Sequence: Synthetic oligonucleotide
ccattgtaccacagcctgggtgacagag

SEQ ID NO: 394286 - DNA, 29 bp, Artificial Sequence
  Description of Artificial Sequence: Synthetic oligonucleotide
cattgtaccacagcctgggtgacagagtg

SEQ ID NO: 394287 - DNA, 30 bp, Artificial Sequence
  Description of Artificial Sequence: Synthetic oligonucleotide
attgtaccacagcctgggtgacagagtgag

SEQ ID NO: 394288 - DNA, 29 bp, Artificial Sequence
  Description of Artificial Sequence: Synthetic oligonucleotide
ttgtaccacagcctgggtgacagagtgag

SEQ ID NO: 394289 - DNA, 28 bp, Artificial Sequence
  Description of Artificial Sequence: Synthetic oligonucleotide
tgtaccacagcctgggtgacagagtgag

SEQ ID NO: 394290 - DNA, 27 bp, Artificial Sequence
  Description of Artificial Sequence: Synthetic oligonucleotide
gtaccacagcctgggtgacagagtgag

SEQ ID NO: 394291 - DNA, 28 bp, Artificial Sequence
  Description of Artificial Sequence: Synthetic oligonucleotide
taccacagcctgggtgacagagtgagac

SEQ ID NO: 394292 - DNA, 27 bp, Artificial Sequence
  Description of Artificial Sequence: Synthetic oligonucleotide
accacagcctgggtgacagagtgagac

SEQ ID NO: 394293 - DNA, 27 bp, Artificial Sequence
  Description of Artificial Sequence: Synthetic oligonucleotide
ccacagcctgggtgacagagtgagact

SEQ ID NO: 394294 - DNA, 28 bp, Artificial Sequence
  Description of Artificial Sequence: Synthetic oligonucleotide
cacagcctgggtgacagagtgagactac

SEQ ID NO: 394295 - DNA, 28 bp, Artificial Sequence
  Description of Artificial Sequence: Synthetic oligonucleotide
acagcctgggtgacagagtgagactacg

SEQ ID NO: 394296 - DNA, 59 bp, Artificial Sequence
  Description of Artificial Sequence: Synthetic oligonucleotide
tgacagagtgagactacgtctcaaaaaaaaagaaaaagaaaagaaaaagaaaaaaaaag

SEQ ID NO: 394297 - DNA, 58 bp, Artificial Sequence
  Description of Artificial Sequence: Synthetic oligonucleotide
gacagagtgagactacgtctcaaaaaaaaagaaaaagaaaagaaaaagaaaaaaaaag

SEQ ID NO: 394298 - DNA, 60 bp, Artificial Sequence
  Description of Artificial Sequence: Synthetic oligonucleotide
acagagtgagactacgtctcaaaaaaaaagaaaaagaaaagaaaaagaaaaaaaaagaaa

SEQ ID NO: 394299 - DNA, 60 bp, Artificial Sequence
  Description of Artificial Sequence: Synthetic oligonucleotide
cagagtgagactacgtctcaaaaaaaaagaaaaagaaaagaaaaagaaaaaaaaagaaaa

SEQ ID NO: 394300 - DNA, 60 bp, Artificial Sequence
  Description of Artificial Sequence: Synthetic oligonucleotide
agagtgagactacgtctcaaaaaaaaagaaaaagaaaagaaaaagaaaaaaaaagaaaaa

SEQ ID NO: 394301 - DNA, 60 bp, Artificial Sequence
  Description of Artificial Sequence: Synthetic oligonucleotide
gagtgagactacgtctcaaaaaaaaagaaaaagaaaagaaaaagaaaaaaaaagaaaaac

SEQ ID NO: 394302 - DNA, 60 bp, Artificial Sequence
  Description of Artificial Sequence: Synthetic oligonucleotide
agtgagactacgtctcaaaaaaaaagaaaaagaaaagaaaaagaaaaaaaaagaaaaaca

SEQ ID NO: 394303 - DNA, 60 bp, Artificial Sequence
  Description of Artificial Sequence: Synthetic oligonucleotide
gtgagactacgtctcaaaaaaaaagaaaaagaaaagaaaaagaaaaaaaaagaaaaacac

SEQ ID NO: 394304 - DNA, 60 bp, Artificial Sequence
  Description of Artificial Sequence: Synthetic oligonucleotide
tgagactacgtctcaaaaaaaaagaaaaagaaaagaaaaagaaaaaaaaagaaaaacacc

SEQ ID NO: 394305 - DNA, 60 bp, Artificial Sequence
  Description of Artificial Sequence: Synthetic oligonucleotide
gagactacgtctcaaaaaaaaagaaaaagaaaagaaaaagaaaaaaaaagaaaaacaccc

SEQ ID NO: 394306 - DNA, 60 bp, Artificial Sequence
  Description of Artificial Sequence: Synthetic oligonucleotide
agactacgtctcaaaaaaaaagaaaaagaaaagaaaaagaaaaaaaaagaaaaacaccca

SEQ ID NO: 394307 - DNA, 60 bp, Artificial Sequence
  Description of Artificial Sequence: Synthetic oligonucleotide
gactacgtctcaaaaaaaaagaaaaagaaaagaaaaagaaaaaaaaagaaaaacacccat

SEQ ID NO: 394308 - DNA, 60 bp, Artificial Sequence
  Description of Artificial Sequence: Synthetic oligonucleotide
actacgtctcaaaaaaaaagaaaaagaaaagaaaaagaaaaaaaaagaaaaacacccatc

SEQ ID NO: 394309 - DNA, 60 bp, Artificial Sequence
  Description of Artificial Sequence: Synthetic oligonucleotide
ctacgtctcaaaaaaaaagaaaaagaaaagaaaaagaaaaaaaaagaaaaacacccatcc

SEQ ID NO: 394310 - DNA, 60 bp, Artificial Sequence
  Description of Artificial Sequence: Synthetic oligonucleotide
tacgtctcaaaaaaaaagaaaaagaaaagaaaaagaaaaaaaaagaaaaacacccatccc

SEQ ID NO: 394311 - DNA, 59 bp, Artificial Sequence
  Description of Artificial Sequence: Synthetic oligonucleotide
acgtctcaaaaaaaaagaaaaagaaaagaaaaagaaaaaaaaagaaaaacacccatccc

SEQ ID NO: 394312 - DNA, 58 bp, Artificial Sequence
  Description of Artificial Sequence: Synthetic oligonucleotide
cgtctcaaaaaaaaagaaaaagaaaagaaaaagaaaaaaaaagaaaaacacccatccc

SEQ ID NO: 394313 - DNA, 59 bp, Artificial Sequence
  Description of Artificial Sequence: Synthetic oligonucleotide
gtctcaaaaaaaaagaaaaagaaaagaaaaagaaaaaaaaagaaaaacacccatccctc

SEQ ID NO: 394314 - DNA, 60 bp, Artificial Sequence
  Description of Artificial Sequence: Synthetic oligonucleotide
tctcaaaaaaaaagaaaaagaaaagaaaaagaaaaaaaaagaaaaacacccatccctctt

SEQ ID NO: 394315 - DNA, 60 bp, Artificial Sequence
  Description of Artificial Sequence: Synthetic oligonucleotide
ctcaaaaaaaaagaaaaagaaaagaaaaagaaaaaaaaagaaaaacacccatccctcttg

SEQ ID NO: 394316 - DNA, 60 bp, Artificial Sequence
  Description of Artificial Sequence: Synthetic oligonucleotide
tcaaaaaaaaagaaaaagaaaagaaaaagaaaaaaaaagaaaaacacccatccctcttgc

SEQ ID NO: 394317 - DNA, 59 bp, Artificial Sequence
  Description of Artificial Sequence: Synthetic oligonucleotide
caaaaaaaaagaaaaagaaaagaaaaagaaaaaaaaagaaaaacacccatccctcttgc

SEQ ID NO: 394318 - DNA, 59 bp, Artificial Sequence
  Description of Artificial Sequence: Synthetic oligonucleotide
aaaaaaaaagaaaaagaaaagaaaaagaaaaaaaaagaaaaacacccatccctcttgcg

SEQ ID NO: 394319 - DNA, 58 bp, Artificial Sequence
  Description of Artificial Sequence: Synthetic oligonucleotide
aaaaaaaagaaaaagaaaagaaaaagaaaaaaaaagaaaaacacccatccctcttgcg

SEQ ID NO: 394320 - DNA, 57 bp, Artificial Sequence
  Description of Artificial Sequence: Synthetic oligonucleotide
aaaaaaagaaaaagaaaagaaaaagaaaaaaaaagaaaaacacccatccctcttgcg

SEQ ID NO: 394321 - DNA, 56 bp, Artificial Sequence
  Description of Artificial Sequence: Synthetic oligonucleotide
aaaaaagaaaaagaaaagaaaaagaaaaaaaaagaaaaacacccatccctcttgcg

SEQ ID NO: 394322 - DNA, 55 bp, Artificial Sequence
  Description of Artificial Sequence: Synthetic oligonucleotide
aaaaagaaaaagaaaagaaaaagaaaaaaaaagaaaaacacccatccctcttgcg

SEQ ID NO: 394323 - DNA, 54 bp, Artificial Sequence
  Description of Artificial Sequence: Synthetic oligonucleotide
aaaagaaaaagaaaagaaaaagaaaaaaaaagaaaaacacccatccctcttgcg

SEQ ID NO: 394324 - DNA, 35 bp, Artificial Sequence
  Description of Artificial Sequence: Synthetic oligonucleotide
gcagacatgcacacaccagagaagattccaatttc

SEQ ID NO: 394325 - DNA, 35 bp, Artificial Sequence
  Description of Artificial Sequence: Synthetic oligonucleotide
cagacatgcacacaccagagaagattccaatttcg

SEQ ID NO: 394326 - DNA, 36 bp, Artificial Sequence
  Description of Artificial Sequence: Synthetic oligonucleotide
agacatgcacacaccagagaagattccaatttcgtg

SEQ ID NO: 394327 - DNA, 35 bp, Artificial Sequence
  Description of Artificial Sequence: Synthetic oligonucleotide
gacatgcacacaccagagaagattccaatttcgtg

SEQ ID NO: 394328 - DNA, 36 bp, Artificial Sequence
  Description of Artificial Sequence: Synthetic oligonucleotide
acatgcacacaccagagaagattccaatttcgtgtc

SEQ ID NO: 394329 - DNA, 35 bp, Artificial Sequence
  Description of Artificial Sequence: Synthetic oligonucleotide
catgcacacaccagagaagattccaatttcgtgtc

SEQ ID NO: 394330 - DNA, 35 bp, Artificial Sequence
  Description of Artificial Sequence: Synthetic oligonucleotide
atgcacacaccagagaagattccaatttcgtgtcc

SEQ ID NO: 394331 - DNA, 34 bp, Artificial Sequence
  Description of Artificial Sequence: Synthetic oligonucleotide
tgcacacaccagagaagattccaatttcgtgtcc

SEQ ID NO: 394332 - DNA, 33 bp, Artificial Sequence
  Description of Artificial Sequence: Synthetic oligonucleotide
gcacacaccagagaagattccaatttcgtgtcc

SEQ ID NO: 394333 - DNA, 34 bp, Artificial Sequence
  Description of Artificial Sequence: Synthetic oligonucleotide
cacacaccagagaagattccaatttcgtgtcctc

SEQ ID NO: 394334 - DNA, 34 bp, Artificial Sequence
  Description of Artificial Sequence: Synthetic oligonucleotide
acacaccagagaagattccaatttcgtgtcctcc

SEQ ID NO: 394335 - DNA, 33 bp, Artificial Sequence
  Description of Artificial Sequence: Synthetic oligonucleotide
cacaccagagaagattccaatttcgtgtcctcc

SEQ ID NO: 394336 - DNA, 33 bp, Artificial Sequence
  Description of Artificial Sequence: Synthetic oligonucleotide
acaccagagaagattccaatttcgtgtcctccc

SEQ ID NO: 394337 - DNA, 32 bp, Artificial Sequence
  Description of Artificial Sequence: Synthetic oligonucleotide
caccagagaagattccaatttcgtgtcctccc

SEQ ID NO: 394338 - DNA, 38 bp, Artificial Sequence
  Description of Artificial Sequence: Synthetic oligonucleotide
accagagaagattccaatttcgtgtcctccctttattc

SEQ ID NO: 394339 - DNA, 37 bp, Artificial Sequence
  Description of Artificial Sequence: Synthetic oligonucleotide
ccagagaagattccaatttcgtgtcctccctttattc

SEQ ID NO: 394340 - DNA, 40 bp, Artificial Sequence
  Description of Artificial Sequence: Synthetic oligonucleotide
cagagaagattccaatttcgtgtcctccctttattcatag

SEQ ID NO: 394341 - DNA, 42 bp, Artificial Sequence
  Description of Artificial Sequence: Synthetic oligonucleotide
agagaagattccaatttcgtgtcctccctttattcatagaac

SEQ ID NO: 394342 - DNA, 41 bp, Artificial Sequence
  Description of Artificial Sequence: Synthetic oligonucleotide
gagaagattccaatttcgtgtcctccctttattcatagaac

SEQ ID NO: 394343 - DNA, 45 bp, Artificial Sequence
  Description of Artificial Sequence: Synthetic oligonucleotide
agaagattccaatttcgtgtcctccctttattcatagaacaattc

SEQ ID NO: 394344 - DNA, 44 bp, Artificial Sequence
  Description of Artificial Sequence: Synthetic oligonucleotide
gaagattccaatttcgtgtcctccctttattcatagaacaattc

SEQ ID NO: 394345 - DNA, 44 bp, Artificial Sequence
  Description of Artificial Sequence: Synthetic oligonucleotide
aagattccaatttcgtgtcctccctttattcatagaacaattcc

SEQ ID NO: 394346 - DNA, 43 bp, Artificial Sequence
  Description of Artificial Sequence: Synthetic oligonucleotide
agattccaatttcgtgtcctccctttattcatagaacaattcc

SEQ ID NO: 394347 - DNA, 42 bp, Artificial Sequence
  Description of Artificial Sequence: Synthetic oligonucleotide
gattccaatttcgtgtcctccctttattcatagaacaattcc

SEQ ID NO: 394348 - DNA, 43 bp, Artificial Sequence
  Description of Artificial Sequence: Synthetic oligonucleotide
attccaatttcgtgtcctccctttattcatagaacaattcctc

SEQ ID NO: 394349 - DNA, 42 bp, Artificial Sequence
  Description of Artificial Sequence: Synthetic oligonucleotide
ttccaatttcgtgtcctccctttattcatagaacaattcctc

SEQ ID NO: 394350 - DNA, 41 bp, Artificial Sequence
  Description of Artificial Sequence: Synthetic oligonucleotide
tccaatttcgtgtcctccctttattcatagaacaattcctc

SEQ ID NO: 394351 - DNA, 40 bp, Artificial Sequence
  Description of Artificial Sequence: Synthetic oligonucleotide
ccaatttcgtgtcctccctttattcatagaacaattcctc

SEQ ID NO: 394352 - DNA, 42 bp, Artificial Sequence
  Description of Artificial Sequence: Synthetic oligonucleotide
caatttcgtgtcctccctttattcatagaacaattcctcaag

SEQ ID NO: 394353 - DNA, 43 bp, Artificial Sequence
  Description of Artificial Sequence: Synthetic oligonucleotide
aatttcgtgtcctccctttattcatagaacaattcctcaagtc

SEQ ID NO: 394354 - DNA, 42 bp, Artificial Sequence
  Description of Artificial Sequence: Synthetic oligonucleotide
atttcgtgtcctccctttattcatagaacaattcctcaagtc

SEQ ID NO: 394355 - DNA, 41 bp, Artificial Sequence
  Description of Artificial Sequence: Synthetic oligonucleotide
tttcgtgtcctccctttattcatagaacaattcctcaagtc

SEQ ID NO: 394356 - DNA, 40 bp, Artificial Sequence
  Description of Artificial Sequence: Synthetic oligonucleotide
ttcgtgtcctccctttattcatagaacaattcctcaagtc

SEQ ID NO: 394357 - DNA, 39 bp, Artificial Sequence
  Description of Artificial Sequence: Synthetic oligonucleotide
tcgtgtcctccctttattcatagaacaattcctcaagtc

SEQ ID NO: 394358 - DNA, 38 bp, Artificial Sequence
  Description of Artificial Sequence: Synthetic oligonucleotide
cgtgtcctccctttattcatagaacaattcctcaagtc

SEQ ID NO: 394359 - DNA, 27 bp, Artificial Sequence
  Description of Artificial Sequence: Synthetic oligonucleotide
acactgggtcagcccaacaccctcatc

SEQ ID NO: 394360 - DNA, 27 bp, Artificial Sequence
  Description of Artificial Sequence: Synthetic oligonucleotide
cactgggtcagcccaacaccctcatct

SEQ ID NO: 394361 - DNA, 27 bp, Artificial Sequence
  Description of Artificial Sequence: Synthetic oligonucleotide
actgggtcagcccaacaccctcatctg

SEQ ID NO: 394362 - DNA, 27 bp, Artificial Sequence
  Description of Artificial Sequence: Synthetic oligonucleotide
ctgggtcagcccaacaccctcatctgt

SEQ ID NO: 394363 - DNA, 27 bp, Artificial Sequence
  Description of Artificial Sequence: Synthetic oligonucleotide
tgggtcagcccaacaccctcatctgtc

SEQ ID NO: 394364 - DNA, 27 bp, Artificial Sequence
  Description of Artificial Sequence: Synthetic oligonucleotide
gggtcagcccaacaccctcatctgtct

SEQ ID NO: 394365 - DNA, 28 bp, Artificial Sequence
  Description of Artificial Sequence: Synthetic oligonucleotide
ggtcagcccaacaccctcatctgtcttg

SEQ ID NO: 394366 - DNA, 29 bp, Artificial Sequence
  Description of Artificial Sequence: Synthetic oligonucleotide
gtcagcccaacaccctcatctgtcttgtg

SEQ ID NO: 394367 - DNA, 29 bp, Artificial Sequence
  Description of Artificial Sequence: Synthetic oligonucleotide
tcagcccaacaccctcatctgtcttgtgg

SEQ ID NO: 394368 - DNA, 28 bp, Artificial Sequence
  Description of Artificial Sequence: Synthetic oligonucleotide
cagcccaacaccctcatctgtcttgtgg

SEQ ID NO: 394369 - DNA, 29 bp, Artificial Sequence
  Description of Artificial Sequence: Synthetic oligonucleotide
agcccaacaccctcatctgtcttgtggac

SEQ ID NO: 394370 - DNA, 28 bp, Artificial Sequence
  Description of Artificial Sequence: Synthetic oligonucleotide
gcccaacaccctcatctgtcttgtggac

SEQ ID NO: 394371 - DNA, 30 bp, Artificial Sequence; identical to SEQ ID NO: 55874
  Description of Artificial Sequence: Synthetic oligonucleotide

SEQ ID NO: 394372 - DNA, 32 bp, Artificial Sequence; identical to SEQ ID NO: 55875
  Description of Artificial Sequence: Synthetic oligonucleotide

SEQ ID NO: 394373 - DNA, 35 bp, Artificial Sequence; identical to SEQ ID NO: 55876
  Description of Artificial Sequence: Synthetic oligonucleotide

SEQ ID NO: 394374 - DNA, 35 bp, Artificial Sequence; identical to SEQ ID NO: 55877
  Description of Artificial Sequence: Synthetic oligonucleotide

SEQ ID NO: 394375 - DNA, 34 bp, Artificial Sequence; identical to SEQ ID NO: 55878
  Description of Artificial Sequence: Synthetic oligonucleotide

SEQ ID NO: 394376 - DNA, 33 bp, Artificial Sequence; identical to SEQ ID NO: 55879
  Description of Artificial Sequence: Synthetic oligonucleotide

SEQ ID NO: 394377 - DNA, 34 bp, Artificial Sequence; identical to SEQ ID NO: 55880
  Description of Artificial Sequence: Synthetic oligonucleotide

SEQ ID NO: 394378 - DNA, 33 bp, Artificial Sequence; identical to SEQ ID NO: 55881
  Description of Artificial Sequence: Synthetic oligonucleotide

SEQ ID NO: 394379 - DNA, 33 bp, Artificial Sequence; identical to SEQ ID NO: 55882
  Description of Artificial Sequence: Synthetic oligonucleotide

SEQ ID NO: 394380 - DNA, 34 bp, Artificial Sequence; identical to SEQ ID NO: 55883
  Description of Artificial Sequence: Synthetic oligonucleotide

SEQ ID NO: 394381 - DNA, 35 bp, Artificial Sequence; identical to SEQ ID NO: 55884
  Description of Artificial Sequence: Synthetic oligonucleotide

SEQ ID NO: 394382 - DNA, 34 bp, Artificial Sequence; identical to SEQ ID NO: 55885
  Description of Artificial Sequence: Synthetic oligonucleotide

SEQ ID NO: 394383 - DNA, 34 bp, Artificial Sequence; identical to SEQ ID NO: 55886
  Description of Artificial Sequence: Synthetic oligonucleotide

SEQ ID NO: 394384 - DNA, 33 bp, Artificial Sequence; identical to SEQ ID NO: 55887
  Description of Artificial Sequence: Synthetic oligonucleotide

SEQ ID NO: 394385 - DNA, 32 bp, Artificial Sequence; identical to SEQ ID NO: 55888
  Description of Artificial Sequence: Synthetic oligonucleotide

SEQ ID NO: 394386 - DNA, 33 bp, Artificial Sequence; identical to SEQ ID NO: 55889
  Description of Artificial Sequence: Synthetic oligonucleotide

SEQ ID NO: 394387 - DNA, 34 bp, Artificial Sequence; identical to SEQ ID NO: 55890
  Description of Artificial Sequence: Synthetic oligonucleotide

SEQ ID NO: 394388 - DNA, 33 bp, Artificial Sequence; identical to SEQ ID NO: 55891
  Description of Artificial Sequence: Synthetic oligonucleotide

SEQ ID NO: 394389 - DNA, 33 bp, Artificial Sequence; identical to SEQ ID NO: 55892
  Description of Artificial Sequence: Synthetic oligonucleotide

SEQ ID NO: 394390 - DNA, 32 bp, Artificial Sequence; identical to SEQ ID NO: 55893
  Description of Artificial Sequence: Synthetic oligonucleotide

SEQ ID NO: 394391 - DNA, 31 bp, Artificial Sequence; identical to SEQ ID NO: 55894
  Description of Artificial Sequence: Synthetic oligonucleotide

SEQ ID NO: 394392 - DNA, 31 bp, Artificial Sequence; identical to SEQ ID NO: 55895
  Description of Artificial Sequence: Synthetic oligonucleotide

SEQ ID NO: 394393 - DNA, 30 bp, Artificial Sequence; identical to SEQ ID NO: 55896
  Description of Artificial Sequence: Synthetic oligonucleotide

SEQ ID NO: 394394 - DNA, 29 bp, Artificial Sequence
  Description of Artificial Sequence: Synthetic oligonucleotide
ctttcctcctgtggtcaacatcacctggc

SEQ ID NO: 394395 - DNA, 30 bp, Artificial Sequence; identical to SEQ ID NO: 55898
  Description of Artificial Sequence: Synthetic oligonucleotide

SEQ ID NO: 394396 - DNA, 29 bp, Artificial Sequence
  Description of Artificial Sequence: Synthetic oligonucleotide
ttcctcctgtggtcaacatcacctggctg

SEQ ID NO: 394397 - DNA, 28 bp, Artificial Sequence
  Description of Artificial Sequence: Synthetic oligonucleotide
tcctcctgtggtcaacatcacctggctg

SEQ ID NO: 394398 - DNA, 27 bp, Artificial Sequence
  Description of Artificial Sequence: Synthetic oligonucleotide
cctcctgtggtcaacatcacctggctg

SEQ ID NO: 394399 - DNA, 28 bp, Artificial Sequence
  Description of Artificial Sequence: Synthetic oligonucleotide
ctcctgtggtcaacatcacctggctgag

SEQ ID NO: 394400 - DNA, 28 bp, Artificial Sequence
  Description of Artificial Sequence: Synthetic oligonucleotide
tcctgtggtcaacatcacctggctgagc

SEQ ID NO: 394401 - DNA, 27 bp, Artificial Sequence
  Description of Artificial Sequence: Synthetic oligonucleotide
cctgtggtcaacatcacctggctgagc

SEQ ID NO: 394402 - DNA, 30 bp, Artificial Sequence; identical to SEQ ID NO: 55905
  Description of Artificial Sequence: Synthetic oligonucleotide

SEQ ID NO: 394403 - DNA, 30 bp, Artificial Sequence; identical to SEQ ID NO: 55906
  Description of Artificial Sequence: Synthetic oligonucleotide

SEQ ID NO: 394404 - DNA, 29 bp, Artificial Sequence
  Description of Artificial Sequence: Synthetic oligonucleotide
gtggtcaacatcacctggctgagcaatgg

SEQ ID NO: 394405 - DNA, 29 bp, Artificial Sequence
  Description of Artificial Sequence: Synthetic oligonucleotide
tggtcaacatcacctggctgagcaatggg

SEQ ID NO: 394406 - DNA, 28 bp, Artificial Sequence
  Description of Artificial Sequence: Synthetic oligonucleotide
ggtcaacatcacctggctgagcaatggg

SEQ ID NO: 394407 - DNA, 28 bp, Artificial Sequence
  Description of Artificial Sequence: Synthetic oligonucleotide
gtcaacatcacctggctgagcaatgggc

SEQ ID NO: 394408 - DNA, 29 bp, Artificial Sequence
  Description of Artificial Sequence: Synthetic oligonucleotide
tcaacatcacctggctgagcaatgggcag

SEQ ID NO: 394409 - DNA, 28 bp, Artificial Sequence
  Description of Artificial Sequence: Synthetic oligonucleotide
caacatcacctggctgagcaatgggcag

SEQ ID NO: 394410 - DNA, 29 bp, Artificial Sequence
  Description of Artificial Sequence: Synthetic oligonucleotide
aacatcacctggctgagcaatgggcagtc

SEQ ID NO: 394411 - DNA, 28 bp, Artificial Sequence
  Description of Artificial Sequence: Synthetic oligonucleotide
acatcacctggctgagcaatgggcagtc

SEQ ID NO: 394412 - DNA, 27 bp, Artificial Sequence
  Description of Artificial Sequence: Synthetic oligonucleotide
catcacctggctgagcaatgggcagtc

SEQ ID NO: 394413 - DNA, 28 bp, Artificial Sequence
  Description of Artificial Sequence: Synthetic oligonucleotide
atcacctggctgagcaatgggcagtcag

SEQ ID NO: 394414 - DNA, 27 bp, Artificial Sequence
  Description of Artificial Sequence: Synthetic oligonucleotide
tcacctggctgagcaatgggcagtcag

SEQ ID NO: 394415 - DNA, 27 bp, Artificial Sequence
  Description of Artificial Sequence: Synthetic oligonucleotide
cacctggctgagcaatgggcagtcagt

SEQ ID NO: 394416 - DNA, 27 bp, Artificial Sequence
  Description of Artificial Sequence: Synthetic oligonucleotide
acctggctgagcaatgggcagtcagtc

SEQ ID NO: 394417 - DNA, 27 bp, Artificial Sequence
  Description of Artificial Sequence: Synthetic oligonucleotide
cctggctgagcaatgggcagtcagtca

SEQ ID NO: 394418 - DNA, 27 bp, Artificial Sequence
  Description of Artificial Sequence: Synthetic oligonucleotide
ctggctgagcaatgggcagtcagtcac

SEQ ID NO: 394419 - DNA, 23 bp, Artificial Sequence
  Description of Artificial Sequence: Synthetic oligonucleotide
tgggggccctcgctctgaccact

SEQ ID NO: 394420 - DNA, 22 bp, Artificial Sequence
  Description of Artificial Sequence: Synthetic oligonucleotide
gggggccctcgctctgaccact

SEQ ID NO: 394421 - DNA, 23 bp, Artificial Sequence
  Description of Artificial Sequence: Synthetic oligonucleotide
ggggccctcgctctgaccactgt

SEQ ID NO: 394422 - DNA, 25 bp, Artificial Sequence
  Description of Artificial Sequence: Synthetic oligonucleotide
gggccctcgctctgaccactgtgat

SEQ ID NO: 394423 - DNA, 26 bp, Artificial Sequence
  Description of Artificial Sequence: Synthetic oligonucleotide
ggccctcgctctgaccactgtgatga

SEQ ID NO: 394424 - DNA, 26 bp, Artificial Sequence
  Description of Artificial Sequence: Synthetic oligonucleotide
gccctcgctctgaccactgtgatgag

SEQ ID NO: 394425 - DNA, 26 bp, Artificial Sequence
  Description of Artificial Sequence: Synthetic oligonucleotide
ccctcgctctgaccactgtgatgagc

SEQ ID NO: 394426 - DNA, 26 bp, Artificial Sequence
  Description of Artificial Sequence: Synthetic oligonucleotide
cctcgctctgaccactgtgatgagcc

SEQ ID NO: 394427 - DNA, 26 bp, Artificial Sequence
  Description of Artificial Sequence: Synthetic oligonucleotide
ctcgctctgaccactgtgatgagccc

SEQ ID NO: 394428 - DNA, 27 bp, Artificial Sequence
  Description of Artificial Sequence: Synthetic oligonucleotide
tcgctctgaccactgtgatgagcccct

SEQ ID NO: 394429 - DNA, 26 bp, Artificial Sequence
  Description of Artificial Sequence: Synthetic oligonucleotide
cgctctgaccactgtgatgagcccct

SEQ ID NO: 394430 - DNA, 27 bp, Artificial Sequence
  Description of Artificial Sequence: Synthetic oligonucleotide
gctctgaccactgtgatgagcccctgt

SEQ ID NO: 394431 - DNA, 27 bp, Artificial Sequence
  Description of Artificial Sequence: Synthetic oligonucleotide
ctctgaccactgtgatgagcccctgtg

SEQ ID NO: 394432 - DNA, 27 bp, Artificial Sequence
  Description of Artificial Sequence: Synthetic oligonucleotide
tctgaccactgtgatgagcccctgtgg

SEQ ID NO: 394433 - DNA, 27 bp, Artificial Sequence
  Description of Artificial Sequence: Synthetic oligonucleotide
ctgaccactgtgatgagcccctgtgga

SEQ ID NO: 394434 - DNA, 27 bp, Artificial Sequence
  Description of Artificial Sequence: Synthetic oligonucleotide
tgaccactgtgatgagcccctgtggag

SEQ ID NO: 394435 - DNA, 26 bp, Artificial Sequence
  Description of Artificial Sequence: Synthetic oligonucleotide
gaccactgtgatgagcccctgtggag

SEQ ID NO: 394436 - DNA, 27 bp, Artificial Sequence
  Description of Artificial Sequence: Synthetic oligonucleotide
accactgtgatgagcccctgtggaggt

SEQ ID NO: 394437 - DNA, 26 bp, Artificial Sequence
  Description of Artificial Sequence: Synthetic oligonucleotide
ccactgtgatgagcccctgtggaggt

SEQ ID NO: 394438 - DNA, 27 bp, Artificial Sequence
  Description of Artificial Sequence: Synthetic oligonucleotide
cactgtgatgagcccctgtggaggtga

SEQ ID NO: 394439 - DNA, 28 bp, Artificial Sequence
  Description of Artificial Sequence: Synthetic oligonucleotide
actgtgatgagcccctgtggaggtgaag

SEQ ID NO: 394440 - DNA, 27 bp, Artificial Sequence
  Description of Artificial Sequence: Synthetic oligonucleotide
ctgtgatgagcccctgtggaggtgaag

SEQ ID NO: 394441 - DNA, 28 bp, Artificial Sequence
  Description of Artificial Sequence: Synthetic oligonucleotide
tgtgatgagcccctgtggaggtgaagac

SEQ ID NO: 394442 - DNA, 31 bp, Artificial Sequence; identical to SEQ ID NO: 55945
  Description of Artificial Sequence: Synthetic oligonucleotide

SEQ ID NO: 394443 - DNA, 30 bp, Artificial Sequence; identical to SEQ ID NO: 55946
  Description of Artificial Sequence: Synthetic oligonucleotide

SEQ ID NO: 394444 - DNA, 32 bp, Artificial Sequence; identical to SEQ ID NO: 55947
  Description of Artificial Sequence: Synthetic oligonucleotide

SEQ ID NO: 394445 - DNA, 31 bp, Artificial Sequence; identical to SEQ ID NO: 55948
  Description of Artificial Sequence: Synthetic oligonucleotide

SEQ ID NO: 394446 - DNA, 31 bp, Artificial Sequence; identical to SEQ ID NO: 55949
  Description of Artificial Sequence: Synthetic oligonucleotide

SEQ ID NO: 394447 - DNA, 31 bp, Artificial Sequence; identical to SEQ ID NO: 55950
  Description of Artificial Sequence: Synthetic oligonucleotide

SEQ ID NO: 394448 - DNA, 30 bp, Artificial Sequence; identical to SEQ ID NO: 55951
  Description of Artificial Sequence: Synthetic oligonucleotide

SEQ ID NO: 394449 - DNA, 31 bp, Artificial Sequence; identical to SEQ ID NO: 55952
  Description of Artificial Sequence: Synthetic oligonucleotide

SEQ ID NO: 394450 - DNA, 33 bp, Artificial Sequence; identical to SEQ ID NO: 55953
  Description of Artificial Sequence: Synthetic oligonucleotide

SEQ ID NO: 394451 - DNA, 32 bp, Artificial Sequence; identical to SEQ ID NO: 55954
  Description of Artificial Sequence: Synthetic oligonucleotide

SEQ ID NO: 394452 - DNA, 33 bp, Artificial Sequence; identical to SEQ ID NO: 55955
  Description of Artificial Sequence: Synthetic oligonucleotide

SEQ ID NO: 394453 - DNA, 32 bp, Artificial Sequence; identical to SEQ ID NO: 55956
  Description of Artificial Sequence: Synthetic oligonucleotide

SEQ ID NO: 394454 - DNA, 31 bp, Artificial Sequence; identical to SEQ ID NO: 55957
  Description of Artificial Sequence: Synthetic oligonucleotide

SEQ ID NO: 394455 - DNA, 31 bp, Artificial Sequence; identical to SEQ ID NO: 55958
  Description of Artificial Sequence: Synthetic oligonucleotide

SEQ ID NO: 394456 - DNA, 30 bp, Artificial Sequence; identical to SEQ ID NO: 55959
  Description of Artificial Sequence: Synthetic oligonucleotide

SEQ ID NO: 394457 - DNA, 31 bp, Artificial Sequence; identical to SEQ ID NO: 55960
  Description of Artificial Sequence: Synthetic oligonucleotide

SEQ ID NO: 394458 - DNA, 30 bp, Artificial Sequence; identical to SEQ ID NO: 55961
  Description of Artificial Sequence: Synthetic oligonucleotide

SEQ ID NO: 394459 - DNA, 29 bp, Artificial Sequence
  Description of Artificial Sequence: Synthetic oligonucleotide
tgtggctgaccatgttgcctcttgtggtg

SEQ ID NO: 394460 - DNA, 28 bp, Artificial Sequence
  Description of Artificial Sequence: Synthetic oligonucleotide
gtggctgaccatgttgcctcttgtggtg

SEQ ID NO: 394461 - DNA, 32 bp, Artificial Sequence; identical to SEQ ID NO: 55964
  Description of Artificial Sequence: Synthetic oligonucleotide

SEQ ID NO: 394462 - DNA, 31 bp, Artificial Sequence; identical to SEQ ID NO: 55965
  Description of Artificial Sequence: Synthetic oligonucleotide

SEQ ID NO: 394463 - DNA, 33 bp, Artificial Sequence; identical to SEQ ID NO: 55966
  Description of Artificial Sequence: Synthetic oligonucleotide

SEQ ID NO: 394464 - DNA, 35 bp, Artificial Sequence; identical to SEQ ID NO: 55967
  Description of Artificial Sequence: Synthetic oligonucleotide

SEQ ID NO: 394465 - DNA, 35 bp, Artificial Sequence; identical to SEQ ID NO: 55968
  Description of Artificial Sequence: Synthetic oligonucleotide

SEQ ID NO: 394466 - DNA, 34 bp, Artificial Sequence; identical to SEQ ID NO: 55969
  Description of Artificial Sequence: Synthetic oligonucleotide

SEQ ID NO: 394467 - DNA, 35 bp, Artificial Sequence; identical to SEQ ID NO: 55970
  Description of Artificial Sequence: Synthetic oligonucleotide

SEQ ID NO: 394468 - DNA, 34 bp, Artificial Sequence; identical to SEQ ID NO: 55971
  Description of Artificial Sequence: Synthetic oligonucleotide

SEQ ID NO: 394469 - DNA, 39 bp, Artificial Sequence; identical to SEQ ID NO: 55972
  Description of Artificial Sequence: Synthetic oligonucleotide

SEQ ID NO: 394470 - DNA, 39 bp, Artificial Sequence; identical to SEQ ID NO: 55973
  Description of Artificial Sequence: Synthetic oligonucleotide

SEQ ID NO: 394471 - DNA, 38 bp, Artificial Sequence; identical to SEQ ID NO: 55974
  Description of Artificial Sequence: Synthetic oligonucleotide

SEQ ID NO: 394472 - DNA, 30 bp, Artificial Sequence; identical to SEQ ID NO: 55975
  Description of Artificial Sequence: Synthetic oligonucleotide

SEQ ID NO: 394473 - DNA, 29 bp, Artificial Sequence
  Description of Artificial Sequence: Synthetic oligonucleotide
accagttttacggtccctctggccagttc

SEQ ID NO: 394474 - DNA, 28 bp, Artificial Sequence
  Description of Artificial Sequence: Synthetic oligonucleotide
ccagttttacggtccctctggccagttc

SEQ ID NO: 394475 - DNA, 29 bp, Artificial Sequence
  Description of Artificial Sequence: Synthetic oligonucleotide
cagttttacggtccctctggccagttcac

SEQ ID NO: 394476 - DNA, 29 bp, Artificial Sequence
  Description of Artificial Sequence: Synthetic oligonucleotide
agttttacggtccctctggccagttcacc

SEQ ID NO: 394477 - DNA, 28 bp, Artificial Sequence
  Description of Artificial Sequence: Synthetic oligonucleotide
gttttacggtccctctggccagttcacc

SEQ ID NO: 394478 - DNA, 28 bp, Artificial Sequence
  Description of Artificial Sequence: Synthetic oligonucleotide
ttttacggtccctctggccagttcaccc

SEQ ID NO: 394479 - DNA, 27 bp, Artificial Sequence
  Description of Artificial Sequence: Synthetic oligonucleotide
tttacggtccctctggccagttcaccc

SEQ ID NO: 394480 - DNA, 27 bp, Artificial Sequence
  Description of Artificial Sequence: Synthetic oligonucleotide
ttacggtccctctggccagttcaccca

SEQ ID NO: 394481 - DNA, 27 bp, Artificial Sequence
  Description of Artificial Sequence: Synthetic oligonucleotide
tacggtccctctggccagttcacccat

SEQ ID NO: 394482 - DNA, 26 bp, Artificial Sequence
  Description of Artificial Sequence: Synthetic oligonucleotide
acggtccctctggccagttcacccat

SEQ ID NO: 394483 - DNA, 25 bp, Artificial Sequence
  Description of Artificial Sequence: Synthetic oligonucleotide
cggtccctctggccagttcacccat

SEQ ID NO: 394484 - DNA, 27 bp, Artificial Sequence
  Description of Artificial Sequence: Synthetic oligonucleotide
ggtccctctggccagttcacccatgaa

SEQ ID NO: 394485 - DNA, 30 bp, Artificial Sequence; identical to SEQ ID NO: 55988
  Description of Artificial Sequence: Synthetic oligonucleotide

SEQ ID NO: 394486 - DNA, 32 bp, Artificial Sequence; identical to SEQ ID NO: 55989
  Description of Artificial Sequence: Synthetic oligonucleotide

SEQ ID NO: 394487 - DNA, 31 bp, Artificial Sequence; identical to SEQ ID NO: 55990
  Description of Artificial Sequence: Synthetic oligonucleotide

SEQ ID NO: 394488 - DNA, 31 bp, Artificial Sequence; identical to SEQ ID NO: 55991
  Description of Artificial Sequence: Synthetic oligonucleotide

SEQ ID NO: 394489 - DNA, 32 bp, Artificial Sequence; identical to SEQ ID NO: 55992
  Description of Artificial Sequence: Synthetic oligonucleotide

SEQ ID NO: 394490 - DNA, 34 bp, Artificial Sequence; identical to SEQ ID NO: 55993
  Description of Artificial Sequence: Synthetic oligonucleotide

SEQ ID NO: 394491 - DNA, 33 bp, Artificial Sequence; identical to SEQ ID NO: 55994
  Description of Artificial Sequence: Synthetic oligonucleotide

SEQ ID NO: 394492 - DNA, 34 bp, Artificial Sequence; identical to SEQ ID NO: 55995
  Description of Artificial Sequence: Synthetic oligonucleotide

SEQ ID NO: 394493 - DNA, 33 bp, Artificial Sequence; identical to SEQ ID NO: 55996
  Description of Artificial Sequence: Synthetic oligonucleotide

SEQ ID NO: 394494 - DNA, 33 bp, Artificial Sequence; identical to SEQ ID NO: 55997
  Description of Artificial Sequence: Synthetic oligonucleotide

SEQ ID NO: 394495 - DNA, 34 bp, Artificial Sequence; identical to SEQ ID NO: 55998
  Description of Artificial Sequence: Synthetic oligonucleotide

SEQ ID NO: 394496 - DNA, 36 bp, Artificial Sequence; identical to SEQ ID NO: 55999
  Description of Artificial Sequence: Synthetic oligonucleotide

SEQ ID NO: 394497 - DNA, 38 bp, Artificial Sequence; identical to SEQ ID NO: 56000
  Description of Artificial Sequence: Synthetic oligonucleotide

SEQ ID NO: 394498 - DNA, 37 bp, Artificial Sequence; identical to SEQ ID NO: 56001
  Description of Artificial Sequence: Synthetic oligonucleotide

SEQ ID NO: 394499 - DNA, 37 bp, Artificial Sequence; identical to SEQ ID NO: 56002
  Description of Artificial Sequence: Synthetic oligonucleotide

SEQ ID NO: 394500 - DNA, 36 bp, Artificial Sequence; identical to SEQ ID NO: 56003
  Description of Artificial Sequence: Synthetic oligonucleotide

SEQ ID NO: 394501 - DNA, 31 bp, Artificial Sequence; identical to SEQ ID NO: 56004
  Description of Artificial Sequence: Synthetic oligonucleotide

SEQ ID NO: 394502 - DNA, 30 bp, Artificial Sequence; identical to SEQ ID NO: 56005
  Description of Artificial Sequence: Synthetic oligonucleotide

SEQ ID NO: 394503 - DNA, 32 bp, Artificial Sequence; identical to SEQ ID NO: 56006
  Description of Artificial Sequence: Synthetic oligonucleotide

SEQ ID NO: 394504 - DNA, 31 bp, Artificial Sequence; identical to SEQ ID NO: 56007
  Description of Artificial Sequence: Synthetic oligonucleotide

SEQ ID NO: 394505 - DNA, 30 bp, Artificial Sequence; identical to SEQ ID NO: 56008
  Description of Artificial Sequence: Synthetic oligonucleotide

SEQ ID NO: 394506 - DNA, 30 bp, Artificial Sequence; identical to SEQ ID NO: 56009
  Description of Artificial Sequence: Synthetic oligonucleotide

SEQ ID NO: 394507 - DNA, 29 bp, Artificial Sequence
  Description of Artificial Sequence: Synthetic oligonucleotide
gcagttctacgtggacctggagaagaagg

SEQ ID NO: 394508 - DNA, 30 bp, Artificial Sequence; identical to SEQ ID NO: 56011
  Description of Artificial Sequence: Synthetic oligonucleotide

SEQ ID NO: 394509 - DNA, 31 bp, Artificial Sequence; identical to SEQ ID NO: 56012
  Description of Artificial Sequence: Synthetic oligonucleotide

SEQ ID NO: 394510 - DNA, 30 bp, Artificial Sequence; identical to SEQ ID NO: 56013
  Description of Artificial Sequence: Synthetic oligonucleotide

SEQ ID NO: 394511 - DNA, 31 bp, Artificial Sequence; identical to SEQ ID NO: 56014
  Description of Artificial Sequence: Synthetic oligonucleotide

SEQ ID NO: 394512 - DNA, 30 bp, Artificial Sequence; identical to SEQ ID NO: 56015
  Description of Artificial Sequence: Synthetic oligonucleotide

SEQ ID NO: 394513 - DNA, 29 bp, Artificial Sequence
  Description of Artificial Sequence: Synthetic oligonucleotide
ctacgtggacctggagaagaaggagactg

SEQ ID NO: 394514 - DNA, 29 bp, Artificial Sequence
  Description of Artificial Sequence: Synthetic oligonucleotide
tacgtggacctggagaagaaggagactgc

SEQ ID NO: 394515 - DNA, 28 bp, Artificial Sequence
  Description of Artificial Sequence: Synthetic oligonucleotide
acgtggacctggagaagaaggagactgc

SEQ ID NO: 394516 - DNA, 27 bp, Artificial Sequence
  Description of Artificial Sequence: Synthetic oligonucleotide
cgtggacctggagaagaaggagactgc

SEQ ID NO: 394517 - DNA, 27 bp, Artificial Sequence
  Description of Artificial Sequence: Synthetic oligonucleotide
gtggacctggagaagaaggagactgcc

SEQ ID NO: 394518 - DNA, 28 bp, Artificial Sequence
  Description of Artificial Sequence: Synthetic oligonucleotide
tggacctggagaagaaggagactgcctg

SEQ ID NO: 394519 - DNA, 27 bp, Artificial Sequence
  Description of Artificial Sequence: Synthetic oligonucleotide
ggacctggagaagaaggagactgcctg

SEQ ID NO: 394520 - DNA, 27 bp, Artificial Sequence
  Description of Artificial Sequence: Synthetic oligonucleotide
gacctggagaagaaggagactgcctgg

SEQ ID NO: 394521 - DNA, 27 bp, Artificial Sequence
  Description of Artificial Sequence: Synthetic oligonucleotide
acctggagaagaaggagactgcctggc

SEQ ID NO: 394522 - DNA, 26 bp, Artificial Sequence
  Description of Artificial Sequence: Synthetic oligonucleotide
cctggagaagaaggagactgcctggc

SEQ ID NO: 394523 - DNA, 26 bp, Artificial Sequence
  Description of Artificial Sequence: Synthetic oligonucleotide
ctggagaagaaggagactgcctggcg

SEQ ID NO: 394524 - DNA, 27 bp, Artificial Sequence
  Description of Artificial Sequence: Synthetic oligonucleotide
tggagaagaaggagactgcctggcggt

SEQ ID NO: 394525 - DNA, 26 bp, Artificial Sequence
  Description of Artificial Sequence: Synthetic oligonucleotide
ggagaagaaggagactgcctggcggt

SEQ ID NO: 394526 - DNA, 26 bp, Artificial Sequence
  Description of Artificial Sequence: Synthetic oligonucleotide
gagaagaaggagactgcctggcggtg

SEQ ID NO: 394527 - DNA, 26 bp, Artificial Sequence
  Description of Artificial Sequence: Synthetic oligonucleotide
agaagaaggagactgcctggcggtgg

SEQ ID NO: 394528 - DNA, 25 bp, Artificial Sequence
  Description of Artificial Sequence: Synthetic oligonucleotide
gaagaaggagactgcctggcggtgg

SEQ ID NO: 394529 - DNA, 25 bp, Artificial Sequence
  Description of Artificial Sequence: Synthetic oligonucleotide
aagaaggagactgcctggcggtggc

SEQ ID NO: 394530 - DNA, 24 bp, Artificial Sequence
  Description of Artificial Sequence: Synthetic oligonucleotide
agaaggagactgcctggcggtggc

SEQ ID NO: 394531 - DNA, 30 bp, Artificial Sequence; identical to SEQ ID NO: 56034
  Description of Artificial Sequence: Synthetic oligonucleotide

SEQ ID NO: 394532 - DNA, 30 bp, Artificial Sequence; identical to SEQ ID NO: 56035
  Description of Artificial Sequence: Synthetic oligonucleotide

SEQ ID NO: 394533 - DNA, 29 bp, Artificial Sequence
  Description of Artificial Sequence: Synthetic oligonucleotide
caacatcacatggctgagcaatgggcacg

SEQ ID NO: 394534 - DNA, 29 bp, Artificial Sequence
  Description of Artificial Sequence: Synthetic oligonucleotide
aacatcacatggctgagcaatgggcacgc

SEQ ID NO: 394535 - DNA, 28 bp, Artificial Sequence
  Description of Artificial Sequence: Synthetic oligonucleotide
acatcacatggctgagcaatgggcacgc

SEQ ID NO: 394536 - DNA, 27 bp, Artificial Sequence
  Description of Artificial Sequence: Synthetic oligonucleotide
catcacatggctgagcaatgggcacgc

SEQ ID NO: 394537 - DNA, 28 bp, Artificial Sequence
  Description of Artificial Sequence: Synthetic oligonucleotide
atcacatggctgagcaatgggcacgcag

SEQ ID NO: 394538 - DNA, 27 bp, Artificial Sequence
  Description of Artificial Sequence: Synthetic oligonucleotide
tcacatggctgagcaatgggcacgcag

SEQ ID NO: 394539 - DNA, 27 bp, Artificial Sequence
  Description of Artificial Sequence: Synthetic oligonucleotide
cacatggctgagcaatgggcacgcagt

SEQ ID NO: 394540 - DNA, 27 bp, Artificial Sequence
  Description of Artificial Sequence: Synthetic oligonucleotide
acatggctgagcaatgggcacgcagtc

SEQ ID NO: 394541 - DNA, 27 bp, Artificial Sequence
  Description of Artificial Sequence: Synthetic oligonucleotide
catggctgagcaatgggcacgcagtca

SEQ ID NO: 394542 - DNA, 27 bp, Artificial Sequence
  Description of Artificial Sequence: Synthetic oligonucleotide
atggctgagcaatgggcacgcagtcac

SEQ ID NO: 394543 - DNA, 27 bp, Artificial Sequence
  Description of Artificial Sequence: Synthetic oligonucleotide
tggctgagcaatgggcacgcagtcaca

SEQ ID NO: 394544 - DNA, 26 bp, Artificial Sequence
  Description of Artificial Sequence: Synthetic oligonucleotide
ggctgagcaatgggcacgcagtcaca

SEQ ID NO: 394545 - DNA, 27 bp, Artificial Sequence
  Description of Artificial Sequence: Synthetic oligonucleotide
gctgagcaatgggcacgcagtcacaga

SEQ ID NO: 394546 - DNA, 28 bp, Artificial Sequence
  Description of Artificial Sequence: Synthetic oligonucleotide
ctgagcaatgggcacgcagtcacagaag

SEQ ID NO: 394547 - DNA, 28 bp, Artificial Sequence
  Description of Artificial Sequence: Synthetic oligonucleotide
tgagcaatgggcacgcagtcacagaagg

SEQ ID NO: 394548 - DNA, 27 bp, Artificial Sequence
  Description of Artificial Sequence: Synthetic oligonucleotide
gagcaatgggcacgcagtcacagaagg

SEQ ID NO: 394549 - DNA, 28 bp, Artificial Sequence
  Description of Artificial Sequence: Synthetic oligonucleotide
agcaatgggcacgcagtcacagaaggtg

SEQ ID NO: 394550 - DNA, 27 bp, Artificial Sequence
  Description of Artificial Sequence: Synthetic oligonucleotide
gcaatgggcacgcagtcacagaaggtg

SEQ ID NO: 394551 - DNA, 30 bp, Artificial Sequence; identical to SEQ ID NO: 56054
  Description of Artificial Sequence: Synthetic oligonucleotide

SEQ ID NO: 394552 - DNA, 31 bp, Artificial Sequence; identical to SEQ ID NO: 56055
  Description of Artificial Sequence: Synthetic oligonucleotide

SEQ ID NO: 394553 - DNA, 30 bp, Artificial Sequence; identical to SEQ ID NO: 56056
  Description of Artificial Sequence: Synthetic oligonucleotide

SEQ ID NO: 394554 - DNA, 29 bp, Artificial Sequence
  Description of Artificial Sequence: Synthetic oligonucleotide
tgggcacgcagtcacagaaggtgtttctg

SEQ ID NO: 394555 - DNA, 28 bp, Artificial Sequence
  Description of Artificial Sequence: Synthetic oligonucleotide
gggcacgcagtcacagaaggtgtttctg

SEQ ID NO: 394556 - DNA, 29 bp, Artificial Sequence
  Description of Artificial Sequence: Synthetic oligonucleotide
ggcacgcagtcacagaaggtgtttctgag

SEQ ID NO: 394557 - DNA, 30 bp, Artificial Sequence; identical to SEQ ID NO: 56060
  Description of Artificial Sequence: Synthetic oligonucleotide

SEQ ID NO: 394558 - DNA, 30 bp, Artificial Sequence; identical to SEQ ID NO: 56061
  Description of Artificial Sequence: Synthetic oligonucleotide

SEQ ID NO: 394559 - DNA, 31 bp, Artificial Sequence; identical to SEQ ID NO: 56062
  Description of Artificial Sequence: Synthetic oligonucleotide

SEQ ID NO: 394560 - DNA, 30 bp, Artificial Sequence; identical to SEQ ID NO: 56063
  Description of Artificial Sequence: Synthetic oligonucleotide

SEQ ID NO: 394561 - DNA, 30 bp, Artificial Sequence; identical to SEQ ID NO: 56064
  Description of Artificial Sequence: Synthetic oligonucleotide

SEQ ID NO: 394562 - DNA, 26 bp, Artificial Sequence
  Description of Artificial Sequence: Synthetic oligonucleotide
gttggtgcttccagacaccaagggcc

SEQ ID NO: 394563 - DNA, 27 bp, Artificial Sequence
  Description of Artificial Sequence: Synthetic oligonucleotide
ttggtgcttccagacaccaagggccct

SEQ ID NO: 394564 - DNA, 27 bp, Artificial Sequence
  Description of Artificial Sequence: Synthetic oligonucleotide
tggtgcttccagacaccaagggccctt

SEQ ID NO: 394565 - DNA, 26 bp, Artificial Sequence
  Description of Artificial Sequence: Synthetic oligonucleotide
ggtgcttccagacaccaagggccctt

SEQ ID NO: 394566 - DNA, 27 bp, Artificial Sequence
  Description of Artificial Sequence: Synthetic oligonucleotide
gtgcttccagacaccaagggcccttgt

SEQ ID NO: 394567 - DNA, 27 bp, Artificial Sequence
  Description of Artificial Sequence: Synthetic oligonucleotide
tgcttccagacaccaagggcccttgtg

SEQ ID NO: 394568 - DNA, 27 bp, Artificial Sequence
  Description of Artificial Sequence: Synthetic oligonucleotide
gcttccagacaccaagggcccttgtga

SEQ ID NO: 394569 - DNA, 29 bp, Artificial Sequence
  Description of Artificial Sequence: Synthetic oligonucleotide
aggctgagacgggcagatcatgaggttag

SEQ ID NO: 394570 - DNA, 28 bp, Artificial Sequence
  Description of Artificial Sequence: Synthetic oligonucleotide
ggctgagacgggcagatcatgaggttag

SEQ ID NO: 394571 - DNA, 28 bp, Artificial Sequence
  Description of Artificial Sequence: Synthetic oligonucleotide
gctgagacgggcagatcatgaggttagg

SEQ ID NO: 394572 - DNA, 29 bp, Artificial Sequence
  Description of Artificial Sequence: Synthetic oligonucleotide
ctgagacgggcagatcatgaggttaggag

SEQ ID NO: 394573 - DNA, 31 bp, Artificial Sequence
  Description of Artificial Sequence: Synthetic oligonucleotide
tgagacgggcagatcatgaggttaggagttc

SEQ ID NO: 394574 - DNA, 30 bp, Artificial Sequence
  Description of Artificial Sequence: Synthetic oligonucleotide
gagacgggcagatcatgaggttaggagttc

SEQ ID NO: 394575 - DNA, 32 bp, Artificial Sequence
  Description of Artificial Sequence: Synthetic oligonucleotide
agacgggcagatcatgaggttaggagttcaag

SEQ ID NO: 394576 - DNA, 31 bp, Artificial Sequence
  Description of Artificial Sequence: Synthetic oligonucleotide
gacgggcagatcatgaggttaggagttcaag

SEQ ID NO: 394577 - DNA, 32 bp, Artificial Sequence
  Description of Artificial Sequence: Synthetic oligonucleotide
acgggcagatcatgaggttaggagttcaagac

SEQ ID NO: 394578 - DNA, 31 bp, Artificial Sequence
  Description of Artificial Sequence: Synthetic oligonucleotide
cgggcagatcatgaggttaggagttcaagac

SEQ ID NO: 394579 - DNA, 31 bp, Artificial Sequence
  Description of Artificial Sequence: Synthetic oligonucleotide
gggcagatcatgaggttaggagttcaagacc

SEQ ID NO: 394580 - DNA, 32 bp, Artificial Sequence
  Description of Artificial Sequence: Synthetic oligonucleotide
ggcagatcatgaggttaggagttcaagaccag

SEQ ID NO: 394581 - DNA, 32 bp, Artificial Sequence
  Description of Artificial Sequence: Synthetic oligonucleotide
gcagatcatgaggttaggagttcaagaccagc

SEQ ID NO: 394582 - DNA, 32 bp, Artificial Sequence
  Description of Artificial Sequence: Synthetic oligonucleotide
cagatcatgaggttaggagttcaagaccagcg

SEQ ID NO: 394583 - DNA, 33 bp, Artificial Sequence
  Description of Artificial Sequence: Synthetic oligonucleotide
agatcatgaggttaggagttcaagaccagcgtg

SEQ ID NO: 394584 - DNA, 32 bp, Artificial Sequence
  Description of Artificial Sequence: Synthetic oligonucleotide
gatcatgaggttaggagttcaagaccagcgtg

SEQ ID NO: 394585 - DNA, 32 bp, Artificial Sequence
  Description of Artificial Sequence: Synthetic oligonucleotide
atcatgaggttaggagttcaagaccagcgtgg

SEQ ID NO: 394586 - DNA, 31 bp, Artificial Sequence
  Description of Artificial Sequence: Synthetic oligonucleotide
tcatgaggttaggagttcaagaccagcgtgg

SEQ ID NO: 394587 - DNA, 30 bp, Artificial Sequence
  Description of Artificial Sequence: Synthetic oligonucleotide
catgaggttaggagttcaagaccagcgtgg

SEQ ID NO: 394588 - DNA, 30 bp, Artificial Sequence
  Description of Artificial Sequence: Synthetic oligonucleotide
atgaggttaggagttcaagaccagcgtggc

SEQ ID NO: 394589 - DNA, 29 bp, Artificial Sequence
  Description of Artificial Sequence: Synthetic oligonucleotide
tgaggttaggagttcaagaccagcgtggc

SEQ ID NO: 394590 - DNA, 28 bp, Artificial Sequence
  Description of Artificial Sequence: Synthetic oligonucleotide
gaggttaggagttcaagaccagcgtggc

SEQ ID NO: 394591 - DNA, 28 bp, Artificial Sequence
  Description of Artificial Sequence: Synthetic oligonucleotide
aggttaggagttcaagaccagcgtggcc

SEQ ID NO: 394592 - DNA, 27 bp, Artificial Sequence
  Description of Artificial Sequence: Synthetic oligonucleotide
ggttaggagttcaagaccagcgtggcc

SEQ ID NO: 394593 - DNA, 29 bp, Artificial Sequence
  Description of Artificial Sequence: Synthetic oligonucleotide
gttaggagttcaagaccagcgtggccaac

SEQ ID NO: 394594 - DNA, 32 bp, Artificial Sequence
  Description of Artificial Sequence: Synthetic oligonucleotide
ttaggagttcaagaccagcgtggccaacatag

SEQ ID NO: 394595 - DNA, 31 bp, Artificial Sequence
  Description of Artificial Sequence: Synthetic oligonucleotide
taggagttcaagaccagcgtggccaacatag

SEQ ID NO: 394596 - DNA, 29 bp, Artificial Sequence
  Description of Artificial Sequence: Synthetic oligonucleotide
ctcagcctgggtgacagagtgagactatg

SEQ ID NO: 394597 - DNA, 30 bp, Artificial Sequence
  Description of Artificial Sequence: Synthetic oligonucleotide
tcagcctgggtgacagagtgagactatgtc

SEQ ID NO: 394598 - DNA, 29 bp, Artificial Sequence
  Description of Artificial Sequence: Synthetic oligonucleotide
cagcctgggtgacagagtgagactatgtc

SEQ ID NO: 394599 - DNA, 30 bp, Artificial Sequence
  Description of Artificial Sequence: Synthetic oligonucleotide
agcctgggtgacagagtgagactatgtctc

SEQ ID NO: 394600 - DNA, 29 bp, Artificial Sequence
  Description of Artificial Sequence: Synthetic oligonucleotide
gcctgggtgacagagtgagactatgtctc

SEQ ID NO: 394601 - DNA, 38 bp, Artificial Sequence
  Description of Artificial Sequence: Synthetic oligonucleotide
cctgggtgacagagtgagactatgtctcaaaaaaaaag

SEQ ID NO: 394602 - DNA, 43 bp, Artificial Sequence
  Description of Artificial Sequence: Synthetic oligonucleotide
ctgggtgacagagtgagactatgtctcaaaaaaaaagaaaaag

SEQ ID NO: 394603 - DNA, 47 bp, Artificial Sequence
  Description of Artificial Sequence: Synthetic oligonucleotide
tgggtgacagagtgagactatgtctcaaaaaaaaagaaaaagaaaag

SEQ ID NO: 394604 - DNA, 46 bp, Artificial Sequence
  Description of Artificial Sequence: Synthetic oligonucleotide
gggtgacagagtgagactatgtctcaaaaaaaaagaaaaagaaaag

SEQ ID NO: 394605 - DNA, 51 bp, Artificial Sequence
  Description of Artificial Sequence: Synthetic oligonucleotide
ggtgacagagtgagactatgtctcaaaaaaaaagaaaaagaaaagaaaaag

SEQ ID NO: 394606 - DNA, 60 bp, Artificial Sequence
  Description of Artificial Sequence: Synthetic oligonucleotide
gtgacagagtgagactatgtctcaaaaaaaaagaaaaagaaaagaaaaagaaaaaaaaag

SEQ ID NO: 394607 - DNA, 60 bp, Artificial Sequence
  Description of Artificial Sequence: Synthetic oligonucleotide
tgacagagtgagactatgtctcaaaaaaaaagaaaaagaaaagaaaaagaaaaaaaaaga

SEQ ID NO: 394608 - DNA, 60 bp, Artificial Sequence
  Description of Artificial Sequence: Synthetic oligonucleotide
gacagagtgagactatgtctcaaaaaaaaagaaaaagaaaagaaaaagaaaaaaaaagaa

SEQ ID NO: 394609 - DNA, 60 bp, Artificial Sequence
  Description of Artificial Sequence: Synthetic oligonucleotide
acagagtgagactatgtctcaaaaaaaaagaaaaagaaaagaaaaagaaaaaaaaagaaa

SEQ ID NO: 394610 - DNA, 60 bp, Artificial Sequence
  Description of Artificial Sequence: Synthetic oligonucleotide
cagagtgagactatgtctcaaaaaaaaagaaaaagaaaagaaaaagaaaaaaaaagaaaa

SEQ ID NO: 394611 - DNA, 60 bp, Artificial Sequence
  Description of Artificial Sequence: Synthetic oligonucleotide
agagtgagactatgtctcaaaaaaaaagaaaaagaaaagaaaaagaaaaaaaaagaaaaa

SEQ ID NO: 394612 - DNA, 60 bp, Artificial Sequence
  Description of Artificial Sequence: Synthetic oligonucleotide
gagtgagactatgtctcaaaaaaaaagaaaaagaaaagaaaaagaaaaaaaaagaaaaac

SEQ ID NO: 394613 - DNA, 60 bp, Artificial Sequence
  Description of Artificial Sequence: Synthetic oligonucleotide
agtgagactatgtctcaaaaaaaaagaaaaagaaaagaaaaagaaaaaaaaagaaaaaca

SEQ ID NO: 394614 - DNA, 60 bp, Artificial Sequence
  Description of Artificial Sequence: Synthetic oligonucleotide
gtgagactatgtctcaaaaaaaaagaaaaagaaaagaaaaagaaaaaaaaagaaaaacac

SEQ ID NO: 394615 - DNA, 60 bp, Artificial Sequence
  Description of Artificial Sequence: Synthetic oligonucleotide
tgagactatgtctcaaaaaaaaagaaaaagaaaagaaaaagaaaaaaaaagaaaaacacc

SEQ ID NO: 394616 - DNA, 60 bp, Artificial Sequence
  Description of Artificial Sequence: Synthetic oligonucleotide
gagactatgtctcaaaaaaaaagaaaaagaaaagaaaaagaaaaaaaaagaaaaacaccc

SEQ ID NO: 394617 - DNA, 60 bp, Artificial Sequence
  Description of Artificial Sequence: Synthetic oligonucleotide
agactatgtctcaaaaaaaaagaaaaagaaaagaaaaagaaaaaaaaagaaaaacaccca

SEQ ID NO: 394618 - DNA, 60 bp, Artificial Sequence
  Description of Artificial Sequence: Synthetic oligonucleotide
gactatgtctcaaaaaaaaagaaaaagaaaagaaaaagaaaaaaaaagaaaaacacccat

SEQ ID NO: 394619 - DNA, 60 bp, Artificial Sequence
  Description of Artificial Sequence: Synthetic oligonucleotide
actatgtctcaaaaaaaaagaaaaagaaaagaaaaagaaaaaaaaagaaaaacacccatc

SEQ ID NO: 394620 - DNA, 60 bp, Artificial Sequence
  Description of Artificial Sequence: Synthetic oligonucleotide
ctatgtctcaaaaaaaaagaaaaagaaaagaaaaagaaaaaaaaagaaaaacacccatcc

SEQ ID NO: 394621 - DNA, 60 bp, Artificial Sequence
  Description of Artificial Sequence: Synthetic oligonucleotide
tatgtctcaaaaaaaaagaaaaagaaaagaaaaagaaaaaaaaagaaaaacacccatccc

SEQ ID NO: 394622 - DNA, 60 bp, Artificial Sequence
  Description of Artificial Sequence: Synthetic oligonucleotide
atgtctcaaaaaaaaagaaaaagaaaagaaaaagaaaaaaaaagaaaaacacccatccct

SEQ ID NO: 394623 - DNA, 60 bp, Artificial Sequence
  Description of Artificial Sequence: Synthetic oligonucleotide
tgtctcaaaaaaaaagaaaaagaaaagaaaaagaaaaaaaaagaaaaacacccatccctc

SEQ ID NO: 394624 - DNA, 36 bp, Artificial Sequence
  Description of Artificial Sequence: Synthetic oligonucleotide
gcagacatgcacacaccagagaagattccaatttag

SEQ ID NO: 394625 - DNA, 37 bp, Artificial Sequence
  Description of Artificial Sequence: Synthetic oligonucleotide
cagacatgcacacaccagagaagattccaatttagtg

SEQ ID NO: 394626 - DNA, 38 bp, Artificial Sequence
  Description of Artificial Sequence: Synthetic oligonucleotide
agacatgcacacaccagagaagattccaatttagtgtc

SEQ ID NO: 394627 - DNA, 37 bp, Artificial Sequence
  Description of Artificial Sequence: Synthetic oligonucleotide
gacatgcacacaccagagaagattccaatttagtgtc

SEQ ID NO: 394628 - DNA, 37 bp, Artificial Sequence
  Description of Artificial Sequence: Synthetic oligonucleotide
acatgcacacaccagagaagattccaatttagtgtcc

SEQ ID NO: 394629 - DNA, 36 bp, Artificial Sequence
  Description of Artificial Sequence: Synthetic oligonucleotide
catgcacacaccagagaagattccaatttagtgtcc

SEQ ID NO: 394630 - DNA, 37 bp, Artificial Sequence
  Description of Artificial Sequence: Synthetic oligonucleotide
atgcacacaccagagaagattccaatttagtgtcctc

SEQ ID NO: 394631 - DNA, 36 bp, Artificial Sequence
  Description of Artificial Sequence: Synthetic oligonucleotide
tgcacacaccagagaagattccaatttagtgtcctc

SEQ ID NO: 394632 - DNA, 35 bp, Artificial Sequence
  Description of Artificial Sequence: Synthetic oligonucleotide
gcacacaccagagaagattccaatttagtgtcctc

SEQ ID NO: 394633 - DNA, 35 bp, Artificial Sequence
  Description of Artificial Sequence: Synthetic oligonucleotide
cacacaccagagaagattccaatttagtgtcctcc

SEQ ID NO: 394634 - DNA, 35 bp, Artificial Sequence
  Description of Artificial Sequence: Synthetic oligonucleotide
acacaccagagaagattccaatttagtgtcctccc

SEQ ID NO: 394635 - DNA, 34 bp, Artificial Sequence
  Description of Artificial Sequence: Synthetic oligonucleotide
cacaccagagaagattccaatttagtgtcctccc

SEQ ID NO: 394636 - DNA, 40 bp, Artificial Sequence
  Description of Artificial Sequence: Synthetic oligonucleotide
acaccagagaagattccaatttagtgtcctccctttattc

SEQ ID NO: 394637 - DNA, 39 bp, Artificial Sequence
  Description of Artificial Sequence: Synthetic oligonucleotide
caccagagaagattccaatttagtgtcctccctttattc

SEQ ID NO: 394638 - DNA, 42 bp, Artificial Sequence
  Description of Artificial Sequence: Synthetic oligonucleotide
accagagaagattccaatttagtgtcctccctttattcatag

SEQ ID NO: 394639 - DNA, 41 bp, Artificial Sequence
  Description of Artificial Sequence: Synthetic oligonucleotide
ccagagaagattccaatttagtgtcctccctttattcatag

SEQ ID NO: 394640 - DNA, 43 bp, Artificial Sequence
  Description of Artificial Sequence: Synthetic oligonucleotide
cagagaagattccaatttagtgtcctccctttattcatagaac

SEQ ID NO: 394641 - DNA, 47 bp, Artificial Sequence
  Description of Artificial Sequence: Synthetic oligonucleotide
agagaagattccaatttagtgtcctccctttattcatagaacaattc

SEQ ID NO: 394642 - DNA, 46 bp, Artificial Sequence
  Description of Artificial Sequence: Synthetic oligonucleotide
gagaagattccaatttagtgtcctccctttattcatagaacaattc

SEQ ID NO: 394643 - DNA, 46 bp, Artificial Sequence
  Description of Artificial Sequence: Synthetic oligonucleotide
agaagattccaatttagtgtcctccctttattcatagaacaattcc

SEQ ID NO: 394644 - DNA, 45 bp, Artificial Sequence
  Description of Artificial Sequence: Synthetic oligonucleotide
gaagattccaatttagtgtcctccctttattcatagaacaattcc

SEQ ID NO: 394645 - DNA, 46 bp, Artificial Sequence
  Description of Artificial Sequence: Synthetic oligonucleotide
aagattccaatttagtgtcctccctttattcatagaacaattcctc

SEQ ID NO: 394646 - DNA, 45 bp, Artificial Sequence
  Description of Artificial Sequence: Synthetic oligonucleotide
agattccaatttagtgtcctccctttattcatagaacaattcctc

SEQ ID NO: 394647 - DNA, 44 bp, Artificial Sequence
  Description of Artificial Sequence: Synthetic oligonucleotide
gattccaatttagtgtcctccctttattcatagaacaattcctc

SEQ ID NO: 394648 - DNA, 46 bp, Artificial Sequence
  Description of Artificial Sequence: Synthetic oligonucleotide
attccaatttagtgtcctccctttattcatagaacaattcctcaag

SEQ ID NO: 394649 - DNA, 45 bp, Artificial Sequence
  Description of Artificial Sequence: Synthetic oligonucleotide
ttccaatttagtgtcctccctttattcatagaacaattcctcaag

SEQ ID NO: 394650 - DNA, 44 bp, Artificial Sequence
  Description of Artificial Sequence: Synthetic oligonucleotide
tccaatttagtgtcctccctttattcatagaacaattcctcaag

SEQ ID NO: 394651 - DNA, 43 bp, Artificial Sequence
  Description of Artificial Sequence: Synthetic oligonucleotide
ccaatttagtgtcctccctttattcatagaacaattcctcaag

SEQ ID NO: 394652 - DNA, 44 bp, Artificial Sequence
  Description of Artificial Sequence: Synthetic oligonucleotide
caatttagtgtcctccctttattcatagaacaattcctcaagtc

SEQ ID NO: 394653 - DNA, 44 bp, Artificial Sequence
  Description of Artificial Sequence: Synthetic oligonucleotide
aatttagtgtcctccctttattcatagaacaattcctcaagtcc

SEQ ID NO: 394654 - DNA, 43 bp, Artificial Sequence
  Description of Artificial Sequence: Synthetic oligonucleotide
atttagtgtcctccctttattcatagaacaattcctcaagtcc

SEQ ID NO: 394655 - DNA, 42 bp, Artificial Sequence
  Description of Artificial Sequence: Synthetic oligonucleotide
tttagtgtcctccctttattcatagaacaattcctcaagtcc

SEQ ID NO: 394656 - DNA, 41 bp, Artificial Sequence
  Description of Artificial Sequence: Synthetic oligonucleotide
ttagtgtcctccctttattcatagaacaattcctcaagtcc

SEQ ID NO: 394657 - DNA, 40 bp, Artificial Sequence
  Description of Artificial Sequence: Synthetic oligonucleotide
tagtgtcctccctttattcatagaacaattcctcaagtcc

SEQ ID NO: 394658 - DNA, 26 bp, Artificial Sequence
  Description of Artificial Sequence: Synthetic oligonucleotide
acgaggctgctcagaaatgcccaccg

SEQ ID NO: 394659 - DNA, 25 bp, Artificial Sequence
  Description of Artificial Sequence: Synthetic oligonucleotide
cgaggctgctcagaaatgcccaccg

SEQ ID NO: 394660 - DNA, 26 bp, Artificial Sequence
  Description of Artificial Sequence: Synthetic oligonucleotide
gaggctgctcagaaatgcccaccgct

SEQ ID NO: 394661 - DNA, 26 bp, Artificial Sequence
  Description of Artificial Sequence: Synthetic oligonucleotide
aggctgctcagaaatgcccaccgctg

SEQ ID NO: 394662 - DNA, 25 bp, Artificial Sequence
  Description of Artificial Sequence: Synthetic oligonucleotide
ggctgctcagaaatgcccaccgctg

SEQ ID NO: 394663 - DNA, 25 bp, Artificial Sequence
  Description of Artificial Sequence: Synthetic oligonucleotide
gctgctcagaaatgcccaccgctgg

SEQ ID NO: 394664 - DNA, 25 bp, Artificial Sequence
  Description of Artificial Sequence: Synthetic oligonucleotide
ctgctcagaaatgcccaccgctggc

SEQ ID NO: 394665 - DNA, 26 bp, Artificial Sequence
  Description of Artificial Sequence: Synthetic oligonucleotide
tgctcagaaatgcccaccgctggcca

SEQ ID NO: 394666 - DNA, 25 bp, Artificial Sequence
  Description of Artificial Sequence: Synthetic oligonucleotide
gctcagaaatgcccaccgctggcca

SEQ ID NO: 394667 - DNA, 25 bp, Artificial Sequence
  Description of Artificial Sequence: Synthetic oligonucleotide
ctcagaaatgcccaccgctggccag

SEQ ID NO: 394668 - DNA, 25 bp, Artificial Sequence
  Description of Artificial Sequence: Synthetic oligonucleotide
tcagaaatgcccaccgctggccagg

SEQ ID NO: 394669 - DNA, 24 bp, Artificial Sequence
  Description of Artificial Sequence: Synthetic oligonucleotide
cagaaatgcccaccgctggccagg

SEQ ID NO: 394670 - DNA, 24 bp, Artificial Sequence
  Description of Artificial Sequence: Synthetic oligonucleotide
agaaatgcccaccgctggccaggc

SEQ ID NO: 394671 - DNA, 23 bp, Artificial Sequence
  Description of Artificial Sequence: Synthetic oligonucleotide
gaaatgcccaccgctggccaggc

SEQ ID NO: 394672 - DNA, 23 bp, Artificial Sequence
  Description of Artificial Sequence: Synthetic oligonucleotide
aaatgcccaccgctggccaggcg

SEQ ID NO: 394673 - DNA, 22 bp, Artificial Sequence
  Description of Artificial Sequence: Synthetic oligonucleotide
aatgcccaccgctggccaggcg

SEQ ID NO: 394674 - DNA, 21 bp, Artificial Sequence
  Description of Artificial Sequence: Synthetic oligonucleotide
atgcccaccgctggccaggcg

SEQ ID NO: 394675 - DNA, 20 bp, Artificial Sequence
  Description of Artificial Sequence: Synthetic oligonucleotide
tgcccaccgctggccaggcg

SEQ ID NO: 394676 - DNA, 20 bp, Artificial Sequence
  Description of Artificial Sequence: Synthetic oligonucleotide
gcccaccgctggccaggcgt

SEQ ID NO: 394677 - DNA, 20 bp, Artificial Sequence
  Description of Artificial Sequence: Synthetic oligonucleotide
cccaccgctggccaggcgct

SEQ ID NO: 394678 - DNA, 20 bp, Artificial Sequence
  Description of Artificial Sequence: Synthetic oligonucleotide
ccaccgctggccaggcgcgt

SEQ ID NO: 394679 - DNA, 20 bp, Artificial Sequence
  Description of Artificial Sequence: Synthetic oligonucleotide
caccgctggccaggcgcggt

SEQ ID NO: 394680 - DNA, 20 bp, Artificial Sequence
  Description of Artificial Sequence: Synthetic oligonucleotide
accgctggccaggcgcggtg

SEQ ID NO: 394681 - DNA, 20 bp, Artificial Sequence
  Description of Artificial Sequence: Synthetic oligonucleotide
ccgctggccaggcgcggtgt

SEQ ID NO: 394682 - DNA, 20 bp, Artificial Sequence
  Description of Artificial Sequence: Synthetic oligonucleotide
cgctggccaggcgcggtggt

SEQ ID NO: 394683 - DNA, 20 bp, Artificial Sequence
  Description of Artificial Sequence: Synthetic oligonucleotide
gctggccaggcgcggtggct

SEQ ID NO: 394684 - DNA, 23 bp, Artificial Sequence
  Description of Artificial Sequence: Synthetic oligonucleotide
ggggccctcgctctgaccaccat

SEQ ID NO: 394685 - DNA, 25 bp, Artificial Sequence
  Description of Artificial Sequence: Synthetic oligonucleotide
gggccctcgctctgaccaccatgat

SEQ ID NO: 394686 - DNA, 26 bp, Artificial Sequence
  Description of Artificial Sequence: Synthetic oligonucleotide
ggccctcgctctgaccaccatgatga

SEQ ID NO: 394687 - DNA, 26 bp, Artificial Sequence
  Description of Artificial Sequence: Synthetic oligonucleotide
gccctcgctctgaccaccatgatgag

SEQ ID NO: 394688 - DNA, 26 bp, Artificial Sequence
  Description of Artificial Sequence: Synthetic oligonucleotide
ccctcgctctgaccaccatgatgagc

SEQ ID NO: 394689 - DNA, 26 bp, Artificial Sequence
  Description of Artificial Sequence: Synthetic oligonucleotide
cctcgctctgaccaccatgatgagcc

SEQ ID NO: 394690 - DNA, 27 bp, Artificial Sequence
  Description of Artificial Sequence: Synthetic oligonucleotide
ctcgctctgaccaccatgatgagccct

SEQ ID NO: 394691 - DNA, 28 bp, Artificial Sequence
  Description of Artificial Sequence: Synthetic oligonucleotide
tcgctctgaccaccatgatgagcccttg

SEQ ID NO: 394692 - DNA, 27 bp, Artificial Sequence
  Description of Artificial Sequence: Synthetic oligonucleotide
cgctctgaccaccatgatgagcccttg

SEQ ID NO: 394693 - DNA, 28 bp, Artificial Sequence
  Description of Artificial Sequence: Synthetic oligonucleotide
gctctgaccaccatgatgagcccttgtg

SEQ ID NO: 394694 - DNA, 28 bp, Artificial Sequence
  Description of Artificial Sequence: Synthetic oligonucleotide
ctctgaccaccatgatgagcccttgtgg

SEQ ID NO: 394695 - DNA, 29 bp, Artificial Sequence
  Description of Artificial Sequence: Synthetic oligonucleotide
tctgaccaccatgatgagcccttgtggag

SEQ ID NO: 394696 - DNA, 28 bp, Artificial Sequence
  Description of Artificial Sequence: Synthetic oligonucleotide
ctgaccaccatgatgagcccttgtggag

SEQ ID NO: 394697 - DNA, 28 bp, Artificial Sequence
  Description of Artificial Sequence: Synthetic oligonucleotide
tgaccaccatgatgagcccttgtggagg

SEQ ID NO: 394698 - DNA, 27 bp, Artificial Sequence
  Description of Artificial Sequence: Synthetic oligonucleotide
gaccaccatgatgagcccttgtggagg

SEQ ID NO: 394699 - DNA, 28 bp, Artificial Sequence
  Description of Artificial Sequence: Synthetic oligonucleotide
accaccatgatgagcccttgtggaggtg

SEQ ID NO: 394700 - DNA, 27 bp, Artificial Sequence
  Description of Artificial Sequence: Synthetic oligonucleotide
ccaccatgatgagcccttgtggaggtg

SEQ ID NO: 394701 - DNA, 29 bp, Artificial Sequence
  Description of Artificial Sequence: Synthetic oligonucleotide
caccatgatgagcccttgtggaggtgaag

SEQ ID NO: 394702 - DNA, 29 bp, Artificial Sequence
  Description of Artificial Sequence: Synthetic oligonucleotide
accatgatgagcccttgtggaggtgaagg

SEQ ID NO: 394703 - DNA, 28 bp, Artificial Sequence
  Description of Artificial Sequence: Synthetic oligonucleotide
ccatgatgagcccttgtggaggtgaagg

SEQ ID NO: 394704 - DNA, 28 bp, Artificial Sequence
  Description of Artificial Sequence: Synthetic oligonucleotide
catgatgagcccttgtggaggtgaaggc

SEQ ID NO: 394705 - DNA, 31 bp, Artificial Sequence; identical to SEQ ID NO: 56093
  Description of Artificial Sequence: Synthetic oligonucleotide

SEQ ID NO: 394706 - DNA, 30 bp, Artificial Sequence; identical to SEQ ID NO: 56094
  Description of Artificial Sequence: Synthetic oligonucleotide

SEQ ID NO: 394707 - DNA, 29 bp, Artificial Sequence
  Description of Artificial Sequence: Synthetic oligonucleotide
gatgagcccttgtggaggtgaaggcattg

SEQ ID NO: 394708 - DNA, 30 bp, Artificial Sequence; identical to SEQ ID NO: 56096
  Description of Artificial Sequence: Synthetic oligonucleotide

SEQ ID NO: 394709 - DNA, 29 bp, Artificial Sequence
  Description of Artificial Sequence: Synthetic oligonucleotide
tgagcccttgtggaggtgaaggcattgtg

SEQ ID NO: 394710 - DNA, 28 bp, Artificial Sequence
  Description of Artificial Sequence: Synthetic oligonucleotide
gagcccttgtggaggtgaaggcattgtg

SEQ ID NO: 394711 - DNA, 28 bp, Artificial Sequence
  Description of Artificial Sequence: Synthetic oligonucleotide
agcccttgtggaggtgaaggcattgtgg

SEQ ID NO: 394712 - DNA, 27 bp, Artificial Sequence
  Description of Artificial Sequence: Synthetic oligonucleotide
gcccttgtggaggtgaaggcattgtgg

SEQ ID NO: 394713 - DNA, 27 bp, Artificial Sequence
  Description of Artificial Sequence: Synthetic oligonucleotide
cccttgtggaggtgaaggcattgtggc

SEQ ID NO: 394714 - DNA, 28 bp, Artificial Sequence
  Description of Artificial Sequence: Synthetic oligonucleotide
ccttgtggaggtgaaggcattgtggctg

SEQ ID NO: 394715 - DNA, 29 bp, Artificial Sequence
  Description of Artificial Sequence: Synthetic oligonucleotide
cttgtggaggtgaaggcattgtggctgac

SEQ ID NO: 394716 - DNA, 29 bp, Artificial Sequence
  Description of Artificial Sequence: Synthetic oligonucleotide
ttgtggaggtgaaggcattgtggctgacc

SEQ ID NO: 394717 - DNA, 28 bp, Artificial Sequence
  Description of Artificial Sequence: Synthetic oligonucleotide
tgtggaggtgaaggcattgtggctgacc

SEQ ID NO: 394718 - DNA, 27 bp, Artificial Sequence
  Description of Artificial Sequence: Synthetic oligonucleotide
gtggaggtgaaggcattgtggctgacc

SEQ ID NO: 394719 - DNA, 28 bp, Artificial Sequence
  Description of Artificial Sequence: Synthetic oligonucleotide
tggaggtgaaggcattgtggctgaccac

SEQ ID NO: 394720 - DNA, 27 bp, Artificial Sequence
  Description of Artificial Sequence: Synthetic oligonucleotide
ggaggtgaaggcattgtggctgaccac

SEQ ID NO: 394721 - DNA, 27 bp, Artificial Sequence
  Description of Artificial Sequence: Synthetic oligonucleotide
gaggtgaaggcattgtggctgaccacg

SEQ ID NO: 394722 - DNA, 29 bp, Artificial Sequence
  Description of Artificial Sequence: Synthetic oligonucleotide
aggtgaaggcattgtggctgaccacgttg

SEQ ID NO: 394723 - DNA, 28 bp, Artificial Sequence
  Description of Artificial Sequence: Synthetic oligonucleotide
ggtgaaggcattgtggctgaccacgttg

SEQ ID NO: 394724 - DNA, 28 bp, Artificial Sequence
  Description of Artificial Sequence: Synthetic oligonucleotide
gtgaaggcattgtggctgaccacgttgc

SEQ ID NO: 394725 - DNA, 28 bp, Artificial Sequence
  Description of Artificial Sequence: Synthetic oligonucleotide
tgaaggcattgtggctgaccacgttgcc

SEQ ID NO: 394726 - DNA, 27 bp, Artificial Sequence
  Description of Artificial Sequence: Synthetic oligonucleotide
gaaggcattgtggctgaccacgttgcc

SEQ ID NO: 394727 - DNA, 28 bp, Artificial Sequence
  Description of Artificial Sequence: Synthetic oligonucleotide
aaggcattgtggctgaccacgttgcctc

SEQ ID NO: 394728 - DNA, 27 bp, Artificial Sequence
  Description of Artificial Sequence: Synthetic oligonucleotide
aggcattgtggctgaccacgttgcctc

SEQ ID NO: 394729 - DNA, 27 bp, Artificial Sequence
  Description of Artificial Sequence: Synthetic oligonucleotide
ggcattgtggctgaccacgttgcctct

SEQ ID NO: 394730 - DNA, 28 bp, Artificial Sequence
  Description of Artificial Sequence: Synthetic oligonucleotide
gcattgtggctgaccacgttgcctcttg

SEQ ID NO: 394731 - DNA, 29 bp, Artificial Sequence
  Description of Artificial Sequence: Synthetic oligonucleotide
tcagagctcacagagactgtggtctgcac

SEQ ID NO: 394732 - DNA, 28 bp, Artificial Sequence
  Description of Artificial Sequence: Synthetic oligonucleotide
cagagctcacagagactgtggtctgcac

SEQ ID NO: 394733 - DNA, 28 bp, Artificial Sequence
  Description of Artificial Sequence: Synthetic oligonucleotide
agagctcacagagactgtggtctgcacc

SEQ ID NO: 394734 - DNA, 27 bp, Artificial Sequence
  Description of Artificial Sequence: Synthetic oligonucleotide
gagctcacagagactgtggtctgcacc

SEQ ID NO: 394735 - DNA, 27 bp, Artificial Sequence
  Description of Artificial Sequence: Synthetic oligonucleotide
agctcacagagactgtggtctgcaccc

SEQ ID NO: 394736 - DNA, 27 bp, Artificial Sequence
  Description of Artificial Sequence: Synthetic oligonucleotide
gctcacagagactgtggtctgcaccct

SEQ ID NO: 394737 - DNA, 27 bp, Artificial Sequence
  Description of Artificial Sequence: Synthetic oligonucleotide
ctcacagagactgtggtctgcaccctg

SEQ ID NO: 394738 - DNA, 27 bp, Artificial Sequence
  Description of Artificial Sequence: Synthetic oligonucleotide
tcacagagactgtggtctgcaccctgg

SEQ ID NO: 394739 - DNA, 26 bp, Artificial Sequence
  Description of Artificial Sequence: Synthetic oligonucleotide
cacagagactgtggtctgcaccctgg

SEQ ID NO: 394740 - DNA, 26 bp, Artificial Sequence
  Description of Artificial Sequence: Synthetic oligonucleotide
acagagactgtggtctgcaccctggg

SEQ ID NO: 394741 - DNA, 25 bp, Artificial Sequence
  Description of Artificial Sequence: Synthetic oligonucleotide
cagagactgtggtctgcaccctggg

SEQ ID NO: 394742 - DNA, 27 bp, Artificial Sequence
  Description of Artificial Sequence: Synthetic oligonucleotide
agagactgtggtctgcaccctggggtt

SEQ ID NO: 394743 - DNA, 26 bp, Artificial Sequence
  Description of Artificial Sequence: Synthetic oligonucleotide
gagactgtggtctgcaccctggggtt

SEQ ID NO: 394744 - DNA, 27 bp, Artificial Sequence
  Description of Artificial Sequence: Synthetic oligonucleotide
agactgtggtctgcaccctggggttgt

SEQ ID NO: 394745 - DNA, 26 bp, Artificial Sequence
  Description of Artificial Sequence: Synthetic oligonucleotide
gactgtggtctgcaccctggggttgt

SEQ ID NO: 394746 - DNA, 27 bp, Artificial Sequence
  Description of Artificial Sequence: Synthetic oligonucleotide
actgtggtctgcaccctggggttgtct

SEQ ID NO: 394747 - DNA, 26 bp, Artificial Sequence
  Description of Artificial Sequence: Synthetic oligonucleotide
ctgtggtctgcaccctggggttgtct

SEQ ID NO: 394748 - DNA, 27 bp, Artificial Sequence
  Description of Artificial Sequence: Synthetic oligonucleotide
tgtggtctgcaccctggggttgtctgt

SEQ ID NO: 394749 - DNA, 26 bp, Artificial Sequence
  Description of Artificial Sequence: Synthetic oligonucleotide
gtggtctgcaccctggggttgtctgt

SEQ ID NO: 394750 - DNA, 26 bp, Artificial Sequence
  Description of Artificial Sequence: Synthetic oligonucleotide
tggtctgcaccctggggttgtctgtg

SEQ ID NO: 394751 - DNA, 25 bp, Artificial Sequence
  Description of Artificial Sequence: Synthetic oligonucleotide
ggtctgcaccctggggttgtctgtg

SEQ ID NO: 394752 - DNA, 25 bp, Artificial Sequence
  Description of Artificial Sequence: Synthetic oligonucleotide
gtctgcaccctggggttgtctgtgg

SEQ ID NO: 394753 - DNA, 25 bp, Artificial Sequence
  Description of Artificial Sequence: Synthetic oligonucleotide
tctgcaccctggggttgtctgtggg

SEQ ID NO: 394754 - DNA, 24 bp, Artificial Sequence
  Description of Artificial Sequence: Synthetic oligonucleotide
ctgcaccctggggttgtctgtggg

SEQ ID NO: 394755 - DNA, 24 bp, Artificial Sequence
  Description of Artificial Sequence: Synthetic oligonucleotide
tgcaccctggggttgtctgtgggc

SEQ ID NO: 394756 - DNA, 23 bp, Artificial Sequence
  Description of Artificial Sequence: Synthetic oligonucleotide
gcaccctggggttgtctgtgggc

SEQ ID NO: 394757 - DNA, 24 bp, Artificial Sequence
  Description of Artificial Sequence: Synthetic oligonucleotide
caccctggggttgtctgtgggcct

SEQ ID NO: 394758 - DNA, 24 bp, Artificial Sequence
  Description of Artificial Sequence: Synthetic oligonucleotide
accctggggttgtctgtgggcctc

SEQ ID NO: 394759 - DNA, 26 bp, Artificial Sequence
  Description of Artificial Sequence: Synthetic oligonucleotide
ctcgctctgaccaccatgatgagccc

SEQ ID NO: 394760 - DNA, 27 bp, Artificial Sequence
  Description of Artificial Sequence: Synthetic oligonucleotide
tcgctctgaccaccatgatgagcccct

SEQ ID NO: 394761 - DNA, 26 bp, Artificial Sequence
  Description of Artificial Sequence: Synthetic oligonucleotide
cgctctgaccaccatgatgagcccct

SEQ ID NO: 394762 - DNA, 27 bp, Artificial Sequence
  Description of Artificial Sequence: Synthetic oligonucleotide
gctctgaccaccatgatgagcccctgt

SEQ ID NO: 394763 - DNA, 27 bp, Artificial Sequence
  Description of Artificial Sequence: Synthetic oligonucleotide
ctctgaccaccatgatgagcccctgtg

SEQ ID NO: 394764 - DNA, 27 bp, Artificial Sequence
  Description of Artificial Sequence: Synthetic oligonucleotide
tctgaccaccatgatgagcccctgtgg

SEQ ID NO: 394765 - DNA, 27 bp, Artificial Sequence
  Description of Artificial Sequence: Synthetic oligonucleotide
ctgaccaccatgatgagcccctgtgga

SEQ ID NO: 394766 - DNA, 27 bp, Artificial Sequence
  Description of Artificial Sequence: Synthetic oligonucleotide
tgaccaccatgatgagcccctgtggag

SEQ ID NO: 394767 - DNA, 26 bp, Artificial Sequence
  Description of Artificial Sequence: Synthetic oligonucleotide
gaccaccatgatgagcccctgtggag

SEQ ID NO: 394768 - DNA, 27 bp, Artificial Sequence
  Description of Artificial Sequence: Synthetic oligonucleotide
accaccatgatgagcccctgtggaggt

SEQ ID NO: 394769 - DNA, 26 bp, Artificial Sequence
  Description of Artificial Sequence: Synthetic oligonucleotide
ccaccatgatgagcccctgtggaggt

SEQ ID NO: 394770 - DNA, 27 bp, Artificial Sequence
  Description of Artificial Sequence: Synthetic oligonucleotide
caccatgatgagcccctgtggaggtga

SEQ ID NO: 394771 - DNA, 28 bp, Artificial Sequence
  Description of Artificial Sequence: Synthetic oligonucleotide
accatgatgagcccctgtggaggtgaag

SEQ ID NO: 394772 - DNA, 27 bp, Artificial Sequence
  Description of Artificial Sequence: Synthetic oligonucleotide
ccatgatgagcccctgtggaggtgaag

SEQ ID NO: 394773 - DNA, 27 bp, Artificial Sequence
  Description of Artificial Sequence: Synthetic oligonucleotide
catgatgagcccctgtggaggtgaagg

SEQ ID NO: 394774 - DNA, 27 bp, Artificial Sequence
  Description of Artificial Sequence: Synthetic oligonucleotide
atgatgagcccctgtggaggtgaaggc

SEQ ID NO: 394775 - DNA, 27 bp, Artificial Sequence
  Description of Artificial Sequence: Synthetic oligonucleotide
tgatgagcccctgtggaggtgaaggca

SEQ ID NO: 394776 - DNA, 27 bp, Artificial Sequence
  Description of Artificial Sequence: Synthetic oligonucleotide
gatgagcccctgtggaggtgaaggcat

SEQ ID NO: 394777 - DNA, 28 bp, Artificial Sequence
  Description of Artificial Sequence: Synthetic oligonucleotide
atgagcccctgtggaggtgaaggcattg

SEQ ID NO: 394778 - DNA, 27 bp, Artificial Sequence
  Description of Artificial Sequence: Synthetic oligonucleotide
tgagcccctgtggaggtgaaggcattg

SEQ ID NO: 394779 - DNA, 27 bp, Artificial Sequence
  Description of Artificial Sequence: Synthetic oligonucleotide
gagcccctgtggaggtgaaggcattgt

SEQ ID NO: 394780 - DNA, 27 bp, Artificial Sequence
  Description of Artificial Sequence: Synthetic oligonucleotide
agcccctgtggaggtgaaggcattgtg

SEQ ID NO: 394781 - DNA, 26 bp, Artificial Sequence
  Description of Artificial Sequence: Synthetic oligonucleotide
gcccctgtggaggtgaaggcattgtg

SEQ ID NO: 394782 - DNA, 26 bp, Artificial Sequence
  Description of Artificial Sequence: Synthetic oligonucleotide
cccctgtggaggtgaaggcattgtgg

SEQ ID NO: 394783 - DNA, 27 bp, Artificial Sequence
  Description of Artificial Sequence: Synthetic oligonucleotide
ccctgtggaggtgaaggcattgtggct

SEQ ID NO: 394784 - DNA, 27 bp, Artificial Sequence
  Description of Artificial Sequence: Synthetic oligonucleotide
cctgtggaggtgaaggcattgtggctg

SEQ ID NO: 394785 - DNA, 28 bp, Artificial Sequence
  Description of Artificial Sequence: Synthetic oligonucleotide
ctgtggaggtgaaggcattgtggctgac

SEQ ID NO: 394786 - DNA, 28 bp, Artificial Sequence
  Description of Artificial Sequence: Synthetic oligonucleotide
ttctacgtggacctggagaggaaggagg

SEQ ID NO: 394787 - DNA, 27 bp, Artificial Sequence
  Description of Artificial Sequence: Synthetic oligonucleotide
tctacgtggacctggagaggaaggagg

SEQ ID NO: 394788 - DNA, 26 bp, Artificial Sequence
  Description of Artificial Sequence: Synthetic oligonucleotide
ctacgtggacctggagaggaaggagg

SEQ ID NO: 394789 - DNA, 27 bp, Artificial Sequence
  Description of Artificial Sequence: Synthetic oligonucleotide
tacgtggacctggagaggaaggaggct

SEQ ID NO: 394790 - DNA, 26 bp, Artificial Sequence
  Description of Artificial Sequence: Synthetic oligonucleotide
acgtggacctggagaggaaggaggct

SEQ ID NO: 394791 - DNA, 25 bp, Artificial Sequence
  Description of Artificial Sequence: Synthetic oligonucleotide
cgtggacctggagaggaaggaggct

SEQ ID NO: 394792 - DNA, 25 bp, Artificial Sequence
  Description of Artificial Sequence: Synthetic oligonucleotide
gtggacctggagaggaaggaggctg

SEQ ID NO: 394793 - DNA, 25 bp, Artificial Sequence
  Description of Artificial Sequence: Synthetic oligonucleotide
tggacctggagaggaaggaggctgc

SEQ ID NO: 394794 - DNA, 24 bp, Artificial Sequence
  Description of Artificial Sequence: Synthetic oligonucleotide
ggacctggagaggaaggaggctgc

SEQ ID NO: 394795 - DNA, 25 bp, Artificial Sequence
  Description of Artificial Sequence: Synthetic oligonucleotide
gacctggagaggaaggaggctgcct

SEQ ID NO: 394796 - DNA, 25 bp, Artificial Sequence
  Description of Artificial Sequence: Synthetic oligonucleotide
acctggagaggaaggaggctgcctg

SEQ ID NO: 394797 - DNA, 24 bp, Artificial Sequence
  Description of Artificial Sequence: Synthetic oligonucleotide
cctggagaggaaggaggctgcctg

SEQ ID NO: 394798 - DNA, 24 bp, Artificial Sequence
  Description of Artificial Sequence: Synthetic oligonucleotide
ctggagaggaaggaggctgcctgg

SEQ ID NO: 394799 - DNA, 24 bp, Artificial Sequence
  Description of Artificial Sequence: Synthetic oligonucleotide
tggagaggaaggaggctgcctggc

SEQ ID NO: 394800 - DNA, 23 bp, Artificial Sequence
  Description of Artificial Sequence: Synthetic oligonucleotide
ggagaggaaggaggctgcctggc

SEQ ID NO: 394801 - DNA, 23 bp, Artificial Sequence
  Description of Artificial Sequence: Synthetic oligonucleotide
gagaggaaggaggctgcctggcg

SEQ ID NO: 394802 - DNA, 24 bp, Artificial Sequence
  Description of Artificial Sequence: Synthetic oligonucleotide
agaggaaggaggctgcctggcggt

SEQ ID NO: 394803 - DNA, 23 bp, Artificial Sequence
  Description of Artificial Sequence: Synthetic oligonucleotide
gaggaaggaggctgcctggcggt

SEQ ID NO: 394804 - DNA, 23 bp, Artificial Sequence
  Description of Artificial Sequence: Synthetic oligonucleotide
aggaaggaggctgcctggcggtg

SEQ ID NO: 394805 - DNA, 22 bp, Artificial Sequence
  Description of Artificial Sequence: Synthetic oligonucleotide
ggaaggaggctgcctggcggtg

SEQ ID NO: 394806 - DNA, 22 bp, Artificial Sequence
  Description of Artificial Sequence: Synthetic oligonucleotide
gaaggaggctgcctggcggtgg

SEQ ID NO: 394807 - DNA, 22 bp, Artificial Sequence
  Description of Artificial Sequence: Synthetic oligonucleotide
aaggaggctgcctggcggtggc

SEQ ID NO: 394808 - DNA, 21 bp, Artificial Sequence
  Description of Artificial Sequence: Synthetic oligonucleotide
aggaggctgcctggcggtggc

SEQ ID NO: 394809 - DNA, 20 bp, Artificial Sequence
  Description of Artificial Sequence: Synthetic oligonucleotide
ggaggctgcctggcggtggc

SEQ ID NO: 394810 - DNA, 21 bp, Artificial Sequence
  Description of Artificial Sequence: Synthetic oligonucleotide
gaggctgcctggcggtggcct

SEQ ID NO: 394811 - DNA, 22 bp, Artificial Sequence
  Description of Artificial Sequence: Synthetic oligonucleotide
aggctgcctggcggtggcctga

SEQ ID NO: 394812 - DNA, 21 bp, Artificial Sequence
  Description of Artificial Sequence: Synthetic oligonucleotide
ggctgcctggcggtggcctga

SEQ ID NO: 394813 - DNA, 23 bp, Artificial Sequence
  Description of Artificial Sequence: Synthetic oligonucleotide
gctgcctggcggtggcctgagtt

SEQ ID NO: 394814 - DNA, 45 bp, Artificial Sequence; identical to SEQ ID NO: 56202
  Description of Artificial Sequence: Synthetic oligonucleotide

SEQ ID NO: 394815 - DNA, 44 bp, Artificial Sequence; identical to SEQ ID NO: 56203
  Description of Artificial Sequence: Synthetic oligonucleotide

SEQ ID NO: 394816 - DNA, 43 bp, Artificial Sequence; identical to SEQ ID NO: 56204
  Description of Artificial Sequence: Synthetic oligonucleotide

SEQ ID NO: 394817 - DNA, 42 bp, Artificial Sequence; identical to SEQ ID NO: 56205
  Description of Artificial Sequence: Synthetic oligonucleotide

SEQ ID NO: 394818 - DNA, 42 bp, Artificial Sequence; identical to SEQ ID NO: 56206
  Description of Artificial Sequence: Synthetic oligonucleotide

SEQ ID NO: 394819 - DNA, 41 bp, Artificial Sequence; identical to SEQ ID NO: 56207
  Description of Artificial Sequence: Synthetic oligonucleotide

SEQ ID NO: 394820 - DNA, 40 bp, Artificial Sequence; identical to SEQ ID NO: 56208
  Description of Artificial Sequence: Synthetic oligonucleotide

SEQ ID NO: 394821 - DNA, 42 bp, Artificial Sequence; identical to SEQ ID NO: 56209
  Description of Artificial Sequence: Synthetic oligonucleotide

SEQ ID NO: 394822 - DNA, 44 bp, Artificial Sequence; identical to SEQ ID NO: 56210
  Description of Artificial Sequence: Synthetic oligonucleotide

SEQ ID NO: 394823 - DNA, 45 bp, Artificial Sequence; identical to SEQ ID NO: 56211
  Description of Artificial Sequence: Synthetic oligonucleotide

SEQ ID NO: 394824 - DNA, 44 bp, Artificial Sequence; identical to SEQ ID NO: 56212
  Description of Artificial Sequence: Synthetic oligonucleotide

SEQ ID NO: 394825 - DNA, 46 bp, Artificial Sequence; identical to SEQ ID NO: 56213
  Description of Artificial Sequence: Synthetic oligonucleotide

SEQ ID NO: 394826 - DNA, 45 bp, Artificial Sequence; identical to SEQ ID NO: 56214
  Description of Artificial Sequence: Synthetic oligonucleotide

SEQ ID NO: 394827 - DNA, 45 bp, Artificial Sequence; identical to SEQ ID NO: 56215
  Description of Artificial Sequence: Synthetic oligonucleotide

SEQ ID NO: 394828 - DNA, 45 bp, Artificial Sequence; identical to SEQ ID NO: 56216
  Description of Artificial Sequence: Synthetic oligonucleotide

SEQ ID NO: 394829 - DNA, 45 bp, Artificial Sequence; identical to SEQ ID NO: 56217
  Description of Artificial Sequence: Synthetic oligonucleotide

SEQ ID NO: 394830 - DNA, 44 bp, Artificial Sequence; identical to SEQ ID NO: 56218
  Description of Artificial Sequence: Synthetic oligonucleotide

SEQ ID NO: 394831 - DNA, 43 bp, Artificial Sequence; identical to SEQ ID NO: 56219
  Description of Artificial Sequence: Synthetic oligonucleotide

SEQ ID NO: 394832 - DNA, 42 bp, Artificial Sequence; identical to SEQ ID NO: 56220
  Description of Artificial Sequence: Synthetic oligonucleotide

SEQ ID NO: 394833 - DNA, 41 bp, Artificial Sequence; identical to SEQ ID NO: 56221
  Description of Artificial Sequence: Synthetic oligonucleotide

SEQ ID NO: 394834 - DNA, 42 bp, Artificial Sequence; identical to SEQ ID NO: 56222
  Description of Artificial Sequence: Synthetic oligonucleotide

SEQ ID NO: 394835 - DNA, 41 bp, Artificial Sequence; identical to SEQ ID NO: 56223
  Description of Artificial Sequence: Synthetic oligonucleotide

SEQ ID NO: 394836 - DNA, 41 bp, Artificial Sequence; identical to SEQ ID NO: 56224
  Description of Artificial Sequence: Synthetic oligonucleotide

SEQ ID NO: 394837 - DNA, 40 bp, Artificial Sequence; identical to SEQ ID NO: 56225
  Description of Artificial Sequence: Synthetic oligonucleotide

SEQ ID NO: 394838 - DNA, 39 bp, Artificial Sequence; identical to SEQ ID NO: 56226
  Description of Artificial Sequence: Synthetic oligonucleotide

SEQ ID NO: 394839 - DNA, 41 bp, Artificial Sequence; identical to SEQ ID NO: 56227
  Description of Artificial Sequence: Synthetic oligonucleotide

SEQ ID NO: 394840 - DNA, 40 bp, Artificial Sequence; identical to SEQ ID NO: 56228
  Description of Artificial Sequence: Synthetic oligonucleotide

SEQ ID NO: 394841 - DNA, 39 bp, Artificial Sequence; identical to SEQ ID NO: 56229
  Description of Artificial Sequence: Synthetic oligonucleotide

SEQ ID NO: 394842 - DNA, 39 bp, Artificial Sequence; identical to SEQ ID NO: 56230
  Description of Artificial Sequence: Synthetic oligonucleotide

SEQ ID NO: 394843 - DNA, 38 bp, Artificial Sequence; identical to SEQ ID NO: 56231
  Description of Artificial Sequence: Synthetic oligonucleotide

SEQ ID NO: 394844 - DNA, 37 bp, Artificial Sequence; identical to SEQ ID NO: 56232
  Description of Artificial Sequence: Synthetic oligonucleotide

SEQ ID NO: 394845 - DNA, 40 bp, Artificial Sequence; identical to SEQ ID NO: 56233
  Description of Artificial Sequence: Synthetic oligonucleotide

SEQ ID NO: 394846 - DNA, 39 bp, Artificial Sequence; identical to SEQ ID NO: 56234
  Description of Artificial Sequence: Synthetic oligonucleotide

SEQ ID NO: 394847 - DNA, 38 bp, Artificial Sequence; identical to SEQ ID NO: 56235
  Description of Artificial Sequence: Synthetic oligonucleotide

SEQ ID NO: 394848 - DNA, 39 bp, Artificial Sequence; identical to SEQ ID NO: 56236
  Description of Artificial Sequence: Synthetic oligonucleotide

SEQ ID NO: 394849 - DNA, 38 bp, Artificial Sequence; identical to SEQ ID NO: 56237
  Description of Artificial Sequence: Synthetic oligonucleotide

SEQ ID NO: 394850 - DNA, 37 bp, Artificial Sequence; identical to SEQ ID NO: 56238
  Description of Artificial Sequence: Synthetic oligonucleotide

SEQ ID NO: 394851 - DNA, 37 bp, Artificial Sequence; identical to SEQ ID NO: 56239
  Description of Artificial Sequence: Synthetic oligonucleotide

SEQ ID NO: 394852 - DNA, 36 bp, Artificial Sequence; identical to SEQ ID NO: 56240
  Description of Artificial Sequence: Synthetic oligonucleotide

SEQ ID NO: 394853 - DNA, 35 bp, Artificial Sequence; identical to SEQ ID NO: 56241
  Description of Artificial Sequence: Synthetic oligonucleotide

SEQ ID NO: 394854 - DNA, 34 bp, Artificial Sequence; identical to SEQ ID NO: 56242
  Description of Artificial Sequence: Synthetic oligonucleotide

SEQ ID NO: 394855 - DNA, 33 bp, Artificial Sequence; identical to SEQ ID NO: 56243
  Description of Artificial Sequence: Synthetic oligonucleotide

SEQ ID NO: 394856 - DNA, 32 bp, Artificial Sequence; identical to SEQ ID NO: 56244
  Description of Artificial Sequence: Synthetic oligonucleotide

SEQ ID NO: 394857 - DNA, 31 bp, Artificial Sequence; identical to SEQ ID NO: 56245
  Description of Artificial Sequence: Synthetic oligonucleotide

SEQ ID NO: 394858 - DNA, 39 bp, Artificial Sequence
  Description of Artificial Sequence: Synthetic oligonucleotide
aaaaattcctggaggttgtaacccagaaaatcctgaagg

SEQ ID NO: 394859 - DNA, 38 bp, Artificial Sequence
  Description of Artificial Sequence: Synthetic oligonucleotide
aaaattcctggaggttgtaacccagaaaatcctgaagg

SEQ ID NO: 394860 - DNA, 37 bp, Artificial Sequence
  Description of Artificial Sequence: Synthetic oligonucleotide
aaattcctggaggttgtaacccagaaaatcctgaagg

SEQ ID NO: 394861 - DNA, 36 bp, Artificial Sequence
  Description of Artificial Sequence: Synthetic oligonucleotide
aattcctggaggttgtaacccagaaaatcctgaagg

SEQ ID NO: 394862 - DNA, 35 bp, Artificial Sequence
  Description of Artificial Sequence: Synthetic oligonucleotide
attcctggaggttgtaacccagaaaatcctgaagg

SEQ ID NO: 394863 - DNA, 34 bp, Artificial Sequence
  Description of Artificial Sequence: Synthetic oligonucleotide
ttcctggaggttgtaacccagaaaatcctgaagg

SEQ ID NO: 394864 - DNA, 33 bp, Artificial Sequence
  Description of Artificial Sequence: Synthetic oligonucleotide
tcctggaggttgtaacccagaaaatcctgaagg

SEQ ID NO: 394865 - DNA, 32 bp, Artificial Sequence
  Description of Artificial Sequence: Synthetic oligonucleotide
cctggaggttgtaacccagaaaatcctgaagg

SEQ ID NO: 394866 - DNA, 34 bp, Artificial Sequence
  Description of Artificial Sequence: Synthetic oligonucleotide
ctggaggttgtaacccagaaaatcctgaaggatg

SEQ ID NO: 394867 - DNA, 34 bp, Artificial Sequence
  Description of Artificial Sequence: Synthetic oligonucleotide
tggaggttgtaacccagaaaatcctgaaggatgc

SEQ ID NO: 394868 - DNA, 33 bp, Artificial Sequence
  Description of Artificial Sequence: Synthetic oligonucleotide
ggaggttgtaacccagaaaatcctgaaggatgc

SEQ ID NO: 394869 - DNA, 33 bp, Artificial Sequence
  Description of Artificial Sequence: Synthetic oligonucleotide
gaggttgtaacccagaaaatcctgaaggatgcc

SEQ ID NO: 394870 - DNA, 41 bp, Artificial Sequence
  Description of Artificial Sequence: Synthetic oligonucleotide
aggttgtaacccagaaaatcctgaaggatgccatataattg

SEQ ID NO: 394871 - DNA, 40 bp, Artificial Sequence
  Description of Artificial Sequence: Synthetic oligonucleotide
ggttgtaacccagaaaatcctgaaggatgccatataattg

SEQ ID NO: 394872 - DNA, 42 bp, Artificial Sequence
  Description of Artificial Sequence: Synthetic oligonucleotide
gttgtaacccagaaaatcctgaaggatgccatataattgatg

SEQ ID NO: 394873 - DNA, 43 bp, Artificial Sequence
  Description of Artificial Sequence: Synthetic oligonucleotide
ttgtaacccagaaaatcctgaaggatgccatataattgatgac

SEQ ID NO: 394874 - DNA, 42 bp, Artificial Sequence
  Description of Artificial Sequence: Synthetic oligonucleotide
tgtaacccagaaaatcctgaaggatgccatataattgatgac

SEQ ID NO: 394875 - DNA, 41 bp, Artificial Sequence
  Description of Artificial Sequence: Synthetic oligonucleotide
gtaacccagaaaatcctgaaggatgccatataattgatgac

SEQ ID NO: 394876 - DNA, 41 bp, Artificial Sequence
  Description of Artificial Sequence: Synthetic oligonucleotide
taacccagaaaatcctgaaggatgccatataattgatgacc

SEQ ID NO: 394877 - DNA, 40 bp, Artificial Sequence
  Description of Artificial Sequence: Synthetic oligonucleotide
aacccagaaaatcctgaaggatgccatataattgatgacc

SEQ ID NO: 394878 - DNA, 39 bp, Artificial Sequence
  Description of Artificial Sequence: Synthetic oligonucleotide
acccagaaaatcctgaaggatgccatataattgatgacc

SEQ ID NO: 394879 - DNA, 38 bp, Artificial Sequence
  Description of Artificial Sequence: Synthetic oligonucleotide
cccagaaaatcctgaaggatgccatataattgatgacc

SEQ ID NO: 394880 - DNA, 39 bp, Artificial Sequence
  Description of Artificial Sequence: Synthetic oligonucleotide
ccagaaaatcctgaaggatgccatataattgatgacctc

SEQ ID NO: 394881 - DNA, 41 bp, Artificial Sequence
  Description of Artificial Sequence: Synthetic oligonucleotide
cagaaaatcctgaaggatgccatataattgatgacctcatc

SEQ ID NO: 394882 - DNA, 44 bp, Artificial Sequence
  Description of Artificial Sequence: Synthetic oligonucleotide
agaaaatcctgaaggatgccatataattgatgacctcatctatc

SEQ ID NO: 394883 - DNA, 43 bp, Artificial Sequence
  Description of Artificial Sequence: Synthetic oligonucleotide
gaaaatcctgaaggatgccatataattgatgacctcatctatc

SEQ ID NO: 394884 - DNA, 43 bp, Artificial Sequence
  Description of Artificial Sequence: Synthetic oligonucleotide
aaaatcctgaaggatgccatataattgatgacctcatctatcc

SEQ ID NO: 394885 - DNA, 42 bp, Artificial Sequence
  Description of Artificial Sequence: Synthetic oligonucleotide
aaatcctgaaggatgccatataattgatgacctcatctatcc

SEQ ID NO: 394886 - DNA, 41 bp, Artificial Sequence
  Description of Artificial Sequence: Synthetic oligonucleotide
aatcctgaaggatgccatataattgatgacctcatctatcc

SEQ ID NO: 394887 - DNA, 40 bp, Artificial Sequence
  Description of Artificial Sequence: Synthetic oligonucleotide
atcctgaaggatgccatataattgatgacctcatctatcc

SEQ ID NO: 394888 - DNA, 39 bp, Artificial Sequence
  Description of Artificial Sequence: Synthetic oligonucleotide
tcctgaaggatgccatataattgatgacctcatctatcc

SEQ ID NO: 394889 - DNA, 38 bp, Artificial Sequence
  Description of Artificial Sequence: Synthetic oligonucleotide
cctgaaggatgccatataattgatgacctcatctatcc

SEQ ID NO: 394890 - DNA, 40 bp, Artificial Sequence
  Description of Artificial Sequence: Synthetic oligonucleotide
ctgaaggatgccatataattgatgacctcatctatccatg

SEQ ID NO: 394891 - DNA, 41 bp, Artificial Sequence
  Description of Artificial Sequence: Synthetic oligonucleotide
tgaaggatgccatataattgatgacctcatctatccatgag

SEQ ID NO: 394892 - DNA, 40 bp, Artificial Sequence
  Description of Artificial Sequence: Synthetic oligonucleotide
gaaggatgccatataattgatgacctcatctatccatgag

SEQ ID NO: 394893 - DNA, 40 bp, Artificial Sequence
  Description of Artificial Sequence: Synthetic oligonucleotide
aaggatgccatataattgatgacctcatctatccatgagg

SEQ ID NO: 394894 - DNA, 39 bp, Artificial Sequence
  Description of Artificial Sequence: Synthetic oligonucleotide
aggatgccatataattgatgacctcatctatccatgagg

SEQ ID NO: 394895 - DNA, 38 bp, Artificial Sequence
  Description of Artificial Sequence: Synthetic oligonucleotide
ggatgccatataattgatgacctcatctatccatgagg

SEQ ID NO: 394896 - DNA, 38 bp, Artificial Sequence
  Description of Artificial Sequence: Synthetic oligonucleotide
gatgccatataattgatgacctcatctatccatgaggc

SEQ ID NO: 394897 - DNA, 39 bp, Artificial Sequence
  Description of Artificial Sequence: Synthetic oligonucleotide
atgccatataattgatgacctcatctatccatgaggctg

SEQ ID NO: 394898 - DNA, 38 bp, Artificial Sequence
  Description of Artificial Sequence: Synthetic oligonucleotide
tgccatataattgatgacctcatctatccatgaggctg

SEQ ID NO: 394899 - DNA, 37 bp, Artificial Sequence
  Description of Artificial Sequence: Synthetic oligonucleotide
gccatataattgatgacctcatctatccatgaggctg

SEQ ID NO: 394900 - DNA, 37 bp, Artificial Sequence
  Description of Artificial Sequence: Synthetic oligonucleotide
ccatataattgatgacctcatctatccatgaggctgc

SEQ ID NO: 394901 - DNA, 38 bp, Artificial Sequence
  Description of Artificial Sequence: Synthetic oligonucleotide
catataattgatgacctcatctatccatgaggctgctc

SEQ ID NO: 394902 - DNA, 39 bp, Artificial Sequence
  Description of Artificial Sequence: Synthetic oligonucleotide
atataattgatgacctcatctatccatgaggctgctcag

SEQ ID NO: 394903 - DNA, 38 bp, Artificial Sequence
  Description of Artificial Sequence: Synthetic oligonucleotide
tataattgatgacctcatctatccatgaggctgctcag

SEQ ID NO: 394904 - DNA, 37 bp, Artificial Sequence
  Description of Artificial Sequence: Synthetic oligonucleotide
ataattgatgacctcatctatccatgaggctgctcag

SEQ ID NO: 394905 - DNA, 36 bp, Artificial Sequence
  Description of Artificial Sequence: Synthetic oligonucleotide
taattgatgacctcatctatccatgaggctgctcag

SEQ ID NO: 394906 - DNA, 35 bp, Artificial Sequence
  Description of Artificial Sequence: Synthetic oligonucleotide
aattgatgacctcatctatccatgaggctgctcag

SEQ ID NO: 394907 - DNA, 34 bp, Artificial Sequence
  Description of Artificial Sequence: Synthetic oligonucleotide
attgatgacctcatctatccatgaggctgctcag

SEQ ID NO: 394908 - DNA, 33 bp, Artificial Sequence
  Description of Artificial Sequence: Synthetic oligonucleotide
ttgatgacctcatctatccatgaggctgctcag

SEQ ID NO: 394909 - DNA, 32 bp, Artificial Sequence
  Description of Artificial Sequence: Synthetic oligonucleotide
tgatgacctcatctatccatgaggctgctcag

SEQ ID NO: 394910 - DNA, 31 bp, Artificial Sequence
  Description of Artificial Sequence: Synthetic oligonucleotide
gatgacctcatctatccatgaggctgctcag

SEQ ID NO: 394911 - DNA, 35 bp, Artificial Sequence
  Description of Artificial Sequence: Synthetic oligonucleotide
atgacctcatctatccatgaggctgctcagaaatg

SEQ ID NO: 394912 - DNA, 34 bp, Artificial Sequence
  Description of Artificial Sequence: Synthetic oligonucleotide
tgacctcatctatccatgaggctgctcagaaatg

SEQ ID NO: 394913 - DNA, 33 bp, Artificial Sequence
  Description of Artificial Sequence: Synthetic oligonucleotide
gacctcatctatccatgaggctgctcagaaatg

SEQ ID NO: 394914 - DNA, 33 bp, Artificial Sequence
  Description of Artificial Sequence: Synthetic oligonucleotide
acctcatctatccatgaggctgctcagaaatgc

SEQ ID NO: 394915 - DNA, 32 bp, Artificial Sequence
  Description of Artificial Sequence: Synthetic oligonucleotide
cctcatctatccatgaggctgctcagaaatgc

SEQ ID NO: 394916 - DNA, 32 bp, Artificial Sequence
  Description of Artificial Sequence: Synthetic oligonucleotide
ctcatctatccatgaggctgctcagaaatgcc

SEQ ID NO: 394917 - DNA, 32 bp, Artificial Sequence
  Description of Artificial Sequence: Synthetic oligonucleotide
tcatctatccatgaggctgctcagaaatgccc

SEQ ID NO: 394918 - DNA, 31 bp, Artificial Sequence
  Description of Artificial Sequence: Synthetic oligonucleotide
catctatccatgaggctgctcagaaatgccc

SEQ ID NO: 394919 - DNA, 32 bp, Artificial Sequence
  Description of Artificial Sequence: Synthetic oligonucleotide
atctatccatgaggctgctcagaaatgcccac

SEQ ID NO: 394920 - DNA, 31 bp, Artificial Sequence
  Description of Artificial Sequence: Synthetic oligonucleotide
tctatccatgaggctgctcagaaatgcccac

SEQ ID NO: 394921 - DNA, 30 bp, Artificial Sequence
  Description of Artificial Sequence: Synthetic oligonucleotide
ctatccatgaggctgctcagaaatgcccac

SEQ ID NO: 394922 - DNA, 30 bp, Artificial Sequence
  Description of Artificial Sequence: Synthetic oligonucleotide
tatccatgaggctgctcagaaatgcccacc

SEQ ID NO: 394923 - DNA, 29 bp, Artificial Sequence
  Description of Artificial Sequence: Synthetic oligonucleotide
atccatgaggctgctcagaaatgcccacc

SEQ ID NO: 394924 - DNA, 28 bp, Artificial Sequence
  Description of Artificial Sequence: Synthetic oligonucleotide
tccatgaggctgctcagaaatgcccacc

SEQ ID NO: 394925 - DNA, 27 bp, Artificial Sequence
  Description of Artificial Sequence: Synthetic oligonucleotide
ccatgaggctgctcagaaatgcccacc

SEQ ID NO: 394926 - DNA, 27 bp, Artificial Sequence
  Description of Artificial Sequence: Synthetic oligonucleotide
catgaggctgctcagaaatgcccaccc

SEQ ID NO: 394927 - DNA, 27 bp, Artificial Sequence
  Description of Artificial Sequence: Synthetic oligonucleotide
atgaggctgctcagaaatgcccacccc

SEQ ID NO: 394928 - DNA, 27 bp, Artificial Sequence
  Description of Artificial Sequence: Synthetic oligonucleotide
tgaggctgctcagaaatgcccacccct

SEQ ID NO: 394929 - DNA, 26 bp, Artificial Sequence
  Description of Artificial Sequence: Synthetic oligonucleotide
aggcgcggtggctcatgcctgtaatc

SEQ ID NO: 394930 - DNA, 25 bp, Artificial Sequence
  Description of Artificial Sequence: Synthetic oligonucleotide
ggcgcggtggctcatgcctgtaatc

SEQ ID NO: 394931 - DNA, 27 bp, Artificial Sequence
  Description of Artificial Sequence: Synthetic oligonucleotide
gcgcggtggctcatgcctgtaatccaa

SEQ ID NO: 394932 - DNA, 27 bp, Artificial Sequence
  Description of Artificial Sequence: Synthetic oligonucleotide
cgcggtggctcatgcctgtaatccaag

SEQ ID NO: 394933 - DNA, 27 bp, Artificial Sequence
  Description of Artificial Sequence: Synthetic oligonucleotide
gcggtggctcatgcctgtaatccaagc

SEQ ID NO: 394934 - DNA, 28 bp, Artificial Sequence
  Description of Artificial Sequence: Synthetic oligonucleotide
cggtggctcatgcctgtaatccaagcac

SEQ ID NO: 394935 - DNA, 31 bp, Artificial Sequence
  Description of Artificial Sequence: Synthetic oligonucleotide
ggtggctcatgcctgtaatccaagcactttg

SEQ ID NO: 394936 - DNA, 31 bp, Artificial Sequence
  Description of Artificial Sequence: Synthetic oligonucleotide
gtggctcatgcctgtaatccaagcactttgg

SEQ ID NO: 394937 - DNA, 31 bp, Artificial Sequence
  Description of Artificial Sequence: Synthetic oligonucleotide
tggctcatgcctgtaatccaagcactttggg

SEQ ID NO: 394938 - DNA, 30 bp, Artificial Sequence
  Description of Artificial Sequence: Synthetic oligonucleotide
ggctcatgcctgtaatccaagcactttggg

SEQ ID NO: 394939 - DNA, 31 bp, Artificial Sequence
  Description of Artificial Sequence: Synthetic oligonucleotide
gctcatgcctgtaatccaagcactttgggag

SEQ ID NO: 394940 - DNA, 31 bp, Artificial Sequence
  Description of Artificial Sequence: Synthetic oligonucleotide
ctcatgcctgtaatccaagcactttgggagg

SEQ ID NO: 394941 - DNA, 31 bp, Artificial Sequence
  Description of Artificial Sequence: Synthetic oligonucleotide
tcatgcctgtaatccaagcactttgggaggc

SEQ ID NO: 394942 - DNA, 30 bp, Artificial Sequence
  Description of Artificial Sequence: Synthetic oligonucleotide
catgcctgtaatccaagcactttgggaggc

SEQ ID NO: 394943 - DNA, 31 bp, Artificial Sequence
  Description of Artificial Sequence: Synthetic oligonucleotide
atgcctgtaatccaagcactttgggaggctg

SEQ ID NO: 394944 - DNA, 30 bp, Artificial Sequence
  Description of Artificial Sequence: Synthetic oligonucleotide
tgcctgtaatccaagcactttgggaggctg

SEQ ID NO: 394945 - DNA, 29 bp, Artificial Sequence
  Description of Artificial Sequence: Synthetic oligonucleotide
gcctgtaatccaagcactttgggaggctg

SEQ ID NO: 394946 - DNA, 30 bp, Artificial Sequence
  Description of Artificial Sequence: Synthetic oligonucleotide
cctgtaatccaagcactttgggaggctgag

SEQ ID NO: 394947 - DNA, 30 bp, Artificial Sequence
  Description of Artificial Sequence: Synthetic oligonucleotide
ctgtaatccaagcactttgggaggctgagg

SEQ ID NO: 394948 - DNA, 30 bp, Artificial Sequence
  Description of Artificial Sequence: Synthetic oligonucleotide
tgtaatccaagcactttgggaggctgaggc

SEQ ID NO: 394949 - DNA, 29 bp, Artificial Sequence
  Description of Artificial Sequence: Synthetic oligonucleotide
gtaatccaagcactttgggaggctgaggc

SEQ ID NO: 394950 - DNA, 30 bp, Artificial Sequence
  Description of Artificial Sequence: Synthetic oligonucleotide
taatccaagcactttgggaggctgaggcag

SEQ ID NO: 394951 - DNA, 29 bp, Artificial Sequence
  Description of Artificial Sequence: Synthetic oligonucleotide
aatccaagcactttgggaggctgaggcag

SEQ ID NO: 394952 - DNA, 28 bp, Artificial Sequence
  Description of Artificial Sequence: Synthetic oligonucleotide
atccaagcactttgggaggctgaggcag

SEQ ID NO: 394953 - DNA, 27 bp, Artificial Sequence
  Description of Artificial Sequence: Synthetic oligonucleotide
tccaagcactttgggaggctgaggcag

SEQ ID NO: 394954 - DNA, 26 bp, Artificial Sequence
  Description of Artificial Sequence: Synthetic oligonucleotide
ccaagcactttgggaggctgaggcag

SEQ ID NO: 394955 - DNA, 26 bp, Artificial Sequence
  Description of Artificial Sequence: Synthetic oligonucleotide
caagcactttgggaggctgaggcagg

SEQ ID NO: 394956 - DNA, 27 bp, Artificial Sequence
  Description of Artificial Sequence: Synthetic oligonucleotide
aagcactttgggaggctgaggcaggca

SEQ ID NO: 394957 - DNA, 26 bp, Artificial Sequence
  Description of Artificial Sequence: Synthetic oligonucleotide
agcactttgggaggctgaggcaggca

SEQ ID NO: 394958 - DNA, 25 bp, Artificial Sequence
  Description of Artificial Sequence: Synthetic oligonucleotide
gcactttgggaggctgaggcaggca

SEQ ID NO: 394959 - DNA, 27 bp, Artificial Sequence
  Description of Artificial Sequence: Synthetic oligonucleotide
cactttgggaggctgaggcaggcagat

SEQ ID NO: 394960 - DNA, 27 bp, Artificial Sequence
  Description of Artificial Sequence: Synthetic oligonucleotide
actttgggaggctgaggcaggcagatc

SEQ ID NO: 394961 - DNA, 27 bp, Artificial Sequence
  Description of Artificial Sequence: Synthetic oligonucleotide
ctttgggaggctgaggcaggcagatca

SEQ ID NO: 394962 - DNA, 27 bp, Artificial Sequence
  Description of Artificial Sequence: Synthetic oligonucleotide
tttgggaggctgaggcaggcagatcac

SEQ ID NO: 394963 - DNA, 26 bp, Artificial Sequence
  Description of Artificial Sequence: Synthetic oligonucleotide
ttgggaggctgaggcaggcagatcac

SEQ ID NO: 394964 - DNA, 25 bp, Artificial Sequence
  Description of Artificial Sequence: Synthetic oligonucleotide
tgggaggctgaggcaggcagatcac

SEQ ID NO: 394965 - DNA, 24 bp, Artificial Sequence
  Description of Artificial Sequence: Synthetic oligonucleotide
gggaggctgaggcaggcagatcac

SEQ ID NO: 394966 - DNA, 25 bp, Artificial Sequence
  Description of Artificial Sequence: Synthetic oligonucleotide
ggaggctgaggcaggcagatcacga

SEQ ID NO: 394967 - DNA, 25 bp, Artificial Sequence
  Description of Artificial Sequence: Synthetic oligonucleotide
gaggctgaggcaggcagatcacgag

SEQ ID NO: 394968 - DNA, 26 bp, Artificial Sequence
  Description of Artificial Sequence: Synthetic oligonucleotide
aggctgaggcaggcagatcacgaggt

SEQ ID NO: 394969 - DNA, 25 bp, Artificial Sequence
  Description of Artificial Sequence: Synthetic oligonucleotide
ggctgaggcaggcagatcacgaggt

SEQ ID NO: 394970 - DNA, 26 bp, Artificial Sequence
  Description of Artificial Sequence: Synthetic oligonucleotide
gctgaggcaggcagatcacgaggtca

SEQ ID NO: 394971 - DNA, 26 bp, Artificial Sequence
  Description of Artificial Sequence: Synthetic oligonucleotide
ctgaggcaggcagatcacgaggtcag

SEQ ID NO: 394972 - DNA, 27 bp, Artificial Sequence
  Description of Artificial Sequence: Synthetic oligonucleotide
tgaggcaggcagatcacgaggtcagga

SEQ ID NO: 394973 - DNA, 26 bp, Artificial Sequence
  Description of Artificial Sequence: Synthetic oligonucleotide
gaggcaggcagatcacgaggtcagga

SEQ ID NO: 394974 - DNA, 27 bp, Artificial Sequence
  Description of Artificial Sequence: Synthetic oligonucleotide
aggcaggcagatcacgaggtcaggagt

SEQ ID NO: 394975 - DNA, 27 bp, Artificial Sequence
  Description of Artificial Sequence: Synthetic oligonucleotide
ggcaggcagatcacgaggtcaggagtt

SEQ ID NO: 394976 - DNA, 27 bp, Artificial Sequence
  Description of Artificial Sequence: Synthetic oligonucleotide
gcaggcagatcacgaggtcaggagttc

SEQ ID NO: 394977 - DNA, 29 bp, Artificial Sequence
  Description of Artificial Sequence: Synthetic oligonucleotide
caggcagatcacgaggtcaggagttcaag

SEQ ID NO: 394978 - DNA, 30 bp, Artificial Sequence
  Description of Artificial Sequence: Synthetic oligonucleotide
aggcagatcacgaggtcaggagttcaagac

SEQ ID NO: 394979 - DNA, 29 bp, Artificial Sequence
  Description of Artificial Sequence: Synthetic oligonucleotide
ggcagatcacgaggtcaggagttcaagac

SEQ ID NO: 394980 - DNA, 29 bp, Artificial Sequence
  Description of Artificial Sequence: Synthetic oligonucleotide
gcagatcacgaggtcaggagttcaagacc

SEQ ID NO: 394981 - DNA, 30 bp, Artificial Sequence
  Description of Artificial Sequence: Synthetic oligonucleotide
cagatcacgaggtcaggagttcaagaccag

SEQ ID NO: 394982 - DNA, 30 bp, Artificial Sequence
  Description of Artificial Sequence: Synthetic oligonucleotide
agatcacgaggtcaggagttcaagaccagc

SEQ ID NO: 394983 - DNA, 29 bp, Artificial Sequence
  Description of Artificial Sequence: Synthetic oligonucleotide
gatcacgaggtcaggagttcaagaccagc

SEQ ID NO: 394984 - DNA, 29 bp, Artificial Sequence
  Description of Artificial Sequence: Synthetic oligonucleotide
atcacgaggtcaggagttcaagaccagcg

SEQ ID NO: 394985 - DNA, 28 bp, Artificial Sequence
  Description of Artificial Sequence: Synthetic oligonucleotide
tcacgaggtcaggagttcaagaccagcg

SEQ ID NO: 394986 - DNA, 27 bp, Artificial Sequence
  Description of Artificial Sequence: Synthetic oligonucleotide
cacgaggtcaggagttcaagaccagcg

SEQ ID NO: 394987 - DNA, 28 bp, Artificial Sequence
  Description of Artificial Sequence: Synthetic oligonucleotide
acgaggtcaggagttcaagaccagcgtg

SEQ ID NO: 394988 - DNA, 27 bp, Artificial Sequence
  Description of Artificial Sequence: Synthetic oligonucleotide
cgaggtcaggagttcaagaccagcgtg

SEQ ID NO: 394989 - DNA, 33 bp, Artificial Sequence
  Description of Artificial Sequence: Synthetic oligonucleotide
ttcaagaccagcgtggccaacatagtgaaactc

SEQ ID NO: 394990 - DNA, 32 bp, Artificial Sequence
  Description of Artificial Sequence: Synthetic oligonucleotide
tcaagaccagcgtggccaacatagtgaaactc

SEQ ID NO: 394991 - DNA, 31 bp, Artificial Sequence
  Description of Artificial Sequence: Synthetic oligonucleotide
caagaccagcgtggccaacatagtgaaactc

SEQ ID NO: 394992 - DNA, 32 bp, Artificial Sequence
  Description of Artificial Sequence: Synthetic oligonucleotide
aagaccagcgtggccaacatagtgaaactctg

SEQ ID NO: 394993 - DNA, 31 bp, Artificial Sequence
  Description of Artificial Sequence: Synthetic oligonucleotide
agaccagcgtggccaacatagtgaaactctg

SEQ ID NO: 394994 - DNA, 30 bp, Artificial Sequence
  Description of Artificial Sequence: Synthetic oligonucleotide
gaccagcgtggccaacatagtgaaactctg

SEQ ID NO: 394995 - DNA, 31 bp, Artificial Sequence
  Description of Artificial Sequence: Synthetic oligonucleotide
accagcgtggccaacatagtgaaactctgtc

SEQ ID NO: 394996 - DNA, 30 bp, Artificial Sequence
  Description of Artificial Sequence: Synthetic oligonucleotide
ccagcgtggccaacatagtgaaactctgtc

SEQ ID NO: 394997 - DNA, 31 bp, Artificial Sequence
  Description of Artificial Sequence: Synthetic oligonucleotide
cagcgtggccaacatagtgaaactctgtctc

SEQ ID NO: 394998 - DNA, 33 bp, Artificial Sequence
  Description of Artificial Sequence: Synthetic oligonucleotide
agcgtggccaacatagtgaaactctgtctctac

SEQ ID NO: 394999 - DNA, 32 bp, Artificial Sequence
  Description of Artificial Sequence: Synthetic oligonucleotide
gcgtggccaacatagtgaaactctgtctctac

SEQ ID NO: 395000 - DNA, 40 bp, Artificial Sequence
  Description of Artificial Sequence: Synthetic oligonucleotide
cgtggccaacatagtgaaactctgtctctactaaaaatac

SEQ ID NO: 395001 - DNA, 41 bp, Artificial Sequence
  Description of Artificial Sequence: Synthetic oligonucleotide
gtggccaacatagtgaaactctgtctctactaaaaatacag

SEQ ID NO: 395002 - DNA, 47 bp, Artificial Sequence
  Description of Artificial Sequence: Synthetic oligonucleotide
tggccaacatagtgaaactctgtctctactaaaaatacagaaattag

SEQ ID NO: 395003 - DNA, 46 bp, Artificial Sequence
  Description of Artificial Sequence: Synthetic oligonucleotide
ggccaacatagtgaaactctgtctctactaaaaatacagaaattag

SEQ ID NO: 395004 - DNA, 46 bp, Artificial Sequence
  Description of Artificial Sequence: Synthetic oligonucleotide
gccaacatagtgaaactctgtctctactaaaaatacagaaattagc

SEQ ID NO: 395005 - DNA, 46 bp, Artificial Sequence
  Description of Artificial Sequence: Synthetic oligonucleotide
ccaacatagtgaaactctgtctctactaaaaatacagaaattagcc

SEQ ID NO: 395006 - DNA, 46 bp, Artificial Sequence
  Description of Artificial Sequence: Synthetic oligonucleotide
caacatagtgaaactctgtctctactaaaaatacagaaattagccg

SEQ ID NO: 395007 - DNA, 46 bp, Artificial Sequence
  Description of Artificial Sequence: Synthetic oligonucleotide
aacatagtgaaactctgtctctactaaaaatacagaaattagccgg

SEQ ID NO: 395008 - DNA, 45 bp, Artificial Sequence
  Description of Artificial Sequence: Synthetic oligonucleotide
acatagtgaaactctgtctctactaaaaatacagaaattagccgg

SEQ ID NO: 395009 - DNA, 44 bp, Artificial Sequence
  Description of Artificial Sequence: Synthetic oligonucleotide
catagtgaaactctgtctctactaaaaatacagaaattagccgg

SEQ ID NO: 395010 - DNA, 44 bp, Artificial Sequence
  Description of Artificial Sequence: Synthetic oligonucleotide
atagtgaaactctgtctctactaaaaatacagaaattagccggg

SEQ ID NO: 395011 - DNA, 43 bp, Artificial Sequence
  Description of Artificial Sequence: Synthetic oligonucleotide
tagtgaaactctgtctctactaaaaatacagaaattagccggg

SEQ ID NO: 395012 - DNA, 42 bp, Artificial Sequence
  Description of Artificial Sequence: Synthetic oligonucleotide
agtgaaactctgtctctactaaaaatacagaaattagccggg

SEQ ID NO: 395013 - DNA, 41 bp, Artificial Sequence
  Description of Artificial Sequence: Synthetic oligonucleotide
gtgaaactctgtctctactaaaaatacagaaattagccggg

SEQ ID NO: 395014 - DNA, 41 bp, Artificial Sequence
  Description of Artificial Sequence: Synthetic oligonucleotide
tgaaactctgtctctactaaaaatacagaaattagccgggc

SEQ ID NO: 395015 - DNA, 40 bp, Artificial Sequence
  Description of Artificial Sequence: Synthetic oligonucleotide
gaaactctgtctctactaaaaatacagaaattagccgggc

SEQ ID NO: 395016 - DNA, 42 bp, Artificial Sequence
  Description of Artificial Sequence: Synthetic oligonucleotide
aaactctgtctctactaaaaatacagaaattagccgggcatg

SEQ ID NO: 395017 - DNA, 41 bp, Artificial Sequence
  Description of Artificial Sequence: Synthetic oligonucleotide
aactctgtctctactaaaaatacagaaattagccgggcatg

SEQ ID NO: 395018 - DNA, 40 bp, Artificial Sequence
  Description of Artificial Sequence: Synthetic oligonucleotide
actctgtctctactaaaaatacagaaattagccgggcatg

SEQ ID NO: 395019 - DNA, 39 bp, Artificial Sequence
  Description of Artificial Sequence: Synthetic oligonucleotide
ctctgtctctactaaaaatacagaaattagccgggcatg

SEQ ID NO: 395020 - DNA, 39 bp, Artificial Sequence
  Description of Artificial Sequence: Synthetic oligonucleotide
tctgtctctactaaaaatacagaaattagccgggcatgg

SEQ ID NO: 395021 - DNA, 38 bp, Artificial Sequence
  Description of Artificial Sequence: Synthetic oligonucleotide
ctgtctctactaaaaatacagaaattagccgggcatgg

SEQ ID NO: 395022 - DNA, 39 bp, Artificial Sequence
  Description of Artificial Sequence: Synthetic oligonucleotide
tgtctctactaaaaatacagaaattagccgggcatggtg

SEQ ID NO: 395023 - DNA, 38 bp, Artificial Sequence
  Description of Artificial Sequence: Synthetic oligonucleotide
gtctctactaaaaatacagaaattagccgggcatggtg

SEQ ID NO: 395024 - DNA, 38 bp, Artificial Sequence
  Description of Artificial Sequence: Synthetic oligonucleotide
tctctactaaaaatacagaaattagccgggcatggtgg

SEQ ID NO: 395025 - DNA, 37 bp, Artificial Sequence
  Description of Artificial Sequence: Synthetic oligonucleotide
ctctactaaaaatacagaaattagccgggcatggtgg

SEQ ID NO: 395026 - DNA, 37 bp, Artificial Sequence
  Description of Artificial Sequence: Synthetic oligonucleotide
tctactaaaaatacagaaattagccgggcatggtggc

SEQ ID NO: 395027 - DNA, 36 bp, Artificial Sequence
  Description of Artificial Sequence: Synthetic oligonucleotide
ctactaaaaatacagaaattagccgggcatggtggc

SEQ ID NO: 395028 - DNA, 37 bp, Artificial Sequence
  Description of Artificial Sequence: Synthetic oligonucleotide
tactaaaaatacagaaattagccgggcatggtggcag

SEQ ID NO: 395029 - DNA, 36 bp, Artificial Sequence
  Description of Artificial Sequence: Synthetic oligonucleotide
actaaaaatacagaaattagccgggcatggtggcag

SEQ ID NO: 395030 - DNA, 35 bp, Artificial Sequence
  Description of Artificial Sequence: Synthetic oligonucleotide
ctaaaaatacagaaattagccgggcatggtggcag

SEQ ID NO: 395031 - DNA, 35 bp, Artificial Sequence
  Description of Artificial Sequence: Synthetic oligonucleotide
taaaaatacagaaattagccgggcatggtggcagg

SEQ ID NO: 395032 - DNA, 34 bp, Artificial Sequence
  Description of Artificial Sequence: Synthetic oligonucleotide
aaaaatacagaaattagccgggcatggtggcagg

SEQ ID NO: 395033 - DNA, 33 bp, Artificial Sequence
  Description of Artificial Sequence: Synthetic oligonucleotide
aaaatacagaaattagccgggcatggtggcagg

SEQ ID NO: 395034 - DNA, 32 bp, Artificial Sequence
  Description of Artificial Sequence: Synthetic oligonucleotide
aaatacagaaattagccgggcatggtggcagg

SEQ ID NO: 395035 - DNA, 31 bp, Artificial Sequence
  Description of Artificial Sequence: Synthetic oligonucleotide
aatacagaaattagccgggcatggtggcagg

SEQ ID NO: 395036 - DNA, 30 bp, Artificial Sequence
  Description of Artificial Sequence: Synthetic oligonucleotide
atacagaaattagccgggcatggtggcagg

SEQ ID NO: 395037 - DNA, 29 bp, Artificial Sequence
  Description of Artificial Sequence: Synthetic oligonucleotide
tacagaaattagccgggcatggtggcagg

SEQ ID NO: 395038 - DNA, 28 bp, Artificial Sequence
  Description of Artificial Sequence: Synthetic oligonucleotide
acagaaattagccgggcatggtggcagg

SEQ ID NO: 395039 - DNA, 27 bp, Artificial Sequence
  Description of Artificial Sequence: Synthetic oligonucleotide
cagaaattagccgggcatggtggcagg

SEQ ID NO: 395040 - DNA, 27 bp, Artificial Sequence
  Description of Artificial Sequence: Synthetic oligonucleotide
agaaattagccgggcatggtggcaggc

SEQ ID NO: 395041 - DNA, 27 bp, Artificial Sequence
  Description of Artificial Sequence: Synthetic oligonucleotide
gaaattagccgggcatggtggcaggca

SEQ ID NO: 395042 - DNA, 27 bp, Artificial Sequence
  Description of Artificial Sequence: Synthetic oligonucleotide
aaattagccgggcatggtggcaggcac

SEQ ID NO: 395043 - DNA, 26 bp, Artificial Sequence
  Description of Artificial Sequence: Synthetic oligonucleotide
aattagccgggcatggtggcaggcac

SEQ ID NO: 395044 - DNA, 25 bp, Artificial Sequence
  Description of Artificial Sequence: Synthetic oligonucleotide
attagccgggcatggtggcaggcac

SEQ ID NO: 395045 - DNA, 24 bp, Artificial Sequence
  Description of Artificial Sequence: Synthetic oligonucleotide
ttagccgggcatggtggcaggcac

SEQ ID NO: 395046 - DNA, 23 bp, Artificial Sequence
  Description of Artificial Sequence: Synthetic oligonucleotide
tagccgggcatggtggcaggcac

SEQ ID NO: 395047 - DNA, 22 bp, Artificial Sequence
  Description of Artificial Sequence: Synthetic oligonucleotide
agccgggcatggtggcaggcac

SEQ ID NO: 395048 - DNA, 21 bp, Artificial Sequence
  Description of Artificial Sequence: Synthetic oligonucleotide
gccgggcatggtggcaggcac

SEQ ID NO: 395049 - DNA, 22 bp, Artificial Sequence
  Description of Artificial Sequence: Synthetic oligonucleotide
ccgggcatggtggcaggcacct

SEQ ID NO: 395050 - DNA, 22 bp, Artificial Sequence
  Description of Artificial Sequence: Synthetic oligonucleotide
cgggcatggtggcaggcacctg

SEQ ID NO: 395051 - DNA, 23 bp, Artificial Sequence
  Description of Artificial Sequence: Synthetic oligonucleotide
gggcatggtggcaggcacctgca

SEQ ID NO: 395052 - DNA, 24 bp, Artificial Sequence
  Description of Artificial Sequence: Synthetic oligonucleotide
ggcatggtggcaggcacctgcagt

SEQ ID NO: 395053 - DNA, 24 bp, Artificial Sequence
  Description of Artificial Sequence: Synthetic oligonucleotide
gcatggtggcaggcacctgcagtc

SEQ ID NO: 395054 - DNA, 24 bp, Artificial Sequence
  Description of Artificial Sequence: Synthetic oligonucleotide
catggtggcaggcacctgcagtcc

SEQ ID NO: 395055 - DNA, 25 bp, Artificial Sequence
  Description of Artificial Sequence: Synthetic oligonucleotide
atggtggcaggcacctgcagtccca

SEQ ID NO: 395056 - DNA, 24 bp, Artificial Sequence
  Description of Artificial Sequence: Synthetic oligonucleotide
tggtggcaggcacctgcagtccca

SEQ ID NO: 395057 - DNA, 23 bp, Artificial Sequence
  Description of Artificial Sequence: Synthetic oligonucleotide
ggtggcaggcacctgcagtccca

SEQ ID NO: 395058 - DNA, 23 bp, Artificial Sequence
  Description of Artificial Sequence: Synthetic oligonucleotide
gtggcaggcacctgcagtcccag

SEQ ID NO: 395059 - DNA, 25 bp, Artificial Sequence
  Description of Artificial Sequence: Synthetic oligonucleotide
tggcaggcacctgcagtcccagcta

SEQ ID NO: 395060 - DNA, 24 bp, Artificial Sequence
  Description of Artificial Sequence: Synthetic oligonucleotide
ggcaggcacctgcagtcccagcta

SEQ ID NO: 395061 - DNA, 26 bp, Artificial Sequence
  Description of Artificial Sequence: Synthetic oligonucleotide
gcaggcacctgcagtcccagctactt

SEQ ID NO: 395062 - DNA, 26 bp, Artificial Sequence
  Description of Artificial Sequence: Synthetic oligonucleotide
caggcacctgcagtcccagctacttg

SEQ ID NO: 395063 - DNA, 26 bp, Artificial Sequence
  Description of Artificial Sequence: Synthetic oligonucleotide
aggcacctgcagtcccagctacttgg

SEQ ID NO: 395064 - DNA, 25 bp, Artificial Sequence
  Description of Artificial Sequence: Synthetic oligonucleotide
ggcacctgcagtcccagctacttgg

SEQ ID NO: 395065 - DNA, 26 bp, Artificial Sequence
  Description of Artificial Sequence: Synthetic oligonucleotide
gcacctgcagtcccagctacttggga

SEQ ID NO: 395066 - DNA, 26 bp, Artificial Sequence
  Description of Artificial Sequence: Synthetic oligonucleotide
cacctgcagtcccagctacttgggag

SEQ ID NO: 395067 - DNA, 26 bp, Artificial Sequence
  Description of Artificial Sequence: Synthetic oligonucleotide
acctgcagtcccagctacttgggagg

SEQ ID NO: 395068 - DNA, 26 bp, Artificial Sequence
  Description of Artificial Sequence: Synthetic oligonucleotide
tcccagctacttgggagggtgaggca

SEQ ID NO: 395069 - DNA, 25 bp, Artificial Sequence
  Description of Artificial Sequence: Synthetic oligonucleotide
cccagctacttgggagggtgaggca

SEQ ID NO: 395070 - DNA, 25 bp, Artificial Sequence
  Description of Artificial Sequence: Synthetic oligonucleotide
ccagctacttgggagggtgaggcag

SEQ ID NO: 395071 - DNA, 26 bp, Artificial Sequence
  Description of Artificial Sequence: Synthetic oligonucleotide
cagctacttgggagggtgaggcagga

SEQ ID NO: 395072 - DNA, 27 bp, Artificial Sequence
  Description of Artificial Sequence: Synthetic oligonucleotide
agctacttgggagggtgaggcaggaga

SEQ ID NO: 395073 - DNA, 27 bp, Artificial Sequence
  Description of Artificial Sequence: Synthetic oligonucleotide
gctacttgggagggtgaggcaggagaa

SEQ ID NO: 395074 - DNA, 28 bp, Artificial Sequence
  Description of Artificial Sequence: Synthetic oligonucleotide
ctacttgggagggtgaggcaggagaatc

SEQ ID NO: 395075 - DNA, 28 bp, Artificial Sequence
  Description of Artificial Sequence: Synthetic oligonucleotide
tacttgggagggtgaggcaggagaatcg

SEQ ID NO: 395076 - DNA, 27 bp, Artificial Sequence
  Description of Artificial Sequence: Synthetic oligonucleotide
acttgggagggtgaggcaggagaatcg

SEQ ID NO: 395077 - DNA, 26 bp, Artificial Sequence
  Description of Artificial Sequence: Synthetic oligonucleotide
cttgggagggtgaggcaggagaatcg

SEQ ID NO: 395078 - DNA, 27 bp, Artificial Sequence
  Description of Artificial Sequence: Synthetic oligonucleotide
ttgggagggtgaggcaggagaatcgct

SEQ ID NO: 395079 - DNA, 27 bp, Artificial Sequence
  Description of Artificial Sequence: Synthetic oligonucleotide
tgggagggtgaggcaggagaatcgctt

SEQ ID NO: 395080 - DNA, 26 bp, Artificial Sequence
  Description of Artificial Sequence: Synthetic oligonucleotide
gggagggtgaggcaggagaatcgctt

SEQ ID NO: 395081 - DNA, 27 bp, Artificial Sequence
  Description of Artificial Sequence: Synthetic oligonucleotide
ggagggtgaggcaggagaatcgcttga

SEQ ID NO: 395082 - DNA, 28 bp, Artificial Sequence
  Description of Artificial Sequence: Synthetic oligonucleotide
gagggtgaggcaggagaatcgcttgaac

SEQ ID NO: 395083 - DNA, 28 bp, Artificial Sequence
  Description of Artificial Sequence: Synthetic oligonucleotide
agggtgaggcaggagaatcgcttgaacc

SEQ ID NO: 395084 - DNA, 27 bp, Artificial Sequence
  Description of Artificial Sequence: Synthetic oligonucleotide
gggtgaggcaggagaatcgcttgaacc

SEQ ID NO: 395085 - DNA, 27 bp, Artificial Sequence
  Description of Artificial Sequence: Synthetic oligonucleotide
ggtgaggcaggagaatcgcttgaaccc

SEQ ID NO: 395086 - DNA, 27 bp, Artificial Sequence
  Description of Artificial Sequence: Synthetic oligonucleotide
gtgaggcaggagaatcgcttgaacccg

SEQ ID NO: 395087 - DNA, 27 bp, Artificial Sequence
  Description of Artificial Sequence: Synthetic oligonucleotide
tgaggcaggagaatcgcttgaacccgg

SEQ ID NO: 395088 - DNA, 26 bp, Artificial Sequence
  Description of Artificial Sequence: Synthetic oligonucleotide
gaggcaggagaatcgcttgaacccgg

SEQ ID NO: 395089 - DNA, 27 bp, Artificial Sequence
  Description of Artificial Sequence: Synthetic oligonucleotide
aggcaggagaatcgcttgaacccggga

SEQ ID NO: 395090 - DNA, 26 bp, Artificial Sequence
  Description of Artificial Sequence: Synthetic oligonucleotide
ggcaggagaatcgcttgaacccggga

SEQ ID NO: 395091 - DNA, 26 bp, Artificial Sequence
  Description of Artificial Sequence: Synthetic oligonucleotide
gcaggagaatcgcttgaacccgggag

SEQ ID NO: 395092 - DNA, 26 bp, Artificial Sequence
  Description of Artificial Sequence: Synthetic oligonucleotide
caggagaatcgcttgaacccgggagg

SEQ ID NO: 395093 - DNA, 27 bp, Artificial Sequence
  Description of Artificial Sequence: Synthetic oligonucleotide
aggagaatcgcttgaacccgggaggca

SEQ ID NO: 395094 - DNA, 27 bp, Artificial Sequence
  Description of Artificial Sequence: Synthetic oligonucleotide
ggagaatcgcttgaacccgggaggcaa

SEQ ID NO: 395095 - DNA, 28 bp, Artificial Sequence
  Description of Artificial Sequence: Synthetic oligonucleotide
gagaatcgcttgaacccgggaggcaaag

SEQ ID NO: 395096 - DNA, 28 bp, Artificial Sequence
  Description of Artificial Sequence: Synthetic oligonucleotide
agaatcgcttgaacccgggaggcaaagg

SEQ ID NO: 395097 - DNA, 27 bp, Artificial Sequence
  Description of Artificial Sequence: Synthetic oligonucleotide
gaatcgcttgaacccgggaggcaaagg

SEQ ID NO: 395098 - DNA, 29 bp, Artificial Sequence
  Description of Artificial Sequence: Synthetic oligonucleotide
aatcgcttgaacccgggaggcaaaggttg

SEQ ID NO: 395099 - DNA, 28 bp, Artificial Sequence
  Description of Artificial Sequence: Synthetic oligonucleotide
atcgcttgaacccgggaggcaaaggttg

SEQ ID NO: 395100 - DNA, 27 bp, Artificial Sequence
  Description of Artificial Sequence: Synthetic oligonucleotide
tcgcttgaacccgggaggcaaaggttg

SEQ ID NO: 395101 - DNA, 26 bp, Artificial Sequence
  Description of Artificial Sequence: Synthetic oligonucleotide
cgcttgaacccgggaggcaaaggttg

SEQ ID NO: 395102 - DNA, 27 bp, Artificial Sequence
  Description of Artificial Sequence: Synthetic oligonucleotide
gcttgaacccgggaggcaaaggttgca

SEQ ID NO: 395103 - DNA, 27 bp, Artificial Sequence
  Description of Artificial Sequence: Synthetic oligonucleotide
cttgaacccgggaggcaaaggttgcag

SEQ ID NO: 395104 - DNA, 28 bp, Artificial Sequence
  Description of Artificial Sequence: Synthetic oligonucleotide
ttgaacccgggaggcaaaggttgcagtg

SEQ ID NO: 395105 - DNA, 27 bp, Artificial Sequence
  Description of Artificial Sequence: Synthetic oligonucleotide
tgaacccgggaggcaaaggttgcagtg

SEQ ID NO: 395106 - DNA, 27 bp, Artificial Sequence
  Description of Artificial Sequence: Synthetic oligonucleotide
gaacccgggaggcaaaggttgcagtga

SEQ ID NO: 395107 - DNA, 27 bp, Artificial Sequence
  Description of Artificial Sequence: Synthetic oligonucleotide
aacccgggaggcaaaggttgcagtgag

SEQ ID NO: 395108 - DNA, 26 bp, Artificial Sequence
  Description of Artificial Sequence: Synthetic oligonucleotide
acccgggaggcaaaggttgcagtgag

SEQ ID NO: 395109 - DNA, 25 bp, Artificial Sequence
  Description of Artificial Sequence: Synthetic oligonucleotide
cccgggaggcaaaggttgcagtgag

SEQ ID NO: 395110 - DNA, 27 bp, Artificial Sequence
  Description of Artificial Sequence: Synthetic oligonucleotide
ggcaaaggttgcagtgagccgagacca

SEQ ID NO: 395111 - DNA, 28 bp, Artificial Sequence
  Description of Artificial Sequence: Synthetic oligonucleotide
gcaaaggttgcagtgagccgagaccatg

SEQ ID NO: 395112 - DNA, 28 bp, Artificial Sequence
  Description of Artificial Sequence: Synthetic oligonucleotide
caaaggttgcagtgagccgagaccatgc

SEQ ID NO: 395113 - DNA, 28 bp, Artificial Sequence
  Description of Artificial Sequence: Synthetic oligonucleotide
aaaggttgcagtgagccgagaccatgcc

SEQ ID NO: 395114 - DNA, 27 bp, Artificial Sequence
  Description of Artificial Sequence: Synthetic oligonucleotide
aaggttgcagtgagccgagaccatgcc

SEQ ID NO: 395115 - DNA, 27 bp, Artificial Sequence
  Description of Artificial Sequence: Synthetic oligonucleotide
aggttgcagtgagccgagaccatgcca

SEQ ID NO: 395116 - DNA, 27 bp, Artificial Sequence
  Description of Artificial Sequence: Synthetic oligonucleotide
ggttgcagtgagccgagaccatgccat

SEQ ID NO: 395117 - DNA, 28 bp, Artificial Sequence
  Description of Artificial Sequence: Synthetic oligonucleotide
gttgcagtgagccgagaccatgccattg

SEQ ID NO: 395118 - DNA, 30 bp, Artificial Sequence
  Description of Artificial Sequence: Synthetic oligonucleotide
ttgcagtgagccgagaccatgccattgtac

SEQ ID NO: 395119 - DNA, 29 bp, Artificial Sequence
  Description of Artificial Sequence: Synthetic oligonucleotide
tgcagtgagccgagaccatgccattgtac

SEQ ID NO: 395120 - DNA, 28 bp, Artificial Sequence
  Description of Artificial Sequence: Synthetic oligonucleotide
gcagtgagccgagaccatgccattgtac

SEQ ID NO: 395121 - DNA, 28 bp, Artificial Sequence
  Description of Artificial Sequence: Synthetic oligonucleotide
cagtgagccgagaccatgccattgtacc

SEQ ID NO: 395122 - DNA, 29 bp, Artificial Sequence
  Description of Artificial Sequence: Synthetic oligonucleotide
agtgagccgagaccatgccattgtacctc

SEQ ID NO: 395123 - DNA, 28 bp, Artificial Sequence
  Description of Artificial Sequence: Synthetic oligonucleotide
gtgagccgagaccatgccattgtacctc

SEQ ID NO: 395124 - DNA, 29 bp, Artificial Sequence
  Description of Artificial Sequence: Synthetic oligonucleotide
tgagccgagaccatgccattgtacctcag

SEQ ID NO: 395125 - DNA, 28 bp, Artificial Sequence
  Description of Artificial Sequence: Synthetic oligonucleotide
gagccgagaccatgccattgtacctcag

SEQ ID NO: 395126 - DNA, 28 bp, Artificial Sequence
  Description of Artificial Sequence: Synthetic oligonucleotide
agccgagaccatgccattgtacctcagc

SEQ ID NO: 395127 - DNA, 27 bp, Artificial Sequence
  Description of Artificial Sequence: Synthetic oligonucleotide
gccgagaccatgccattgtacctcagc

SEQ ID NO: 395128 - DNA, 27 bp, Artificial Sequence
  Description of Artificial Sequence: Synthetic oligonucleotide
ccgagaccatgccattgtacctcagcc

SEQ ID NO: 395129 - DNA, 28 bp, Artificial Sequence
  Description of Artificial Sequence: Synthetic oligonucleotide
cgagaccatgccattgtacctcagcctg

SEQ ID NO: 395130 - DNA, 28 bp, Artificial Sequence
  Description of Artificial Sequence: Synthetic oligonucleotide
gagaccatgccattgtacctcagcctgg

SEQ ID NO: 395131 - DNA, 28 bp, Artificial Sequence
  Description of Artificial Sequence: Synthetic oligonucleotide
agaccatgccattgtacctcagcctggg

SEQ ID NO: 395132 - DNA, 27 bp, Artificial Sequence
  Description of Artificial Sequence: Synthetic oligonucleotide
gaccatgccattgtacctcagcctggg

SEQ ID NO: 395133 - DNA, 28 bp, Artificial Sequence
  Description of Artificial Sequence: Synthetic oligonucleotide
accatgccattgtacctcagcctgggtg

SEQ ID NO: 395134 - DNA, 27 bp, Artificial Sequence
  Description of Artificial Sequence: Synthetic oligonucleotide
ccatgccattgtacctcagcctgggtg

SEQ ID NO: 395135 - DNA, 28 bp, Artificial Sequence
  Description of Artificial Sequence: Synthetic oligonucleotide
catgccattgtacctcagcctgggtgac

SEQ ID NO: 395136 - DNA, 29 bp, Artificial Sequence
  Description of Artificial Sequence: Synthetic oligonucleotide
atgccattgtacctcagcctgggtgacag

SEQ ID NO: 395137 - DNA, 28 bp, Artificial Sequence
  Description of Artificial Sequence: Synthetic oligonucleotide
ctgggtgacagagtgagactacgtctcg

SEQ ID NO: 395138 - DNA, 37 bp, Artificial Sequence
  Description of Artificial Sequence: Synthetic oligonucleotide
tgggtgacagagtgagactacgtctcgaaaaataaag

SEQ ID NO: 395139 - DNA, 36 bp, Artificial Sequence
  Description of Artificial Sequence: Synthetic oligonucleotide
gggtgacagagtgagactacgtctcgaaaaataaag

SEQ ID NO: 395140 - DNA, 41 bp, Artificial Sequence
  Description of Artificial Sequence: Synthetic oligonucleotide
ggtgacagagtgagactacgtctcgaaaaataaagaaaaag

SEQ ID NO: 395141 - DNA, 45 bp, Artificial Sequence
  Description of Artificial Sequence: Synthetic oligonucleotide
gtgacagagtgagactacgtctcgaaaaataaagaaaaagaaaag

SEQ ID NO: 395142 - DNA, 50 bp, Artificial Sequence
  Description of Artificial Sequence: Synthetic oligonucleotide
tgacagagtgagactacgtctcgaaaaataaagaaaaagaaaagaaaaag

SEQ ID NO: 395143 - DNA, 49 bp, Artificial Sequence
  Description of Artificial Sequence: Synthetic oligonucleotide
gacagagtgagactacgtctcgaaaaataaagaaaaagaaaagaaaaag

SEQ ID NO: 395144 - DNA, 58 bp, Artificial Sequence
  Description of Artificial Sequence: Synthetic oligonucleotide
acagagtgagactacgtctcgaaaaataaagaaaaagaaaagaaaaagaaaaaaaaag

SEQ ID NO: 395145 - DNA, 57 bp, Artificial Sequence
  Description of Artificial Sequence: Synthetic oligonucleotide
cagagtgagactacgtctcgaaaaataaagaaaaagaaaagaaaaagaaaaaaaaag

SEQ ID NO: 395146 - DNA, 60 bp, Artificial Sequence
  Description of Artificial Sequence: Synthetic oligonucleotide
agagtgagactacgtctcgaaaaataaagaaaaagaaaagaaaaagaaaaaaaaagaaaa

SEQ ID NO: 395147 - DNA, 60 bp, Artificial Sequence
  Description of Artificial Sequence: Synthetic oligonucleotide
gagtgagactacgtctcgaaaaataaagaaaaagaaaagaaaaagaaaaaaaaagaaaaa

SEQ ID NO: 395148 - DNA, 60 bp, Artificial Sequence
  Description of Artificial Sequence: Synthetic oligonucleotide
agtgagactacgtctcgaaaaataaagaaaaagaaaagaaaaagaaaaaaaaagaaaaat

SEQ ID NO: 395149 - DNA, 60 bp, Artificial Sequence
  Description of Artificial Sequence: Synthetic oligonucleotide
gtgagactacgtctcgaaaaataaagaaaaagaaaagaaaaagaaaaaaaaagaaaaatt

SEQ ID NO: 395150 - DNA, 60 bp, Artificial Sequence
  Description of Artificial Sequence: Synthetic oligonucleotide
tgagactacgtctcgaaaaataaagaaaaagaaaagaaaaagaaaaaaaaagaaaaattc

SEQ ID NO: 395151 - DNA, 60 bp, Artificial Sequence
  Description of Artificial Sequence: Synthetic oligonucleotide
gagactacgtctcgaaaaataaagaaaaagaaaagaaaaagaaaaaaaaagaaaaattcc

SEQ ID NO: 395152 - DNA, 60 bp, Artificial Sequence
  Description of Artificial Sequence: Synthetic oligonucleotide
agactacgtctcgaaaaataaagaaaaagaaaagaaaaagaaaaaaaaagaaaaattccc

SEQ ID NO: 395153 - DNA, 60 bp, Artificial Sequence
  Description of Artificial Sequence: Synthetic oligonucleotide
gactacgtctcgaaaaataaagaaaaagaaaagaaaaagaaaaaaaaagaaaaattccca

SEQ ID NO: 395154 - DNA, 60 bp, Artificial Sequence
  Description of Artificial Sequence: Synthetic oligonucleotide
actacgtctcgaaaaataaagaaaaagaaaagaaaaagaaaaaaaaagaaaaattcccat

SEQ ID NO: 395155 - DNA, 60 bp, Artificial Sequence
  Description of Artificial Sequence: Synthetic oligonucleotide
ctacgtctcgaaaaataaagaaaaagaaaagaaaaagaaaaaaaaagaaaaattcccatc

SEQ ID NO: 395156 - DNA, 60 bp, Artificial Sequence
  Description of Artificial Sequence: Synthetic oligonucleotide
tacgtctcgaaaaataaagaaaaagaaaagaaaaagaaaaaaaaagaaaaattcccatcc

SEQ ID NO: 395157 - DNA, 60 bp, Artificial Sequence
  Description of Artificial Sequence: Synthetic oligonucleotide
acgtctcgaaaaataaagaaaaagaaaagaaaaagaaaaaaaaagaaaaattcccatccc

SEQ ID NO: 395158 - DNA, 59 bp, Artificial Sequence
  Description of Artificial Sequence: Synthetic oligonucleotide
cgtctcgaaaaataaagaaaaagaaaagaaaaagaaaaaaaaagaaaaattcccatccc

SEQ ID NO: 395159 - DNA, 60 bp, Artificial Sequence
  Description of Artificial Sequence: Synthetic oligonucleotide
gtctcgaaaaataaagaaaaagaaaagaaaaagaaaaaaaaagaaaaattcccatccctt

SEQ ID NO: 395160 - DNA, 60 bp, Artificial Sequence
  Description of Artificial Sequence: Synthetic oligonucleotide
tctcgaaaaataaagaaaaagaaaagaaaaagaaaaaaaaagaaaaattcccatcccttt

SEQ ID NO: 395161 - DNA, 60 bp, Artificial Sequence
  Description of Artificial Sequence: Synthetic oligonucleotide
ctcgaaaaataaagaaaaagaaaagaaaaagaaaaaaaaagaaaaattcccatccctttt

SEQ ID NO: 395162 - DNA, 60 bp, Artificial Sequence
  Description of Artificial Sequence: Synthetic oligonucleotide
tcgaaaaataaagaaaaagaaaagaaaaagaaaaaaaaagaaaaattcccatcccttttg

SEQ ID NO: 395163 - DNA, 60 bp, Artificial Sequence
  Description of Artificial Sequence: Synthetic oligonucleotide
cgaaaaataaagaaaaagaaaagaaaaagaaaaaaaaagaaaaattcccatcccttttgc

SEQ ID NO: 395164 - DNA, 60 bp, Artificial Sequence
  Description of Artificial Sequence: Synthetic oligonucleotide
gaaaaataaagaaaaagaaaagaaaaagaaaaaaaaagaaaaattcccatcccttttgcg

SEQ ID NO: 395165 - DNA, 60 bp, Artificial Sequence
  Description of Artificial Sequence: Synthetic oligonucleotide
aaaaataaagaaaaagaaaagaaaaagaaaaaaaaagaaaaattcccatcccttttgcga

SEQ ID NO: 395166 - DNA, 60 bp, Artificial Sequence
  Description of Artificial Sequence: Synthetic oligonucleotide
aaaataaagaaaaagaaaagaaaaagaaaaaaaaagaaaaattcccatcccttttgcgaa

SEQ ID NO: 395167 - DNA, 60 bp, Artificial Sequence
  Description of Artificial Sequence: Synthetic oligonucleotide
aaataaagaaaaagaaaagaaaaagaaaaaaaaagaaaaattcccatcccttttgcgaat

SEQ ID NO: 395168 - DNA, 60 bp, Artificial Sequence
  Description of Artificial Sequence: Synthetic oligonucleotide
aataaagaaaaagaaaagaaaaagaaaaaaaaagaaaaattcccatcccttttgcgaatg

SEQ ID NO: 395169 - DNA, 60 bp, Artificial Sequence
  Description of Artificial Sequence: Synthetic oligonucleotide
ataaagaaaaagaaaagaaaaagaaaaaaaaagaaaaattcccatcccttttgcgaatgg

SEQ ID NO: 395170 - DNA, 59 bp, Artificial Sequence
  Description of Artificial Sequence: Synthetic oligonucleotide
taaagaaaaagaaaagaaaaagaaaaaaaaagaaaaattcccatcccttttgcgaatgg

SEQ ID NO: 395171 - DNA, 58 bp, Artificial Sequence
  Description of Artificial Sequence: Synthetic oligonucleotide
aaagaaaaagaaaagaaaaagaaaaaaaaagaaaaattcccatcccttttgcgaatgg

SEQ ID NO: 395172 - DNA, 57 bp, Artificial Sequence
  Description of Artificial Sequence: Synthetic oligonucleotide
aagaaaaagaaaagaaaaagaaaaaaaaagaaaaattcccatcccttttgcgaatgg

SEQ ID NO: 395173 - DNA, 56 bp, Artificial Sequence
  Description of Artificial Sequence: Synthetic oligonucleotide
agaaaaagaaaagaaaaagaaaaaaaaagaaaaattcccatcccttttgcgaatgg

SEQ ID NO: 395174 - DNA, 55 bp, Artificial Sequence
  Description of Artificial Sequence: Synthetic oligonucleotide
gaaaaagaaaagaaaaagaaaaaaaaagaaaaattcccatcccttttgcgaatgg

SEQ ID NO: 395175 - DNA, 55 bp, Artificial Sequence
  Description of Artificial Sequence: Synthetic oligonucleotide
aaaaagaaaagaaaaagaaaaaaaaagaaaaattcccatcccttttgcgaatggc

SEQ ID NO: 395176 - DNA, 54 bp, Artificial Sequence
  Description of Artificial Sequence: Synthetic oligonucleotide
aaaagaaaagaaaaagaaaaaaaaagaaaaattcccatcccttttgcgaatggc

SEQ ID NO: 395177 - DNA, 53 bp, Artificial Sequence
  Description of Artificial Sequence: Synthetic oligonucleotide
aaagaaaagaaaaagaaaaaaaaagaaaaattcccatcccttttgcgaatggc

SEQ ID NO: 395178 - DNA, 52 bp, Artificial Sequence
  Description of Artificial Sequence: Synthetic oligonucleotide
aagaaaagaaaaagaaaaaaaaagaaaaattcccatcccttttgcgaatggc

SEQ ID NO: 395179 - DNA, 51 bp, Artificial Sequence
  Description of Artificial Sequence: Synthetic oligonucleotide
agaaaagaaaaagaaaaaaaaagaaaaattcccatcccttttgcgaatggc

SEQ ID NO: 395180 - DNA, 50 bp, Artificial Sequence
  Description of Artificial Sequence: Synthetic oligonucleotide
gaaaagaaaaagaaaaaaaaagaaaaattcccatcccttttgcgaatggc

SEQ ID NO: 395181 - DNA, 51 bp, Artificial Sequence
  Description of Artificial Sequence: Synthetic oligonucleotide
aaaagaaaaagaaaaaaaaagaaaaattcccatcccttttgcgaatggcag

SEQ ID NO: 395182 - DNA, 50 bp, Artificial Sequence
  Description of Artificial Sequence: Synthetic oligonucleotide
aaagaaaaagaaaaaaaaagaaaaattcccatcccttttgcgaatggcag

SEQ ID NO: 395183 - DNA, 49 bp, Artificial Sequence
  Description of Artificial Sequence: Synthetic oligonucleotide
aagaaaaagaaaaaaaaagaaaaattcccatcccttttgcgaatggcag

SEQ ID NO: 395184 - DNA, 48 bp, Artificial Sequence
  Description of Artificial Sequence: Synthetic oligonucleotide
agaaaaagaaaaaaaaagaaaaattcccatcccttttgcgaatggcag

SEQ ID NO: 395185 - DNA, 47 bp, Artificial Sequence
  Description of Artificial Sequence: Synthetic oligonucleotide
gaaaaagaaaaaaaaagaaaaattcccatcccttttgcgaatggcag

SEQ ID NO: 395186 - DNA, 48 bp, Artificial Sequence
  Description of Artificial Sequence: Synthetic oligonucleotide
aaaaagaaaaaaaaagaaaaattcccatcccttttgcgaatggcagac

SEQ ID NO: 395187 - DNA, 47 bp, Artificial Sequence
  Description of Artificial Sequence: Synthetic oligonucleotide
aaaagaaaaaaaaagaaaaattcccatcccttttgcgaatggcagac

SEQ ID NO: 395188 - DNA, 46 bp, Artificial Sequence
  Description of Artificial Sequence: Synthetic oligonucleotide
aaagaaaaaaaaagaaaaattcccatcccttttgcgaatggcagac

SEQ ID NO: 395189 - DNA, 45 bp, Artificial Sequence
  Description of Artificial Sequence: Synthetic oligonucleotide
aagaaaaaaaaagaaaaattcccatcccttttgcgaatggcagac

SEQ ID NO: 395190 - DNA, 44 bp, Artificial Sequence
  Description of Artificial Sequence: Synthetic oligonucleotide
agaaaaaaaaagaaaaattcccatcccttttgcgaatggcagac

SEQ ID NO: 395191 - DNA, 43 bp, Artificial Sequence
  Description of Artificial Sequence: Synthetic oligonucleotide
gaaaaaaaaagaaaaattcccatcccttttgcgaatggcagac

SEQ ID NO: 395192 - DNA, 45 bp, Artificial Sequence
  Description of Artificial Sequence: Synthetic oligonucleotide
aaaaaaaaagaaaaattcccatcccttttgcgaatggcagacatg

SEQ ID NO: 395193 - DNA, 44 bp, Artificial Sequence
  Description of Artificial Sequence: Synthetic oligonucleotide
aaaaaaaagaaaaattcccatcccttttgcgaatggcagacatg

SEQ ID NO: 395194 - DNA, 43 bp, Artificial Sequence
  Description of Artificial Sequence: Synthetic oligonucleotide
aaaaaaagaaaaattcccatcccttttgcgaatggcagacatg

SEQ ID NO: 395195 - DNA, 42 bp, Artificial Sequence
  Description of Artificial Sequence: Synthetic oligonucleotide
aaaaaagaaaaattcccatcccttttgcgaatggcagacatg

SEQ ID NO: 395196 - DNA, 41 bp, Artificial Sequence
  Description of Artificial Sequence: Synthetic oligonucleotide
aaaaagaaaaattcccatcccttttgcgaatggcagacatg

SEQ ID NO: 395197 - DNA, 40 bp, Artificial Sequence
  Description of Artificial Sequence: Synthetic oligonucleotide
aaaagaaaaattcccatcccttttgcgaatggcagacatg

SEQ ID NO: 395198 - DNA, 39 bp, Artificial Sequence
  Description of Artificial Sequence: Synthetic oligonucleotide
aaagaaaaattcccatcccttttgcgaatggcagacatg

SEQ ID NO: 395199 - DNA, 38 bp, Artificial Sequence
  Description of Artificial Sequence: Synthetic oligonucleotide
aagaaaaattcccatcccttttgcgaatggcagacatg

SEQ ID NO: 395200 - DNA, 37 bp, Artificial Sequence
  Description of Artificial Sequence: Synthetic oligonucleotide
agaaaaattcccatcccttttgcgaatggcagacatg

SEQ ID NO: 395201 - DNA, 36 bp, Artificial Sequence
  Description of Artificial Sequence: Synthetic oligonucleotide
gaaaaattcccatcccttttgcgaatggcagacatg

SEQ ID NO: 395202 - DNA, 36 bp, Artificial Sequence
  Description of Artificial Sequence: Synthetic oligonucleotide
aaaaattcccatcccttttgcgaatggcagacatgc

SEQ ID NO: 395203 - DNA, 35 bp, Artificial Sequence
  Description of Artificial Sequence: Synthetic oligonucleotide
aaaattcccatcccttttgcgaatggcagacatgc

SEQ ID NO: 395204 - DNA, 34 bp, Artificial Sequence
  Description of Artificial Sequence: Synthetic oligonucleotide
aaattcccatcccttttgcgaatggcagacatgc

SEQ ID NO: 395205 - DNA, 33 bp, Artificial Sequence
  Description of Artificial Sequence: Synthetic oligonucleotide
aattcccatcccttttgcgaatggcagacatgc

SEQ ID NO: 395206 - DNA, 32 bp, Artificial Sequence
  Description of Artificial Sequence: Synthetic oligonucleotide
attcccatcccttttgcgaatggcagacatgc

SEQ ID NO: 395207 - DNA, 31 bp, Artificial Sequence
  Description of Artificial Sequence: Synthetic oligonucleotide
ttcccatcccttttgcgaatggcagacatgc

SEQ ID NO: 395208 - DNA, 30 bp, Artificial Sequence
  Description of Artificial Sequence: Synthetic oligonucleotide
tcccatcccttttgcgaatggcagacatgc

SEQ ID NO: 395209 - DNA, 29 bp, Artificial Sequence
  Description of Artificial Sequence: Synthetic oligonucleotide
cccatcccttttgcgaatggcagacatgc

SEQ ID NO: 395210 - DNA, 30 bp, Artificial Sequence
  Description of Artificial Sequence: Synthetic oligonucleotide
ccatcccttttgcgaatggcagacatgcac

SEQ ID NO: 395211 - DNA, 31 bp, Artificial Sequence
  Description of Artificial Sequence: Synthetic oligonucleotide
catcccttttgcgaatggcagacatgcacac

SEQ ID NO: 395212 - DNA, 32 bp, Artificial Sequence
  Description of Artificial Sequence: Synthetic oligonucleotide
atcccttttgcgaatggcagacatgcacacac

SEQ ID NO: 395213 - DNA, 31 bp, Artificial Sequence
  Description of Artificial Sequence: Synthetic oligonucleotide
tcccttttgcgaatggcagacatgcacacac

SEQ ID NO: 395214 - DNA, 30 bp, Artificial Sequence
  Description of Artificial Sequence: Synthetic oligonucleotide
cccttttgcgaatggcagacatgcacacac

SEQ ID NO: 395215 - DNA, 30 bp, Artificial Sequence
  Description of Artificial Sequence: Synthetic oligonucleotide
ccttttgcgaatggcagacatgcacacacc

SEQ ID NO: 395216 - DNA, 31 bp, Artificial Sequence
  Description of Artificial Sequence: Synthetic oligonucleotide
cttttgcgaatggcagacatgcacacaccag

SEQ ID NO: 395217 - DNA, 32 bp, Artificial Sequence
  Description of Artificial Sequence: Synthetic oligonucleotide
ttttgcgaatggcagacatgcacacaccagag

SEQ ID NO: 395218 - DNA, 31 bp, Artificial Sequence
  Description of Artificial Sequence: Synthetic oligonucleotide
tttgcgaatggcagacatgcacacaccagag

SEQ ID NO: 395219 - DNA, 30 bp, Artificial Sequence
  Description of Artificial Sequence: Synthetic oligonucleotide
ttgcgaatggcagacatgcacacaccagag

SEQ ID NO: 395220 - DNA, 29 bp, Artificial Sequence
  Description of Artificial Sequence: Synthetic oligonucleotide
tgcgaatggcagacatgcacacaccagag

SEQ ID NO: 395221 - DNA, 28 bp, Artificial Sequence
  Description of Artificial Sequence: Synthetic oligonucleotide
gcgaatggcagacatgcacacaccagag

SEQ ID NO: 395222 - DNA, 30 bp, Artificial Sequence
  Description of Artificial Sequence: Synthetic oligonucleotide
cgaatggcagacatgcacacaccagagaag

SEQ ID NO: 395223 - DNA, 33 bp, Artificial Sequence
  Description of Artificial Sequence: Synthetic oligonucleotide
gaatggcagacatgcacacaccagagaagattc

SEQ ID NO: 395224 - DNA, 33 bp, Artificial Sequence
  Description of Artificial Sequence: Synthetic oligonucleotide
aatggcagacatgcacacaccagagaagattcc

SEQ ID NO: 395225 - DNA, 32 bp, Artificial Sequence
  Description of Artificial Sequence: Synthetic oligonucleotide
atggcagacatgcacacaccagagaagattcc

SEQ ID NO: 395226 - DNA, 39 bp, Artificial Sequence
  Description of Artificial Sequence: Synthetic oligonucleotide
acatgcacacaccagagaagattccaatttagtgtcttc

SEQ ID NO: 395227 - DNA, 38 bp, Artificial Sequence
  Description of Artificial Sequence: Synthetic oligonucleotide
catgcacacaccagagaagattccaatttagtgtcttc

SEQ ID NO: 395228 - DNA, 38 bp, Artificial Sequence
  Description of Artificial Sequence: Synthetic oligonucleotide
atgcacacaccagagaagattccaatttagtgtcttcc

SEQ ID NO: 395229 - DNA, 37 bp, Artificial Sequence
  Description of Artificial Sequence: Synthetic oligonucleotide
tgcacacaccagagaagattccaatttagtgtcttcc

SEQ ID NO: 395230 - DNA, 36 bp, Artificial Sequence
  Description of Artificial Sequence: Synthetic oligonucleotide
gcacacaccagagaagattccaatttagtgtcttcc

SEQ ID NO: 395231 - DNA, 36 bp, Artificial Sequence
  Description of Artificial Sequence: Synthetic oligonucleotide
cacacaccagagaagattccaatttagtgtcttccc

SEQ ID NO: 395232 - DNA, 37 bp, Artificial Sequence
  Description of Artificial Sequence: Synthetic oligonucleotide
acacaccagagaagattccaatttagtgtcttccctc

SEQ ID NO: 395233 - DNA, 36 bp, Artificial Sequence
  Description of Artificial Sequence: Synthetic oligonucleotide
cacaccagagaagattccaatttagtgtcttccctc

SEQ ID NO: 395234 - DNA, 37 bp, Artificial Sequence
  Description of Artificial Sequence: Synthetic oligonucleotide
acaccagagaagattccaatttagtgtcttccctctc

SEQ ID NO: 395235 - DNA, 36 bp, Artificial Sequence
  Description of Artificial Sequence: Synthetic oligonucleotide
caccagagaagattccaatttagtgtcttccctctc

SEQ ID NO: 395236 - DNA, 38 bp, Artificial Sequence
  Description of Artificial Sequence: Synthetic oligonucleotide
accagagaagattccaatttagtgtcttccctctcttc

SEQ ID NO: 395237 - DNA, 37 bp, Artificial Sequence
  Description of Artificial Sequence: Synthetic oligonucleotide
ccagagaagattccaatttagtgtcttccctctcttc

SEQ ID NO: 395238 - DNA, 40 bp, Artificial Sequence
  Description of Artificial Sequence: Synthetic oligonucleotide
cagagaagattccaatttagtgtcttccctctcttcatag

SEQ ID NO: 395239 - DNA, 42 bp, Artificial Sequence
  Description of Artificial Sequence: Synthetic oligonucleotide
agagaagattccaatttagtgtcttccctctcttcatagaac

SEQ ID NO: 395240 - DNA, 41 bp, Artificial Sequence
  Description of Artificial Sequence: Synthetic oligonucleotide
gagaagattccaatttagtgtcttccctctcttcatagaac

SEQ ID NO: 395241 - DNA, 45 bp, Artificial Sequence
  Description of Artificial Sequence: Synthetic oligonucleotide
agaagattccaatttagtgtcttccctctcttcatagaacaattc

SEQ ID NO: 395242 - DNA, 44 bp, Artificial Sequence
  Description of Artificial Sequence: Synthetic oligonucleotide
gaagattccaatttagtgtcttccctctcttcatagaacaattc

SEQ ID NO: 395243 - DNA, 44 bp, Artificial Sequence
  Description of Artificial Sequence: Synthetic oligonucleotide
aagattccaatttagtgtcttccctctcttcatagaacaattcc

SEQ ID NO: 395244 - DNA, 43 bp, Artificial Sequence
  Description of Artificial Sequence: Synthetic oligonucleotide
agattccaatttagtgtcttccctctcttcatagaacaattcc

SEQ ID NO: 395245 - DNA, 42 bp, Artificial Sequence
  Description of Artificial Sequence: Synthetic oligonucleotide
gattccaatttagtgtcttccctctcttcatagaacaattcc

SEQ ID NO: 395246 - DNA, 43 bp, Artificial Sequence
  Description of Artificial Sequence: Synthetic oligonucleotide
attccaatttagtgtcttccctctcttcatagaacaattcctc

SEQ ID NO: 395247 - DNA, 42 bp, Artificial Sequence
  Description of Artificial Sequence: Synthetic oligonucleotide
ttccaatttagtgtcttccctctcttcatagaacaattcctc

SEQ ID NO: 395248 - DNA, 41 bp, Artificial Sequence
  Description of Artificial Sequence: Synthetic oligonucleotide
tccaatttagtgtcttccctctcttcatagaacaattcctc

SEQ ID NO: 395249 - DNA, 40 bp, Artificial Sequence
  Description of Artificial Sequence: Synthetic oligonucleotide
ccaatttagtgtcttccctctcttcatagaacaattcctc

SEQ ID NO: 395250 - DNA, 42 bp, Artificial Sequence
  Description of Artificial Sequence: Synthetic oligonucleotide
caatttagtgtcttccctctcttcatagaacaattcctcaag

SEQ ID NO: 395251 - DNA, 43 bp, Artificial Sequence
  Description of Artificial Sequence: Synthetic oligonucleotide
aatttagtgtcttccctctcttcatagaacaattcctcaagtc

SEQ ID NO: 395252 - DNA, 42 bp, Artificial Sequence
  Description of Artificial Sequence: Synthetic oligonucleotide
atttagtgtcttccctctcttcatagaacaattcctcaagtc

SEQ ID NO: 395253 - DNA, 41 bp, Artificial Sequence
  Description of Artificial Sequence: Synthetic oligonucleotide
tttagtgtcttccctctcttcatagaacaattcctcaagtc

SEQ ID NO: 395254 - DNA, 40 bp, Artificial Sequence
  Description of Artificial Sequence: Synthetic oligonucleotide
ttagtgtcttccctctcttcatagaacaattcctcaagtc

SEQ ID NO: 395255 - DNA, 39 bp, Artificial Sequence
  Description of Artificial Sequence: Synthetic oligonucleotide
tagtgtcttccctctcttcatagaacaattcctcaagtc

SEQ ID NO: 395256 - DNA, 38 bp, Artificial Sequence
  Description of Artificial Sequence: Synthetic oligonucleotide
agtgtcttccctctcttcatagaacaattcctcaagtc

SEQ ID NO: 395257 - DNA, 37 bp, Artificial Sequence
  Description of Artificial Sequence: Synthetic oligonucleotide
gtgtcttccctctcttcatagaacaattcctcaagtc

SEQ ID NO: 395258 - DNA, 37 bp, Artificial Sequence
  Description of Artificial Sequence: Synthetic oligonucleotide
tgtcttccctctcttcatagaacaattcctcaagtcc

SEQ ID NO: 395259 - DNA, 36 bp, Artificial Sequence
  Description of Artificial Sequence: Synthetic oligonucleotide
gtcttccctctcttcatagaacaattcctcaagtcc

SEQ ID NO: 395260 - DNA, 37 bp, Artificial Sequence
  Description of Artificial Sequence: Synthetic oligonucleotide
tcttccctctcttcatagaacaattcctcaagtccac

SEQ ID NO: 395261 - DNA, 36 bp, Artificial Sequence
  Description of Artificial Sequence: Synthetic oligonucleotide
cttccctctcttcatagaacaattcctcaagtccac

SEQ ID NO: 395262 - DNA, 37 bp, Artificial Sequence
  Description of Artificial Sequence: Synthetic oligonucleotide
ttccctctcttcatagaacaattcctcaagtccactc

SEQ ID NO: 395263 - DNA, 36 bp, Artificial Sequence
  Description of Artificial Sequence: Synthetic oligonucleotide
tccctctcttcatagaacaattcctcaagtccactc

SEQ ID NO: 395264 - DNA, 35 bp, Artificial Sequence
  Description of Artificial Sequence: Synthetic oligonucleotide
ccctctcttcatagaacaattcctcaagtccactc

SEQ ID NO: 395265 - DNA, 36 bp, Artificial Sequence
  Description of Artificial Sequence: Synthetic oligonucleotide
cctctcttcatagaacaattcctcaagtccactctg

SEQ ID NO: 395266 - DNA, 37 bp, Artificial Sequence
  Description of Artificial Sequence: Synthetic oligonucleotide
ctctcttcatagaacaattcctcaagtccactctgag

SEQ ID NO: 395267 - DNA, 39 bp, Artificial Sequence
  Description of Artificial Sequence: Synthetic oligonucleotide
tctcttcatagaacaattcctcaagtccactctgagtag

SEQ ID NO: 395268 - DNA, 38 bp, Artificial Sequence
  Description of Artificial Sequence: Synthetic oligonucleotide
ctcttcatagaacaattcctcaagtccactctgagtag

SEQ ID NO: 395269 - DNA, 39 bp, Artificial Sequence
  Description of Artificial Sequence: Synthetic oligonucleotide
tcttcatagaacaattcctcaagtccactctgagtagag

SEQ ID NO: 395270 - DNA, 38 bp, Artificial Sequence
  Description of Artificial Sequence: Synthetic oligonucleotide
cttcatagaacaattcctcaagtccactctgagtagag

SEQ ID NO: 395271 - DNA, 32 bp, Artificial Sequence
  Description of Artificial Sequence: Synthetic oligonucleotide
aagtccactctgagtagaggctgcatcacaac

SEQ ID NO: 395272 - DNA, 31 bp, Artificial Sequence
  Description of Artificial Sequence: Synthetic oligonucleotide
agtccactctgagtagaggctgcatcacaac

SEQ ID NO: 395273 - DNA, 30 bp, Artificial Sequence
  Description of Artificial Sequence: Synthetic oligonucleotide
gtccactctgagtagaggctgcatcacaac

SEQ ID NO: 395274 - DNA, 32 bp, Artificial Sequence
  Description of Artificial Sequence: Synthetic oligonucleotide
tccactctgagtagaggctgcatcacaacaag

SEQ ID NO: 395275 - DNA, 31 bp, Artificial Sequence
  Description of Artificial Sequence: Synthetic oligonucleotide
ccactctgagtagaggctgcatcacaacaag

SEQ ID NO: 395276 - DNA, 31 bp, Artificial Sequence
  Description of Artificial Sequence: Synthetic oligonucleotide
cactctgagtagaggctgcatcacaacaagg

SEQ ID NO: 395277 - DNA, 31 bp, Artificial Sequence
  Description of Artificial Sequence: Synthetic oligonucleotide
actctgagtagaggctgcatcacaacaaggg

SEQ ID NO: 395278 - DNA, 30 bp, Artificial Sequence
  Description of Artificial Sequence: Synthetic oligonucleotide
ctctgagtagaggctgcatcacaacaaggg

SEQ ID NO: 395279 - DNA, 30 bp, Artificial Sequence
  Description of Artificial Sequence: Synthetic oligonucleotide
tctgagtagaggctgcatcacaacaagggg

SEQ ID NO: 395280 - DNA, 29 bp, Artificial Sequence
  Description of Artificial Sequence: Synthetic oligonucleotide
ctgagtagaggctgcatcacaacaagggg

SEQ ID NO: 395281 - DNA, 32 bp, Artificial Sequence
  Description of Artificial Sequence: Synthetic oligonucleotide
tgagtagaggctgcatcacaacaaggggattg

SEQ ID NO: 395282 - DNA, 31 bp, Artificial Sequence
  Description of Artificial Sequence: Synthetic oligonucleotide
gagtagaggctgcatcacaacaaggggattg

SEQ ID NO: 395283 - DNA, 31 bp, Artificial Sequence
  Description of Artificial Sequence: Synthetic oligonucleotide
agtagaggctgcatcacaacaaggggattgc

SEQ ID NO: 395284 - DNA, 30 bp, Artificial Sequence
  Description of Artificial Sequence: Synthetic oligonucleotide
gtagaggctgcatcacaacaaggggattgc

SEQ ID NO: 395285 - DNA, 30 bp, Artificial Sequence
  Description of Artificial Sequence: Synthetic oligonucleotide
tagaggctgcatcacaacaaggggattgcc

SEQ ID NO: 395286 - DNA, 29 bp, Artificial Sequence
  Description of Artificial Sequence: Synthetic oligonucleotide
agaggctgcatcacaacaaggggattgcc

SEQ ID NO: 395287 - DNA, 28 bp, Artificial Sequence
  Description of Artificial Sequence: Synthetic oligonucleotide
gaggctgcatcacaacaaggggattgcc

SEQ ID NO: 395288 - DNA, 28 bp, Artificial Sequence
  Description of Artificial Sequence: Synthetic oligonucleotide
aggctgcatcacaacaaggggattgccc

SEQ ID NO: 395289 - DNA, 27 bp, Artificial Sequence
  Description of Artificial Sequence: Synthetic oligonucleotide
ggctgcatcacaacaaggggattgccc

SEQ ID NO: 395290 - DNA, 28 bp, Artificial Sequence
  Description of Artificial Sequence: Synthetic oligonucleotide
gctgcatcacaacaaggggattgccctg

SEQ ID NO: 395291 - DNA, 29 bp, Artificial Sequence
  Description of Artificial Sequence: Synthetic oligonucleotide
ctgcatcacaacaaggggattgccctgtc

SEQ ID NO: 395292 - DNA, 30 bp, Artificial Sequence
  Description of Artificial Sequence: Synthetic oligonucleotide
tgcatcacaacaaggggattgccctgtctc

SEQ ID NO: 395293 - DNA, 29 bp, Artificial Sequence
  Description of Artificial Sequence: Synthetic oligonucleotide
gcatcacaacaaggggattgccctgtctc

SEQ ID NO: 395294 - DNA, 29 bp, Artificial Sequence
  Description of Artificial Sequence: Synthetic oligonucleotide
catcacaacaaggggattgccctgtctcc

SEQ ID NO: 395295 - DNA, 31 bp, Artificial Sequence
  Description of Artificial Sequence: Synthetic oligonucleotide
atcacaacaaggggattgccctgtctccttc

SEQ ID NO: 395296 - DNA, 30 bp, Artificial Sequence
  Description of Artificial Sequence: Synthetic oligonucleotide
tcacaacaaggggattgccctgtctccttc

SEQ ID NO: 395297 - DNA, 29 bp, Artificial Sequence
  Description of Artificial Sequence: Synthetic oligonucleotide
cacaacaaggggattgccctgtctccttc

SEQ ID NO: 395298 - DNA, 29 bp, Artificial Sequence
  Description of Artificial Sequence: Synthetic oligonucleotide
acaacaaggggattgccctgtctccttcc

SEQ ID NO: 395299 - DNA, 28 bp, Artificial Sequence
  Description of Artificial Sequence: Synthetic oligonucleotide
caacaaggggattgccctgtctccttcc

SEQ ID NO: 395300 - DNA, 29 bp, Artificial Sequence
  Description of Artificial Sequence: Synthetic oligonucleotide
aacaaggggattgccctgtctccttccag

SEQ ID NO: 395301 - DNA, 28 bp, Artificial Sequence
  Description of Artificial Sequence: Synthetic oligonucleotide
acaaggggattgccctgtctccttccag

SEQ ID NO: 395302 - DNA, 27 bp, Artificial Sequence
  Description of Artificial Sequence: Synthetic oligonucleotide
caaggggattgccctgtctccttccag

SEQ ID NO: 395303 - DNA, 27 bp, Artificial Sequence
  Description of Artificial Sequence: Synthetic oligonucleotide
aaggggattgccctgtctccttccagg

SEQ ID NO: 395304 - DNA, 26 bp, Artificial Sequence
  Description of Artificial Sequence: Synthetic oligonucleotide
aggggattgccctgtctccttccagg

SEQ ID NO: 395305 - DNA, 25 bp, Artificial Sequence
  Description of Artificial Sequence: Synthetic oligonucleotide
ggggattgccctgtctccttccagg

SEQ ID NO: 395306 - DNA, 25 bp, Artificial Sequence
  Description of Artificial Sequence: Synthetic oligonucleotide
gggattgccctgtctccttccaggg

SEQ ID NO: 395307 - DNA, 26 bp, Artificial Sequence
  Description of Artificial Sequence: Synthetic oligonucleotide
ggattgccctgtctccttccagggct

SEQ ID NO: 395308 - DNA, 27 bp, Artificial Sequence
  Description of Artificial Sequence: Synthetic oligonucleotide
gattgccctgtctccttccagggctct

SEQ ID NO: 395309 - DNA, 32 bp, Artificial Sequence
  Description of Artificial Sequence: Synthetic oligonucleotide
attgccctgtctccttccagggctcttaatag

SEQ ID NO: 395310 - DNA, 31 bp, Artificial Sequence
  Description of Artificial Sequence: Synthetic oligonucleotide
ttgccctgtctccttccagggctcttaatag

SEQ ID NO: 395311 - DNA, 30 bp, Artificial Sequence
  Description of Artificial Sequence: Synthetic oligonucleotide
tgccctgtctccttccagggctcttaatag

SEQ ID NO: 395312 - DNA, 29 bp, Artificial Sequence
  Description of Artificial Sequence: Synthetic oligonucleotide
gccctgtctccttccagggctcttaatag

SEQ ID NO: 395313 - DNA, 32 bp, Artificial Sequence
  Description of Artificial Sequence: Synthetic oligonucleotide
ccctgtctccttccagggctcttaatagaaac

SEQ ID NO: 395314 - DNA, 33 bp, Artificial Sequence
  Description of Artificial Sequence: Synthetic oligonucleotide
cctgtctccttccagggctcttaatagaaactc

SEQ ID NO: 395315 - DNA, 35 bp, Artificial Sequence
  Description of Artificial Sequence: Synthetic oligonucleotide
ctgtctccttccagggctcttaatagaaactcttc

SEQ ID NO: 395316 - DNA, 37 bp, Artificial Sequence
  Description of Artificial Sequence: Synthetic oligonucleotide
tgtctccttccagggctcttaatagaaactcttcaac

SEQ ID NO: 395317 - DNA, 36 bp, Artificial Sequence
  Description of Artificial Sequence: Synthetic oligonucleotide
gtctccttccagggctcttaatagaaactcttcaac

SEQ ID NO: 395318 - DNA, 38 bp, Artificial Sequence
  Description of Artificial Sequence: Synthetic oligonucleotide
tctccttccagggctcttaatagaaactcttcaactag

SEQ ID NO: 395319 - DNA, 37 bp, Artificial Sequence
  Description of Artificial Sequence: Synthetic oligonucleotide
ctccttccagggctcttaatagaaactcttcaactag

SEQ ID NO: 395320 - DNA, 40 bp, Artificial Sequence
  Description of Artificial Sequence: Synthetic oligonucleotide
tccttccagggctcttaatagaaactcttcaactagtaac

SEQ ID NO: 395321 - DNA, 39 bp, Artificial Sequence
  Description of Artificial Sequence: Synthetic oligonucleotide
ccttccagggctcttaatagaaactcttcaactagtaac

SEQ ID NO: 395322 - DNA, 40 bp, Artificial Sequence
  Description of Artificial Sequence: Synthetic oligonucleotide
cttccagggctcttaatagaaactcttcaactagtaactg

SEQ ID NO: 395323 - DNA, 41 bp, Artificial Sequence
  Description of Artificial Sequence: Synthetic oligonucleotide
ttccagggctcttaatagaaactcttcaactagtaactgag

SEQ ID NO: 395324 - DNA, 40 bp, Artificial Sequence
  Description of Artificial Sequence: Synthetic oligonucleotide
tccagggctcttaatagaaactcttcaactagtaactgag

SEQ ID NO: 395325 - DNA, 39 bp, Artificial Sequence
  Description of Artificial Sequence: Synthetic oligonucleotide
ccagggctcttaatagaaactcttcaactagtaactgag

SEQ ID NO: 395326 - DNA, 41 bp, Artificial Sequence
  Description of Artificial Sequence: Synthetic oligonucleotide
cagggctcttaatagaaactcttcaactagtaactgagatg

SEQ ID NO: 395327 - DNA, 42 bp, Artificial Sequence
  Description of Artificial Sequence: Synthetic oligonucleotide
agggctcttaatagaaactcttcaactagtaactgagatgtc

SEQ ID NO: 395328 - DNA, 41 bp, Artificial Sequence
  Description of Artificial Sequence: Synthetic oligonucleotide
gggctcttaatagaaactcttcaactagtaactgagatgtc

SEQ ID NO: 395329 - DNA, 42 bp, Artificial Sequence
  Description of Artificial Sequence: Synthetic oligonucleotide
ggctcttaatagaaactcttcaactagtaactgagatgtcac

SEQ ID NO: 395330 - DNA, 42 bp, Artificial Sequence
  Description of Artificial Sequence: Synthetic oligonucleotide
gctcttaatagaaactcttcaactagtaactgagatgtcacc

SEQ ID NO: 395331 - DNA, 44 bp, Artificial Sequence
  Description of Artificial Sequence: Synthetic oligonucleotide
ctcttaatagaaactcttcaactagtaactgagatgtcaccatg

SEQ ID NO: 395332 - DNA, 44 bp, Artificial Sequence
  Description of Artificial Sequence: Synthetic oligonucleotide
tcttaatagaaactcttcaactagtaactgagatgtcaccatgg

SEQ ID NO: 395333 - DNA, 43 bp, Artificial Sequence
  Description of Artificial Sequence: Synthetic oligonucleotide
cttaatagaaactcttcaactagtaactgagatgtcaccatgg

SEQ ID NO: 395334 - DNA, 43 bp, Artificial Sequence
  Description of Artificial Sequence: Synthetic oligonucleotide
ttaatagaaactcttcaactagtaactgagatgtcaccatggg

SEQ ID NO: 395335 - DNA, 42 bp, Artificial Sequence
  Description of Artificial Sequence: Synthetic oligonucleotide
taatagaaactcttcaactagtaactgagatgtcaccatggg

SEQ ID NO: 395336 - DNA, 41 bp, Artificial Sequence
  Description of Artificial Sequence: Synthetic oligonucleotide
aatagaaactcttcaactagtaactgagatgtcaccatggg

SEQ ID NO: 395337 - DNA, 40 bp, Artificial Sequence
  Description of Artificial Sequence: Synthetic oligonucleotide
atagaaactcttcaactagtaactgagatgtcaccatggg

SEQ ID NO: 395338 - DNA, 39 bp, Artificial Sequence
  Description of Artificial Sequence: Synthetic oligonucleotide
tagaaactcttcaactagtaactgagatgtcaccatggg

SEQ ID NO: 395339 - DNA, 38 bp, Artificial Sequence
  Description of Artificial Sequence: Synthetic oligonucleotide
agaaactcttcaactagtaactgagatgtcaccatggg

SEQ ID NO: 395340 - DNA, 37 bp, Artificial Sequence
  Description of Artificial Sequence: Synthetic oligonucleotide
gaaactcttcaactagtaactgagatgtcaccatggg

SEQ ID NO: 395341 - DNA, 37 bp, Artificial Sequence
  Description of Artificial Sequence: Synthetic oligonucleotide
aaactcttcaactagtaactgagatgtcaccatgggg

SEQ ID NO: 395342 - DNA, 36 bp, Artificial Sequence
  Description of Artificial Sequence: Synthetic oligonucleotide
aactcttcaactagtaactgagatgtcaccatgggg

SEQ ID NO: 395343 - DNA, 35 bp, Artificial Sequence
  Description of Artificial Sequence: Synthetic oligonucleotide
actcttcaactagtaactgagatgtcaccatgggg

SEQ ID NO: 395344 - DNA, 34 bp, Artificial Sequence
  Description of Artificial Sequence: Synthetic oligonucleotide
ctcttcaactagtaactgagatgtcaccatgggg

SEQ ID NO: 395345 - DNA, 34 bp, Artificial Sequence
  Description of Artificial Sequence: Synthetic oligonucleotide
tcttcaactagtaactgagatgtcaccatggggg

SEQ ID NO: 395346 - DNA, 33 bp, Artificial Sequence
  Description of Artificial Sequence: Synthetic oligonucleotide
cttcaactagtaactgagatgtcaccatggggg

SEQ ID NO: 395347 - DNA, 39 bp, Artificial Sequence
  Description of Artificial Sequence: Synthetic oligonucleotide
ttcaactagtaactgagatgtcaccatgggggatttttc

SEQ ID NO: 395348 - DNA, 38 bp, Artificial Sequence
  Description of Artificial Sequence: Synthetic oligonucleotide
tcaactagtaactgagatgtcaccatgggggatttttc

SEQ ID NO: 395349 - DNA, 37 bp, Artificial Sequence
  Description of Artificial Sequence: Synthetic oligonucleotide
caactagtaactgagatgtcaccatgggggatttttc

SEQ ID NO: 395350 - DNA, 42 bp, Artificial Sequence
  Description of Artificial Sequence: Synthetic oligonucleotide
aactagtaactgagatgtcaccatgggggatttttctaattg

SEQ ID NO: 395351 - DNA, 41 bp, Artificial Sequence
  Description of Artificial Sequence: Synthetic oligonucleotide
actagtaactgagatgtcaccatgggggatttttctaattg

SEQ ID NO: 395352 - DNA, 40 bp, Artificial Sequence
  Description of Artificial Sequence: Synthetic oligonucleotide
ctagtaactgagatgtcaccatgggggatttttctaattg

SEQ ID NO: 395353 - DNA, 40 bp, Artificial Sequence
  Description of Artificial Sequence: Synthetic oligonucleotide
tagtaactgagatgtcaccatgggggatttttctaattgg

SEQ ID NO: 395354 - DNA, 39 bp, Artificial Sequence
  Description of Artificial Sequence: Synthetic oligonucleotide
agtaactgagatgtcaccatgggggatttttctaattgg

SEQ ID NO: 395355 - DNA, 38 bp, Artificial Sequence
  Description of Artificial Sequence: Synthetic oligonucleotide
gtaactgagatgtcaccatgggggatttttctaattgg

SEQ ID NO: 395356 - DNA, 38 bp, Artificial Sequence
  Description of Artificial Sequence: Synthetic oligonucleotide
taactgagatgtcaccatgggggatttttctaattggc

SEQ ID NO: 395357 - DNA, 37 bp, Artificial Sequence
  Description of Artificial Sequence: Synthetic oligonucleotide
aactgagatgtcaccatgggggatttttctaattggc

SEQ ID NO: 395358 - DNA, 36 bp, Artificial Sequence
  Description of Artificial Sequence: Synthetic oligonucleotide
actgagatgtcaccatgggggatttttctaattggc

SEQ ID NO: 395359 - DNA, 35 bp, Artificial Sequence
  Description of Artificial Sequence: Synthetic oligonucleotide
ctgagatgtcaccatgggggatttttctaattggc

SEQ ID NO: 395360 - DNA, 35 bp, Artificial Sequence
  Description of Artificial Sequence: Synthetic oligonucleotide
tgagatgtcaccatgggggatttttctaattggcc

SEQ ID NO: 395361 - DNA, 34 bp, Artificial Sequence
  Description of Artificial Sequence: Synthetic oligonucleotide
gagatgtcaccatgggggatttttctaattggcc

SEQ ID NO: 395362 - DNA, 38 bp, Artificial Sequence
  Description of Artificial Sequence: Synthetic oligonucleotide
agatgtcaccatgggggatttttctaattggccaaaac

SEQ ID NO: 395363 - DNA, 37 bp, Artificial Sequence
  Description of Artificial Sequence: Synthetic oligonucleotide
gatgtcaccatgggggatttttctaattggccaaaac

SEQ ID NO: 395364 - DNA, 37 bp, Artificial Sequence
  Description of Artificial Sequence: Synthetic oligonucleotide
atgtcaccatgggggatttttctaattggccaaaacc

SEQ ID NO: 395365 - DNA, 36 bp, Artificial Sequence
  Description of Artificial Sequence: Synthetic oligonucleotide
tgtcaccatgggggatttttctaattggccaaaacc

SEQ ID NO: 395366 - DNA, 35 bp, Artificial Sequence
  Description of Artificial Sequence: Synthetic oligonucleotide
gtcaccatgggggatttttctaattggccaaaacc

SEQ ID NO: 395367 - DNA, 36 bp, Artificial Sequence
  Description of Artificial Sequence: Synthetic oligonucleotide
tcaccatgggggatttttctaattggccaaaacctg

SEQ ID NO: 395368 - DNA, 35 bp, Artificial Sequence
  Description of Artificial Sequence: Synthetic oligonucleotide
caccatgggggatttttctaattggccaaaacctg

SEQ ID NO: 395369 - DNA, 36 bp, Artificial Sequence
  Description of Artificial Sequence: Synthetic oligonucleotide
accatgggggatttttctaattggccaaaacctgac

SEQ ID NO: 395370 - DNA, 35 bp, Artificial Sequence
  Description of Artificial Sequence: Synthetic oligonucleotide
ccatgggggatttttctaattggccaaaacctgac

SEQ ID NO: 395371 - DNA, 37 bp, Artificial Sequence
  Description of Artificial Sequence: Synthetic oligonucleotide
catgggggatttttctaattggccaaaacctgacttg

SEQ ID NO: 395372 - DNA, 37 bp, Artificial Sequence
  Description of Artificial Sequence: Synthetic oligonucleotide
atgggggatttttctaattggccaaaacctgacttgg

SEQ ID NO: 395373 - DNA, 36 bp, Artificial Sequence
  Description of Artificial Sequence: Synthetic oligonucleotide
tgggggatttttctaattggccaaaacctgacttgg

SEQ ID NO: 395374 - DNA, 35 bp, Artificial Sequence
  Description of Artificial Sequence: Synthetic oligonucleotide
gggggatttttctaattggccaaaacctgacttgg

SEQ ID NO: 395375 - DNA, 36 bp, Artificial Sequence
  Description of Artificial Sequence: Synthetic oligonucleotide
ttgaggtcctcacaattactctacagctcagaacag

SEQ ID NO: 395376 - DNA, 35 bp, Artificial Sequence
  Description of Artificial Sequence: Synthetic oligonucleotide
tgaggtcctcacaattactctacagctcagaacag

SEQ ID NO: 395377 - DNA, 34 bp, Artificial Sequence
  Description of Artificial Sequence: Synthetic oligonucleotide
gaggtcctcacaattactctacagctcagaacag

SEQ ID NO: 395378 - DNA, 34 bp, Artificial Sequence
  Description of Artificial Sequence: Synthetic oligonucleotide
aggtcctcacaattactctacagctcagaacagc

SEQ ID NO: 395379 - DNA, 33 bp, Artificial Sequence
  Description of Artificial Sequence: Synthetic oligonucleotide
ggtcctcacaattactctacagctcagaacagc

SEQ ID NO: 395380 - DNA, 35 bp, Artificial Sequence
  Description of Artificial Sequence: Synthetic oligonucleotide
gtcctcacaattactctacagctcagaacagcaac

SEQ ID NO: 395381 - DNA, 36 bp, Artificial Sequence
  Description of Artificial Sequence: Synthetic oligonucleotide
tcctcacaattactctacagctcagaacagcaactg

SEQ ID NO: 395382 - DNA, 35 bp, Artificial Sequence
  Description of Artificial Sequence: Synthetic oligonucleotide
cctcacaattactctacagctcagaacagcaactg

SEQ ID NO: 395383 - DNA, 35 bp, Artificial Sequence
  Description of Artificial Sequence: Synthetic oligonucleotide
ctcacaattactctacagctcagaacagcaactgc

SEQ ID NO: 395384 - DNA, 36 bp, Artificial Sequence
  Description of Artificial Sequence: Synthetic oligonucleotide
tcacaattactctacagctcagaacagcaactgctg

SEQ ID NO: 395385 - DNA, 35 bp, Artificial Sequence
  Description of Artificial Sequence: Synthetic oligonucleotide
cacaattactctacagctcagaacagcaactgctg

SEQ ID NO: 395386 - DNA, 36 bp, Artificial Sequence
  Description of Artificial Sequence: Synthetic oligonucleotide
acaattactctacagctcagaacagcaactgctgag

SEQ ID NO: 395387 - DNA, 35 bp, Artificial Sequence
  Description of Artificial Sequence: Synthetic oligonucleotide
caattactctacagctcagaacagcaactgctgag

SEQ ID NO: 395388 - DNA, 35 bp, Artificial Sequence
  Description of Artificial Sequence: Synthetic oligonucleotide
aattactctacagctcagaacagcaactgctgagg

SEQ ID NO: 395389 - DNA, 34 bp, Artificial Sequence
  Description of Artificial Sequence: Synthetic oligonucleotide
attactctacagctcagaacagcaactgctgagg

SEQ ID NO: 395390 - DNA, 33 bp, Artificial Sequence
  Description of Artificial Sequence: Synthetic oligonucleotide
ttactctacagctcagaacagcaactgctgagg

SEQ ID NO: 395391 - DNA, 32 bp, Artificial Sequence
  Description of Artificial Sequence: Synthetic oligonucleotide
tactctacagctcagaacagcaactgctgagg

SEQ ID NO: 395392 - DNA, 31 bp, Artificial Sequence
  Description of Artificial Sequence: Synthetic oligonucleotide
actctacagctcagaacagcaactgctgagg

SEQ ID NO: 395393 - DNA, 30 bp, Artificial Sequence
  Description of Artificial Sequence: Synthetic oligonucleotide
ctctacagctcagaacagcaactgctgagg

SEQ ID NO: 395394 - DNA, 30 bp, Artificial Sequence
  Description of Artificial Sequence: Synthetic oligonucleotide
tctacagctcagaacagcaactgctgaggc

SEQ ID NO: 395395 - DNA, 29 bp, Artificial Sequence
  Description of Artificial Sequence: Synthetic oligonucleotide
ctacagctcagaacagcaactgctgaggc

SEQ ID NO: 395396 - DNA, 30 bp, Artificial Sequence
  Description of Artificial Sequence: Synthetic oligonucleotide
tacagctcagaacagcaactgctgaggctg

SEQ ID NO: 395397 - DNA, 29 bp, Artificial Sequence
  Description of Artificial Sequence: Synthetic oligonucleotide
acagctcagaacagcaactgctgaggctg

SEQ ID NO: 395398 - DNA, 28 bp, Artificial Sequence
  Description of Artificial Sequence: Synthetic oligonucleotide
cagctcagaacagcaactgctgaggctg

SEQ ID NO: 395399 - DNA, 28 bp, Artificial Sequence
  Description of Artificial Sequence: Synthetic oligonucleotide
agctcagaacagcaactgctgaggctgc

SEQ ID NO: 395400 - DNA, 27 bp, Artificial Sequence
  Description of Artificial Sequence: Synthetic oligonucleotide
gctcagaacagcaactgctgaggctgc

SEQ ID NO: 395401 - DNA, 27 bp, Artificial Sequence
  Description of Artificial Sequence: Synthetic oligonucleotide
ctcagaacagcaactgctgaggctgcc

SEQ ID NO: 395402 - DNA, 29 bp, Artificial Sequence
  Description of Artificial Sequence: Synthetic oligonucleotide
tcagaacagcaactgctgaggctgccttg

SEQ ID NO: 395403 - DNA, 28 bp, Artificial Sequence
  Description of Artificial Sequence: Synthetic oligonucleotide
cagaacagcaactgctgaggctgccttg

SEQ ID NO: 395404 - DNA, 28 bp, Artificial Sequence
  Description of Artificial Sequence: Synthetic oligonucleotide
agaacagcaactgctgaggctgccttgg

SEQ ID NO: 395405 - DNA, 27 bp, Artificial Sequence
  Description of Artificial Sequence: Synthetic oligonucleotide
gaacagcaactgctgaggctgccttgg

SEQ ID NO: 395406 - DNA, 27 bp, Artificial Sequence
  Description of Artificial Sequence: Synthetic oligonucleotide
aacagcaactgctgaggctgccttggg

SEQ ID NO: 395407 - DNA, 27 bp, Artificial Sequence
  Description of Artificial Sequence: Synthetic oligonucleotide
acagcaactgctgaggctgccttggga

SEQ ID NO: 395408 - DNA, 27 bp, Artificial Sequence
  Description of Artificial Sequence: Synthetic oligonucleotide
cagcaactgctgaggctgccttgggaa

SEQ ID NO: 395409 - DNA, 27 bp, Artificial Sequence
  Description of Artificial Sequence: Synthetic oligonucleotide
agcaactgctgaggctgccttgggaag

SEQ ID NO: 395410 - DNA, 27 bp, Artificial Sequence
  Description of Artificial Sequence: Synthetic oligonucleotide
gcaactgctgaggctgccttgggaaga

SEQ ID NO: 395411 - DNA, 28 bp, Artificial Sequence
  Description of Artificial Sequence: Synthetic oligonucleotide
caactgctgaggctgccttgggaagaag

SEQ ID NO: 395412 - DNA, 30 bp, Artificial Sequence
  Description of Artificial Sequence: Synthetic oligonucleotide
aactgctgaggctgccttgggaagaagatg

SEQ ID NO: 395413 - DNA, 29 bp, Artificial Sequence
  Description of Artificial Sequence: Synthetic oligonucleotide
actgctgaggctgccttgggaagaagatg

SEQ ID NO: 395414 - DNA, 28 bp, Artificial Sequence
  Description of Artificial Sequence: Synthetic oligonucleotide
ctgctgaggctgccttgggaagaagatg

SEQ ID NO: 395415 - DNA, 30 bp, Artificial Sequence
  Description of Artificial Sequence: Synthetic oligonucleotide
tgctgaggctgccttgggaagaagatgatc

SEQ ID NO: 395416 - DNA, 29 bp, Artificial Sequence
  Description of Artificial Sequence: Synthetic oligonucleotide
gctgaggctgccttgggaagaagatgatc

SEQ ID NO: 395417 - DNA, 29 bp, Artificial Sequence
  Description of Artificial Sequence: Synthetic oligonucleotide
ctgaggctgccttgggaagaagatgatcc

SEQ ID NO: 395418 - DNA, 33 bp, Artificial Sequence
  Description of Artificial Sequence: Synthetic oligonucleotide
tgaggctgccttgggaagaagatgatcctaaac

SEQ ID NO: 395419 - DNA, 32 bp, Artificial Sequence
  Description of Artificial Sequence: Synthetic oligonucleotide
gaggctgccttgggaagaagatgatcctaaac

SEQ ID NO: 395420 - DNA, 35 bp, Artificial Sequence
  Description of Artificial Sequence: Synthetic oligonucleotide
aggctgccttgggaagaagatgatcctaaacaaag

SEQ ID NO: 395421 - DNA, 34 bp, Artificial Sequence
  Description of Artificial Sequence: Synthetic oligonucleotide
ggctgccttgggaagaagatgatcctaaacaaag

SEQ ID NO: 395422 - DNA, 34 bp, Artificial Sequence
  Description of Artificial Sequence: Synthetic oligonucleotide
gctgccttgggaagaagatgatcctaaacaaagc

SEQ ID NO: 395423 - DNA, 35 bp, Artificial Sequence
  Description of Artificial Sequence: Synthetic oligonucleotide
ctgccttgggaagaagatgatcctaaacaaagctc

SEQ ID NO: 395424 - DNA, 36 bp, Artificial Sequence
  Description of Artificial Sequence: Synthetic oligonucleotide
tgccttgggaagaagatgatcctaaacaaagctctg

SEQ ID NO: 395425 - DNA, 35 bp, Artificial Sequence
  Description of Artificial Sequence: Synthetic oligonucleotide
gccttgggaagaagatgatcctaaacaaagctctg

SEQ ID NO: 395426 - DNA, 37 bp, Artificial Sequence
  Description of Artificial Sequence: Synthetic oligonucleotide
ccttgggaagaagatgatcctaaacaaagctctgatg

SEQ ID NO: 395427 - DNA, 37 bp, Artificial Sequence
  Description of Artificial Sequence: Synthetic oligonucleotide
cttgggaagaagatgatcctaaacaaagctctgatgc

SEQ ID NO: 395428 - DNA, 38 bp, Artificial Sequence
  Description of Artificial Sequence: Synthetic oligonucleotide
ttgggaagaagatgatcctaaacaaagctctgatgctg

SEQ ID NO: 395429 - DNA, 37 bp, Artificial Sequence
  Description of Artificial Sequence: Synthetic oligonucleotide
tgggaagaagatgatcctaaacaaagctctgatgctg

SEQ ID NO: 395430 - DNA, 36 bp, Artificial Sequence
  Description of Artificial Sequence: Synthetic oligonucleotide
gggaagaagatgatcctaaacaaagctctgatgctg

SEQ ID NO: 395431 - DNA, 36 bp, Artificial Sequence
  Description of Artificial Sequence: Synthetic oligonucleotide
ggaagaagatgatcctaaacaaagctctgatgctgg

SEQ ID NO: 395432 - DNA, 36 bp, Artificial Sequence
  Description of Artificial Sequence: Synthetic oligonucleotide
gaagaagatgatcctaaacaaagctctgatgctggg

SEQ ID NO: 395433 - DNA, 36 bp, Artificial Sequence
  Description of Artificial Sequence: Synthetic oligonucleotide
aagaagatgatcctaaacaaagctctgatgctgggg

SEQ ID NO: 395434 - DNA, 35 bp, Artificial Sequence
  Description of Artificial Sequence: Synthetic oligonucleotide
agaagatgatcctaaacaaagctctgatgctgggg

SEQ ID NO: 395435 - DNA, 34 bp, Artificial Sequence
  Description of Artificial Sequence: Synthetic oligonucleotide
gaagatgatcctaaacaaagctctgatgctgggg

SEQ ID NO: 395436 - DNA, 34 bp, Artificial Sequence
  Description of Artificial Sequence: Synthetic oligonucleotide
aagatgatcctaaacaaagctctgatgctggggg

SEQ ID NO: 395437 - DNA, 33 bp, Artificial Sequence
  Description of Artificial Sequence: Synthetic oligonucleotide
agatgatcctaaacaaagctctgatgctggggg

SEQ ID NO: 395438 - DNA, 32 bp, Artificial Sequence
  Description of Artificial Sequence: Synthetic oligonucleotide
gatgatcctaaacaaagctctgatgctggggg

SEQ ID NO: 395439 - DNA, 32 bp, Artificial Sequence; identical to SEQ ID NO: 56246
  Description of Artificial Sequence: Synthetic oligonucleotide

SEQ ID NO: 395440 - DNA, 31 bp, Artificial Sequence; identical to SEQ ID NO: 56247
  Description of Artificial Sequence: Synthetic oligonucleotide

SEQ ID NO: 395441 - DNA, 30 bp, Artificial Sequence; identical to SEQ ID NO: 56248
  Description of Artificial Sequence: Synthetic oligonucleotide

SEQ ID NO: 395442 - DNA, 30 bp, Artificial Sequence; identical to SEQ ID NO: 56249
  Description of Artificial Sequence: Synthetic oligonucleotide

SEQ ID NO: 395443 - DNA, 29 bp, Artificial Sequence
  Description of Artificial Sequence: Synthetic oligonucleotide
tcctaaacaaagctctgatgctgggggcc

SEQ ID NO: 395444 - DNA, 28 bp, Artificial Sequence
  Description of Artificial Sequence: Synthetic oligonucleotide
cctaaacaaagctctgatgctgggggcc

SEQ ID NO: 395445 - DNA, 28 bp, Artificial Sequence
  Description of Artificial Sequence: Synthetic oligonucleotide
ctaaacaaagctctgatgctgggggccc

SEQ ID NO: 395446 - DNA, 29 bp, Artificial Sequence
  Description of Artificial Sequence: Synthetic oligonucleotide
taaacaaagctctgatgctgggggccctc

SEQ ID NO: 395447 - DNA, 28 bp, Artificial Sequence
  Description of Artificial Sequence: Synthetic oligonucleotide
aaacaaagctctgatgctgggggccctc

SEQ ID NO: 395448 - DNA, 27 bp, Artificial Sequence
  Description of Artificial Sequence: Synthetic oligonucleotide
aacaaagctctgatgctgggggccctc

SEQ ID NO: 395449 - DNA, 26 bp, Artificial Sequence
  Description of Artificial Sequence: Synthetic oligonucleotide
acaaagctctgatgctgggggccctc

SEQ ID NO: 395450 - DNA, 25 bp, Artificial Sequence
  Description of Artificial Sequence: Synthetic oligonucleotide
caaagctctgatgctgggggccctc

SEQ ID NO: 395451 - DNA, 25 bp, Artificial Sequence
  Description of Artificial Sequence: Synthetic oligonucleotide
aaagctctgatgctgggggccctcg

SEQ ID NO: 395452 - DNA, 24 bp, Artificial Sequence
  Description of Artificial Sequence: Synthetic oligonucleotide
aagctctgatgctgggggccctcg

SEQ ID NO: 395453 - DNA, 23 bp, Artificial Sequence
  Description of Artificial Sequence: Synthetic oligonucleotide
agctctgatgctgggggccctcg

SEQ ID NO: 395454 - DNA, 22 bp, Artificial Sequence
  Description of Artificial Sequence: Synthetic oligonucleotide
gctctgatgctgggggccctcg

SEQ ID NO: 395455 - DNA, 22 bp, Artificial Sequence
  Description of Artificial Sequence: Synthetic oligonucleotide
ctctgatgctgggggccctcgc

SEQ ID NO: 395456 - DNA, 22 bp, Artificial Sequence
  Description of Artificial Sequence: Synthetic oligonucleotide
tctgatgctgggggccctcgcc

SEQ ID NO: 395457 - DNA, 21 bp, Artificial Sequence
  Description of Artificial Sequence: Synthetic oligonucleotide
ctgatgctgggggccctcgcc

SEQ ID NO: 395458 - DNA, 22 bp, Artificial Sequence
  Description of Artificial Sequence: Synthetic oligonucleotide
tgatgctgggggccctcgccct

SEQ ID NO: 395459 - DNA, 21 bp, Artificial Sequence
  Description of Artificial Sequence: Synthetic oligonucleotide
gatgctgggggccctcgccct

SEQ ID NO: 395460 - DNA, 22 bp, Artificial Sequence
  Description of Artificial Sequence: Synthetic oligonucleotide
atgctgggggccctcgccctga

SEQ ID NO: 395461 - DNA, 21 bp, Artificial Sequence
  Description of Artificial Sequence: Synthetic oligonucleotide
tgctgggggccctcgccctga

SEQ ID NO: 395462 - DNA, 20 bp, Artificial Sequence
  Description of Artificial Sequence: Synthetic oligonucleotide
gctgggggccctcgccctga

SEQ ID NO: 395463 - DNA, 20 bp, Artificial Sequence
  Description of Artificial Sequence: Synthetic oligonucleotide
ctgggggccctcgccctgac

SEQ ID NO: 395464 - DNA, 21 bp, Artificial Sequence
  Description of Artificial Sequence: Synthetic oligonucleotide
tgggggccctcgccctgacca

SEQ ID NO: 395465 - DNA, 20 bp, Artificial Sequence
  Description of Artificial Sequence: Synthetic oligonucleotide
gggggccctcgccctgacca

SEQ ID NO: 395466 - DNA, 20 bp, Artificial Sequence
  Description of Artificial Sequence: Synthetic oligonucleotide
ggggccctcgccctgaccac

SEQ ID NO: 395467 - DNA, 20 bp, Artificial Sequence
  Description of Artificial Sequence: Synthetic oligonucleotide
gggccctcgccctgaccacc

SEQ ID NO: 395468 - DNA, 21 bp, Artificial Sequence
  Description of Artificial Sequence: Synthetic oligonucleotide
ggccctcgccctgaccaccgt

SEQ ID NO: 395469 - DNA, 23 bp, Artificial Sequence
  Description of Artificial Sequence: Synthetic oligonucleotide
gccctcgccctgaccaccgtgat

SEQ ID NO: 395470 - DNA, 24 bp, Artificial Sequence
  Description of Artificial Sequence: Synthetic oligonucleotide
ccctcgccctgaccaccgtgatga

SEQ ID NO: 395471 - DNA, 24 bp, Artificial Sequence
  Description of Artificial Sequence: Synthetic oligonucleotide
cctcgccctgaccaccgtgatgag

SEQ ID NO: 395472 - DNA, 24 bp, Artificial Sequence
  Description of Artificial Sequence: Synthetic oligonucleotide
ctcgccctgaccaccgtgatgagc

SEQ ID NO: 395473 - DNA, 24 bp, Artificial Sequence
  Description of Artificial Sequence: Synthetic oligonucleotide
tcgccctgaccaccgtgatgagcc

SEQ ID NO: 395474 - DNA, 23 bp, Artificial Sequence
  Description of Artificial Sequence: Synthetic oligonucleotide
cgccctgaccaccgtgatgagcc

SEQ ID NO: 395475 - DNA, 25 bp, Artificial Sequence
  Description of Artificial Sequence: Synthetic oligonucleotide
gccctgaccaccgtgatgagccctt

SEQ ID NO: 395476 - DNA, 26 bp, Artificial Sequence
  Description of Artificial Sequence: Synthetic oligonucleotide
ccctgaccaccgtgatgagcccttgt

SEQ ID NO: 395477 - DNA, 26 bp, Artificial Sequence
  Description of Artificial Sequence: Synthetic oligonucleotide
cctgaccaccgtgatgagcccttgtg

SEQ ID NO: 395478 - DNA, 27 bp, Artificial Sequence
  Description of Artificial Sequence: Synthetic oligonucleotide
ctgaccaccgtgatgagcccttgtgga

SEQ ID NO: 395479 - DNA, 27 bp, Artificial Sequence
  Description of Artificial Sequence: Synthetic oligonucleotide
tgaccaccgtgatgagcccttgtggag

SEQ ID NO: 395480 - DNA, 26 bp, Artificial Sequence
  Description of Artificial Sequence: Synthetic oligonucleotide
gaccaccgtgatgagcccttgtggag

SEQ ID NO: 395481 - DNA, 27 bp, Artificial Sequence
  Description of Artificial Sequence: Synthetic oligonucleotide
accaccgtgatgagcccttgtggaggt

SEQ ID NO: 395482 - DNA, 26 bp, Artificial Sequence
  Description of Artificial Sequence: Synthetic oligonucleotide
ccaccgtgatgagcccttgtggaggt

SEQ ID NO: 395483 - DNA, 27 bp, Artificial Sequence
  Description of Artificial Sequence: Synthetic oligonucleotide
caccgtgatgagcccttgtggaggtga

SEQ ID NO: 395484 - DNA, 28 bp, Artificial Sequence
  Description of Artificial Sequence: Synthetic oligonucleotide
accgtgatgagcccttgtggaggtgaag

SEQ ID NO: 395485 - DNA, 27 bp, Artificial Sequence
  Description of Artificial Sequence: Synthetic oligonucleotide
ccgtgatgagcccttgtggaggtgaag

SEQ ID NO: 395486 - DNA, 28 bp, Artificial Sequence
  Description of Artificial Sequence: Synthetic oligonucleotide
cgtgatgagcccttgtggaggtgaagac

SEQ ID NO: 395487 - DNA, 31 bp, Artificial Sequence; identical to SEQ ID NO: 56294
  Description of Artificial Sequence: Synthetic oligonucleotide

SEQ ID NO: 395488 - DNA, 32 bp, Artificial Sequence; identical to SEQ ID NO: 56295
  Description of Artificial Sequence: Synthetic oligonucleotide

SEQ ID NO: 395489 - DNA, 31 bp, Artificial Sequence; identical to SEQ ID NO: 56296
  Description of Artificial Sequence: Synthetic oligonucleotide

SEQ ID NO: 395490 - DNA, 31 bp, Artificial Sequence; identical to SEQ ID NO: 56297
  Description of Artificial Sequence: Synthetic oligonucleotide

SEQ ID NO: 395491 - DNA, 30 bp, Artificial Sequence; identical to SEQ ID NO: 56298
  Description of Artificial Sequence: Synthetic oligonucleotide

SEQ ID NO: 395492 - DNA, 29 bp, Artificial Sequence
  Description of Artificial Sequence: Synthetic oligonucleotide
gagcccttgtggaggtgaagacattgtgg

SEQ ID NO: 395493 - DNA, 29 bp, Artificial Sequence
  Description of Artificial Sequence: Synthetic oligonucleotide
agcccttgtggaggtgaagacattgtggc

SEQ ID NO: 395494 - DNA, 28 bp, Artificial Sequence
  Description of Artificial Sequence: Synthetic oligonucleotide
gcccttgtggaggtgaagacattgtggc

SEQ ID NO: 395495 - DNA, 29 bp, Artificial Sequence
  Description of Artificial Sequence: Synthetic oligonucleotide
cccttgtggaggtgaagacattgtggctg

SEQ ID NO: 395496 - DNA, 30 bp, Artificial Sequence; identical to SEQ ID NO: 56303
  Description of Artificial Sequence: Synthetic oligonucleotide

SEQ ID NO: 395497 - DNA, 30 bp, Artificial Sequence; identical to SEQ ID NO: 56304
  Description of Artificial Sequence: Synthetic oligonucleotide

SEQ ID NO: 395498 - DNA, 31 bp, Artificial Sequence; identical to SEQ ID NO: 56305
  Description of Artificial Sequence: Synthetic oligonucleotide

SEQ ID NO: 395499 - DNA, 32 bp, Artificial Sequence; identical to SEQ ID NO: 56306
  Description of Artificial Sequence: Synthetic oligonucleotide

SEQ ID NO: 395500 - DNA, 31 bp, Artificial Sequence; identical to SEQ ID NO: 56307
  Description of Artificial Sequence: Synthetic oligonucleotide

SEQ ID NO: 395501 - DNA, 30 bp, Artificial Sequence; identical to SEQ ID NO: 56308
  Description of Artificial Sequence: Synthetic oligonucleotide

SEQ ID NO: 395502 - DNA, 30 bp, Artificial Sequence; identical to SEQ ID NO: 56309
  Description of Artificial Sequence: Synthetic oligonucleotide

SEQ ID NO: 395503 - DNA, 29 bp, Artificial Sequence
  Description of Artificial Sequence: Synthetic oligonucleotide
cattgtggctgaccacgttgcctcttacg

SEQ ID NO: 395504 - DNA, 29 bp, Artificial Sequence
  Description of Artificial Sequence: Synthetic oligonucleotide
attgtggctgaccacgttgcctcttacgg

SEQ ID NO: 395505 - DNA, 28 bp, Artificial Sequence
  Description of Artificial Sequence: Synthetic oligonucleotide
ttgtggctgaccacgttgcctcttacgg

SEQ ID NO: 395506 - DNA, 27 bp, Artificial Sequence
  Description of Artificial Sequence: Synthetic oligonucleotide
tgtggctgaccacgttgcctcttacgg

SEQ ID NO: 395507 - DNA, 27 bp, Artificial Sequence
  Description of Artificial Sequence: Synthetic oligonucleotide
gtggctgaccacgttgcctcttacggt

SEQ ID NO: 395508 - DNA, 27 bp, Artificial Sequence
  Description of Artificial Sequence: Synthetic oligonucleotide
tggctgaccacgttgcctcttacggtg

SEQ ID NO: 395509 - DNA, 27 bp, Artificial Sequence
  Description of Artificial Sequence: Synthetic oligonucleotide
ggctgaccacgttgcctcttacggtgt

SEQ ID NO: 395510 - DNA, 30 bp, Artificial Sequence; identical to SEQ ID NO: 56317
  Description of Artificial Sequence: Synthetic oligonucleotide

SEQ ID NO: 395511 - DNA, 32 bp, Artificial Sequence; identical to SEQ ID NO: 56318
  Description of Artificial Sequence: Synthetic oligonucleotide

SEQ ID NO: 395512 - DNA, 34 bp, Artificial Sequence; identical to SEQ ID NO: 56319
  Description of Artificial Sequence: Synthetic oligonucleotide

SEQ ID NO: 395513 - DNA, 33 bp, Artificial Sequence; identical to SEQ ID NO: 56320
  Description of Artificial Sequence: Synthetic oligonucleotide

SEQ ID NO: 395514 - DNA, 33 bp, Artificial Sequence; identical to SEQ ID NO: 56321
  Description of Artificial Sequence: Synthetic oligonucleotide

SEQ ID NO: 395515 - DNA, 32 bp, Artificial Sequence; identical to SEQ ID NO: 56322
  Description of Artificial Sequence: Synthetic oligonucleotide

SEQ ID NO: 395516 - DNA, 33 bp, Artificial Sequence; identical to SEQ ID NO: 56323
  Description of Artificial Sequence: Synthetic oligonucleotide

SEQ ID NO: 395517 - DNA, 34 bp, Artificial Sequence; identical to SEQ ID NO: 56324
  Description of Artificial Sequence: Synthetic oligonucleotide

SEQ ID NO: 395518 - DNA, 33 bp, Artificial Sequence; identical to SEQ ID NO: 56325
  Description of Artificial Sequence: Synthetic oligonucleotide

SEQ ID NO: 395519 - DNA, 36 bp, Artificial Sequence; identical to SEQ ID NO: 56326
  Description of Artificial Sequence: Synthetic oligonucleotide

SEQ ID NO: 395520 - DNA, 36 bp, Artificial Sequence; identical to SEQ ID NO: 56327
  Description of Artificial Sequence: Synthetic oligonucleotide

SEQ ID NO: 395521 - DNA, 35 bp, Artificial Sequence; identical to SEQ ID NO: 56328
  Description of Artificial Sequence: Synthetic oligonucleotide

SEQ ID NO: 395522 - DNA, 34 bp, Artificial Sequence; identical to SEQ ID NO: 56329
  Description of Artificial Sequence: Synthetic oligonucleotide

SEQ ID NO: 395523 - DNA, 34 bp, Artificial Sequence; identical to SEQ ID NO: 56330
  Description of Artificial Sequence: Synthetic oligonucleotide

SEQ ID NO: 395524 - DNA, 35 bp, Artificial Sequence; identical to SEQ ID NO: 56331
  Description of Artificial Sequence: Synthetic oligonucleotide

SEQ ID NO: 395525 - DNA, 35 bp, Artificial Sequence; identical to SEQ ID NO: 56332
  Description of Artificial Sequence: Synthetic oligonucleotide

SEQ ID NO: 395526 - DNA, 34 bp, Artificial Sequence; identical to SEQ ID NO: 56333
  Description of Artificial Sequence: Synthetic oligonucleotide

SEQ ID NO: 395527 - DNA, 34 bp, Artificial Sequence; identical to SEQ ID NO: 56334
  Description of Artificial Sequence: Synthetic oligonucleotide

SEQ ID NO: 395528 - DNA, 33 bp, Artificial Sequence; identical to SEQ ID NO: 56335
  Description of Artificial Sequence: Synthetic oligonucleotide

SEQ ID NO: 395529 - DNA, 32 bp, Artificial Sequence; identical to SEQ ID NO: 56336
  Description of Artificial Sequence: Synthetic oligonucleotide

SEQ ID NO: 395530 - DNA, 31 bp, Artificial Sequence; identical to SEQ ID NO: 56337
  Description of Artificial Sequence: Synthetic oligonucleotide

SEQ ID NO: 395531 - DNA, 32 bp, Artificial Sequence; identical to SEQ ID NO: 56338
  Description of Artificial Sequence: Synthetic oligonucleotide

SEQ ID NO: 395532 - DNA, 33 bp, Artificial Sequence; identical to SEQ ID NO: 56339
  Description of Artificial Sequence: Synthetic oligonucleotide

SEQ ID NO: 395533 - DNA, 33 bp, Artificial Sequence; identical to SEQ ID NO: 56340
  Description of Artificial Sequence: Synthetic oligonucleotide

SEQ ID NO: 395534 - DNA, 32 bp, Artificial Sequence; identical to SEQ ID NO: 56341
  Description of Artificial Sequence: Synthetic oligonucleotide

SEQ ID NO: 395535 - DNA, 32 bp, Artificial Sequence; identical to SEQ ID NO: 56342
  Description of Artificial Sequence: Synthetic oligonucleotide

SEQ ID NO: 395536 - DNA, 31 bp, Artificial Sequence; identical to SEQ ID NO: 56343
  Description of Artificial Sequence: Synthetic oligonucleotide

SEQ ID NO: 395537 - DNA, 30 bp, Artificial Sequence; identical to SEQ ID NO: 56344
  Description of Artificial Sequence: Synthetic oligonucleotide

SEQ ID NO: 395538 - DNA, 29 bp, Artificial Sequence
  Description of Artificial Sequence: Synthetic oligonucleotide
acttgtaccagtcttacggtccctctggc

SEQ ID NO: 395539 - DNA, 28 bp, Artificial Sequence
  Description of Artificial Sequence: Synthetic oligonucleotide
cttgtaccagtcttacggtccctctggc

SEQ ID NO: 395540 - DNA, 28 bp, Artificial Sequence
  Description of Artificial Sequence: Synthetic oligonucleotide
ttgtaccagtcttacggtccctctggcc

SEQ ID NO: 395541 - DNA, 27 bp, Artificial Sequence
  Description of Artificial Sequence: Synthetic oligonucleotide
tgtaccagtcttacggtccctctggcc

SEQ ID NO: 395542 - DNA, 27 bp, Artificial Sequence
  Description of Artificial Sequence: Synthetic oligonucleotide
gtaccagtcttacggtccctctggcca

SEQ ID NO: 395543 - DNA, 27 bp, Artificial Sequence
  Description of Artificial Sequence: Synthetic oligonucleotide
taccagtcttacggtccctctggccag

SEQ ID NO: 395544 - DNA, 27 bp, Artificial Sequence
  Description of Artificial Sequence: Synthetic oligonucleotide
accagtcttacggtccctctggccagt

SEQ ID NO: 395545 - DNA, 27 bp, Artificial Sequence
  Description of Artificial Sequence: Synthetic oligonucleotide
ccagtcttacggtccctctggccagtt

SEQ ID NO: 395546 - DNA, 27 bp, Artificial Sequence
  Description of Artificial Sequence: Synthetic oligonucleotide
cagtcttacggtccctctggccagttc

SEQ ID NO: 395547 - DNA, 28 bp, Artificial Sequence
  Description of Artificial Sequence: Synthetic oligonucleotide
agtcttacggtccctctggccagttcac

SEQ ID NO: 395548 - DNA, 27 bp, Artificial Sequence
  Description of Artificial Sequence: Synthetic oligonucleotide
gtcttacggtccctctggccagttcac

SEQ ID NO: 395549 - DNA, 27 bp, Artificial Sequence
  Description of Artificial Sequence: Synthetic oligonucleotide
tcttacggtccctctggccagttcacc

SEQ ID NO: 395550 - DNA, 26 bp, Artificial Sequence
  Description of Artificial Sequence: Synthetic oligonucleotide
cttacggtccctctggccagttcacc

SEQ ID NO: 395551 - DNA, 33 bp, Artificial Sequence; identical to SEQ ID NO: 56358
  Description of Artificial Sequence: Synthetic oligonucleotide

SEQ ID NO: 395552 - DNA, 32 bp, Artificial Sequence; identical to SEQ ID NO: 56359
  Description of Artificial Sequence: Synthetic oligonucleotide

SEQ ID NO: 395553 - DNA, 32 bp, Artificial Sequence; identical to SEQ ID NO: 56360
  Description of Artificial Sequence: Synthetic oligonucleotide

SEQ ID NO: 395554 - DNA, 31 bp, Artificial Sequence; identical to SEQ ID NO: 56361
  Description of Artificial Sequence: Synthetic oligonucleotide

SEQ ID NO: 395555 - DNA, 32 bp, Artificial Sequence; identical to SEQ ID NO: 56362
  Description of Artificial Sequence: Synthetic oligonucleotide

SEQ ID NO: 395556 - DNA, 32 bp, Artificial Sequence; identical to SEQ ID NO: 56363
  Description of Artificial Sequence: Synthetic oligonucleotide

SEQ ID NO: 395557 - DNA, 33 bp, Artificial Sequence; identical to SEQ ID NO: 56364
  Description of Artificial Sequence: Synthetic oligonucleotide

SEQ ID NO: 395558 - DNA, 35 bp, Artificial Sequence; identical to SEQ ID NO: 56365
  Description of Artificial Sequence: Synthetic oligonucleotide

SEQ ID NO: 395559 - DNA, 34 bp, Artificial Sequence; identical to SEQ ID NO: 56366
  Description of Artificial Sequence: Synthetic oligonucleotide

SEQ ID NO: 395560 - DNA, 37 bp, Artificial Sequence; identical to SEQ ID NO: 56367
  Description of Artificial Sequence: Synthetic oligonucleotide

SEQ ID NO: 395561 - DNA, 36 bp, Artificial Sequence; identical to SEQ ID NO: 56368
  Description of Artificial Sequence: Synthetic oligonucleotide

SEQ ID NO: 395562 - DNA, 35 bp, Artificial Sequence; identical to SEQ ID NO: 56369
  Description of Artificial Sequence: Synthetic oligonucleotide

SEQ ID NO: 395563 - DNA, 36 bp, Artificial Sequence; identical to SEQ ID NO: 56370
  Description of Artificial Sequence: Synthetic oligonucleotide

SEQ ID NO: 395564 - DNA, 35 bp, Artificial Sequence; identical to SEQ ID NO: 56371
  Description of Artificial Sequence: Synthetic oligonucleotide

SEQ ID NO: 395565 - DNA, 35 bp, Artificial Sequence; identical to SEQ ID NO: 56372
  Description of Artificial Sequence: Synthetic oligonucleotide

SEQ ID NO: 395566 - DNA, 36 bp, Artificial Sequence; identical to SEQ ID NO: 56373
  Description of Artificial Sequence: Synthetic oligonucleotide

SEQ ID NO: 395567 - DNA, 36 bp, Artificial Sequence; identical to SEQ ID NO: 56374
  Description of Artificial Sequence: Synthetic oligonucleotide

SEQ ID NO: 395568 - DNA, 35 bp, Artificial Sequence; identical to SEQ ID NO: 56375
  Description of Artificial Sequence: Synthetic oligonucleotide

SEQ ID NO: 395569 - DNA, 34 bp, Artificial Sequence; identical to SEQ ID NO: 56376
  Description of Artificial Sequence: Synthetic oligonucleotide

SEQ ID NO: 395570 - DNA, 35 bp, Artificial Sequence; identical to SEQ ID NO: 56377
  Description of Artificial Sequence: Synthetic oligonucleotide

SEQ ID NO: 395571 - DNA, 34 bp, Artificial Sequence; identical to SEQ ID NO: 56378
  Description of Artificial Sequence: Synthetic oligonucleotide

SEQ ID NO: 395572 - DNA, 33 bp, Artificial Sequence; identical to SEQ ID NO: 56379
  Description of Artificial Sequence: Synthetic oligonucleotide

SEQ ID NO: 395573 - DNA, 32 bp, Artificial Sequence; identical to SEQ ID NO: 56380
  Description of Artificial Sequence: Synthetic oligonucleotide

SEQ ID NO: 395574 - DNA, 31 bp, Artificial Sequence; identical to SEQ ID NO: 56381
  Description of Artificial Sequence: Synthetic oligonucleotide

SEQ ID NO: 395575 - DNA, 30 bp, Artificial Sequence; identical to SEQ ID NO: 56382
  Description of Artificial Sequence: Synthetic oligonucleotide

SEQ ID NO: 395576 - DNA, 30 bp, Artificial Sequence; identical to SEQ ID NO: 56383
  Description of Artificial Sequence: Synthetic oligonucleotide

SEQ ID NO: 395577 - DNA, 29 bp, Artificial Sequence
  Description of Artificial Sequence: Synthetic oligonucleotide
tggagacgaggagttctatgtggacctgg

SEQ ID NO: 395578 - DNA, 28 bp, Artificial Sequence
  Description of Artificial Sequence: Synthetic oligonucleotide
ggagacgaggagttctatgtggacctgg

SEQ ID NO: 395579 - DNA, 29 bp, Artificial Sequence
  Description of Artificial Sequence: Synthetic oligonucleotide
gagacgaggagttctatgtggacctggag

SEQ ID NO: 395580 - DNA, 30 bp, Artificial Sequence; identical to SEQ ID NO: 56387
  Description of Artificial Sequence: Synthetic oligonucleotide

SEQ ID NO: 395581 - DNA, 29 bp, Artificial Sequence
  Description of Artificial Sequence: Synthetic oligonucleotide
gacgaggagttctatgtggacctggagag

SEQ ID NO: 395582 - DNA, 29 bp, Artificial Sequence
  Description of Artificial Sequence: Synthetic oligonucleotide
acgaggagttctatgtggacctggagagg

SEQ ID NO: 395583 - DNA, 28 bp, Artificial Sequence
  Description of Artificial Sequence: Synthetic oligonucleotide
cgaggagttctatgtggacctggagagg

SEQ ID NO: 395584 - DNA, 30 bp, Artificial Sequence; identical to SEQ ID NO: 56391
  Description of Artificial Sequence: Synthetic oligonucleotide

SEQ ID NO: 395585 - DNA, 30 bp, Artificial Sequence; identical to SEQ ID NO: 56392
  Description of Artificial Sequence: Synthetic oligonucleotide

SEQ ID NO: 395586 - DNA, 29 bp, Artificial Sequence
  Description of Artificial Sequence: Synthetic oligonucleotide
ggagttctatgtggacctggagaggaagg

SEQ ID NO: 395587 - DNA, 30 bp, Artificial Sequence; identical to SEQ ID NO: 56394
  Description of Artificial Sequence: Synthetic oligonucleotide

SEQ ID NO: 395588 - DNA, 31 bp, Artificial Sequence; identical to SEQ ID NO: 56395
  Description of Artificial Sequence: Synthetic oligonucleotide

SEQ ID NO: 395589 - DNA, 30 bp, Artificial Sequence; identical to SEQ ID NO: 56396
  Description of Artificial Sequence: Synthetic oligonucleotide

SEQ ID NO: 395590 - DNA, 31 bp, Artificial Sequence; identical to SEQ ID NO: 56397
  Description of Artificial Sequence: Synthetic oligonucleotide

SEQ ID NO: 395591 - DNA, 30 bp, Artificial Sequence; identical to SEQ ID NO: 56398
  Description of Artificial Sequence: Synthetic oligonucleotide

SEQ ID NO: 395592 - DNA, 29 bp, Artificial Sequence
  Description of Artificial Sequence: Synthetic oligonucleotide
ctatgtggacctggagaggaaggagactg

SEQ ID NO: 395593 - DNA, 30 bp, Artificial Sequence; identical to SEQ ID NO: 56400
  Description of Artificial Sequence: Synthetic oligonucleotide

SEQ ID NO: 395594 - DNA, 29 bp, Artificial Sequence
  Description of Artificial Sequence: Synthetic oligonucleotide
atgtggacctggagaggaaggagactgtc

SEQ ID NO: 395595 - DNA, 28 bp, Artificial Sequence
  Description of Artificial Sequence: Synthetic oligonucleotide
tgtggacctggagaggaaggagactgtc

SEQ ID NO: 395596 - DNA, 27 bp, Artificial Sequence
  Description of Artificial Sequence: Synthetic oligonucleotide
gtggacctggagaggaaggagactgtc

SEQ ID NO: 395597 - DNA, 28 bp, Artificial Sequence
  Description of Artificial Sequence: Synthetic oligonucleotide
tggacctggagaggaaggagactgtctg

SEQ ID NO: 395598 - DNA, 27 bp, Artificial Sequence
  Description of Artificial Sequence: Synthetic oligonucleotide
ggacctggagaggaaggagactgtctg

SEQ ID NO: 395599 - DNA, 27 bp, Artificial Sequence
  Description of Artificial Sequence: Synthetic oligonucleotide
gacctggagaggaaggagactgtctgg

SEQ ID NO: 395600 - DNA, 29 bp, Artificial Sequence
  Description of Artificial Sequence: Synthetic oligonucleotide
acctggagaggaaggagactgtctggaag

SEQ ID NO: 395601 - DNA, 28 bp, Artificial Sequence
  Description of Artificial Sequence: Synthetic oligonucleotide
cctggagaggaaggagactgtctggaag

SEQ ID NO: 395602 - DNA, 30 bp, Artificial Sequence; identical to SEQ ID NO: 56409
  Description of Artificial Sequence: Synthetic oligonucleotide

SEQ ID NO: 395603 - DNA, 30 bp, Artificial Sequence; identical to SEQ ID NO: 56410
  Description of Artificial Sequence: Synthetic oligonucleotide

SEQ ID NO: 395604 - DNA, 29 bp, Artificial Sequence
  Description of Artificial Sequence: Synthetic oligonucleotide
ggagaggaaggagactgtctggaagttgc

SEQ ID NO: 395605 - DNA, 29 bp, Artificial Sequence
  Description of Artificial Sequence: Synthetic oligonucleotide
gagaggaaggagactgtctggaagttgcc

SEQ ID NO: 395606 - DNA, 30 bp, Artificial Sequence; identical to SEQ ID NO: 56413
  Description of Artificial Sequence: Synthetic oligonucleotide

SEQ ID NO: 395607 - DNA, 29 bp, Artificial Sequence
  Description of Artificial Sequence: Synthetic oligonucleotide
gaggaaggagactgtctggaagttgcctc

SEQ ID NO: 395608 - DNA, 30 bp, Artificial Sequence; identical to SEQ ID NO: 56415
  Description of Artificial Sequence: Synthetic oligonucleotide

SEQ ID NO: 395609 - DNA, 29 bp, Artificial Sequence
  Description of Artificial Sequence: Synthetic oligonucleotide
ggaaggagactgtctggaagttgcctctg

SEQ ID NO: 395610 - DNA, 31 bp, Artificial Sequence; identical to SEQ ID NO: 56417
  Description of Artificial Sequence: Synthetic oligonucleotide

SEQ ID NO: 395611 - DNA, 31 bp, Artificial Sequence; identical to SEQ ID NO: 56418
  Description of Artificial Sequence: Synthetic oligonucleotide

SEQ ID NO: 395612 - DNA, 30 bp, Artificial Sequence; identical to SEQ ID NO: 56419
  Description of Artificial Sequence: Synthetic oligonucleotide

SEQ ID NO: 395613 - DNA, 29 bp, Artificial Sequence
  Description of Artificial Sequence: Synthetic oligonucleotide
ggagactgtctggaagttgcctctgttcc

SEQ ID NO: 395614 - DNA, 30 bp, Artificial Sequence; identical to SEQ ID NO: 56421
  Description of Artificial Sequence: Synthetic oligonucleotide

SEQ ID NO: 395615 - DNA, 31 bp, Artificial Sequence; identical to SEQ ID NO: 56422
  Description of Artificial Sequence: Synthetic oligonucleotide

SEQ ID NO: 395616 - DNA, 30 bp, Artificial Sequence; identical to SEQ ID NO: 56423
  Description of Artificial Sequence: Synthetic oligonucleotide

SEQ ID NO: 395617 - DNA, 31 bp, Artificial Sequence; identical to SEQ ID NO: 56424
  Description of Artificial Sequence: Synthetic oligonucleotide

SEQ ID NO: 395618 - DNA, 30 bp, Artificial Sequence; identical to SEQ ID NO: 56425
  Description of Artificial Sequence: Synthetic oligonucleotide

SEQ ID NO: 395619 - DNA, 33 bp, Artificial Sequence; identical to SEQ ID NO: 56426
  Description of Artificial Sequence: Synthetic oligonucleotide

SEQ ID NO: 395620 - DNA, 32 bp, Artificial Sequence; identical to SEQ ID NO: 56427
  Description of Artificial Sequence: Synthetic oligonucleotide

SEQ ID NO: 395621 - DNA, 36 bp, Artificial Sequence; identical to SEQ ID NO: 56428
  Description of Artificial Sequence: Synthetic oligonucleotide

SEQ ID NO: 395622 - DNA, 35 bp, Artificial Sequence; identical to SEQ ID NO: 56429
  Description of Artificial Sequence: Synthetic oligonucleotide

SEQ ID NO: 395623 - DNA, 36 bp, Artificial Sequence; identical to SEQ ID NO: 56430
  Description of Artificial Sequence: Synthetic oligonucleotide

SEQ ID NO: 395624 - DNA, 35 bp, Artificial Sequence; identical to SEQ ID NO: 56431
  Description of Artificial Sequence: Synthetic oligonucleotide

SEQ ID NO: 395625 - DNA, 35 bp, Artificial Sequence; identical to SEQ ID NO: 56432
  Description of Artificial Sequence: Synthetic oligonucleotide

SEQ ID NO: 395626 - DNA, 35 bp, Artificial Sequence; identical to SEQ ID NO: 56433
  Description of Artificial Sequence: Synthetic oligonucleotide

SEQ ID NO: 395627 - DNA, 34 bp, Artificial Sequence; identical to SEQ ID NO: 56434
  Description of Artificial Sequence: Synthetic oligonucleotide

SEQ ID NO: 395628 - DNA, 33 bp, Artificial Sequence; identical to SEQ ID NO: 56435
  Description of Artificial Sequence: Synthetic oligonucleotide

SEQ ID NO: 395629 - DNA, 33 bp, Artificial Sequence; identical to SEQ ID NO: 56436
  Description of Artificial Sequence: Synthetic oligonucleotide

SEQ ID NO: 395630 - DNA, 32 bp, Artificial Sequence; identical to SEQ ID NO: 56437
  Description of Artificial Sequence: Synthetic oligonucleotide

SEQ ID NO: 395631 - DNA, 31 bp, Artificial Sequence; identical to SEQ ID NO: 56438
  Description of Artificial Sequence: Synthetic oligonucleotide

SEQ ID NO: 395632 - DNA, 31 bp, Artificial Sequence; identical to SEQ ID NO: 56439
  Description of Artificial Sequence: Synthetic oligonucleotide

SEQ ID NO: 395633 - DNA, 36 bp, Artificial Sequence; identical to SEQ ID NO: 56440
  Description of Artificial Sequence: Synthetic oligonucleotide

SEQ ID NO: 395634 - DNA, 36 bp, Artificial Sequence; identical to SEQ ID NO: 56441
  Description of Artificial Sequence: Synthetic oligonucleotide

SEQ ID NO: 395635 - DNA, 35 bp, Artificial Sequence; identical to SEQ ID NO: 56442
  Description of Artificial Sequence: Synthetic oligonucleotide

SEQ ID NO: 395636 - DNA, 36 bp, Artificial Sequence; identical to SEQ ID NO: 56443
  Description of Artificial Sequence: Synthetic oligonucleotide

SEQ ID NO: 395637 - DNA, 35 bp, Artificial Sequence; identical to SEQ ID NO: 56444
  Description of Artificial Sequence: Synthetic oligonucleotide

SEQ ID NO: 395638 - DNA, 36 bp, Artificial Sequence; identical to SEQ ID NO: 56445
  Description of Artificial Sequence: Synthetic oligonucleotide

SEQ ID NO: 395639 - DNA, 35 bp, Artificial Sequence; identical to SEQ ID NO: 56446
  Description of Artificial Sequence: Synthetic oligonucleotide

SEQ ID NO: 395640 - DNA, 34 bp, Artificial Sequence; identical to SEQ ID NO: 56447
  Description of Artificial Sequence: Synthetic oligonucleotide

SEQ ID NO: 395641 - DNA, 35 bp, Artificial Sequence; identical to SEQ ID NO: 56448
  Description of Artificial Sequence: Synthetic oligonucleotide

SEQ ID NO: 395642 - DNA, 38 bp, Artificial Sequence; identical to SEQ ID NO: 56449
  Description of Artificial Sequence: Synthetic oligonucleotide

SEQ ID NO: 395643 - DNA, 37 bp, Artificial Sequence; identical to SEQ ID NO: 56450
  Description of Artificial Sequence: Synthetic oligonucleotide

SEQ ID NO: 395644 - DNA, 39 bp, Artificial Sequence; identical to SEQ ID NO: 56451
  Description of Artificial Sequence: Synthetic oligonucleotide

SEQ ID NO: 395645 - DNA, 38 bp, Artificial Sequence; identical to SEQ ID NO: 56452
  Description of Artificial Sequence: Synthetic oligonucleotide

SEQ ID NO: 395646 - DNA, 38 bp, Artificial Sequence; identical to SEQ ID NO: 56453
  Description of Artificial Sequence: Synthetic oligonucleotide

SEQ ID NO: 395647 - DNA, 37 bp, Artificial Sequence; identical to SEQ ID NO: 56454
  Description of Artificial Sequence: Synthetic oligonucleotide

SEQ ID NO: 395648 - DNA, 37 bp, Artificial Sequence; identical to SEQ ID NO: 56455
  Description of Artificial Sequence: Synthetic oligonucleotide

SEQ ID NO: 395649 - DNA, 36 bp, Artificial Sequence; identical to SEQ ID NO: 56456
  Description of Artificial Sequence: Synthetic oligonucleotide

SEQ ID NO: 395650 - DNA, 35 bp, Artificial Sequence; identical to SEQ ID NO: 56457
  Description of Artificial Sequence: Synthetic oligonucleotide

SEQ ID NO: 395651 - DNA, 34 bp, Artificial Sequence; identical to SEQ ID NO: 56458
  Description of Artificial Sequence: Synthetic oligonucleotide

SEQ ID NO: 395652 - DNA, 35 bp, Artificial Sequence; identical to SEQ ID NO: 56459
  Description of Artificial Sequence: Synthetic oligonucleotide

SEQ ID NO: 395653 - DNA, 34 bp, Artificial Sequence; identical to SEQ ID NO: 56460
  Description of Artificial Sequence: Synthetic oligonucleotide

SEQ ID NO: 395654 - DNA, 33 bp, Artificial Sequence; identical to SEQ ID NO: 56461
  Description of Artificial Sequence: Synthetic oligonucleotide

SEQ ID NO: 395655 - DNA, 32 bp, Artificial Sequence; identical to SEQ ID NO: 56462
  Description of Artificial Sequence: Synthetic oligonucleotide

SEQ ID NO: 395656 - DNA, 31 bp, Artificial Sequence; identical to SEQ ID NO: 56463
  Description of Artificial Sequence: Synthetic oligonucleotide

SEQ ID NO: 395657 - DNA, 32 bp, Artificial Sequence; identical to SEQ ID NO: 56464
  Description of Artificial Sequence: Synthetic oligonucleotide

SEQ ID NO: 395658 - DNA, 31 bp, Artificial Sequence; identical to SEQ ID NO: 56465
  Description of Artificial Sequence: Synthetic oligonucleotide

SEQ ID NO: 395659 - DNA, 31 bp, Artificial Sequence; identical to SEQ ID NO: 56466
  Description of Artificial Sequence: Synthetic oligonucleotide

SEQ ID NO: 395660 - DNA, 36 bp, Artificial Sequence; identical to SEQ ID NO: 56467
  Description of Artificial Sequence: Synthetic oligonucleotide

SEQ ID NO: 395661 - DNA, 40 bp, Artificial Sequence; identical to SEQ ID NO: 56468
  Description of Artificial Sequence: Synthetic oligonucleotide

SEQ ID NO: 395662 - DNA, 42 bp, Artificial Sequence; identical to SEQ ID NO: 56469
  Description of Artificial Sequence: Synthetic oligonucleotide

SEQ ID NO: 395663 - DNA, 44 bp, Artificial Sequence; identical to SEQ ID NO: 56470
  Description of Artificial Sequence: Synthetic oligonucleotide

SEQ ID NO: 395664 - DNA, 43 bp, Artificial Sequence; identical to SEQ ID NO: 56471
  Description of Artificial Sequence: Synthetic oligonucleotide

SEQ ID NO: 395665 - DNA, 42 bp, Artificial Sequence; identical to SEQ ID NO: 56472
  Description of Artificial Sequence: Synthetic oligonucleotide

SEQ ID NO: 395666 - DNA, 41 bp, Artificial Sequence; identical to SEQ ID NO: 56473
  Description of Artificial Sequence: Synthetic oligonucleotide

SEQ ID NO: 395667 - DNA, 40 bp, Artificial Sequence; identical to SEQ ID NO: 56474
  Description of Artificial Sequence: Synthetic oligonucleotide

SEQ ID NO: 395668 - DNA, 39 bp, Artificial Sequence; identical to SEQ ID NO: 56475
  Description of Artificial Sequence: Synthetic oligonucleotide

SEQ ID NO: 395669 - DNA, 41 bp, Artificial Sequence; identical to SEQ ID NO: 56476
  Description of Artificial Sequence: Synthetic oligonucleotide

SEQ ID NO: 395670 - DNA, 41 bp, Artificial Sequence; identical to SEQ ID NO: 56477
  Description of Artificial Sequence: Synthetic oligonucleotide

SEQ ID NO: 395671 - DNA, 40 bp, Artificial Sequence; identical to SEQ ID NO: 56478
  Description of Artificial Sequence: Synthetic oligonucleotide

SEQ ID NO: 395672 - DNA, 41 bp, Artificial Sequence; identical to SEQ ID NO: 56479
  Description of Artificial Sequence: Synthetic oligonucleotide

SEQ ID NO: 395673 - DNA, 40 bp, Artificial Sequence; identical to SEQ ID NO: 56480
  Description of Artificial Sequence: Synthetic oligonucleotide

SEQ ID NO: 395674 - DNA, 46 bp, Artificial Sequence; identical to SEQ ID NO: 56481
  Description of Artificial Sequence: Synthetic oligonucleotide

SEQ ID NO: 395675 - DNA, 45 bp, Artificial Sequence; identical to SEQ ID NO: 56482
  Description of Artificial Sequence: Synthetic oligonucleotide

SEQ ID NO: 395676 - DNA, 45 bp, Artificial Sequence; identical to SEQ ID NO: 56483
  Description of Artificial Sequence: Synthetic oligonucleotide

SEQ ID NO: 395677 - DNA, 44 bp, Artificial Sequence; identical to SEQ ID NO: 56484
  Description of Artificial Sequence: Synthetic oligonucleotide

SEQ ID NO: 395678 - DNA, 43 bp, Artificial Sequence; identical to SEQ ID NO: 56485
  Description of Artificial Sequence: Synthetic oligonucleotide

SEQ ID NO: 395679 - DNA, 42 bp, Artificial Sequence; identical to SEQ ID NO: 56486
  Description of Artificial Sequence: Synthetic oligonucleotide

SEQ ID NO: 395680 - DNA, 42 bp, Artificial Sequence; identical to SEQ ID NO: 56487
  Description of Artificial Sequence: Synthetic oligonucleotide

SEQ ID NO: 395681 - DNA, 41 bp, Artificial Sequence; identical to SEQ ID NO: 56488
  Description of Artificial Sequence: Synthetic oligonucleotide

SEQ ID NO: 395682 - DNA, 40 bp, Artificial Sequence; identical to SEQ ID NO: 56489
  Description of Artificial Sequence: Synthetic oligonucleotide

SEQ ID NO: 395683 - DNA, 41 bp, Artificial Sequence; identical to SEQ ID NO: 56490
  Description of Artificial Sequence: Synthetic oligonucleotide

SEQ ID NO: 395684 - DNA, 41 bp, Artificial Sequence; identical to SEQ ID NO: 56491
  Description of Artificial Sequence: Synthetic oligonucleotide

SEQ ID NO: 395685 - DNA, 43 bp, Artificial Sequence; identical to SEQ ID NO: 56492
  Description of Artificial Sequence: Synthetic oligonucleotide

SEQ ID NO: 395686 - DNA, 42 bp, Artificial Sequence; identical to SEQ ID NO: 56493
  Description of Artificial Sequence: Synthetic oligonucleotide

SEQ ID NO: 395687 - DNA, 43 bp, Artificial Sequence; identical to SEQ ID NO: 56494
  Description of Artificial Sequence: Synthetic oligonucleotide

SEQ ID NO: 395688 - DNA, 42 bp, Artificial Sequence; identical to SEQ ID NO: 56495
  Description of Artificial Sequence: Synthetic oligonucleotide

SEQ ID NO: 395689 - DNA, 44 bp, Artificial Sequence; identical to SEQ ID NO: 56496
  Description of Artificial Sequence: Synthetic oligonucleotide

SEQ ID NO: 395690 - DNA, 44 bp, Artificial Sequence; identical to SEQ ID NO: 56497
  Description of Artificial Sequence: Synthetic oligonucleotide

SEQ ID NO: 395691 - DNA, 43 bp, Artificial Sequence; identical to SEQ ID NO: 56498
  Description of Artificial Sequence: Synthetic oligonucleotide

SEQ ID NO: 395692 - DNA, 42 bp, Artificial Sequence; identical to SEQ ID NO: 56499
  Description of Artificial Sequence: Synthetic oligonucleotide

SEQ ID NO: 395693 - DNA, 41 bp, Artificial Sequence; identical to SEQ ID NO: 56500
  Description of Artificial Sequence: Synthetic oligonucleotide

SEQ ID NO: 395694 - DNA, 40 bp, Artificial Sequence; identical to SEQ ID NO: 56501
  Description of Artificial Sequence: Synthetic oligonucleotide

SEQ ID NO: 395695 - DNA, 39 bp, Artificial Sequence; identical to SEQ ID NO: 56502
  Description of Artificial Sequence: Synthetic oligonucleotide

SEQ ID NO: 395696 - DNA, 39 bp, Artificial Sequence; identical to SEQ ID NO: 56503
  Description of Artificial Sequence: Synthetic oligonucleotide

SEQ ID NO: 395697 - DNA, 38 bp, Artificial Sequence; identical to SEQ ID NO: 56504
  Description of Artificial Sequence: Synthetic oligonucleotide

SEQ ID NO: 395698 - DNA, 37 bp, Artificial Sequence; identical to SEQ ID NO: 56505
  Description of Artificial Sequence: Synthetic oligonucleotide

SEQ ID NO: 395699 - DNA, 36 bp, Artificial Sequence; identical to SEQ ID NO: 56506
  Description of Artificial Sequence: Synthetic oligonucleotide

SEQ ID NO: 395700 - DNA, 35 bp, Artificial Sequence; identical to SEQ ID NO: 56507
  Description of Artificial Sequence: Synthetic oligonucleotide

SEQ ID NO: 395701 - DNA, 35 bp, Artificial Sequence; identical to SEQ ID NO: 56508
  Description of Artificial Sequence: Synthetic oligonucleotide

SEQ ID NO: 395702 - DNA, 34 bp, Artificial Sequence; identical to SEQ ID NO: 56509
  Description of Artificial Sequence: Synthetic oligonucleotide

SEQ ID NO: 395703 - DNA, 33 bp, Artificial Sequence; identical to SEQ ID NO: 56510
  Description of Artificial Sequence: Synthetic oligonucleotide

SEQ ID NO: 395704 - DNA, 34 bp, Artificial Sequence; identical to SEQ ID NO: 56511
  Description of Artificial Sequence: Synthetic oligonucleotide

SEQ ID NO: 395705 - DNA, 33 bp, Artificial Sequence; identical to SEQ ID NO: 56512
  Description of Artificial Sequence: Synthetic oligonucleotide

SEQ ID NO: 395706 - DNA, 32 bp, Artificial Sequence; identical to SEQ ID NO: 56513
  Description of Artificial Sequence: Synthetic oligonucleotide

SEQ ID NO: 395707 - DNA, 32 bp, Artificial Sequence; identical to SEQ ID NO: 56514
  Description of Artificial Sequence: Synthetic oligonucleotide

SEQ ID NO: 395708 - DNA, 31 bp, Artificial Sequence; identical to SEQ ID NO: 56515
  Description of Artificial Sequence: Synthetic oligonucleotide

SEQ ID NO: 395709 - DNA, 30 bp, Artificial Sequence; identical to SEQ ID NO: 56516
  Description of Artificial Sequence: Synthetic oligonucleotide

SEQ ID NO: 395710 - DNA, 32 bp, Artificial Sequence; identical to SEQ ID NO: 56517
  Description of Artificial Sequence: Synthetic oligonucleotide

SEQ ID NO: 395711 - DNA, 32 bp, Artificial Sequence; identical to SEQ ID NO: 56518
  Description of Artificial Sequence: Synthetic oligonucleotide

SEQ ID NO: 395712 - DNA, 31 bp, Artificial Sequence; identical to SEQ ID NO: 56519
  Description of Artificial Sequence: Synthetic oligonucleotide

SEQ ID NO: 395713 - DNA, 34 bp, Artificial Sequence; identical to SEQ ID NO: 56520
  Description of Artificial Sequence: Synthetic oligonucleotide

SEQ ID NO: 395714 - DNA, 33 bp, Artificial Sequence; identical to SEQ ID NO: 56521
  Description of Artificial Sequence: Synthetic oligonucleotide

SEQ ID NO: 395715 - DNA, 32 bp, Artificial Sequence; identical to SEQ ID NO: 56522
  Description of Artificial Sequence: Synthetic oligonucleotide

SEQ ID NO: 395716 - DNA, 31 bp, Artificial Sequence; identical to SEQ ID NO: 56523
  Description of Artificial Sequence: Synthetic oligonucleotide

SEQ ID NO: 395717 - DNA, 30 bp, Artificial Sequence; identical to SEQ ID NO: 56524
  Description of Artificial Sequence: Synthetic oligonucleotide

SEQ ID NO: 395718 - DNA, 29 bp, Artificial Sequence
  Description of Artificial Sequence: Synthetic oligonucleotide
acgctccaactctaccgctgctaccaatg

SEQ ID NO: 395719 - DNA, 28 bp, Artificial Sequence
  Description of Artificial Sequence: Synthetic oligonucleotide
cgctccaactctaccgctgctaccaatg

SEQ ID NO: 395720 - DNA, 29 bp, Artificial Sequence
  Description of Artificial Sequence: Synthetic oligonucleotide
gctccaactctaccgctgctaccaatgag

SEQ ID NO: 395721 - DNA, 29 bp, Artificial Sequence
  Description of Artificial Sequence: Synthetic oligonucleotide
ctccaactctaccgctgctaccaatgagg

SEQ ID NO: 395722 - DNA, 31 bp, Artificial Sequence; identical to SEQ ID NO: 56529
  Description of Artificial Sequence: Synthetic oligonucleotide

SEQ ID NO: 395723 - DNA, 30 bp, Artificial Sequence; identical to SEQ ID NO: 56530
  Description of Artificial Sequence: Synthetic oligonucleotide

SEQ ID NO: 395724 - DNA, 29 bp, Artificial Sequence
  Description of Artificial Sequence: Synthetic oligonucleotide
tcaacatcacctggctgagcaatgggcac

SEQ ID NO: 395725 - DNA, 28 bp, Artificial Sequence
  Description of Artificial Sequence: Synthetic oligonucleotide
caacatcacctggctgagcaatgggcac

SEQ ID NO: 395726 - DNA, 29 bp, Artificial Sequence
  Description of Artificial Sequence: Synthetic oligonucleotide
aacatcacctggctgagcaatgggcactc

SEQ ID NO: 395727 - DNA, 28 bp, Artificial Sequence
  Description of Artificial Sequence: Synthetic oligonucleotide
acatcacctggctgagcaatgggcactc

SEQ ID NO: 395728 - DNA, 27 bp, Artificial Sequence
  Description of Artificial Sequence: Synthetic oligonucleotide
catcacctggctgagcaatgggcactc

SEQ ID NO: 395729 - DNA, 28 bp, Artificial Sequence
  Description of Artificial Sequence: Synthetic oligonucleotide
atcacctggctgagcaatgggcactcag

SEQ ID NO: 395730 - DNA, 27 bp, Artificial Sequence
  Description of Artificial Sequence: Synthetic oligonucleotide
tcacctggctgagcaatgggcactcag

SEQ ID NO: 395731 - DNA, 27 bp, Artificial Sequence
  Description of Artificial Sequence: Synthetic oligonucleotide
cacctggctgagcaatgggcactcagt

SEQ ID NO: 395732 - DNA, 27 bp, Artificial Sequence
  Description of Artificial Sequence: Synthetic oligonucleotide
acctggctgagcaatgggcactcagtc

SEQ ID NO: 395733 - DNA, 27 bp, Artificial Sequence
  Description of Artificial Sequence: Synthetic oligonucleotide
cctggctgagcaatgggcactcagtca

SEQ ID NO: 395734 - DNA, 27 bp, Artificial Sequence
  Description of Artificial Sequence: Synthetic oligonucleotide
ctggctgagcaatgggcactcagtcac

SEQ ID NO: 395735 - DNA, 28 bp, Artificial Sequence
  Description of Artificial Sequence: Synthetic oligonucleotide
tggctgagcaatgggcactcagtcacag

SEQ ID NO: 395736 - DNA, 27 bp, Artificial Sequence
  Description of Artificial Sequence: Synthetic oligonucleotide
ggctgagcaatgggcactcagtcacag

SEQ ID NO: 395737 - DNA, 29 bp, Artificial Sequence
  Description of Artificial Sequence: Synthetic oligonucleotide
gctgagcaatgggcactcagtcacagaag

SEQ ID NO: 395738 - DNA, 29 bp, Artificial Sequence
  Description of Artificial Sequence: Synthetic oligonucleotide
ctgagcaatgggcactcagtcacagaagg

SEQ ID NO: 395739 - DNA, 30 bp, Artificial Sequence; identical to SEQ ID NO: 56546
  Description of Artificial Sequence: Synthetic oligonucleotide

SEQ ID NO: 395740 - DNA, 29 bp, Artificial Sequence
  Description of Artificial Sequence: Synthetic oligonucleotide
gagcaatgggcactcagtcacagaaggtg

SEQ ID NO: 395741 - DNA, 32 bp, Artificial Sequence; identical to SEQ ID NO: 56548
  Description of Artificial Sequence: Synthetic oligonucleotide

SEQ ID NO: 395742 - DNA, 31 bp, Artificial Sequence; identical to SEQ ID NO: 56549
  Description of Artificial Sequence: Synthetic oligonucleotide

SEQ ID NO: 395743 - DNA, 32 bp, Artificial Sequence; identical to SEQ ID NO: 56550
  Description of Artificial Sequence: Synthetic oligonucleotide

SEQ ID NO: 395744 - DNA, 33 bp, Artificial Sequence; identical to SEQ ID NO: 56551
  Description of Artificial Sequence: Synthetic oligonucleotide

SEQ ID NO: 395745 - DNA, 32 bp, Artificial Sequence; identical to SEQ ID NO: 56552
  Description of Artificial Sequence: Synthetic oligonucleotide

SEQ ID NO: 395746 - DNA, 31 bp, Artificial Sequence; identical to SEQ ID NO: 56553
  Description of Artificial Sequence: Synthetic oligonucleotide

SEQ ID NO: 395747 - DNA, 30 bp, Artificial Sequence; identical to SEQ ID NO: 56554
  Description of Artificial Sequence: Synthetic oligonucleotide

SEQ ID NO: 395748 - DNA, 31 bp, Artificial Sequence; identical to SEQ ID NO: 56555
  Description of Artificial Sequence: Synthetic oligonucleotide

SEQ ID NO: 395749 - DNA, 31 bp, Artificial Sequence; identical to SEQ ID NO: 56556
  Description of Artificial Sequence: Synthetic oligonucleotide

SEQ ID NO: 395750 - DNA, 32 bp, Artificial Sequence; identical to SEQ ID NO: 56557
  Description of Artificial Sequence: Synthetic oligonucleotide

SEQ ID NO: 395751 - DNA, 32 bp, Artificial Sequence; identical to SEQ ID NO: 56558
  Description of Artificial Sequence: Synthetic oligonucleotide

SEQ ID NO: 395752 - DNA, 31 bp, Artificial Sequence; identical to SEQ ID NO: 56559
  Description of Artificial Sequence: Synthetic oligonucleotide

SEQ ID NO: 395753 - DNA, 25 bp, Artificial Sequence
  Description of Artificial Sequence: Synthetic oligonucleotide
caaggtggagcactggggcctggat

SEQ ID NO: 395754 - DNA, 26 bp, Artificial Sequence
  Description of Artificial Sequence: Synthetic oligonucleotide
aaggtggagcactggggcctggatga

SEQ ID NO: 395755 - DNA, 25 bp, Artificial Sequence
  Description of Artificial Sequence: Synthetic oligonucleotide
aggtggagcactggggcctggatga

SEQ ID NO: 395756 - DNA, 24 bp, Artificial Sequence
  Description of Artificial Sequence: Synthetic oligonucleotide
ggtggagcactggggcctggatga

SEQ ID NO: 395757 - DNA, 24 bp, Artificial Sequence
  Description of Artificial Sequence: Synthetic oligonucleotide
gtggagcactggggcctggatgag

SEQ ID NO: 395758 - DNA, 24 bp, Artificial Sequence
  Description of Artificial Sequence: Synthetic oligonucleotide
tggagcactggggcctggatgagc

SEQ ID NO: 395759 - DNA, 23 bp, Artificial Sequence
  Description of Artificial Sequence: Synthetic oligonucleotide
ggagcactggggcctggatgagc

SEQ ID NO: 395760 - DNA, 24 bp, Artificial Sequence
  Description of Artificial Sequence: Synthetic oligonucleotide
gagcactggggcctggatgagcct

SEQ ID NO: 395761 - DNA, 26 bp, Artificial Sequence
  Description of Artificial Sequence: Synthetic oligonucleotide
agcactggggcctggatgagcctctt

SEQ ID NO: 395762 - DNA, 25 bp, Artificial Sequence
  Description of Artificial Sequence: Synthetic oligonucleotide
gcactggggcctggatgagcctctt

SEQ ID NO: 395763 - DNA, 26 bp, Artificial Sequence
  Description of Artificial Sequence: Synthetic oligonucleotide
cactggggcctggatgagcctcttct

SEQ ID NO: 395764 - DNA, 27 bp, Artificial Sequence
  Description of Artificial Sequence: Synthetic oligonucleotide
actggggcctggatgagcctcttctga

SEQ ID NO: 395765 - DNA, 27 bp, Artificial Sequence
  Description of Artificial Sequence: Synthetic oligonucleotide
ctggggcctggatgagcctcttctgaa

SEQ ID NO: 395766 - DNA, 28 bp, Artificial Sequence
  Description of Artificial Sequence: Synthetic oligonucleotide
tggggcctggatgagcctcttctgaaac

SEQ ID NO: 395767 - DNA, 27 bp, Artificial Sequence
  Description of Artificial Sequence: Synthetic oligonucleotide
ggggcctggatgagcctcttctgaaac

SEQ ID NO: 395768 - DNA, 28 bp, Artificial Sequence
  Description of Artificial Sequence: Synthetic oligonucleotide
gggcctggatgagcctcttctgaaacac

SEQ ID NO: 395769 - DNA, 29 bp, Artificial Sequence
  Description of Artificial Sequence: Synthetic oligonucleotide
ggcctggatgagcctcttctgaaacactg

SEQ ID NO: 395770 - DNA, 29 bp, Artificial Sequence
  Description of Artificial Sequence: Synthetic oligonucleotide
gcctggatgagcctcttctgaaacactgg

SEQ ID NO: 395771 - DNA, 29 bp, Artificial Sequence
  Description of Artificial Sequence: Synthetic oligonucleotide
cctggatgagcctcttctgaaacactggg

SEQ ID NO: 395772 - DNA, 30 bp, Artificial Sequence; identical to SEQ ID NO: 56579
  Description of Artificial Sequence: Synthetic oligonucleotide

SEQ ID NO: 395773 - DNA, 30 bp, Artificial Sequence; identical to SEQ ID NO: 56580
  Description of Artificial Sequence: Synthetic oligonucleotide

SEQ ID NO: 395774 - DNA, 29 bp, Artificial Sequence
  Description of Artificial Sequence: Synthetic oligonucleotide
ggatgagcctcttctgaaacactgggagc

SEQ ID NO: 395775 - DNA, 29 bp, Artificial Sequence
  Description of Artificial Sequence: Synthetic oligonucleotide
gatgagcctcttctgaaacactgggagcc

SEQ ID NO: 395776 - DNA, 30 bp, Artificial Sequence; identical to SEQ ID NO: 56583
  Description of Artificial Sequence: Synthetic oligonucleotide

SEQ ID NO: 395777 - DNA, 29 bp, Artificial Sequence
  Description of Artificial Sequence: Synthetic oligonucleotide
tgagcctcttctgaaacactgggagcctg

SEQ ID NO: 395778 - DNA, 28 bp, Artificial Sequence
  Description of Artificial Sequence: Synthetic oligonucleotide
gagcctcttctgaaacactgggagcctg

SEQ ID NO: 395779 - DNA, 30 bp, Artificial Sequence; identical to SEQ ID NO: 56586
  Description of Artificial Sequence: Synthetic oligonucleotide

SEQ ID NO: 395780 - DNA, 29 bp, Artificial Sequence
  Description of Artificial Sequence: Synthetic oligonucleotide
gaaacactgggagcctgagattccagcac

SEQ ID NO: 395781 - DNA, 29 bp, Artificial Sequence
  Description of Artificial Sequence: Synthetic oligonucleotide
aaacactgggagcctgagattccagcacc

SEQ ID NO: 395782 - DNA, 28 bp, Artificial Sequence
  Description of Artificial Sequence: Synthetic oligonucleotide
aacactgggagcctgagattccagcacc

SEQ ID NO: 395783 - DNA, 27 bp, Artificial Sequence
  Description of Artificial Sequence: Synthetic oligonucleotide
acactgggagcctgagattccagcacc

SEQ ID NO: 395784 - DNA, 27 bp, Artificial Sequence
  Description of Artificial Sequence: Synthetic oligonucleotide
cactgggagcctgagattccagcacct

SEQ ID NO: 395785 - DNA, 29 bp, Artificial Sequence
  Description of Artificial Sequence: Synthetic oligonucleotide
actgggagcctgagattccagcacctatg

SEQ ID NO: 395786 - DNA, 28 bp, Artificial Sequence
  Description of Artificial Sequence: Synthetic oligonucleotide
ctgggagcctgagattccagcacctatg

SEQ ID NO: 395787 - DNA, 29 bp, Artificial Sequence
  Description of Artificial Sequence: Synthetic oligonucleotide
tgggagcctgagattccagcacctatgtc

SEQ ID NO: 395788 - DNA, 28 bp, Artificial Sequence
  Description of Artificial Sequence: Synthetic oligonucleotide
gggagcctgagattccagcacctatgtc

SEQ ID NO: 395789 - DNA, 29 bp, Artificial Sequence
  Description of Artificial Sequence: Synthetic oligonucleotide
ggagcctgagattccagcacctatgtcag

SEQ ID NO: 395790 - DNA, 30 bp, Artificial Sequence; identical to SEQ ID NO: 56597
  Description of Artificial Sequence: Synthetic oligonucleotide

SEQ ID NO: 395791 - DNA, 30 bp, Artificial Sequence; identical to SEQ ID NO: 56598
  Description of Artificial Sequence: Synthetic oligonucleotide

SEQ ID NO: 395792 - DNA, 29 bp, Artificial Sequence
  Description of Artificial Sequence: Synthetic oligonucleotide
gcctgagattccagcacctatgtcagagc

SEQ ID NO: 395793 - DNA, 30 bp, Artificial Sequence; identical to SEQ ID NO: 56600
  Description of Artificial Sequence: Synthetic oligonucleotide

SEQ ID NO: 395794 - DNA, 31 bp, Artificial Sequence; identical to SEQ ID NO: 56601
  Description of Artificial Sequence: Synthetic oligonucleotide

SEQ ID NO: 395795 - DNA, 32 bp, Artificial Sequence; identical to SEQ ID NO: 56602
  Description of Artificial Sequence: Synthetic oligonucleotide

SEQ ID NO: 395796 - DNA, 31 bp, Artificial Sequence; identical to SEQ ID NO: 56603
  Description of Artificial Sequence: Synthetic oligonucleotide

SEQ ID NO: 395797 - DNA, 32 bp, Artificial Sequence; identical to SEQ ID NO: 56604
  Description of Artificial Sequence: Synthetic oligonucleotide

SEQ ID NO: 395798 - DNA, 31 bp, Artificial Sequence; identical to SEQ ID NO: 56605
  Description of Artificial Sequence: Synthetic oligonucleotide

SEQ ID NO: 395799 - DNA, 32 bp, Artificial Sequence; identical to SEQ ID NO: 56606
  Description of Artificial Sequence: Synthetic oligonucleotide

SEQ ID NO: 395800 - DNA, 31 bp, Artificial Sequence; identical to SEQ ID NO: 56607
  Description of Artificial Sequence: Synthetic oligonucleotide

SEQ ID NO: 395801 - DNA, 30 bp, Artificial Sequence; identical to SEQ ID NO: 56608
  Description of Artificial Sequence: Synthetic oligonucleotide

SEQ ID NO: 395802 - DNA, 29 bp, Artificial Sequence
  Description of Artificial Sequence: Synthetic oligonucleotide
ccagcacctatgtcagagctcacagagac

SEQ ID NO: 395803 - DNA, 30 bp, Artificial Sequence; identical to SEQ ID NO: 56610
  Description of Artificial Sequence: Synthetic oligonucleotide

SEQ ID NO: 395804 - DNA, 31 bp, Artificial Sequence; identical to SEQ ID NO: 56611
  Description of Artificial Sequence: Synthetic oligonucleotide

SEQ ID NO: 395805 - DNA, 30 bp, Artificial Sequence; identical to SEQ ID NO: 56612
  Description of Artificial Sequence: Synthetic oligonucleotide

SEQ ID NO: 395806 - DNA, 30 bp, Artificial Sequence; identical to SEQ ID NO: 56613
  Description of Artificial Sequence: Synthetic oligonucleotide

SEQ ID NO: 395807 - DNA, 31 bp, Artificial Sequence; identical to SEQ ID NO: 56614
  Description of Artificial Sequence: Synthetic oligonucleotide

SEQ ID NO: 395808 - DNA, 24 bp, Artificial Sequence
  Description of Artificial Sequence: Synthetic oligonucleotide
gcctcgtgggcattgtggtgggga

SEQ ID NO: 395809 - DNA, 24 bp, Artificial Sequence
  Description of Artificial Sequence: Synthetic oligonucleotide
cctcgtgggcattgtggtggggac

SEQ ID NO: 395810 - DNA, 24 bp, Artificial Sequence
  Description of Artificial Sequence: Synthetic oligonucleotide
ctcgtgggcattgtggtggggacc

SEQ ID NO: 395811 - DNA, 25 bp, Artificial Sequence
  Description of Artificial Sequence: Synthetic oligonucleotide
tcgtgggcattgtggtggggaccgt

SEQ ID NO: 395812 - DNA, 24 bp, Artificial Sequence
  Description of Artificial Sequence: Synthetic oligonucleotide
cgtgggcattgtggtggggaccgt

SEQ ID NO: 395813 - DNA, 26 bp, Artificial Sequence
  Description of Artificial Sequence: Synthetic oligonucleotide
gtgggcattgtggtggggaccgtctt

SEQ ID NO: 395814 - DNA, 27 bp, Artificial Sequence
  Description of Artificial Sequence: Synthetic oligonucleotide
tgggcattgtggtggggaccgtcttga

SEQ ID NO: 395815 - DNA, 27 bp, Artificial Sequence
  Description of Artificial Sequence: Synthetic oligonucleotide
gggcattgtggtggggaccgtcttgat

SEQ ID NO: 395816 - DNA, 27 bp, Artificial Sequence
  Description of Artificial Sequence: Synthetic oligonucleotide
ggcattgtggtggggaccgtcttgatc

SEQ ID NO: 395817 - DNA, 29 bp, Artificial Sequence
  Description of Artificial Sequence: Synthetic oligonucleotide
gcattgtggtggggaccgtcttgatcatc

SEQ ID NO: 395818 - DNA, 29 bp, Artificial Sequence
  Description of Artificial Sequence: Synthetic oligonucleotide
cattgtggtggggaccgtcttgatcatcc

SEQ ID NO: 395819 - DNA, 29 bp, Artificial Sequence
  Description of Artificial Sequence: Synthetic oligonucleotide
attgtggtggggaccgtcttgatcatccg

SEQ ID NO: 395820 - DNA, 28 bp, Artificial Sequence
  Description of Artificial Sequence: Synthetic oligonucleotide
ttgtggtggggaccgtcttgatcatccg

SEQ ID NO: 395821 - DNA, 27 bp, Artificial Sequence
  Description of Artificial Sequence: Synthetic oligonucleotide
tgtggtggggaccgtcttgatcatccg

SEQ ID NO: 395822 - DNA, 27 bp, Artificial Sequence
  Description of Artificial Sequence: Synthetic oligonucleotide
gtggtggggaccgtcttgatcatccga

SEQ ID NO: 395823 - DNA, 27 bp, Artificial Sequence
  Description of Artificial Sequence: Synthetic oligonucleotide
tggtggggaccgtcttgatcatccgag

SEQ ID NO: 395824 - DNA, 26 bp, Artificial Sequence
  Description of Artificial Sequence: Synthetic oligonucleotide
ggtggggaccgtcttgatcatccgag

SEQ ID NO: 395825 - DNA, 26 bp, Artificial Sequence
  Description of Artificial Sequence: Synthetic oligonucleotide
gtggggaccgtcttgatcatccgagg

SEQ ID NO: 395826 - DNA, 26 bp, Artificial Sequence
  Description of Artificial Sequence: Synthetic oligonucleotide
tggggaccgtcttgatcatccgaggc

SEQ ID NO: 395827 - DNA, 25 bp, Artificial Sequence
  Description of Artificial Sequence: Synthetic oligonucleotide
ggggaccgtcttgatcatccgaggc

SEQ ID NO: 395828 - DNA, 26 bp, Artificial Sequence
  Description of Artificial Sequence: Synthetic oligonucleotide
gggaccgtcttgatcatccgaggcct

SEQ ID NO: 395829 - DNA, 26 bp, Artificial Sequence
  Description of Artificial Sequence: Synthetic oligonucleotide
ggaccgtcttgatcatccgaggcctg

SEQ ID NO: 395830 - DNA, 26 bp, Artificial Sequence
  Description of Artificial Sequence: Synthetic oligonucleotide
gaccgtcttgatcatccgaggcctgc

SEQ ID NO: 395831 - DNA, 27 bp, Artificial Sequence
  Description of Artificial Sequence: Synthetic oligonucleotide
accgtcttgatcatccgaggcctgcgt

SEQ ID NO: 395832 - DNA, 27 bp, Artificial Sequence
  Description of Artificial Sequence: Synthetic oligonucleotide
ccgtcttgatcatccgaggcctgcgtt

SEQ ID NO: 395833 - DNA, 27 bp, Artificial Sequence
  Description of Artificial Sequence: Synthetic oligonucleotide
cgtcttgatcatccgaggcctgcgttc

SEQ ID NO: 395834 - DNA, 28 bp, Artificial Sequence
  Description of Artificial Sequence: Synthetic oligonucleotide
gtcttgatcatccgaggcctgcgttcag

SEQ ID NO: 395835 - DNA, 30 bp, Artificial Sequence; identical to SEQ ID NO: 56642
  Description of Artificial Sequence: Synthetic oligonucleotide

SEQ ID NO: 395836 - DNA, 29 bp, Artificial Sequence
  Description of Artificial Sequence: Synthetic oligonucleotide
cttgatcatccgaggcctgcgttcagttg

SEQ ID NO: 395837 - DNA, 29 bp, Artificial Sequence
  Description of Artificial Sequence: Synthetic oligonucleotide
ttgatcatccgaggcctgcgttcagttgg

SEQ ID NO: 395838 - DNA, 28 bp, Artificial Sequence
  Description of Artificial Sequence: Synthetic oligonucleotide
tgatcatccgaggcctgcgttcagttgg

SEQ ID NO: 395839 - DNA, 27 bp, Artificial Sequence
  Description of Artificial Sequence: Synthetic oligonucleotide
gatcatccgaggcctgcgttcagttgg

SEQ ID NO: 395840 - DNA, 28 bp, Artificial Sequence
  Description of Artificial Sequence: Synthetic oligonucleotide
atcatccgaggcctgcgttcagttggtg

SEQ ID NO: 395841 - DNA, 27 bp, Artificial Sequence
  Description of Artificial Sequence: Synthetic oligonucleotide
tcatccgaggcctgcgttcagttggtg

SEQ ID NO: 395842 - DNA, 26 bp, Artificial Sequence
  Description of Artificial Sequence: Synthetic oligonucleotide
catccgaggcctgcgttcagttggtg

SEQ ID NO: 395843 - DNA, 27 bp, Artificial Sequence
  Description of Artificial Sequence: Synthetic oligonucleotide
atccgaggcctgcgttcagttggtgct

SEQ ID NO: 395844 - DNA, 27 bp, Artificial Sequence
  Description of Artificial Sequence: Synthetic oligonucleotide
tccgaggcctgcgttcagttggtgctt

SEQ ID NO: 395845 - DNA, 26 bp, Artificial Sequence
  Description of Artificial Sequence: Synthetic oligonucleotide
ccgaggcctgcgttcagttggtgctt

SEQ ID NO: 395846 - DNA, 26 bp, Artificial Sequence
  Description of Artificial Sequence: Synthetic oligonucleotide
cgaggcctgcgttcagttggtgcttc

SEQ ID NO: 395847 - DNA, 27 bp, Artificial Sequence
  Description of Artificial Sequence: Synthetic oligonucleotide
gaggcctgcgttcagttggtgcttcca

SEQ ID NO: 395848 - DNA, 39 bp, Artificial Sequence
  Description of Artificial Sequence: Synthetic oligonucleotide
aggttgtaacccagaaaatcctgaaggatgccatataac

SEQ ID NO: 395849 - DNA, 38 bp, Artificial Sequence
  Description of Artificial Sequence: Synthetic oligonucleotide
ggttgtaacccagaaaatcctgaaggatgccatataac

SEQ ID NO: 395850 - DNA, 39 bp, Artificial Sequence
  Description of Artificial Sequence: Synthetic oligonucleotide
gttgtaacccagaaaatcctgaaggatgccatataactg

SEQ ID NO: 395851 - DNA, 41 bp, Artificial Sequence
  Description of Artificial Sequence: Synthetic oligonucleotide
ttgtaacccagaaaatcctgaaggatgccatataactgatg

SEQ ID NO: 395852 - DNA, 40 bp, Artificial Sequence
  Description of Artificial Sequence: Synthetic oligonucleotide
tgtaacccagaaaatcctgaaggatgccatataactgatg

SEQ ID NO: 395853 - DNA, 39 bp, Artificial Sequence
  Description of Artificial Sequence: Synthetic oligonucleotide
gtaacccagaaaatcctgaaggatgccatataactgatg

SEQ ID NO: 395854 - DNA, 40 bp, Artificial Sequence
  Description of Artificial Sequence: Synthetic oligonucleotide
taacccagaaaatcctgaaggatgccatataactgatgac

SEQ ID NO: 395855 - DNA, 39 bp, Artificial Sequence
  Description of Artificial Sequence: Synthetic oligonucleotide
aacccagaaaatcctgaaggatgccatataactgatgac

SEQ ID NO: 395856 - DNA, 38 bp, Artificial Sequence
  Description of Artificial Sequence: Synthetic oligonucleotide
acccagaaaatcctgaaggatgccatataactgatgac

SEQ ID NO: 395857 - DNA, 37 bp, Artificial Sequence
  Description of Artificial Sequence: Synthetic oligonucleotide
cccagaaaatcctgaaggatgccatataactgatgac

SEQ ID NO: 395858 - DNA, 37 bp, Artificial Sequence
  Description of Artificial Sequence: Synthetic oligonucleotide
ccagaaaatcctgaaggatgccatataactgatgacc

SEQ ID NO: 395859 - DNA, 38 bp, Artificial Sequence
  Description of Artificial Sequence: Synthetic oligonucleotide
cagaaaatcctgaaggatgccatataactgatgacctc

SEQ ID NO: 395860 - DNA, 40 bp, Artificial Sequence
  Description of Artificial Sequence: Synthetic oligonucleotide
agaaaatcctgaaggatgccatataactgatgacctcatc

SEQ ID NO: 395861 - DNA, 39 bp, Artificial Sequence
  Description of Artificial Sequence: Synthetic oligonucleotide
gaaaatcctgaaggatgccatataactgatgacctcatc

SEQ ID NO: 395862 - DNA, 42 bp, Artificial Sequence
  Description of Artificial Sequence: Synthetic oligonucleotide
aaaatcctgaaggatgccatataactgatgacctcatctatc

SEQ ID NO: 395863 - DNA, 41 bp, Artificial Sequence
  Description of Artificial Sequence: Synthetic oligonucleotide
aaatcctgaaggatgccatataactgatgacctcatctatc

SEQ ID NO: 395864 - DNA, 40 bp, Artificial Sequence
  Description of Artificial Sequence: Synthetic oligonucleotide
aatcctgaaggatgccatataactgatgacctcatctatc

SEQ ID NO: 395865 - DNA, 39 bp, Artificial Sequence
  Description of Artificial Sequence: Synthetic oligonucleotide
atcctgaaggatgccatataactgatgacctcatctatc

SEQ ID NO: 395866 - DNA, 38 bp, Artificial Sequence
  Description of Artificial Sequence: Synthetic oligonucleotide
tcctgaaggatgccatataactgatgacctcatctatc

SEQ ID NO: 395867 - DNA, 37 bp, Artificial Sequence
  Description of Artificial Sequence: Synthetic oligonucleotide
cctgaaggatgccatataactgatgacctcatctatc

SEQ ID NO: 395868 - DNA, 37 bp, Artificial Sequence
  Description of Artificial Sequence: Synthetic oligonucleotide
ctgaaggatgccatataactgatgacctcatctatcc

SEQ ID NO: 395869 - DNA, 39 bp, Artificial Sequence
  Description of Artificial Sequence: Synthetic oligonucleotide
tgaaggatgccatataactgatgacctcatctatccatg

SEQ ID NO: 395870 - DNA, 38 bp, Artificial Sequence
  Description of Artificial Sequence: Synthetic oligonucleotide
gaaggatgccatataactgatgacctcatctatccatg

SEQ ID NO: 395871 - DNA, 39 bp, Artificial Sequence
  Description of Artificial Sequence: Synthetic oligonucleotide
aaggatgccatataactgatgacctcatctatccatgag

SEQ ID NO: 395872 - DNA, 38 bp, Artificial Sequence
  Description of Artificial Sequence: Synthetic oligonucleotide
aggatgccatataactgatgacctcatctatccatgag

SEQ ID NO: 395873 - DNA, 37 bp, Artificial Sequence
  Description of Artificial Sequence: Synthetic oligonucleotide
ggatgccatataactgatgacctcatctatccatgag

SEQ ID NO: 395874 - DNA, 37 bp, Artificial Sequence
  Description of Artificial Sequence: Synthetic oligonucleotide
gatgccatataactgatgacctcatctatccatgagg

SEQ ID NO: 395875 - DNA, 37 bp, Artificial Sequence
  Description of Artificial Sequence: Synthetic oligonucleotide
atgccatataactgatgacctcatctatccatgaggc

SEQ ID NO: 395876 - DNA, 36 bp, Artificial Sequence
  Description of Artificial Sequence: Synthetic oligonucleotide
tgccatataactgatgacctcatctatccatgaggc

SEQ ID NO: 395877 - DNA, 35 bp, Artificial Sequence
  Description of Artificial Sequence: Synthetic oligonucleotide
gccatataactgatgacctcatctatccatgaggc

SEQ ID NO: 395878 - DNA, 36 bp, Artificial Sequence
  Description of Artificial Sequence: Synthetic oligonucleotide
ccatataactgatgacctcatctatccatgaggctg

SEQ ID NO: 395879 - DNA, 36 bp, Artificial Sequence
  Description of Artificial Sequence: Synthetic oligonucleotide
catataactgatgacctcatctatccatgaggctgc

SEQ ID NO: 395880 - DNA, 37 bp, Artificial Sequence
  Description of Artificial Sequence: Synthetic oligonucleotide
atataactgatgacctcatctatccatgaggctgctc

SEQ ID NO: 395881 - DNA, 36 bp, Artificial Sequence
  Description of Artificial Sequence: Synthetic oligonucleotide
tataactgatgacctcatctatccatgaggctgctc

SEQ ID NO: 395882 - DNA, 35 bp, Artificial Sequence
  Description of Artificial Sequence: Synthetic oligonucleotide
ataactgatgacctcatctatccatgaggctgctc

SEQ ID NO: 395883 - DNA, 34 bp, Artificial Sequence
  Description of Artificial Sequence: Synthetic oligonucleotide
taactgatgacctcatctatccatgaggctgctc

SEQ ID NO: 395884 - DNA, 33 bp, Artificial Sequence
  Description of Artificial Sequence: Synthetic oligonucleotide
aactgatgacctcatctatccatgaggctgctc

SEQ ID NO: 395885 - DNA, 32 bp, Artificial Sequence
  Description of Artificial Sequence: Synthetic oligonucleotide
actgatgacctcatctatccatgaggctgctc

SEQ ID NO: 395886 - DNA, 31 bp, Artificial Sequence
  Description of Artificial Sequence: Synthetic oligonucleotide
ctgatgacctcatctatccatgaggctgctc

SEQ ID NO: 395887 - DNA, 32 bp, Artificial Sequence
  Description of Artificial Sequence: Synthetic oligonucleotide
atctatccatgaggctgctcagaaatgccctc

SEQ ID NO: 395888 - DNA, 31 bp, Artificial Sequence
  Description of Artificial Sequence: Synthetic oligonucleotide
tctatccatgaggctgctcagaaatgccctc

SEQ ID NO: 395889 - DNA, 30 bp, Artificial Sequence
  Description of Artificial Sequence: Synthetic oligonucleotide
ctatccatgaggctgctcagaaatgccctc

SEQ ID NO: 395890 - DNA, 30 bp, Artificial Sequence
  Description of Artificial Sequence: Synthetic oligonucleotide
tatccatgaggctgctcagaaatgccctcc

SEQ ID NO: 395891 - DNA, 29 bp, Artificial Sequence
  Description of Artificial Sequence: Synthetic oligonucleotide
atccatgaggctgctcagaaatgccctcc

SEQ ID NO: 395892 - DNA, 28 bp, Artificial Sequence
  Description of Artificial Sequence: Synthetic oligonucleotide
tccatgaggctgctcagaaatgccctcc

SEQ ID NO: 395893 - DNA, 27 bp, Artificial Sequence
  Description of Artificial Sequence: Synthetic oligonucleotide
ccatgaggctgctcagaaatgccctcc

SEQ ID NO: 395894 - DNA, 27 bp, Artificial Sequence
  Description of Artificial Sequence: Synthetic oligonucleotide
catgaggctgctcagaaatgccctccc

SEQ ID NO: 395895 - DNA, 27 bp, Artificial Sequence
  Description of Artificial Sequence: Synthetic oligonucleotide
atgaggctgctcagaaatgccctcccc

SEQ ID NO: 395896 - DNA, 27 bp, Artificial Sequence
  Description of Artificial Sequence: Synthetic oligonucleotide
tgaggctgctcagaaatgccctcccct

SEQ ID NO: 395897 - DNA, 26 bp, Artificial Sequence
  Description of Artificial Sequence: Synthetic oligonucleotide
gaggctgctcagaaatgccctcccct

SEQ ID NO: 395898 - DNA, 26 bp, Artificial Sequence
  Description of Artificial Sequence: Synthetic oligonucleotide
aggctgctcagaaatgccctcccctg

SEQ ID NO: 395899 - DNA, 25 bp, Artificial Sequence
  Description of Artificial Sequence: Synthetic oligonucleotide
ggctgctcagaaatgccctcccctg

SEQ ID NO: 395900 - DNA, 25 bp, Artificial Sequence
  Description of Artificial Sequence: Synthetic oligonucleotide
gctgctcagaaatgccctcccctgg

SEQ ID NO: 395901 - DNA, 25 bp, Artificial Sequence
  Description of Artificial Sequence: Synthetic oligonucleotide
ctgctcagaaatgccctcccctggc

SEQ ID NO: 395902 - DNA, 26 bp, Artificial Sequence
  Description of Artificial Sequence: Synthetic oligonucleotide
tgctcagaaatgccctcccctggcca

SEQ ID NO: 395903 - DNA, 25 bp, Artificial Sequence
  Description of Artificial Sequence: Synthetic oligonucleotide
gctcagaaatgccctcccctggcca

SEQ ID NO: 395904 - DNA, 25 bp, Artificial Sequence
  Description of Artificial Sequence: Synthetic oligonucleotide
ctcagaaatgccctcccctggccag

SEQ ID NO: 395905 - DNA, 25 bp, Artificial Sequence
  Description of Artificial Sequence: Synthetic oligonucleotide
tcagaaatgccctcccctggccagg

SEQ ID NO: 395906 - DNA, 24 bp, Artificial Sequence
  Description of Artificial Sequence: Synthetic oligonucleotide
cagaaatgccctcccctggccagg

SEQ ID NO: 395907 - DNA, 25 bp, Artificial Sequence
  Description of Artificial Sequence: Synthetic oligonucleotide
agaaatgccctcccctggccaggca

SEQ ID NO: 395908 - DNA, 24 bp, Artificial Sequence
  Description of Artificial Sequence: Synthetic oligonucleotide
gaaatgccctcccctggccaggca

SEQ ID NO: 395909 - DNA, 24 bp, Artificial Sequence
  Description of Artificial Sequence: Synthetic oligonucleotide
aaatgccctcccctggccaggcac

SEQ ID NO: 395910 - DNA, 23 bp, Artificial Sequence
  Description of Artificial Sequence: Synthetic oligonucleotide
aatgccctcccctggccaggcac

SEQ ID NO: 395911 - DNA, 22 bp, Artificial Sequence
  Description of Artificial Sequence: Synthetic oligonucleotide
atgccctcccctggccaggcac

SEQ ID NO: 395912 - DNA, 21 bp, Artificial Sequence
  Description of Artificial Sequence: Synthetic oligonucleotide
tgccctcccctggccaggcac

SEQ ID NO: 395913 - DNA, 20 bp, Artificial Sequence
  Description of Artificial Sequence: Synthetic oligonucleotide
gccctcccctggccaggcac

SEQ ID NO: 395914 - DNA, 20 bp, Artificial Sequence
  Description of Artificial Sequence: Synthetic oligonucleotide
ccctcccctggccaggcacg

SEQ ID NO: 395915 - DNA, 21 bp, Artificial Sequence
  Description of Artificial Sequence: Synthetic oligonucleotide
cctcccctggccaggcacggt

SEQ ID NO: 395916 - DNA, 21 bp, Artificial Sequence
  Description of Artificial Sequence: Synthetic oligonucleotide
ctcccctggccaggcacggtg

SEQ ID NO: 395917 - DNA, 21 bp, Artificial Sequence
  Description of Artificial Sequence: Synthetic oligonucleotide
tcccctggccaggcacggtgg

SEQ ID NO: 395918 - DNA, 27 bp, Artificial Sequence
  Description of Artificial Sequence: Synthetic oligonucleotide
aggcacggtggctcatgcctgtaatcc

SEQ ID NO: 395919 - DNA, 27 bp, Artificial Sequence
  Description of Artificial Sequence: Synthetic oligonucleotide
ggcacggtggctcatgcctgtaatcca

SEQ ID NO: 395920 - DNA, 28 bp, Artificial Sequence
  Description of Artificial Sequence: Synthetic oligonucleotide
gcacggtggctcatgcctgtaatccaag

SEQ ID NO: 395921 - DNA, 28 bp, Artificial Sequence
  Description of Artificial Sequence: Synthetic oligonucleotide
cacggtggctcatgcctgtaatccaagc

SEQ ID NO: 395922 - DNA, 29 bp, Artificial Sequence
  Description of Artificial Sequence: Synthetic oligonucleotide
acggtggctcatgcctgtaatccaagcac

SEQ ID NO: 395923 - DNA, 28 bp, Artificial Sequence
  Description of Artificial Sequence: Synthetic oligonucleotide
tttgggaggctgaggcaggcagatcatg

SEQ ID NO: 395924 - DNA, 27 bp, Artificial Sequence
  Description of Artificial Sequence: Synthetic oligonucleotide
ttgggaggctgaggcaggcagatcatg

SEQ ID NO: 395925 - DNA, 27 bp, Artificial Sequence
  Description of Artificial Sequence: Synthetic oligonucleotide
tgggaggctgaggcaggcagatcatga

SEQ ID NO: 395926 - DNA, 26 bp, Artificial Sequence
  Description of Artificial Sequence: Synthetic oligonucleotide
gggaggctgaggcaggcagatcatga

SEQ ID NO: 395927 - DNA, 26 bp, Artificial Sequence
  Description of Artificial Sequence: Synthetic oligonucleotide
ggaggctgaggcaggcagatcatgag

SEQ ID NO: 395928 - DNA, 27 bp, Artificial Sequence
  Description of Artificial Sequence: Synthetic oligonucleotide
gaggctgaggcaggcagatcatgaggt

SEQ ID NO: 395929 - DNA, 27 bp, Artificial Sequence
  Description of Artificial Sequence: Synthetic oligonucleotide
aggctgaggcaggcagatcatgaggtc

SEQ ID NO: 395930 - DNA, 27 bp, Artificial Sequence
  Description of Artificial Sequence: Synthetic oligonucleotide
ggctgaggcaggcagatcatgaggtca

SEQ ID NO: 395931 - DNA, 27 bp, Artificial Sequence
  Description of Artificial Sequence: Synthetic oligonucleotide
gctgaggcaggcagatcatgaggtcag

SEQ ID NO: 395932 - DNA, 27 bp, Artificial Sequence
  Description of Artificial Sequence: Synthetic oligonucleotide
ctgaggcaggcagatcatgaggtcagg

SEQ ID NO: 395933 - DNA, 28 bp, Artificial Sequence
  Description of Artificial Sequence: Synthetic oligonucleotide
tgaggcaggcagatcatgaggtcaggag

SEQ ID NO: 395934 - DNA, 27 bp, Artificial Sequence
  Description of Artificial Sequence: Synthetic oligonucleotide
gaggcaggcagatcatgaggtcaggag

SEQ ID NO: 395935 - DNA, 29 bp, Artificial Sequence
  Description of Artificial Sequence: Synthetic oligonucleotide
aggcaggcagatcatgaggtcaggagttc

SEQ ID NO: 395936 - DNA, 28 bp, Artificial Sequence
  Description of Artificial Sequence: Synthetic oligonucleotide
ggcaggcagatcatgaggtcaggagttc

SEQ ID NO: 395937 - DNA, 30 bp, Artificial Sequence
  Description of Artificial Sequence: Synthetic oligonucleotide
gcaggcagatcatgaggtcaggagttcaag

SEQ ID NO: 395938 - DNA, 31 bp, Artificial Sequence
  Description of Artificial Sequence: Synthetic oligonucleotide
caggcagatcatgaggtcaggagttcaagac

SEQ ID NO: 395939 - DNA, 31 bp, Artificial Sequence
  Description of Artificial Sequence: Synthetic oligonucleotide
aggcagatcatgaggtcaggagttcaagacc

SEQ ID NO: 395940 - DNA, 35 bp, Artificial Sequence
  Description of Artificial Sequence: Synthetic oligonucleotide
taaaaatacagaaattagccgggcatggtggcagc

SEQ ID NO: 395941 - DNA, 34 bp, Artificial Sequence
  Description of Artificial Sequence: Synthetic oligonucleotide
aaaaatacagaaattagccgggcatggtggcagc

SEQ ID NO: 395942 - DNA, 33 bp, Artificial Sequence
  Description of Artificial Sequence: Synthetic oligonucleotide
aaaatacagaaattagccgggcatggtggcagc

SEQ ID NO: 395943 - DNA, 32 bp, Artificial Sequence
  Description of Artificial Sequence: Synthetic oligonucleotide
aaatacagaaattagccgggcatggtggcagc

SEQ ID NO: 395944 - DNA, 31 bp, Artificial Sequence
  Description of Artificial Sequence: Synthetic oligonucleotide
aatacagaaattagccgggcatggtggcagc

SEQ ID NO: 395945 - DNA, 30 bp, Artificial Sequence
  Description of Artificial Sequence: Synthetic oligonucleotide
atacagaaattagccgggcatggtggcagc

SEQ ID NO: 395946 - DNA, 29 bp, Artificial Sequence
  Description of Artificial Sequence: Synthetic oligonucleotide
tacagaaattagccgggcatggtggcagc

SEQ ID NO: 395947 - DNA, 28 bp, Artificial Sequence
  Description of Artificial Sequence: Synthetic oligonucleotide
acagaaattagccgggcatggtggcagc

SEQ ID NO: 395948 - DNA, 27 bp, Artificial Sequence
  Description of Artificial Sequence: Synthetic oligonucleotide
cagaaattagccgggcatggtggcagc

SEQ ID NO: 395949 - DNA, 27 bp, Artificial Sequence
  Description of Artificial Sequence: Synthetic oligonucleotide
agaaattagccgggcatggtggcagcc

SEQ ID NO: 395950 - DNA, 26 bp, Artificial Sequence
  Description of Artificial Sequence: Synthetic oligonucleotide
gaaattagccgggcatggtggcagcc

SEQ ID NO: 395951 - DNA, 26 bp, Artificial Sequence
  Description of Artificial Sequence: Synthetic oligonucleotide
aaattagccgggcatggtggcagccg

SEQ ID NO: 395952 - DNA, 25 bp, Artificial Sequence
  Description of Artificial Sequence: Synthetic oligonucleotide
aattagccgggcatggtggcagccg

SEQ ID NO: 395953 - DNA, 24 bp, Artificial Sequence
  Description of Artificial Sequence: Synthetic oligonucleotide
attagccgggcatggtggcagccg

SEQ ID NO: 395954 - DNA, 23 bp, Artificial Sequence
  Description of Artificial Sequence: Synthetic oligonucleotide
ttagccgggcatggtggcagccg

SEQ ID NO: 395955 - DNA, 22 bp, Artificial Sequence
  Description of Artificial Sequence: Synthetic oligonucleotide
tagccgggcatggtggcagccg

SEQ ID NO: 395956 - DNA, 21 bp, Artificial Sequence
  Description of Artificial Sequence: Synthetic oligonucleotide
agccgggcatggtggcagccg

SEQ ID NO: 395957 - DNA, 20 bp, Artificial Sequence
  Description of Artificial Sequence: Synthetic oligonucleotide
gccgggcatggtggcagccg

SEQ ID NO: 395958 - DNA, 20 bp, Artificial Sequence
  Description of Artificial Sequence: Synthetic oligonucleotide
ccgggcatggtggcagccgc

SEQ ID NO: 395959 - DNA, 21 bp, Artificial Sequence
  Description of Artificial Sequence: Synthetic oligonucleotide
cgggcatggtggcagccgcct

SEQ ID NO: 395960 - DNA, 21 bp, Artificial Sequence
  Description of Artificial Sequence: Synthetic oligonucleotide
gggcatggtggcagccgcctg

SEQ ID NO: 395961 - DNA, 22 bp, Artificial Sequence
  Description of Artificial Sequence: Synthetic oligonucleotide
ggcatggtggcagccgcctgca

SEQ ID NO: 395962 - DNA, 23 bp, Artificial Sequence
  Description of Artificial Sequence: Synthetic oligonucleotide
gcatggtggcagccgcctgcagt

SEQ ID NO: 395963 - DNA, 23 bp, Artificial Sequence
  Description of Artificial Sequence: Synthetic oligonucleotide
catggtggcagccgcctgcagtc

SEQ ID NO: 395964 - DNA, 23 bp, Artificial Sequence
  Description of Artificial Sequence: Synthetic oligonucleotide
atggtggcagccgcctgcagtcc

SEQ ID NO: 395965 - DNA, 22 bp, Artificial Sequence
  Description of Artificial Sequence: Synthetic oligonucleotide
tggtggcagccgcctgcagtcc

SEQ ID NO: 395966 - DNA, 21 bp, Artificial Sequence
  Description of Artificial Sequence: Synthetic oligonucleotide
ggtggcagccgcctgcagtcc

SEQ ID NO: 395967 - DNA, 22 bp, Artificial Sequence
  Description of Artificial Sequence: Synthetic oligonucleotide
gtggcagccgcctgcagtccca

SEQ ID NO: 395968 - DNA, 22 bp, Artificial Sequence
  Description of Artificial Sequence: Synthetic oligonucleotide
tggcagccgcctgcagtcccag

SEQ ID NO: 395969 - DNA, 21 bp, Artificial Sequence
  Description of Artificial Sequence: Synthetic oligonucleotide
ggcagccgcctgcagtcccag

SEQ ID NO: 395970 - DNA, 23 bp, Artificial Sequence
  Description of Artificial Sequence: Synthetic oligonucleotide
gcagccgcctgcagtcccagcta

SEQ ID NO: 395971 - DNA, 24 bp, Artificial Sequence
  Description of Artificial Sequence: Synthetic oligonucleotide
cagccgcctgcagtcccagctact

SEQ ID NO: 395972 - DNA, 24 bp, Artificial Sequence
  Description of Artificial Sequence: Synthetic oligonucleotide
agccgcctgcagtcccagctactc

SEQ ID NO: 395973 - DNA, 23 bp, Artificial Sequence
  Description of Artificial Sequence: Synthetic oligonucleotide
gccgcctgcagtcccagctactc

SEQ ID NO: 395974 - DNA, 23 bp, Artificial Sequence
  Description of Artificial Sequence: Synthetic oligonucleotide
ccgcctgcagtcccagctactcg

SEQ ID NO: 395975 - DNA, 23 bp, Artificial Sequence
  Description of Artificial Sequence: Synthetic oligonucleotide
cgcctgcagtcccagctactcgg

SEQ ID NO: 395976 - DNA, 24 bp, Artificial Sequence
  Description of Artificial Sequence: Synthetic oligonucleotide
gcctgcagtcccagctactcggga

SEQ ID NO: 395977 - DNA, 24 bp, Artificial Sequence
  Description of Artificial Sequence: Synthetic oligonucleotide
cctgcagtcccagctactcgggag

SEQ ID NO: 395978 - DNA, 24 bp, Artificial Sequence
  Description of Artificial Sequence: Synthetic oligonucleotide
ctgcagtcccagctactcgggagg

SEQ ID NO: 395979 - DNA, 25 bp, Artificial Sequence
  Description of Artificial Sequence: Synthetic oligonucleotide
tgcagtcccagctactcgggagggt

SEQ ID NO: 395980 - DNA, 24 bp, Artificial Sequence
  Description of Artificial Sequence: Synthetic oligonucleotide
gcagtcccagctactcgggagggt

SEQ ID NO: 395981 - DNA, 25 bp, Artificial Sequence
  Description of Artificial Sequence: Synthetic oligonucleotide
cagtcccagctactcgggagggtga

SEQ ID NO: 395982 - DNA, 25 bp, Artificial Sequence
  Description of Artificial Sequence: Synthetic oligonucleotide
agtcccagctactcgggagggtgag

SEQ ID NO: 395983 - DNA, 24 bp, Artificial Sequence
  Description of Artificial Sequence: Synthetic oligonucleotide
gtcccagctactcgggagggtgag

SEQ ID NO: 395984 - DNA, 24 bp, Artificial Sequence
  Description of Artificial Sequence: Synthetic oligonucleotide
tcccagctactcgggagggtgagg

SEQ ID NO: 395985 - DNA, 23 bp, Artificial Sequence
  Description of Artificial Sequence: Synthetic oligonucleotide
cccagctactcgggagggtgagg

SEQ ID NO: 395986 - DNA, 24 bp, Artificial Sequence
  Description of Artificial Sequence: Synthetic oligonucleotide
ccagctactcgggagggtgaggca

SEQ ID NO: 395987 - DNA, 24 bp, Artificial Sequence
  Description of Artificial Sequence: Synthetic oligonucleotide
cagctactcgggagggtgaggcag

SEQ ID NO: 395988 - DNA, 25 bp, Artificial Sequence
  Description of Artificial Sequence: Synthetic oligonucleotide
agctactcgggagggtgaggcagga

SEQ ID NO: 395989 - DNA, 24 bp, Artificial Sequence
  Description of Artificial Sequence: Synthetic oligonucleotide
gctactcgggagggtgaggcagga

SEQ ID NO: 395990 - DNA, 27 bp, Artificial Sequence
  Description of Artificial Sequence: Synthetic oligonucleotide
ctactcgggagggtgaggcaggagaat

SEQ ID NO: 395991 - DNA, 27 bp, Artificial Sequence
  Description of Artificial Sequence: Synthetic oligonucleotide
tactcgggagggtgaggcaggagaatc

SEQ ID NO: 395992 - DNA, 26 bp, Artificial Sequence
  Description of Artificial Sequence: Synthetic oligonucleotide
actcgggagggtgaggcaggagaatc

SEQ ID NO: 395993 - DNA, 25 bp, Artificial Sequence
  Description of Artificial Sequence: Synthetic oligonucleotide
ctcgggagggtgaggcaggagaatc

SEQ ID NO: 395994 - DNA, 25 bp, Artificial Sequence
  Description of Artificial Sequence: Synthetic oligonucleotide
tcgggagggtgaggcaggagaatcg

SEQ ID NO: 395995 - DNA, 24 bp, Artificial Sequence
  Description of Artificial Sequence: Synthetic oligonucleotide
cgggagggtgaggcaggagaatcg

SEQ ID NO: 395996 - DNA, 28 bp, Artificial Sequence
  Description of Artificial Sequence: Synthetic oligonucleotide
ggtgaggcaggagaatcgcttgaacctg

SEQ ID NO: 395997 - DNA, 28 bp, Artificial Sequence
  Description of Artificial Sequence: Synthetic oligonucleotide
gtgaggcaggagaatcgcttgaacctgg

SEQ ID NO: 395998 - DNA, 28 bp, Artificial Sequence
  Description of Artificial Sequence: Synthetic oligonucleotide
tgaggcaggagaatcgcttgaacctggg

SEQ ID NO: 395999 - DNA, 27 bp, Artificial Sequence
  Description of Artificial Sequence: Synthetic oligonucleotide
gaggcaggagaatcgcttgaacctggg

SEQ ID NO: 396000 - DNA, 28 bp, Artificial Sequence
  Description of Artificial Sequence: Synthetic oligonucleotide
aggcaggagaatcgcttgaacctgggag

SEQ ID NO: 396001 - DNA, 27 bp, Artificial Sequence
  Description of Artificial Sequence: Synthetic oligonucleotide
ggcaggagaatcgcttgaacctgggag

SEQ ID NO: 396002 - DNA, 27 bp, Artificial Sequence
  Description of Artificial Sequence: Synthetic oligonucleotide
gcaggagaatcgcttgaacctgggagg

SEQ ID NO: 396003 - DNA, 27 bp, Artificial Sequence
  Description of Artificial Sequence: Synthetic oligonucleotide
caggagaatcgcttgaacctgggaggc

SEQ ID NO: 396004 - DNA, 30 bp, Artificial Sequence
  Description of Artificial Sequence: Synthetic oligonucleotide
aggagaatcgcttgaacctgggaggcaaag

SEQ ID NO: 396005 - DNA, 29 bp, Artificial Sequence
  Description of Artificial Sequence: Synthetic oligonucleotide
ggagaatcgcttgaacctgggaggcaaag

SEQ ID NO: 396006 - DNA, 29 bp, Artificial Sequence
  Description of Artificial Sequence: Synthetic oligonucleotide
gagaatcgcttgaacctgggaggcaaagg

SEQ ID NO: 396007 - DNA, 31 bp, Artificial Sequence
  Description of Artificial Sequence: Synthetic oligonucleotide
agaatcgcttgaacctgggaggcaaaggttg

SEQ ID NO: 396008 - DNA, 30 bp, Artificial Sequence
  Description of Artificial Sequence: Synthetic oligonucleotide
gaatcgcttgaacctgggaggcaaaggttg

SEQ ID NO: 396009 - DNA, 30 bp, Artificial Sequence
  Description of Artificial Sequence: Synthetic oligonucleotide
aatcgcttgaacctgggaggcaaaggttgc

SEQ ID NO: 396010 - DNA, 29 bp, Artificial Sequence
  Description of Artificial Sequence: Synthetic oligonucleotide
atcgcttgaacctgggaggcaaaggttgc

SEQ ID NO: 396011 - DNA, 28 bp, Artificial Sequence
  Description of Artificial Sequence: Synthetic oligonucleotide
tcgcttgaacctgggaggcaaaggttgc

SEQ ID NO: 396012 - DNA, 27 bp, Artificial Sequence
  Description of Artificial Sequence: Synthetic oligonucleotide
cgcttgaacctgggaggcaaaggttgc

SEQ ID NO: 396013 - DNA, 28 bp, Artificial Sequence
  Description of Artificial Sequence: Synthetic oligonucleotide
gcttgaacctgggaggcaaaggttgcag

SEQ ID NO: 396014 - DNA, 29 bp, Artificial Sequence
  Description of Artificial Sequence: Synthetic oligonucleotide
cttgaacctgggaggcaaaggttgcagtg

SEQ ID NO: 396015 - DNA, 30 bp, Artificial Sequence
  Description of Artificial Sequence: Synthetic oligonucleotide
ttgaacctgggaggcaaaggttgcagtgag

SEQ ID NO: 396016 - DNA, 29 bp, Artificial Sequence
  Description of Artificial Sequence: Synthetic oligonucleotide
tgaacctgggaggcaaaggttgcagtgag

SEQ ID NO: 396017 - DNA, 28 bp, Artificial Sequence
  Description of Artificial Sequence: Synthetic oligonucleotide
gaacctgggaggcaaaggttgcagtgag

SEQ ID NO: 396018 - DNA, 28 bp, Artificial Sequence
  Description of Artificial Sequence: Synthetic oligonucleotide
aacctgggaggcaaaggttgcagtgagc

SEQ ID NO: 396019 - DNA, 27 bp, Artificial Sequence
  Description of Artificial Sequence: Synthetic oligonucleotide
acctgggaggcaaaggttgcagtgagc

SEQ ID NO: 396020 - DNA, 26 bp, Artificial Sequence
  Description of Artificial Sequence: Synthetic oligonucleotide
cctgggaggcaaaggttgcagtgagc

SEQ ID NO: 396021 - DNA, 26 bp, Artificial Sequence
  Description of Artificial Sequence: Synthetic oligonucleotide
ctgggaggcaaaggttgcagtgagcc

SEQ ID NO: 396022 - DNA, 27 bp, Artificial Sequence
  Description of Artificial Sequence: Synthetic oligonucleotide
tgggaggcaaaggttgcagtgagccga

SEQ ID NO: 396023 - DNA, 32 bp, Artificial Sequence
  Description of Artificial Sequence: Synthetic oligonucleotide
tgggtgacagagtgagactacgtctcgaaaag

SEQ ID NO: 396024 - DNA, 31 bp, Artificial Sequence
  Description of Artificial Sequence: Synthetic oligonucleotide
gggtgacagagtgagactacgtctcgaaaag

SEQ ID NO: 396025 - DNA, 35 bp, Artificial Sequence
  Description of Artificial Sequence: Synthetic oligonucleotide
ggtgacagagtgagactacgtctcgaaaagaaaag

SEQ ID NO: 396026 - DNA, 40 bp, Artificial Sequence
  Description of Artificial Sequence: Synthetic oligonucleotide
gtgacagagtgagactacgtctcgaaaagaaaagaaaaag

SEQ ID NO: 396027 - DNA, 44 bp, Artificial Sequence
  Description of Artificial Sequence: Synthetic oligonucleotide
tgacagagtgagactacgtctcgaaaagaaaagaaaaagaaaag

SEQ ID NO: 396028 - DNA, 43 bp, Artificial Sequence
  Description of Artificial Sequence: Synthetic oligonucleotide
gacagagtgagactacgtctcgaaaagaaaagaaaaagaaaag

SEQ ID NO: 396029 - DNA, 48 bp, Artificial Sequence
  Description of Artificial Sequence: Synthetic oligonucleotide
acagagtgagactacgtctcgaaaagaaaagaaaaagaaaagaaaaag

SEQ ID NO: 396030 - DNA, 47 bp, Artificial Sequence
  Description of Artificial Sequence: Synthetic oligonucleotide
cagagtgagactacgtctcgaaaagaaaagaaaaagaaaagaaaaag

SEQ ID NO: 396031 - DNA, 56 bp, Artificial Sequence
  Description of Artificial Sequence: Synthetic oligonucleotide
agagtgagactacgtctcgaaaagaaaagaaaaagaaaagaaaaagaaaaaaaaag

SEQ ID NO: 396032 - DNA, 55 bp, Artificial Sequence
  Description of Artificial Sequence: Synthetic oligonucleotide
gagtgagactacgtctcgaaaagaaaagaaaaagaaaagaaaaagaaaaaaaaag

SEQ ID NO: 396033 - DNA, 60 bp, Artificial Sequence
  Description of Artificial Sequence: Synthetic oligonucleotide
agtgagactacgtctcgaaaagaaaagaaaaagaaaagaaaaagaaaaaaaaagaaaaat

SEQ ID NO: 396034 - DNA, 60 bp, Artificial Sequence
  Description of Artificial Sequence: Synthetic oligonucleotide
gtgagactacgtctcgaaaagaaaagaaaaagaaaagaaaaagaaaaaaaaagaaaaatg

SEQ ID NO: 396035 - DNA, 60 bp, Artificial Sequence
  Description of Artificial Sequence: Synthetic oligonucleotide
tgagactacgtctcgaaaagaaaagaaaaagaaaagaaaaagaaaaaaaaagaaaaatgc

SEQ ID NO: 396036 - DNA, 59 bp, Artificial Sequence
  Description of Artificial Sequence: Synthetic oligonucleotide
gagactacgtctcgaaaagaaaagaaaaagaaaagaaaaagaaaaaaaaagaaaaatgc

SEQ ID NO: 396037 - DNA, 59 bp, Artificial Sequence
  Description of Artificial Sequence: Synthetic oligonucleotide
agactacgtctcgaaaagaaaagaaaaagaaaagaaaaagaaaaaaaaagaaaaatgcc

SEQ ID NO: 396038 - DNA, 58 bp, Artificial Sequence
  Description of Artificial Sequence: Synthetic oligonucleotide
gactacgtctcgaaaagaaaagaaaaagaaaagaaaaagaaaaaaaaagaaaaatgcc

SEQ ID NO: 396039 - DNA, 58 bp, Artificial Sequence
  Description of Artificial Sequence: Synthetic oligonucleotide
actacgtctcgaaaagaaaagaaaaagaaaagaaaaagaaaaaaaaagaaaaatgccc

SEQ ID NO: 396040 - DNA, 57 bp, Artificial Sequence
  Description of Artificial Sequence: Synthetic oligonucleotide
ctacgtctcgaaaagaaaagaaaaagaaaagaaaaagaaaaaaaaagaaaaatgccc

SEQ ID NO: 396041 - DNA, 59 bp, Artificial Sequence
  Description of Artificial Sequence: Synthetic oligonucleotide
tacgtctcgaaaagaaaagaaaaagaaaagaaaaagaaaaaaaaagaaaaatgcccatc

SEQ ID NO: 396042 - DNA, 58 bp, Artificial Sequence
  Description of Artificial Sequence: Synthetic oligonucleotide
acgtctcgaaaagaaaagaaaaagaaaagaaaaagaaaaaaaaagaaaaatgcccatc

SEQ ID NO: 396043 - DNA, 57 bp, Artificial Sequence
  Description of Artificial Sequence: Synthetic oligonucleotide
cgtctcgaaaagaaaagaaaaagaaaagaaaaagaaaaaaaaagaaaaatgcccatc

SEQ ID NO: 396044 - DNA, 57 bp, Artificial Sequence
  Description of Artificial Sequence: Synthetic oligonucleotide
gtctcgaaaagaaaagaaaaagaaaagaaaaagaaaaaaaaagaaaaatgcccatcc

SEQ ID NO: 396045 - DNA, 57 bp, Artificial Sequence
  Description of Artificial Sequence: Synthetic oligonucleotide
tctcgaaaagaaaagaaaaagaaaagaaaaagaaaaaaaaagaaaaatgcccatccc

SEQ ID NO: 396046 - DNA, 56 bp, Artificial Sequence
  Description of Artificial Sequence: Synthetic oligonucleotide
ctcgaaaagaaaagaaaaagaaaagaaaaagaaaaaaaaagaaaaatgcccatccc

SEQ ID NO: 396047 - DNA, 57 bp, Artificial Sequence
  Description of Artificial Sequence: Synthetic oligonucleotide
tcgaaaagaaaagaaaaagaaaagaaaaagaaaaaaaaagaaaaatgcccatccctc

SEQ ID NO: 396048 - DNA, 56 bp, Artificial Sequence
  Description of Artificial Sequence: Synthetic oligonucleotide
cgaaaagaaaagaaaaagaaaagaaaaagaaaaaaaaagaaaaatgcccatccctc

SEQ ID NO: 396049 - DNA, 58 bp, Artificial Sequence
  Description of Artificial Sequence: Synthetic oligonucleotide
gaaaagaaaagaaaaagaaaagaaaaagaaaaaaaaagaaaaatgcccatccctcttg

SEQ ID NO: 396050 - DNA, 58 bp, Artificial Sequence
  Description of Artificial Sequence: Synthetic oligonucleotide
aaaagaaaagaaaaagaaaagaaaaagaaaaaaaaagaaaaatgcccatccctcttgc

SEQ ID NO: 396051 - DNA, 57 bp, Artificial Sequence
  Description of Artificial Sequence: Synthetic oligonucleotide
aaagaaaagaaaaagaaaagaaaaagaaaaaaaaagaaaaatgcccatccctcttgc

SEQ ID NO: 396052 - DNA, 56 bp, Artificial Sequence
  Description of Artificial Sequence: Synthetic oligonucleotide
aagaaaagaaaaagaaaagaaaaagaaaaaaaaagaaaaatgcccatccctcttgc

SEQ ID NO: 396053 - DNA, 55 bp, Artificial Sequence
  Description of Artificial Sequence: Synthetic oligonucleotide
agaaaagaaaaagaaaagaaaaagaaaaaaaaagaaaaatgcccatccctcttgc

SEQ ID NO: 396054 - DNA, 54 bp, Artificial Sequence
  Description of Artificial Sequence: Synthetic oligonucleotide
gaaaagaaaaagaaaagaaaaagaaaaaaaaagaaaaatgcccatccctcttgc

SEQ ID NO: 396055 - DNA, 54 bp, Artificial Sequence
  Description of Artificial Sequence: Synthetic oligonucleotide
aaaagaaaaagaaaagaaaaagaaaaaaaaagaaaaatgcccatccctcttgcg

SEQ ID NO: 396056 - DNA, 53 bp, Artificial Sequence
  Description of Artificial Sequence: Synthetic oligonucleotide
aaagaaaaagaaaagaaaaagaaaaaaaaagaaaaatgcccatccctcttgcg

SEQ ID NO: 396057 - DNA, 52 bp, Artificial Sequence
  Description of Artificial Sequence: Synthetic oligonucleotide
aagaaaaagaaaagaaaaagaaaaaaaaagaaaaatgcccatccctcttgcg

SEQ ID NO: 396058 - DNA, 51 bp, Artificial Sequence
  Description of Artificial Sequence: Synthetic oligonucleotide
agaaaaagaaaagaaaaagaaaaaaaaagaaaaatgcccatccctcttgcg

SEQ ID NO: 396059 - DNA, 50 bp, Artificial Sequence
  Description of Artificial Sequence: Synthetic oligonucleotide
gaaaaagaaaagaaaaagaaaaaaaaagaaaaatgcccatccctcttgcg

SEQ ID NO: 396060 - DNA, 53 bp, Artificial Sequence
  Description of Artificial Sequence: Synthetic oligonucleotide
aaaaagaaaagaaaaagaaaaaaaaagaaaaatgcccatccctcttgcgaatg

SEQ ID NO: 396061 - DNA, 52 bp, Artificial Sequence
  Description of Artificial Sequence: Synthetic oligonucleotide
aaaagaaaagaaaaagaaaaaaaaagaaaaatgcccatccctcttgcgaatg

SEQ ID NO: 396062 - DNA, 51 bp, Artificial Sequence
  Description of Artificial Sequence: Synthetic oligonucleotide
aaagaaaagaaaaagaaaaaaaaagaaaaatgcccatccctcttgcgaatg

SEQ ID NO: 396063 - DNA, 50 bp, Artificial Sequence
  Description of Artificial Sequence: Synthetic oligonucleotide
aagaaaagaaaaagaaaaaaaaagaaaaatgcccatccctcttgcgaatg

SEQ ID NO: 396064 - DNA, 49 bp, Artificial Sequence
  Description of Artificial Sequence: Synthetic oligonucleotide
agaaaagaaaaagaaaaaaaaagaaaaatgcccatccctcttgcgaatg

SEQ ID NO: 396065 - DNA, 48 bp, Artificial Sequence
  Description of Artificial Sequence: Synthetic oligonucleotide
gaaaagaaaaagaaaaaaaaagaaaaatgcccatccctcttgcgaatg

SEQ ID NO: 396066 - DNA, 48 bp, Artificial Sequence
  Description of Artificial Sequence: Synthetic oligonucleotide
aaaagaaaaagaaaaaaaaagaaaaatgcccatccctcttgcgaatgg

SEQ ID NO: 396067 - DNA, 47 bp, Artificial Sequence
  Description of Artificial Sequence: Synthetic oligonucleotide
aaagaaaaagaaaaaaaaagaaaaatgcccatccctcttgcgaatgg

SEQ ID NO: 396068 - DNA, 46 bp, Artificial Sequence
  Description of Artificial Sequence: Synthetic oligonucleotide
aagaaaaagaaaaaaaaagaaaaatgcccatccctcttgcgaatgg

SEQ ID NO: 396069 - DNA, 45 bp, Artificial Sequence
  Description of Artificial Sequence: Synthetic oligonucleotide
agaaaaagaaaaaaaaagaaaaatgcccatccctcttgcgaatgg

SEQ ID NO: 396070 - DNA, 44 bp, Artificial Sequence
  Description of Artificial Sequence: Synthetic oligonucleotide
gaaaaagaaaaaaaaagaaaaatgcccatccctcttgcgaatgg

SEQ ID NO: 396071 - DNA, 44 bp, Artificial Sequence
  Description of Artificial Sequence: Synthetic oligonucleotide
aaaaagaaaaaaaaagaaaaatgcccatccctcttgcgaatggc

SEQ ID NO: 396072 - DNA, 43 bp, Artificial Sequence
  Description of Artificial Sequence: Synthetic oligonucleotide
aaaagaaaaaaaaagaaaaatgcccatccctcttgcgaatggc

SEQ ID NO: 396073 - DNA, 42 bp, Artificial Sequence
  Description of Artificial Sequence: Synthetic oligonucleotide
aaagaaaaaaaaagaaaaatgcccatccctcttgcgaatggc

SEQ ID NO: 396074 - DNA, 41 bp, Artificial Sequence
  Description of Artificial Sequence: Synthetic oligonucleotide
aagaaaaaaaaagaaaaatgcccatccctcttgcgaatggc

SEQ ID NO: 396075 - DNA, 40 bp, Artificial Sequence
  Description of Artificial Sequence: Synthetic oligonucleotide
agaaaaaaaaagaaaaatgcccatccctcttgcgaatggc

SEQ ID NO: 396076 - DNA, 39 bp, Artificial Sequence
  Description of Artificial Sequence: Synthetic oligonucleotide
gaaaaaaaaagaaaaatgcccatccctcttgcgaatggc

SEQ ID NO: 396077 - DNA, 40 bp, Artificial Sequence
  Description of Artificial Sequence: Synthetic oligonucleotide
aaaaaaaaagaaaaatgcccatccctcttgcgaatggcag

SEQ ID NO: 396078 - DNA, 39 bp, Artificial Sequence
  Description of Artificial Sequence: Synthetic oligonucleotide
aaaaaaaagaaaaatgcccatccctcttgcgaatggcag

SEQ ID NO: 396079 - DNA, 38 bp, Artificial Sequence
  Description of Artificial Sequence: Synthetic oligonucleotide
aaaaaaagaaaaatgcccatccctcttgcgaatggcag

SEQ ID NO: 396080 - DNA, 37 bp, Artificial Sequence
  Description of Artificial Sequence: Synthetic oligonucleotide
aaaaaagaaaaatgcccatccctcttgcgaatggcag

SEQ ID NO: 396081 - DNA, 36 bp, Artificial Sequence
  Description of Artificial Sequence: Synthetic oligonucleotide
aaaaagaaaaatgcccatccctcttgcgaatggcag

SEQ ID NO: 396082 - DNA, 35 bp, Artificial Sequence
  Description of Artificial Sequence: Synthetic oligonucleotide
aaaagaaaaatgcccatccctcttgcgaatggcag

SEQ ID NO: 396083 - DNA, 34 bp, Artificial Sequence
  Description of Artificial Sequence: Synthetic oligonucleotide
aaagaaaaatgcccatccctcttgcgaatggcag

SEQ ID NO: 396084 - DNA, 33 bp, Artificial Sequence
  Description of Artificial Sequence: Synthetic oligonucleotide
aagaaaaatgcccatccctcttgcgaatggcag

SEQ ID NO: 396085 - DNA, 32 bp, Artificial Sequence
  Description of Artificial Sequence: Synthetic oligonucleotide
agaaaaatgcccatccctcttgcgaatggcag

SEQ ID NO: 396086 - DNA, 31 bp, Artificial Sequence
  Description of Artificial Sequence: Synthetic oligonucleotide
gaaaaatgcccatccctcttgcgaatggcag

SEQ ID NO: 396087 - DNA, 32 bp, Artificial Sequence
  Description of Artificial Sequence: Synthetic oligonucleotide
aaaaatgcccatccctcttgcgaatggcagac

SEQ ID NO: 396088 - DNA, 31 bp, Artificial Sequence
  Description of Artificial Sequence: Synthetic oligonucleotide
aaaatgcccatccctcttgcgaatggcagac

SEQ ID NO: 396089 - DNA, 30 bp, Artificial Sequence
  Description of Artificial Sequence: Synthetic oligonucleotide
aaatgcccatccctcttgcgaatggcagac

SEQ ID NO: 396090 - DNA, 29 bp, Artificial Sequence
  Description of Artificial Sequence: Synthetic oligonucleotide
aatgcccatccctcttgcgaatggcagac

SEQ ID NO: 396091 - DNA, 28 bp, Artificial Sequence
  Description of Artificial Sequence: Synthetic oligonucleotide
atgcccatccctcttgcgaatggcagac

SEQ ID NO: 396092 - DNA, 27 bp, Artificial Sequence
  Description of Artificial Sequence: Synthetic oligonucleotide
tgcccatccctcttgcgaatggcagac

SEQ ID NO: 396093 - DNA, 27 bp, Artificial Sequence
  Description of Artificial Sequence: Synthetic oligonucleotide
gcccatccctcttgcgaatggcagaca

SEQ ID NO: 396094 - DNA, 28 bp, Artificial Sequence
  Description of Artificial Sequence: Synthetic oligonucleotide
cccatccctcttgcgaatggcagacatg

SEQ ID NO: 396095 - DNA, 28 bp, Artificial Sequence
  Description of Artificial Sequence: Synthetic oligonucleotide
ccatccctcttgcgaatggcagacatgc

SEQ ID NO: 396096 - DNA, 29 bp, Artificial Sequence
  Description of Artificial Sequence: Synthetic oligonucleotide
catccctcttgcgaatggcagacatgcac

SEQ ID NO: 396097 - DNA, 30 bp, Artificial Sequence
  Description of Artificial Sequence: Synthetic oligonucleotide
atccctcttgcgaatggcagacatgcacac

SEQ ID NO: 396098 - DNA, 29 bp, Artificial Sequence
  Description of Artificial Sequence: Synthetic oligonucleotide
tccctcttgcgaatggcagacatgcacac

SEQ ID NO: 396099 - DNA, 28 bp, Artificial Sequence
  Description of Artificial Sequence: Synthetic oligonucleotide
ccctcttgcgaatggcagacatgcacac

SEQ ID NO: 396100 - DNA, 29 bp, Artificial Sequence
  Description of Artificial Sequence: Synthetic oligonucleotide
cctcttgcgaatggcagacatgcacacac

SEQ ID NO: 396101 - DNA, 29 bp, Artificial Sequence
  Description of Artificial Sequence: Synthetic oligonucleotide
ctcttgcgaatggcagacatgcacacacc

SEQ ID NO: 396102 - DNA, 30 bp, Artificial Sequence
  Description of Artificial Sequence: Synthetic oligonucleotide
tcttgcgaatggcagacatgcacacaccag

SEQ ID NO: 396103 - DNA, 29 bp, Artificial Sequence
  Description of Artificial Sequence: Synthetic oligonucleotide
cttgcgaatggcagacatgcacacaccag

SEQ ID NO: 396104 - DNA, 35 bp, Artificial Sequence
  Description of Artificial Sequence: Synthetic oligonucleotide
acaccagagaagattccaatttagtgtcctccctc

SEQ ID NO: 396105 - DNA, 34 bp, Artificial Sequence
  Description of Artificial Sequence: Synthetic oligonucleotide
caccagagaagattccaatttagtgtcctccctc

SEQ ID NO: 396106 - DNA, 35 bp, Artificial Sequence
  Description of Artificial Sequence: Synthetic oligonucleotide
accagagaagattccaatttagtgtcctccctctg

SEQ ID NO: 396107 - DNA, 34 bp, Artificial Sequence
  Description of Artificial Sequence: Synthetic oligonucleotide
ccagagaagattccaatttagtgtcctccctctg

SEQ ID NO: 396108 - DNA, 36 bp, Artificial Sequence
  Description of Artificial Sequence: Synthetic oligonucleotide
cagagaagattccaatttagtgtcctccctctgttc

SEQ ID NO: 396109 - DNA, 39 bp, Artificial Sequence
  Description of Artificial Sequence: Synthetic oligonucleotide
agagaagattccaatttagtgtcctccctctgttcatag

SEQ ID NO: 396110 - DNA, 38 bp, Artificial Sequence
  Description of Artificial Sequence: Synthetic oligonucleotide
gagaagattccaatttagtgtcctccctctgttcatag

SEQ ID NO: 396111 - DNA, 40 bp, Artificial Sequence
  Description of Artificial Sequence: Synthetic oligonucleotide
agaagattccaatttagtgtcctccctctgttcatagaac

SEQ ID NO: 396112 - DNA, 39 bp, Artificial Sequence
  Description of Artificial Sequence: Synthetic oligonucleotide
gaagattccaatttagtgtcctccctctgttcatagaac

SEQ ID NO: 396113 - DNA, 43 bp, Artificial Sequence
  Description of Artificial Sequence: Synthetic oligonucleotide
aagattccaatttagtgtcctccctctgttcatagaacaattc

SEQ ID NO: 396114 - DNA, 42 bp, Artificial Sequence
  Description of Artificial Sequence: Synthetic oligonucleotide
agattccaatttagtgtcctccctctgttcatagaacaattc

SEQ ID NO: 396115 - DNA, 41 bp, Artificial Sequence
  Description of Artificial Sequence: Synthetic oligonucleotide
gattccaatttagtgtcctccctctgttcatagaacaattc

SEQ ID NO: 396116 - DNA, 41 bp, Artificial Sequence
  Description of Artificial Sequence: Synthetic oligonucleotide
attccaatttagtgtcctccctctgttcatagaacaattcc

SEQ ID NO: 396117 - DNA, 40 bp, Artificial Sequence
  Description of Artificial Sequence: Synthetic oligonucleotide
ttccaatttagtgtcctccctctgttcatagaacaattcc

SEQ ID NO: 396118 - DNA, 39 bp, Artificial Sequence
  Description of Artificial Sequence: Synthetic oligonucleotide
tccaatttagtgtcctccctctgttcatagaacaattcc

SEQ ID NO: 396119 - DNA, 38 bp, Artificial Sequence
  Description of Artificial Sequence: Synthetic oligonucleotide
ccaatttagtgtcctccctctgttcatagaacaattcc

SEQ ID NO: 396120 - DNA, 39 bp, Artificial Sequence
  Description of Artificial Sequence: Synthetic oligonucleotide
caatttagtgtcctccctctgttcatagaacaattcctc

SEQ ID NO: 396121 - DNA, 41 bp, Artificial Sequence
  Description of Artificial Sequence: Synthetic oligonucleotide
aatttagtgtcctccctctgttcatagaacaattcctcaag

SEQ ID NO: 396122 - DNA, 40 bp, Artificial Sequence
  Description of Artificial Sequence: Synthetic oligonucleotide
atttagtgtcctccctctgttcatagaacaattcctcaag

SEQ ID NO: 396123 - DNA, 39 bp, Artificial Sequence
  Description of Artificial Sequence: Synthetic oligonucleotide
tttagtgtcctccctctgttcatagaacaattcctcaag

SEQ ID NO: 396124 - DNA, 38 bp, Artificial Sequence
  Description of Artificial Sequence: Synthetic oligonucleotide
ttagtgtcctccctctgttcatagaacaattcctcaag

SEQ ID NO: 396125 - DNA, 37 bp, Artificial Sequence
  Description of Artificial Sequence: Synthetic oligonucleotide
tagtgtcctccctctgttcatagaacaattcctcaag

SEQ ID NO: 396126 - DNA, 36 bp, Artificial Sequence
  Description of Artificial Sequence: Synthetic oligonucleotide
agtgtcctccctctgttcatagaacaattcctcaag

SEQ ID NO: 396127 - DNA, 35 bp, Artificial Sequence
  Description of Artificial Sequence: Synthetic oligonucleotide
gtgtcctccctctgttcatagaacaattcctcaag

SEQ ID NO: 396128 - DNA, 36 bp, Artificial Sequence
  Description of Artificial Sequence: Synthetic oligonucleotide
tgtcctccctctgttcatagaacaattcctcaagtc

SEQ ID NO: 396129 - DNA, 35 bp, Artificial Sequence
  Description of Artificial Sequence: Synthetic oligonucleotide
gtcctccctctgttcatagaacaattcctcaagtc

SEQ ID NO: 396130 - DNA, 35 bp, Artificial Sequence
  Description of Artificial Sequence: Synthetic oligonucleotide
tcctccctctgttcatagaacaattcctcaagtcc

SEQ ID NO: 396131 - DNA, 34 bp, Artificial Sequence
  Description of Artificial Sequence: Synthetic oligonucleotide
cctccctctgttcatagaacaattcctcaagtcc

SEQ ID NO: 396132 - DNA, 35 bp, Artificial Sequence
  Description of Artificial Sequence: Synthetic oligonucleotide
ctccctctgttcatagaacaattcctcaagtccac

SEQ ID NO: 396133 - DNA, 36 bp, Artificial Sequence
  Description of Artificial Sequence: Synthetic oligonucleotide
tccctctgttcatagaacaattcctcaagtccactc

SEQ ID NO: 396134 - DNA, 35 bp, Artificial Sequence
  Description of Artificial Sequence: Synthetic oligonucleotide
ccctctgttcatagaacaattcctcaagtccactc

SEQ ID NO: 396135 - DNA, 36 bp, Artificial Sequence
  Description of Artificial Sequence: Synthetic oligonucleotide
cctctgttcatagaacaattcctcaagtccactctg

SEQ ID NO: 396136 - DNA, 37 bp, Artificial Sequence
  Description of Artificial Sequence: Synthetic oligonucleotide
ctctgttcatagaacaattcctcaagtccactctgag

SEQ ID NO: 396137 - DNA, 39 bp, Artificial Sequence
  Description of Artificial Sequence: Synthetic oligonucleotide
tctgttcatagaacaattcctcaagtccactctgagtag

SEQ ID NO: 396138 - DNA, 38 bp, Artificial Sequence
  Description of Artificial Sequence: Synthetic oligonucleotide
ctgttcatagaacaattcctcaagtccactctgagtag

SEQ ID NO: 396139 - DNA, 39 bp, Artificial Sequence
  Description of Artificial Sequence: Synthetic oligonucleotide
tgttcatagaacaattcctcaagtccactctgagtagag

SEQ ID NO: 396140 - DNA, 38 bp, Artificial Sequence
  Description of Artificial Sequence: Synthetic oligonucleotide
gttcatagaacaattcctcaagtccactctgagtagag

SEQ ID NO: 396141 - DNA, 32 bp, Artificial Sequence
  Description of Artificial Sequence: Synthetic oligonucleotide
attgccctgtctccttccagggctcttaatac

SEQ ID NO: 396142 - DNA, 31 bp, Artificial Sequence
  Description of Artificial Sequence: Synthetic oligonucleotide
ttgccctgtctccttccagggctcttaatac

SEQ ID NO: 396143 - DNA, 30 bp, Artificial Sequence
  Description of Artificial Sequence: Synthetic oligonucleotide
tgccctgtctccttccagggctcttaatac

SEQ ID NO: 396144 - DNA, 29 bp, Artificial Sequence
  Description of Artificial Sequence: Synthetic oligonucleotide
gccctgtctccttccagggctcttaatac

SEQ ID NO: 396145 - DNA, 32 bp, Artificial Sequence
  Description of Artificial Sequence: Synthetic oligonucleotide
ccctgtctccttccagggctcttaatacaaac

SEQ ID NO: 396146 - DNA, 33 bp, Artificial Sequence
  Description of Artificial Sequence: Synthetic oligonucleotide
cctgtctccttccagggctcttaatacaaactc

SEQ ID NO: 396147 - DNA, 35 bp, Artificial Sequence
  Description of Artificial Sequence: Synthetic oligonucleotide
ctgtctccttccagggctcttaatacaaactcttc

SEQ ID NO: 396148 - DNA, 36 bp, Artificial Sequence
  Description of Artificial Sequence: Synthetic oligonucleotide
tgtctccttccagggctcttaatacaaactcttcag

SEQ ID NO: 396149 - DNA, 35 bp, Artificial Sequence
  Description of Artificial Sequence: Synthetic oligonucleotide
gtctccttccagggctcttaatacaaactcttcag

SEQ ID NO: 396150 - DNA, 35 bp, Artificial Sequence
  Description of Artificial Sequence: Synthetic oligonucleotide
tctccttccagggctcttaatacaaactcttcagc

SEQ ID NO: 396151 - DNA, 34 bp, Artificial Sequence
  Description of Artificial Sequence: Synthetic oligonucleotide
ctccttccagggctcttaatacaaactcttcagc

SEQ ID NO: 396152 - DNA, 36 bp, Artificial Sequence
  Description of Artificial Sequence: Synthetic oligonucleotide
tccttccagggctcttaatacaaactcttcagctag

SEQ ID NO: 396153 - DNA, 35 bp, Artificial Sequence
  Description of Artificial Sequence: Synthetic oligonucleotide
ccttccagggctcttaatacaaactcttcagctag

SEQ ID NO: 396154 - DNA, 38 bp, Artificial Sequence
  Description of Artificial Sequence: Synthetic oligonucleotide
cttccagggctcttaatacaaactcttcagctagtaac

SEQ ID NO: 396155 - DNA, 39 bp, Artificial Sequence
  Description of Artificial Sequence: Synthetic oligonucleotide
ttccagggctcttaatacaaactcttcagctagtaactg

SEQ ID NO: 396156 - DNA, 38 bp, Artificial Sequence
  Description of Artificial Sequence: Synthetic oligonucleotide
tccagggctcttaatacaaactcttcagctagtaactg

SEQ ID NO: 396157 - DNA, 37 bp, Artificial Sequence
  Description of Artificial Sequence: Synthetic oligonucleotide
ccagggctcttaatacaaactcttcagctagtaactg

SEQ ID NO: 396158 - DNA, 38 bp, Artificial Sequence
  Description of Artificial Sequence: Synthetic oligonucleotide
cagggctcttaatacaaactcttcagctagtaactgag

SEQ ID NO: 396159 - DNA, 40 bp, Artificial Sequence
  Description of Artificial Sequence: Synthetic oligonucleotide
agggctcttaatacaaactcttcagctagtaactgagatg

SEQ ID NO: 396160 - DNA, 39 bp, Artificial Sequence
  Description of Artificial Sequence: Synthetic oligonucleotide
gggctcttaatacaaactcttcagctagtaactgagatg

SEQ ID NO: 396161 - DNA, 40 bp, Artificial Sequence
  Description of Artificial Sequence: Synthetic oligonucleotide
ggctcttaatacaaactcttcagctagtaactgagatgtc

SEQ ID NO: 396162 - DNA, 41 bp, Artificial Sequence
  Description of Artificial Sequence: Synthetic oligonucleotide
gctcttaatacaaactcttcagctagtaactgagatgtcac

SEQ ID NO: 396163 - DNA, 41 bp, Artificial Sequence
  Description of Artificial Sequence: Synthetic oligonucleotide
ctcttaatacaaactcttcagctagtaactgagatgtcacc

SEQ ID NO: 396164 - DNA, 43 bp, Artificial Sequence
  Description of Artificial Sequence: Synthetic oligonucleotide
tcttaatacaaactcttcagctagtaactgagatgtcaccatg

SEQ ID NO: 396165 - DNA, 42 bp, Artificial Sequence
  Description of Artificial Sequence: Synthetic oligonucleotide
cttaatacaaactcttcagctagtaactgagatgtcaccatg

SEQ ID NO: 396166 - DNA, 42 bp, Artificial Sequence
  Description of Artificial Sequence: Synthetic oligonucleotide
ttaatacaaactcttcagctagtaactgagatgtcaccatgg

SEQ ID NO: 396167 - DNA, 41 bp, Artificial Sequence
  Description of Artificial Sequence: Synthetic oligonucleotide
taatacaaactcttcagctagtaactgagatgtcaccatgg

SEQ ID NO: 396168 - DNA, 40 bp, Artificial Sequence
  Description of Artificial Sequence: Synthetic oligonucleotide
aatacaaactcttcagctagtaactgagatgtcaccatgg

SEQ ID NO: 396169 - DNA, 39 bp, Artificial Sequence
  Description of Artificial Sequence: Synthetic oligonucleotide
atacaaactcttcagctagtaactgagatgtcaccatgg

SEQ ID NO: 396170 - DNA, 38 bp, Artificial Sequence
  Description of Artificial Sequence: Synthetic oligonucleotide
tacaaactcttcagctagtaactgagatgtcaccatgg

SEQ ID NO: 396171 - DNA, 37 bp, Artificial Sequence
  Description of Artificial Sequence: Synthetic oligonucleotide
acaaactcttcagctagtaactgagatgtcaccatgg

SEQ ID NO: 396172 - DNA, 36 bp, Artificial Sequence
  Description of Artificial Sequence: Synthetic oligonucleotide
caaactcttcagctagtaactgagatgtcaccatgg

SEQ ID NO: 396173 - DNA, 36 bp, Artificial Sequence
  Description of Artificial Sequence: Synthetic oligonucleotide
aaactcttcagctagtaactgagatgtcaccatggg

SEQ ID NO: 396174 - DNA, 35 bp, Artificial Sequence
  Description of Artificial Sequence: Synthetic oligonucleotide
aactcttcagctagtaactgagatgtcaccatggg

SEQ ID NO: 396175 - DNA, 34 bp, Artificial Sequence
  Description of Artificial Sequence: Synthetic oligonucleotide
actcttcagctagtaactgagatgtcaccatggg

SEQ ID NO: 396176 - DNA, 33 bp, Artificial Sequence
  Description of Artificial Sequence: Synthetic oligonucleotide
ctcttcagctagtaactgagatgtcaccatggg

SEQ ID NO: 396177 - DNA, 33 bp, Artificial Sequence
  Description of Artificial Sequence: Synthetic oligonucleotide
tcttcagctagtaactgagatgtcaccatgggg

SEQ ID NO: 396178 - DNA, 32 bp, Artificial Sequence
  Description of Artificial Sequence: Synthetic oligonucleotide
cttcagctagtaactgagatgtcaccatgggg

SEQ ID NO: 396179 - DNA, 32 bp, Artificial Sequence
  Description of Artificial Sequence: Synthetic oligonucleotide
ttcagctagtaactgagatgtcaccatggggg

SEQ ID NO: 396180 - DNA, 31 bp, Artificial Sequence
  Description of Artificial Sequence: Synthetic oligonucleotide
tcagctagtaactgagatgtcaccatggggg

SEQ ID NO: 396181 - DNA, 30 bp, Artificial Sequence
  Description of Artificial Sequence: Synthetic oligonucleotide
cagctagtaactgagatgtcaccatggggg

SEQ ID NO: 396182 - DNA, 36 bp, Artificial Sequence
  Description of Artificial Sequence: Synthetic oligonucleotide
agctagtaactgagatgtcaccatgggggatttttc

SEQ ID NO: 396183 - DNA, 35 bp, Artificial Sequence
  Description of Artificial Sequence: Synthetic oligonucleotide
gctagtaactgagatgtcaccatgggggatttttc

SEQ ID NO: 396184 - DNA, 35 bp, Artificial Sequence
  Description of Artificial Sequence: Synthetic oligonucleotide
catgggggatttttctaattggccaaaacctgacc

SEQ ID NO: 396185 - DNA, 36 bp, Artificial Sequence
  Description of Artificial Sequence: Synthetic oligonucleotide
atgggggatttttctaattggccaaaacctgacctg

SEQ ID NO: 396186 - DNA, 35 bp, Artificial Sequence
  Description of Artificial Sequence: Synthetic oligonucleotide
tgggggatttttctaattggccaaaacctgacctg

SEQ ID NO: 396187 - DNA, 34 bp, Artificial Sequence
  Description of Artificial Sequence: Synthetic oligonucleotide
gggggatttttctaattggccaaaacctgacctg

SEQ ID NO: 396188 - DNA, 34 bp, Artificial Sequence
  Description of Artificial Sequence: Synthetic oligonucleotide
ggggatttttctaattggccaaaacctgacctgg

SEQ ID NO: 396189 - DNA, 34 bp, Artificial Sequence
  Description of Artificial Sequence: Synthetic oligonucleotide
gggatttttctaattggccaaaacctgacctggc

SEQ ID NO: 396190 - DNA, 35 bp, Artificial Sequence
  Description of Artificial Sequence: Synthetic oligonucleotide
ggatttttctaattggccaaaacctgacctggcag

SEQ ID NO: 396191 - DNA, 35 bp, Artificial Sequence
  Description of Artificial Sequence: Synthetic oligonucleotide
gatttttctaattggccaaaacctgacctggcagg

SEQ ID NO: 396192 - DNA, 35 bp, Artificial Sequence
  Description of Artificial Sequence: Synthetic oligonucleotide
atttttctaattggccaaaacctgacctggcaggg

SEQ ID NO: 396193 - DNA, 34 bp, Artificial Sequence
  Description of Artificial Sequence: Synthetic oligonucleotide
tttttctaattggccaaaacctgacctggcaggg

SEQ ID NO: 396194 - DNA, 33 bp, Artificial Sequence
  Description of Artificial Sequence: Synthetic oligonucleotide
ttttctaattggccaaaacctgacctggcaggg

SEQ ID NO: 396195 - DNA, 32 bp, Artificial Sequence
  Description of Artificial Sequence: Synthetic oligonucleotide
tttctaattggccaaaacctgacctggcaggg

SEQ ID NO: 396196 - DNA, 31 bp, Artificial Sequence
  Description of Artificial Sequence: Synthetic oligonucleotide
ttctaattggccaaaacctgacctggcaggg

SEQ ID NO: 396197 - DNA, 30 bp, Artificial Sequence
  Description of Artificial Sequence: Synthetic oligonucleotide
tctaattggccaaaacctgacctggcaggg

SEQ ID NO: 396198 - DNA, 29 bp, Artificial Sequence
  Description of Artificial Sequence: Synthetic oligonucleotide
ctaattggccaaaacctgacctggcaggg

SEQ ID NO: 396199 - DNA, 32 bp, Artificial Sequence
  Description of Artificial Sequence: Synthetic oligonucleotide
taattggccaaaacctgacctggcagggtttg

SEQ ID NO: 396200 - DNA, 31 bp, Artificial Sequence
  Description of Artificial Sequence: Synthetic oligonucleotide
aattggccaaaacctgacctggcagggtttg

SEQ ID NO: 396201 - DNA, 30 bp, Artificial Sequence
  Description of Artificial Sequence: Synthetic oligonucleotide
attggccaaaacctgacctggcagggtttg

SEQ ID NO: 396202 - DNA, 29 bp, Artificial Sequence
  Description of Artificial Sequence: Synthetic oligonucleotide
ttggccaaaacctgacctggcagggtttg

SEQ ID NO: 396203 - DNA, 28 bp, Artificial Sequence
  Description of Artificial Sequence: Synthetic oligonucleotide
tggccaaaacctgacctggcagggtttg

SEQ ID NO: 396204 - DNA, 27 bp, Artificial Sequence
  Description of Artificial Sequence: Synthetic oligonucleotide
ggccaaaacctgacctggcagggtttg

SEQ ID NO: 396205 - DNA, 27 bp, Artificial Sequence
  Description of Artificial Sequence: Synthetic oligonucleotide
gccaaaacctgacctggcagggtttgg

SEQ ID NO: 396206 - DNA, 30 bp, Artificial Sequence
  Description of Artificial Sequence: Synthetic oligonucleotide
ccaaaacctgacctggcagggtttggtttg

SEQ ID NO: 396207 - DNA, 30 bp, Artificial Sequence
  Description of Artificial Sequence: Synthetic oligonucleotide
caaaacctgacctggcagggtttggtttgg

SEQ ID NO: 396208 - DNA, 30 bp, Artificial Sequence
  Description of Artificial Sequence: Synthetic oligonucleotide
aaaacctgacctggcagggtttggtttggg

SEQ ID NO: 396209 - DNA, 29 bp, Artificial Sequence
  Description of Artificial Sequence: Synthetic oligonucleotide
aaacctgacctggcagggtttggtttggg

SEQ ID NO: 396210 - DNA, 28 bp, Artificial Sequence
  Description of Artificial Sequence: Synthetic oligonucleotide
aacctgacctggcagggtttggtttggg

SEQ ID NO: 396211 - DNA, 27 bp, Artificial Sequence
  Description of Artificial Sequence: Synthetic oligonucleotide
acctgacctggcagggtttggtttggg

SEQ ID NO: 396212 - DNA, 27 bp, Artificial Sequence
  Description of Artificial Sequence: Synthetic oligonucleotide
cctgacctggcagggtttggtttgggt

SEQ ID NO: 396213 - DNA, 27 bp, Artificial Sequence
  Description of Artificial Sequence: Synthetic oligonucleotide
ctgacctggcagggtttggtttgggtg

SEQ ID NO: 396214 - DNA, 28 bp, Artificial Sequence
  Description of Artificial Sequence: Synthetic oligonucleotide
tgacctggcagggtttggtttgggtgtc

SEQ ID NO: 396215 - DNA, 27 bp, Artificial Sequence
  Description of Artificial Sequence: Synthetic oligonucleotide
gacctggcagggtttggtttgggtgtc

SEQ ID NO: 396216 - DNA, 29 bp, Artificial Sequence
  Description of Artificial Sequence: Synthetic oligonucleotide
acctggcagggtttggtttgggtgtcttc

SEQ ID NO: 396217 - DNA, 28 bp, Artificial Sequence
  Description of Artificial Sequence: Synthetic oligonucleotide
cctggcagggtttggtttgggtgtcttc

SEQ ID NO: 396218 - DNA, 29 bp, Artificial Sequence
  Description of Artificial Sequence: Synthetic oligonucleotide
ctggcagggtttggtttgggtgtcttcag

SEQ ID NO: 396219 - DNA, 34 bp, Artificial Sequence
  Description of Artificial Sequence: Synthetic oligonucleotide
gtttgggtgtcttcagatttccttgtcttgaggc

SEQ ID NO: 396220 - DNA, 34 bp, Artificial Sequence
  Description of Artificial Sequence: Synthetic oligonucleotide
tttgggtgtcttcagatttccttgtcttgaggcc

SEQ ID NO: 396221 - DNA, 33 bp, Artificial Sequence
  Description of Artificial Sequence: Synthetic oligonucleotide
ttgggtgtcttcagatttccttgtcttgaggcc

SEQ ID NO: 396222 - DNA, 32 bp, Artificial Sequence
  Description of Artificial Sequence: Synthetic oligonucleotide
tgggtgtcttcagatttccttgtcttgaggcc

SEQ ID NO: 396223 - DNA, 31 bp, Artificial Sequence
  Description of Artificial Sequence: Synthetic oligonucleotide
gggtgtcttcagatttccttgtcttgaggcc

SEQ ID NO: 396224 - DNA, 31 bp, Artificial Sequence
  Description of Artificial Sequence: Synthetic oligonucleotide
ggtgtcttcagatttccttgtcttgaggccc

SEQ ID NO: 396225 - DNA, 32 bp, Artificial Sequence
  Description of Artificial Sequence: Synthetic oligonucleotide
gtgtcttcagatttccttgtcttgaggccctc

SEQ ID NO: 396226 - DNA, 33 bp, Artificial Sequence
  Description of Artificial Sequence: Synthetic oligonucleotide
tgtcttcagatttccttgtcttgaggccctcac

SEQ ID NO: 396227 - DNA, 32 bp, Artificial Sequence
  Description of Artificial Sequence: Synthetic oligonucleotide
gtcttcagatttccttgtcttgaggccctcac

SEQ ID NO: 396228 - DNA, 36 bp, Artificial Sequence
  Description of Artificial Sequence: Synthetic oligonucleotide
tcttcagatttccttgtcttgaggccctcacaattg

SEQ ID NO: 396229 - DNA, 35 bp, Artificial Sequence
  Description of Artificial Sequence: Synthetic oligonucleotide
cttcagatttccttgtcttgaggccctcacaattg

SEQ ID NO: 396230 - DNA, 35 bp, Artificial Sequence
  Description of Artificial Sequence: Synthetic oligonucleotide
ttcagatttccttgtcttgaggccctcacaattgc

SEQ ID NO: 396231 - DNA, 34 bp, Artificial Sequence
  Description of Artificial Sequence: Synthetic oligonucleotide
tcagatttccttgtcttgaggccctcacaattgc

SEQ ID NO: 396232 - DNA, 33 bp, Artificial Sequence
  Description of Artificial Sequence: Synthetic oligonucleotide
cagatttccttgtcttgaggccctcacaattgc

SEQ ID NO: 396233 - DNA, 34 bp, Artificial Sequence
  Description of Artificial Sequence: Synthetic oligonucleotide
agatttccttgtcttgaggccctcacaattgctc

SEQ ID NO: 396234 - DNA, 33 bp, Artificial Sequence
  Description of Artificial Sequence: Synthetic oligonucleotide
gatttccttgtcttgaggccctcacaattgctc

SEQ ID NO: 396235 - DNA, 35 bp, Artificial Sequence
  Description of Artificial Sequence: Synthetic oligonucleotide
atttccttgtcttgaggccctcacaattgctctac

SEQ ID NO: 396236 - DNA, 34 bp, Artificial Sequence
  Description of Artificial Sequence: Synthetic oligonucleotide
tttccttgtcttgaggccctcacaattgctctac

SEQ ID NO: 396237 - DNA, 33 bp, Artificial Sequence
  Description of Artificial Sequence: Synthetic oligonucleotide
ttccttgtcttgaggccctcacaattgctctac

SEQ ID NO: 396238 - DNA, 32 bp, Artificial Sequence
  Description of Artificial Sequence: Synthetic oligonucleotide
tccttgtcttgaggccctcacaattgctctac

SEQ ID NO: 396239 - DNA, 31 bp, Artificial Sequence
  Description of Artificial Sequence: Synthetic oligonucleotide
ccttgtcttgaggccctcacaattgctctac

SEQ ID NO: 396240 - DNA, 32 bp, Artificial Sequence
  Description of Artificial Sequence: Synthetic oligonucleotide
cttgtcttgaggccctcacaattgctctacag

SEQ ID NO: 396241 - DNA, 32 bp, Artificial Sequence
  Description of Artificial Sequence: Synthetic oligonucleotide
ttgtcttgaggccctcacaattgctctacagc

SEQ ID NO: 396242 - DNA, 31 bp, Artificial Sequence
  Description of Artificial Sequence: Synthetic oligonucleotide
tgtcttgaggccctcacaattgctctacagc

SEQ ID NO: 396243 - DNA, 30 bp, Artificial Sequence
  Description of Artificial Sequence: Synthetic oligonucleotide
gtcttgaggccctcacaattgctctacagc

SEQ ID NO: 396244 - DNA, 31 bp, Artificial Sequence
  Description of Artificial Sequence: Synthetic oligonucleotide
tcttgaggccctcacaattgctctacagctc

SEQ ID NO: 396245 - DNA, 30 bp, Artificial Sequence
  Description of Artificial Sequence: Synthetic oligonucleotide
cttgaggccctcacaattgctctacagctc

SEQ ID NO: 396246 - DNA, 31 bp, Artificial Sequence
  Description of Artificial Sequence: Synthetic oligonucleotide
ttgaggccctcacaattgctctacagctcag

SEQ ID NO: 396247 - DNA, 30 bp, Artificial Sequence
  Description of Artificial Sequence: Synthetic oligonucleotide
tgaggccctcacaattgctctacagctcag

SEQ ID NO: 396248 - DNA, 29 bp, Artificial Sequence
  Description of Artificial Sequence: Synthetic oligonucleotide
gaggccctcacaattgctctacagctcag

SEQ ID NO: 396249 - DNA, 31 bp, Artificial Sequence
  Description of Artificial Sequence: Synthetic oligonucleotide
aggccctcacaattgctctacagctcagaac

SEQ ID NO: 396250 - DNA, 30 bp, Artificial Sequence
  Description of Artificial Sequence: Synthetic oligonucleotide
ggccctcacaattgctctacagctcagaac

SEQ ID NO: 396251 - DNA, 31 bp, Artificial Sequence
  Description of Artificial Sequence: Synthetic oligonucleotide
gccctcacaattgctctacagctcagaacag

SEQ ID NO: 396252 - DNA, 31 bp, Artificial Sequence
  Description of Artificial Sequence: Synthetic oligonucleotide
ccctcacaattgctctacagctcagaacagc

SEQ ID NO: 396253 - DNA, 33 bp, Artificial Sequence
  Description of Artificial Sequence: Synthetic oligonucleotide
cctcacaattgctctacagctcagaacagcaac

SEQ ID NO: 396254 - DNA, 34 bp, Artificial Sequence
  Description of Artificial Sequence: Synthetic oligonucleotide
ctcacaattgctctacagctcagaacagcaactg

SEQ ID NO: 396255 - DNA, 34 bp, Artificial Sequence
  Description of Artificial Sequence: Synthetic oligonucleotide
tcacaattgctctacagctcagaacagcaactgc

SEQ ID NO: 396256 - DNA, 33 bp, Artificial Sequence
  Description of Artificial Sequence: Synthetic oligonucleotide
cacaattgctctacagctcagaacagcaactgc

SEQ ID NO: 396257 - DNA, 34 bp, Artificial Sequence
  Description of Artificial Sequence: Synthetic oligonucleotide
acaattgctctacagctcagaacagcaactgctg

SEQ ID NO: 396258 - DNA, 33 bp, Artificial Sequence
  Description of Artificial Sequence: Synthetic oligonucleotide
caattgctctacagctcagaacagcaactgctg

SEQ ID NO: 396259 - DNA, 34 bp, Artificial Sequence
  Description of Artificial Sequence: Synthetic oligonucleotide
aattgctctacagctcagaacagcaactgctgag

SEQ ID NO: 396260 - DNA, 33 bp, Artificial Sequence
  Description of Artificial Sequence: Synthetic oligonucleotide
attgctctacagctcagaacagcaactgctgag

SEQ ID NO: 396261 - DNA, 32 bp, Artificial Sequence
  Description of Artificial Sequence: Synthetic oligonucleotide
ttgctctacagctcagaacagcaactgctgag

SEQ ID NO: 396262 - DNA, 31 bp, Artificial Sequence
  Description of Artificial Sequence: Synthetic oligonucleotide
tgctctacagctcagaacagcaactgctgag

SEQ ID NO: 396263 - DNA, 30 bp, Artificial Sequence
  Description of Artificial Sequence: Synthetic oligonucleotide
gctctacagctcagaacagcaactgctgag

SEQ ID NO: 396264 - DNA, 36 bp, Artificial Sequence
  Description of Artificial Sequence: Synthetic oligonucleotide
cttgggaagaggatgatcctaaacaaagctctgatg

SEQ ID NO: 396265 - DNA, 36 bp, Artificial Sequence
  Description of Artificial Sequence: Synthetic oligonucleotide
ttgggaagaggatgatcctaaacaaagctctgatgc

SEQ ID NO: 396266 - DNA, 35 bp, Artificial Sequence
  Description of Artificial Sequence: Synthetic oligonucleotide
tgggaagaggatgatcctaaacaaagctctgatgc

SEQ ID NO: 396267 - DNA, 34 bp, Artificial Sequence
  Description of Artificial Sequence: Synthetic oligonucleotide
gggaagaggatgatcctaaacaaagctctgatgc

SEQ ID NO: 396268 - DNA, 35 bp, Artificial Sequence
  Description of Artificial Sequence: Synthetic oligonucleotide
ggaagaggatgatcctaaacaaagctctgatgctg

SEQ ID NO: 396269 - DNA, 35 bp, Artificial Sequence
  Description of Artificial Sequence: Synthetic oligonucleotide
gaagaggatgatcctaaacaaagctctgatgctgg

SEQ ID NO: 396270 - DNA, 35 bp, Artificial Sequence
  Description of Artificial Sequence: Synthetic oligonucleotide
aagaggatgatcctaaacaaagctctgatgctggg

SEQ ID NO: 396271 - DNA, 34 bp, Artificial Sequence
  Description of Artificial Sequence: Synthetic oligonucleotide
agaggatgatcctaaacaaagctctgatgctggg

SEQ ID NO: 396272 - DNA, 33 bp, Artificial Sequence
  Description of Artificial Sequence: Synthetic oligonucleotide
gaggatgatcctaaacaaagctctgatgctggg

SEQ ID NO: 396273 - DNA, 33 bp, Artificial Sequence
  Description of Artificial Sequence: Synthetic oligonucleotide
aggatgatcctaaacaaagctctgatgctgggg

SEQ ID NO: 396274 - DNA, 32 bp, Artificial Sequence
  Description of Artificial Sequence: Synthetic oligonucleotide
ggatgatcctaaacaaagctctgatgctgggg

SEQ ID NO: 396275 - DNA, 32 bp, Artificial Sequence; identical to SEQ ID NO: 56655
  Description of Artificial Sequence: Synthetic oligonucleotide

SEQ ID NO: 396276 - DNA, 34 bp, Artificial Sequence; identical to SEQ ID NO: 56656
  Description of Artificial Sequence: Synthetic oligonucleotide

SEQ ID NO: 396277 - DNA, 33 bp, Artificial Sequence; identical to SEQ ID NO: 56657
  Description of Artificial Sequence: Synthetic oligonucleotide

SEQ ID NO: 396278 - DNA, 33 bp, Artificial Sequence; identical to SEQ ID NO: 56658
  Description of Artificial Sequence: Synthetic oligonucleotide

SEQ ID NO: 396279 - DNA, 32 bp, Artificial Sequence; identical to SEQ ID NO: 56659
  Description of Artificial Sequence: Synthetic oligonucleotide

SEQ ID NO: 396280 - DNA, 31 bp, Artificial Sequence; identical to SEQ ID NO: 56660
  Description of Artificial Sequence: Synthetic oligonucleotide

SEQ ID NO: 396281 - DNA, 31 bp, Artificial Sequence; identical to SEQ ID NO: 56661
  Description of Artificial Sequence: Synthetic oligonucleotide

SEQ ID NO: 396282 - DNA, 30 bp, Artificial Sequence; identical to SEQ ID NO: 56662
  Description of Artificial Sequence: Synthetic oligonucleotide

SEQ ID NO: 396283 - DNA, 31 bp, Artificial Sequence; identical to SEQ ID NO: 56663
  Description of Artificial Sequence: Synthetic oligonucleotide

SEQ ID NO: 396284 - DNA, 30 bp, Artificial Sequence; identical to SEQ ID NO: 56664
  Description of Artificial Sequence: Synthetic oligonucleotide

SEQ ID NO: 396285 - DNA, 29 bp, Artificial Sequence
  Description of Artificial Sequence: Synthetic oligonucleotide
tgtggctgaccatgttgcctcttacggtg

SEQ ID NO: 396286 - DNA, 28 bp, Artificial Sequence
  Description of Artificial Sequence: Synthetic oligonucleotide
gtggctgaccatgttgcctcttacggtg

SEQ ID NO: 396287 - DNA, 32 bp, Artificial Sequence; identical to SEQ ID NO: 56667
  Description of Artificial Sequence: Synthetic oligonucleotide

SEQ ID NO: 396288 - DNA, 31 bp, Artificial Sequence; identical to SEQ ID NO: 56668
  Description of Artificial Sequence: Synthetic oligonucleotide

SEQ ID NO: 396289 - DNA, 33 bp, Artificial Sequence; identical to SEQ ID NO: 56669
  Description of Artificial Sequence: Synthetic oligonucleotide

SEQ ID NO: 396290 - DNA, 35 bp, Artificial Sequence; identical to SEQ ID NO: 56670
  Description of Artificial Sequence: Synthetic oligonucleotide

SEQ ID NO: 396291 - DNA, 35 bp, Artificial Sequence; identical to SEQ ID NO: 56671
  Description of Artificial Sequence: Synthetic oligonucleotide

SEQ ID NO: 396292 - DNA, 34 bp, Artificial Sequence; identical to SEQ ID NO: 56672
  Description of Artificial Sequence: Synthetic oligonucleotide

SEQ ID NO: 396293 - DNA, 35 bp, Artificial Sequence; identical to SEQ ID NO: 56673
  Description of Artificial Sequence: Synthetic oligonucleotide

SEQ ID NO: 396294 - DNA, 34 bp, Artificial Sequence; identical to SEQ ID NO: 56674
  Description of Artificial Sequence: Synthetic oligonucleotide

SEQ ID NO: 396295 - DNA, 35 bp, Artificial Sequence; identical to SEQ ID NO: 56675
  Description of Artificial Sequence: Synthetic oligonucleotide

SEQ ID NO: 396296 - DNA, 39 bp, Artificial Sequence; identical to SEQ ID NO: 56676
  Description of Artificial Sequence: Synthetic oligonucleotide

SEQ ID NO: 396297 - DNA, 38 bp, Artificial Sequence; identical to SEQ ID NO: 56677
  Description of Artificial Sequence: Synthetic oligonucleotide

SEQ ID NO: 396298 - DNA, 37 bp, Artificial Sequence; identical to SEQ ID NO: 56678
  Description of Artificial Sequence: Synthetic oligonucleotide

SEQ ID NO: 396299 - DNA, 37 bp, Artificial Sequence; identical to SEQ ID NO: 56679
  Description of Artificial Sequence: Synthetic oligonucleotide

SEQ ID NO: 396300 - DNA, 36 bp, Artificial Sequence; identical to SEQ ID NO: 56680
  Description of Artificial Sequence: Synthetic oligonucleotide

SEQ ID NO: 396301 - DNA, 35 bp, Artificial Sequence; identical to SEQ ID NO: 56681
  Description of Artificial Sequence: Synthetic oligonucleotide

SEQ ID NO: 396302 - DNA, 36 bp, Artificial Sequence; identical to SEQ ID NO: 56682
  Description of Artificial Sequence: Synthetic oligonucleotide

SEQ ID NO: 396303 - DNA, 36 bp, Artificial Sequence; identical to SEQ ID NO: 56683
  Description of Artificial Sequence: Synthetic oligonucleotide

SEQ ID NO: 396304 - DNA, 36 bp, Artificial Sequence; identical to SEQ ID NO: 56684
  Description of Artificial Sequence: Synthetic oligonucleotide

SEQ ID NO: 396305 - DNA, 35 bp, Artificial Sequence; identical to SEQ ID NO: 56685
  Description of Artificial Sequence: Synthetic oligonucleotide

SEQ ID NO: 396306 - DNA, 36 bp, Artificial Sequence; identical to SEQ ID NO: 56686
  Description of Artificial Sequence: Synthetic oligonucleotide

SEQ ID NO: 396307 - DNA, 35 bp, Artificial Sequence; identical to SEQ ID NO: 56687
  Description of Artificial Sequence: Synthetic oligonucleotide

SEQ ID NO: 396308 - DNA, 34 bp, Artificial Sequence; identical to SEQ ID NO: 56688
  Description of Artificial Sequence: Synthetic oligonucleotide

SEQ ID NO: 396309 - DNA, 33 bp, Artificial Sequence; identical to SEQ ID NO: 56689
  Description of Artificial Sequence: Synthetic oligonucleotide

SEQ ID NO: 396310 - DNA, 34 bp, Artificial Sequence; identical to SEQ ID NO: 56690
  Description of Artificial Sequence: Synthetic oligonucleotide

SEQ ID NO: 396311 - DNA, 34 bp, Artificial Sequence; identical to SEQ ID NO: 56691
  Description of Artificial Sequence: Synthetic oligonucleotide

SEQ ID NO: 396312 - DNA, 34 bp, Artificial Sequence; identical to SEQ ID NO: 56692
  Description of Artificial Sequence: Synthetic oligonucleotide

SEQ ID NO: 396313 - DNA, 33 bp, Artificial Sequence; identical to SEQ ID NO: 56693
  Description of Artificial Sequence: Synthetic oligonucleotide

SEQ ID NO: 396314 - DNA, 33 bp, Artificial Sequence; identical to SEQ ID NO: 56694
  Description of Artificial Sequence: Synthetic oligonucleotide

SEQ ID NO: 396315 - DNA, 32 bp, Artificial Sequence; identical to SEQ ID NO: 56695
  Description of Artificial Sequence: Synthetic oligonucleotide

SEQ ID NO: 396316 - DNA, 31 bp, Artificial Sequence; identical to SEQ ID NO: 56696
  Description of Artificial Sequence: Synthetic oligonucleotide

SEQ ID NO: 396317 - DNA, 30 bp, Artificial Sequence; identical to SEQ ID NO: 56697
  Description of Artificial Sequence: Synthetic oligonucleotide

SEQ ID NO: 396318 - DNA, 29 bp, Artificial Sequence
  Description of Artificial Sequence: Synthetic oligonucleotide
cttgtaccagtcttatggtccctctgggc

SEQ ID NO: 396319 - DNA, 30 bp, Artificial Sequence; identical to SEQ ID NO: 56699
  Description of Artificial Sequence: Synthetic oligonucleotide

SEQ ID NO: 396320 - DNA, 29 bp, Artificial Sequence
  Description of Artificial Sequence: Synthetic oligonucleotide
tgtaccagtcttatggtccctctgggcag

SEQ ID NO: 396321 - DNA, 28 bp, Artificial Sequence
  Description of Artificial Sequence: Synthetic oligonucleotide
gtaccagtcttatggtccctctgggcag

SEQ ID NO: 396322 - DNA, 30 bp, Artificial Sequence; identical to SEQ ID NO: 56702
  Description of Artificial Sequence: Synthetic oligonucleotide

SEQ ID NO: 396323 - DNA, 29 bp, Artificial Sequence
  Description of Artificial Sequence: Synthetic oligonucleotide
accagtcttatggtccctctgggcagtac

SEQ ID NO: 396324 - DNA, 28 bp, Artificial Sequence
  Description of Artificial Sequence: Synthetic oligonucleotide
ccagtcttatggtccctctgggcagtac

SEQ ID NO: 396325 - DNA, 29 bp, Artificial Sequence
  Description of Artificial Sequence: Synthetic oligonucleotide
cagtcttatggtccctctgggcagtacag

SEQ ID NO: 396326 - DNA, 29 bp, Artificial Sequence
  Description of Artificial Sequence: Synthetic oligonucleotide
agtcttatggtccctctgggcagtacagc

SEQ ID NO: 396327 - DNA, 28 bp, Artificial Sequence
  Description of Artificial Sequence: Synthetic oligonucleotide
gtcttatggtccctctgggcagtacagc

SEQ ID NO: 396328 - DNA, 28 bp, Artificial Sequence
  Description of Artificial Sequence: Synthetic oligonucleotide
tcttatggtccctctgggcagtacagcc

SEQ ID NO: 396329 - DNA, 27 bp, Artificial Sequence
  Description of Artificial Sequence: Synthetic oligonucleotide
cttatggtccctctgggcagtacagcc

SEQ ID NO: 396330 - DNA, 29 bp, Artificial Sequence
  Description of Artificial Sequence: Synthetic oligonucleotide
ttatggtccctctgggcagtacagccatg

SEQ ID NO: 396331 - DNA, 28 bp, Artificial Sequence
  Description of Artificial Sequence: Synthetic oligonucleotide
tatggtccctctgggcagtacagccatg

SEQ ID NO: 396332 - DNA, 27 bp, Artificial Sequence
  Description of Artificial Sequence: Synthetic oligonucleotide
atggtccctctgggcagtacagccatg

SEQ ID NO: 396333 - DNA, 27 bp, Artificial Sequence
  Description of Artificial Sequence: Synthetic oligonucleotide
tggtccctctgggcagtacagccatga

SEQ ID NO: 396334 - DNA, 27 bp, Artificial Sequence
  Description of Artificial Sequence: Synthetic oligonucleotide
ggtccctctgggcagtacagccatgaa

SEQ ID NO: 396335 - DNA, 30 bp, Artificial Sequence; identical to SEQ ID NO: 56715
  Description of Artificial Sequence: Synthetic oligonucleotide

SEQ ID NO: 396336 - DNA, 32 bp, Artificial Sequence; identical to SEQ ID NO: 56716
  Description of Artificial Sequence: Synthetic oligonucleotide

SEQ ID NO: 396337 - DNA, 31 bp, Artificial Sequence; identical to SEQ ID NO: 56717
  Description of Artificial Sequence: Synthetic oligonucleotide

SEQ ID NO: 396338 - DNA, 31 bp, Artificial Sequence; identical to SEQ ID NO: 56718
  Description of Artificial Sequence: Synthetic oligonucleotide

SEQ ID NO: 396339 - DNA, 32 bp, Artificial Sequence; identical to SEQ ID NO: 56719
  Description of Artificial Sequence: Synthetic oligonucleotide

SEQ ID NO: 396340 - DNA, 33 bp, Artificial Sequence; identical to SEQ ID NO: 56720
  Description of Artificial Sequence: Synthetic oligonucleotide

SEQ ID NO: 396341 - DNA, 32 bp, Artificial Sequence; identical to SEQ ID NO: 56721
  Description of Artificial Sequence: Synthetic oligonucleotide

SEQ ID NO: 396342 - DNA, 32 bp, Artificial Sequence; identical to SEQ ID NO: 56722
  Description of Artificial Sequence: Synthetic oligonucleotide

SEQ ID NO: 396343 - DNA, 31 bp, Artificial Sequence; identical to SEQ ID NO: 56723
  Description of Artificial Sequence: Synthetic oligonucleotide

SEQ ID NO: 396344 - DNA, 32 bp, Artificial Sequence; identical to SEQ ID NO: 56724
  Description of Artificial Sequence: Synthetic oligonucleotide

SEQ ID NO: 396345 - DNA, 32 bp, Artificial Sequence; identical to SEQ ID NO: 56725
  Description of Artificial Sequence: Synthetic oligonucleotide

SEQ ID NO: 396346 - DNA, 33 bp, Artificial Sequence; identical to SEQ ID NO: 56726
  Description of Artificial Sequence: Synthetic oligonucleotide

SEQ ID NO: 396347 - DNA, 35 bp, Artificial Sequence; identical to SEQ ID NO: 56727
  Description of Artificial Sequence: Synthetic oligonucleotide

SEQ ID NO: 396348 - DNA, 34 bp, Artificial Sequence; identical to SEQ ID NO: 56728
  Description of Artificial Sequence: Synthetic oligonucleotide

SEQ ID NO: 396349 - DNA, 37 bp, Artificial Sequence; identical to SEQ ID NO: 56729
  Description of Artificial Sequence: Synthetic oligonucleotide

SEQ ID NO: 396350 - DNA, 36 bp, Artificial Sequence; identical to SEQ ID NO: 56730
  Description of Artificial Sequence: Synthetic oligonucleotide

SEQ ID NO: 396351 - DNA, 35 bp, Artificial Sequence; identical to SEQ ID NO: 56731
  Description of Artificial Sequence: Synthetic oligonucleotide

SEQ ID NO: 396352 - DNA, 36 bp, Artificial Sequence; identical to SEQ ID NO: 56732
  Description of Artificial Sequence: Synthetic oligonucleotide

SEQ ID NO: 396353 - DNA, 35 bp, Artificial Sequence; identical to SEQ ID NO: 56733
  Description of Artificial Sequence: Synthetic oligonucleotide

SEQ ID NO: 396354 - DNA, 27 bp, Artificial Sequence
  Description of Artificial Sequence: Synthetic oligonucleotide
acctggagaggaaggagactgtctggc

SEQ ID NO: 396355 - DNA, 27 bp, Artificial Sequence
  Description of Artificial Sequence: Synthetic oligonucleotide
cctggagaggaaggagactgtctggca

SEQ ID NO: 396356 - DNA, 27 bp, Artificial Sequence
  Description of Artificial Sequence: Synthetic oligonucleotide
ctggagaggaaggagactgtctggcag

SEQ ID NO: 396357 - DNA, 29 bp, Artificial Sequence
  Description of Artificial Sequence: Synthetic oligonucleotide
tggagaggaaggagactgtctggcagttg

SEQ ID NO: 396358 - DNA, 28 bp, Artificial Sequence
  Description of Artificial Sequence: Synthetic oligonucleotide
ggagaggaaggagactgtctggcagttg

SEQ ID NO: 396359 - DNA, 28 bp, Artificial Sequence
  Description of Artificial Sequence: Synthetic oligonucleotide
gagaggaaggagactgtctggcagttgc

SEQ ID NO: 396360 - DNA, 28 bp, Artificial Sequence
  Description of Artificial Sequence: Synthetic oligonucleotide
agaggaaggagactgtctggcagttgcc

SEQ ID NO: 396361 - DNA, 27 bp, Artificial Sequence
  Description of Artificial Sequence: Synthetic oligonucleotide
gaggaaggagactgtctggcagttgcc

SEQ ID NO: 396362 - DNA, 28 bp, Artificial Sequence
  Description of Artificial Sequence: Synthetic oligonucleotide
aggaaggagactgtctggcagttgcctc

SEQ ID NO: 396363 - DNA, 27 bp, Artificial Sequence
  Description of Artificial Sequence: Synthetic oligonucleotide
ggaaggagactgtctggcagttgcctc

SEQ ID NO: 396364 - DNA, 28 bp, Artificial Sequence
  Description of Artificial Sequence: Synthetic oligonucleotide
gaaggagactgtctggcagttgcctctg

SEQ ID NO: 396365 - DNA, 30 bp, Artificial Sequence; identical to SEQ ID NO: 56745
  Description of Artificial Sequence: Synthetic oligonucleotide

SEQ ID NO: 396366 - DNA, 29 bp, Artificial Sequence
  Description of Artificial Sequence: Synthetic oligonucleotide
aggagactgtctggcagttgcctctgttc

SEQ ID NO: 396367 - DNA, 28 bp, Artificial Sequence
  Description of Artificial Sequence: Synthetic oligonucleotide
ggagactgtctggcagttgcctctgttc

SEQ ID NO: 396368 - DNA, 28 bp, Artificial Sequence
  Description of Artificial Sequence: Synthetic oligonucleotide
gagactgtctggcagttgcctctgttcc

SEQ ID NO: 396369 - DNA, 28 bp, Artificial Sequence
  Description of Artificial Sequence: Synthetic oligonucleotide
agactgtctggcagttgcctctgttccg

SEQ ID NO: 396370 - DNA, 27 bp, Artificial Sequence
  Description of Artificial Sequence: Synthetic oligonucleotide
gactgtctggcagttgcctctgttccg

SEQ ID NO: 396371 - DNA, 27 bp, Artificial Sequence
  Description of Artificial Sequence: Synthetic oligonucleotide
actgtctggcagttgcctctgttccgc

SEQ ID NO: 396372 - DNA, 27 bp, Artificial Sequence
  Description of Artificial Sequence: Synthetic oligonucleotide
ctgtctggcagttgcctctgttccgca

SEQ ID NO: 396373 - DNA, 27 bp, Artificial Sequence
  Description of Artificial Sequence: Synthetic oligonucleotide
tgtctggcagttgcctctgttccgcag

SEQ ID NO: 396374 - DNA, 27 bp, Artificial Sequence
  Description of Artificial Sequence: Synthetic oligonucleotide
gtctggcagttgcctctgttccgcaga

SEQ ID NO: 396375 - DNA, 31 bp, Artificial Sequence; identical to SEQ ID NO: 56755
  Description of Artificial Sequence: Synthetic oligonucleotide

SEQ ID NO: 396376 - DNA, 30 bp, Artificial Sequence; identical to SEQ ID NO: 56756
  Description of Artificial Sequence: Synthetic oligonucleotide

SEQ ID NO: 396377 - DNA, 32 bp, Artificial Sequence; identical to SEQ ID NO: 56757
  Description of Artificial Sequence: Synthetic oligonucleotide

SEQ ID NO: 396378 - DNA, 31 bp, Artificial Sequence; identical to SEQ ID NO: 56758
  Description of Artificial Sequence: Synthetic oligonucleotide

SEQ ID NO: 396379 - DNA, 35 bp, Artificial Sequence; identical to SEQ ID NO: 56759
  Description of Artificial Sequence: Synthetic oligonucleotide

SEQ ID NO: 396380 - DNA, 36 bp, Artificial Sequence; identical to SEQ ID NO: 56760
  Description of Artificial Sequence: Synthetic oligonucleotide

SEQ ID NO: 396381 - DNA, 36 bp, Artificial Sequence; identical to SEQ ID NO: 56761
  Description of Artificial Sequence: Synthetic oligonucleotide

SEQ ID NO: 396382 - DNA, 35 bp, Artificial Sequence; identical to SEQ ID NO: 56762
  Description of Artificial Sequence: Synthetic oligonucleotide

SEQ ID NO: 396383 - DNA, 35 bp, Artificial Sequence; identical to SEQ ID NO: 56763
  Description of Artificial Sequence: Synthetic oligonucleotide

SEQ ID NO: 396384 - DNA, 34 bp, Artificial Sequence; identical to SEQ ID NO: 56764
  Description of Artificial Sequence: Synthetic oligonucleotide

SEQ ID NO: 396385 - DNA, 33 bp, Artificial Sequence; identical to SEQ ID NO: 56765
  Description of Artificial Sequence: Synthetic oligonucleotide

SEQ ID NO: 396386 - DNA, 33 bp, Artificial Sequence; identical to SEQ ID NO: 56766
  Description of Artificial Sequence: Synthetic oligonucleotide

SEQ ID NO: 396387 - DNA, 33 bp, Artificial Sequence; identical to SEQ ID NO: 56767
  Description of Artificial Sequence: Synthetic oligonucleotide

SEQ ID NO: 396388 - DNA, 38 bp, Artificial Sequence; identical to SEQ ID NO: 56768
  Description of Artificial Sequence: Synthetic oligonucleotide

SEQ ID NO: 396389 - DNA, 37 bp, Artificial Sequence; identical to SEQ ID NO: 56769
  Description of Artificial Sequence: Synthetic oligonucleotide

SEQ ID NO: 396390 - DNA, 37 bp, Artificial Sequence; identical to SEQ ID NO: 56770
  Description of Artificial Sequence: Synthetic oligonucleotide

SEQ ID NO: 396391 - DNA, 36 bp, Artificial Sequence; identical to SEQ ID NO: 56771
  Description of Artificial Sequence: Synthetic oligonucleotide

SEQ ID NO: 396392 - DNA, 37 bp, Artificial Sequence; identical to SEQ ID NO: 56772
  Description of Artificial Sequence: Synthetic oligonucleotide

SEQ ID NO: 396393 - DNA, 36 bp, Artificial Sequence; identical to SEQ ID NO: 56773
  Description of Artificial Sequence: Synthetic oligonucleotide

SEQ ID NO: 396394 - DNA, 35 bp, Artificial Sequence; identical to SEQ ID NO: 56774
  Description of Artificial Sequence: Synthetic oligonucleotide

SEQ ID NO: 396395 - DNA, 36 bp, Artificial Sequence; identical to SEQ ID NO: 56775
  Description of Artificial Sequence: Synthetic oligonucleotide

SEQ ID NO: 396396 - DNA, 37 bp, Artificial Sequence; identical to SEQ ID NO: 56776
  Description of Artificial Sequence: Synthetic oligonucleotide

SEQ ID NO: 396397 - DNA, 40 bp, Artificial Sequence; identical to SEQ ID NO: 56777
  Description of Artificial Sequence: Synthetic oligonucleotide

SEQ ID NO: 396398 - DNA, 42 bp, Artificial Sequence; identical to SEQ ID NO: 56778
  Description of Artificial Sequence: Synthetic oligonucleotide

SEQ ID NO: 396399 - DNA, 41 bp, Artificial Sequence; identical to SEQ ID NO: 56779
  Description of Artificial Sequence: Synthetic oligonucleotide

SEQ ID NO: 396400 - DNA, 41 bp, Artificial Sequence; identical to SEQ ID NO: 56780
  Description of Artificial Sequence: Synthetic oligonucleotide

SEQ ID NO: 396401 - DNA, 40 bp, Artificial Sequence; identical to SEQ ID NO: 56781
  Description of Artificial Sequence: Synthetic oligonucleotide

SEQ ID NO: 396402 - DNA, 39 bp, Artificial Sequence; identical to SEQ ID NO: 56782
  Description of Artificial Sequence: Synthetic oligonucleotide

SEQ ID NO: 396403 - DNA, 38 bp, Artificial Sequence; identical to SEQ ID NO: 56783
  Description of Artificial Sequence: Synthetic oligonucleotide

SEQ ID NO: 396404 - DNA, 37 bp, Artificial Sequence; identical to SEQ ID NO: 56784
  Description of Artificial Sequence: Synthetic oligonucleotide

SEQ ID NO: 396405 - DNA, 36 bp, Artificial Sequence; identical to SEQ ID NO: 56785
  Description of Artificial Sequence: Synthetic oligonucleotide

SEQ ID NO: 396406 - DNA, 36 bp, Artificial Sequence; identical to SEQ ID NO: 56786
  Description of Artificial Sequence: Synthetic oligonucleotide

SEQ ID NO: 396407 - DNA, 41 bp, Artificial Sequence; identical to SEQ ID NO: 56787
  Description of Artificial Sequence: Synthetic oligonucleotide

SEQ ID NO: 396408 - DNA, 40 bp, Artificial Sequence; identical to SEQ ID NO: 56788
  Description of Artificial Sequence: Synthetic oligonucleotide

SEQ ID NO: 396409 - DNA, 41 bp, Artificial Sequence; identical to SEQ ID NO: 56789
  Description of Artificial Sequence: Synthetic oligonucleotide

SEQ ID NO: 396410 - DNA, 40 bp, Artificial Sequence; identical to SEQ ID NO: 56790
  Description of Artificial Sequence: Synthetic oligonucleotide

SEQ ID NO: 396411 - DNA, 46 bp, Artificial Sequence; identical to SEQ ID NO: 56791
  Description of Artificial Sequence: Synthetic oligonucleotide

SEQ ID NO: 396412 - DNA, 45 bp, Artificial Sequence; identical to SEQ ID NO: 56792
  Description of Artificial Sequence: Synthetic oligonucleotide

SEQ ID NO: 396413 - DNA, 45 bp, Artificial Sequence; identical to SEQ ID NO: 56793
  Description of Artificial Sequence: Synthetic oligonucleotide

SEQ ID NO: 396414 - DNA, 44 bp, Artificial Sequence; identical to SEQ ID NO: 56794
  Description of Artificial Sequence: Synthetic oligonucleotide

SEQ ID NO: 396415 - DNA, 43 bp, Artificial Sequence; identical to SEQ ID NO: 56795
  Description of Artificial Sequence: Synthetic oligonucleotide

SEQ ID NO: 396416 - DNA, 42 bp, Artificial Sequence; identical to SEQ ID NO: 56796
  Description of Artificial Sequence: Synthetic oligonucleotide

SEQ ID NO: 396417 - DNA, 42 bp, Artificial Sequence; identical to SEQ ID NO: 56797
  Description of Artificial Sequence: Synthetic oligonucleotide

SEQ ID NO: 396418 - DNA, 41 bp, Artificial Sequence; identical to SEQ ID NO: 56798
  Description of Artificial Sequence: Synthetic oligonucleotide

SEQ ID NO: 396419 - DNA, 40 bp, Artificial Sequence; identical to SEQ ID NO: 56799
  Description of Artificial Sequence: Synthetic oligonucleotide

SEQ ID NO: 396420 - DNA, 41 bp, Artificial Sequence; identical to SEQ ID NO: 56800
  Description of Artificial Sequence: Synthetic oligonucleotide

SEQ ID NO: 396421 - DNA, 41 bp, Artificial Sequence; identical to SEQ ID NO: 56801
  Description of Artificial Sequence: Synthetic oligonucleotide

SEQ ID NO: 396422 - DNA, 43 bp, Artificial Sequence; identical to SEQ ID NO: 56802
  Description of Artificial Sequence: Synthetic oligonucleotide

SEQ ID NO: 396423 - DNA, 42 bp, Artificial Sequence; identical to SEQ ID NO: 56803
  Description of Artificial Sequence: Synthetic oligonucleotide

SEQ ID NO: 396424 - DNA, 43 bp, Artificial Sequence; identical to SEQ ID NO: 56804
  Description of Artificial Sequence: Synthetic oligonucleotide

SEQ ID NO: 396425 - DNA, 42 bp, Artificial Sequence; identical to SEQ ID NO: 56805
  Description of Artificial Sequence: Synthetic oligonucleotide

SEQ ID NO: 396426 - DNA, 44 bp, Artificial Sequence; identical to SEQ ID NO: 56806
  Description of Artificial Sequence: Synthetic oligonucleotide

SEQ ID NO: 396427 - DNA, 44 bp, Artificial Sequence; identical to SEQ ID NO: 56807
  Description of Artificial Sequence: Synthetic oligonucleotide

SEQ ID NO: 396428 - DNA, 43 bp, Artificial Sequence; identical to SEQ ID NO: 56808
  Description of Artificial Sequence: Synthetic oligonucleotide

SEQ ID NO: 396429 - DNA, 42 bp, Artificial Sequence; identical to SEQ ID NO: 56809
  Description of Artificial Sequence: Synthetic oligonucleotide

SEQ ID NO: 396430 - DNA, 41 bp, Artificial Sequence; identical to SEQ ID NO: 56810
  Description of Artificial Sequence: Synthetic oligonucleotide

SEQ ID NO: 396431 - DNA, 40 bp, Artificial Sequence; identical to SEQ ID NO: 56811
  Description of Artificial Sequence: Synthetic oligonucleotide

SEQ ID NO: 396432 - DNA, 39 bp, Artificial Sequence; identical to SEQ ID NO: 56812
  Description of Artificial Sequence: Synthetic oligonucleotide

SEQ ID NO: 396433 - DNA, 39 bp, Artificial Sequence; identical to SEQ ID NO: 56813
  Description of Artificial Sequence: Synthetic oligonucleotide

SEQ ID NO: 396434 - DNA, 38 bp, Artificial Sequence; identical to SEQ ID NO: 56814
  Description of Artificial Sequence: Synthetic oligonucleotide

SEQ ID NO: 396435 - DNA, 37 bp, Artificial Sequence; identical to SEQ ID NO: 56815
  Description of Artificial Sequence: Synthetic oligonucleotide

SEQ ID NO: 396436 - DNA, 36 bp, Artificial Sequence; identical to SEQ ID NO: 56816
  Description of Artificial Sequence: Synthetic oligonucleotide

SEQ ID NO: 396437 - DNA, 35 bp, Artificial Sequence; identical to SEQ ID NO: 56817
  Description of Artificial Sequence: Synthetic oligonucleotide

SEQ ID NO: 396438 - DNA, 35 bp, Artificial Sequence; identical to SEQ ID NO: 56818
  Description of Artificial Sequence: Synthetic oligonucleotide

SEQ ID NO: 396439 - DNA, 34 bp, Artificial Sequence; identical to SEQ ID NO: 56819
  Description of Artificial Sequence: Synthetic oligonucleotide

SEQ ID NO: 396440 - DNA, 33 bp, Artificial Sequence; identical to SEQ ID NO: 56820
  Description of Artificial Sequence: Synthetic oligonucleotide

SEQ ID NO: 396441 - DNA, 34 bp, Artificial Sequence; identical to SEQ ID NO: 56821
  Description of Artificial Sequence: Synthetic oligonucleotide

SEQ ID NO: 396442 - DNA, 33 bp, Artificial Sequence; identical to SEQ ID NO: 56822
  Description of Artificial Sequence: Synthetic oligonucleotide

SEQ ID NO: 396443 - DNA, 32 bp, Artificial Sequence; identical to SEQ ID NO: 56823
  Description of Artificial Sequence: Synthetic oligonucleotide

SEQ ID NO: 396444 - DNA, 32 bp, Artificial Sequence; identical to SEQ ID NO: 56824
  Description of Artificial Sequence: Synthetic oligonucleotide

SEQ ID NO: 396445 - DNA, 31 bp, Artificial Sequence; identical to SEQ ID NO: 56825
  Description of Artificial Sequence: Synthetic oligonucleotide

SEQ ID NO: 396446 - DNA, 30 bp, Artificial Sequence; identical to SEQ ID NO: 56826
  Description of Artificial Sequence: Synthetic oligonucleotide

SEQ ID NO: 396447 - DNA, 32 bp, Artificial Sequence; identical to SEQ ID NO: 56827
  Description of Artificial Sequence: Synthetic oligonucleotide

SEQ ID NO: 396448 - DNA, 33 bp, Artificial Sequence; identical to SEQ ID NO: 56828
  Description of Artificial Sequence: Synthetic oligonucleotide

SEQ ID NO: 396449 - DNA, 32 bp, Artificial Sequence; identical to SEQ ID NO: 56829
  Description of Artificial Sequence: Synthetic oligonucleotide

SEQ ID NO: 396450 - DNA, 33 bp, Artificial Sequence; identical to SEQ ID NO: 56830
  Description of Artificial Sequence: Synthetic oligonucleotide

SEQ ID NO: 396451 - DNA, 32 bp, Artificial Sequence; identical to SEQ ID NO: 56831
  Description of Artificial Sequence: Synthetic oligonucleotide

SEQ ID NO: 396452 - DNA, 31 bp, Artificial Sequence; identical to SEQ ID NO: 56832
  Description of Artificial Sequence: Synthetic oligonucleotide

SEQ ID NO: 396453 - DNA, 31 bp, Artificial Sequence; identical to SEQ ID NO: 56833
  Description of Artificial Sequence: Synthetic oligonucleotide

SEQ ID NO: 396454 - DNA, 30 bp, Artificial Sequence; identical to SEQ ID NO: 56834
  Description of Artificial Sequence: Synthetic oligonucleotide

SEQ ID NO: 396455 - DNA, 33 bp, Artificial Sequence; identical to SEQ ID NO: 56835
  Description of Artificial Sequence: Synthetic oligonucleotide

SEQ ID NO: 396456 - DNA, 32 bp, Artificial Sequence; identical to SEQ ID NO: 56836
  Description of Artificial Sequence: Synthetic oligonucleotide

SEQ ID NO: 396457 - DNA, 31 bp, Artificial Sequence; identical to SEQ ID NO: 56837
  Description of Artificial Sequence: Synthetic oligonucleotide

SEQ ID NO: 396458 - DNA, 30 bp, Artificial Sequence; identical to SEQ ID NO: 56838
  Description of Artificial Sequence: Synthetic oligonucleotide

SEQ ID NO: 396459 - DNA, 31 bp, Artificial Sequence; identical to SEQ ID NO: 56839
  Description of Artificial Sequence: Synthetic oligonucleotide

SEQ ID NO: 396460 - DNA, 30 bp, Artificial Sequence; identical to SEQ ID NO: 56840
  Description of Artificial Sequence: Synthetic oligonucleotide

SEQ ID NO: 396461 - DNA, 31 bp, Artificial Sequence; identical to SEQ ID NO: 56841
  Description of Artificial Sequence: Synthetic oligonucleotide

SEQ ID NO: 396462 - DNA, 30 bp, Artificial Sequence; identical to SEQ ID NO: 56842
  Description of Artificial Sequence: Synthetic oligonucleotide

SEQ ID NO: 396463 - DNA, 31 bp, Artificial Sequence; identical to SEQ ID NO: 56843
  Description of Artificial Sequence: Synthetic oligonucleotide

SEQ ID NO: 396464 - DNA, 31 bp, Artificial Sequence; identical to SEQ ID NO: 56844
  Description of Artificial Sequence: Synthetic oligonucleotide

SEQ ID NO: 396465 - DNA, 32 bp, Artificial Sequence; identical to SEQ ID NO: 56845
  Description of Artificial Sequence: Synthetic oligonucleotide

SEQ ID NO: 396466 - DNA, 31 bp, Artificial Sequence; identical to SEQ ID NO: 56846
  Description of Artificial Sequence: Synthetic oligonucleotide

SEQ ID NO: 396467 - DNA, 32 bp, Artificial Sequence; identical to SEQ ID NO: 56847
  Description of Artificial Sequence: Synthetic oligonucleotide

SEQ ID NO: 396468 - DNA, 33 bp, Artificial Sequence; identical to SEQ ID NO: 56848
  Description of Artificial Sequence: Synthetic oligonucleotide

SEQ ID NO: 396469 - DNA, 34 bp, Artificial Sequence; identical to SEQ ID NO: 56849
  Description of Artificial Sequence: Synthetic oligonucleotide

SEQ ID NO: 396470 - DNA, 33 bp, Artificial Sequence; identical to SEQ ID NO: 56850
  Description of Artificial Sequence: Synthetic oligonucleotide

SEQ ID NO: 396471 - DNA, 34 bp, Artificial Sequence; identical to SEQ ID NO: 56851
  Description of Artificial Sequence: Synthetic oligonucleotide

SEQ ID NO: 396472 - DNA, 33 bp, Artificial Sequence; identical to SEQ ID NO: 56852
  Description of Artificial Sequence: Synthetic oligonucleotide

SEQ ID NO: 396473 - DNA, 34 bp, Artificial Sequence; identical to SEQ ID NO: 56853
  Description of Artificial Sequence: Synthetic oligonucleotide

SEQ ID NO: 396474 - DNA, 33 bp, Artificial Sequence; identical to SEQ ID NO: 56854
  Description of Artificial Sequence: Synthetic oligonucleotide

SEQ ID NO: 396475 - DNA, 32 bp, Artificial Sequence; identical to SEQ ID NO: 56855
  Description of Artificial Sequence: Synthetic oligonucleotide

SEQ ID NO: 396476 - DNA, 31 bp, Artificial Sequence; identical to SEQ ID NO: 56856
  Description of Artificial Sequence: Synthetic oligonucleotide

SEQ ID NO: 396477 - DNA, 32 bp, Artificial Sequence; identical to SEQ ID NO: 56857
  Description of Artificial Sequence: Synthetic oligonucleotide

SEQ ID NO: 396478 - DNA, 32 bp, Artificial Sequence; identical to SEQ ID NO: 56858
  Description of Artificial Sequence: Synthetic oligonucleotide

SEQ ID NO: 396479 - DNA, 31 bp, Artificial Sequence; identical to SEQ ID NO: 56859
  Description of Artificial Sequence: Synthetic oligonucleotide

SEQ ID NO: 396480 - DNA, 39 bp, Artificial Sequence
  Description of Artificial Sequence: Synthetic oligonucleotide
aaaaattcctggaggttgtaacccagaaaatcctgatgg

SEQ ID NO: 396481 - DNA, 38 bp, Artificial Sequence
  Description of Artificial Sequence: Synthetic oligonucleotide
aaaattcctggaggttgtaacccagaaaatcctgatgg

SEQ ID NO: 396482 - DNA, 37 bp, Artificial Sequence
  Description of Artificial Sequence: Synthetic oligonucleotide
aaattcctggaggttgtaacccagaaaatcctgatgg

SEQ ID NO: 396483 - DNA, 36 bp, Artificial Sequence
  Description of Artificial Sequence: Synthetic oligonucleotide
aattcctggaggttgtaacccagaaaatcctgatgg

SEQ ID NO: 396484 - DNA, 35 bp, Artificial Sequence
  Description of Artificial Sequence: Synthetic oligonucleotide
attcctggaggttgtaacccagaaaatcctgatgg

SEQ ID NO: 396485 - DNA, 34 bp, Artificial Sequence
  Description of Artificial Sequence: Synthetic oligonucleotide
ttcctggaggttgtaacccagaaaatcctgatgg

SEQ ID NO: 396486 - DNA, 33 bp, Artificial Sequence
  Description of Artificial Sequence: Synthetic oligonucleotide
tcctggaggttgtaacccagaaaatcctgatgg

SEQ ID NO: 396487 - DNA, 32 bp, Artificial Sequence
  Description of Artificial Sequence: Synthetic oligonucleotide
cctggaggttgtaacccagaaaatcctgatgg

SEQ ID NO: 396488 - DNA, 34 bp, Artificial Sequence
  Description of Artificial Sequence: Synthetic oligonucleotide
ctggaggttgtaacccagaaaatcctgatggatg

SEQ ID NO: 396489 - DNA, 34 bp, Artificial Sequence
  Description of Artificial Sequence: Synthetic oligonucleotide
tggaggttgtaacccagaaaatcctgatggatgc

SEQ ID NO: 396490 - DNA, 33 bp, Artificial Sequence
  Description of Artificial Sequence: Synthetic oligonucleotide
ggaggttgtaacccagaaaatcctgatggatgc

SEQ ID NO: 396491 - DNA, 33 bp, Artificial Sequence
  Description of Artificial Sequence: Synthetic oligonucleotide
gaggttgtaacccagaaaatcctgatggatgcc

SEQ ID NO: 396492 - DNA, 39 bp, Artificial Sequence
  Description of Artificial Sequence: Synthetic oligonucleotide
aggttgtaacccagaaaatcctgatggatgccatataac

SEQ ID NO: 396493 - DNA, 38 bp, Artificial Sequence
  Description of Artificial Sequence: Synthetic oligonucleotide
ggttgtaacccagaaaatcctgatggatgccatataac

SEQ ID NO: 396494 - DNA, 39 bp, Artificial Sequence
  Description of Artificial Sequence: Synthetic oligonucleotide
gttgtaacccagaaaatcctgatggatgccatataactg

SEQ ID NO: 396495 - DNA, 41 bp, Artificial Sequence
  Description of Artificial Sequence: Synthetic oligonucleotide
ttgtaacccagaaaatcctgatggatgccatataactgatg

SEQ ID NO: 396496 - DNA, 40 bp, Artificial Sequence
  Description of Artificial Sequence: Synthetic oligonucleotide
tgtaacccagaaaatcctgatggatgccatataactgatg

SEQ ID NO: 396497 - DNA, 39 bp, Artificial Sequence
  Description of Artificial Sequence: Synthetic oligonucleotide
gtaacccagaaaatcctgatggatgccatataactgatg

SEQ ID NO: 396498 - DNA, 40 bp, Artificial Sequence
  Description of Artificial Sequence: Synthetic oligonucleotide
taacccagaaaatcctgatggatgccatataactgatgac

SEQ ID NO: 396499 - DNA, 39 bp, Artificial Sequence
  Description of Artificial Sequence: Synthetic oligonucleotide
aacccagaaaatcctgatggatgccatataactgatgac

SEQ ID NO: 396500 - DNA, 38 bp, Artificial Sequence
  Description of Artificial Sequence: Synthetic oligonucleotide
acccagaaaatcctgatggatgccatataactgatgac

SEQ ID NO: 396501 - DNA, 37 bp, Artificial Sequence
  Description of Artificial Sequence: Synthetic oligonucleotide
cccagaaaatcctgatggatgccatataactgatgac

SEQ ID NO: 396502 - DNA, 37 bp, Artificial Sequence
  Description of Artificial Sequence: Synthetic oligonucleotide
ccagaaaatcctgatggatgccatataactgatgacc

SEQ ID NO: 396503 - DNA, 38 bp, Artificial Sequence
  Description of Artificial Sequence: Synthetic oligonucleotide
cagaaaatcctgatggatgccatataactgatgacctc

SEQ ID NO: 396504 - DNA, 40 bp, Artificial Sequence
  Description of Artificial Sequence: Synthetic oligonucleotide
agaaaatcctgatggatgccatataactgatgacctcatc

SEQ ID NO: 396505 - DNA, 39 bp, Artificial Sequence
  Description of Artificial Sequence: Synthetic oligonucleotide
gaaaatcctgatggatgccatataactgatgacctcatc

SEQ ID NO: 396506 - DNA, 42 bp, Artificial Sequence
  Description of Artificial Sequence: Synthetic oligonucleotide
aaaatcctgatggatgccatataactgatgacctcatctatc

SEQ ID NO: 396507 - DNA, 41 bp, Artificial Sequence
  Description of Artificial Sequence: Synthetic oligonucleotide
aaatcctgatggatgccatataactgatgacctcatctatc

SEQ ID NO: 396508 - DNA, 40 bp, Artificial Sequence
  Description of Artificial Sequence: Synthetic oligonucleotide
aatcctgatggatgccatataactgatgacctcatctatc

SEQ ID NO: 396509 - DNA, 39 bp, Artificial Sequence
  Description of Artificial Sequence: Synthetic oligonucleotide
atcctgatggatgccatataactgatgacctcatctatc

SEQ ID NO: 396510 - DNA, 38 bp, Artificial Sequence
  Description of Artificial Sequence: Synthetic oligonucleotide
tcctgatggatgccatataactgatgacctcatctatc

SEQ ID NO: 396511 - DNA, 37 bp, Artificial Sequence
  Description of Artificial Sequence: Synthetic oligonucleotide
cctgatggatgccatataactgatgacctcatctatc

SEQ ID NO: 396512 - DNA, 37 bp, Artificial Sequence
  Description of Artificial Sequence: Synthetic oligonucleotide
ctgatggatgccatataactgatgacctcatctatcc

SEQ ID NO: 396513 - DNA, 39 bp, Artificial Sequence
  Description of Artificial Sequence: Synthetic oligonucleotide
tgatggatgccatataactgatgacctcatctatccatg

SEQ ID NO: 396514 - DNA, 38 bp, Artificial Sequence
  Description of Artificial Sequence: Synthetic oligonucleotide
gatggatgccatataactgatgacctcatctatccatg

SEQ ID NO: 396515 - DNA, 39 bp, Artificial Sequence
  Description of Artificial Sequence: Synthetic oligonucleotide
atggatgccatataactgatgacctcatctatccatgag

SEQ ID NO: 396516 - DNA, 38 bp, Artificial Sequence
  Description of Artificial Sequence: Synthetic oligonucleotide
tggatgccatataactgatgacctcatctatccatgag

SEQ ID NO: 396517 - DNA, 24 bp, Artificial Sequence
  Description of Artificial Sequence: Synthetic oligonucleotide
agaaatgccctcccctggccaggc

SEQ ID NO: 396518 - DNA, 23 bp, Artificial Sequence
  Description of Artificial Sequence: Synthetic oligonucleotide
gaaatgccctcccctggccaggc

SEQ ID NO: 396519 - DNA, 23 bp, Artificial Sequence
  Description of Artificial Sequence: Synthetic oligonucleotide
aaatgccctcccctggccaggcg

SEQ ID NO: 396520 - DNA, 22 bp, Artificial Sequence
  Description of Artificial Sequence: Synthetic oligonucleotide
aatgccctcccctggccaggcg

SEQ ID NO: 396521 - DNA, 21 bp, Artificial Sequence
  Description of Artificial Sequence: Synthetic oligonucleotide
atgccctcccctggccaggcg

SEQ ID NO: 396522 - DNA, 20 bp, Artificial Sequence
  Description of Artificial Sequence: Synthetic oligonucleotide
tgccctcccctggccaggcg

SEQ ID NO: 396523 - DNA, 20 bp, Artificial Sequence
  Description of Artificial Sequence: Synthetic oligonucleotide
gccctcccctggccaggcgt

SEQ ID NO: 396524 - DNA, 20 bp, Artificial Sequence
  Description of Artificial Sequence: Synthetic oligonucleotide
ccctcccctggccaggcgct

SEQ ID NO: 396525 - DNA, 20 bp, Artificial Sequence
  Description of Artificial Sequence: Synthetic oligonucleotide
cctcccctggccaggcgcgt

SEQ ID NO: 396526 - DNA, 20 bp, Artificial Sequence
  Description of Artificial Sequence: Synthetic oligonucleotide
ctcccctggccaggcgcggt

SEQ ID NO: 396527 - DNA, 20 bp, Artificial Sequence
  Description of Artificial Sequence: Synthetic oligonucleotide
tcccctggccaggcgcggtg

SEQ ID NO: 396528 - DNA, 37 bp, Artificial Sequence
  Description of Artificial Sequence: Synthetic oligonucleotide
atgcacacaccagagaagattccaatttagtgtcctg

SEQ ID NO: 396529 - DNA, 36 bp, Artificial Sequence
  Description of Artificial Sequence: Synthetic oligonucleotide
tgcacacaccagagaagattccaatttagtgtcctg

SEQ ID NO: 396530 - DNA, 35 bp, Artificial Sequence
  Description of Artificial Sequence: Synthetic oligonucleotide
gcacacaccagagaagattccaatttagtgtcctg

SEQ ID NO: 396531 - DNA, 35 bp, Artificial Sequence
  Description of Artificial Sequence: Synthetic oligonucleotide
cacacaccagagaagattccaatttagtgtcctgc

SEQ ID NO: 396532 - DNA, 35 bp, Artificial Sequence
  Description of Artificial Sequence: Synthetic oligonucleotide
acacaccagagaagattccaatttagtgtcctgcc

SEQ ID NO: 396533 - DNA, 34 bp, Artificial Sequence
  Description of Artificial Sequence: Synthetic oligonucleotide
cacaccagagaagattccaatttagtgtcctgcc

SEQ ID NO: 396534 - DNA, 35 bp, Artificial Sequence
  Description of Artificial Sequence: Synthetic oligonucleotide
acaccagagaagattccaatttagtgtcctgcctc

SEQ ID NO: 396535 - DNA, 34 bp, Artificial Sequence
  Description of Artificial Sequence: Synthetic oligonucleotide
caccagagaagattccaatttagtgtcctgcctc

SEQ ID NO: 396536 - DNA, 35 bp, Artificial Sequence
  Description of Artificial Sequence: Synthetic oligonucleotide
accagagaagattccaatttagtgtcctgcctctg

SEQ ID NO: 396537 - DNA, 34 bp, Artificial Sequence
  Description of Artificial Sequence: Synthetic oligonucleotide
ccagagaagattccaatttagtgtcctgcctctg

SEQ ID NO: 396538 - DNA, 36 bp, Artificial Sequence
  Description of Artificial Sequence: Synthetic oligonucleotide
cagagaagattccaatttagtgtcctgcctctgttc

SEQ ID NO: 396539 - DNA, 39 bp, Artificial Sequence
  Description of Artificial Sequence: Synthetic oligonucleotide
agagaagattccaatttagtgtcctgcctctgttcatag

SEQ ID NO: 396540 - DNA, 38 bp, Artificial Sequence
  Description of Artificial Sequence: Synthetic oligonucleotide
gagaagattccaatttagtgtcctgcctctgttcatag

SEQ ID NO: 396541 - DNA, 40 bp, Artificial Sequence
  Description of Artificial Sequence: Synthetic oligonucleotide
agaagattccaatttagtgtcctgcctctgttcatagaac

SEQ ID NO: 396542 - DNA, 39 bp, Artificial Sequence
  Description of Artificial Sequence: Synthetic oligonucleotide
gaagattccaatttagtgtcctgcctctgttcatagaac

SEQ ID NO: 396543 - DNA, 43 bp, Artificial Sequence
  Description of Artificial Sequence: Synthetic oligonucleotide
aagattccaatttagtgtcctgcctctgttcatagaacaattc

SEQ ID NO: 396544 - DNA, 42 bp, Artificial Sequence
  Description of Artificial Sequence: Synthetic oligonucleotide
agattccaatttagtgtcctgcctctgttcatagaacaattc

SEQ ID NO: 396545 - DNA, 41 bp, Artificial Sequence
  Description of Artificial Sequence: Synthetic oligonucleotide
gattccaatttagtgtcctgcctctgttcatagaacaattc

SEQ ID NO: 396546 - DNA, 41 bp, Artificial Sequence
  Description of Artificial Sequence: Synthetic oligonucleotide
attccaatttagtgtcctgcctctgttcatagaacaattcc

SEQ ID NO: 396547 - DNA, 40 bp, Artificial Sequence
  Description of Artificial Sequence: Synthetic oligonucleotide
ttccaatttagtgtcctgcctctgttcatagaacaattcc

SEQ ID NO: 396548 - DNA, 39 bp, Artificial Sequence
  Description of Artificial Sequence: Synthetic oligonucleotide
tccaatttagtgtcctgcctctgttcatagaacaattcc

SEQ ID NO: 396549 - DNA, 38 bp, Artificial Sequence
  Description of Artificial Sequence: Synthetic oligonucleotide
ccaatttagtgtcctgcctctgttcatagaacaattcc

SEQ ID NO: 396550 - DNA, 39 bp, Artificial Sequence
  Description of Artificial Sequence: Synthetic oligonucleotide
caatttagtgtcctgcctctgttcatagaacaattcctc

SEQ ID NO: 396551 - DNA, 41 bp, Artificial Sequence
  Description of Artificial Sequence: Synthetic oligonucleotide
aatttagtgtcctgcctctgttcatagaacaattcctcaag

SEQ ID NO: 396552 - DNA, 40 bp, Artificial Sequence
  Description of Artificial Sequence: Synthetic oligonucleotide
atttagtgtcctgcctctgttcatagaacaattcctcaag

SEQ ID NO: 396553 - DNA, 39 bp, Artificial Sequence
  Description of Artificial Sequence: Synthetic oligonucleotide
tttagtgtcctgcctctgttcatagaacaattcctcaag

SEQ ID NO: 396554 - DNA, 38 bp, Artificial Sequence
  Description of Artificial Sequence: Synthetic oligonucleotide
ttagtgtcctgcctctgttcatagaacaattcctcaag

SEQ ID NO: 396555 - DNA, 37 bp, Artificial Sequence
  Description of Artificial Sequence: Synthetic oligonucleotide
tagtgtcctgcctctgttcatagaacaattcctcaag

SEQ ID NO: 396556 - DNA, 36 bp, Artificial Sequence
  Description of Artificial Sequence: Synthetic oligonucleotide
agtgtcctgcctctgttcatagaacaattcctcaag

SEQ ID NO: 396557 - DNA, 35 bp, Artificial Sequence
  Description of Artificial Sequence: Synthetic oligonucleotide
gtgtcctgcctctgttcatagaacaattcctcaag

SEQ ID NO: 396558 - DNA, 36 bp, Artificial Sequence
  Description of Artificial Sequence: Synthetic oligonucleotide
tgtcctgcctctgttcatagaacaattcctcaagtc

SEQ ID NO: 396559 - DNA, 35 bp, Artificial Sequence
  Description of Artificial Sequence: Synthetic oligonucleotide
gtcctgcctctgttcatagaacaattcctcaagtc

SEQ ID NO: 396560 - DNA, 35 bp, Artificial Sequence
  Description of Artificial Sequence: Synthetic oligonucleotide
tcctgcctctgttcatagaacaattcctcaagtcc

SEQ ID NO: 396561 - DNA, 34 bp, Artificial Sequence
  Description of Artificial Sequence: Synthetic oligonucleotide
cctgcctctgttcatagaacaattcctcaagtcc

SEQ ID NO: 396562 - DNA, 35 bp, Artificial Sequence
  Description of Artificial Sequence: Synthetic oligonucleotide
ctgcctctgttcatagaacaattcctcaagtccac

SEQ ID NO: 396563 - DNA, 36 bp, Artificial Sequence
  Description of Artificial Sequence: Synthetic oligonucleotide
tgcctctgttcatagaacaattcctcaagtccactc

SEQ ID NO: 396564 - DNA, 35 bp, Artificial Sequence
  Description of Artificial Sequence: Synthetic oligonucleotide
gcctctgttcatagaacaattcctcaagtccactc

SEQ ID NO: 396565 - DNA, 37 bp, Artificial Sequence
  Description of Artificial Sequence: Synthetic oligonucleotide
tgtctccttccagggctcttaatacaaactcttcaac

SEQ ID NO: 396566 - DNA, 44 bp, Artificial Sequence
  Description of Artificial Sequence: Synthetic oligonucleotide
ctcttaatacaaactcttcaactagtaactgagatgtcaccatg

SEQ ID NO: 396567 - DNA, 44 bp, Artificial Sequence
  Description of Artificial Sequence: Synthetic oligonucleotide
tcttaatacaaactcttcaactagtaactgagatgtcaccatgg

SEQ ID NO: 396568 - DNA, 43 bp, Artificial Sequence
  Description of Artificial Sequence: Synthetic oligonucleotide
cttaatacaaactcttcaactagtaactgagatgtcaccatgg

SEQ ID NO: 396569 - DNA, 43 bp, Artificial Sequence
  Description of Artificial Sequence: Synthetic oligonucleotide
ttaatacaaactcttcaactagtaactgagatgtcaccatggg

SEQ ID NO: 396570 - DNA, 42 bp, Artificial Sequence
  Description of Artificial Sequence: Synthetic oligonucleotide
taatacaaactcttcaactagtaactgagatgtcaccatggg

SEQ ID NO: 396571 - DNA, 41 bp, Artificial Sequence
  Description of Artificial Sequence: Synthetic oligonucleotide
aatacaaactcttcaactagtaactgagatgtcaccatggg

SEQ ID NO: 396572 - DNA, 40 bp, Artificial Sequence
  Description of Artificial Sequence: Synthetic oligonucleotide
atacaaactcttcaactagtaactgagatgtcaccatggg

SEQ ID NO: 396573 - DNA, 39 bp, Artificial Sequence
  Description of Artificial Sequence: Synthetic oligonucleotide
tacaaactcttcaactagtaactgagatgtcaccatggg

SEQ ID NO: 396574 - DNA, 38 bp, Artificial Sequence
  Description of Artificial Sequence: Synthetic oligonucleotide
acaaactcttcaactagtaactgagatgtcaccatggg

SEQ ID NO: 396575 - DNA, 37 bp, Artificial Sequence
  Description of Artificial Sequence: Synthetic oligonucleotide
caaactcttcaactagtaactgagatgtcaccatggg

SEQ ID NO: 396576 - DNA, 22 bp, Artificial Sequence
  Description of Artificial Sequence: Synthetic oligonucleotide
gccctcgccctgaccaccgtga

SEQ ID NO: 396577 - DNA, 22 bp, Artificial Sequence
  Description of Artificial Sequence: Synthetic oligonucleotide
ccctcgccctgaccaccgtgac

SEQ ID NO: 396578 - DNA, 23 bp, Artificial Sequence
  Description of Artificial Sequence: Synthetic oligonucleotide
cctcgccctgaccaccgtgacga

SEQ ID NO: 396579 - DNA, 23 bp, Artificial Sequence
  Description of Artificial Sequence: Synthetic oligonucleotide
ctcgccctgaccaccgtgacgag

SEQ ID NO: 396580 - DNA, 23 bp, Artificial Sequence
  Description of Artificial Sequence: Synthetic oligonucleotide
tcgccctgaccaccgtgacgagc

SEQ ID NO: 396581 - DNA, 22 bp, Artificial Sequence
  Description of Artificial Sequence: Synthetic oligonucleotide
cgccctgaccaccgtgacgagc

SEQ ID NO: 396582 - DNA, 22 bp, Artificial Sequence
  Description of Artificial Sequence: Synthetic oligonucleotide
gccctgaccaccgtgacgagcc

SEQ ID NO: 396583 - DNA, 24 bp, Artificial Sequence
  Description of Artificial Sequence: Synthetic oligonucleotide
ccctgaccaccgtgacgagccctt

SEQ ID NO: 396584 - DNA, 25 bp, Artificial Sequence
  Description of Artificial Sequence: Synthetic oligonucleotide
cctgaccaccgtgacgagcccttgt

SEQ ID NO: 396585 - DNA, 25 bp, Artificial Sequence
  Description of Artificial Sequence: Synthetic oligonucleotide
ctgaccaccgtgacgagcccttgtg

SEQ ID NO: 396586 - DNA, 26 bp, Artificial Sequence
  Description of Artificial Sequence: Synthetic oligonucleotide
tgaccaccgtgacgagcccttgtgga

SEQ ID NO: 396587 - DNA, 25 bp, Artificial Sequence
  Description of Artificial Sequence: Synthetic oligonucleotide
gaccaccgtgacgagcccttgtgga

SEQ ID NO: 396588 - DNA, 25 bp, Artificial Sequence
  Description of Artificial Sequence: Synthetic oligonucleotide
accaccgtgacgagcccttgtggag

SEQ ID NO: 396589 - DNA, 24 bp, Artificial Sequence
  Description of Artificial Sequence: Synthetic oligonucleotide
ccaccgtgacgagcccttgtggag

SEQ ID NO: 396590 - DNA, 25 bp, Artificial Sequence
  Description of Artificial Sequence: Synthetic oligonucleotide
caccgtgacgagcccttgtggaggt

SEQ ID NO: 396591 - DNA, 27 bp, Artificial Sequence
  Description of Artificial Sequence: Synthetic oligonucleotide
accgtgacgagcccttgtggaggtgaa

SEQ ID NO: 396592 - DNA, 26 bp, Artificial Sequence
  Description of Artificial Sequence: Synthetic oligonucleotide
ccgtgacgagcccttgtggaggtgaa

SEQ ID NO: 396593 - DNA, 27 bp, Artificial Sequence
  Description of Artificial Sequence: Synthetic oligonucleotide
cgtgacgagcccttgtggaggtgaaga

SEQ ID NO: 396594 - DNA, 27 bp, Artificial Sequence
  Description of Artificial Sequence: Synthetic oligonucleotide
gtgacgagcccttgtggaggtgaagac

SEQ ID NO: 396595 - DNA, 30 bp, Artificial Sequence; identical to SEQ ID NO: 56879
  Description of Artificial Sequence: Synthetic oligonucleotide

SEQ ID NO: 396596 - DNA, 29 bp, Artificial Sequence
  Description of Artificial Sequence: Synthetic oligonucleotide
gacgagcccttgtggaggtgaagacattg

SEQ ID NO: 396597 - DNA, 30 bp, Artificial Sequence; identical to SEQ ID NO: 56881
  Description of Artificial Sequence: Synthetic oligonucleotide

SEQ ID NO: 396598 - DNA, 29 bp, Artificial Sequence
  Description of Artificial Sequence: Synthetic oligonucleotide
cgagcccttgtggaggtgaagacattgtg

SEQ ID NO: 396599 - DNA, 34 bp, Artificial Sequence; identical to SEQ ID NO: 56883
  Description of Artificial Sequence: Synthetic oligonucleotide

SEQ ID NO: 396600 - DNA, 33 bp, Artificial Sequence; identical to SEQ ID NO: 56884
  Description of Artificial Sequence: Synthetic oligonucleotide

SEQ ID NO: 396601 - DNA, 32 bp, Artificial Sequence; identical to SEQ ID NO: 56885
  Description of Artificial Sequence: Synthetic oligonucleotide

SEQ ID NO: 396602 - DNA, 34 bp, Artificial Sequence; identical to SEQ ID NO: 56886
  Description of Artificial Sequence: Synthetic oligonucleotide

SEQ ID NO: 396603 - DNA, 33 bp, Artificial Sequence; identical to SEQ ID NO: 56887
  Description of Artificial Sequence: Synthetic oligonucleotide

SEQ ID NO: 396604 - DNA, 32 bp, Artificial Sequence; identical to SEQ ID NO: 56888
  Description of Artificial Sequence: Synthetic oligonucleotide

SEQ ID NO: 396605 - DNA, 33 bp, Artificial Sequence; identical to SEQ ID NO: 56889
  Description of Artificial Sequence: Synthetic oligonucleotide

SEQ ID NO: 396606 - DNA, 32 bp, Artificial Sequence; identical to SEQ ID NO: 56890
  Description of Artificial Sequence: Synthetic oligonucleotide

SEQ ID NO: 396607 - DNA, 38 bp, Artificial Sequence; identical to SEQ ID NO: 56891
  Description of Artificial Sequence: Synthetic oligonucleotide

SEQ ID NO: 396608 - DNA, 37 bp, Artificial Sequence; identical to SEQ ID NO: 56892
  Description of Artificial Sequence: Synthetic oligonucleotide

SEQ ID NO: 396609 - DNA, 36 bp, Artificial Sequence; identical to SEQ ID NO: 56893
  Description of Artificial Sequence: Synthetic oligonucleotide

SEQ ID NO: 396610 - DNA, 35 bp, Artificial Sequence; identical to SEQ ID NO: 56894
  Description of Artificial Sequence: Synthetic oligonucleotide

SEQ ID NO: 396611 - DNA, 36 bp, Artificial Sequence; identical to SEQ ID NO: 56895
  Description of Artificial Sequence: Synthetic oligonucleotide

SEQ ID NO: 396612 - DNA, 37 bp, Artificial Sequence; identical to SEQ ID NO: 56896
  Description of Artificial Sequence: Synthetic oligonucleotide

SEQ ID NO: 396613 - DNA, 36 bp, Artificial Sequence; identical to SEQ ID NO: 56897
  Description of Artificial Sequence: Synthetic oligonucleotide

SEQ ID NO: 396614 - DNA, 36 bp, Artificial Sequence; identical to SEQ ID NO: 56898
  Description of Artificial Sequence: Synthetic oligonucleotide

SEQ ID NO: 396615 - DNA, 35 bp, Artificial Sequence; identical to SEQ ID NO: 56899
  Description of Artificial Sequence: Synthetic oligonucleotide

SEQ ID NO: 396616 - DNA, 37 bp, Artificial Sequence; identical to SEQ ID NO: 56900
  Description of Artificial Sequence: Synthetic oligonucleotide

SEQ ID NO: 396617 - DNA, 37 bp, Artificial Sequence; identical to SEQ ID NO: 56901
  Description of Artificial Sequence: Synthetic oligonucleotide

SEQ ID NO: 396618 - DNA, 36 bp, Artificial Sequence; identical to SEQ ID NO: 56902
  Description of Artificial Sequence: Synthetic oligonucleotide

SEQ ID NO: 396619 - DNA, 35 bp, Artificial Sequence; identical to SEQ ID NO: 56903
  Description of Artificial Sequence: Synthetic oligonucleotide

SEQ ID NO: 396620 - DNA, 36 bp, Artificial Sequence; identical to SEQ ID NO: 56904
  Description of Artificial Sequence: Synthetic oligonucleotide

SEQ ID NO: 396621 - DNA, 36 bp, Artificial Sequence; identical to SEQ ID NO: 56905
  Description of Artificial Sequence: Synthetic oligonucleotide

SEQ ID NO: 396622 - DNA, 35 bp, Artificial Sequence; identical to SEQ ID NO: 56906
  Description of Artificial Sequence: Synthetic oligonucleotide

SEQ ID NO: 396623 - DNA, 36 bp, Artificial Sequence; identical to SEQ ID NO: 56907
  Description of Artificial Sequence: Synthetic oligonucleotide

SEQ ID NO: 396624 - DNA, 36 bp, Artificial Sequence; identical to SEQ ID NO: 56908
  Description of Artificial Sequence: Synthetic oligonucleotide

SEQ ID NO: 396625 - DNA, 37 bp, Artificial Sequence; identical to SEQ ID NO: 56909
  Description of Artificial Sequence: Synthetic oligonucleotide

SEQ ID NO: 396626 - DNA, 36 bp, Artificial Sequence; identical to SEQ ID NO: 56910
  Description of Artificial Sequence: Synthetic oligonucleotide

SEQ ID NO: 396627 - DNA, 35 bp, Artificial Sequence; identical to SEQ ID NO: 56911
  Description of Artificial Sequence: Synthetic oligonucleotide

SEQ ID NO: 396628 - DNA, 36 bp, Artificial Sequence; identical to SEQ ID NO: 56912
  Description of Artificial Sequence: Synthetic oligonucleotide

SEQ ID NO: 396629 - DNA, 35 bp, Artificial Sequence; identical to SEQ ID NO: 56913
  Description of Artificial Sequence: Synthetic oligonucleotide

SEQ ID NO: 396630 - DNA, 35 bp, Artificial Sequence; identical to SEQ ID NO: 56914
  Description of Artificial Sequence: Synthetic oligonucleotide

SEQ ID NO: 396631 - DNA, 27 bp, Artificial Sequence
  Description of Artificial Sequence: Synthetic oligonucleotide
aacaaagctctgctgctgggggccctt

SEQ ID NO: 396632 - DNA, 26 bp, Artificial Sequence
  Description of Artificial Sequence: Synthetic oligonucleotide
acaaagctctgctgctgggggccctt

SEQ ID NO: 396633 - DNA, 25 bp, Artificial Sequence
  Description of Artificial Sequence: Synthetic oligonucleotide
caaagctctgctgctgggggccctt

SEQ ID NO: 396634 - DNA, 25 bp, Artificial Sequence
  Description of Artificial Sequence: Synthetic oligonucleotide
aaagctctgctgctgggggcccttg

SEQ ID NO: 396635 - DNA, 24 bp, Artificial Sequence
  Description of Artificial Sequence: Synthetic oligonucleotide
aagctctgctgctgggggcccttg

SEQ ID NO: 396636 - DNA, 23 bp, Artificial Sequence
  Description of Artificial Sequence: Synthetic oligonucleotide
agctctgctgctgggggcccttg

SEQ ID NO: 396637 - DNA, 22 bp, Artificial Sequence
  Description of Artificial Sequence: Synthetic oligonucleotide
gctctgctgctgggggcccttg

SEQ ID NO: 396638 - DNA, 22 bp, Artificial Sequence
  Description of Artificial Sequence: Synthetic oligonucleotide
ctctgctgctgggggcccttgc

SEQ ID NO: 396639 - DNA, 22 bp, Artificial Sequence
  Description of Artificial Sequence: Synthetic oligonucleotide
tctgctgctgggggcccttgcc

SEQ ID NO: 396640 - DNA, 21 bp, Artificial Sequence
  Description of Artificial Sequence: Synthetic oligonucleotide
ctgctgctgggggcccttgcc

SEQ ID NO: 396641 - DNA, 22 bp, Artificial Sequence
  Description of Artificial Sequence: Synthetic oligonucleotide
tgctgctgggggcccttgccct

SEQ ID NO: 396642 - DNA, 21 bp, Artificial Sequence
  Description of Artificial Sequence: Synthetic oligonucleotide
gctgctgggggcccttgccct

SEQ ID NO: 396643 - DNA, 22 bp, Artificial Sequence
  Description of Artificial Sequence: Synthetic oligonucleotide
ctgctgggggcccttgccctga

SEQ ID NO: 396644 - DNA, 22 bp, Artificial Sequence
  Description of Artificial Sequence: Synthetic oligonucleotide
tgctgggggcccttgccctgac

SEQ ID NO: 396645 - DNA, 21 bp, Artificial Sequence
  Description of Artificial Sequence: Synthetic oligonucleotide
gctgggggcccttgccctgac

SEQ ID NO: 396646 - DNA, 22 bp, Artificial Sequence
  Description of Artificial Sequence: Synthetic oligonucleotide
ctgggggcccttgccctgacca

SEQ ID NO: 396647 - DNA, 22 bp, Artificial Sequence
  Description of Artificial Sequence: Synthetic oligonucleotide
tgggggcccttgccctgaccac

SEQ ID NO: 396648 - DNA, 21 bp, Artificial Sequence
  Description of Artificial Sequence: Synthetic oligonucleotide
gggggcccttgccctgaccac

SEQ ID NO: 396649 - DNA, 21 bp, Artificial Sequence
  Description of Artificial Sequence: Synthetic oligonucleotide
ggggcccttgccctgaccacc

SEQ ID NO: 396650 - DNA, 22 bp, Artificial Sequence
  Description of Artificial Sequence: Synthetic oligonucleotide
gggcccttgccctgaccaccgt

SEQ ID NO: 396651 - DNA, 24 bp, Artificial Sequence
  Description of Artificial Sequence: Synthetic oligonucleotide
ggcccttgccctgaccaccgtgat

SEQ ID NO: 396652 - DNA, 25 bp, Artificial Sequence
  Description of Artificial Sequence: Synthetic oligonucleotide
gcccttgccctgaccaccgtgatga

SEQ ID NO: 396653 - DNA, 25 bp, Artificial Sequence
  Description of Artificial Sequence: Synthetic oligonucleotide
cccttgccctgaccaccgtgatgag

SEQ ID NO: 396654 - DNA, 25 bp, Artificial Sequence
  Description of Artificial Sequence: Synthetic oligonucleotide
ccttgccctgaccaccgtgatgagc

SEQ ID NO: 396655 - DNA, 25 bp, Artificial Sequence
  Description of Artificial Sequence: Synthetic oligonucleotide
cttgccctgaccaccgtgatgagcc

SEQ ID NO: 396656 - DNA, 25 bp, Artificial Sequence
  Description of Artificial Sequence: Synthetic oligonucleotide
ttgccctgaccaccgtgatgagccc

SEQ ID NO: 396657 - DNA, 24 bp, Artificial Sequence
  Description of Artificial Sequence: Synthetic oligonucleotide
tgccctgaccaccgtgatgagccc

SEQ ID NO: 396658 - DNA, 23 bp, Artificial Sequence
  Description of Artificial Sequence: Synthetic oligonucleotide
gccctgaccaccgtgatgagccc

SEQ ID NO: 396659 - DNA, 24 bp, Artificial Sequence
  Description of Artificial Sequence: Synthetic oligonucleotide
ccctgaccaccgtgatgagcccct

SEQ ID NO: 396660 - DNA, 25 bp, Artificial Sequence
  Description of Artificial Sequence: Synthetic oligonucleotide
cctgaccaccgtgatgagcccctgt

SEQ ID NO: 396661 - DNA, 35 bp, Artificial Sequence; identical to SEQ ID NO: 56945
  Description of Artificial Sequence: Synthetic oligonucleotide

SEQ ID NO: 396662 - DNA, 34 bp, Artificial Sequence; identical to SEQ ID NO: 56946
  Description of Artificial Sequence: Synthetic oligonucleotide

SEQ ID NO: 396663 - DNA, 34 bp, Artificial Sequence; identical to SEQ ID NO: 56947
  Description of Artificial Sequence: Synthetic oligonucleotide

SEQ ID NO: 396664 - DNA, 33 bp, Artificial Sequence; identical to SEQ ID NO: 56948
  Description of Artificial Sequence: Synthetic oligonucleotide

SEQ ID NO: 396665 - DNA, 32 bp, Artificial Sequence; identical to SEQ ID NO: 56949
  Description of Artificial Sequence: Synthetic oligonucleotide

SEQ ID NO: 396666 - DNA, 33 bp, Artificial Sequence; identical to SEQ ID NO: 56950
  Description of Artificial Sequence: Synthetic oligonucleotide

SEQ ID NO: 396667 - DNA, 32 bp, Artificial Sequence; identical to SEQ ID NO: 56951
  Description of Artificial Sequence: Synthetic oligonucleotide

SEQ ID NO: 396668 - DNA, 36 bp, Artificial Sequence; identical to SEQ ID NO: 56952
  Description of Artificial Sequence: Synthetic oligonucleotide

SEQ ID NO: 396669 - DNA, 35 bp, Artificial Sequence; identical to SEQ ID NO: 56953
  Description of Artificial Sequence: Synthetic oligonucleotide

SEQ ID NO: 396670 - DNA, 34 bp, Artificial Sequence; identical to SEQ ID NO: 56954
  Description of Artificial Sequence: Synthetic oligonucleotide

SEQ ID NO: 396671 - DNA, 33 bp, Artificial Sequence; identical to SEQ ID NO: 56955
  Description of Artificial Sequence: Synthetic oligonucleotide

SEQ ID NO: 396672 - DNA, 35 bp, Artificial Sequence; identical to SEQ ID NO: 56956
  Description of Artificial Sequence: Synthetic oligonucleotide

SEQ ID NO: 396673 - DNA, 34 bp, Artificial Sequence; identical to SEQ ID NO: 56957
  Description of Artificial Sequence: Synthetic oligonucleotide

SEQ ID NO: 396674 - DNA, 36 bp, Artificial Sequence; identical to SEQ ID NO: 56958
  Description of Artificial Sequence: Synthetic oligonucleotide

SEQ ID NO: 396675 - DNA, 36 bp, Artificial Sequence; identical to SEQ ID NO: 56959
  Description of Artificial Sequence: Synthetic oligonucleotide

SEQ ID NO: 396676 - DNA, 37 bp, Artificial Sequence; identical to SEQ ID NO: 56960
  Description of Artificial Sequence: Synthetic oligonucleotide

SEQ ID NO: 396677 - DNA, 36 bp, Artificial Sequence; identical to SEQ ID NO: 56961
  Description of Artificial Sequence: Synthetic oligonucleotide

SEQ ID NO: 396678 - DNA, 37 bp, Artificial Sequence; identical to SEQ ID NO: 56962
  Description of Artificial Sequence: Synthetic oligonucleotide

SEQ ID NO: 396679 - DNA, 36 bp, Artificial Sequence; identical to SEQ ID NO: 56963
  Description of Artificial Sequence: Synthetic oligonucleotide

SEQ ID NO: 396680 - DNA, 39 bp, Artificial Sequence; identical to SEQ ID NO: 56964
  Description of Artificial Sequence: Synthetic oligonucleotide

SEQ ID NO: 396681 - DNA, 39 bp, Artificial Sequence; identical to SEQ ID NO: 56965
  Description of Artificial Sequence: Synthetic oligonucleotide

SEQ ID NO: 396682 - DNA, 38 bp, Artificial Sequence; identical to SEQ ID NO: 56966
  Description of Artificial Sequence: Synthetic oligonucleotide

SEQ ID NO: 396683 - DNA, 37 bp, Artificial Sequence; identical to SEQ ID NO: 56967
  Description of Artificial Sequence: Synthetic oligonucleotide

SEQ ID NO: 396684 - DNA, 37 bp, Artificial Sequence; identical to SEQ ID NO: 56968
  Description of Artificial Sequence: Synthetic oligonucleotide

SEQ ID NO: 396685 - DNA, 36 bp, Artificial Sequence; identical to SEQ ID NO: 56969
  Description of Artificial Sequence: Synthetic oligonucleotide

SEQ ID NO: 396686 - DNA, 35 bp, Artificial Sequence; identical to SEQ ID NO: 56970
  Description of Artificial Sequence: Synthetic oligonucleotide

SEQ ID NO: 396687 - DNA, 36 bp, Artificial Sequence; identical to SEQ ID NO: 56971
  Description of Artificial Sequence: Synthetic oligonucleotide

SEQ ID NO: 396688 - DNA, 36 bp, Artificial Sequence; identical to SEQ ID NO: 56972
  Description of Artificial Sequence: Synthetic oligonucleotide

SEQ ID NO: 396689 - DNA, 36 bp, Artificial Sequence; identical to SEQ ID NO: 56973
  Description of Artificial Sequence: Synthetic oligonucleotide

SEQ ID NO: 396690 - DNA, 35 bp, Artificial Sequence; identical to SEQ ID NO: 56974
  Description of Artificial Sequence: Synthetic oligonucleotide

SEQ ID NO: 396691 - DNA, 36 bp, Artificial Sequence; identical to SEQ ID NO: 56975
  Description of Artificial Sequence: Synthetic oligonucleotide

SEQ ID NO: 396692 - DNA, 35 bp, Artificial Sequence; identical to SEQ ID NO: 56976
  Description of Artificial Sequence: Synthetic oligonucleotide

SEQ ID NO: 396693 - DNA, 34 bp, Artificial Sequence; identical to SEQ ID NO: 56977
  Description of Artificial Sequence: Synthetic oligonucleotide

SEQ ID NO: 396694 - DNA, 33 bp, Artificial Sequence; identical to SEQ ID NO: 56978
  Description of Artificial Sequence: Synthetic oligonucleotide

SEQ ID NO: 396695 - DNA, 27 bp, Artificial Sequence
  Description of Artificial Sequence: Synthetic oligonucleotide
ccagtcttacggtccctctggccagta

SEQ ID NO: 396696 - DNA, 27 bp, Artificial Sequence
  Description of Artificial Sequence: Synthetic oligonucleotide
cagtcttacggtccctctggccagtac

SEQ ID NO: 396697 - DNA, 28 bp, Artificial Sequence
  Description of Artificial Sequence: Synthetic oligonucleotide
agtcttacggtccctctggccagtacac

SEQ ID NO: 396698 - DNA, 27 bp, Artificial Sequence
  Description of Artificial Sequence: Synthetic oligonucleotide
gtcttacggtccctctggccagtacac

SEQ ID NO: 396699 - DNA, 27 bp, Artificial Sequence
  Description of Artificial Sequence: Synthetic oligonucleotide
tcttacggtccctctggccagtacacc

SEQ ID NO: 396700 - DNA, 26 bp, Artificial Sequence
  Description of Artificial Sequence: Synthetic oligonucleotide
cttacggtccctctggccagtacacc

SEQ ID NO: 396701 - DNA, 33 bp, Artificial Sequence; identical to SEQ ID NO: 56985
  Description of Artificial Sequence: Synthetic oligonucleotide

SEQ ID NO: 396702 - DNA, 32 bp, Artificial Sequence; identical to SEQ ID NO: 56986
  Description of Artificial Sequence: Synthetic oligonucleotide

SEQ ID NO: 396703 - DNA, 32 bp, Artificial Sequence; identical to SEQ ID NO: 56987
  Description of Artificial Sequence: Synthetic oligonucleotide

SEQ ID NO: 396704 - DNA, 31 bp, Artificial Sequence; identical to SEQ ID NO: 56988
  Description of Artificial Sequence: Synthetic oligonucleotide

SEQ ID NO: 396705 - DNA, 32 bp, Artificial Sequence; identical to SEQ ID NO: 56989
  Description of Artificial Sequence: Synthetic oligonucleotide

SEQ ID NO: 396706 - DNA, 32 bp, Artificial Sequence; identical to SEQ ID NO: 56990
  Description of Artificial Sequence: Synthetic oligonucleotide

SEQ ID NO: 396707 - DNA, 33 bp, Artificial Sequence; identical to SEQ ID NO: 56991
  Description of Artificial Sequence: Synthetic oligonucleotide

SEQ ID NO: 396708 - DNA, 35 bp, Artificial Sequence; identical to SEQ ID NO: 56992
  Description of Artificial Sequence: Synthetic oligonucleotide

SEQ ID NO: 396709 - DNA, 34 bp, Artificial Sequence; identical to SEQ ID NO: 56993
  Description of Artificial Sequence: Synthetic oligonucleotide

SEQ ID NO: 396710 - DNA, 36 bp, Artificial Sequence; identical to SEQ ID NO: 56994
  Description of Artificial Sequence: Synthetic oligonucleotide

SEQ ID NO: 396711 - DNA, 35 bp, Artificial Sequence; identical to SEQ ID NO: 56995
  Description of Artificial Sequence: Synthetic oligonucleotide

SEQ ID NO: 396712 - DNA, 34 bp, Artificial Sequence; identical to SEQ ID NO: 56996
  Description of Artificial Sequence: Synthetic oligonucleotide

SEQ ID NO: 396713 - DNA, 34 bp, Artificial Sequence; identical to SEQ ID NO: 56997
  Description of Artificial Sequence: Synthetic oligonucleotide

SEQ ID NO: 396714 - DNA, 33 bp, Artificial Sequence; identical to SEQ ID NO: 56998
  Description of Artificial Sequence: Synthetic oligonucleotide

SEQ ID NO: 396715 - DNA, 34 bp, Artificial Sequence; identical to SEQ ID NO: 56999
  Description of Artificial Sequence: Synthetic oligonucleotide

SEQ ID NO: 396716 - DNA, 34 bp, Artificial Sequence; identical to SEQ ID NO: 57000
  Description of Artificial Sequence: Synthetic oligonucleotide

SEQ ID NO: 396717 - DNA, 35 bp, Artificial Sequence; identical to SEQ ID NO: 57001
  Description of Artificial Sequence: Synthetic oligonucleotide

SEQ ID NO: 396718 - DNA, 34 bp, Artificial Sequence; identical to SEQ ID NO: 57002
  Description of Artificial Sequence: Synthetic oligonucleotide

SEQ ID NO: 396719 - DNA, 33 bp, Artificial Sequence; identical to SEQ ID NO: 57003
  Description of Artificial Sequence: Synthetic oligonucleotide

SEQ ID NO: 396720 - DNA, 33 bp, Artificial Sequence; identical to SEQ ID NO: 57004
  Description of Artificial Sequence: Synthetic oligonucleotide

SEQ ID NO: 396721 - DNA, 32 bp, Artificial Sequence; identical to SEQ ID NO: 57005
  Description of Artificial Sequence: Synthetic oligonucleotide

SEQ ID NO: 396722 - DNA, 31 bp, Artificial Sequence; identical to SEQ ID NO: 57006
  Description of Artificial Sequence: Synthetic oligonucleotide

SEQ ID NO: 396723 - DNA, 30 bp, Artificial Sequence; identical to SEQ ID NO: 57007
  Description of Artificial Sequence: Synthetic oligonucleotide

SEQ ID NO: 396724 - DNA, 29 bp, Artificial Sequence
  Description of Artificial Sequence: Synthetic oligonucleotide
tgatggagacgagcagttctacgtggacc

SEQ ID NO: 396725 - DNA, 28 bp, Artificial Sequence
  Description of Artificial Sequence: Synthetic oligonucleotide
gatggagacgagcagttctacgtggacc

SEQ ID NO: 396726 - DNA, 29 bp, Artificial Sequence
  Description of Artificial Sequence: Synthetic oligonucleotide
atggagacgagcagttctacgtggacctg

SEQ ID NO: 396727 - DNA, 28 bp, Artificial Sequence
  Description of Artificial Sequence: Synthetic oligonucleotide
tggagacgagcagttctacgtggacctg

SEQ ID NO: 396728 - DNA, 27 bp, Artificial Sequence
  Description of Artificial Sequence: Synthetic oligonucleotide
ggagacgagcagttctacgtggacctg

SEQ ID NO: 396729 - DNA, 27 bp, Artificial Sequence
  Description of Artificial Sequence: Synthetic oligonucleotide
gagacgagcagttctacgtggacctgg

SEQ ID NO: 396730 - DNA, 27 bp, Artificial Sequence
  Description of Artificial Sequence: Synthetic oligonucleotide
agacgagcagttctacgtggacctggg

SEQ ID NO: 396731 - DNA, 26 bp, Artificial Sequence
  Description of Artificial Sequence: Synthetic oligonucleotide
gacgagcagttctacgtggacctggg

SEQ ID NO: 396732 - DNA, 27 bp, Artificial Sequence
  Description of Artificial Sequence: Synthetic oligonucleotide
acgagcagttctacgtggacctgggga

SEQ ID NO: 396733 - DNA, 26 bp, Artificial Sequence
  Description of Artificial Sequence: Synthetic oligonucleotide
cgagcagttctacgtggacctgggga

SEQ ID NO: 396734 - DNA, 26 bp, Artificial Sequence
  Description of Artificial Sequence: Synthetic oligonucleotide
gagcagttctacgtggacctggggag

SEQ ID NO: 396735 - DNA, 27 bp, Artificial Sequence
  Description of Artificial Sequence: Synthetic oligonucleotide
agcagttctacgtggacctggggagga

SEQ ID NO: 396736 - DNA, 27 bp, Artificial Sequence
  Description of Artificial Sequence: Synthetic oligonucleotide
gcagttctacgtggacctggggaggaa

SEQ ID NO: 396737 - DNA, 27 bp, Artificial Sequence
  Description of Artificial Sequence: Synthetic oligonucleotide
cagttctacgtggacctggggaggaag

SEQ ID NO: 396738 - DNA, 27 bp, Artificial Sequence
  Description of Artificial Sequence: Synthetic oligonucleotide
agttctacgtggacctggggaggaagg

SEQ ID NO: 396739 - DNA, 27 bp, Artificial Sequence
  Description of Artificial Sequence: Synthetic oligonucleotide
gttctacgtggacctggggaggaagga

SEQ ID NO: 396740 - DNA, 27 bp, Artificial Sequence
  Description of Artificial Sequence: Synthetic oligonucleotide
ttctacgtggacctggggaggaaggag

SEQ ID NO: 396741 - DNA, 27 bp, Artificial Sequence
  Description of Artificial Sequence: Synthetic oligonucleotide
tctacgtggacctggggaggaaggaga

SEQ ID NO: 396742 - DNA, 26 bp, Artificial Sequence
  Description of Artificial Sequence: Synthetic oligonucleotide
ctacgtggacctggggaggaaggaga

SEQ ID NO: 396743 - DNA, 27 bp, Artificial Sequence
  Description of Artificial Sequence: Synthetic oligonucleotide
tacgtggacctggggaggaaggagact

SEQ ID NO: 396744 - DNA, 26 bp, Artificial Sequence
  Description of Artificial Sequence: Synthetic oligonucleotide
acgtggacctggggaggaaggagact

SEQ ID NO: 396745 - DNA, 25 bp, Artificial Sequence
  Description of Artificial Sequence: Synthetic oligonucleotide
cgtggacctggggaggaaggagact

SEQ ID NO: 396746 - DNA, 26 bp, Artificial Sequence
  Description of Artificial Sequence: Synthetic oligonucleotide
gtggacctggggaggaaggagactgt

SEQ ID NO: 396747 - DNA, 27 bp, Artificial Sequence
  Description of Artificial Sequence: Synthetic oligonucleotide
tggacctggggaggaaggagactgtct

SEQ ID NO: 396748 - DNA, 26 bp, Artificial Sequence
  Description of Artificial Sequence: Synthetic oligonucleotide
ggacctggggaggaaggagactgtct

SEQ ID NO: 396749 - DNA, 26 bp, Artificial Sequence
  Description of Artificial Sequence: Synthetic oligonucleotide
gacctggggaggaaggagactgtctg

SEQ ID NO: 396750 - DNA, 27 bp, Artificial Sequence
  Description of Artificial Sequence: Synthetic oligonucleotide
acctggggaggaaggagactgtctggt

SEQ ID NO: 396751 - DNA, 26 bp, Artificial Sequence
  Description of Artificial Sequence: Synthetic oligonucleotide
cctggggaggaaggagactgtctggt

SEQ ID NO: 396752 - DNA, 27 bp, Artificial Sequence
  Description of Artificial Sequence: Synthetic oligonucleotide
ctggggaggaaggagactgtctggtgt

SEQ ID NO: 396753 - DNA, 29 bp, Artificial Sequence
  Description of Artificial Sequence: Synthetic oligonucleotide
tggggaggaaggagactgtctggtgtttg

SEQ ID NO: 396754 - DNA, 28 bp, Artificial Sequence
  Description of Artificial Sequence: Synthetic oligonucleotide
ggggaggaaggagactgtctggtgtttg

SEQ ID NO: 396755 - DNA, 28 bp, Artificial Sequence
  Description of Artificial Sequence: Synthetic oligonucleotide
gggaggaaggagactgtctggtgtttgc

SEQ ID NO: 396756 - DNA, 28 bp, Artificial Sequence
  Description of Artificial Sequence: Synthetic oligonucleotide
ggaggaaggagactgtctggtgtttgcc

SEQ ID NO: 396757 - DNA, 29 bp, Artificial Sequence
  Description of Artificial Sequence: Synthetic oligonucleotide
gaggaaggagactgtctggtgtttgcctg

SEQ ID NO: 396758 - DNA, 31 bp, Artificial Sequence; identical to SEQ ID NO: 57042
  Description of Artificial Sequence: Synthetic oligonucleotide

SEQ ID NO: 396759 - DNA, 30 bp, Artificial Sequence; identical to SEQ ID NO: 57043
  Description of Artificial Sequence: Synthetic oligonucleotide

SEQ ID NO: 396760 - DNA, 31 bp, Artificial Sequence; identical to SEQ ID NO: 57044
  Description of Artificial Sequence: Synthetic oligonucleotide

SEQ ID NO: 396761 - DNA, 32 bp, Artificial Sequence; identical to SEQ ID NO: 57045
  Description of Artificial Sequence: Synthetic oligonucleotide

SEQ ID NO: 396762 - DNA, 31 bp, Artificial Sequence; identical to SEQ ID NO: 57046
  Description of Artificial Sequence: Synthetic oligonucleotide

SEQ ID NO: 396763 - DNA, 30 bp, Artificial Sequence; identical to SEQ ID NO: 57047
  Description of Artificial Sequence: Synthetic oligonucleotide

SEQ ID NO: 396764 - DNA, 31 bp, Artificial Sequence; identical to SEQ ID NO: 57048
  Description of Artificial Sequence: Synthetic oligonucleotide

SEQ ID NO: 396765 - DNA, 37 bp, Artificial Sequence; identical to SEQ ID NO: 57049
  Description of Artificial Sequence: Synthetic oligonucleotide

SEQ ID NO: 396766 - DNA, 36 bp, Artificial Sequence; identical to SEQ ID NO: 57050
  Description of Artificial Sequence: Synthetic oligonucleotide

SEQ ID NO: 396767 - DNA, 40 bp, Artificial Sequence; identical to SEQ ID NO: 57051
  Description of Artificial Sequence: Synthetic oligonucleotide

SEQ ID NO: 396768 - DNA, 39 bp, Artificial Sequence; identical to SEQ ID NO: 57052
  Description of Artificial Sequence: Synthetic oligonucleotide

SEQ ID NO: 396769 - DNA, 40 bp, Artificial Sequence; identical to SEQ ID NO: 57053
  Description of Artificial Sequence: Synthetic oligonucleotide

SEQ ID NO: 396770 - DNA, 39 bp, Artificial Sequence; identical to SEQ ID NO: 57054
  Description of Artificial Sequence: Synthetic oligonucleotide

SEQ ID NO: 396771 - DNA, 39 bp, Artificial Sequence; identical to SEQ ID NO: 57055
  Description of Artificial Sequence: Synthetic oligonucleotide

SEQ ID NO: 396772 - DNA, 38 bp, Artificial Sequence; identical to SEQ ID NO: 57056
  Description of Artificial Sequence: Synthetic oligonucleotide

SEQ ID NO: 396773 - DNA, 38 bp, Artificial Sequence; identical to SEQ ID NO: 57057
  Description of Artificial Sequence: Synthetic oligonucleotide

SEQ ID NO: 396774 - DNA, 37 bp, Artificial Sequence; identical to SEQ ID NO: 57058
  Description of Artificial Sequence: Synthetic oligonucleotide

SEQ ID NO: 396775 - DNA, 37 bp, Artificial Sequence; identical to SEQ ID NO: 57059
  Description of Artificial Sequence: Synthetic oligonucleotide

SEQ ID NO: 396776 - DNA, 37 bp, Artificial Sequence; identical to SEQ ID NO: 57060
  Description of Artificial Sequence: Synthetic oligonucleotide

SEQ ID NO: 396777 - DNA, 36 bp, Artificial Sequence; identical to SEQ ID NO: 57061
  Description of Artificial Sequence: Synthetic oligonucleotide

SEQ ID NO: 396778 - DNA, 41 bp, Artificial Sequence; identical to SEQ ID NO: 57062
  Description of Artificial Sequence: Synthetic oligonucleotide

SEQ ID NO: 396779 - DNA, 40 bp, Artificial Sequence; identical to SEQ ID NO: 57063
  Description of Artificial Sequence: Synthetic oligonucleotide

SEQ ID NO: 396780 - DNA, 39 bp, Artificial Sequence; identical to SEQ ID NO: 57064
  Description of Artificial Sequence: Synthetic oligonucleotide

SEQ ID NO: 396781 - DNA, 38 bp, Artificial Sequence; identical to SEQ ID NO: 57065
  Description of Artificial Sequence: Synthetic oligonucleotide

SEQ ID NO: 396782 - DNA, 38 bp, Artificial Sequence; identical to SEQ ID NO: 57066
  Description of Artificial Sequence: Synthetic oligonucleotide

SEQ ID NO: 396783 - DNA, 39 bp, Artificial Sequence; identical to SEQ ID NO: 57067
  Description of Artificial Sequence: Synthetic oligonucleotide

SEQ ID NO: 396784 - DNA, 40 bp, Artificial Sequence; identical to SEQ ID NO: 57068
  Description of Artificial Sequence: Synthetic oligonucleotide

SEQ ID NO: 396785 - DNA, 39 bp, Artificial Sequence; identical to SEQ ID NO: 57069
  Description of Artificial Sequence: Synthetic oligonucleotide

SEQ ID NO: 396786 - DNA, 40 bp, Artificial Sequence; identical to SEQ ID NO: 57070
  Description of Artificial Sequence: Synthetic oligonucleotide

SEQ ID NO: 396787 - DNA, 39 bp, Artificial Sequence; identical to SEQ ID NO: 57071
  Description of Artificial Sequence: Synthetic oligonucleotide

SEQ ID NO: 396788 - DNA, 38 bp, Artificial Sequence; identical to SEQ ID NO: 57072
  Description of Artificial Sequence: Synthetic oligonucleotide

SEQ ID NO: 396789 - DNA, 41 bp, Artificial Sequence; identical to SEQ ID NO: 57073
  Description of Artificial Sequence: Synthetic oligonucleotide

SEQ ID NO: 396790 - DNA, 40 bp, Artificial Sequence; identical to SEQ ID NO: 57074
  Description of Artificial Sequence: Synthetic oligonucleotide

SEQ ID NO: 396791 - DNA, 42 bp, Artificial Sequence; identical to SEQ ID NO: 57075
  Description of Artificial Sequence: Synthetic oligonucleotide

SEQ ID NO: 396792 - DNA, 41 bp, Artificial Sequence; identical to SEQ ID NO: 57076
  Description of Artificial Sequence: Synthetic oligonucleotide

SEQ ID NO: 396793 - DNA, 41 bp, Artificial Sequence; identical to SEQ ID NO: 57077
  Description of Artificial Sequence: Synthetic oligonucleotide

SEQ ID NO: 396794 - DNA, 40 bp, Artificial Sequence; identical to SEQ ID NO: 57078
  Description of Artificial Sequence: Synthetic oligonucleotide

SEQ ID NO: 396795 - DNA, 40 bp, Artificial Sequence; identical to SEQ ID NO: 57079
  Description of Artificial Sequence: Synthetic oligonucleotide

SEQ ID NO: 396796 - DNA, 39 bp, Artificial Sequence; identical to SEQ ID NO: 57080
  Description of Artificial Sequence: Synthetic oligonucleotide

SEQ ID NO: 396797 - DNA, 38 bp, Artificial Sequence; identical to SEQ ID NO: 57081
  Description of Artificial Sequence: Synthetic oligonucleotide

SEQ ID NO: 396798 - DNA, 32 bp, Artificial Sequence; identical to SEQ ID NO: 57082
  Description of Artificial Sequence: Synthetic oligonucleotide

SEQ ID NO: 396799 - DNA, 36 bp, Artificial Sequence; identical to SEQ ID NO: 57083
  Description of Artificial Sequence: Synthetic oligonucleotide

SEQ ID NO: 396800 - DNA, 37 bp, Artificial Sequence; identical to SEQ ID NO: 57084
  Description of Artificial Sequence: Synthetic oligonucleotide

SEQ ID NO: 396801 - DNA, 39 bp, Artificial Sequence; identical to SEQ ID NO: 57085
  Description of Artificial Sequence: Synthetic oligonucleotide

SEQ ID NO: 396802 - DNA, 41 bp, Artificial Sequence; identical to SEQ ID NO: 57086
  Description of Artificial Sequence: Synthetic oligonucleotide

SEQ ID NO: 396803 - DNA, 40 bp, Artificial Sequence; identical to SEQ ID NO: 57087
  Description of Artificial Sequence: Synthetic oligonucleotide

SEQ ID NO: 396804 - DNA, 39 bp, Artificial Sequence; identical to SEQ ID NO: 57088
  Description of Artificial Sequence: Synthetic oligonucleotide

SEQ ID NO: 396805 - DNA, 38 bp, Artificial Sequence; identical to SEQ ID NO: 57089
  Description of Artificial Sequence: Synthetic oligonucleotide

SEQ ID NO: 396806 - DNA, 37 bp, Artificial Sequence; identical to SEQ ID NO: 57090
  Description of Artificial Sequence: Synthetic oligonucleotide

SEQ ID NO: 396807 - DNA, 36 bp, Artificial Sequence; identical to SEQ ID NO: 57091
  Description of Artificial Sequence: Synthetic oligonucleotide

SEQ ID NO: 396808 - DNA, 38 bp, Artificial Sequence; identical to SEQ ID NO: 57092
  Description of Artificial Sequence: Synthetic oligonucleotide

SEQ ID NO: 396809 - DNA, 40 bp, Artificial Sequence; identical to SEQ ID NO: 57093
  Description of Artificial Sequence: Synthetic oligonucleotide

SEQ ID NO: 396810 - DNA, 39 bp, Artificial Sequence; identical to SEQ ID NO: 57094
  Description of Artificial Sequence: Synthetic oligonucleotide

SEQ ID NO: 396811 - DNA, 39 bp, Artificial Sequence; identical to SEQ ID NO: 57095
  Description of Artificial Sequence: Synthetic oligonucleotide

SEQ ID NO: 396812 - DNA, 38 bp, Artificial Sequence; identical to SEQ ID NO: 57096
  Description of Artificial Sequence: Synthetic oligonucleotide

SEQ ID NO: 396813 - DNA, 39 bp, Artificial Sequence; identical to SEQ ID NO: 57097
  Description of Artificial Sequence: Synthetic oligonucleotide

SEQ ID NO: 396814 - DNA, 38 bp, Artificial Sequence; identical to SEQ ID NO: 57098
  Description of Artificial Sequence: Synthetic oligonucleotide

SEQ ID NO: 396815 - DNA, 44 bp, Artificial Sequence; identical to SEQ ID NO: 57099
  Description of Artificial Sequence: Synthetic oligonucleotide

SEQ ID NO: 396816 - DNA, 43 bp, Artificial Sequence; identical to SEQ ID NO: 57100
  Description of Artificial Sequence: Synthetic oligonucleotide

SEQ ID NO: 396817 - DNA, 42 bp, Artificial Sequence; identical to SEQ ID NO: 57101
  Description of Artificial Sequence: Synthetic oligonucleotide

SEQ ID NO: 396818 - DNA, 41 bp, Artificial Sequence; identical to SEQ ID NO: 57102
  Description of Artificial Sequence: Synthetic oligonucleotide

SEQ ID NO: 396819 - DNA, 41 bp, Artificial Sequence; identical to SEQ ID NO: 57103
  Description of Artificial Sequence: Synthetic oligonucleotide

SEQ ID NO: 396820 - DNA, 40 bp, Artificial Sequence; identical to SEQ ID NO: 57104
  Description of Artificial Sequence: Synthetic oligonucleotide

SEQ ID NO: 396821 - DNA, 39 bp, Artificial Sequence; identical to SEQ ID NO: 57105
  Description of Artificial Sequence: Synthetic oligonucleotide

SEQ ID NO: 396822 - DNA, 39 bp, Artificial Sequence; identical to SEQ ID NO: 57106
  Description of Artificial Sequence: Synthetic oligonucleotide

SEQ ID NO: 396823 - DNA, 40 bp, Artificial Sequence; identical to SEQ ID NO: 57107
  Description of Artificial Sequence: Synthetic oligonucleotide

SEQ ID NO: 396824 - DNA, 40 bp, Artificial Sequence; identical to SEQ ID NO: 57108
  Description of Artificial Sequence: Synthetic oligonucleotide

SEQ ID NO: 396825 - DNA, 39 bp, Artificial Sequence; identical to SEQ ID NO: 57109
  Description of Artificial Sequence: Synthetic oligonucleotide

SEQ ID NO: 396826 - DNA, 41 bp, Artificial Sequence; identical to SEQ ID NO: 57110
  Description of Artificial Sequence: Synthetic oligonucleotide

SEQ ID NO: 396827 - DNA, 40 bp, Artificial Sequence; identical to SEQ ID NO: 57111
  Description of Artificial Sequence: Synthetic oligonucleotide

SEQ ID NO: 396828 - DNA, 41 bp, Artificial Sequence; identical to SEQ ID NO: 57112
  Description of Artificial Sequence: Synthetic oligonucleotide

SEQ ID NO: 396829 - DNA, 40 bp, Artificial Sequence; identical to SEQ ID NO: 57113
  Description of Artificial Sequence: Synthetic oligonucleotide

SEQ ID NO: 396830 - DNA, 42 bp, Artificial Sequence; identical to SEQ ID NO: 57114
  Description of Artificial Sequence: Synthetic oligonucleotide

SEQ ID NO: 396831 - DNA, 41 bp, Artificial Sequence; identical to SEQ ID NO: 57115
  Description of Artificial Sequence: Synthetic oligonucleotide

SEQ ID NO: 396832 - DNA, 40 bp, Artificial Sequence; identical to SEQ ID NO: 57116
  Description of Artificial Sequence: Synthetic oligonucleotide

SEQ ID NO: 396833 - DNA, 39 bp, Artificial Sequence; identical to SEQ ID NO: 57117
  Description of Artificial Sequence: Synthetic oligonucleotide

SEQ ID NO: 396834 - DNA, 38 bp, Artificial Sequence; identical to SEQ ID NO: 57118
  Description of Artificial Sequence: Synthetic oligonucleotide

SEQ ID NO: 396835 - DNA, 39 bp, Artificial Sequence; identical to SEQ ID NO: 57119
  Description of Artificial Sequence: Synthetic oligonucleotide

SEQ ID NO: 396836 - DNA, 38 bp, Artificial Sequence; identical to SEQ ID NO: 57120
  Description of Artificial Sequence: Synthetic oligonucleotide

SEQ ID NO: 396837 - DNA, 38 bp, Artificial Sequence; identical to SEQ ID NO: 57121
  Description of Artificial Sequence: Synthetic oligonucleotide

SEQ ID NO: 396838 - DNA, 37 bp, Artificial Sequence; identical to SEQ ID NO: 57122
  Description of Artificial Sequence: Synthetic oligonucleotide

SEQ ID NO: 396839 - DNA, 36 bp, Artificial Sequence; identical to SEQ ID NO: 57123
  Description of Artificial Sequence: Synthetic oligonucleotide

SEQ ID NO: 396840 - DNA, 37 bp, Artificial Sequence; identical to SEQ ID NO: 57124
  Description of Artificial Sequence: Synthetic oligonucleotide

SEQ ID NO: 396841 - DNA, 36 bp, Artificial Sequence; identical to SEQ ID NO: 57125
  Description of Artificial Sequence: Synthetic oligonucleotide

SEQ ID NO: 396842 - DNA, 35 bp, Artificial Sequence; identical to SEQ ID NO: 57126
  Description of Artificial Sequence: Synthetic oligonucleotide

SEQ ID NO: 396843 - DNA, 35 bp, Artificial Sequence; identical to SEQ ID NO: 57127
  Description of Artificial Sequence: Synthetic oligonucleotide

SEQ ID NO: 396844 - DNA, 34 bp, Artificial Sequence; identical to SEQ ID NO: 57128
  Description of Artificial Sequence: Synthetic oligonucleotide

SEQ ID NO: 396845 - DNA, 33 bp, Artificial Sequence; identical to SEQ ID NO: 57129
  Description of Artificial Sequence: Synthetic oligonucleotide

SEQ ID NO: 396846 - DNA, 35 bp, Artificial Sequence; identical to SEQ ID NO: 57130
  Description of Artificial Sequence: Synthetic oligonucleotide

SEQ ID NO: 396847 - DNA, 34 bp, Artificial Sequence; identical to SEQ ID NO: 57131
  Description of Artificial Sequence: Synthetic oligonucleotide

SEQ ID NO: 396848 - DNA, 33 bp, Artificial Sequence; identical to SEQ ID NO: 57132
  Description of Artificial Sequence: Synthetic oligonucleotide

SEQ ID NO: 396849 - DNA, 33 bp, Artificial Sequence; identical to SEQ ID NO: 57133
  Description of Artificial Sequence: Synthetic oligonucleotide

SEQ ID NO: 396850 - DNA, 36 bp, Artificial Sequence; identical to SEQ ID NO: 57134
  Description of Artificial Sequence: Synthetic oligonucleotide

SEQ ID NO: 396851 - DNA, 35 bp, Artificial Sequence; identical to SEQ ID NO: 57135
  Description of Artificial Sequence: Synthetic oligonucleotide

SEQ ID NO: 396852 - DNA, 36 bp, Artificial Sequence; identical to SEQ ID NO: 57136
  Description of Artificial Sequence: Synthetic oligonucleotide

SEQ ID NO: 396853 - DNA, 35 bp, Artificial Sequence; identical to SEQ ID NO: 57137
  Description of Artificial Sequence: Synthetic oligonucleotide

SEQ ID NO: 396854 - DNA, 34 bp, Artificial Sequence; identical to SEQ ID NO: 57138
  Description of Artificial Sequence: Synthetic oligonucleotide

SEQ ID NO: 396855 - DNA, 33 bp, Artificial Sequence; identical to SEQ ID NO: 57139
  Description of Artificial Sequence: Synthetic oligonucleotide

SEQ ID NO: 396856 - DNA, 32 bp, Artificial Sequence; identical to SEQ ID NO: 57140
  Description of Artificial Sequence: Synthetic oligonucleotide

SEQ ID NO: 396857 - DNA, 31 bp, Artificial Sequence; identical to SEQ ID NO: 57141
  Description of Artificial Sequence: Synthetic oligonucleotide

SEQ ID NO: 396858 - DNA, 30 bp, Artificial Sequence; identical to SEQ ID NO: 57142
  Description of Artificial Sequence: Synthetic oligonucleotide

SEQ ID NO: 396859 - DNA, 30 bp, Artificial Sequence; identical to SEQ ID NO: 57143
  Description of Artificial Sequence: Synthetic oligonucleotide

SEQ ID NO: 396860 - DNA, 32 bp, Artificial Sequence; identical to SEQ ID NO: 57144
  Description of Artificial Sequence: Synthetic oligonucleotide

SEQ ID NO: 396861 - DNA, 32 bp, Artificial Sequence; identical to SEQ ID NO: 57145
  Description of Artificial Sequence: Synthetic oligonucleotide

SEQ ID NO: 396862 - DNA, 31 bp, Artificial Sequence; identical to SEQ ID NO: 57146
  Description of Artificial Sequence: Synthetic oligonucleotide

SEQ ID NO: 396863 - DNA, 32 bp, Artificial Sequence; identical to SEQ ID NO: 57147
  Description of Artificial Sequence: Synthetic oligonucleotide

SEQ ID NO: 396864 - DNA, 33 bp, Artificial Sequence; identical to SEQ ID NO: 57148
  Description of Artificial Sequence: Synthetic oligonucleotide

SEQ ID NO: 396865 - DNA, 32 bp, Artificial Sequence; identical to SEQ ID NO: 57149
  Description of Artificial Sequence: Synthetic oligonucleotide

SEQ ID NO: 396866 - DNA, 31 bp, Artificial Sequence; identical to SEQ ID NO: 57150
  Description of Artificial Sequence: Synthetic oligonucleotide

SEQ ID NO: 396867 - DNA, 31 bp, Artificial Sequence; identical to SEQ ID NO: 57151
  Description of Artificial Sequence: Synthetic oligonucleotide

SEQ ID NO: 396868 - DNA, 30 bp, Artificial Sequence; identical to SEQ ID NO: 57152
  Description of Artificial Sequence: Synthetic oligonucleotide

SEQ ID NO: 396869 - DNA, 31 bp, Artificial Sequence; identical to SEQ ID NO: 57153
  Description of Artificial Sequence: Synthetic oligonucleotide

SEQ ID NO: 396870 - DNA, 30 bp, Artificial Sequence; identical to SEQ ID NO: 57154
  Description of Artificial Sequence: Synthetic oligonucleotide

SEQ ID NO: 396871 - DNA, 29 bp, Artificial Sequence
  Description of Artificial Sequence: Synthetic oligonucleotide
ctgctgctaccaatgaggttcctgaggtc

SEQ ID NO: 396872 - DNA, 30 bp, Artificial Sequence; identical to SEQ ID NO: 57156
  Description of Artificial Sequence: Synthetic oligonucleotide

SEQ ID NO: 396873 - DNA, 30 bp, Artificial Sequence; identical to SEQ ID NO: 57157
  Description of Artificial Sequence: Synthetic oligonucleotide

SEQ ID NO: 396874 - DNA, 30 bp, Artificial Sequence; identical to SEQ ID NO: 57158
  Description of Artificial Sequence: Synthetic oligonucleotide

SEQ ID NO: 396875 - DNA, 29 bp, Artificial Sequence
  Description of Artificial Sequence: Synthetic oligonucleotide
cacagtgttttccaagtctcccgtgacgc

SEQ ID NO: 396876 - DNA, 30 bp, Artificial Sequence; identical to SEQ ID NO: 57160
  Description of Artificial Sequence: Synthetic oligonucleotide

SEQ ID NO: 396877 - DNA, 29 bp, Artificial Sequence
  Description of Artificial Sequence: Synthetic oligonucleotide
cagtgttttccaagtctcccgtgacgctg

SEQ ID NO: 396878 - DNA, 29 bp, Artificial Sequence
  Description of Artificial Sequence: Synthetic oligonucleotide
agtgttttccaagtctcccgtgacgctgg

SEQ ID NO: 396879 - DNA, 28 bp, Artificial Sequence
  Description of Artificial Sequence: Synthetic oligonucleotide
gtgttttccaagtctcccgtgacgctgg

SEQ ID NO: 396880 - DNA, 28 bp, Artificial Sequence
  Description of Artificial Sequence: Synthetic oligonucleotide
tgttttccaagtctcccgtgacgctggg

SEQ ID NO: 396881 - DNA, 27 bp, Artificial Sequence
  Description of Artificial Sequence: Synthetic oligonucleotide
gttttccaagtctcccgtgacgctggg

SEQ ID NO: 396882 - DNA, 28 bp, Artificial Sequence
  Description of Artificial Sequence: Synthetic oligonucleotide
ttttccaagtctcccgtgacgctgggtc

SEQ ID NO: 396883 - DNA, 27 bp, Artificial Sequence
  Description of Artificial Sequence: Synthetic oligonucleotide
tttccaagtctcccgtgacgctgggtc

SEQ ID NO: 396884 - DNA, 27 bp, Artificial Sequence
  Description of Artificial Sequence: Synthetic oligonucleotide
ttccaagtctcccgtgacgctgggtca

SEQ ID NO: 396885 - DNA, 26 bp, Artificial Sequence
  Description of Artificial Sequence: Synthetic oligonucleotide
tccaagtctcccgtgacgctgggtca

SEQ ID NO: 396886 - DNA, 25 bp, Artificial Sequence
  Description of Artificial Sequence: Synthetic oligonucleotide
ccaagtctcccgtgacgctgggtca

SEQ ID NO: 396887 - DNA, 25 bp, Artificial Sequence
  Description of Artificial Sequence: Synthetic oligonucleotide
caagtctcccgtgacgctgggtcag

SEQ ID NO: 396888 - DNA, 25 bp, Artificial Sequence
  Description of Artificial Sequence: Synthetic oligonucleotide
aagtctcccgtgacgctgggtcagc

SEQ ID NO: 396889 - DNA, 24 bp, Artificial Sequence
  Description of Artificial Sequence: Synthetic oligonucleotide
agtctcccgtgacgctgggtcagc

SEQ ID NO: 396890 - DNA, 23 bp, Artificial Sequence
  Description of Artificial Sequence: Synthetic oligonucleotide
gtctcccgtgacgctgggtcagc

SEQ ID NO: 396891 - DNA, 23 bp, Artificial Sequence
  Description of Artificial Sequence: Synthetic oligonucleotide
tctcccgtgacgctgggtcagcc

SEQ ID NO: 396892 - DNA, 22 bp, Artificial Sequence
  Description of Artificial Sequence: Synthetic oligonucleotide
ctcccgtgacgctgggtcagcc

SEQ ID NO: 396893 - DNA, 24 bp, Artificial Sequence
  Description of Artificial Sequence: Synthetic oligonucleotide
tcccgtgacgctgggtcagcccaa

SEQ ID NO: 396894 - DNA, 23 bp, Artificial Sequence
  Description of Artificial Sequence: Synthetic oligonucleotide
cccgtgacgctgggtcagcccaa

SEQ ID NO: 396895 - DNA, 24 bp, Artificial Sequence
  Description of Artificial Sequence: Synthetic oligonucleotide
ccgtgacgctgggtcagcccaaca

SEQ ID NO: 396896 - DNA, 24 bp, Artificial Sequence
  Description of Artificial Sequence: Synthetic oligonucleotide
cgtgacgctgggtcagcccaacac

SEQ ID NO: 396897 - DNA, 24 bp, Artificial Sequence
  Description of Artificial Sequence: Synthetic oligonucleotide
gtgacgctgggtcagcccaacacc

SEQ ID NO: 396898 - DNA, 25 bp, Artificial Sequence
  Description of Artificial Sequence: Synthetic oligonucleotide
tgacgctgggtcagcccaacaccct

SEQ ID NO: 396899 - DNA, 24 bp, Artificial Sequence
  Description of Artificial Sequence: Synthetic oligonucleotide
gacgctgggtcagcccaacaccct

SEQ ID NO: 396900 - DNA, 26 bp, Artificial Sequence
  Description of Artificial Sequence: Synthetic oligonucleotide
acgctgggtcagcccaacaccctcat

SEQ ID NO: 396901 - DNA, 25 bp, Artificial Sequence
  Description of Artificial Sequence: Synthetic oligonucleotide
cgctgggtcagcccaacaccctcat

SEQ ID NO: 396902 - DNA, 26 bp, Artificial Sequence
  Description of Artificial Sequence: Synthetic oligonucleotide
gctgggtcagcccaacaccctcatct

SEQ ID NO: 396903 - DNA, 31 bp, Artificial Sequence; identical to SEQ ID NO: 57187
  Description of Artificial Sequence: Synthetic oligonucleotide

SEQ ID NO: 396904 - DNA, 30 bp, Artificial Sequence; identical to SEQ ID NO: 57188
  Description of Artificial Sequence: Synthetic oligonucleotide

SEQ ID NO: 396905 - DNA, 31 bp, Artificial Sequence; identical to SEQ ID NO: 57189
  Description of Artificial Sequence: Synthetic oligonucleotide

SEQ ID NO: 396906 - DNA, 30 bp, Artificial Sequence; identical to SEQ ID NO: 57190
  Description of Artificial Sequence: Synthetic oligonucleotide

SEQ ID NO: 396907 - DNA, 29 bp, Artificial Sequence
  Description of Artificial Sequence: Synthetic oligonucleotide
catcacatggctgagcaatgggcactcag

SEQ ID NO: 396908 - DNA, 30 bp, Artificial Sequence; identical to SEQ ID NO: 57192
  Description of Artificial Sequence: Synthetic oligonucleotide

SEQ ID NO: 396909 - DNA, 29 bp, Artificial Sequence
  Description of Artificial Sequence: Synthetic oligonucleotide
tcacatggctgagcaatgggcactcagtc

SEQ ID NO: 396910 - DNA, 28 bp, Artificial Sequence
  Description of Artificial Sequence: Synthetic oligonucleotide
cacatggctgagcaatgggcactcagtc

SEQ ID NO: 396911 - DNA, 29 bp, Artificial Sequence
  Description of Artificial Sequence: Synthetic oligonucleotide
acatggctgagcaatgggcactcagtcac

SEQ ID NO: 396912 - DNA, 28 bp, Artificial Sequence
  Description of Artificial Sequence: Synthetic oligonucleotide
catggctgagcaatgggcactcagtcac

SEQ ID NO: 396913 - DNA, 29 bp, Artificial Sequence
  Description of Artificial Sequence: Synthetic oligonucleotide
atggctgagcaatgggcactcagtcacag

SEQ ID NO: 396914 - DNA, 23 bp, Artificial Sequence
  Description of Artificial Sequence: Synthetic oligonucleotide
gtggagcactggggcctggacga

SEQ ID NO: 396915 - DNA, 23 bp, Artificial Sequence
  Description of Artificial Sequence: Synthetic oligonucleotide
tggagcactggggcctggacgag

SEQ ID NO: 396916 - DNA, 22 bp, Artificial Sequence
  Description of Artificial Sequence: Synthetic oligonucleotide
ggagcactggggcctggacgag

SEQ ID NO: 396917 - DNA, 22 bp, Artificial Sequence
  Description of Artificial Sequence: Synthetic oligonucleotide
gagcactggggcctggacgagc

SEQ ID NO: 396918 - DNA, 23 bp, Artificial Sequence
  Description of Artificial Sequence: Synthetic oligonucleotide
agcactggggcctggacgagcct

SEQ ID NO: 396919 - DNA, 22 bp, Artificial Sequence
  Description of Artificial Sequence: Synthetic oligonucleotide
gcactggggcctggacgagcct

SEQ ID NO: 396920 - DNA, 24 bp, Artificial Sequence
  Description of Artificial Sequence: Synthetic oligonucleotide
cactggggcctggacgagcctctt

SEQ ID NO: 396921 - DNA, 25 bp, Artificial Sequence
  Description of Artificial Sequence: Synthetic oligonucleotide
actggggcctggacgagcctcttct

SEQ ID NO: 396922 - DNA, 24 bp, Artificial Sequence
  Description of Artificial Sequence: Synthetic oligonucleotide
ctggggcctggacgagcctcttct

SEQ ID NO: 396923 - DNA, 27 bp, Artificial Sequence
  Description of Artificial Sequence: Synthetic oligonucleotide
tggggcctggacgagcctcttctgaaa

SEQ ID NO: 396924 - DNA, 26 bp, Artificial Sequence
  Description of Artificial Sequence: Synthetic oligonucleotide
ggggcctggacgagcctcttctgaaa

SEQ ID NO: 396925 - DNA, 27 bp, Artificial Sequence
  Description of Artificial Sequence: Synthetic oligonucleotide
gggcctggacgagcctcttctgaaaca

SEQ ID NO: 396926 - DNA, 27 bp, Artificial Sequence
  Description of Artificial Sequence: Synthetic oligonucleotide
ggcctggacgagcctcttctgaaacac

SEQ ID NO: 396927 - DNA, 28 bp, Artificial Sequence
  Description of Artificial Sequence: Synthetic oligonucleotide
gcctggacgagcctcttctgaaacactg

SEQ ID NO: 396928 - DNA, 28 bp, Artificial Sequence
  Description of Artificial Sequence: Synthetic oligonucleotide
cctggacgagcctcttctgaaacactgg

SEQ ID NO: 396929 - DNA, 28 bp, Artificial Sequence
  Description of Artificial Sequence: Synthetic oligonucleotide
ctggacgagcctcttctgaaacactggg

SEQ ID NO: 396930 - DNA, 29 bp, Artificial Sequence
  Description of Artificial Sequence: Synthetic oligonucleotide
tggacgagcctcttctgaaacactgggag

SEQ ID NO: 396931 - DNA, 28 bp, Artificial Sequence
  Description of Artificial Sequence: Synthetic oligonucleotide
ggacgagcctcttctgaaacactgggag

SEQ ID NO: 396932 - DNA, 28 bp, Artificial Sequence
  Description of Artificial Sequence: Synthetic oligonucleotide
gacgagcctcttctgaaacactgggagc

SEQ ID NO: 396933 - DNA, 28 bp, Artificial Sequence
  Description of Artificial Sequence: Synthetic oligonucleotide
acgagcctcttctgaaacactgggagcc

SEQ ID NO: 396934 - DNA, 27 bp, Artificial Sequence
  Description of Artificial Sequence: Synthetic oligonucleotide
cgagcctcttctgaaacactgggagcc

SEQ ID NO: 396935 - DNA, 27 bp, Artificial Sequence
  Description of Artificial Sequence: Synthetic oligonucleotide
agagactgtggtctgcgccctgggatt

SEQ ID NO: 396936 - DNA, 26 bp, Artificial Sequence
  Description of Artificial Sequence: Synthetic oligonucleotide
gagactgtggtctgcgccctgggatt

SEQ ID NO: 396937 - DNA, 27 bp, Artificial Sequence
  Description of Artificial Sequence: Synthetic oligonucleotide
agactgtggtctgcgccctgggattgt

SEQ ID NO: 396938 - DNA, 26 bp, Artificial Sequence
  Description of Artificial Sequence: Synthetic oligonucleotide
gactgtggtctgcgccctgggattgt

SEQ ID NO: 396939 - DNA, 27 bp, Artificial Sequence
  Description of Artificial Sequence: Synthetic oligonucleotide
actgtggtctgcgccctgggattgtct

SEQ ID NO: 396940 - DNA, 26 bp, Artificial Sequence
  Description of Artificial Sequence: Synthetic oligonucleotide
ctgtggtctgcgccctgggattgtct

SEQ ID NO: 396941 - DNA, 27 bp, Artificial Sequence
  Description of Artificial Sequence: Synthetic oligonucleotide
tgtggtctgcgccctgggattgtctgt

SEQ ID NO: 396942 - DNA, 26 bp, Artificial Sequence
  Description of Artificial Sequence: Synthetic oligonucleotide
gtggtctgcgccctgggattgtctgt

SEQ ID NO: 396943 - DNA, 26 bp, Artificial Sequence
  Description of Artificial Sequence: Synthetic oligonucleotide
tggtctgcgccctgggattgtctgtg

SEQ ID NO: 396944 - DNA, 25 bp, Artificial Sequence
  Description of Artificial Sequence: Synthetic oligonucleotide
ggtctgcgccctgggattgtctgtg

SEQ ID NO: 396945 - DNA, 25 bp, Artificial Sequence
  Description of Artificial Sequence: Synthetic oligonucleotide
gtctgcgccctgggattgtctgtgg

SEQ ID NO: 396946 - DNA, 25 bp, Artificial Sequence
  Description of Artificial Sequence: Synthetic oligonucleotide
tctgcgccctgggattgtctgtggg

SEQ ID NO: 396947 - DNA, 24 bp, Artificial Sequence
  Description of Artificial Sequence: Synthetic oligonucleotide
ctgcgccctgggattgtctgtggg

SEQ ID NO: 396948 - DNA, 24 bp, Artificial Sequence
  Description of Artificial Sequence: Synthetic oligonucleotide
tgcgccctgggattgtctgtgggc

SEQ ID NO: 396949 - DNA, 23 bp, Artificial Sequence
  Description of Artificial Sequence: Synthetic oligonucleotide
gcgccctgggattgtctgtgggc

SEQ ID NO: 396950 - DNA, 24 bp, Artificial Sequence
  Description of Artificial Sequence: Synthetic oligonucleotide
cgccctgggattgtctgtgggcct

SEQ ID NO: 396951 - DNA, 24 bp, Artificial Sequence
  Description of Artificial Sequence: Synthetic oligonucleotide
gccctgggattgtctgtgggcctc

SEQ ID NO: 396952 - DNA, 25 bp, Artificial Sequence
  Description of Artificial Sequence: Synthetic oligonucleotide
ccctgggattgtctgtgggcctcgt

SEQ ID NO: 396953 - DNA, 25 bp, Artificial Sequence
  Description of Artificial Sequence: Synthetic oligonucleotide
cctgggattgtctgtgggcctcgtg

SEQ ID NO: 396954 - DNA, 25 bp, Artificial Sequence
  Description of Artificial Sequence: Synthetic oligonucleotide
ctgggattgtctgtgggcctcgtgg

SEQ ID NO: 396955 - DNA, 25 bp, Artificial Sequence
  Description of Artificial Sequence: Synthetic oligonucleotide
tgggattgtctgtgggcctcgtggg

SEQ ID NO: 396956 - DNA, 24 bp, Artificial Sequence
  Description of Artificial Sequence: Synthetic oligonucleotide
gggattgtctgtgggcctcgtggg

SEQ ID NO: 396957 - DNA, 27 bp, Artificial Sequence
  Description of Artificial Sequence: Synthetic oligonucleotide
ggattgtctgtgggcctcgtgggcatt

SEQ ID NO: 396958 - DNA, 27 bp, Artificial Sequence
  Description of Artificial Sequence: Synthetic oligonucleotide
gattgtctgtgggcctcgtgggcattg

SEQ ID NO: 396959 - DNA, 28 bp, Artificial Sequence
  Description of Artificial Sequence: Synthetic oligonucleotide
attgtctgtgggcctcgtgggcattgtg

SEQ ID NO: 396960 - DNA, 30 bp, Artificial Sequence; identical to SEQ ID NO: 57244
  Description of Artificial Sequence: Synthetic oligonucleotide

SEQ ID NO: 396961 - DNA, 31 bp, Artificial Sequence; identical to SEQ ID NO: 57245
  Description of Artificial Sequence: Synthetic oligonucleotide

SEQ ID NO: 396962 - DNA, 30 bp, Artificial Sequence; identical to SEQ ID NO: 57246
  Description of Artificial Sequence: Synthetic oligonucleotide

SEQ ID NO: 396963 - DNA, 29 bp, Artificial Sequence
  Description of Artificial Sequence: Synthetic oligonucleotide
tgtggtgggcactgtcttcatcatccgag

SEQ ID NO: 396964 - DNA, 28 bp, Artificial Sequence
  Description of Artificial Sequence: Synthetic oligonucleotide
gtggtgggcactgtcttcatcatccgag

SEQ ID NO: 396965 - DNA, 28 bp, Artificial Sequence
  Description of Artificial Sequence: Synthetic oligonucleotide
tggtgggcactgtcttcatcatccgagg

SEQ ID NO: 396966 - DNA, 27 bp, Artificial Sequence
  Description of Artificial Sequence: Synthetic oligonucleotide
ggtgggcactgtcttcatcatccgagg

SEQ ID NO: 396967 - DNA, 27 bp, Artificial Sequence
  Description of Artificial Sequence: Synthetic oligonucleotide
gtgggcactgtcttcatcatccgaggc

SEQ ID NO: 396968 - DNA, 27 bp, Artificial Sequence
  Description of Artificial Sequence: Synthetic oligonucleotide
tgggcactgtcttcatcatccgaggcc

SEQ ID NO: 396969 - DNA, 27 bp, Artificial Sequence
  Description of Artificial Sequence: Synthetic oligonucleotide
gggcactgtcttcatcatccgaggcct

SEQ ID NO: 396970 - DNA, 27 bp, Artificial Sequence
  Description of Artificial Sequence: Synthetic oligonucleotide
ggcactgtcttcatcatccgaggcctg

SEQ ID NO: 396971 - DNA, 27 bp, Artificial Sequence
  Description of Artificial Sequence: Synthetic oligonucleotide
gcactgtcttcatcatccgaggcctgc

SEQ ID NO: 396972 - DNA, 27 bp, Artificial Sequence
  Description of Artificial Sequence: Synthetic oligonucleotide
cactgtcttcatcatccgaggcctgcg

SEQ ID NO: 396973 - DNA, 29 bp, Artificial Sequence
  Description of Artificial Sequence: Synthetic oligonucleotide
actgtcttcatcatccgaggcctgcgttc

SEQ ID NO: 396974 - DNA, 28 bp, Artificial Sequence
  Description of Artificial Sequence: Synthetic oligonucleotide
ctgtcttcatcatccgaggcctgcgttc

SEQ ID NO: 396975 - DNA, 29 bp, Artificial Sequence
  Description of Artificial Sequence: Synthetic oligonucleotide
tgtcttcatcatccgaggcctgcgttcag

SEQ ID NO: 396976 - DNA, 28 bp, Artificial Sequence
  Description of Artificial Sequence: Synthetic oligonucleotide
gtcttcatcatccgaggcctgcgttcag

SEQ ID NO: 396977 - DNA, 30 bp, Artificial Sequence; identical to SEQ ID NO: 57261
  Description of Artificial Sequence: Synthetic oligonucleotide

SEQ ID NO: 396978 - DNA, 29 bp, Artificial Sequence
  Description of Artificial Sequence: Synthetic oligonucleotide
cttcatcatccgaggcctgcgttcagttg

SEQ ID NO: 396979 - DNA, 29 bp, Artificial Sequence
  Description of Artificial Sequence: Synthetic oligonucleotide
ttcatcatccgaggcctgcgttcagttgg

SEQ ID NO: 396980 - DNA, 28 bp, Artificial Sequence
  Description of Artificial Sequence: Synthetic oligonucleotide
tcatcatccgaggcctgcgttcagttgg

SEQ ID NO: 396981 - DNA, 27 bp, Artificial Sequence
  Description of Artificial Sequence: Synthetic oligonucleotide
catcatccgaggcctgcgttcagttgg

SEQ ID NO: 396982 - DNA, 33 bp, Artificial Sequence; identical to SEQ ID NO: 57266
  Description of Artificial Sequence: Synthetic oligonucleotide

SEQ ID NO: 396983 - DNA, 32 bp, Artificial Sequence; identical to SEQ ID NO: 57267
  Description of Artificial Sequence: Synthetic oligonucleotide

SEQ ID NO: 396984 - DNA, 31 bp, Artificial Sequence; identical to SEQ ID NO: 57268
  Description of Artificial Sequence: Synthetic oligonucleotide

SEQ ID NO: 396985 - DNA, 32 bp, Artificial Sequence; identical to SEQ ID NO: 57269
  Description of Artificial Sequence: Synthetic oligonucleotide

SEQ ID NO: 396986 - DNA, 33 bp, Artificial Sequence; identical to SEQ ID NO: 57270
  Description of Artificial Sequence: Synthetic oligonucleotide

SEQ ID NO: 396987 - DNA, 32 bp, Artificial Sequence; identical to SEQ ID NO: 57271
  Description of Artificial Sequence: Synthetic oligonucleotide

SEQ ID NO: 396988 - DNA, 32 bp, Artificial Sequence; identical to SEQ ID NO: 57272
  Description of Artificial Sequence: Synthetic oligonucleotide

SEQ ID NO: 396989 - DNA, 31 bp, Artificial Sequence; identical to SEQ ID NO: 57273
  Description of Artificial Sequence: Synthetic oligonucleotide

SEQ ID NO: 396990 - DNA, 31 bp, Artificial Sequence; identical to SEQ ID NO: 57274
  Description of Artificial Sequence: Synthetic oligonucleotide

SEQ ID NO: 396991 - DNA, 32 bp, Artificial Sequence; identical to SEQ ID NO: 57275
  Description of Artificial Sequence: Synthetic oligonucleotide

SEQ ID NO: 396992 - DNA, 31 bp, Artificial Sequence; identical to SEQ ID NO: 57276
  Description of Artificial Sequence: Synthetic oligonucleotide

SEQ ID NO: 396993 - DNA, 31 bp, Artificial Sequence; identical to SEQ ID NO: 57277
  Description of Artificial Sequence: Synthetic oligonucleotide

SEQ ID NO: 396994 - DNA, 30 bp, Artificial Sequence; identical to SEQ ID NO: 57278
  Description of Artificial Sequence: Synthetic oligonucleotide

SEQ ID NO: 396995 - DNA, 30 bp, Artificial Sequence; identical to SEQ ID NO: 57279
  Description of Artificial Sequence: Synthetic oligonucleotide

SEQ ID NO: 396996 - DNA, 29 bp, Artificial Sequence
  Description of Artificial Sequence: Synthetic oligonucleotide
gtgttttccaagtctcctgtgacgctggg

SEQ ID NO: 396997 - DNA, 30 bp, Artificial Sequence; identical to SEQ ID NO: 57281
  Description of Artificial Sequence: Synthetic oligonucleotide

SEQ ID NO: 396998 - DNA, 29 bp, Artificial Sequence
  Description of Artificial Sequence: Synthetic oligonucleotide
gttttccaagtctcctgtgacgctgggtc

SEQ ID NO: 396999 - DNA, 30 bp, Artificial Sequence; identical to SEQ ID NO: 57283
  Description of Artificial Sequence: Synthetic oligonucleotide

SEQ ID NO: 397000 - DNA, 29 bp, Artificial Sequence
  Description of Artificial Sequence: Synthetic oligonucleotide
tttccaagtctcctgtgacgctgggtcag

SEQ ID NO: 397001 - DNA, 28 bp, Artificial Sequence
  Description of Artificial Sequence: Synthetic oligonucleotide
ttccaagtctcctgtgacgctgggtcag

SEQ ID NO: 397002 - DNA, 27 bp, Artificial Sequence
  Description of Artificial Sequence: Synthetic oligonucleotide
tccaagtctcctgtgacgctgggtcag

SEQ ID NO: 397003 - DNA, 26 bp, Artificial Sequence
  Description of Artificial Sequence: Synthetic oligonucleotide
ccaagtctcctgtgacgctgggtcag

SEQ ID NO: 397004 - DNA, 26 bp, Artificial Sequence
  Description of Artificial Sequence: Synthetic oligonucleotide
caagtctcctgtgacgctgggtcagc

SEQ ID NO: 397005 - DNA, 26 bp, Artificial Sequence
  Description of Artificial Sequence: Synthetic oligonucleotide
aagtctcctgtgacgctgggtcagcc

SEQ ID NO: 397006 - DNA, 25 bp, Artificial Sequence
  Description of Artificial Sequence: Synthetic oligonucleotide
agtctcctgtgacgctgggtcagcc

SEQ ID NO: 397007 - DNA, 24 bp, Artificial Sequence
  Description of Artificial Sequence: Synthetic oligonucleotide
gtctcctgtgacgctgggtcagcc

SEQ ID NO: 397008 - DNA, 26 bp, Artificial Sequence
  Description of Artificial Sequence: Synthetic oligonucleotide
tctcctgtgacgctgggtcagcccaa

SEQ ID NO: 397009 - DNA, 25 bp, Artificial Sequence
  Description of Artificial Sequence: Synthetic oligonucleotide
ctcctgtgacgctgggtcagcccaa

SEQ ID NO: 397010 - DNA, 26 bp, Artificial Sequence
  Description of Artificial Sequence: Synthetic oligonucleotide
tcctgtgacgctgggtcagcccaaca

SEQ ID NO: 397011 - DNA, 25 bp, Artificial Sequence
  Description of Artificial Sequence: Synthetic oligonucleotide
cctgtgacgctgggtcagcccaaca

SEQ ID NO: 397012 - DNA, 25 bp, Artificial Sequence
  Description of Artificial Sequence: Synthetic oligonucleotide
ctgtgacgctgggtcagcccaacac

SEQ ID NO: 397013 - DNA, 25 bp, Artificial Sequence
  Description of Artificial Sequence: Synthetic oligonucleotide
tgtgacgctgggtcagcccaacacc

SEQ ID NO: 397014 - DNA, 32 bp, Artificial Sequence; identical to SEQ ID NO: 57298
  Description of Artificial Sequence: Synthetic oligonucleotide

SEQ ID NO: 397015 - DNA, 33 bp, Artificial Sequence; identical to SEQ ID NO: 57299
  Description of Artificial Sequence: Synthetic oligonucleotide

SEQ ID NO: 397016 - DNA, 33 bp, Artificial Sequence; identical to SEQ ID NO: 57300
  Description of Artificial Sequence: Synthetic oligonucleotide

SEQ ID NO: 397017 - DNA, 35 bp, Artificial Sequence; identical to SEQ ID NO: 57301
  Description of Artificial Sequence: Synthetic oligonucleotide

SEQ ID NO: 397018 - DNA, 34 bp, Artificial Sequence; identical to SEQ ID NO: 57302
  Description of Artificial Sequence: Synthetic oligonucleotide

SEQ ID NO: 397019 - DNA, 34 bp, Artificial Sequence; identical to SEQ ID NO: 57303
  Description of Artificial Sequence: Synthetic oligonucleotide

SEQ ID NO: 397020 - DNA, 33 bp, Artificial Sequence; identical to SEQ ID NO: 57304
  Description of Artificial Sequence: Synthetic oligonucleotide

SEQ ID NO: 397021 - DNA, 34 bp, Artificial Sequence; identical to SEQ ID NO: 57305
  Description of Artificial Sequence: Synthetic oligonucleotide

SEQ ID NO: 397022 - DNA, 33 bp, Artificial Sequence; identical to SEQ ID NO: 57306
  Description of Artificial Sequence: Synthetic oligonucleotide

SEQ ID NO: 397023 - DNA, 34 bp, Artificial Sequence; identical to SEQ ID NO: 57307
  Description of Artificial Sequence: Synthetic oligonucleotide

SEQ ID NO: 397024 - DNA, 33 bp, Artificial Sequence; identical to SEQ ID NO: 57308
  Description of Artificial Sequence: Synthetic oligonucleotide

SEQ ID NO: 397025 - DNA, 33 bp, Artificial Sequence; identical to SEQ ID NO: 57309
  Description of Artificial Sequence: Synthetic oligonucleotide

SEQ ID NO: 397026 - DNA, 32 bp, Artificial Sequence; identical to SEQ ID NO: 57310
  Description of Artificial Sequence: Synthetic oligonucleotide

SEQ ID NO: 397027 - DNA, 34 bp, Artificial Sequence; identical to SEQ ID NO: 57311
  Description of Artificial Sequence: Synthetic oligonucleotide

SEQ ID NO: 397028 - DNA, 33 bp, Artificial Sequence; identical to SEQ ID NO: 57312
  Description of Artificial Sequence: Synthetic oligonucleotide

SEQ ID NO: 397029 - DNA, 34 bp, Artificial Sequence; identical to SEQ ID NO: 57313
  Description of Artificial Sequence: Synthetic oligonucleotide

SEQ ID NO: 397030 - DNA, 33 bp, Artificial Sequence; identical to SEQ ID NO: 57314
  Description of Artificial Sequence: Synthetic oligonucleotide

SEQ ID NO: 397031 - DNA, 32 bp, Artificial Sequence; identical to SEQ ID NO: 57315
  Description of Artificial Sequence: Synthetic oligonucleotide

SEQ ID NO: 397032 - DNA, 33 bp, Artificial Sequence; identical to SEQ ID NO: 57316
  Description of Artificial Sequence: Synthetic oligonucleotide

SEQ ID NO: 397033 - DNA, 35 bp, Artificial Sequence; identical to SEQ ID NO: 57317
  Description of Artificial Sequence: Synthetic oligonucleotide

SEQ ID NO: 397034 - DNA, 34 bp, Artificial Sequence; identical to SEQ ID NO: 57318
  Description of Artificial Sequence: Synthetic oligonucleotide

SEQ ID NO: 397035 - DNA, 37 bp, Artificial Sequence; identical to SEQ ID NO: 57319
  Description of Artificial Sequence: Synthetic oligonucleotide

SEQ ID NO: 397036 - DNA, 36 bp, Artificial Sequence; identical to SEQ ID NO: 57320
  Description of Artificial Sequence: Synthetic oligonucleotide

SEQ ID NO: 397037 - DNA, 35 bp, Artificial Sequence; identical to SEQ ID NO: 57321
  Description of Artificial Sequence: Synthetic oligonucleotide

SEQ ID NO: 397038 - DNA, 34 bp, Artificial Sequence; identical to SEQ ID NO: 57322
  Description of Artificial Sequence: Synthetic oligonucleotide

SEQ ID NO: 397039 - DNA, 34 bp, Artificial Sequence; identical to SEQ ID NO: 57323
  Description of Artificial Sequence: Synthetic oligonucleotide

SEQ ID NO: 397040 - DNA, 33 bp, Artificial Sequence; identical to SEQ ID NO: 57324
  Description of Artificial Sequence: Synthetic oligonucleotide

SEQ ID NO: 397041 - DNA, 35 bp, Artificial Sequence; identical to SEQ ID NO: 57325
  Description of Artificial Sequence: Synthetic oligonucleotide

SEQ ID NO: 397042 - DNA, 34 bp, Artificial Sequence; identical to SEQ ID NO: 57326
  Description of Artificial Sequence: Synthetic oligonucleotide

SEQ ID NO: 397043 - DNA, 36 bp, Artificial Sequence; identical to SEQ ID NO: 57327
  Description of Artificial Sequence: Synthetic oligonucleotide

SEQ ID NO: 397044 - DNA, 35 bp, Artificial Sequence; identical to SEQ ID NO: 57328
  Description of Artificial Sequence: Synthetic oligonucleotide

SEQ ID NO: 397045 - DNA, 37 bp, Artificial Sequence; identical to SEQ ID NO: 57360
  Description of Artificial Sequence: Synthetic oligonucleotide

SEQ ID NO: 397046 - DNA, 38 bp, Artificial Sequence; identical to SEQ ID NO: 57361
  Description of Artificial Sequence: Synthetic oligonucleotide

SEQ ID NO: 397047 - DNA, 37 bp, Artificial Sequence; identical to SEQ ID NO: 57362
  Description of Artificial Sequence: Synthetic oligonucleotide

SEQ ID NO: 397048 - DNA, 37 bp, Artificial Sequence; identical to SEQ ID NO: 57363
  Description of Artificial Sequence: Synthetic oligonucleotide

SEQ ID NO: 397049 - DNA, 36 bp, Artificial Sequence; identical to SEQ ID NO: 57364
  Description of Artificial Sequence: Synthetic oligonucleotide

SEQ ID NO: 397050 - DNA, 37 bp, Artificial Sequence; identical to SEQ ID NO: 57365
  Description of Artificial Sequence: Synthetic oligonucleotide

SEQ ID NO: 397051 - DNA, 38 bp, Artificial Sequence; identical to SEQ ID NO: 57366
  Description of Artificial Sequence: Synthetic oligonucleotide

SEQ ID NO: 397052 - DNA, 37 bp, Artificial Sequence; identical to SEQ ID NO: 57367
  Description of Artificial Sequence: Synthetic oligonucleotide

SEQ ID NO: 397053 - DNA, 36 bp, Artificial Sequence; identical to SEQ ID NO: 57368
  Description of Artificial Sequence: Synthetic oligonucleotide

SEQ ID NO: 397054 - DNA, 36 bp, Artificial Sequence; identical to SEQ ID NO: 57369
  Description of Artificial Sequence: Synthetic oligonucleotide

SEQ ID NO: 397055 - DNA, 35 bp, Artificial Sequence; identical to SEQ ID NO: 57370
  Description of Artificial Sequence: Synthetic oligonucleotide

SEQ ID NO: 397056 - DNA, 37 bp, Artificial Sequence; identical to SEQ ID NO: 57371
  Description of Artificial Sequence: Synthetic oligonucleotide

SEQ ID NO: 397057 - DNA, 36 bp, Artificial Sequence; identical to SEQ ID NO: 57372
  Description of Artificial Sequence: Synthetic oligonucleotide

SEQ ID NO: 397058 - DNA, 36 bp, Artificial Sequence; identical to SEQ ID NO: 57373
  Description of Artificial Sequence: Synthetic oligonucleotide

SEQ ID NO: 397059 - DNA, 35 bp, Artificial Sequence; identical to SEQ ID NO: 57374
  Description of Artificial Sequence: Synthetic oligonucleotide

SEQ ID NO: 397060 - DNA, 34 bp, Artificial Sequence; identical to SEQ ID NO: 57375
  Description of Artificial Sequence: Synthetic oligonucleotide

SEQ ID NO: 397061 - DNA, 35 bp, Artificial Sequence; identical to SEQ ID NO: 57376
  Description of Artificial Sequence: Synthetic oligonucleotide

SEQ ID NO: 397062 - DNA, 34 bp, Artificial Sequence; identical to SEQ ID NO: 57377
  Description of Artificial Sequence: Synthetic oligonucleotide

SEQ ID NO: 397063 - DNA, 33 bp, Artificial Sequence; identical to SEQ ID NO: 57378
  Description of Artificial Sequence: Synthetic oligonucleotide

SEQ ID NO: 397064 - DNA, 32 bp, Artificial Sequence; identical to SEQ ID NO: 57379
  Description of Artificial Sequence: Synthetic oligonucleotide

SEQ ID NO: 397065 - DNA, 32 bp, Artificial Sequence; identical to SEQ ID NO: 57380
  Description of Artificial Sequence: Synthetic oligonucleotide

SEQ ID NO: 397066 - DNA, 32 bp, Artificial Sequence; identical to SEQ ID NO: 57381
  Description of Artificial Sequence: Synthetic oligonucleotide

SEQ ID NO: 397067 - DNA, 31 bp, Artificial Sequence; identical to SEQ ID NO: 57382
  Description of Artificial Sequence: Synthetic oligonucleotide

SEQ ID NO: 397068 - DNA, 30 bp, Artificial Sequence; identical to SEQ ID NO: 57383
  Description of Artificial Sequence: Synthetic oligonucleotide

SEQ ID NO: 397069 - DNA, 32 bp, Artificial Sequence; identical to SEQ ID NO: 57384
  Description of Artificial Sequence: Synthetic oligonucleotide

SEQ ID NO: 397070 - DNA, 31 bp, Artificial Sequence; identical to SEQ ID NO: 57385
  Description of Artificial Sequence: Synthetic oligonucleotide

SEQ ID NO: 397071 - DNA, 30 bp, Artificial Sequence; identical to SEQ ID NO: 57386
  Description of Artificial Sequence: Synthetic oligonucleotide

SEQ ID NO: 397072 - DNA, 31 bp, Artificial Sequence; identical to SEQ ID NO: 57387
  Description of Artificial Sequence: Synthetic oligonucleotide

SEQ ID NO: 397073 - DNA, 30 bp, Artificial Sequence; identical to SEQ ID NO: 57388
  Description of Artificial Sequence: Synthetic oligonucleotide

SEQ ID NO: 397074 - DNA, 29 bp, Artificial Sequence
  Description of Artificial Sequence: Synthetic oligonucleotide
gatcagtcacctcaccttcctcccttctg

SEQ ID NO: 397075 - DNA, 29 bp, Artificial Sequence
  Description of Artificial Sequence: Synthetic oligonucleotide
atcagtcacctcaccttcctcccttctgc

SEQ ID NO: 397076 - DNA, 28 bp, Artificial Sequence
  Description of Artificial Sequence: Synthetic oligonucleotide
tcagtcacctcaccttcctcccttctgc

SEQ ID NO: 397077 - DNA, 27 bp, Artificial Sequence
  Description of Artificial Sequence: Synthetic oligonucleotide
cagtcacctcaccttcctcccttctgc

SEQ ID NO: 397078 - DNA, 28 bp, Artificial Sequence
  Description of Artificial Sequence: Synthetic oligonucleotide
agtcacctcaccttcctcccttctgctg

SEQ ID NO: 397079 - DNA, 27 bp, Artificial Sequence
  Description of Artificial Sequence: Synthetic oligonucleotide
gtcacctcaccttcctcccttctgctg

SEQ ID NO: 397080 - DNA, 29 bp, Artificial Sequence
  Description of Artificial Sequence: Synthetic oligonucleotide
tcacctcaccttcctcccttctgctgatg

SEQ ID NO: 397081 - DNA, 28 bp, Artificial Sequence
  Description of Artificial Sequence: Synthetic oligonucleotide
cacctcaccttcctcccttctgctgatg

SEQ ID NO: 397082 - DNA, 30 bp, Artificial Sequence; identical to SEQ ID NO: 57397
  Description of Artificial Sequence: Synthetic oligonucleotide

SEQ ID NO: 397083 - DNA, 29 bp, Artificial Sequence
  Description of Artificial Sequence: Synthetic oligonucleotide
aaacaaagctctgatgctgggggcccttg

SEQ ID NO: 397084 - DNA, 28 bp, Artificial Sequence
  Description of Artificial Sequence: Synthetic oligonucleotide
aacaaagctctgatgctgggggcccttg

SEQ ID NO: 397085 - DNA, 27 bp, Artificial Sequence
  Description of Artificial Sequence: Synthetic oligonucleotide
acaaagctctgatgctgggggcccttg

SEQ ID NO: 397086 - DNA, 26 bp, Artificial Sequence
  Description of Artificial Sequence: Synthetic oligonucleotide
caaagctctgatgctgggggcccttg

SEQ ID NO: 397087 - DNA, 26 bp, Artificial Sequence
  Description of Artificial Sequence: Synthetic oligonucleotide
aaagctctgatgctgggggcccttgc

SEQ ID NO: 397088 - DNA, 25 bp, Artificial Sequence
  Description of Artificial Sequence: Synthetic oligonucleotide
aagctctgatgctgggggcccttgc

SEQ ID NO: 397089 - DNA, 24 bp, Artificial Sequence
  Description of Artificial Sequence: Synthetic oligonucleotide
agctctgatgctgggggcccttgc

SEQ ID NO: 397090 - DNA, 23 bp, Artificial Sequence
  Description of Artificial Sequence: Synthetic oligonucleotide
gctctgatgctgggggcccttgc

SEQ ID NO: 397091 - DNA, 23 bp, Artificial Sequence
  Description of Artificial Sequence: Synthetic oligonucleotide
ctctgatgctgggggcccttgcc

SEQ ID NO: 397092 - DNA, 24 bp, Artificial Sequence
  Description of Artificial Sequence: Synthetic oligonucleotide
tctgatgctgggggcccttgccct

SEQ ID NO: 397093 - DNA, 23 bp, Artificial Sequence
  Description of Artificial Sequence: Synthetic oligonucleotide
ctgatgctgggggcccttgccct

SEQ ID NO: 397094 - DNA, 24 bp, Artificial Sequence
  Description of Artificial Sequence: Synthetic oligonucleotide
tgatgctgggggcccttgccctga

SEQ ID NO: 397095 - DNA, 23 bp, Artificial Sequence
  Description of Artificial Sequence: Synthetic oligonucleotide
gatgctgggggcccttgccctga

SEQ ID NO: 397096 - DNA, 23 bp, Artificial Sequence
  Description of Artificial Sequence: Synthetic oligonucleotide
atgctgggggcccttgccctgac

SEQ ID NO: 397097 - DNA, 29 bp, Artificial Sequence
  Description of Artificial Sequence: Synthetic oligonucleotide
gaggtgaagacattgtggctgaccacgtc

SEQ ID NO: 397098 - DNA, 29 bp, Artificial Sequence
  Description of Artificial Sequence: Synthetic oligonucleotide
aggtgaagacattgtggctgaccacgtcg

SEQ ID NO: 397099 - DNA, 28 bp, Artificial Sequence
  Description of Artificial Sequence: Synthetic oligonucleotide
ggtgaagacattgtggctgaccacgtcg

SEQ ID NO: 397100 - DNA, 28 bp, Artificial Sequence
  Description of Artificial Sequence: Synthetic oligonucleotide
gtgaagacattgtggctgaccacgtcgc

SEQ ID NO: 397101 - DNA, 28 bp, Artificial Sequence
  Description of Artificial Sequence: Synthetic oligonucleotide
tgaagacattgtggctgaccacgtcgcc

SEQ ID NO: 397102 - DNA, 27 bp, Artificial Sequence
  Description of Artificial Sequence: Synthetic oligonucleotide
gaagacattgtggctgaccacgtcgcc

SEQ ID NO: 397103 - DNA, 28 bp, Artificial Sequence
  Description of Artificial Sequence: Synthetic oligonucleotide
aagacattgtggctgaccacgtcgcctc

SEQ ID NO: 397104 - DNA, 27 bp, Artificial Sequence
  Description of Artificial Sequence: Synthetic oligonucleotide
agacattgtggctgaccacgtcgcctc

SEQ ID NO: 397105 - DNA, 27 bp, Artificial Sequence
  Description of Artificial Sequence: Synthetic oligonucleotide
gacattgtggctgaccacgtcgcctct

SEQ ID NO: 397106 - DNA, 30 bp, Artificial Sequence; identical to SEQ ID NO: 57421
  Description of Artificial Sequence: Synthetic oligonucleotide

SEQ ID NO: 397107 - DNA, 29 bp, Artificial Sequence
  Description of Artificial Sequence: Synthetic oligonucleotide
cattgtggctgaccacgtcgcctcttatg

SEQ ID NO: 397108 - DNA, 29 bp, Artificial Sequence
  Description of Artificial Sequence: Synthetic oligonucleotide
attgtggctgaccacgtcgcctcttatgg

SEQ ID NO: 397109 - DNA, 28 bp, Artificial Sequence
  Description of Artificial Sequence: Synthetic oligonucleotide
ttgtggctgaccacgtcgcctcttatgg

SEQ ID NO: 397110 - DNA, 27 bp, Artificial Sequence
  Description of Artificial Sequence: Synthetic oligonucleotide
tgtggctgaccacgtcgcctcttatgg

SEQ ID NO: 397111 - DNA, 27 bp, Artificial Sequence
  Description of Artificial Sequence: Synthetic oligonucleotide
gtggctgaccacgtcgcctcttatggt

SEQ ID NO: 397112 - DNA, 27 bp, Artificial Sequence
  Description of Artificial Sequence: Synthetic oligonucleotide
tggctgaccacgtcgcctcttatggtg

SEQ ID NO: 397113 - DNA, 27 bp, Artificial Sequence
  Description of Artificial Sequence: Synthetic oligonucleotide
ggctgaccacgtcgcctcttatggtgt

SEQ ID NO: 397114 - DNA, 30 bp, Artificial Sequence; identical to SEQ ID NO: 57429
  Description of Artificial Sequence: Synthetic oligonucleotide

SEQ ID NO: 397115 - DNA, 32 bp, Artificial Sequence; identical to SEQ ID NO: 57430
  Description of Artificial Sequence: Synthetic oligonucleotide

SEQ ID NO: 397116 - DNA, 34 bp, Artificial Sequence; identical to SEQ ID NO: 57431
  Description of Artificial Sequence: Synthetic oligonucleotide

SEQ ID NO: 397117 - DNA, 33 bp, Artificial Sequence; identical to SEQ ID NO: 57432
  Description of Artificial Sequence: Synthetic oligonucleotide

SEQ ID NO: 397118 - DNA, 33 bp, Artificial Sequence; identical to SEQ ID NO: 57433
  Description of Artificial Sequence: Synthetic oligonucleotide

SEQ ID NO: 397119 - DNA, 32 bp, Artificial Sequence; identical to SEQ ID NO: 57434
  Description of Artificial Sequence: Synthetic oligonucleotide

SEQ ID NO: 397120 - DNA, 33 bp, Artificial Sequence; identical to SEQ ID NO: 57435
  Description of Artificial Sequence: Synthetic oligonucleotide

SEQ ID NO: 397121 - DNA, 34 bp, Artificial Sequence; identical to SEQ ID NO: 57436
  Description of Artificial Sequence: Synthetic oligonucleotide

SEQ ID NO: 397122 - DNA, 33 bp, Artificial Sequence; identical to SEQ ID NO: 57437
  Description of Artificial Sequence: Synthetic oligonucleotide

SEQ ID NO: 397123 - DNA, 36 bp, Artificial Sequence; identical to SEQ ID NO: 57438
  Description of Artificial Sequence: Synthetic oligonucleotide

SEQ ID NO: 397124 - DNA, 36 bp, Artificial Sequence; identical to SEQ ID NO: 57439
  Description of Artificial Sequence: Synthetic oligonucleotide

SEQ ID NO: 397125 - DNA, 35 bp, Artificial Sequence; identical to SEQ ID NO: 57440
  Description of Artificial Sequence: Synthetic oligonucleotide

SEQ ID NO: 397126 - DNA, 28 bp, Artificial Sequence
  Description of Artificial Sequence: Synthetic oligonucleotide
gagatgagcagttctacgtggacctggg

SEQ ID NO: 397127 - DNA, 28 bp, Artificial Sequence
  Description of Artificial Sequence: Synthetic oligonucleotide
agatgagcagttctacgtggacctgggg

SEQ ID NO: 397128 - DNA, 27 bp, Artificial Sequence
  Description of Artificial Sequence: Synthetic oligonucleotide
gatgagcagttctacgtggacctgggg

SEQ ID NO: 397129 - DNA, 28 bp, Artificial Sequence
  Description of Artificial Sequence: Synthetic oligonucleotide
atgagcagttctacgtggacctggggag

SEQ ID NO: 397130 - DNA, 27 bp, Artificial Sequence
  Description of Artificial Sequence: Synthetic oligonucleotide
tgagcagttctacgtggacctggggag

SEQ ID NO: 397131 - DNA, 32 bp, Artificial Sequence; identical to SEQ ID NO: 57446
  Description of Artificial Sequence: Synthetic oligonucleotide

SEQ ID NO: 397132 - DNA, 31 bp, Artificial Sequence; identical to SEQ ID NO: 57447
  Description of Artificial Sequence: Synthetic oligonucleotide

SEQ ID NO: 397133 - DNA, 31 bp, Artificial Sequence; identical to SEQ ID NO: 57448
  Description of Artificial Sequence: Synthetic oligonucleotide

SEQ ID NO: 397134 - DNA, 36 bp, Artificial Sequence; identical to SEQ ID NO: 57449
  Description of Artificial Sequence: Synthetic oligonucleotide

SEQ ID NO: 397135 - DNA, 40 bp, Artificial Sequence; identical to SEQ ID NO: 57450
  Description of Artificial Sequence: Synthetic oligonucleotide

SEQ ID NO: 397136 - DNA, 42 bp, Artificial Sequence; identical to SEQ ID NO: 57451
  Description of Artificial Sequence: Synthetic oligonucleotide

SEQ ID NO: 397137 - DNA, 44 bp, Artificial Sequence; identical to SEQ ID NO: 57452
  Description of Artificial Sequence: Synthetic oligonucleotide

SEQ ID NO: 397138 - DNA, 43 bp, Artificial Sequence; identical to SEQ ID NO: 57453
  Description of Artificial Sequence: Synthetic oligonucleotide

SEQ ID NO: 397139 - DNA, 42 bp, Artificial Sequence; identical to SEQ ID NO: 57454
  Description of Artificial Sequence: Synthetic oligonucleotide

SEQ ID NO: 397140 - DNA, 41 bp, Artificial Sequence; identical to SEQ ID NO: 57455
  Description of Artificial Sequence: Synthetic oligonucleotide

SEQ ID NO: 397141 - DNA, 40 bp, Artificial Sequence; identical to SEQ ID NO: 57456
  Description of Artificial Sequence: Synthetic oligonucleotide

SEQ ID NO: 397142 - DNA, 39 bp, Artificial Sequence; identical to SEQ ID NO: 57457
  Description of Artificial Sequence: Synthetic oligonucleotide

SEQ ID NO: 397143 - DNA, 40 bp, Artificial Sequence; identical to SEQ ID NO: 57458
  Description of Artificial Sequence: Synthetic oligonucleotide

SEQ ID NO: 397144 - DNA, 41 bp, Artificial Sequence; identical to SEQ ID NO: 57459
  Description of Artificial Sequence: Synthetic oligonucleotide

SEQ ID NO: 397145 - DNA, 40 bp, Artificial Sequence; identical to SEQ ID NO: 57460
  Description of Artificial Sequence: Synthetic oligonucleotide

SEQ ID NO: 397146 - DNA, 41 bp, Artificial Sequence; identical to SEQ ID NO: 57461
  Description of Artificial Sequence: Synthetic oligonucleotide

SEQ ID NO: 397147 - DNA, 40 bp, Artificial Sequence; identical to SEQ ID NO: 57462
  Description of Artificial Sequence: Synthetic oligonucleotide

SEQ ID NO: 397148 - DNA, 46 bp, Artificial Sequence; identical to SEQ ID NO: 57463
  Description of Artificial Sequence: Synthetic oligonucleotide

SEQ ID NO: 397149 - DNA, 45 bp, Artificial Sequence; identical to SEQ ID NO: 57464
  Description of Artificial Sequence: Synthetic oligonucleotide

SEQ ID NO: 397150 - DNA, 45 bp, Artificial Sequence; identical to SEQ ID NO: 57465
  Description of Artificial Sequence: Synthetic oligonucleotide

SEQ ID NO: 397151 - DNA, 44 bp, Artificial Sequence; identical to SEQ ID NO: 57466
  Description of Artificial Sequence: Synthetic oligonucleotide

SEQ ID NO: 397152 - DNA, 43 bp, Artificial Sequence; identical to SEQ ID NO: 57467
  Description of Artificial Sequence: Synthetic oligonucleotide

SEQ ID NO: 397153 - DNA, 42 bp, Artificial Sequence; identical to SEQ ID NO: 57468
  Description of Artificial Sequence: Synthetic oligonucleotide

SEQ ID NO: 397154 - DNA, 42 bp, Artificial Sequence; identical to SEQ ID NO: 57469
  Description of Artificial Sequence: Synthetic oligonucleotide

SEQ ID NO: 397155 - DNA, 41 bp, Artificial Sequence; identical to SEQ ID NO: 57470
  Description of Artificial Sequence: Synthetic oligonucleotide

SEQ ID NO: 397156 - DNA, 40 bp, Artificial Sequence; identical to SEQ ID NO: 57471
  Description of Artificial Sequence: Synthetic oligonucleotide

SEQ ID NO: 397157 - DNA, 41 bp, Artificial Sequence; identical to SEQ ID NO: 57472
  Description of Artificial Sequence: Synthetic oligonucleotide

SEQ ID NO: 397158 - DNA, 41 bp, Artificial Sequence; identical to SEQ ID NO: 57473
  Description of Artificial Sequence: Synthetic oligonucleotide

SEQ ID NO: 397159 - DNA, 43 bp, Artificial Sequence; identical to SEQ ID NO: 57474
  Description of Artificial Sequence: Synthetic oligonucleotide

SEQ ID NO: 397160 - DNA, 42 bp, Artificial Sequence; identical to SEQ ID NO: 57475
  Description of Artificial Sequence: Synthetic oligonucleotide

SEQ ID NO: 397161 - DNA, 43 bp, Artificial Sequence; identical to SEQ ID NO: 57476
  Description of Artificial Sequence: Synthetic oligonucleotide

SEQ ID NO: 397162 - DNA, 42 bp, Artificial Sequence; identical to SEQ ID NO: 57477
  Description of Artificial Sequence: Synthetic oligonucleotide

SEQ ID NO: 397163 - DNA, 44 bp, Artificial Sequence; identical to SEQ ID NO: 57478
  Description of Artificial Sequence: Synthetic oligonucleotide

SEQ ID NO: 397164 - DNA, 44 bp, Artificial Sequence; identical to SEQ ID NO: 57479
  Description of Artificial Sequence: Synthetic oligonucleotide

SEQ ID NO: 397165 - DNA, 43 bp, Artificial Sequence; identical to SEQ ID NO: 57480
  Description of Artificial Sequence: Synthetic oligonucleotide

SEQ ID NO: 397166 - DNA, 42 bp, Artificial Sequence; identical to SEQ ID NO: 57481
  Description of Artificial Sequence: Synthetic oligonucleotide

SEQ ID NO: 397167 - DNA, 41 bp, Artificial Sequence; identical to SEQ ID NO: 57482
  Description of Artificial Sequence: Synthetic oligonucleotide

SEQ ID NO: 397168 - DNA, 40 bp, Artificial Sequence; identical to SEQ ID NO: 57483
  Description of Artificial Sequence: Synthetic oligonucleotide

SEQ ID NO: 397169 - DNA, 39 bp, Artificial Sequence; identical to SEQ ID NO: 57484
  Description of Artificial Sequence: Synthetic oligonucleotide

SEQ ID NO: 397170 - DNA, 39 bp, Artificial Sequence; identical to SEQ ID NO: 57485
  Description of Artificial Sequence: Synthetic oligonucleotide

SEQ ID NO: 397171 - DNA, 38 bp, Artificial Sequence; identical to SEQ ID NO: 57486
  Description of Artificial Sequence: Synthetic oligonucleotide

SEQ ID NO: 397172 - DNA, 37 bp, Artificial Sequence; identical to SEQ ID NO: 57487
  Description of Artificial Sequence: Synthetic oligonucleotide

SEQ ID NO: 397173 - DNA, 36 bp, Artificial Sequence; identical to SEQ ID NO: 57488
  Description of Artificial Sequence: Synthetic oligonucleotide

SEQ ID NO: 397174 - DNA, 35 bp, Artificial Sequence; identical to SEQ ID NO: 57489
  Description of Artificial Sequence: Synthetic oligonucleotide

SEQ ID NO: 397175 - DNA, 35 bp, Artificial Sequence; identical to SEQ ID NO: 57490
  Description of Artificial Sequence: Synthetic oligonucleotide

SEQ ID NO: 397176 - DNA, 34 bp, Artificial Sequence; identical to SEQ ID NO: 57491
  Description of Artificial Sequence: Synthetic oligonucleotide

SEQ ID NO: 397177 - DNA, 33 bp, Artificial Sequence; identical to SEQ ID NO: 57492
  Description of Artificial Sequence: Synthetic oligonucleotide

SEQ ID NO: 397178 - DNA, 34 bp, Artificial Sequence; identical to SEQ ID NO: 57493
  Description of Artificial Sequence: Synthetic oligonucleotide

SEQ ID NO: 397179 - DNA, 33 bp, Artificial Sequence; identical to SEQ ID NO: 57494
  Description of Artificial Sequence: Synthetic oligonucleotide

SEQ ID NO: 397180 - DNA, 32 bp, Artificial Sequence; identical to SEQ ID NO: 57495
  Description of Artificial Sequence: Synthetic oligonucleotide

SEQ ID NO: 397181 - DNA, 32 bp, Artificial Sequence; identical to SEQ ID NO: 57496
  Description of Artificial Sequence: Synthetic oligonucleotide

SEQ ID NO: 397182 - DNA, 31 bp, Artificial Sequence; identical to SEQ ID NO: 57497
  Description of Artificial Sequence: Synthetic oligonucleotide

SEQ ID NO: 397183 - DNA, 33 bp, Artificial Sequence; identical to SEQ ID NO: 57498
  Description of Artificial Sequence: Synthetic oligonucleotide

SEQ ID NO: 397184 - DNA, 27 bp, Artificial Sequence
  Description of Artificial Sequence: Synthetic oligonucleotide
tcccgtgacactgggtcagcccaacat

SEQ ID NO: 397185 - DNA, 26 bp, Artificial Sequence
  Description of Artificial Sequence: Synthetic oligonucleotide
cccgtgacactgggtcagcccaacat

SEQ ID NO: 397186 - DNA, 26 bp, Artificial Sequence
  Description of Artificial Sequence: Synthetic oligonucleotide
ccgtgacactgggtcagcccaacatc

SEQ ID NO: 397187 - DNA, 27 bp, Artificial Sequence
  Description of Artificial Sequence: Synthetic oligonucleotide
cgtgacactgggtcagcccaacatcct

SEQ ID NO: 397188 - DNA, 27 bp, Artificial Sequence
  Description of Artificial Sequence: Synthetic oligonucleotide
gtgacactgggtcagcccaacatcctc

SEQ ID NO: 397189 - DNA, 29 bp, Artificial Sequence
  Description of Artificial Sequence: Synthetic oligonucleotide
tgacactgggtcagcccaacatcctcatc

SEQ ID NO: 397190 - DNA, 28 bp, Artificial Sequence
  Description of Artificial Sequence: Synthetic oligonucleotide
gacactgggtcagcccaacatcctcatc

SEQ ID NO: 397191 - DNA, 29 bp, Artificial Sequence
  Description of Artificial Sequence: Synthetic oligonucleotide
acactgggtcagcccaacatcctcatctg

SEQ ID NO: 397192 - DNA, 28 bp, Artificial Sequence
  Description of Artificial Sequence: Synthetic oligonucleotide
cactgggtcagcccaacatcctcatctg

SEQ ID NO: 397193 - DNA, 29 bp, Artificial Sequence
  Description of Artificial Sequence: Synthetic oligonucleotide
actgggtcagcccaacatcctcatctgtc

SEQ ID NO: 397194 - DNA, 28 bp, Artificial Sequence
  Description of Artificial Sequence: Synthetic oligonucleotide
ctgggtcagcccaacatcctcatctgtc

SEQ ID NO: 397195 - DNA, 30 bp, Artificial Sequence; identical to SEQ ID NO: 57510
  Description of Artificial Sequence: Synthetic oligonucleotide

SEQ ID NO: 397196 - DNA, 29 bp, Artificial Sequence
  Description of Artificial Sequence: Synthetic oligonucleotide
gggtcagcccaacatcctcatctgtcttg

SEQ ID NO: 397197 - DNA, 30 bp, Artificial Sequence; identical to SEQ ID NO: 57512
  Description of Artificial Sequence: Synthetic oligonucleotide

SEQ ID NO: 397198 - DNA, 30 bp, Artificial Sequence; identical to SEQ ID NO: 57513
  Description of Artificial Sequence: Synthetic oligonucleotide

SEQ ID NO: 397199 - DNA, 31 bp, Artificial Sequence; identical to SEQ ID NO: 57514
  Description of Artificial Sequence: Synthetic oligonucleotide

SEQ ID NO: 397200 - DNA, 30 bp, Artificial Sequence; identical to SEQ ID NO: 57515
  Description of Artificial Sequence: Synthetic oligonucleotide

SEQ ID NO: 397201 - DNA, 32 bp, Artificial Sequence; identical to SEQ ID NO: 57516
  Description of Artificial Sequence: Synthetic oligonucleotide

SEQ ID NO: 397202 - DNA, 31 bp, Artificial Sequence; identical to SEQ ID NO: 57517
  Description of Artificial Sequence: Synthetic oligonucleotide

SEQ ID NO: 397203 - DNA, 33 bp, Artificial Sequence; identical to SEQ ID NO: 57518
  Description of Artificial Sequence: Synthetic oligonucleotide

SEQ ID NO: 397204 - DNA, 36 bp, Artificial Sequence; identical to SEQ ID NO: 57519
  Description of Artificial Sequence: Synthetic oligonucleotide

SEQ ID NO: 397205 - DNA, 36 bp, Artificial Sequence; identical to SEQ ID NO: 57520
  Description of Artificial Sequence: Synthetic oligonucleotide

SEQ ID NO: 397206 - DNA, 37 bp, Artificial Sequence; identical to SEQ ID NO: 57521
  Description of Artificial Sequence: Synthetic oligonucleotide

SEQ ID NO: 397207 - DNA, 36 bp, Artificial Sequence; identical to SEQ ID NO: 57522
  Description of Artificial Sequence: Synthetic oligonucleotide

SEQ ID NO: 397208 - DNA, 35 bp, Artificial Sequence; identical to SEQ ID NO: 57523
  Description of Artificial Sequence: Synthetic oligonucleotide

SEQ ID NO: 397209 - DNA, 35 bp, Artificial Sequence; identical to SEQ ID NO: 57524
  Description of Artificial Sequence: Synthetic oligonucleotide

SEQ ID NO: 397210 - DNA, 34 bp, Artificial Sequence; identical to SEQ ID NO: 57525
  Description of Artificial Sequence: Synthetic oligonucleotide

SEQ ID NO: 397211 - DNA, 37 bp, Artificial Sequence; identical to SEQ ID NO: 57526
  Description of Artificial Sequence: Synthetic oligonucleotide

SEQ ID NO: 397212 - DNA, 36 bp, Artificial Sequence; identical to SEQ ID NO: 57527
  Description of Artificial Sequence: Synthetic oligonucleotide

SEQ ID NO: 397213 - DNA, 37 bp, Artificial Sequence; identical to SEQ ID NO: 57528
  Description of Artificial Sequence: Synthetic oligonucleotide

SEQ ID NO: 397214 - DNA, 36 bp, Artificial Sequence; identical to SEQ ID NO: 57529
  Description of Artificial Sequence: Synthetic oligonucleotide

SEQ ID NO: 397215 - DNA, 36 bp, Artificial Sequence; identical to SEQ ID NO: 57530
  Description of Artificial Sequence: Synthetic oligonucleotide

SEQ ID NO: 397216 - DNA, 35 bp, Artificial Sequence; identical to SEQ ID NO: 57531
  Description of Artificial Sequence: Synthetic oligonucleotide

SEQ ID NO: 397217 - DNA, 34 bp, Artificial Sequence; identical to SEQ ID NO: 57532
  Description of Artificial Sequence: Synthetic oligonucleotide

SEQ ID NO: 397218 - DNA, 35 bp, Artificial Sequence; identical to SEQ ID NO: 57533
  Description of Artificial Sequence: Synthetic oligonucleotide

SEQ ID NO: 397219 - DNA, 34 bp, Artificial Sequence; identical to SEQ ID NO: 57534
  Description of Artificial Sequence: Synthetic oligonucleotide

SEQ ID NO: 397220 - DNA, 33 bp, Artificial Sequence; identical to SEQ ID NO: 57535
  Description of Artificial Sequence: Synthetic oligonucleotide

SEQ ID NO: 397221 - DNA, 32 bp, Artificial Sequence; identical to SEQ ID NO: 57536
  Description of Artificial Sequence: Synthetic oligonucleotide

SEQ ID NO: 397222 - DNA, 32 bp, Artificial Sequence; identical to SEQ ID NO: 57537
  Description of Artificial Sequence: Synthetic oligonucleotide

SEQ ID NO: 397223 - DNA, 32 bp, Artificial Sequence; identical to SEQ ID NO: 57538
  Description of Artificial Sequence: Synthetic oligonucleotide

SEQ ID NO: 397224 - DNA, 31 bp, Artificial Sequence; identical to SEQ ID NO: 57539
  Description of Artificial Sequence: Synthetic oligonucleotide

SEQ ID NO: 397225 - DNA, 30 bp, Artificial Sequence; identical to SEQ ID NO: 57540
  Description of Artificial Sequence: Synthetic oligonucleotide

SEQ ID NO: 397226 - DNA, 32 bp, Artificial Sequence; identical to SEQ ID NO: 57541
  Description of Artificial Sequence: Synthetic oligonucleotide

SEQ ID NO: 397227 - DNA, 31 bp, Artificial Sequence; identical to SEQ ID NO: 57542
  Description of Artificial Sequence: Synthetic oligonucleotide

SEQ ID NO: 397228 - DNA, 30 bp, Artificial Sequence; identical to SEQ ID NO: 57543
  Description of Artificial Sequence: Synthetic oligonucleotide

SEQ ID NO: 397229 - DNA, 31 bp, Artificial Sequence; identical to SEQ ID NO: 57544
  Description of Artificial Sequence: Synthetic oligonucleotide

SEQ ID NO: 397230 - DNA, 30 bp, Artificial Sequence; identical to SEQ ID NO: 57545
  Description of Artificial Sequence: Synthetic oligonucleotide

SEQ ID NO: 397231 - DNA, 29 bp, Artificial Sequence
  Description of Artificial Sequence: Synthetic oligonucleotide
gatcagttacctcaccctcctcccttctg

SEQ ID NO: 397232 - DNA, 29 bp, Artificial Sequence
  Description of Artificial Sequence: Synthetic oligonucleotide
atcagttacctcaccctcctcccttctgc

SEQ ID NO: 397233 - DNA, 28 bp, Artificial Sequence
  Description of Artificial Sequence: Synthetic oligonucleotide
tcagttacctcaccctcctcccttctgc

SEQ ID NO: 397234 - DNA, 27 bp, Artificial Sequence
  Description of Artificial Sequence: Synthetic oligonucleotide
cagttacctcaccctcctcccttctgc

SEQ ID NO: 397235 - DNA, 28 bp, Artificial Sequence
  Description of Artificial Sequence: Synthetic oligonucleotide
agttacctcaccctcctcccttctgctg

SEQ ID NO: 397236 - DNA, 27 bp, Artificial Sequence
  Description of Artificial Sequence: Synthetic oligonucleotide
gttacctcaccctcctcccttctgctg

SEQ ID NO: 397237 - DNA, 28 bp, Artificial Sequence
  Description of Artificial Sequence: Synthetic oligonucleotide
ttacctcaccctcctcccttctgctgag

SEQ ID NO: 397238 - DNA, 27 bp, Artificial Sequence
  Description of Artificial Sequence: Synthetic oligonucleotide
tacctcaccctcctcccttctgctgag

SEQ ID NO: 397239 - DNA, 26 bp, Artificial Sequence
  Description of Artificial Sequence: Synthetic oligonucleotide
acctcaccctcctcccttctgctgag

SEQ ID NO: 397240 - DNA, 25 bp, Artificial Sequence
  Description of Artificial Sequence: Synthetic oligonucleotide
cctcaccctcctcccttctgctgag

SEQ ID NO: 397241 - DNA, 26 bp, Artificial Sequence
  Description of Artificial Sequence: Synthetic oligonucleotide
ctcaccctcctcccttctgctgagga

SEQ ID NO: 397242 - DNA, 27 bp, Artificial Sequence
  Description of Artificial Sequence: Synthetic oligonucleotide
tcaccctcctcccttctgctgaggaga

SEQ ID NO: 397243 - DNA, 26 bp, Artificial Sequence
  Description of Artificial Sequence: Synthetic oligonucleotide
caccctcctcccttctgctgaggaga

SEQ ID NO: 397244 - DNA, 27 bp, Artificial Sequence
  Description of Artificial Sequence: Synthetic oligonucleotide
accctcctcccttctgctgaggagagt

SEQ ID NO: 397245 - DNA, 27 bp, Artificial Sequence
  Description of Artificial Sequence: Synthetic oligonucleotide
ccctcctcccttctgctgaggagagtt

SEQ ID NO: 397246 - DNA, 29 bp, Artificial Sequence
  Description of Artificial Sequence: Synthetic oligonucleotide
cctcctcccttctgctgaggagagttatg

SEQ ID NO: 397247 - DNA, 30 bp, Artificial Sequence; identical to SEQ ID NO: 57562
  Description of Artificial Sequence: Synthetic oligonucleotide

SEQ ID NO: 397248 - DNA, 31 bp, Artificial Sequence; identical to SEQ ID NO: 57563
  Description of Artificial Sequence: Synthetic oligonucleotide

SEQ ID NO: 397249 - DNA, 30 bp, Artificial Sequence; identical to SEQ ID NO: 57564
  Description of Artificial Sequence: Synthetic oligonucleotide

SEQ ID NO: 397250 - DNA, 30 bp, Artificial Sequence; identical to SEQ ID NO: 57565
  Description of Artificial Sequence: Synthetic oligonucleotide

SEQ ID NO: 397251 - DNA, 32 bp, Artificial Sequence; identical to SEQ ID NO: 57566
  Description of Artificial Sequence: Synthetic oligonucleotide

SEQ ID NO: 397252 - DNA, 31 bp, Artificial Sequence; identical to SEQ ID NO: 57567
  Description of Artificial Sequence: Synthetic oligonucleotide

SEQ ID NO: 397253 - DNA, 31 bp, Artificial Sequence; identical to SEQ ID NO: 57568
  Description of Artificial Sequence: Synthetic oligonucleotide

SEQ ID NO: 397254 - DNA, 32 bp, Artificial Sequence; identical to SEQ ID NO: 57569
  Description of Artificial Sequence: Synthetic oligonucleotide

SEQ ID NO: 397255 - DNA, 32 bp, Artificial Sequence; identical to SEQ ID NO: 57570
  Description of Artificial Sequence: Synthetic oligonucleotide

SEQ ID NO: 397256 - DNA, 31 bp, Artificial Sequence; identical to SEQ ID NO: 57571
  Description of Artificial Sequence: Synthetic oligonucleotide

SEQ ID NO: 397257 - DNA, 30 bp, Artificial Sequence; identical to SEQ ID NO: 57572
  Description of Artificial Sequence: Synthetic oligonucleotide

SEQ ID NO: 397258 - DNA, 31 bp, Artificial Sequence; identical to SEQ ID NO: 57573
  Description of Artificial Sequence: Synthetic oligonucleotide

SEQ ID NO: 397259 - DNA, 30 bp, Artificial Sequence; identical to SEQ ID NO: 57574
  Description of Artificial Sequence: Synthetic oligonucleotide

SEQ ID NO: 397260 - DNA, 30 bp, Artificial Sequence; identical to SEQ ID NO: 57575
  Description of Artificial Sequence: Synthetic oligonucleotide

SEQ ID NO: 397261 - DNA, 31 bp, Artificial Sequence; identical to SEQ ID NO: 57576
  Description of Artificial Sequence: Synthetic oligonucleotide

SEQ ID NO: 397262 - DNA, 30 bp, Artificial Sequence; identical to SEQ ID NO: 57577
  Description of Artificial Sequence: Synthetic oligonucleotide

SEQ ID NO: 397263 - DNA, 31 bp, Artificial Sequence; identical to SEQ ID NO: 57578
  Description of Artificial Sequence: Synthetic oligonucleotide

SEQ ID NO: 397264 - DNA, 30 bp, Artificial Sequence; identical to SEQ ID NO: 57579
  Description of Artificial Sequence: Synthetic oligonucleotide

SEQ ID NO: 397265 - DNA, 30 bp, Artificial Sequence; identical to SEQ ID NO: 57580
  Description of Artificial Sequence: Synthetic oligonucleotide

SEQ ID NO: 397266 - DNA, 30 bp, Artificial Sequence; identical to SEQ ID NO: 57581
  Description of Artificial Sequence: Synthetic oligonucleotide

SEQ ID NO: 397267 - DNA, 29 bp, Artificial Sequence
  Description of Artificial Sequence: Synthetic oligonucleotide
gagttatgactgcaaggtggagcactggg

SEQ ID NO: 397268 - DNA, 29 bp, Artificial Sequence
  Description of Artificial Sequence: Synthetic oligonucleotide
agttatgactgcaaggtggagcactgggg

SEQ ID NO: 397269 - DNA, 28 bp, Artificial Sequence
  Description of Artificial Sequence: Synthetic oligonucleotide
gttatgactgcaaggtggagcactgggg

SEQ ID NO: 397270 - DNA, 26 bp, Artificial Sequence
  Description of Artificial Sequence: Synthetic oligonucleotide
aaggtggagcactggggcctggacaa

SEQ ID NO: 397271 - DNA, 25 bp, Artificial Sequence
  Description of Artificial Sequence: Synthetic oligonucleotide
aggtggagcactggggcctggacaa

SEQ ID NO: 397272 - DNA, 24 bp, Artificial Sequence
  Description of Artificial Sequence: Synthetic oligonucleotide
ggtggagcactggggcctggacaa

SEQ ID NO: 397273 - DNA, 24 bp, Artificial Sequence
  Description of Artificial Sequence: Synthetic oligonucleotide
gtggagcactggggcctggacaag

SEQ ID NO: 397274 - DNA, 24 bp, Artificial Sequence
  Description of Artificial Sequence: Synthetic oligonucleotide
tggagcactggggcctggacaagc

SEQ ID NO: 397275 - DNA, 23 bp, Artificial Sequence
  Description of Artificial Sequence: Synthetic oligonucleotide
ggagcactggggcctggacaagc

SEQ ID NO: 397276 - DNA, 24 bp, Artificial Sequence
  Description of Artificial Sequence: Synthetic oligonucleotide
gagcactggggcctggacaagcct

SEQ ID NO: 397277 - DNA, 26 bp, Artificial Sequence
  Description of Artificial Sequence: Synthetic oligonucleotide
agcactggggcctggacaagcctctt

SEQ ID NO: 397278 - DNA, 25 bp, Artificial Sequence
  Description of Artificial Sequence: Synthetic oligonucleotide
gcactggggcctggacaagcctctt

SEQ ID NO: 397279 - DNA, 26 bp, Artificial Sequence
  Description of Artificial Sequence: Synthetic oligonucleotide
cactggggcctggacaagcctcttct

SEQ ID NO: 397280 - DNA, 27 bp, Artificial Sequence
  Description of Artificial Sequence: Synthetic oligonucleotide
actggggcctggacaagcctcttctga

SEQ ID NO: 397281 - DNA, 27 bp, Artificial Sequence
  Description of Artificial Sequence: Synthetic oligonucleotide
ctggggcctggacaagcctcttctgaa

SEQ ID NO: 397282 - DNA, 28 bp, Artificial Sequence
  Description of Artificial Sequence: Synthetic oligonucleotide
tggggcctggacaagcctcttctgaaac

SEQ ID NO: 397283 - DNA, 27 bp, Artificial Sequence
  Description of Artificial Sequence: Synthetic oligonucleotide
ggggcctggacaagcctcttctgaaac

SEQ ID NO: 397284 - DNA, 28 bp, Artificial Sequence
  Description of Artificial Sequence: Synthetic oligonucleotide
gggcctggacaagcctcttctgaaacac

SEQ ID NO: 397285 - DNA, 29 bp, Artificial Sequence
  Description of Artificial Sequence: Synthetic oligonucleotide
ggcctggacaagcctcttctgaaacactg

SEQ ID NO: 397286 - DNA, 29 bp, Artificial Sequence
  Description of Artificial Sequence: Synthetic oligonucleotide
gcctggacaagcctcttctgaaacactgg

SEQ ID NO: 397287 - DNA, 29 bp, Artificial Sequence
  Description of Artificial Sequence: Synthetic oligonucleotide
cctggacaagcctcttctgaaacactggg

SEQ ID NO: 397288 - DNA, 30 bp, Artificial Sequence; identical to SEQ ID NO: 57603
  Description of Artificial Sequence: Synthetic oligonucleotide

SEQ ID NO: 397289 - DNA, 30 bp, Artificial Sequence; identical to SEQ ID NO: 57604
  Description of Artificial Sequence: Synthetic oligonucleotide

SEQ ID NO: 397290 - DNA, 29 bp, Artificial Sequence
  Description of Artificial Sequence: Synthetic oligonucleotide
ggacaagcctcttctgaaacactgggagc

SEQ ID NO: 397291 - DNA, 29 bp, Artificial Sequence
  Description of Artificial Sequence: Synthetic oligonucleotide
gacaagcctcttctgaaacactgggagcc

SEQ ID NO: 397292 - DNA, 30 bp, Artificial Sequence; identical to SEQ ID NO: 57607
  Description of Artificial Sequence: Synthetic oligonucleotide

SEQ ID NO: 397293 - DNA, 29 bp, Artificial Sequence
  Description of Artificial Sequence: Synthetic oligonucleotide
caagcctcttctgaaacactgggagcctg

SEQ ID NO: 397294 - DNA, 30 bp, Artificial Sequence; identical to SEQ ID NO: 57609
  Description of Artificial Sequence: Synthetic oligonucleotide

SEQ ID NO: 397295 - DNA, 42 bp, Artificial Sequence
  Description of Artificial Sequence: Synthetic oligonucleotide
aaaaattcctggaggttgtaactcagaaaatcctgaaggatg

SEQ ID NO: 397296 - DNA, 41 bp, Artificial Sequence
  Description of Artificial Sequence: Synthetic oligonucleotide
aaaattcctggaggttgtaactcagaaaatcctgaaggatg

SEQ ID NO: 397297 - DNA, 40 bp, Artificial Sequence
  Description of Artificial Sequence: Synthetic oligonucleotide
aaattcctggaggttgtaactcagaaaatcctgaaggatg

SEQ ID NO: 397298 - DNA, 39 bp, Artificial Sequence
  Description of Artificial Sequence: Synthetic oligonucleotide
aattcctggaggttgtaactcagaaaatcctgaaggatg

SEQ ID NO: 397299 - DNA, 38 bp, Artificial Sequence
  Description of Artificial Sequence: Synthetic oligonucleotide
attcctggaggttgtaactcagaaaatcctgaaggatg

SEQ ID NO: 397300 - DNA, 37 bp, Artificial Sequence
  Description of Artificial Sequence: Synthetic oligonucleotide
ttcctggaggttgtaactcagaaaatcctgaaggatg

SEQ ID NO: 397301 - DNA, 36 bp, Artificial Sequence
  Description of Artificial Sequence: Synthetic oligonucleotide
tcctggaggttgtaactcagaaaatcctgaaggatg

SEQ ID NO: 397302 - DNA, 35 bp, Artificial Sequence
  Description of Artificial Sequence: Synthetic oligonucleotide
cctggaggttgtaactcagaaaatcctgaaggatg

SEQ ID NO: 397303 - DNA, 35 bp, Artificial Sequence
  Description of Artificial Sequence: Synthetic oligonucleotide
ctggaggttgtaactcagaaaatcctgaaggatgc

SEQ ID NO: 397304 - DNA, 35 bp, Artificial Sequence
  Description of Artificial Sequence: Synthetic oligonucleotide
tggaggttgtaactcagaaaatcctgaaggatgcc

SEQ ID NO: 397305 - DNA, 34 bp, Artificial Sequence
  Description of Artificial Sequence: Synthetic oligonucleotide
ggaggttgtaactcagaaaatcctgaaggatgcc

SEQ ID NO: 397306 - DNA, 34 bp, Artificial Sequence
  Description of Artificial Sequence: Synthetic oligonucleotide
gaggttgtaactcagaaaatcctgaaggatgccg

SEQ ID NO: 397307 - DNA, 41 bp, Artificial Sequence
  Description of Artificial Sequence: Synthetic oligonucleotide
aggttgtaactcagaaaatcctgaaggatgccgtataattg

SEQ ID NO: 397308 - DNA, 40 bp, Artificial Sequence
  Description of Artificial Sequence: Synthetic oligonucleotide
ggttgtaactcagaaaatcctgaaggatgccgtataattg

SEQ ID NO: 397309 - DNA, 42 bp, Artificial Sequence
  Description of Artificial Sequence: Synthetic oligonucleotide
gttgtaactcagaaaatcctgaaggatgccgtataattgatg

SEQ ID NO: 397310 - DNA, 44 bp, Artificial Sequence
  Description of Artificial Sequence: Synthetic oligonucleotide
ttgtaactcagaaaatcctgaaggatgccgtataattgatgatg

SEQ ID NO: 397311 - DNA, 43 bp, Artificial Sequence
  Description of Artificial Sequence: Synthetic oligonucleotide
tgtaactcagaaaatcctgaaggatgccgtataattgatgatg

SEQ ID NO: 397312 - DNA, 42 bp, Artificial Sequence
  Description of Artificial Sequence: Synthetic oligonucleotide
gtaactcagaaaatcctgaaggatgccgtataattgatgatg

SEQ ID NO: 397313 - DNA, 43 bp, Artificial Sequence
  Description of Artificial Sequence: Synthetic oligonucleotide
taactcagaaaatcctgaaggatgccgtataattgatgatgtc

SEQ ID NO: 397314 - DNA, 42 bp, Artificial Sequence
  Description of Artificial Sequence: Synthetic oligonucleotide
aactcagaaaatcctgaaggatgccgtataattgatgatgtc

SEQ ID NO: 397315 - DNA, 41 bp, Artificial Sequence
  Description of Artificial Sequence: Synthetic oligonucleotide
actcagaaaatcctgaaggatgccgtataattgatgatgtc

SEQ ID NO: 397316 - DNA, 40 bp, Artificial Sequence
  Description of Artificial Sequence: Synthetic oligonucleotide
ctcagaaaatcctgaaggatgccgtataattgatgatgtc

SEQ ID NO: 397317 - DNA, 42 bp, Artificial Sequence
  Description of Artificial Sequence: Synthetic oligonucleotide
tcagaaaatcctgaaggatgccgtataattgatgatgtcatc

SEQ ID NO: 397318 - DNA, 41 bp, Artificial Sequence
  Description of Artificial Sequence: Synthetic oligonucleotide
cagaaaatcctgaaggatgccgtataattgatgatgtcatc

SEQ ID NO: 397319 - DNA, 44 bp, Artificial Sequence
  Description of Artificial Sequence: Synthetic oligonucleotide
agaaaatcctgaaggatgccgtataattgatgatgtcatctatc

SEQ ID NO: 397320 - DNA, 43 bp, Artificial Sequence
  Description of Artificial Sequence: Synthetic oligonucleotide
gaaaatcctgaaggatgccgtataattgatgatgtcatctatc

SEQ ID NO: 397321 - DNA, 43 bp, Artificial Sequence
  Description of Artificial Sequence: Synthetic oligonucleotide
aaaatcctgaaggatgccgtataattgatgatgtcatctatcc

SEQ ID NO: 397322 - DNA, 42 bp, Artificial Sequence
  Description of Artificial Sequence: Synthetic oligonucleotide
aaatcctgaaggatgccgtataattgatgatgtcatctatcc

SEQ ID NO: 397323 - DNA, 41 bp, Artificial Sequence
  Description of Artificial Sequence: Synthetic oligonucleotide
aatcctgaaggatgccgtataattgatgatgtcatctatcc

SEQ ID NO: 397324 - DNA, 40 bp, Artificial Sequence
  Description of Artificial Sequence: Synthetic oligonucleotide
atcctgaaggatgccgtataattgatgatgtcatctatcc

SEQ ID NO: 397325 - DNA, 39 bp, Artificial Sequence
  Description of Artificial Sequence: Synthetic oligonucleotide
tcctgaaggatgccgtataattgatgatgtcatctatcc

SEQ ID NO: 397326 - DNA, 38 bp, Artificial Sequence
  Description of Artificial Sequence: Synthetic oligonucleotide
cctgaaggatgccgtataattgatgatgtcatctatcc

SEQ ID NO: 397327 - DNA, 39 bp, Artificial Sequence
  Description of Artificial Sequence: Synthetic oligonucleotide
ctgaaggatgccgtataattgatgatgtcatctatccac

SEQ ID NO: 397328 - DNA, 39 bp, Artificial Sequence
  Description of Artificial Sequence: Synthetic oligonucleotide
tgaaggatgccgtataattgatgatgtcatctatccacg

SEQ ID NO: 397329 - DNA, 38 bp, Artificial Sequence
  Description of Artificial Sequence: Synthetic oligonucleotide
gaaggatgccgtataattgatgatgtcatctatccacg

SEQ ID NO: 397330 - DNA, 39 bp, Artificial Sequence
  Description of Artificial Sequence: Synthetic oligonucleotide
aaggatgccgtataattgatgatgtcatctatccacgag

SEQ ID NO: 397331 - DNA, 38 bp, Artificial Sequence
  Description of Artificial Sequence: Synthetic oligonucleotide
aggatgccgtataattgatgatgtcatctatccacgag

SEQ ID NO: 397332 - DNA, 37 bp, Artificial Sequence
  Description of Artificial Sequence: Synthetic oligonucleotide
ggatgccgtataattgatgatgtcatctatccacgag

SEQ ID NO: 397333 - DNA, 37 bp, Artificial Sequence
  Description of Artificial Sequence: Synthetic oligonucleotide
gatgccgtataattgatgatgtcatctatccacgagg

SEQ ID NO: 397334 - DNA, 37 bp, Artificial Sequence
  Description of Artificial Sequence: Synthetic oligonucleotide
atgccgtataattgatgatgtcatctatccacgaggc

SEQ ID NO: 397335 - DNA, 36 bp, Artificial Sequence
  Description of Artificial Sequence: Synthetic oligonucleotide
tgccgtataattgatgatgtcatctatccacgaggc

SEQ ID NO: 397336 - DNA, 35 bp, Artificial Sequence
  Description of Artificial Sequence: Synthetic oligonucleotide
gccgtataattgatgatgtcatctatccacgaggc

SEQ ID NO: 397337 - DNA, 36 bp, Artificial Sequence
  Description of Artificial Sequence: Synthetic oligonucleotide
ccgtataattgatgatgtcatctatccacgaggctg

SEQ ID NO: 397338 - DNA, 36 bp, Artificial Sequence
  Description of Artificial Sequence: Synthetic oligonucleotide
cgtataattgatgatgtcatctatccacgaggctgc

SEQ ID NO: 397339 - DNA, 37 bp, Artificial Sequence
  Description of Artificial Sequence: Synthetic oligonucleotide
gtataattgatgatgtcatctatccacgaggctgctc

SEQ ID NO: 397340 - DNA, 38 bp, Artificial Sequence
  Description of Artificial Sequence: Synthetic oligonucleotide
tataattgatgatgtcatctatccacgaggctgctcag

SEQ ID NO: 397341 - DNA, 37 bp, Artificial Sequence
  Description of Artificial Sequence: Synthetic oligonucleotide
ataattgatgatgtcatctatccacgaggctgctcag

SEQ ID NO: 397342 - DNA, 36 bp, Artificial Sequence
  Description of Artificial Sequence: Synthetic oligonucleotide
taattgatgatgtcatctatccacgaggctgctcag

SEQ ID NO: 397343 - DNA, 35 bp, Artificial Sequence
  Description of Artificial Sequence: Synthetic oligonucleotide
aattgatgatgtcatctatccacgaggctgctcag

SEQ ID NO: 397344 - DNA, 34 bp, Artificial Sequence
  Description of Artificial Sequence: Synthetic oligonucleotide
attgatgatgtcatctatccacgaggctgctcag

SEQ ID NO: 397345 - DNA, 33 bp, Artificial Sequence
  Description of Artificial Sequence: Synthetic oligonucleotide
ttgatgatgtcatctatccacgaggctgctcag

SEQ ID NO: 397346 - DNA, 32 bp, Artificial Sequence
  Description of Artificial Sequence: Synthetic oligonucleotide
tgatgatgtcatctatccacgaggctgctcag

SEQ ID NO: 397347 - DNA, 31 bp, Artificial Sequence
  Description of Artificial Sequence: Synthetic oligonucleotide
gatgatgtcatctatccacgaggctgctcag

SEQ ID NO: 397348 - DNA, 35 bp, Artificial Sequence
  Description of Artificial Sequence: Synthetic oligonucleotide
atgatgtcatctatccacgaggctgctcagaaatg

SEQ ID NO: 397349 - DNA, 34 bp, Artificial Sequence
  Description of Artificial Sequence: Synthetic oligonucleotide
tgatgtcatctatccacgaggctgctcagaaatg

SEQ ID NO: 397350 - DNA, 33 bp, Artificial Sequence
  Description of Artificial Sequence: Synthetic oligonucleotide
gatgtcatctatccacgaggctgctcagaaatg

SEQ ID NO: 397351 - DNA, 33 bp, Artificial Sequence
  Description of Artificial Sequence: Synthetic oligonucleotide
atgtcatctatccacgaggctgctcagaaatgc

SEQ ID NO: 397352 - DNA, 32 bp, Artificial Sequence
  Description of Artificial Sequence: Synthetic oligonucleotide
tgtcatctatccacgaggctgctcagaaatgc

SEQ ID NO: 397353 - DNA, 31 bp, Artificial Sequence
  Description of Artificial Sequence: Synthetic oligonucleotide
gtcatctatccacgaggctgctcagaaatgc

SEQ ID NO: 397354 - DNA, 24 bp, Artificial Sequence
  Description of Artificial Sequence: Synthetic oligonucleotide
agaaatgcccacccctggccaggg

SEQ ID NO: 397355 - DNA, 23 bp, Artificial Sequence
  Description of Artificial Sequence: Synthetic oligonucleotide
gaaatgcccacccctggccaggg

SEQ ID NO: 397356 - DNA, 23 bp, Artificial Sequence
  Description of Artificial Sequence: Synthetic oligonucleotide
aaatgcccacccctggccagggc

SEQ ID NO: 397357 - DNA, 22 bp, Artificial Sequence
  Description of Artificial Sequence: Synthetic oligonucleotide
aatgcccacccctggccagggc

SEQ ID NO: 397358 - DNA, 21 bp, Artificial Sequence
  Description of Artificial Sequence: Synthetic oligonucleotide
atgcccacccctggccagggc

SEQ ID NO: 397359 - DNA, 20 bp, Artificial Sequence
  Description of Artificial Sequence: Synthetic oligonucleotide
tgcccacccctggccagggc

SEQ ID NO: 397360 - DNA, 20 bp, Artificial Sequence
  Description of Artificial Sequence: Synthetic oligonucleotide
gcccacccctggccagggct

SEQ ID NO: 397361 - DNA, 20 bp, Artificial Sequence
  Description of Artificial Sequence: Synthetic oligonucleotide
cccacccctggccagggcgt

SEQ ID NO: 397362 - DNA, 20 bp, Artificial Sequence
  Description of Artificial Sequence: Synthetic oligonucleotide
ccacccctggccagggcggt

SEQ ID NO: 397363 - DNA, 20 bp, Artificial Sequence
  Description of Artificial Sequence: Synthetic oligonucleotide
cacccctggccagggcggtg

SEQ ID NO: 397364 - DNA, 20 bp, Artificial Sequence
  Description of Artificial Sequence: Synthetic oligonucleotide
acccctggccagggcggtgg

SEQ ID NO: 397365 - DNA, 20 bp, Artificial Sequence
  Description of Artificial Sequence: Synthetic oligonucleotide
cccctggccagggcggtggt

SEQ ID NO: 397366 - DNA, 20 bp, Artificial Sequence
  Description of Artificial Sequence: Synthetic oligonucleotide
ccctggccagggcggtggct

SEQ ID NO: 397367 - DNA, 22 bp, Artificial Sequence
  Description of Artificial Sequence: Synthetic oligonucleotide
cctggccagggcggtggctcat

SEQ ID NO: 397368 - DNA, 22 bp, Artificial Sequence
  Description of Artificial Sequence: Synthetic oligonucleotide
ctggccagggcggtggctcatg

SEQ ID NO: 397369 - DNA, 22 bp, Artificial Sequence
  Description of Artificial Sequence: Synthetic oligonucleotide
tggccagggcggtggctcatgc

SEQ ID NO: 397370 - DNA, 21 bp, Artificial Sequence
  Description of Artificial Sequence: Synthetic oligonucleotide
ggccagggcggtggctcatgc

SEQ ID NO: 397371 - DNA, 22 bp, Artificial Sequence
  Description of Artificial Sequence: Synthetic oligonucleotide
gccagggcggtggctcatgcct

SEQ ID NO: 397372 - DNA, 26 bp, Artificial Sequence
  Description of Artificial Sequence: Synthetic oligonucleotide
ccagggcggtggctcatgcctgtaat

SEQ ID NO: 397373 - DNA, 27 bp, Artificial Sequence
  Description of Artificial Sequence: Synthetic oligonucleotide
cagggcggtggctcatgcctgtaatct

SEQ ID NO: 397374 - DNA, 27 bp, Artificial Sequence
  Description of Artificial Sequence: Synthetic oligonucleotide
agggcggtggctcatgcctgtaatctg

SEQ ID NO: 397375 - DNA, 27 bp, Artificial Sequence
  Description of Artificial Sequence: Synthetic oligonucleotide
gggcggtggctcatgcctgtaatctga

SEQ ID NO: 397376 - DNA, 27 bp, Artificial Sequence
  Description of Artificial Sequence: Synthetic oligonucleotide
ggcggtggctcatgcctgtaatctgag

SEQ ID NO: 397377 - DNA, 32 bp, Artificial Sequence
  Description of Artificial Sequence: Synthetic oligonucleotide
ctgtaatctgagcactttgggaggctgagatg

SEQ ID NO: 397378 - DNA, 32 bp, Artificial Sequence
  Description of Artificial Sequence: Synthetic oligonucleotide
tgtaatctgagcactttgggaggctgagatgg

SEQ ID NO: 397379 - DNA, 31 bp, Artificial Sequence
  Description of Artificial Sequence: Synthetic oligonucleotide
gtaatctgagcactttgggaggctgagatgg

SEQ ID NO: 397380 - DNA, 31 bp, Artificial Sequence
  Description of Artificial Sequence: Synthetic oligonucleotide
taatctgagcactttgggaggctgagatggg

SEQ ID NO: 397381 - DNA, 30 bp, Artificial Sequence
  Description of Artificial Sequence: Synthetic oligonucleotide
aatctgagcactttgggaggctgagatggg

SEQ ID NO: 397382 - DNA, 29 bp, Artificial Sequence
  Description of Artificial Sequence: Synthetic oligonucleotide
atctgagcactttgggaggctgagatggg

SEQ ID NO: 397383 - DNA, 28 bp, Artificial Sequence
  Description of Artificial Sequence: Synthetic oligonucleotide
tctgagcactttgggaggctgagatggg

SEQ ID NO: 397384 - DNA, 27 bp, Artificial Sequence
  Description of Artificial Sequence: Synthetic oligonucleotide
ctgagcactttgggaggctgagatggg

SEQ ID NO: 397385 - DNA, 27 bp, Artificial Sequence
  Description of Artificial Sequence: Synthetic oligonucleotide
tgagcactttgggaggctgagatgggc

SEQ ID NO: 397386 - DNA, 27 bp, Artificial Sequence
  Description of Artificial Sequence: Synthetic oligonucleotide
gagcactttgggaggctgagatgggca

SEQ ID NO: 397387 - DNA, 27 bp, Artificial Sequence
  Description of Artificial Sequence: Synthetic oligonucleotide
agcactttgggaggctgagatgggcag

SEQ ID NO: 397388 - DNA, 27 bp, Artificial Sequence
  Description of Artificial Sequence: Synthetic oligonucleotide
gcactttgggaggctgagatgggcaga

SEQ ID NO: 397389 - DNA, 28 bp, Artificial Sequence
  Description of Artificial Sequence: Synthetic oligonucleotide
cactttgggaggctgagatgggcagatc

SEQ ID NO: 397390 - DNA, 29 bp, Artificial Sequence
  Description of Artificial Sequence: Synthetic oligonucleotide
actttgggaggctgagatgggcagatcac

SEQ ID NO: 397391 - DNA, 28 bp, Artificial Sequence
  Description of Artificial Sequence: Synthetic oligonucleotide
ctttgggaggctgagatgggcagatcac

SEQ ID NO: 397392 - DNA, 28 bp, Artificial Sequence
  Description of Artificial Sequence: Synthetic oligonucleotide
tttgggaggctgagatgggcagatcacg

SEQ ID NO: 397393 - DNA, 27 bp, Artificial Sequence
  Description of Artificial Sequence: Synthetic oligonucleotide
ttgggaggctgagatgggcagatcacg

SEQ ID NO: 397394 - DNA, 27 bp, Artificial Sequence
  Description of Artificial Sequence: Synthetic oligonucleotide
tgggaggctgagatgggcagatcacga

SEQ ID NO: 397395 - DNA, 27 bp, Artificial Sequence
  Description of Artificial Sequence: Synthetic oligonucleotide
gggaggctgagatgggcagatcacgaa

SEQ ID NO: 397396 - DNA, 29 bp, Artificial Sequence
  Description of Artificial Sequence: Synthetic oligonucleotide
ggaggctgagatgggcagatcacgaattc

SEQ ID NO: 397397 - DNA, 30 bp, Artificial Sequence
  Description of Artificial Sequence: Synthetic oligonucleotide
gaggctgagatgggcagatcacgaattcag

SEQ ID NO: 397398 - DNA, 30 bp, Artificial Sequence
  Description of Artificial Sequence: Synthetic oligonucleotide
aggctgagatgggcagatcacgaattcagg

SEQ ID NO: 397399 - DNA, 29 bp, Artificial Sequence
  Description of Artificial Sequence: Synthetic oligonucleotide
ggctgagatgggcagatcacgaattcagg

SEQ ID NO: 397400 - DNA, 30 bp, Artificial Sequence
  Description of Artificial Sequence: Synthetic oligonucleotide
gctgagatgggcagatcacgaattcaggag

SEQ ID NO: 397401 - DNA, 32 bp, Artificial Sequence
  Description of Artificial Sequence: Synthetic oligonucleotide
ctgagatgggcagatcacgaattcaggagttc

SEQ ID NO: 397402 - DNA, 32 bp, Artificial Sequence
  Description of Artificial Sequence: Synthetic oligonucleotide
tgagatgggcagatcacgaattcaggagttcg

SEQ ID NO: 397403 - DNA, 31 bp, Artificial Sequence
  Description of Artificial Sequence: Synthetic oligonucleotide
gagatgggcagatcacgaattcaggagttcg

SEQ ID NO: 397404 - DNA, 32 bp, Artificial Sequence
  Description of Artificial Sequence: Synthetic oligonucleotide
agatgggcagatcacgaattcaggagttcgag

SEQ ID NO: 397405 - DNA, 31 bp, Artificial Sequence
  Description of Artificial Sequence: Synthetic oligonucleotide
gatgggcagatcacgaattcaggagttcgag

SEQ ID NO: 397406 - DNA, 32 bp, Artificial Sequence
  Description of Artificial Sequence: Synthetic oligonucleotide
atgggcagatcacgaattcaggagttcgagac

SEQ ID NO: 397407 - DNA, 31 bp, Artificial Sequence
  Description of Artificial Sequence: Synthetic oligonucleotide
tgggcagatcacgaattcaggagttcgagac

SEQ ID NO: 397408 - DNA, 30 bp, Artificial Sequence
  Description of Artificial Sequence: Synthetic oligonucleotide
gggcagatcacgaattcaggagttcgagac

SEQ ID NO: 397409 - DNA, 30 bp, Artificial Sequence
  Description of Artificial Sequence: Synthetic oligonucleotide
ggcagatcacgaattcaggagttcgagacc

SEQ ID NO: 397410 - DNA, 31 bp, Artificial Sequence
  Description of Artificial Sequence: Synthetic oligonucleotide
gcagatcacgaattcaggagttcgagaccag

SEQ ID NO: 397411 - DNA, 31 bp, Artificial Sequence
  Description of Artificial Sequence: Synthetic oligonucleotide
cagatcacgaattcaggagttcgagaccagc

SEQ ID NO: 397412 - DNA, 31 bp, Artificial Sequence
  Description of Artificial Sequence: Synthetic oligonucleotide
agatcacgaattcaggagttcgagaccagcc

SEQ ID NO: 397413 - DNA, 30 bp, Artificial Sequence
  Description of Artificial Sequence: Synthetic oligonucleotide
gatcacgaattcaggagttcgagaccagcc

SEQ ID NO: 397414 - DNA, 31 bp, Artificial Sequence
  Description of Artificial Sequence: Synthetic oligonucleotide
atcacgaattcaggagttcgagaccagcctg

SEQ ID NO: 397415 - DNA, 30 bp, Artificial Sequence
  Description of Artificial Sequence: Synthetic oligonucleotide
tcacgaattcaggagttcgagaccagcctg

SEQ ID NO: 397416 - DNA, 29 bp, Artificial Sequence
  Description of Artificial Sequence: Synthetic oligonucleotide
cacgaattcaggagttcgagaccagcctg

SEQ ID NO: 397417 - DNA, 29 bp, Artificial Sequence
  Description of Artificial Sequence: Synthetic oligonucleotide
acgaattcaggagttcgagaccagcctgg

SEQ ID NO: 397418 - DNA, 28 bp, Artificial Sequence
  Description of Artificial Sequence: Synthetic oligonucleotide
cgaattcaggagttcgagaccagcctgg

SEQ ID NO: 397419 - DNA, 28 bp, Artificial Sequence
  Description of Artificial Sequence: Synthetic oligonucleotide
gaattcaggagttcgagaccagcctggc

SEQ ID NO: 397420 - DNA, 28 bp, Artificial Sequence
  Description of Artificial Sequence: Synthetic oligonucleotide
aattcaggagttcgagaccagcctggcc

SEQ ID NO: 397421 - DNA, 27 bp, Artificial Sequence
  Description of Artificial Sequence: Synthetic oligonucleotide
attcaggagttcgagaccagcctggcc

SEQ ID NO: 397422 - DNA, 27 bp, Artificial Sequence
  Description of Artificial Sequence: Synthetic oligonucleotide
ttcaggagttcgagaccagcctggcca

SEQ ID NO: 397423 - DNA, 27 bp, Artificial Sequence
  Description of Artificial Sequence: Synthetic oligonucleotide
tcaggagttcgagaccagcctggccaa

SEQ ID NO: 397424 - DNA, 26 bp, Artificial Sequence
  Description of Artificial Sequence: Synthetic oligonucleotide
caggagttcgagaccagcctggccaa

SEQ ID NO: 397425 - DNA, 27 bp, Artificial Sequence
  Description of Artificial Sequence: Synthetic oligonucleotide
aggagttcgagaccagcctggccaaca

SEQ ID NO: 397426 - DNA, 27 bp, Artificial Sequence
  Description of Artificial Sequence: Synthetic oligonucleotide
ggagttcgagaccagcctggccaacat

SEQ ID NO: 397427 - DNA, 28 bp, Artificial Sequence
  Description of Artificial Sequence: Synthetic oligonucleotide
gagttcgagaccagcctggccaacatag

SEQ ID NO: 397428 - DNA, 29 bp, Artificial Sequence
  Description of Artificial Sequence: Synthetic oligonucleotide
agttcgagaccagcctggccaacatagtg

SEQ ID NO: 397429 - DNA, 28 bp, Artificial Sequence
  Description of Artificial Sequence: Synthetic oligonucleotide
gttcgagaccagcctggccaacatagtg

SEQ ID NO: 397430 - DNA, 31 bp, Artificial Sequence
  Description of Artificial Sequence: Synthetic oligonucleotide
ttcgagaccagcctggccaacatagtgaaac

SEQ ID NO: 397431 - DNA, 30 bp, Artificial Sequence
  Description of Artificial Sequence: Synthetic oligonucleotide
tcgagaccagcctggccaacatagtgaaac

SEQ ID NO: 397432 - DNA, 29 bp, Artificial Sequence
  Description of Artificial Sequence: Synthetic oligonucleotide
cgagaccagcctggccaacatagtgaaac

SEQ ID NO: 397433 - DNA, 30 bp, Artificial Sequence
  Description of Artificial Sequence: Synthetic oligonucleotide
gagaccagcctggccaacatagtgaaactc

SEQ ID NO: 397434 - DNA, 31 bp, Artificial Sequence
  Description of Artificial Sequence: Synthetic oligonucleotide
agaccagcctggccaacatagtgaaactctg

SEQ ID NO: 397435 - DNA, 30 bp, Artificial Sequence
  Description of Artificial Sequence: Synthetic oligonucleotide
gaccagcctggccaacatagtgaaactctg

SEQ ID NO: 397436 - DNA, 31 bp, Artificial Sequence
  Description of Artificial Sequence: Synthetic oligonucleotide
accagcctggccaacatagtgaaactctgtc

SEQ ID NO: 397437 - DNA, 30 bp, Artificial Sequence
  Description of Artificial Sequence: Synthetic oligonucleotide
ccagcctggccaacatagtgaaactctgtc

SEQ ID NO: 397438 - DNA, 31 bp, Artificial Sequence
  Description of Artificial Sequence: Synthetic oligonucleotide
cagcctggccaacatagtgaaactctgtctc

SEQ ID NO: 397439 - DNA, 33 bp, Artificial Sequence
  Description of Artificial Sequence: Synthetic oligonucleotide
agcctggccaacatagtgaaactctgtctctac

SEQ ID NO: 397440 - DNA, 32 bp, Artificial Sequence
  Description of Artificial Sequence: Synthetic oligonucleotide
gcctggccaacatagtgaaactctgtctctac

SEQ ID NO: 397441 - DNA, 40 bp, Artificial Sequence
  Description of Artificial Sequence: Synthetic oligonucleotide
cctggccaacatagtgaaactctgtctctactaaaaatac

SEQ ID NO: 397442 - DNA, 48 bp, Artificial Sequence
  Description of Artificial Sequence: Synthetic oligonucleotide
ctggccaacatagtgaaactctgtctctactaaaaatacaaaaattag

SEQ ID NO: 397443 - DNA, 48 bp, Artificial Sequence
  Description of Artificial Sequence: Synthetic oligonucleotide
tggccaacatagtgaaactctgtctctactaaaaatacaaaaattagc

SEQ ID NO: 397444 - DNA, 47 bp, Artificial Sequence
  Description of Artificial Sequence: Synthetic oligonucleotide
ggccaacatagtgaaactctgtctctactaaaaatacaaaaattagc

SEQ ID NO: 397445 - DNA, 47 bp, Artificial Sequence
  Description of Artificial Sequence: Synthetic oligonucleotide
gccaacatagtgaaactctgtctctactaaaaatacaaaaattagcc

SEQ ID NO: 397446 - DNA, 47 bp, Artificial Sequence
  Description of Artificial Sequence: Synthetic oligonucleotide
ccaacatagtgaaactctgtctctactaaaaatacaaaaattagccg

SEQ ID NO: 397447 - DNA, 47 bp, Artificial Sequence
  Description of Artificial Sequence: Synthetic oligonucleotide
caacatagtgaaactctgtctctactaaaaatacaaaaattagccgg

SEQ ID NO: 397448 - DNA, 47 bp, Artificial Sequence
  Description of Artificial Sequence: Synthetic oligonucleotide
aacatagtgaaactctgtctctactaaaaatacaaaaattagccggg

SEQ ID NO: 397449 - DNA, 46 bp, Artificial Sequence
  Description of Artificial Sequence: Synthetic oligonucleotide
acatagtgaaactctgtctctactaaaaatacaaaaattagccggg

SEQ ID NO: 397450 - DNA, 45 bp, Artificial Sequence
  Description of Artificial Sequence: Synthetic oligonucleotide
catagtgaaactctgtctctactaaaaatacaaaaattagccggg

SEQ ID NO: 397451 - DNA, 45 bp, Artificial Sequence
  Description of Artificial Sequence: Synthetic oligonucleotide
atagtgaaactctgtctctactaaaaatacaaaaattagccgggc

SEQ ID NO: 397452 - DNA, 44 bp, Artificial Sequence
  Description of Artificial Sequence: Synthetic oligonucleotide
tagtgaaactctgtctctactaaaaatacaaaaattagccgggc

SEQ ID NO: 397453 - DNA, 43 bp, Artificial Sequence
  Description of Artificial Sequence: Synthetic oligonucleotide
agtgaaactctgtctctactaaaaatacaaaaattagccgggc

SEQ ID NO: 397454 - DNA, 42 bp, Artificial Sequence
  Description of Artificial Sequence: Synthetic oligonucleotide
gtgaaactctgtctctactaaaaatacaaaaattagccgggc

SEQ ID NO: 397455 - DNA, 42 bp, Artificial Sequence
  Description of Artificial Sequence: Synthetic oligonucleotide
tgaaactctgtctctactaaaaatacaaaaattagccgggcg

SEQ ID NO: 397456 - DNA, 41 bp, Artificial Sequence
  Description of Artificial Sequence: Synthetic oligonucleotide
gaaactctgtctctactaaaaatacaaaaattagccgggcg

SEQ ID NO: 397457 - DNA, 42 bp, Artificial Sequence
  Description of Artificial Sequence: Synthetic oligonucleotide
aaactctgtctctactaaaaatacaaaaattagccgggcgtg

SEQ ID NO: 397458 - DNA, 41 bp, Artificial Sequence
  Description of Artificial Sequence: Synthetic oligonucleotide
aactctgtctctactaaaaatacaaaaattagccgggcgtg

SEQ ID NO: 397459 - DNA, 40 bp, Artificial Sequence
  Description of Artificial Sequence: Synthetic oligonucleotide
actctgtctctactaaaaatacaaaaattagccgggcgtg

SEQ ID NO: 397460 - DNA, 39 bp, Artificial Sequence
  Description of Artificial Sequence: Synthetic oligonucleotide
ctctgtctctactaaaaatacaaaaattagccgggcgtg

SEQ ID NO: 397461 - DNA, 39 bp, Artificial Sequence
  Description of Artificial Sequence: Synthetic oligonucleotide
tctgtctctactaaaaatacaaaaattagccgggcgtgg

SEQ ID NO: 397462 - DNA, 38 bp, Artificial Sequence
  Description of Artificial Sequence: Synthetic oligonucleotide
ctgtctctactaaaaatacaaaaattagccgggcgtgg

SEQ ID NO: 397463 - DNA, 39 bp, Artificial Sequence
  Description of Artificial Sequence: Synthetic oligonucleotide
tgtctctactaaaaatacaaaaattagccgggcgtggtg

SEQ ID NO: 397464 - DNA, 38 bp, Artificial Sequence
  Description of Artificial Sequence: Synthetic oligonucleotide
gtctctactaaaaatacaaaaattagccgggcgtggtg

SEQ ID NO: 397465 - DNA, 38 bp, Artificial Sequence
  Description of Artificial Sequence: Synthetic oligonucleotide
tctctactaaaaatacaaaaattagccgggcgtggtgg

SEQ ID NO: 397466 - DNA, 37 bp, Artificial Sequence
  Description of Artificial Sequence: Synthetic oligonucleotide
ctctactaaaaatacaaaaattagccgggcgtggtgg

SEQ ID NO: 397467 - DNA, 37 bp, Artificial Sequence
  Description of Artificial Sequence: Synthetic oligonucleotide
tctactaaaaatacaaaaattagccgggcgtggtggc

SEQ ID NO: 397468 - DNA, 36 bp, Artificial Sequence
  Description of Artificial Sequence: Synthetic oligonucleotide
ctactaaaaatacaaaaattagccgggcgtggtggc

SEQ ID NO: 397469 - DNA, 37 bp, Artificial Sequence
  Description of Artificial Sequence: Synthetic oligonucleotide
tactaaaaatacaaaaattagccgggcgtggtggcag

SEQ ID NO: 397470 - DNA, 36 bp, Artificial Sequence
  Description of Artificial Sequence: Synthetic oligonucleotide
actaaaaatacaaaaattagccgggcgtggtggcag

SEQ ID NO: 397471 - DNA, 35 bp, Artificial Sequence
  Description of Artificial Sequence: Synthetic oligonucleotide
ctaaaaatacaaaaattagccgggcgtggtggcag

SEQ ID NO: 397472 - DNA, 35 bp, Artificial Sequence
  Description of Artificial Sequence: Synthetic oligonucleotide
taaaaatacaaaaattagccgggcgtggtggcagg

SEQ ID NO: 397473 - DNA, 34 bp, Artificial Sequence
  Description of Artificial Sequence: Synthetic oligonucleotide
aaaaatacaaaaattagccgggcgtggtggcagg

SEQ ID NO: 397474 - DNA, 33 bp, Artificial Sequence
  Description of Artificial Sequence: Synthetic oligonucleotide
aaaatacaaaaattagccgggcgtggtggcagg

SEQ ID NO: 397475 - DNA, 32 bp, Artificial Sequence
  Description of Artificial Sequence: Synthetic oligonucleotide
aaatacaaaaattagccgggcgtggtggcagg

SEQ ID NO: 397476 - DNA, 31 bp, Artificial Sequence
  Description of Artificial Sequence: Synthetic oligonucleotide
aatacaaaaattagccgggcgtggtggcagg

SEQ ID NO: 397477 - DNA, 30 bp, Artificial Sequence
  Description of Artificial Sequence: Synthetic oligonucleotide
atacaaaaattagccgggcgtggtggcagg

SEQ ID NO: 397478 - DNA, 29 bp, Artificial Sequence
  Description of Artificial Sequence: Synthetic oligonucleotide
tacaaaaattagccgggcgtggtggcagg

SEQ ID NO: 397479 - DNA, 28 bp, Artificial Sequence
  Description of Artificial Sequence: Synthetic oligonucleotide
acaaaaattagccgggcgtggtggcagg

SEQ ID NO: 397480 - DNA, 27 bp, Artificial Sequence
  Description of Artificial Sequence: Synthetic oligonucleotide
caaaaattagccgggcgtggtggcagg

SEQ ID NO: 397481 - DNA, 28 bp, Artificial Sequence
  Description of Artificial Sequence: Synthetic oligonucleotide
aaaaattagccgggcgtggtggcaggtg

SEQ ID NO: 397482 - DNA, 27 bp, Artificial Sequence
  Description of Artificial Sequence: Synthetic oligonucleotide
aaaattagccgggcgtggtggcaggtg

SEQ ID NO: 397483 - DNA, 26 bp, Artificial Sequence
  Description of Artificial Sequence: Synthetic oligonucleotide
aaattagccgggcgtggtggcaggtg

SEQ ID NO: 397484 - DNA, 25 bp, Artificial Sequence
  Description of Artificial Sequence: Synthetic oligonucleotide
aattagccgggcgtggtggcaggtg

SEQ ID NO: 397485 - DNA, 24 bp, Artificial Sequence
  Description of Artificial Sequence: Synthetic oligonucleotide
attagccgggcgtggtggcaggtg

SEQ ID NO: 397486 - DNA, 23 bp, Artificial Sequence
  Description of Artificial Sequence: Synthetic oligonucleotide
ttagccgggcgtggtggcaggtg

SEQ ID NO: 397487 - DNA, 22 bp, Artificial Sequence
  Description of Artificial Sequence: Synthetic oligonucleotide
tagccgggcgtggtggcaggtg

SEQ ID NO: 397488 - DNA, 21 bp, Artificial Sequence
  Description of Artificial Sequence: Synthetic oligonucleotide
agccgggcgtggtggcaggtg

SEQ ID NO: 397489 - DNA, 20 bp, Artificial Sequence
  Description of Artificial Sequence: Synthetic oligonucleotide
gccgggcgtggtggcaggtg

SEQ ID NO: 397490 - DNA, 20 bp, Artificial Sequence
  Description of Artificial Sequence: Synthetic oligonucleotide
ccgggcgtggtggcaggtgc

SEQ ID NO: 397491 - DNA, 21 bp, Artificial Sequence
  Description of Artificial Sequence: Synthetic oligonucleotide
cgggcgtggtggcaggtgcct

SEQ ID NO: 397492 - DNA, 25 bp, Artificial Sequence
  Description of Artificial Sequence: Synthetic oligonucleotide
gggcgtggtggcaggtgcctgtaat

SEQ ID NO: 397493 - DNA, 25 bp, Artificial Sequence
  Description of Artificial Sequence: Synthetic oligonucleotide
ggcgtggtggcaggtgcctgtaatc

SEQ ID NO: 397494 - DNA, 25 bp, Artificial Sequence
  Description of Artificial Sequence: Synthetic oligonucleotide
gcgtggtggcaggtgcctgtaatcc

SEQ ID NO: 397495 - DNA, 26 bp, Artificial Sequence
  Description of Artificial Sequence: Synthetic oligonucleotide
cgtggtggcaggtgcctgtaatccca

SEQ ID NO: 397496 - DNA, 26 bp, Artificial Sequence
  Description of Artificial Sequence: Synthetic oligonucleotide
gtggtggcaggtgcctgtaatcccag

SEQ ID NO: 397497 - DNA, 27 bp, Artificial Sequence
  Description of Artificial Sequence: Synthetic oligonucleotide
tggtggcaggtgcctgtaatcccagct

SEQ ID NO: 397498 - DNA, 27 bp, Artificial Sequence
  Description of Artificial Sequence: Synthetic oligonucleotide
ggtggcaggtgcctgtaatcccagcta

SEQ ID NO: 397499 - DNA, 27 bp, Artificial Sequence
  Description of Artificial Sequence: Synthetic oligonucleotide
gtggcaggtgcctgtaatcccagctac

SEQ ID NO: 397500 - DNA, 29 bp, Artificial Sequence
  Description of Artificial Sequence: Synthetic oligonucleotide
tggcaggtgcctgtaatcccagctacttg

SEQ ID NO: 397501 - DNA, 28 bp, Artificial Sequence
  Description of Artificial Sequence: Synthetic oligonucleotide
ggcaggtgcctgtaatcccagctacttg

SEQ ID NO: 397502 - DNA, 28 bp, Artificial Sequence
  Description of Artificial Sequence: Synthetic oligonucleotide
gcaggtgcctgtaatcccagctacttgg

SEQ ID NO: 397503 - DNA, 28 bp, Artificial Sequence
  Description of Artificial Sequence: Synthetic oligonucleotide
caggtgcctgtaatcccagctacttggg

SEQ ID NO: 397504 - DNA, 29 bp, Artificial Sequence
  Description of Artificial Sequence: Synthetic oligonucleotide
aggtgcctgtaatcccagctacttgggag

SEQ ID NO: 397505 - DNA, 28 bp, Artificial Sequence
  Description of Artificial Sequence: Synthetic oligonucleotide
ggtgcctgtaatcccagctacttgggag

SEQ ID NO: 397506 - DNA, 28 bp, Artificial Sequence
  Description of Artificial Sequence: Synthetic oligonucleotide
gtgcctgtaatcccagctacttgggagg

SEQ ID NO: 397507 - DNA, 28 bp, Artificial Sequence
  Description of Artificial Sequence: Synthetic oligonucleotide
tgcctgtaatcccagctacttgggaggg

SEQ ID NO: 397508 - DNA, 27 bp, Artificial Sequence
  Description of Artificial Sequence: Synthetic oligonucleotide
gcctgtaatcccagctacttgggaggg

SEQ ID NO: 397509 - DNA, 28 bp, Artificial Sequence
  Description of Artificial Sequence: Synthetic oligonucleotide
cctgtaatcccagctacttgggagggtg

SEQ ID NO: 397510 - DNA, 29 bp, Artificial Sequence
  Description of Artificial Sequence: Synthetic oligonucleotide
ctgtaatcccagctacttgggagggtgag

SEQ ID NO: 397511 - DNA, 30 bp, Artificial Sequence
  Description of Artificial Sequence: Synthetic oligonucleotide
tgtaatcccagctacttgggagggtgagac

SEQ ID NO: 397512 - DNA, 29 bp, Artificial Sequence
  Description of Artificial Sequence: Synthetic oligonucleotide
gtaatcccagctacttgggagggtgagac

SEQ ID NO: 397513 - DNA, 30 bp, Artificial Sequence
  Description of Artificial Sequence: Synthetic oligonucleotide
taatcccagctacttgggagggtgagacag

SEQ ID NO: 397514 - DNA, 29 bp, Artificial Sequence
  Description of Artificial Sequence: Synthetic oligonucleotide
aatcccagctacttgggagggtgagacag

SEQ ID NO: 397515 - DNA, 28 bp, Artificial Sequence
  Description of Artificial Sequence: Synthetic oligonucleotide
atcccagctacttgggagggtgagacag

SEQ ID NO: 397516 - DNA, 27 bp, Artificial Sequence
  Description of Artificial Sequence: Synthetic oligonucleotide
tcccagctacttgggagggtgagacag

SEQ ID NO: 397517 - DNA, 26 bp, Artificial Sequence
  Description of Artificial Sequence: Synthetic oligonucleotide
cccagctacttgggagggtgagacag

SEQ ID NO: 397518 - DNA, 27 bp, Artificial Sequence
  Description of Artificial Sequence: Synthetic oligonucleotide
ccagctacttgggagggtgagacagga

SEQ ID NO: 397519 - DNA, 27 bp, Artificial Sequence
  Description of Artificial Sequence: Synthetic oligonucleotide
cagctacttgggagggtgagacaggag

SEQ ID NO: 397520 - DNA, 30 bp, Artificial Sequence
  Description of Artificial Sequence: Synthetic oligonucleotide
agctacttgggagggtgagacaggagaatc

SEQ ID NO: 397521 - DNA, 29 bp, Artificial Sequence
  Description of Artificial Sequence: Synthetic oligonucleotide
gctacttgggagggtgagacaggagaatc

SEQ ID NO: 397522 - DNA, 30 bp, Artificial Sequence
  Description of Artificial Sequence: Synthetic oligonucleotide
ctacttgggagggtgagacaggagaatcac

SEQ ID NO: 397523 - DNA, 32 bp, Artificial Sequence
  Description of Artificial Sequence: Synthetic oligonucleotide
tacttgggagggtgagacaggagaatcacttg

SEQ ID NO: 397524 - DNA, 31 bp, Artificial Sequence
  Description of Artificial Sequence: Synthetic oligonucleotide
acttgggagggtgagacaggagaatcacttg

SEQ ID NO: 397525 - DNA, 30 bp, Artificial Sequence
  Description of Artificial Sequence: Synthetic oligonucleotide
cttgggagggtgagacaggagaatcacttg

SEQ ID NO: 397526 - DNA, 32 bp, Artificial Sequence
  Description of Artificial Sequence: Synthetic oligonucleotide
ttgggagggtgagacaggagaatcacttgaac

SEQ ID NO: 397527 - DNA, 31 bp, Artificial Sequence
  Description of Artificial Sequence: Synthetic oligonucleotide
tgggagggtgagacaggagaatcacttgaac

SEQ ID NO: 397528 - DNA, 30 bp, Artificial Sequence
  Description of Artificial Sequence: Synthetic oligonucleotide
gggagggtgagacaggagaatcacttgaac

SEQ ID NO: 397529 - DNA, 30 bp, Artificial Sequence
  Description of Artificial Sequence: Synthetic oligonucleotide
ggagggtgagacaggagaatcacttgaacc

SEQ ID NO: 397530 - DNA, 30 bp, Artificial Sequence
  Description of Artificial Sequence: Synthetic oligonucleotide
gagggtgagacaggagaatcacttgaaccc

SEQ ID NO: 397531 - DNA, 30 bp, Artificial Sequence
  Description of Artificial Sequence: Synthetic oligonucleotide
agggtgagacaggagaatcacttgaacccg

SEQ ID NO: 397532 - DNA, 29 bp, Artificial Sequence
  Description of Artificial Sequence: Synthetic oligonucleotide
gggtgagacaggagaatcacttgaacccg

SEQ ID NO: 397533 - DNA, 29 bp, Artificial Sequence
  Description of Artificial Sequence: Synthetic oligonucleotide
ggtgagacaggagaatcacttgaacccgg

SEQ ID NO: 397534 - DNA, 29 bp, Artificial Sequence
  Description of Artificial Sequence: Synthetic oligonucleotide
gtgagacaggagaatcacttgaacccggg

SEQ ID NO: 397535 - DNA, 30 bp, Artificial Sequence
  Description of Artificial Sequence: Synthetic oligonucleotide
tgagacaggagaatcacttgaacccgggag

SEQ ID NO: 397536 - DNA, 29 bp, Artificial Sequence
  Description of Artificial Sequence: Synthetic oligonucleotide
gagacaggagaatcacttgaacccgggag

SEQ ID NO: 397537 - DNA, 30 bp, Artificial Sequence
  Description of Artificial Sequence: Synthetic oligonucleotide
agacaggagaatcacttgaacccgggagtc

SEQ ID NO: 397538 - DNA, 29 bp, Artificial Sequence
  Description of Artificial Sequence: Synthetic oligonucleotide
gacaggagaatcacttgaacccgggagtc

SEQ ID NO: 397539 - DNA, 32 bp, Artificial Sequence
  Description of Artificial Sequence: Synthetic oligonucleotide
acaggagaatcacttgaacccgggagtcaaag

SEQ ID NO: 397540 - DNA, 31 bp, Artificial Sequence
  Description of Artificial Sequence: Synthetic oligonucleotide
caggagaatcacttgaacccgggagtcaaag

SEQ ID NO: 397541 - DNA, 34 bp, Artificial Sequence
  Description of Artificial Sequence: Synthetic oligonucleotide
aggagaatcacttgaacccgggagtcaaagtttg

SEQ ID NO: 397542 - DNA, 33 bp, Artificial Sequence
  Description of Artificial Sequence: Synthetic oligonucleotide
ggagaatcacttgaacccgggagtcaaagtttg

SEQ ID NO: 397543 - DNA, 33 bp, Artificial Sequence
  Description of Artificial Sequence: Synthetic oligonucleotide
gagaatcacttgaacccgggagtcaaagtttgc

SEQ ID NO: 397544 - DNA, 34 bp, Artificial Sequence
  Description of Artificial Sequence: Synthetic oligonucleotide
agaatcacttgaacccgggagtcaaagtttgcag

SEQ ID NO: 397545 - DNA, 33 bp, Artificial Sequence
  Description of Artificial Sequence: Synthetic oligonucleotide
gaatcacttgaacccgggagtcaaagtttgcag

SEQ ID NO: 397546 - DNA, 34 bp, Artificial Sequence
  Description of Artificial Sequence: Synthetic oligonucleotide
aatcacttgaacccgggagtcaaagtttgcagtg

SEQ ID NO: 397547 - DNA, 33 bp, Artificial Sequence
  Description of Artificial Sequence: Synthetic oligonucleotide
atcacttgaacccgggagtcaaagtttgcagtg

SEQ ID NO: 397548 - DNA, 32 bp, Artificial Sequence
  Description of Artificial Sequence: Synthetic oligonucleotide
tcacttgaacccgggagtcaaagtttgcagtg

SEQ ID NO: 397549 - DNA, 31 bp, Artificial Sequence
  Description of Artificial Sequence: Synthetic oligonucleotide
cacttgaacccgggagtcaaagtttgcagtg

SEQ ID NO: 397550 - DNA, 32 bp, Artificial Sequence
  Description of Artificial Sequence: Synthetic oligonucleotide
acttgaacccgggagtcaaagtttgcagtgag

SEQ ID NO: 397551 - DNA, 31 bp, Artificial Sequence
  Description of Artificial Sequence: Synthetic oligonucleotide
cttgaacccgggagtcaaagtttgcagtgag

SEQ ID NO: 397552 - DNA, 31 bp, Artificial Sequence
  Description of Artificial Sequence: Synthetic oligonucleotide
ttgaacccgggagtcaaagtttgcagtgagc

SEQ ID NO: 397553 - DNA, 30 bp, Artificial Sequence
  Description of Artificial Sequence: Synthetic oligonucleotide
tgaacccgggagtcaaagtttgcagtgagc

SEQ ID NO: 397554 - DNA, 29 bp, Artificial Sequence
  Description of Artificial Sequence: Synthetic oligonucleotide
gaacccgggagtcaaagtttgcagtgagc

SEQ ID NO: 397555 - DNA, 29 bp, Artificial Sequence
  Description of Artificial Sequence: Synthetic oligonucleotide
aacccgggagtcaaagtttgcagtgagcc

SEQ ID NO: 397556 - DNA, 28 bp, Artificial Sequence
  Description of Artificial Sequence: Synthetic oligonucleotide
acccgggagtcaaagtttgcagtgagcc

SEQ ID NO: 397557 - DNA, 27 bp, Artificial Sequence
  Description of Artificial Sequence: Synthetic oligonucleotide
cccgggagtcaaagtttgcagtgagcc

SEQ ID NO: 397558 - DNA, 27 bp, Artificial Sequence
  Description of Artificial Sequence: Synthetic oligonucleotide
ccgggagtcaaagtttgcagtgagccg

SEQ ID NO: 397559 - DNA, 28 bp, Artificial Sequence
  Description of Artificial Sequence: Synthetic oligonucleotide
cgggagtcaaagtttgcagtgagccgag

SEQ ID NO: 397560 - DNA, 29 bp, Artificial Sequence
  Description of Artificial Sequence: Synthetic oligonucleotide
gggagtcaaagtttgcagtgagccgagac

SEQ ID NO: 397561 - DNA, 29 bp, Artificial Sequence
  Description of Artificial Sequence: Synthetic oligonucleotide
ggagtcaaagtttgcagtgagccgagacc

SEQ ID NO: 397562 - DNA, 31 bp, Artificial Sequence
  Description of Artificial Sequence: Synthetic oligonucleotide
gagtcaaagtttgcagtgagccgagaccatg

SEQ ID NO: 397563 - DNA, 31 bp, Artificial Sequence
  Description of Artificial Sequence: Synthetic oligonucleotide
agtcaaagtttgcagtgagccgagaccatgc

SEQ ID NO: 397564 - DNA, 30 bp, Artificial Sequence
  Description of Artificial Sequence: Synthetic oligonucleotide
gtcaaagtttgcagtgagccgagaccatgc

SEQ ID NO: 397565 - DNA, 30 bp, Artificial Sequence
  Description of Artificial Sequence: Synthetic oligonucleotide
tcaaagtttgcagtgagccgagaccatgcc

SEQ ID NO: 397566 - DNA, 29 bp, Artificial Sequence
  Description of Artificial Sequence: Synthetic oligonucleotide
caaagtttgcagtgagccgagaccatgcc

SEQ ID NO: 397567 - DNA, 32 bp, Artificial Sequence
  Description of Artificial Sequence: Synthetic oligonucleotide
aaagtttgcagtgagccgagaccatgccattg

SEQ ID NO: 397568 - DNA, 31 bp, Artificial Sequence
  Description of Artificial Sequence: Synthetic oligonucleotide
aagtttgcagtgagccgagaccatgccattg

SEQ ID NO: 397569 - DNA, 30 bp, Artificial Sequence
  Description of Artificial Sequence: Synthetic oligonucleotide
agtttgcagtgagccgagaccatgccattg

SEQ ID NO: 397570 - DNA, 29 bp, Artificial Sequence
  Description of Artificial Sequence: Synthetic oligonucleotide
gtttgcagtgagccgagaccatgccattg

SEQ ID NO: 397571 - DNA, 29 bp, Artificial Sequence
  Description of Artificial Sequence: Synthetic oligonucleotide
tttgcagtgagccgagaccatgccattgc

SEQ ID NO: 397572 - DNA, 28 bp, Artificial Sequence
  Description of Artificial Sequence: Synthetic oligonucleotide
ttgcagtgagccgagaccatgccattgc

SEQ ID NO: 397573 - DNA, 27 bp, Artificial Sequence
  Description of Artificial Sequence: Synthetic oligonucleotide
tgcagtgagccgagaccatgccattgc

SEQ ID NO: 397574 - DNA, 27 bp, Artificial Sequence
  Description of Artificial Sequence: Synthetic oligonucleotide
gcagtgagccgagaccatgccattgca

SEQ ID NO: 397575 - DNA, 27 bp, Artificial Sequence
  Description of Artificial Sequence: Synthetic oligonucleotide
cagtgagccgagaccatgccattgcac

SEQ ID NO: 397576 - DNA, 27 bp, Artificial Sequence
  Description of Artificial Sequence: Synthetic oligonucleotide
agtgagccgagaccatgccattgcacc

SEQ ID NO: 397577 - DNA, 27 bp, Artificial Sequence
  Description of Artificial Sequence: Synthetic oligonucleotide
gtgagccgagaccatgccattgcacct

SEQ ID NO: 397578 - DNA, 27 bp, Artificial Sequence
  Description of Artificial Sequence: Synthetic oligonucleotide
tgagccgagaccatgccattgcacctc

SEQ ID NO: 397579 - DNA, 27 bp, Artificial Sequence
  Description of Artificial Sequence: Synthetic oligonucleotide
gagccgagaccatgccattgcacctca

SEQ ID NO: 397580 - DNA, 27 bp, Artificial Sequence
  Description of Artificial Sequence: Synthetic oligonucleotide
agccgagaccatgccattgcacctcag

SEQ ID NO: 397581 - DNA, 26 bp, Artificial Sequence
  Description of Artificial Sequence: Synthetic oligonucleotide
gccgagaccatgccattgcacctcag

SEQ ID NO: 397582 - DNA, 26 bp, Artificial Sequence
  Description of Artificial Sequence: Synthetic oligonucleotide
ccgagaccatgccattgcacctcagc

SEQ ID NO: 397583 - DNA, 27 bp, Artificial Sequence
  Description of Artificial Sequence: Synthetic oligonucleotide
cgagaccatgccattgcacctcagcct

SEQ ID NO: 397584 - DNA, 27 bp, Artificial Sequence
  Description of Artificial Sequence: Synthetic oligonucleotide
gagaccatgccattgcacctcagcctg

SEQ ID NO: 397585 - DNA, 27 bp, Artificial Sequence
  Description of Artificial Sequence: Synthetic oligonucleotide
agaccatgccattgcacctcagcctgg

SEQ ID NO: 397586 - DNA, 26 bp, Artificial Sequence
  Description of Artificial Sequence: Synthetic oligonucleotide
gaccatgccattgcacctcagcctgg

SEQ ID NO: 397587 - DNA, 27 bp, Artificial Sequence
  Description of Artificial Sequence: Synthetic oligonucleotide
accatgccattgcacctcagcctgggt

SEQ ID NO: 397588 - DNA, 26 bp, Artificial Sequence
  Description of Artificial Sequence: Synthetic oligonucleotide
ccatgccattgcacctcagcctgggt

SEQ ID NO: 397589 - DNA, 27 bp, Artificial Sequence
  Description of Artificial Sequence: Synthetic oligonucleotide
catgccattgcacctcagcctgggtga

SEQ ID NO: 397590 - DNA, 27 bp, Artificial Sequence
  Description of Artificial Sequence: Synthetic oligonucleotide
atgccattgcacctcagcctgggtgac

SEQ ID NO: 397591 - DNA, 27 bp, Artificial Sequence
  Description of Artificial Sequence: Synthetic oligonucleotide
tgccattgcacctcagcctgggtgaca

SEQ ID NO: 397592 - DNA, 26 bp, Artificial Sequence
  Description of Artificial Sequence: Synthetic oligonucleotide
gccattgcacctcagcctgggtgaca

SEQ ID NO: 397593 - DNA, 27 bp, Artificial Sequence
  Description of Artificial Sequence: Synthetic oligonucleotide
ccattgcacctcagcctgggtgacaga

SEQ ID NO: 397594 - DNA, 27 bp, Artificial Sequence
  Description of Artificial Sequence: Synthetic oligonucleotide
cattgcacctcagcctgggtgacagag

SEQ ID NO: 397595 - DNA, 28 bp, Artificial Sequence
  Description of Artificial Sequence: Synthetic oligonucleotide
attgcacctcagcctgggtgacagagtg

SEQ ID NO: 397596 - DNA, 27 bp, Artificial Sequence
  Description of Artificial Sequence: Synthetic oligonucleotide
ttgcacctcagcctgggtgacagagtg

SEQ ID NO: 397597 - DNA, 27 bp, Artificial Sequence
  Description of Artificial Sequence: Synthetic oligonucleotide
tgcacctcagcctgggtgacagagtga

SEQ ID NO: 397598 - DNA, 26 bp, Artificial Sequence
  Description of Artificial Sequence: Synthetic oligonucleotide
gcacctcagcctgggtgacagagtga

SEQ ID NO: 397599 - DNA, 27 bp, Artificial Sequence
  Description of Artificial Sequence: Synthetic oligonucleotide
cacctcagcctgggtgacagagtgaga

SEQ ID NO: 397600 - DNA, 30 bp, Artificial Sequence
  Description of Artificial Sequence: Synthetic oligonucleotide
tcagcctgggtgacagagtgagactacatc

SEQ ID NO: 397601 - DNA, 29 bp, Artificial Sequence
  Description of Artificial Sequence: Synthetic oligonucleotide
cagcctgggtgacagagtgagactacatc

SEQ ID NO: 397602 - DNA, 30 bp, Artificial Sequence
  Description of Artificial Sequence: Synthetic oligonucleotide
agcctgggtgacagagtgagactacatctc

SEQ ID NO: 397603 - DNA, 29 bp, Artificial Sequence
  Description of Artificial Sequence: Synthetic oligonucleotide
gcctgggtgacagagtgagactacatctc

SEQ ID NO: 397604 - DNA, 44 bp, Artificial Sequence
  Description of Artificial Sequence: Synthetic oligonucleotide
cctgggtgacagagtgagactacatctcaaaaaaaaaaaaaaag

SEQ ID NO: 397605 - DNA, 47 bp, Artificial Sequence
  Description of Artificial Sequence: Synthetic oligonucleotide
ctgggtgacagagtgagactacatctcaaaaaaaaaaaaaaagaaag

SEQ ID NO: 397606 - DNA, 50 bp, Artificial Sequence
  Description of Artificial Sequence: Synthetic oligonucleotide
tgggtgacagagtgagactacatctcaaaaaaaaaaaaaaagaaagaaag

SEQ ID NO: 397607 - DNA, 49 bp, Artificial Sequence
  Description of Artificial Sequence: Synthetic oligonucleotide
gggtgacagagtgagactacatctcaaaaaaaaaaaaaaagaaagaaag

SEQ ID NO: 397608 - DNA, 56 bp, Artificial Sequence
  Description of Artificial Sequence: Synthetic oligonucleotide
ggtgacagagtgagactacatctcaaaaaaaaaaaaaaagaaagaaagaaaaaaag

SEQ ID NO: 397609 - DNA, 60 bp, Artificial Sequence
  Description of Artificial Sequence: Synthetic oligonucleotide
gtgacagagtgagactacatctcaaaaaaaaaaaaaaagaaagaaagaaaaaaagaaaag

SEQ ID NO: 397610 - DNA, 60 bp, Artificial Sequence
  Description of Artificial Sequence: Synthetic oligonucleotide
tgacagagtgagactacatctcaaaaaaaaaaaaaaagaaagaaagaaaaaaagaaaaga

SEQ ID NO: 397611 - DNA, 60 bp, Artificial Sequence
  Description of Artificial Sequence: Synthetic oligonucleotide
gacagagtgagactacatctcaaaaaaaaaaaaaaagaaagaaagaaaaaaagaaaagaa

SEQ ID NO: 397612 - DNA, 60 bp, Artificial Sequence
  Description of Artificial Sequence: Synthetic oligonucleotide
acagagtgagactacatctcaaaaaaaaaaaaaaagaaagaaagaaaaaaagaaaagaaa

SEQ ID NO: 397613 - DNA, 60 bp, Artificial Sequence
  Description of Artificial Sequence: Synthetic oligonucleotide
cagagtgagactacatctcaaaaaaaaaaaaaaagaaagaaagaaaaaaagaaaagaaat

SEQ ID NO: 397614 - DNA, 60 bp, Artificial Sequence
  Description of Artificial Sequence: Synthetic oligonucleotide
agagtgagactacatctcaaaaaaaaaaaaaaagaaagaaagaaaaaaagaaaagaaatg

SEQ ID NO: 397615 - DNA, 60 bp, Artificial Sequence
  Description of Artificial Sequence: Synthetic oligonucleotide
gagtgagactacatctcaaaaaaaaaaaaaaagaaagaaagaaaaaaagaaaagaaatgc

SEQ ID NO: 397616 - DNA, 60 bp, Artificial Sequence
  Description of Artificial Sequence: Synthetic oligonucleotide
agtgagactacatctcaaaaaaaaaaaaaaagaaagaaagaaaaaaagaaaagaaatgcc

SEQ ID NO: 397617 - DNA, 60 bp, Artificial Sequence
  Description of Artificial Sequence: Synthetic oligonucleotide
gtgagactacatctcaaaaaaaaaaaaaaagaaagaaagaaaaaaagaaaagaaatgccc

SEQ ID NO: 397618 - DNA, 60 bp, Artificial Sequence
  Description of Artificial Sequence: Synthetic oligonucleotide
tgagactacatctcaaaaaaaaaaaaaaagaaagaaagaaaaaaagaaaagaaatgccca

SEQ ID NO: 397619 - DNA, 60 bp, Artificial Sequence
  Description of Artificial Sequence: Synthetic oligonucleotide
gagactacatctcaaaaaaaaaaaaaaagaaagaaagaaaaaaagaaaagaaatgcccac

SEQ ID NO: 397620 - DNA, 60 bp, Artificial Sequence
  Description of Artificial Sequence: Synthetic oligonucleotide
agactacatctcaaaaaaaaaaaaaaagaaagaaagaaaaaaagaaaagaaatgcccacc

SEQ ID NO: 397621 - DNA, 59 bp, Artificial Sequence
  Description of Artificial Sequence: Synthetic oligonucleotide
gactacatctcaaaaaaaaaaaaaaagaaagaaagaaaaaaagaaaagaaatgcccacc

SEQ ID NO: 397622 - DNA, 59 bp, Artificial Sequence
  Description of Artificial Sequence: Synthetic oligonucleotide
actacatctcaaaaaaaaaaaaaaagaaagaaagaaaaaaagaaaagaaatgcccaccc

SEQ ID NO: 397623 - DNA, 58 bp, Artificial Sequence
  Description of Artificial Sequence: Synthetic oligonucleotide
ctacatctcaaaaaaaaaaaaaaagaaagaaagaaaaaaagaaaagaaatgcccaccc

SEQ ID NO: 397624 - DNA, 58 bp, Artificial Sequence
  Description of Artificial Sequence: Synthetic oligonucleotide
tacatctcaaaaaaaaaaaaaaagaaagaaagaaaaaaagaaaagaaatgcccacccc

SEQ ID NO: 397625 - DNA, 57 bp, Artificial Sequence
  Description of Artificial Sequence: Synthetic oligonucleotide
acatctcaaaaaaaaaaaaaaagaaagaaagaaaaaaagaaaagaaatgcccacccc

SEQ ID NO: 397626 - DNA, 56 bp, Artificial Sequence
  Description of Artificial Sequence: Synthetic oligonucleotide
catctcaaaaaaaaaaaaaaagaaagaaagaaaaaaagaaaagaaatgcccacccc

SEQ ID NO: 397627 - DNA, 57 bp, Artificial Sequence
  Description of Artificial Sequence: Synthetic oligonucleotide
atctcaaaaaaaaaaaaaaagaaagaaagaaaaaaagaaaagaaatgcccacccctc

SEQ ID NO: 397628 - DNA, 56 bp, Artificial Sequence
  Description of Artificial Sequence: Synthetic oligonucleotide
tctcaaaaaaaaaaaaaaagaaagaaagaaaaaaagaaaagaaatgcccacccctc

SEQ ID NO: 397629 - DNA, 55 bp, Artificial Sequence
  Description of Artificial Sequence: Synthetic oligonucleotide
ctcaaaaaaaaaaaaaaagaaagaaagaaaaaaagaaaagaaatgcccacccctc

SEQ ID NO: 397630 - DNA, 57 bp, Artificial Sequence
  Description of Artificial Sequence: Synthetic oligonucleotide
tcaaaaaaaaaaaaaaagaaagaaagaaaaaaagaaaagaaatgcccacccctcttg

SEQ ID NO: 397631 - DNA, 56 bp, Artificial Sequence
  Description of Artificial Sequence: Synthetic oligonucleotide
caaaaaaaaaaaaaaagaaagaaagaaaaaaagaaaagaaatgcccacccctcttg

SEQ ID NO: 397632 - DNA, 56 bp, Artificial Sequence
  Description of Artificial Sequence: Synthetic oligonucleotide
aaaaaaaaaaaaaaagaaagaaagaaaaaaagaaaagaaatgcccacccctcttgc

SEQ ID NO: 397633 - DNA, 55 bp, Artificial Sequence
  Description of Artificial Sequence: Synthetic oligonucleotide
aaaaaaaaaaaaaagaaagaaagaaaaaaagaaaagaaatgcccacccctcttgc

SEQ ID NO: 397634 - DNA, 54 bp, Artificial Sequence
  Description of Artificial Sequence: Synthetic oligonucleotide
aaaaaaaaaaaaagaaagaaagaaaaaaagaaaagaaatgcccacccctcttgc

SEQ ID NO: 397635 - DNA, 53 bp, Artificial Sequence
  Description of Artificial Sequence: Synthetic oligonucleotide
aaaaaaaaaaaagaaagaaagaaaaaaagaaaagaaatgcccacccctcttgc

SEQ ID NO: 397636 - DNA, 52 bp, Artificial Sequence
  Description of Artificial Sequence: Synthetic oligonucleotide
aaaaaaaaaaagaaagaaagaaaaaaagaaaagaaatgcccacccctcttgc

SEQ ID NO: 397637 - DNA, 51 bp, Artificial Sequence
  Description of Artificial Sequence: Synthetic oligonucleotide
aaaaaaaaaagaaagaaagaaaaaaagaaaagaaatgcccacccctcttgc

SEQ ID NO: 397638 - DNA, 50 bp, Artificial Sequence
  Description of Artificial Sequence: Synthetic oligonucleotide
aaaaaaaaagaaagaaagaaaaaaagaaaagaaatgcccacccctcttgc

SEQ ID NO: 397639 - DNA, 49 bp, Artificial Sequence
  Description of Artificial Sequence: Synthetic oligonucleotide
aaaaaaaagaaagaaagaaaaaaagaaaagaaatgcccacccctcttgc

SEQ ID NO: 397640 - DNA, 48 bp, Artificial Sequence
  Description of Artificial Sequence: Synthetic oligonucleotide
aaaaaaagaaagaaagaaaaaaagaaaagaaatgcccacccctcttgc

SEQ ID NO: 397641 - DNA, 47 bp, Artificial Sequence
  Description of Artificial Sequence: Synthetic oligonucleotide
aaaaaagaaagaaagaaaaaaagaaaagaaatgcccacccctcttgc

SEQ ID NO: 397642 - DNA, 46 bp, Artificial Sequence
  Description of Artificial Sequence: Synthetic oligonucleotide
aaaaagaaagaaagaaaaaaagaaaagaaatgcccacccctcttgc

SEQ ID NO: 397643 - DNA, 45 bp, Artificial Sequence
  Description of Artificial Sequence: Synthetic oligonucleotide
aaaagaaagaaagaaaaaaagaaaagaaatgcccacccctcttgc

SEQ ID NO: 397644 - DNA, 44 bp, Artificial Sequence
  Description of Artificial Sequence: Synthetic oligonucleotide
aaagaaagaaagaaaaaaagaaaagaaatgcccacccctcttgc

SEQ ID NO: 397645 - DNA, 43 bp, Artificial Sequence
  Description of Artificial Sequence: Synthetic oligonucleotide
aagaaagaaagaaaaaaagaaaagaaatgcccacccctcttgc

SEQ ID NO: 397646 - DNA, 42 bp, Artificial Sequence
  Description of Artificial Sequence: Synthetic oligonucleotide
agaaagaaagaaaaaaagaaaagaaatgcccacccctcttgc

SEQ ID NO: 397647 - DNA, 41 bp, Artificial Sequence
  Description of Artificial Sequence: Synthetic oligonucleotide
gaaagaaagaaaaaaagaaaagaaatgcccacccctcttgc

SEQ ID NO: 397648 - DNA, 41 bp, Artificial Sequence
  Description of Artificial Sequence: Synthetic oligonucleotide
aaagaaagaaaaaaagaaaagaaatgcccacccctcttgcc

SEQ ID NO: 397649 - DNA, 40 bp, Artificial Sequence
  Description of Artificial Sequence: Synthetic oligonucleotide
aagaaagaaaaaaagaaaagaaatgcccacccctcttgcc

SEQ ID NO: 397650 - DNA, 39 bp, Artificial Sequence
  Description of Artificial Sequence: Synthetic oligonucleotide
agaaagaaaaaaagaaaagaaatgcccacccctcttgcc

SEQ ID NO: 397651 - DNA, 38 bp, Artificial Sequence
  Description of Artificial Sequence: Synthetic oligonucleotide
gaaagaaaaaaagaaaagaaatgcccacccctcttgcc

SEQ ID NO: 397652 - DNA, 39 bp, Artificial Sequence
  Description of Artificial Sequence: Synthetic oligonucleotide
aaagaaaaaaagaaaagaaatgcccacccctcttgccac

SEQ ID NO: 397653 - DNA, 38 bp, Artificial Sequence
  Description of Artificial Sequence: Synthetic oligonucleotide
aagaaaaaaagaaaagaaatgcccacccctcttgccac

SEQ ID NO: 397654 - DNA, 37 bp, Artificial Sequence
  Description of Artificial Sequence: Synthetic oligonucleotide
agaaaaaaagaaaagaaatgcccacccctcttgccac

SEQ ID NO: 397655 - DNA, 36 bp, Artificial Sequence
  Description of Artificial Sequence: Synthetic oligonucleotide
gaaaaaaagaaaagaaatgcccacccctcttgccac

SEQ ID NO: 397656 - DNA, 37 bp, Artificial Sequence
  Description of Artificial Sequence: Synthetic oligonucleotide
aaaaaaagaaaagaaatgcccacccctcttgccactg

SEQ ID NO: 397657 - DNA, 36 bp, Artificial Sequence
  Description of Artificial Sequence: Synthetic oligonucleotide
aaaaaagaaaagaaatgcccacccctcttgccactg

SEQ ID NO: 397658 - DNA, 35 bp, Artificial Sequence
  Description of Artificial Sequence: Synthetic oligonucleotide
aaaaagaaaagaaatgcccacccctcttgccactg

SEQ ID NO: 397659 - DNA, 34 bp, Artificial Sequence
  Description of Artificial Sequence: Synthetic oligonucleotide
aaaagaaaagaaatgcccacccctcttgccactg

SEQ ID NO: 397660 - DNA, 33 bp, Artificial Sequence
  Description of Artificial Sequence: Synthetic oligonucleotide
aaagaaaagaaatgcccacccctcttgccactg

SEQ ID NO: 397661 - DNA, 32 bp, Artificial Sequence
  Description of Artificial Sequence: Synthetic oligonucleotide
aagaaaagaaatgcccacccctcttgccactg

SEQ ID NO: 397662 - DNA, 31 bp, Artificial Sequence
  Description of Artificial Sequence: Synthetic oligonucleotide
agaaaagaaatgcccacccctcttgccactg

SEQ ID NO: 397663 - DNA, 30 bp, Artificial Sequence
  Description of Artificial Sequence: Synthetic oligonucleotide
gaaaagaaatgcccacccctcttgccactg

SEQ ID NO: 397664 - DNA, 30 bp, Artificial Sequence
  Description of Artificial Sequence: Synthetic oligonucleotide
aaaagaaatgcccacccctcttgccactgg

SEQ ID NO: 397665 - DNA, 29 bp, Artificial Sequence
  Description of Artificial Sequence: Synthetic oligonucleotide
aaagaaatgcccacccctcttgccactgg

SEQ ID NO: 397666 - DNA, 28 bp, Artificial Sequence
  Description of Artificial Sequence: Synthetic oligonucleotide
aagaaatgcccacccctcttgccactgg

SEQ ID NO: 397667 - DNA, 27 bp, Artificial Sequence
  Description of Artificial Sequence: Synthetic oligonucleotide
agaaatgcccacccctcttgccactgg

SEQ ID NO: 397668 - DNA, 26 bp, Artificial Sequence
  Description of Artificial Sequence: Synthetic oligonucleotide
gaaatgcccacccctcttgccactgg

SEQ ID NO: 397669 - DNA, 27 bp, Artificial Sequence
  Description of Artificial Sequence: Synthetic oligonucleotide
aaatgcccacccctcttgccactggca

SEQ ID NO: 397670 - DNA, 26 bp, Artificial Sequence
  Description of Artificial Sequence: Synthetic oligonucleotide
aatgcccacccctcttgccactggca

SEQ ID NO: 397671 - DNA, 25 bp, Artificial Sequence
  Description of Artificial Sequence: Synthetic oligonucleotide
atgcccacccctcttgccactggca

SEQ ID NO: 397672 - DNA, 24 bp, Artificial Sequence
  Description of Artificial Sequence: Synthetic oligonucleotide
tgcccacccctcttgccactggca

SEQ ID NO: 397673 - DNA, 23 bp, Artificial Sequence
  Description of Artificial Sequence: Synthetic oligonucleotide
gcccacccctcttgccactggca

SEQ ID NO: 397674 - DNA, 24 bp, Artificial Sequence
  Description of Artificial Sequence: Synthetic oligonucleotide
cccacccctcttgccactggcaga

SEQ ID NO: 397675 - DNA, 26 bp, Artificial Sequence
  Description of Artificial Sequence: Synthetic oligonucleotide
ccacccctcttgccactggcagacat

SEQ ID NO: 397676 - DNA, 26 bp, Artificial Sequence
  Description of Artificial Sequence: Synthetic oligonucleotide
cacccctcttgccactggcagacatg

SEQ ID NO: 397677 - DNA, 27 bp, Artificial Sequence
  Description of Artificial Sequence: Synthetic oligonucleotide
acccctcttgccactggcagacatgca

SEQ ID NO: 397678 - DNA, 26 bp, Artificial Sequence
  Description of Artificial Sequence: Synthetic oligonucleotide
cccctcttgccactggcagacatgca

SEQ ID NO: 397679 - DNA, 27 bp, Artificial Sequence
  Description of Artificial Sequence: Synthetic oligonucleotide
ccctcttgccactggcagacatgcaca

SEQ ID NO: 397680 - DNA, 27 bp, Artificial Sequence
  Description of Artificial Sequence: Synthetic oligonucleotide
cctcttgccactggcagacatgcacac

SEQ ID NO: 397681 - DNA, 28 bp, Artificial Sequence
  Description of Artificial Sequence: Synthetic oligonucleotide
ctcttgccactggcagacatgcacacac

SEQ ID NO: 397682 - DNA, 28 bp, Artificial Sequence
  Description of Artificial Sequence: Synthetic oligonucleotide
tcttgccactggcagacatgcacacacc

SEQ ID NO: 397683 - DNA, 27 bp, Artificial Sequence
  Description of Artificial Sequence: Synthetic oligonucleotide
cttgccactggcagacatgcacacacc

SEQ ID NO: 397684 - DNA, 28 bp, Artificial Sequence
  Description of Artificial Sequence: Synthetic oligonucleotide
ttgccactggcagacatgcacacaccag

SEQ ID NO: 397685 - DNA, 27 bp, Artificial Sequence
  Description of Artificial Sequence: Synthetic oligonucleotide
tgccactggcagacatgcacacaccag

SEQ ID NO: 397686 - DNA, 27 bp, Artificial Sequence
  Description of Artificial Sequence: Synthetic oligonucleotide
gccactggcagacatgcacacaccaga

SEQ ID NO: 397687 - DNA, 27 bp, Artificial Sequence
  Description of Artificial Sequence: Synthetic oligonucleotide
ccactggcagacatgcacacaccagag

SEQ ID NO: 397688 - DNA, 29 bp, Artificial Sequence
  Description of Artificial Sequence: Synthetic oligonucleotide
cactggcagacatgcacacaccagagaag

SEQ ID NO: 397689 - DNA, 30 bp, Artificial Sequence
  Description of Artificial Sequence: Synthetic oligonucleotide
gcagacatgcacacaccagagaagattccg

SEQ ID NO: 397690 - DNA, 34 bp, Artificial Sequence
  Description of Artificial Sequence: Synthetic oligonucleotide
cagacatgcacacaccagagaagattccgatttc

SEQ ID NO: 397691 - DNA, 34 bp, Artificial Sequence
  Description of Artificial Sequence: Synthetic oligonucleotide
agacatgcacacaccagagaagattccgatttcg

SEQ ID NO: 397692 - DNA, 33 bp, Artificial Sequence
  Description of Artificial Sequence: Synthetic oligonucleotide
gacatgcacacaccagagaagattccgatttcg

SEQ ID NO: 397693 - DNA, 34 bp, Artificial Sequence
  Description of Artificial Sequence: Synthetic oligonucleotide
acatgcacacaccagagaagattccgatttcgtg

SEQ ID NO: 397694 - DNA, 33 bp, Artificial Sequence
  Description of Artificial Sequence: Synthetic oligonucleotide
catgcacacaccagagaagattccgatttcgtg

SEQ ID NO: 397695 - DNA, 34 bp, Artificial Sequence
  Description of Artificial Sequence: Synthetic oligonucleotide
atgcacacaccagagaagattccgatttcgtgtc

SEQ ID NO: 397696 - DNA, 33 bp, Artificial Sequence
  Description of Artificial Sequence: Synthetic oligonucleotide
tgcacacaccagagaagattccgatttcgtgtc

SEQ ID NO: 397697 - DNA, 32 bp, Artificial Sequence
  Description of Artificial Sequence: Synthetic oligonucleotide
gcacacaccagagaagattccgatttcgtgtc

SEQ ID NO: 397698 - DNA, 32 bp, Artificial Sequence
  Description of Artificial Sequence: Synthetic oligonucleotide
cacacaccagagaagattccgatttcgtgtcc

SEQ ID NO: 397699 - DNA, 33 bp, Artificial Sequence
  Description of Artificial Sequence: Synthetic oligonucleotide
acacaccagagaagattccgatttcgtgtcctc

SEQ ID NO: 397700 - DNA, 32 bp, Artificial Sequence
  Description of Artificial Sequence: Synthetic oligonucleotide
cacaccagagaagattccgatttcgtgtcctc

SEQ ID NO: 397701 - DNA, 32 bp, Artificial Sequence
  Description of Artificial Sequence: Synthetic oligonucleotide
acaccagagaagattccgatttcgtgtcctcc

SEQ ID NO: 397702 - DNA, 31 bp, Artificial Sequence
  Description of Artificial Sequence: Synthetic oligonucleotide
caccagagaagattccgatttcgtgtcctcc

SEQ ID NO: 397703 - DNA, 31 bp, Artificial Sequence
  Description of Artificial Sequence: Synthetic oligonucleotide
accagagaagattccgatttcgtgtcctccc

SEQ ID NO: 397704 - DNA, 30 bp, Artificial Sequence
  Description of Artificial Sequence: Synthetic oligonucleotide
ccagagaagattccgatttcgtgtcctccc

SEQ ID NO: 397705 - DNA, 31 bp, Artificial Sequence
  Description of Artificial Sequence: Synthetic oligonucleotide
cagagaagattccgatttcgtgtcctccctc

SEQ ID NO: 397706 - DNA, 35 bp, Artificial Sequence
  Description of Artificial Sequence: Synthetic oligonucleotide
agagaagattccgatttcgtgtcctccctctattc

SEQ ID NO: 397707 - DNA, 34 bp, Artificial Sequence
  Description of Artificial Sequence: Synthetic oligonucleotide
gagaagattccgatttcgtgtcctccctctattc

SEQ ID NO: 397708 - DNA, 35 bp, Artificial Sequence
  Description of Artificial Sequence: Synthetic oligonucleotide
agaagattccgatttcgtgtcctccctctattcac

SEQ ID NO: 397709 - DNA, 34 bp, Artificial Sequence
  Description of Artificial Sequence: Synthetic oligonucleotide
gaagattccgatttcgtgtcctccctctattcac

SEQ ID NO: 397710 - DNA, 35 bp, Artificial Sequence
  Description of Artificial Sequence: Synthetic oligonucleotide
aagattccgatttcgtgtcctccctctattcacag

SEQ ID NO: 397711 - DNA, 34 bp, Artificial Sequence
  Description of Artificial Sequence: Synthetic oligonucleotide
agattccgatttcgtgtcctccctctattcacag

SEQ ID NO: 397712 - DNA, 33 bp, Artificial Sequence
  Description of Artificial Sequence: Synthetic oligonucleotide
gattccgatttcgtgtcctccctctattcacag

SEQ ID NO: 397713 - DNA, 35 bp, Artificial Sequence
  Description of Artificial Sequence: Synthetic oligonucleotide
attccgatttcgtgtcctccctctattcacagaac

SEQ ID NO: 397714 - DNA, 34 bp, Artificial Sequence
  Description of Artificial Sequence: Synthetic oligonucleotide
ttccgatttcgtgtcctccctctattcacagaac

SEQ ID NO: 397715 - DNA, 33 bp, Artificial Sequence
  Description of Artificial Sequence: Synthetic oligonucleotide
tccgatttcgtgtcctccctctattcacagaac

SEQ ID NO: 397716 - DNA, 32 bp, Artificial Sequence
  Description of Artificial Sequence: Synthetic oligonucleotide
ccgatttcgtgtcctccctctattcacagaac

SEQ ID NO: 397717 - DNA, 36 bp, Artificial Sequence
  Description of Artificial Sequence: Synthetic oligonucleotide
cgatttcgtgtcctccctctattcacagaacatttc

SEQ ID NO: 397718 - DNA, 36 bp, Artificial Sequence
  Description of Artificial Sequence: Synthetic oligonucleotide
gatttcgtgtcctccctctattcacagaacatttcc

SEQ ID NO: 397719 - DNA, 37 bp, Artificial Sequence
  Description of Artificial Sequence: Synthetic oligonucleotide
atttcgtgtcctccctctattcacagaacatttcctc

SEQ ID NO: 397720 - DNA, 36 bp, Artificial Sequence
  Description of Artificial Sequence: Synthetic oligonucleotide
tttcgtgtcctccctctattcacagaacatttcctc

SEQ ID NO: 397721 - DNA, 35 bp, Artificial Sequence
  Description of Artificial Sequence: Synthetic oligonucleotide
ttcgtgtcctccctctattcacagaacatttcctc

SEQ ID NO: 397722 - DNA, 34 bp, Artificial Sequence
  Description of Artificial Sequence: Synthetic oligonucleotide
tcgtgtcctccctctattcacagaacatttcctc

SEQ ID NO: 397723 - DNA, 33 bp, Artificial Sequence
  Description of Artificial Sequence: Synthetic oligonucleotide
cgtgtcctccctctattcacagaacatttcctc

SEQ ID NO: 397724 - DNA, 35 bp, Artificial Sequence
  Description of Artificial Sequence: Synthetic oligonucleotide
gtgtcctccctctattcacagaacatttcctcaag

SEQ ID NO: 397725 - DNA, 36 bp, Artificial Sequence
  Description of Artificial Sequence: Synthetic oligonucleotide
tgtcctccctctattcacagaacatttcctcaagtc

SEQ ID NO: 397726 - DNA, 35 bp, Artificial Sequence
  Description of Artificial Sequence: Synthetic oligonucleotide
gtcctccctctattcacagaacatttcctcaagtc

SEQ ID NO: 397727 - DNA, 35 bp, Artificial Sequence
  Description of Artificial Sequence: Synthetic oligonucleotide
tcctccctctattcacagaacatttcctcaagtcc

SEQ ID NO: 397728 - DNA, 34 bp, Artificial Sequence
  Description of Artificial Sequence: Synthetic oligonucleotide
cctccctctattcacagaacatttcctcaagtcc

SEQ ID NO: 397729 - DNA, 35 bp, Artificial Sequence
  Description of Artificial Sequence: Synthetic oligonucleotide
ctccctctattcacagaacatttcctcaagtccac

SEQ ID NO: 397730 - DNA, 36 bp, Artificial Sequence
  Description of Artificial Sequence: Synthetic oligonucleotide
tccctctattcacagaacatttcctcaagtccactc

SEQ ID NO: 397731 - DNA, 35 bp, Artificial Sequence
  Description of Artificial Sequence: Synthetic oligonucleotide
ccctctattcacagaacatttcctcaagtccactc

SEQ ID NO: 397732 - DNA, 36 bp, Artificial Sequence
  Description of Artificial Sequence: Synthetic oligonucleotide
cctctattcacagaacatttcctcaagtccactctg

SEQ ID NO: 397733 - DNA, 37 bp, Artificial Sequence
  Description of Artificial Sequence: Synthetic oligonucleotide
ctctattcacagaacatttcctcaagtccactctgag

SEQ ID NO: 397734 - DNA, 38 bp, Artificial Sequence
  Description of Artificial Sequence: Synthetic oligonucleotide
tctattcacagaacatttcctcaagtccactctgagtg

SEQ ID NO: 397735 - DNA, 37 bp, Artificial Sequence
  Description of Artificial Sequence: Synthetic oligonucleotide
ctattcacagaacatttcctcaagtccactctgagtg

SEQ ID NO: 397736 - DNA, 37 bp, Artificial Sequence
  Description of Artificial Sequence: Synthetic oligonucleotide
tattcacagaacatttcctcaagtccactctgagtgg

SEQ ID NO: 397737 - DNA, 36 bp, Artificial Sequence
  Description of Artificial Sequence: Synthetic oligonucleotide
attcacagaacatttcctcaagtccactctgagtgg

SEQ ID NO: 397738 - DNA, 35 bp, Artificial Sequence
  Description of Artificial Sequence: Synthetic oligonucleotide
ttcacagaacatttcctcaagtccactctgagtgg

SEQ ID NO: 397739 - DNA, 34 bp, Artificial Sequence
  Description of Artificial Sequence: Synthetic oligonucleotide
tcacagaacatttcctcaagtccactctgagtgg

SEQ ID NO: 397740 - DNA, 33 bp, Artificial Sequence
  Description of Artificial Sequence: Synthetic oligonucleotide
cacagaacatttcctcaagtccactctgagtgg

SEQ ID NO: 397741 - DNA, 34 bp, Artificial Sequence
  Description of Artificial Sequence: Synthetic oligonucleotide
acagaacatttcctcaagtccactctgagtggag

SEQ ID NO: 397742 - DNA, 33 bp, Artificial Sequence
  Description of Artificial Sequence: Synthetic oligonucleotide
cagaacatttcctcaagtccactctgagtggag

SEQ ID NO: 397743 - DNA, 33 bp, Artificial Sequence
  Description of Artificial Sequence: Synthetic oligonucleotide
agaacatttcctcaagtccactctgagtggagg

SEQ ID NO: 397744 - DNA, 32 bp, Artificial Sequence
  Description of Artificial Sequence: Synthetic oligonucleotide
gaacatttcctcaagtccactctgagtggagg

SEQ ID NO: 397745 - DNA, 32 bp, Artificial Sequence
  Description of Artificial Sequence: Synthetic oligonucleotide
aacatttcctcaagtccactctgagtggaggc

SEQ ID NO: 397746 - DNA, 31 bp, Artificial Sequence
  Description of Artificial Sequence: Synthetic oligonucleotide
acatttcctcaagtccactctgagtggaggc

SEQ ID NO: 397747 - DNA, 30 bp, Artificial Sequence
  Description of Artificial Sequence: Synthetic oligonucleotide
catttcctcaagtccactctgagtggaggc

SEQ ID NO: 397748 - DNA, 31 bp, Artificial Sequence
  Description of Artificial Sequence: Synthetic oligonucleotide
atttcctcaagtccactctgagtggaggctg

SEQ ID NO: 397749 - DNA, 30 bp, Artificial Sequence
  Description of Artificial Sequence: Synthetic oligonucleotide
tttcctcaagtccactctgagtggaggctg

SEQ ID NO: 397750 - DNA, 29 bp, Artificial Sequence
  Description of Artificial Sequence: Synthetic oligonucleotide
ttcctcaagtccactctgagtggaggctg

SEQ ID NO: 397751 - DNA, 28 bp, Artificial Sequence
  Description of Artificial Sequence: Synthetic oligonucleotide
tcctcaagtccactctgagtggaggctg

SEQ ID NO: 397752 - DNA, 27 bp, Artificial Sequence
  Description of Artificial Sequence: Synthetic oligonucleotide
cctcaagtccactctgagtggaggctg

SEQ ID NO: 397753 - DNA, 27 bp, Artificial Sequence
  Description of Artificial Sequence: Synthetic oligonucleotide
ctcaagtccactctgagtggaggctgc

SEQ ID NO: 397754 - DNA, 29 bp, Artificial Sequence
  Description of Artificial Sequence: Synthetic oligonucleotide
tcaagtccactctgagtggaggctgcatc

SEQ ID NO: 397755 - DNA, 28 bp, Artificial Sequence
  Description of Artificial Sequence: Synthetic oligonucleotide
caagtccactctgagtggaggctgcatc

SEQ ID NO: 397756 - DNA, 29 bp, Artificial Sequence
  Description of Artificial Sequence: Synthetic oligonucleotide
aagtccactctgagtggaggctgcatcac

SEQ ID NO: 397757 - DNA, 28 bp, Artificial Sequence
  Description of Artificial Sequence: Synthetic oligonucleotide
agtccactctgagtggaggctgcatcac

SEQ ID NO: 397758 - DNA, 27 bp, Artificial Sequence
  Description of Artificial Sequence: Synthetic oligonucleotide
gtccactctgagtggaggctgcatcac

SEQ ID NO: 397759 - DNA, 29 bp, Artificial Sequence
  Description of Artificial Sequence: Synthetic oligonucleotide
tccactctgagtggaggctgcatcacaac

SEQ ID NO: 397760 - DNA, 28 bp, Artificial Sequence
  Description of Artificial Sequence: Synthetic oligonucleotide
ccactctgagtggaggctgcatcacaac

SEQ ID NO: 397761 - DNA, 30 bp, Artificial Sequence
  Description of Artificial Sequence: Synthetic oligonucleotide
cactctgagtggaggctgcatcacaacaag

SEQ ID NO: 397762 - DNA, 30 bp, Artificial Sequence
  Description of Artificial Sequence: Synthetic oligonucleotide
actctgagtggaggctgcatcacaacaagg

SEQ ID NO: 397763 - DNA, 29 bp, Artificial Sequence
  Description of Artificial Sequence: Synthetic oligonucleotide
ctctgagtggaggctgcatcacaacaagg

SEQ ID NO: 397764 - DNA, 29 bp, Artificial Sequence
  Description of Artificial Sequence: Synthetic oligonucleotide
tctgagtggaggctgcatcacaacaaggg

SEQ ID NO: 397765 - DNA, 28 bp, Artificial Sequence
  Description of Artificial Sequence: Synthetic oligonucleotide
ctgagtggaggctgcatcacaacaaggg

SEQ ID NO: 397766 - DNA, 28 bp, Artificial Sequence
  Description of Artificial Sequence: Synthetic oligonucleotide
tgagtggaggctgcatcacaacaagggg

SEQ ID NO: 397767 - DNA, 27 bp, Artificial Sequence
  Description of Artificial Sequence: Synthetic oligonucleotide
gagtggaggctgcatcacaacaagggg

SEQ ID NO: 397768 - DNA, 30 bp, Artificial Sequence
  Description of Artificial Sequence: Synthetic oligonucleotide
agtggaggctgcatcacaacaaggggattg

SEQ ID NO: 397769 - DNA, 29 bp, Artificial Sequence
  Description of Artificial Sequence: Synthetic oligonucleotide
gtggaggctgcatcacaacaaggggattg

SEQ ID NO: 397770 - DNA, 29 bp, Artificial Sequence
  Description of Artificial Sequence: Synthetic oligonucleotide
tggaggctgcatcacaacaaggggattgc

SEQ ID NO: 397771 - DNA, 28 bp, Artificial Sequence
  Description of Artificial Sequence: Synthetic oligonucleotide
ggaggctgcatcacaacaaggggattgc

SEQ ID NO: 397772 - DNA, 39 bp, Artificial Sequence
  Description of Artificial Sequence: Synthetic oligonucleotide
cagggctcttaatacaaactcttcaactagtaactgagg

SEQ ID NO: 397773 - DNA, 40 bp, Artificial Sequence
  Description of Artificial Sequence: Synthetic oligonucleotide
agggctcttaatacaaactcttcaactagtaactgaggtg

SEQ ID NO: 397774 - DNA, 39 bp, Artificial Sequence
  Description of Artificial Sequence: Synthetic oligonucleotide
gggctcttaatacaaactcttcaactagtaactgaggtg

SEQ ID NO: 397775 - DNA, 40 bp, Artificial Sequence
  Description of Artificial Sequence: Synthetic oligonucleotide
ggctcttaatacaaactcttcaactagtaactgaggtgtc

SEQ ID NO: 397776 - DNA, 42 bp, Artificial Sequence
  Description of Artificial Sequence: Synthetic oligonucleotide
gctcttaatacaaactcttcaactagtaactgaggtgtcatc

SEQ ID NO: 397777 - DNA, 45 bp, Artificial Sequence
  Description of Artificial Sequence: Synthetic oligonucleotide
ctcttaatacaaactcttcaactagtaactgaggtgtcatcatag

SEQ ID NO: 397778 - DNA, 45 bp, Artificial Sequence
  Description of Artificial Sequence: Synthetic oligonucleotide
tcttaatacaaactcttcaactagtaactgaggtgtcatcatagg

SEQ ID NO: 397779 - DNA, 44 bp, Artificial Sequence
  Description of Artificial Sequence: Synthetic oligonucleotide
cttaatacaaactcttcaactagtaactgaggtgtcatcatagg

SEQ ID NO: 397780 - DNA, 44 bp, Artificial Sequence
  Description of Artificial Sequence: Synthetic oligonucleotide
ttaatacaaactcttcaactagtaactgaggtgtcatcataggg

SEQ ID NO: 397781 - DNA, 43 bp, Artificial Sequence
  Description of Artificial Sequence: Synthetic oligonucleotide
taatacaaactcttcaactagtaactgaggtgtcatcataggg

SEQ ID NO: 397782 - DNA, 42 bp, Artificial Sequence
  Description of Artificial Sequence: Synthetic oligonucleotide
aatacaaactcttcaactagtaactgaggtgtcatcataggg

SEQ ID NO: 397783 - DNA, 41 bp, Artificial Sequence
  Description of Artificial Sequence: Synthetic oligonucleotide
atacaaactcttcaactagtaactgaggtgtcatcataggg

SEQ ID NO: 397784 - DNA, 40 bp, Artificial Sequence
  Description of Artificial Sequence: Synthetic oligonucleotide
tacaaactcttcaactagtaactgaggtgtcatcataggg

SEQ ID NO: 397785 - DNA, 39 bp, Artificial Sequence
  Description of Artificial Sequence: Synthetic oligonucleotide
acaaactcttcaactagtaactgaggtgtcatcataggg

SEQ ID NO: 397786 - DNA, 38 bp, Artificial Sequence
  Description of Artificial Sequence: Synthetic oligonucleotide
caaactcttcaactagtaactgaggtgtcatcataggg

SEQ ID NO: 397787 - DNA, 38 bp, Artificial Sequence
  Description of Artificial Sequence: Synthetic oligonucleotide
aaactcttcaactagtaactgaggtgtcatcatagggg

SEQ ID NO: 397788 - DNA, 37 bp, Artificial Sequence
  Description of Artificial Sequence: Synthetic oligonucleotide
aactcttcaactagtaactgaggtgtcatcatagggg

SEQ ID NO: 397789 - DNA, 36 bp, Artificial Sequence
  Description of Artificial Sequence: Synthetic oligonucleotide
actcttcaactagtaactgaggtgtcatcatagggg

SEQ ID NO: 397790 - DNA, 35 bp, Artificial Sequence
  Description of Artificial Sequence: Synthetic oligonucleotide
ctcttcaactagtaactgaggtgtcatcatagggg

SEQ ID NO: 397791 - DNA, 41 bp, Artificial Sequence
  Description of Artificial Sequence: Synthetic oligonucleotide
tcttcaactagtaactgaggtgtcatcataggggatttttc

SEQ ID NO: 397792 - DNA, 40 bp, Artificial Sequence
  Description of Artificial Sequence: Synthetic oligonucleotide
cttcaactagtaactgaggtgtcatcataggggatttttc

SEQ ID NO: 397793 - DNA, 46 bp, Artificial Sequence
  Description of Artificial Sequence: Synthetic oligonucleotide
ttcaactagtaactgaggtgtcatcataggggatttttctaattag

SEQ ID NO: 397794 - DNA, 45 bp, Artificial Sequence
  Description of Artificial Sequence: Synthetic oligonucleotide
tcaactagtaactgaggtgtcatcataggggatttttctaattag

SEQ ID NO: 397795 - DNA, 44 bp, Artificial Sequence
  Description of Artificial Sequence: Synthetic oligonucleotide
caactagtaactgaggtgtcatcataggggatttttctaattag

SEQ ID NO: 397796 - DNA, 44 bp, Artificial Sequence
  Description of Artificial Sequence: Synthetic oligonucleotide
aactagtaactgaggtgtcatcataggggatttttctaattagc

SEQ ID NO: 397797 - DNA, 43 bp, Artificial Sequence
  Description of Artificial Sequence: Synthetic oligonucleotide
actagtaactgaggtgtcatcataggggatttttctaattagc

SEQ ID NO: 397798 - DNA, 42 bp, Artificial Sequence
  Description of Artificial Sequence: Synthetic oligonucleotide
ctagtaactgaggtgtcatcataggggatttttctaattagc

SEQ ID NO: 397799 - DNA, 42 bp, Artificial Sequence
  Description of Artificial Sequence: Synthetic oligonucleotide
tagtaactgaggtgtcatcataggggatttttctaattagcc

SEQ ID NO: 397800 - DNA, 41 bp, Artificial Sequence
  Description of Artificial Sequence: Synthetic oligonucleotide
agtaactgaggtgtcatcataggggatttttctaattagcc

SEQ ID NO: 397801 - DNA, 40 bp, Artificial Sequence
  Description of Artificial Sequence: Synthetic oligonucleotide
gtaactgaggtgtcatcataggggatttttctaattagcc

SEQ ID NO: 397802 - DNA, 44 bp, Artificial Sequence
  Description of Artificial Sequence: Synthetic oligonucleotide
taactgaggtgtcatcataggggatttttctaattagccaaaac

SEQ ID NO: 397803 - DNA, 43 bp, Artificial Sequence
  Description of Artificial Sequence: Synthetic oligonucleotide
aactgaggtgtcatcataggggatttttctaattagccaaaac

SEQ ID NO: 397804 - DNA, 42 bp, Artificial Sequence
  Description of Artificial Sequence: Synthetic oligonucleotide
actgaggtgtcatcataggggatttttctaattagccaaaac

SEQ ID NO: 397805 - DNA, 41 bp, Artificial Sequence
  Description of Artificial Sequence: Synthetic oligonucleotide
ctgaggtgtcatcataggggatttttctaattagccaaaac

SEQ ID NO: 397806 - DNA, 41 bp, Artificial Sequence
  Description of Artificial Sequence: Synthetic oligonucleotide
tgaggtgtcatcataggggatttttctaattagccaaaacc

SEQ ID NO: 397807 - DNA, 40 bp, Artificial Sequence
  Description of Artificial Sequence: Synthetic oligonucleotide
gaggtgtcatcataggggatttttctaattagccaaaacc

SEQ ID NO: 397808 - DNA, 41 bp, Artificial Sequence
  Description of Artificial Sequence: Synthetic oligonucleotide
aggtgtcatcataggggatttttctaattagccaaaacctg

SEQ ID NO: 397809 - DNA, 40 bp, Artificial Sequence
  Description of Artificial Sequence: Synthetic oligonucleotide
ggtgtcatcataggggatttttctaattagccaaaacctg

SEQ ID NO: 397810 - DNA, 41 bp, Artificial Sequence
  Description of Artificial Sequence: Synthetic oligonucleotide
gtgtcatcataggggatttttctaattagccaaaacctgac

SEQ ID NO: 397811 - DNA, 43 bp, Artificial Sequence
  Description of Artificial Sequence: Synthetic oligonucleotide
tgtcatcataggggatttttctaattagccaaaacctgacttg

SEQ ID NO: 397812 - DNA, 42 bp, Artificial Sequence
  Description of Artificial Sequence: Synthetic oligonucleotide
gtcatcataggggatttttctaattagccaaaacctgacttg

SEQ ID NO: 397813 - DNA, 42 bp, Artificial Sequence
  Description of Artificial Sequence: Synthetic oligonucleotide
tcatcataggggatttttctaattagccaaaacctgacttgg

SEQ ID NO: 397814 - DNA, 41 bp, Artificial Sequence
  Description of Artificial Sequence: Synthetic oligonucleotide
catcataggggatttttctaattagccaaaacctgacttgg

SEQ ID NO: 397815 - DNA, 41 bp, Artificial Sequence
  Description of Artificial Sequence: Synthetic oligonucleotide
atcataggggatttttctaattagccaaaacctgacttggc

SEQ ID NO: 397816 - DNA, 40 bp, Artificial Sequence
  Description of Artificial Sequence: Synthetic oligonucleotide
tcataggggatttttctaattagccaaaacctgacttggc

SEQ ID NO: 397817 - DNA, 39 bp, Artificial Sequence
  Description of Artificial Sequence: Synthetic oligonucleotide
cataggggatttttctaattagccaaaacctgacttggc

SEQ ID NO: 397818 - DNA, 40 bp, Artificial Sequence
  Description of Artificial Sequence: Synthetic oligonucleotide
ataggggatttttctaattagccaaaacctgacttggcag

SEQ ID NO: 397819 - DNA, 39 bp, Artificial Sequence
  Description of Artificial Sequence: Synthetic oligonucleotide
taggggatttttctaattagccaaaacctgacttggcag

SEQ ID NO: 397820 - DNA, 38 bp, Artificial Sequence
  Description of Artificial Sequence: Synthetic oligonucleotide
aggggatttttctaattagccaaaacctgacttggcag

SEQ ID NO: 397821 - DNA, 37 bp, Artificial Sequence
  Description of Artificial Sequence: Synthetic oligonucleotide
ggggatttttctaattagccaaaacctgacttggcag

SEQ ID NO: 397822 - DNA, 37 bp, Artificial Sequence
  Description of Artificial Sequence: Synthetic oligonucleotide
gggatttttctaattagccaaaacctgacttggcagg

SEQ ID NO: 397823 - DNA, 37 bp, Artificial Sequence
  Description of Artificial Sequence: Synthetic oligonucleotide
ggatttttctaattagccaaaacctgacttggcaggg

SEQ ID NO: 397824 - DNA, 40 bp, Artificial Sequence
  Description of Artificial Sequence: Synthetic oligonucleotide
gatttttctaattagccaaaacctgacttggcagggtttg

SEQ ID NO: 397825 - DNA, 40 bp, Artificial Sequence
  Description of Artificial Sequence: Synthetic oligonucleotide
atttttctaattagccaaaacctgacttggcagggtttgg

SEQ ID NO: 397826 - DNA, 39 bp, Artificial Sequence
  Description of Artificial Sequence: Synthetic oligonucleotide
tttttctaattagccaaaacctgacttggcagggtttgg

SEQ ID NO: 397827 - DNA, 38 bp, Artificial Sequence
  Description of Artificial Sequence: Synthetic oligonucleotide
ttttctaattagccaaaacctgacttggcagggtttgg

SEQ ID NO: 397828 - DNA, 37 bp, Artificial Sequence
  Description of Artificial Sequence: Synthetic oligonucleotide
tttctaattagccaaaacctgacttggcagggtttgg

SEQ ID NO: 397829 - DNA, 36 bp, Artificial Sequence
  Description of Artificial Sequence: Synthetic oligonucleotide
ttctaattagccaaaacctgacttggcagggtttgg

SEQ ID NO: 397830 - DNA, 35 bp, Artificial Sequence
  Description of Artificial Sequence: Synthetic oligonucleotide
tctaattagccaaaacctgacttggcagggtttgg

SEQ ID NO: 397831 - DNA, 34 bp, Artificial Sequence
  Description of Artificial Sequence: Synthetic oligonucleotide
ctaattagccaaaacctgacttggcagggtttgg

SEQ ID NO: 397832 - DNA, 37 bp, Artificial Sequence
  Description of Artificial Sequence: Synthetic oligonucleotide
taattagccaaaacctgacttggcagggtttggtttg

SEQ ID NO: 397833 - DNA, 36 bp, Artificial Sequence
  Description of Artificial Sequence: Synthetic oligonucleotide
aattagccaaaacctgacttggcagggtttggtttg

SEQ ID NO: 397834 - DNA, 35 bp, Artificial Sequence
  Description of Artificial Sequence: Synthetic oligonucleotide
attagccaaaacctgacttggcagggtttggtttg

SEQ ID NO: 397835 - DNA, 34 bp, Artificial Sequence
  Description of Artificial Sequence: Synthetic oligonucleotide
ttagccaaaacctgacttggcagggtttggtttg

SEQ ID NO: 397836 - DNA, 33 bp, Artificial Sequence
  Description of Artificial Sequence: Synthetic oligonucleotide
tagccaaaacctgacttggcagggtttggtttg

SEQ ID NO: 397837 - DNA, 32 bp, Artificial Sequence
  Description of Artificial Sequence: Synthetic oligonucleotide
agccaaaacctgacttggcagggtttggtttg

SEQ ID NO: 397838 - DNA, 33 bp, Artificial Sequence
  Description of Artificial Sequence: Synthetic oligonucleotide
ttggcagggtttggtttgggtgtcttcagattg

SEQ ID NO: 397839 - DNA, 32 bp, Artificial Sequence
  Description of Artificial Sequence: Synthetic oligonucleotide
tggcagggtttggtttgggtgtcttcagattg

SEQ ID NO: 397840 - DNA, 31 bp, Artificial Sequence
  Description of Artificial Sequence: Synthetic oligonucleotide
ggcagggtttggtttgggtgtcttcagattg

SEQ ID NO: 397841 - DNA, 31 bp, Artificial Sequence
  Description of Artificial Sequence: Synthetic oligonucleotide
gcagggtttggtttgggtgtcttcagattgc

SEQ ID NO: 397842 - DNA, 31 bp, Artificial Sequence
  Description of Artificial Sequence: Synthetic oligonucleotide
cagggtttggtttgggtgtcttcagattgcc

SEQ ID NO: 397843 - DNA, 33 bp, Artificial Sequence
  Description of Artificial Sequence: Synthetic oligonucleotide
agggtttggtttgggtgtcttcagattgccttg

SEQ ID NO: 397844 - DNA, 32 bp, Artificial Sequence
  Description of Artificial Sequence: Synthetic oligonucleotide
gggtttggtttgggtgtcttcagattgccttg

SEQ ID NO: 397845 - DNA, 33 bp, Artificial Sequence
  Description of Artificial Sequence: Synthetic oligonucleotide
ggtttggtttgggtgtcttcagattgccttgtc

SEQ ID NO: 397846 - DNA, 34 bp, Artificial Sequence
  Description of Artificial Sequence: Synthetic oligonucleotide
gtttggtttgggtgtcttcagattgccttgtctc

SEQ ID NO: 397847 - DNA, 34 bp, Artificial Sequence
  Description of Artificial Sequence: Synthetic oligonucleotide
tttggtttgggtgtcttcagattgccttgtctcg

SEQ ID NO: 397848 - DNA, 33 bp, Artificial Sequence
  Description of Artificial Sequence: Synthetic oligonucleotide
ttggtttgggtgtcttcagattgccttgtctcg

SEQ ID NO: 397849 - DNA, 32 bp, Artificial Sequence
  Description of Artificial Sequence: Synthetic oligonucleotide
tggtttgggtgtcttcagattgccttgtctcg

SEQ ID NO: 397850 - DNA, 31 bp, Artificial Sequence
  Description of Artificial Sequence: Synthetic oligonucleotide
ggtttgggtgtcttcagattgccttgtctcg

SEQ ID NO: 397851 - DNA, 32 bp, Artificial Sequence
  Description of Artificial Sequence: Synthetic oligonucleotide
gtttgggtgtcttcagattgccttgtctcgag

SEQ ID NO: 397852 - DNA, 32 bp, Artificial Sequence
  Description of Artificial Sequence: Synthetic oligonucleotide
tttgggtgtcttcagattgccttgtctcgagg

SEQ ID NO: 397853 - DNA, 31 bp, Artificial Sequence
  Description of Artificial Sequence: Synthetic oligonucleotide
ttgggtgtcttcagattgccttgtctcgagg

SEQ ID NO: 397854 - DNA, 30 bp, Artificial Sequence
  Description of Artificial Sequence: Synthetic oligonucleotide
tgggtgtcttcagattgccttgtctcgagg

SEQ ID NO: 397855 - DNA, 29 bp, Artificial Sequence
  Description of Artificial Sequence: Synthetic oligonucleotide
gggtgtcttcagattgccttgtctcgagg

SEQ ID NO: 397856 - DNA, 30 bp, Artificial Sequence
  Description of Artificial Sequence: Synthetic oligonucleotide
ggtgtcttcagattgccttgtctcgaggtc

SEQ ID NO: 397857 - DNA, 30 bp, Artificial Sequence
  Description of Artificial Sequence: Synthetic oligonucleotide
gtgtcttcagattgccttgtctcgaggtcc

SEQ ID NO: 397858 - DNA, 31 bp, Artificial Sequence
  Description of Artificial Sequence: Synthetic oligonucleotide
tgtcttcagattgccttgtctcgaggtcctc

SEQ ID NO: 397859 - DNA, 30 bp, Artificial Sequence
  Description of Artificial Sequence: Synthetic oligonucleotide
gtcttcagattgccttgtctcgaggtcctc

SEQ ID NO: 397860 - DNA, 31 bp, Artificial Sequence
  Description of Artificial Sequence: Synthetic oligonucleotide
tcttcagattgccttgtctcgaggtcctcac

SEQ ID NO: 397861 - DNA, 30 bp, Artificial Sequence
  Description of Artificial Sequence: Synthetic oligonucleotide
cttcagattgccttgtctcgaggtcctcac

SEQ ID NO: 397862 - DNA, 34 bp, Artificial Sequence
  Description of Artificial Sequence: Synthetic oligonucleotide
ttcagattgccttgtctcgaggtcctcacaattg

SEQ ID NO: 397863 - DNA, 33 bp, Artificial Sequence
  Description of Artificial Sequence: Synthetic oligonucleotide
tcagattgccttgtctcgaggtcctcacaattg

SEQ ID NO: 397864 - DNA, 32 bp, Artificial Sequence
  Description of Artificial Sequence: Synthetic oligonucleotide
cagattgccttgtctcgaggtcctcacaattg

SEQ ID NO: 397865 - DNA, 32 bp, Artificial Sequence
  Description of Artificial Sequence: Synthetic oligonucleotide
agattgccttgtctcgaggtcctcacaattgc

SEQ ID NO: 397866 - DNA, 31 bp, Artificial Sequence
  Description of Artificial Sequence: Synthetic oligonucleotide
gattgccttgtctcgaggtcctcacaattgc

SEQ ID NO: 397867 - DNA, 32 bp, Artificial Sequence
  Description of Artificial Sequence: Synthetic oligonucleotide
attgccttgtctcgaggtcctcacaattgctc

SEQ ID NO: 397868 - DNA, 31 bp, Artificial Sequence
  Description of Artificial Sequence: Synthetic oligonucleotide
ttgccttgtctcgaggtcctcacaattgctc

SEQ ID NO: 397869 - DNA, 30 bp, Artificial Sequence
  Description of Artificial Sequence: Synthetic oligonucleotide
tgccttgtctcgaggtcctcacaattgctc

SEQ ID NO: 397870 - DNA, 29 bp, Artificial Sequence
  Description of Artificial Sequence: Synthetic oligonucleotide
gccttgtctcgaggtcctcacaattgctc

SEQ ID NO: 397871 - DNA, 31 bp, Artificial Sequence
  Description of Artificial Sequence: Synthetic oligonucleotide
ccttgtctcgaggtcctcacaattgctctac

SEQ ID NO: 397872 - DNA, 33 bp, Artificial Sequence
  Description of Artificial Sequence: Synthetic oligonucleotide
cttgtctcgaggtcctcacaattgctctacaac

SEQ ID NO: 397873 - DNA, 34 bp, Artificial Sequence
  Description of Artificial Sequence: Synthetic oligonucleotide
ttgtctcgaggtcctcacaattgctctacaactc

SEQ ID NO: 397874 - DNA, 33 bp, Artificial Sequence
  Description of Artificial Sequence: Synthetic oligonucleotide
tgtctcgaggtcctcacaattgctctacaactc

SEQ ID NO: 397875 - DNA, 32 bp, Artificial Sequence
  Description of Artificial Sequence: Synthetic oligonucleotide
gtctcgaggtcctcacaattgctctacaactc

SEQ ID NO: 397876 - DNA, 33 bp, Artificial Sequence
  Description of Artificial Sequence: Synthetic oligonucleotide
tctcgaggtcctcacaattgctctacaactcag

SEQ ID NO: 397877 - DNA, 32 bp, Artificial Sequence
  Description of Artificial Sequence: Synthetic oligonucleotide
ctcgaggtcctcacaattgctctacaactcag

SEQ ID NO: 397878 - DNA, 34 bp, Artificial Sequence
  Description of Artificial Sequence: Synthetic oligonucleotide
tcgaggtcctcacaattgctctacaactcagaac

SEQ ID NO: 397879 - DNA, 33 bp, Artificial Sequence
  Description of Artificial Sequence: Synthetic oligonucleotide
cgaggtcctcacaattgctctacaactcagaac

SEQ ID NO: 397880 - DNA, 34 bp, Artificial Sequence
  Description of Artificial Sequence: Synthetic oligonucleotide
gaggtcctcacaattgctctacaactcagaacag

SEQ ID NO: 397881 - DNA, 34 bp, Artificial Sequence
  Description of Artificial Sequence: Synthetic oligonucleotide
aggtcctcacaattgctctacaactcagaacagc

SEQ ID NO: 397882 - DNA, 33 bp, Artificial Sequence
  Description of Artificial Sequence: Synthetic oligonucleotide
ggtcctcacaattgctctacaactcagaacagc

SEQ ID NO: 397883 - DNA, 35 bp, Artificial Sequence
  Description of Artificial Sequence: Synthetic oligonucleotide
gtcctcacaattgctctacaactcagaacagcaac

SEQ ID NO: 397884 - DNA, 36 bp, Artificial Sequence
  Description of Artificial Sequence: Synthetic oligonucleotide
tcctcacaattgctctacaactcagaacagcaactg

SEQ ID NO: 397885 - DNA, 35 bp, Artificial Sequence
  Description of Artificial Sequence: Synthetic oligonucleotide
cctcacaattgctctacaactcagaacagcaactg

SEQ ID NO: 397886 - DNA, 35 bp, Artificial Sequence
  Description of Artificial Sequence: Synthetic oligonucleotide
ctcacaattgctctacaactcagaacagcaactgc

SEQ ID NO: 397887 - DNA, 38 bp, Artificial Sequence
  Description of Artificial Sequence: Synthetic oligonucleotide
tcacaattgctctacaactcagaacagcaactgctaag

SEQ ID NO: 397888 - DNA, 37 bp, Artificial Sequence
  Description of Artificial Sequence: Synthetic oligonucleotide
cacaattgctctacaactcagaacagcaactgctaag

SEQ ID NO: 397889 - DNA, 37 bp, Artificial Sequence
  Description of Artificial Sequence: Synthetic oligonucleotide
acaattgctctacaactcagaacagcaactgctaagg

SEQ ID NO: 397890 - DNA, 36 bp, Artificial Sequence
  Description of Artificial Sequence: Synthetic oligonucleotide
caattgctctacaactcagaacagcaactgctaagg

SEQ ID NO: 397891 - DNA, 36 bp, Artificial Sequence
  Description of Artificial Sequence: Synthetic oligonucleotide
aattgctctacaactcagaacagcaactgctaaggc

SEQ ID NO: 397892 - DNA, 35 bp, Artificial Sequence
  Description of Artificial Sequence: Synthetic oligonucleotide
attgctctacaactcagaacagcaactgctaaggc

SEQ ID NO: 397893 - DNA, 34 bp, Artificial Sequence
  Description of Artificial Sequence: Synthetic oligonucleotide
ttgctctacaactcagaacagcaactgctaaggc

SEQ ID NO: 397894 - DNA, 33 bp, Artificial Sequence
  Description of Artificial Sequence: Synthetic oligonucleotide
tgctctacaactcagaacagcaactgctaaggc

SEQ ID NO: 397895 - DNA, 32 bp, Artificial Sequence
  Description of Artificial Sequence: Synthetic oligonucleotide
gctctacaactcagaacagcaactgctaaggc

SEQ ID NO: 397896 - DNA, 33 bp, Artificial Sequence
  Description of Artificial Sequence: Synthetic oligonucleotide
ctctacaactcagaacagcaactgctaaggctg

SEQ ID NO: 397897 - DNA, 33 bp, Artificial Sequence
  Description of Artificial Sequence: Synthetic oligonucleotide
tctacaactcagaacagcaactgctaaggctgc

SEQ ID NO: 397898 - DNA, 32 bp, Artificial Sequence
  Description of Artificial Sequence: Synthetic oligonucleotide
ctacaactcagaacagcaactgctaaggctgc

SEQ ID NO: 397899 - DNA, 32 bp, Artificial Sequence
  Description of Artificial Sequence: Synthetic oligonucleotide
tacaactcagaacagcaactgctaaggctgcc

SEQ ID NO: 397900 - DNA, 31 bp, Artificial Sequence
  Description of Artificial Sequence: Synthetic oligonucleotide
acaactcagaacagcaactgctaaggctgcc

SEQ ID NO: 397901 - DNA, 30 bp, Artificial Sequence
  Description of Artificial Sequence: Synthetic oligonucleotide
caactcagaacagcaactgctaaggctgcc

SEQ ID NO: 397902 - DNA, 32 bp, Artificial Sequence
  Description of Artificial Sequence: Synthetic oligonucleotide
aactcagaacagcaactgctaaggctgccttg

SEQ ID NO: 397903 - DNA, 31 bp, Artificial Sequence
  Description of Artificial Sequence: Synthetic oligonucleotide
actcagaacagcaactgctaaggctgccttg

SEQ ID NO: 397904 - DNA, 30 bp, Artificial Sequence
  Description of Artificial Sequence: Synthetic oligonucleotide
ctcagaacagcaactgctaaggctgccttg

SEQ ID NO: 397905 - DNA, 30 bp, Artificial Sequence
  Description of Artificial Sequence: Synthetic oligonucleotide
tcagaacagcaactgctaaggctgccttgg

SEQ ID NO: 397906 - DNA, 29 bp, Artificial Sequence
  Description of Artificial Sequence: Synthetic oligonucleotide
cagaacagcaactgctaaggctgccttgg

SEQ ID NO: 397907 - DNA, 29 bp, Artificial Sequence
  Description of Artificial Sequence: Synthetic oligonucleotide
agaacagcaactgctaaggctgccttggg

SEQ ID NO: 397908 - DNA, 28 bp, Artificial Sequence
  Description of Artificial Sequence: Synthetic oligonucleotide
gaacagcaactgctaaggctgccttggg

SEQ ID NO: 397909 - DNA, 30 bp, Artificial Sequence
  Description of Artificial Sequence: Synthetic oligonucleotide
aacagcaactgctaaggctgccttgggaag

SEQ ID NO: 397910 - DNA, 29 bp, Artificial Sequence
  Description of Artificial Sequence: Synthetic oligonucleotide
acagcaactgctaaggctgccttgggaag

SEQ ID NO: 397911 - DNA, 28 bp, Artificial Sequence
  Description of Artificial Sequence: Synthetic oligonucleotide
cagcaactgctaaggctgccttgggaag

SEQ ID NO: 397912 - DNA, 29 bp, Artificial Sequence
  Description of Artificial Sequence: Synthetic oligonucleotide
agcaactgctaaggctgccttgggaagag

SEQ ID NO: 397913 - DNA, 28 bp, Artificial Sequence
  Description of Artificial Sequence: Synthetic oligonucleotide
gcaactgctaaggctgccttgggaagag

SEQ ID NO: 397914 - DNA, 28 bp, Artificial Sequence
  Description of Artificial Sequence: Synthetic oligonucleotide
caactgctaaggctgccttgggaagagg

SEQ ID NO: 397915 - DNA, 30 bp, Artificial Sequence
  Description of Artificial Sequence: Synthetic oligonucleotide
aactgctaaggctgccttgggaagaggatg

SEQ ID NO: 397916 - DNA, 29 bp, Artificial Sequence
  Description of Artificial Sequence: Synthetic oligonucleotide
actgctaaggctgccttgggaagaggatg

SEQ ID NO: 397917 - DNA, 28 bp, Artificial Sequence
  Description of Artificial Sequence: Synthetic oligonucleotide
ctgctaaggctgccttgggaagaggatg

SEQ ID NO: 397918 - DNA, 30 bp, Artificial Sequence
  Description of Artificial Sequence: Synthetic oligonucleotide
tgctaaggctgccttgggaagaggatgatc

SEQ ID NO: 397919 - DNA, 29 bp, Artificial Sequence
  Description of Artificial Sequence: Synthetic oligonucleotide
gctaaggctgccttgggaagaggatgatc

SEQ ID NO: 397920 - DNA, 29 bp, Artificial Sequence
  Description of Artificial Sequence: Synthetic oligonucleotide
ctaaggctgccttgggaagaggatgatcc

SEQ ID NO: 397921 - DNA, 33 bp, Artificial Sequence
  Description of Artificial Sequence: Synthetic oligonucleotide
taaggctgccttgggaagaggatgatcctaaac

SEQ ID NO: 397922 - DNA, 32 bp, Artificial Sequence
  Description of Artificial Sequence: Synthetic oligonucleotide
aaggctgccttgggaagaggatgatcctaaac

SEQ ID NO: 397923 - DNA, 33 bp, Artificial Sequence; identical to SEQ ID NO: 57610
  Description of Artificial Sequence: Synthetic oligonucleotide

SEQ ID NO: 397924 - DNA, 32 bp, Artificial Sequence; identical to SEQ ID NO: 57611
  Description of Artificial Sequence: Synthetic oligonucleotide

SEQ ID NO: 397925 - DNA, 31 bp, Artificial Sequence; identical to SEQ ID NO: 57612
  Description of Artificial Sequence: Synthetic oligonucleotide

SEQ ID NO: 397926 - DNA, 31 bp, Artificial Sequence; identical to SEQ ID NO: 57613
  Description of Artificial Sequence: Synthetic oligonucleotide

SEQ ID NO: 397927 - DNA, 30 bp, Artificial Sequence; identical to SEQ ID NO: 57614
  Description of Artificial Sequence: Synthetic oligonucleotide

SEQ ID NO: 397928 - DNA, 31 bp, Artificial Sequence; identical to SEQ ID NO: 57615
  Description of Artificial Sequence: Synthetic oligonucleotide

SEQ ID NO: 397929 - DNA, 30 bp, Artificial Sequence; identical to SEQ ID NO: 57616
  Description of Artificial Sequence: Synthetic oligonucleotide

SEQ ID NO: 397930 - DNA, 29 bp, Artificial Sequence
  Description of Artificial Sequence: Synthetic oligonucleotide
tgtggctgaccacgttgcctcttatggtg

SEQ ID NO: 397931 - DNA, 28 bp, Artificial Sequence
  Description of Artificial Sequence: Synthetic oligonucleotide
gtggctgaccacgttgcctcttatggtg

SEQ ID NO: 397932 - DNA, 32 bp, Artificial Sequence; identical to SEQ ID NO: 57619
  Description of Artificial Sequence: Synthetic oligonucleotide

SEQ ID NO: 397933 - DNA, 31 bp, Artificial Sequence; identical to SEQ ID NO: 57620
  Description of Artificial Sequence: Synthetic oligonucleotide

SEQ ID NO: 397934 - DNA, 33 bp, Artificial Sequence; identical to SEQ ID NO: 57621
  Description of Artificial Sequence: Synthetic oligonucleotide

SEQ ID NO: 397935 - DNA, 35 bp, Artificial Sequence; identical to SEQ ID NO: 57622
  Description of Artificial Sequence: Synthetic oligonucleotide

SEQ ID NO: 397936 - DNA, 35 bp, Artificial Sequence; identical to SEQ ID NO: 57623
  Description of Artificial Sequence: Synthetic oligonucleotide

SEQ ID NO: 397937 - DNA, 34 bp, Artificial Sequence; identical to SEQ ID NO: 57624
  Description of Artificial Sequence: Synthetic oligonucleotide

SEQ ID NO: 397938 - DNA, 35 bp, Artificial Sequence; identical to SEQ ID NO: 57625
  Description of Artificial Sequence: Synthetic oligonucleotide

SEQ ID NO: 397939 - DNA, 34 bp, Artificial Sequence; identical to SEQ ID NO: 57626
  Description of Artificial Sequence: Synthetic oligonucleotide

SEQ ID NO: 397940 - DNA, 35 bp, Artificial Sequence; identical to SEQ ID NO: 57627
  Description of Artificial Sequence: Synthetic oligonucleotide

SEQ ID NO: 397941 - DNA, 38 bp, Artificial Sequence; identical to SEQ ID NO: 57628
  Description of Artificial Sequence: Synthetic oligonucleotide

SEQ ID NO: 397942 - DNA, 37 bp, Artificial Sequence; identical to SEQ ID NO: 57629
  Description of Artificial Sequence: Synthetic oligonucleotide

SEQ ID NO: 397943 - DNA, 38 bp, Artificial Sequence; identical to SEQ ID NO: 57630
  Description of Artificial Sequence: Synthetic oligonucleotide

SEQ ID NO: 397944 - DNA, 37 bp, Artificial Sequence; identical to SEQ ID NO: 57631
  Description of Artificial Sequence: Synthetic oligonucleotide

SEQ ID NO: 397945 - DNA, 37 bp, Artificial Sequence; identical to SEQ ID NO: 57632
  Description of Artificial Sequence: Synthetic oligonucleotide

SEQ ID NO: 397946 - DNA, 37 bp, Artificial Sequence; identical to SEQ ID NO: 57633
  Description of Artificial Sequence: Synthetic oligonucleotide

SEQ ID NO: 397947 - DNA, 36 bp, Artificial Sequence; identical to SEQ ID NO: 57634
  Description of Artificial Sequence: Synthetic oligonucleotide

SEQ ID NO: 397948 - DNA, 41 bp, Artificial Sequence; identical to SEQ ID NO: 57635
  Description of Artificial Sequence: Synthetic oligonucleotide

SEQ ID NO: 397949 - DNA, 40 bp, Artificial Sequence; identical to SEQ ID NO: 57636
  Description of Artificial Sequence: Synthetic oligonucleotide

SEQ ID NO: 397950 - DNA, 39 bp, Artificial Sequence; identical to SEQ ID NO: 57637
  Description of Artificial Sequence: Synthetic oligonucleotide

SEQ ID NO: 397951 - DNA, 38 bp, Artificial Sequence; identical to SEQ ID NO: 57638
  Description of Artificial Sequence: Synthetic oligonucleotide

SEQ ID NO: 397952 - DNA, 38 bp, Artificial Sequence; identical to SEQ ID NO: 57639
  Description of Artificial Sequence: Synthetic oligonucleotide

SEQ ID NO: 397953 - DNA, 39 bp, Artificial Sequence; identical to SEQ ID NO: 57640
  Description of Artificial Sequence: Synthetic oligonucleotide

SEQ ID NO: 397954 - DNA, 40 bp, Artificial Sequence; identical to SEQ ID NO: 57641
  Description of Artificial Sequence: Synthetic oligonucleotide

SEQ ID NO: 397955 - DNA, 39 bp, Artificial Sequence; identical to SEQ ID NO: 57642
  Description of Artificial Sequence: Synthetic oligonucleotide

SEQ ID NO: 397956 - DNA, 40 bp, Artificial Sequence; identical to SEQ ID NO: 57643
  Description of Artificial Sequence: Synthetic oligonucleotide

SEQ ID NO: 397957 - DNA, 39 bp, Artificial Sequence; identical to SEQ ID NO: 57644
  Description of Artificial Sequence: Synthetic oligonucleotide

SEQ ID NO: 397958 - DNA, 38 bp, Artificial Sequence; identical to SEQ ID NO: 57645
  Description of Artificial Sequence: Synthetic oligonucleotide

SEQ ID NO: 397959 - DNA, 41 bp, Artificial Sequence; identical to SEQ ID NO: 57646
  Description of Artificial Sequence: Synthetic oligonucleotide

SEQ ID NO: 397960 - DNA, 40 bp, Artificial Sequence; identical to SEQ ID NO: 57647
  Description of Artificial Sequence: Synthetic oligonucleotide

SEQ ID NO: 397961 - DNA, 42 bp, Artificial Sequence; identical to SEQ ID NO: 57648
  Description of Artificial Sequence: Synthetic oligonucleotide

SEQ ID NO: 397962 - DNA, 41 bp, Artificial Sequence; identical to SEQ ID NO: 57649
  Description of Artificial Sequence: Synthetic oligonucleotide

SEQ ID NO: 397963 - DNA, 41 bp, Artificial Sequence; identical to SEQ ID NO: 57650
  Description of Artificial Sequence: Synthetic oligonucleotide

SEQ ID NO: 397964 - DNA, 40 bp, Artificial Sequence; identical to SEQ ID NO: 57651
  Description of Artificial Sequence: Synthetic oligonucleotide

SEQ ID NO: 397965 - DNA, 40 bp, Artificial Sequence; identical to SEQ ID NO: 57652
  Description of Artificial Sequence: Synthetic oligonucleotide

SEQ ID NO: 397966 - DNA, 39 bp, Artificial Sequence; identical to SEQ ID NO: 57653
  Description of Artificial Sequence: Synthetic oligonucleotide

SEQ ID NO: 397967 - DNA, 38 bp, Artificial Sequence; identical to SEQ ID NO: 57654
  Description of Artificial Sequence: Synthetic oligonucleotide

SEQ ID NO: 397968 - DNA, 37 bp, Artificial Sequence; identical to SEQ ID NO: 57655
  Description of Artificial Sequence: Synthetic oligonucleotide

SEQ ID NO: 397969 - DNA, 36 bp, Artificial Sequence; identical to SEQ ID NO: 57656
  Description of Artificial Sequence: Synthetic oligonucleotide

SEQ ID NO: 397970 - DNA, 35 bp, Artificial Sequence; identical to SEQ ID NO: 57657
  Description of Artificial Sequence: Synthetic oligonucleotide

SEQ ID NO: 397971 - DNA, 34 bp, Artificial Sequence; identical to SEQ ID NO: 57658
  Description of Artificial Sequence: Synthetic oligonucleotide

SEQ ID NO: 397972 - DNA, 35 bp, Artificial Sequence; identical to SEQ ID NO: 57659
  Description of Artificial Sequence: Synthetic oligonucleotide

SEQ ID NO: 397973 - DNA, 34 bp, Artificial Sequence; identical to SEQ ID NO: 57660
  Description of Artificial Sequence: Synthetic oligonucleotide

SEQ ID NO: 397974 - DNA, 33 bp, Artificial Sequence; identical to SEQ ID NO: 57661
  Description of Artificial Sequence: Synthetic oligonucleotide

SEQ ID NO: 397975 - DNA, 32 bp, Artificial Sequence; identical to SEQ ID NO: 57662
  Description of Artificial Sequence: Synthetic oligonucleotide

SEQ ID NO: 397976 - DNA, 31 bp, Artificial Sequence; identical to SEQ ID NO: 57663
  Description of Artificial Sequence: Synthetic oligonucleotide

SEQ ID NO: 397977 - DNA, 32 bp, Artificial Sequence; identical to SEQ ID NO: 57664
  Description of Artificial Sequence: Synthetic oligonucleotide

SEQ ID NO: 397978 - DNA, 31 bp, Artificial Sequence; identical to SEQ ID NO: 57665
  Description of Artificial Sequence: Synthetic oligonucleotide

SEQ ID NO: 397979 - DNA, 31 bp, Artificial Sequence; identical to SEQ ID NO: 57666
  Description of Artificial Sequence: Synthetic oligonucleotide

SEQ ID NO: 397980 - DNA, 36 bp, Artificial Sequence; identical to SEQ ID NO: 57667
  Description of Artificial Sequence: Synthetic oligonucleotide

SEQ ID NO: 397981 - DNA, 32 bp, Artificial Sequence; identical to SEQ ID NO: 57668
  Description of Artificial Sequence: Synthetic oligonucleotide

SEQ ID NO: 397982 - DNA, 31 bp, Artificial Sequence; identical to SEQ ID NO: 57669
  Description of Artificial Sequence: Synthetic oligonucleotide

SEQ ID NO: 397983 - DNA, 30 bp, Artificial Sequence; identical to SEQ ID NO: 57670
  Description of Artificial Sequence: Synthetic oligonucleotide

SEQ ID NO: 397984 - DNA, 31 bp, Artificial Sequence; identical to SEQ ID NO: 57671
  Description of Artificial Sequence: Synthetic oligonucleotide

SEQ ID NO: 397985 - DNA, 30 bp, Artificial Sequence; identical to SEQ ID NO: 57672
  Description of Artificial Sequence: Synthetic oligonucleotide

SEQ ID NO: 397986 - DNA, 29 bp, Artificial Sequence
  Description of Artificial Sequence: Synthetic oligonucleotide
cagttacctcaccctcctcccttcttctg

SEQ ID NO: 397987 - DNA, 30 bp, Artificial Sequence; identical to SEQ ID NO: 57674
  Description of Artificial Sequence: Synthetic oligonucleotide

SEQ ID NO: 397988 - DNA, 29 bp, Artificial Sequence
  Description of Artificial Sequence: Synthetic oligonucleotide
gttacctcaccctcctcccttcttctgag

SEQ ID NO: 397989 - DNA, 29 bp, Artificial Sequence
  Description of Artificial Sequence: Synthetic oligonucleotide
ttacctcaccctcctcccttcttctgagg

SEQ ID NO: 397990 - DNA, 28 bp, Artificial Sequence
  Description of Artificial Sequence: Synthetic oligonucleotide
tacctcaccctcctcccttcttctgagg

SEQ ID NO: 397991 - DNA, 27 bp, Artificial Sequence
  Description of Artificial Sequence: Synthetic oligonucleotide
acctcaccctcctcccttcttctgagg

SEQ ID NO: 397992 - DNA, 27 bp, Artificial Sequence
  Description of Artificial Sequence: Synthetic oligonucleotide
cctcaccctcctcccttcttctgagga

SEQ ID NO: 397993 - DNA, 27 bp, Artificial Sequence
  Description of Artificial Sequence: Synthetic oligonucleotide
ctcaccctcctcccttcttctgaggag

SEQ ID NO: 397994 - DNA, 28 bp, Artificial Sequence
  Description of Artificial Sequence: Synthetic oligonucleotide
tcaccctcctcccttcttctgaggagag

SEQ ID NO: 397995 - DNA, 27 bp, Artificial Sequence
  Description of Artificial Sequence: Synthetic oligonucleotide
caccctcctcccttcttctgaggagag

SEQ ID NO: 397996 - DNA, 31 bp, Artificial Sequence; identical to SEQ ID NO: 57683
  Description of Artificial Sequence: Synthetic oligonucleotide

SEQ ID NO: 397997 - DNA, 30 bp, Artificial Sequence; identical to SEQ ID NO: 57684
  Description of Artificial Sequence: Synthetic oligonucleotide

SEQ ID NO: 397998 - DNA, 31 bp, Artificial Sequence; identical to SEQ ID NO: 57685
  Description of Artificial Sequence: Synthetic oligonucleotide

SEQ ID NO: 397999 - DNA, 32 bp, Artificial Sequence; identical to SEQ ID NO: 57686
  Description of Artificial Sequence: Synthetic oligonucleotide

SEQ ID NO: 398000 - DNA, 32 bp, Artificial Sequence; identical to SEQ ID NO: 57687
  Description of Artificial Sequence: Synthetic oligonucleotide

SEQ ID NO: 398001 - DNA, 31 bp, Artificial Sequence; identical to SEQ ID NO: 57688
  Description of Artificial Sequence: Synthetic oligonucleotide

SEQ ID NO: 398002 - DNA, 33 bp, Artificial Sequence; identical to SEQ ID NO: 57689
  Description of Artificial Sequence: Synthetic oligonucleotide

SEQ ID NO: 398003 - DNA, 33 bp, Artificial Sequence; identical to SEQ ID NO: 57690
  Description of Artificial Sequence: Synthetic oligonucleotide

SEQ ID NO: 398004 - DNA, 32 bp, Artificial Sequence; identical to SEQ ID NO: 57691
  Description of Artificial Sequence: Synthetic oligonucleotide

SEQ ID NO: 398005 - DNA, 33 bp, Artificial Sequence; identical to SEQ ID NO: 57692
  Description of Artificial Sequence: Synthetic oligonucleotide

SEQ ID NO: 398006 - DNA, 33 bp, Artificial Sequence; identical to SEQ ID NO: 57693
  Description of Artificial Sequence: Synthetic oligonucleotide

SEQ ID NO: 398007 - DNA, 34 bp, Artificial Sequence; identical to SEQ ID NO: 57694
  Description of Artificial Sequence: Synthetic oligonucleotide

SEQ ID NO: 398008 - DNA, 33 bp, Artificial Sequence; identical to SEQ ID NO: 57695
  Description of Artificial Sequence: Synthetic oligonucleotide

SEQ ID NO: 398009 - DNA, 32 bp, Artificial Sequence; identical to SEQ ID NO: 57696
  Description of Artificial Sequence: Synthetic oligonucleotide

SEQ ID NO: 398010 - DNA, 32 bp, Artificial Sequence; identical to SEQ ID NO: 57697
  Description of Artificial Sequence: Synthetic oligonucleotide

SEQ ID NO: 398011 - DNA, 31 bp, Artificial Sequence; identical to SEQ ID NO: 57698
  Description of Artificial Sequence: Synthetic oligonucleotide

SEQ ID NO: 398012 - DNA, 37 bp, Artificial Sequence; identical to SEQ ID NO: 57699
  Description of Artificial Sequence: Synthetic oligonucleotide

SEQ ID NO: 398013 - DNA, 38 bp, Artificial Sequence; identical to SEQ ID NO: 57700
  Description of Artificial Sequence: Synthetic oligonucleotide

SEQ ID NO: 398014 - DNA, 37 bp, Artificial Sequence; identical to SEQ ID NO: 57701
  Description of Artificial Sequence: Synthetic oligonucleotide

SEQ ID NO: 398015 - DNA, 38 bp, Artificial Sequence; identical to SEQ ID NO: 57702
  Description of Artificial Sequence: Synthetic oligonucleotide

SEQ ID NO: 398016 - DNA, 37 bp, Artificial Sequence; identical to SEQ ID NO: 57703
  Description of Artificial Sequence: Synthetic oligonucleotide

SEQ ID NO: 398017 - DNA, 36 bp, Artificial Sequence; identical to SEQ ID NO: 57704
  Description of Artificial Sequence: Synthetic oligonucleotide

SEQ ID NO: 398018 - DNA, 35 bp, Artificial Sequence; identical to SEQ ID NO: 57705
  Description of Artificial Sequence: Synthetic oligonucleotide

SEQ ID NO: 398019 - DNA, 34 bp, Artificial Sequence; identical to SEQ ID NO: 57706
  Description of Artificial Sequence: Synthetic oligonucleotide

SEQ ID NO: 398020 - DNA, 34 bp, Artificial Sequence; identical to SEQ ID NO: 57707
  Description of Artificial Sequence: Synthetic oligonucleotide

SEQ ID NO: 398021 - DNA, 34 bp, Artificial Sequence; identical to SEQ ID NO: 57708
  Description of Artificial Sequence: Synthetic oligonucleotide

SEQ ID NO: 398022 - DNA, 33 bp, Artificial Sequence; identical to SEQ ID NO: 57709
  Description of Artificial Sequence: Synthetic oligonucleotide

SEQ ID NO: 398023 - DNA, 33 bp, Artificial Sequence; identical to SEQ ID NO: 57710
  Description of Artificial Sequence: Synthetic oligonucleotide

SEQ ID NO: 398024 - DNA, 32 bp, Artificial Sequence; identical to SEQ ID NO: 57711
  Description of Artificial Sequence: Synthetic oligonucleotide

SEQ ID NO: 398025 - DNA, 31 bp, Artificial Sequence; identical to SEQ ID NO: 57712
  Description of Artificial Sequence: Synthetic oligonucleotide

SEQ ID NO: 398026 - DNA, 30 bp, Artificial Sequence; identical to SEQ ID NO: 57713
  Description of Artificial Sequence: Synthetic oligonucleotide

SEQ ID NO: 398027 - DNA, 29 bp, Artificial Sequence
  Description of Artificial Sequence: Synthetic oligonucleotide
cttgtaccagtcttacggtctctctggcc

SEQ ID NO: 398028 - DNA, 30 bp, Artificial Sequence; identical to SEQ ID NO: 57715
  Description of Artificial Sequence: Synthetic oligonucleotide

SEQ ID NO: 398029 - DNA, 29 bp, Artificial Sequence
  Description of Artificial Sequence: Synthetic oligonucleotide
tgtaccagtcttacggtctctctggccag

SEQ ID NO: 398030 - DNA, 28 bp, Artificial Sequence
  Description of Artificial Sequence: Synthetic oligonucleotide
gtaccagtcttacggtctctctggccag

SEQ ID NO: 398031 - DNA, 30 bp, Artificial Sequence; identical to SEQ ID NO: 57718
  Description of Artificial Sequence: Synthetic oligonucleotide

SEQ ID NO: 398032 - DNA, 29 bp, Artificial Sequence
  Description of Artificial Sequence: Synthetic oligonucleotide
accagtcttacggtctctctggccagtac

SEQ ID NO: 398033 - DNA, 28 bp, Artificial Sequence
  Description of Artificial Sequence: Synthetic oligonucleotide
ccagtcttacggtctctctggccagtac

SEQ ID NO: 398034 - DNA, 29 bp, Artificial Sequence
  Description of Artificial Sequence: Synthetic oligonucleotide
cagtcttacggtctctctggccagtacac

SEQ ID NO: 398035 - DNA, 29 bp, Artificial Sequence
  Description of Artificial Sequence: Synthetic oligonucleotide
agtcttacggtctctctggccagtacacc

SEQ ID NO: 398036 - DNA, 28 bp, Artificial Sequence
  Description of Artificial Sequence: Synthetic oligonucleotide
gtcttacggtctctctggccagtacacc

SEQ ID NO: 398037 - DNA, 28 bp, Artificial Sequence
  Description of Artificial Sequence: Synthetic oligonucleotide
tcttacggtctctctggccagtacaccc

SEQ ID NO: 398038 - DNA, 27 bp, Artificial Sequence
  Description of Artificial Sequence: Synthetic oligonucleotide
cttacggtctctctggccagtacaccc

SEQ ID NO: 398039 - DNA, 29 bp, Artificial Sequence
  Description of Artificial Sequence: Synthetic oligonucleotide
ttacggtctctctggccagtacacccatg

SEQ ID NO: 398040 - DNA, 28 bp, Artificial Sequence
  Description of Artificial Sequence: Synthetic oligonucleotide
tacggtctctctggccagtacacccatg

SEQ ID NO: 398041 - DNA, 27 bp, Artificial Sequence
  Description of Artificial Sequence: Synthetic oligonucleotide
acggtctctctggccagtacacccatg

SEQ ID NO: 398042 - DNA, 27 bp, Artificial Sequence
  Description of Artificial Sequence: Synthetic oligonucleotide
cggtctctctggccagtacacccatga

SEQ ID NO: 398043 - DNA, 31 bp, Artificial Sequence; identical to SEQ ID NO: 57730
  Description of Artificial Sequence: Synthetic oligonucleotide

SEQ ID NO: 398044 - DNA, 33 bp, Artificial Sequence; identical to SEQ ID NO: 57731
  Description of Artificial Sequence: Synthetic oligonucleotide

SEQ ID NO: 398045 - DNA, 33 bp, Artificial Sequence; identical to SEQ ID NO: 57732
  Description of Artificial Sequence: Synthetic oligonucleotide

SEQ ID NO: 398046 - DNA, 32 bp, Artificial Sequence; identical to SEQ ID NO: 57733
  Description of Artificial Sequence: Synthetic oligonucleotide

SEQ ID NO: 398047 - DNA, 33 bp, Artificial Sequence; identical to SEQ ID NO: 57734
  Description of Artificial Sequence: Synthetic oligonucleotide

SEQ ID NO: 398048 - DNA, 36 bp, Artificial Sequence
  Description of Artificial Sequence: Synthetic oligonucleotide
aggttgtaactcagaaaatcctgaaggatgccgtag

SEQ ID NO: 398049 - DNA, 35 bp, Artificial Sequence
  Description of Artificial Sequence: Synthetic oligonucleotide
ggttgtaactcagaaaatcctgaaggatgccgtag

SEQ ID NO: 398050 - DNA, 39 bp, Artificial Sequence
  Description of Artificial Sequence: Synthetic oligonucleotide
gttgtaactcagaaaatcctgaaggatgccgtagaattg

SEQ ID NO: 398051 - DNA, 41 bp, Artificial Sequence
  Description of Artificial Sequence: Synthetic oligonucleotide
ttgtaactcagaaaatcctgaaggatgccgtagaattgatg

SEQ ID NO: 398052 - DNA, 40 bp, Artificial Sequence
  Description of Artificial Sequence: Synthetic oligonucleotide
tgtaactcagaaaatcctgaaggatgccgtagaattgatg

SEQ ID NO: 398053 - DNA, 39 bp, Artificial Sequence
  Description of Artificial Sequence: Synthetic oligonucleotide
gtaactcagaaaatcctgaaggatgccgtagaattgatg

SEQ ID NO: 398054 - DNA, 40 bp, Artificial Sequence
  Description of Artificial Sequence: Synthetic oligonucleotide
taactcagaaaatcctgaaggatgccgtagaattgatgac

SEQ ID NO: 398055 - DNA, 39 bp, Artificial Sequence
  Description of Artificial Sequence: Synthetic oligonucleotide
aactcagaaaatcctgaaggatgccgtagaattgatgac

SEQ ID NO: 398056 - DNA, 38 bp, Artificial Sequence
  Description of Artificial Sequence: Synthetic oligonucleotide
actcagaaaatcctgaaggatgccgtagaattgatgac

SEQ ID NO: 398057 - DNA, 37 bp, Artificial Sequence
  Description of Artificial Sequence: Synthetic oligonucleotide
ctcagaaaatcctgaaggatgccgtagaattgatgac

SEQ ID NO: 398058 - DNA, 39 bp, Artificial Sequence
  Description of Artificial Sequence: Synthetic oligonucleotide
tcagaaaatcctgaaggatgccgtagaattgatgacatc

SEQ ID NO: 398059 - DNA, 38 bp, Artificial Sequence
  Description of Artificial Sequence: Synthetic oligonucleotide
cagaaaatcctgaaggatgccgtagaattgatgacatc

SEQ ID NO: 398060 - DNA, 40 bp, Artificial Sequence
  Description of Artificial Sequence: Synthetic oligonucleotide
agaaaatcctgaaggatgccgtagaattgatgacatcatc

SEQ ID NO: 398061 - DNA, 39 bp, Artificial Sequence
  Description of Artificial Sequence: Synthetic oligonucleotide
gaaaatcctgaaggatgccgtagaattgatgacatcatc

SEQ ID NO: 398062 - DNA, 42 bp, Artificial Sequence
  Description of Artificial Sequence: Synthetic oligonucleotide
aaaatcctgaaggatgccgtagaattgatgacatcatctatc

SEQ ID NO: 398063 - DNA, 41 bp, Artificial Sequence
  Description of Artificial Sequence: Synthetic oligonucleotide
aaatcctgaaggatgccgtagaattgatgacatcatctatc

SEQ ID NO: 398064 - DNA, 40 bp, Artificial Sequence
  Description of Artificial Sequence: Synthetic oligonucleotide
aatcctgaaggatgccgtagaattgatgacatcatctatc

SEQ ID NO: 398065 - DNA, 39 bp, Artificial Sequence
  Description of Artificial Sequence: Synthetic oligonucleotide
atcctgaaggatgccgtagaattgatgacatcatctatc

SEQ ID NO: 398066 - DNA, 38 bp, Artificial Sequence
  Description of Artificial Sequence: Synthetic oligonucleotide
tcctgaaggatgccgtagaattgatgacatcatctatc

SEQ ID NO: 398067 - DNA, 37 bp, Artificial Sequence
  Description of Artificial Sequence: Synthetic oligonucleotide
cctgaaggatgccgtagaattgatgacatcatctatc

SEQ ID NO: 398068 - DNA, 37 bp, Artificial Sequence
  Description of Artificial Sequence: Synthetic oligonucleotide
ctgaaggatgccgtagaattgatgacatcatctatcc

SEQ ID NO: 398069 - DNA, 38 bp, Artificial Sequence
  Description of Artificial Sequence: Synthetic oligonucleotide
tgaaggatgccgtagaattgatgacatcatctatccac

SEQ ID NO: 398070 - DNA, 37 bp, Artificial Sequence
  Description of Artificial Sequence: Synthetic oligonucleotide
gaaggatgccgtagaattgatgacatcatctatccac

SEQ ID NO: 398071 - DNA, 37 bp, Artificial Sequence
  Description of Artificial Sequence: Synthetic oligonucleotide
aaggatgccgtagaattgatgacatcatctatccacg

SEQ ID NO: 398072 - DNA, 36 bp, Artificial Sequence
  Description of Artificial Sequence: Synthetic oligonucleotide
aggatgccgtagaattgatgacatcatctatccacg

SEQ ID NO: 398073 - DNA, 35 bp, Artificial Sequence
  Description of Artificial Sequence: Synthetic oligonucleotide
ggatgccgtagaattgatgacatcatctatccacg

SEQ ID NO: 398074 - DNA, 36 bp, Artificial Sequence
  Description of Artificial Sequence: Synthetic oligonucleotide
gatgccgtagaattgatgacatcatctatccacgag

SEQ ID NO: 398075 - DNA, 36 bp, Artificial Sequence
  Description of Artificial Sequence: Synthetic oligonucleotide
atgccgtagaattgatgacatcatctatccacgagg

SEQ ID NO: 398076 - DNA, 35 bp, Artificial Sequence
  Description of Artificial Sequence: Synthetic oligonucleotide
tgccgtagaattgatgacatcatctatccacgagg

SEQ ID NO: 398077 - DNA, 34 bp, Artificial Sequence
  Description of Artificial Sequence: Synthetic oligonucleotide
gccgtagaattgatgacatcatctatccacgagg

SEQ ID NO: 398078 - DNA, 34 bp, Artificial Sequence
  Description of Artificial Sequence: Synthetic oligonucleotide
ccgtagaattgatgacatcatctatccacgaggc

SEQ ID NO: 398079 - DNA, 35 bp, Artificial Sequence
  Description of Artificial Sequence: Synthetic oligonucleotide
cgtagaattgatgacatcatctatccacgaggctg

SEQ ID NO: 398080 - DNA, 35 bp, Artificial Sequence
  Description of Artificial Sequence: Synthetic oligonucleotide
gtagaattgatgacatcatctatccacgaggctgc

SEQ ID NO: 398081 - DNA, 36 bp, Artificial Sequence
  Description of Artificial Sequence: Synthetic oligonucleotide
tagaattgatgacatcatctatccacgaggctgctc

SEQ ID NO: 398082 - DNA, 35 bp, Artificial Sequence
  Description of Artificial Sequence: Synthetic oligonucleotide
agaattgatgacatcatctatccacgaggctgctc

SEQ ID NO: 398083 - DNA, 34 bp, Artificial Sequence
  Description of Artificial Sequence: Synthetic oligonucleotide
gaattgatgacatcatctatccacgaggctgctc

SEQ ID NO: 398084 - DNA, 35 bp, Artificial Sequence
  Description of Artificial Sequence: Synthetic oligonucleotide
aattgatgacatcatctatccacgaggctgctcag

SEQ ID NO: 398085 - DNA, 34 bp, Artificial Sequence
  Description of Artificial Sequence: Synthetic oligonucleotide
attgatgacatcatctatccacgaggctgctcag

SEQ ID NO: 398086 - DNA, 33 bp, Artificial Sequence
  Description of Artificial Sequence: Synthetic oligonucleotide
ttgatgacatcatctatccacgaggctgctcag

SEQ ID NO: 398087 - DNA, 32 bp, Artificial Sequence
  Description of Artificial Sequence: Synthetic oligonucleotide
tgatgacatcatctatccacgaggctgctcag

SEQ ID NO: 398088 - DNA, 31 bp, Artificial Sequence
  Description of Artificial Sequence: Synthetic oligonucleotide
gatgacatcatctatccacgaggctgctcag

SEQ ID NO: 398089 - DNA, 35 bp, Artificial Sequence
  Description of Artificial Sequence: Synthetic oligonucleotide
atgacatcatctatccacgaggctgctcagaaatg

SEQ ID NO: 398090 - DNA, 34 bp, Artificial Sequence
  Description of Artificial Sequence: Synthetic oligonucleotide
tgacatcatctatccacgaggctgctcagaaatg

SEQ ID NO: 398091 - DNA, 33 bp, Artificial Sequence
  Description of Artificial Sequence: Synthetic oligonucleotide
gacatcatctatccacgaggctgctcagaaatg

SEQ ID NO: 398092 - DNA, 33 bp, Artificial Sequence
  Description of Artificial Sequence: Synthetic oligonucleotide
acatcatctatccacgaggctgctcagaaatgc

SEQ ID NO: 398093 - DNA, 32 bp, Artificial Sequence
  Description of Artificial Sequence: Synthetic oligonucleotide
catcatctatccacgaggctgctcagaaatgc

SEQ ID NO: 398094 - DNA, 32 bp, Artificial Sequence
  Description of Artificial Sequence: Synthetic oligonucleotide
atcatctatccacgaggctgctcagaaatgcc

SEQ ID NO: 398095 - DNA, 27 bp, Artificial Sequence
  Description of Artificial Sequence: Synthetic oligonucleotide
aaaaattagccgggcgtggtggcaggc

SEQ ID NO: 398096 - DNA, 26 bp, Artificial Sequence
  Description of Artificial Sequence: Synthetic oligonucleotide
aaaattagccgggcgtggtggcaggc

SEQ ID NO: 398097 - DNA, 25 bp, Artificial Sequence
  Description of Artificial Sequence: Synthetic oligonucleotide
aaattagccgggcgtggtggcaggc

SEQ ID NO: 398098 - DNA, 24 bp, Artificial Sequence
  Description of Artificial Sequence: Synthetic oligonucleotide
aattagccgggcgtggtggcaggc

SEQ ID NO: 398099 - DNA, 23 bp, Artificial Sequence
  Description of Artificial Sequence: Synthetic oligonucleotide
attagccgggcgtggtggcaggc

SEQ ID NO: 398100 - DNA, 22 bp, Artificial Sequence
  Description of Artificial Sequence: Synthetic oligonucleotide
ttagccgggcgtggtggcaggc

SEQ ID NO: 398101 - DNA, 21 bp, Artificial Sequence
  Description of Artificial Sequence: Synthetic oligonucleotide
tagccgggcgtggtggcaggc

SEQ ID NO: 398102 - DNA, 20 bp, Artificial Sequence
  Description of Artificial Sequence: Synthetic oligonucleotide
agccgggcgtggtggcaggc

SEQ ID NO: 398103 - DNA, 20 bp, Artificial Sequence
  Description of Artificial Sequence: Synthetic oligonucleotide
gccgggcgtggtggcaggct

SEQ ID NO: 398104 - DNA, 20 bp, Artificial Sequence
  Description of Artificial Sequence: Synthetic oligonucleotide
ccgggcgtggtggcaggcgt

SEQ ID NO: 398105 - DNA, 20 bp, Artificial Sequence
  Description of Artificial Sequence: Synthetic oligonucleotide
cgggcgtggtggcaggcgct

SEQ ID NO: 398106 - DNA, 20 bp, Artificial Sequence
  Description of Artificial Sequence: Synthetic oligonucleotide
gggcgtggtggcaggcgcct

SEQ ID NO: 398107 - DNA, 24 bp, Artificial Sequence
  Description of Artificial Sequence: Synthetic oligonucleotide
ggcgtggtggcaggcgcctgtaat

SEQ ID NO: 398108 - DNA, 24 bp, Artificial Sequence
  Description of Artificial Sequence: Synthetic oligonucleotide
gcgtggtggcaggcgcctgtaatc

SEQ ID NO: 398109 - DNA, 24 bp, Artificial Sequence
  Description of Artificial Sequence: Synthetic oligonucleotide
cgtggtggcaggcgcctgtaatcc

SEQ ID NO: 398110 - DNA, 25 bp, Artificial Sequence
  Description of Artificial Sequence: Synthetic oligonucleotide
gtggtggcaggcgcctgtaatccca

SEQ ID NO: 398111 - DNA, 25 bp, Artificial Sequence
  Description of Artificial Sequence: Synthetic oligonucleotide
tggtggcaggcgcctgtaatcccag

SEQ ID NO: 398112 - DNA, 24 bp, Artificial Sequence
  Description of Artificial Sequence: Synthetic oligonucleotide
ggtggcaggcgcctgtaatcccag

SEQ ID NO: 398113 - DNA, 26 bp, Artificial Sequence
  Description of Artificial Sequence: Synthetic oligonucleotide
gtggcaggcgcctgtaatcccagcta

SEQ ID NO: 398114 - DNA, 27 bp, Artificial Sequence
  Description of Artificial Sequence: Synthetic oligonucleotide
tggcaggcgcctgtaatcccagctact

SEQ ID NO: 398115 - DNA, 27 bp, Artificial Sequence
  Description of Artificial Sequence: Synthetic oligonucleotide
ggcaggcgcctgtaatcccagctactt

SEQ ID NO: 398116 - DNA, 27 bp, Artificial Sequence
  Description of Artificial Sequence: Synthetic oligonucleotide
gcaggcgcctgtaatcccagctacttg

SEQ ID NO: 398117 - DNA, 27 bp, Artificial Sequence
  Description of Artificial Sequence: Synthetic oligonucleotide
caggcgcctgtaatcccagctacttgg

SEQ ID NO: 398118 - DNA, 27 bp, Artificial Sequence
  Description of Artificial Sequence: Synthetic oligonucleotide
aggcgcctgtaatcccagctacttggg

SEQ ID NO: 398119 - DNA, 27 bp, Artificial Sequence
  Description of Artificial Sequence: Synthetic oligonucleotide
ggcgcctgtaatcccagctacttggga

SEQ ID NO: 398120 - DNA, 27 bp, Artificial Sequence
  Description of Artificial Sequence: Synthetic oligonucleotide
gcgcctgtaatcccagctacttgggag

SEQ ID NO: 398121 - DNA, 27 bp, Artificial Sequence
  Description of Artificial Sequence: Synthetic oligonucleotide
cgcctgtaatcccagctacttgggagg

SEQ ID NO: 398122 - DNA, 47 bp, Artificial Sequence
  Description of Artificial Sequence: Synthetic oligonucleotide
cctgggtgacagagtgagactacatctcaaaaaaaaaaaaaaaaaag

SEQ ID NO: 398123 - DNA, 50 bp, Artificial Sequence
  Description of Artificial Sequence: Synthetic oligonucleotide
ctgggtgacagagtgagactacatctcaaaaaaaaaaaaaaaaaagaaag

SEQ ID NO: 398124 - DNA, 58 bp, Artificial Sequence
  Description of Artificial Sequence: Synthetic oligonucleotide
tgggtgacagagtgagactacatctcaaaaaaaaaaaaaaaaaagaaagaaaaaaaag

SEQ ID NO: 398125 - DNA, 57 bp, Artificial Sequence
  Description of Artificial Sequence: Synthetic oligonucleotide
gggtgacagagtgagactacatctcaaaaaaaaaaaaaaaaaagaaagaaaaaaaag

SEQ ID NO: 398126 - DNA, 60 bp, Artificial Sequence
  Description of Artificial Sequence: Synthetic oligonucleotide
ggtgacagagtgagactacatctcaaaaaaaaaaaaaaaaaagaaagaaaaaaaagaaaa

SEQ ID NO: 398127 - DNA, 60 bp, Artificial Sequence
  Description of Artificial Sequence: Synthetic oligonucleotide
gtgacagagtgagactacatctcaaaaaaaaaaaaaaaaaagaaagaaaaaaaagaaaag

SEQ ID NO: 398128 - DNA, 60 bp, Artificial Sequence
  Description of Artificial Sequence: Synthetic oligonucleotide
tgacagagtgagactacatctcaaaaaaaaaaaaaaaaaagaaagaaaaaaaagaaaaga

SEQ ID NO: 398129 - DNA, 60 bp, Artificial Sequence
  Description of Artificial Sequence: Synthetic oligonucleotide
gacagagtgagactacatctcaaaaaaaaaaaaaaaaaagaaagaaaaaaaagaaaagaa

SEQ ID NO: 398130 - DNA, 60 bp, Artificial Sequence
  Description of Artificial Sequence: Synthetic oligonucleotide
acagagtgagactacatctcaaaaaaaaaaaaaaaaaagaaagaaaaaaaagaaaagaaa

SEQ ID NO: 398131 - DNA, 60 bp, Artificial Sequence
  Description of Artificial Sequence: Synthetic oligonucleotide
cagagtgagactacatctcaaaaaaaaaaaaaaaaaagaaagaaaaaaaagaaaagaaat

SEQ ID NO: 398132 - DNA, 60 bp, Artificial Sequence
  Description of Artificial Sequence: Synthetic oligonucleotide
agagtgagactacatctcaaaaaaaaaaaaaaaaaagaaagaaaaaaaagaaaagaaatg

SEQ ID NO: 398133 - DNA, 60 bp, Artificial Sequence
  Description of Artificial Sequence: Synthetic oligonucleotide
gagtgagactacatctcaaaaaaaaaaaaaaaaaagaaagaaaaaaaagaaaagaaatgc

SEQ ID NO: 398134 - DNA, 60 bp, Artificial Sequence
  Description of Artificial Sequence: Synthetic oligonucleotide
agtgagactacatctcaaaaaaaaaaaaaaaaaagaaagaaaaaaaagaaaagaaatgcc

SEQ ID NO: 398135 - DNA, 60 bp, Artificial Sequence
  Description of Artificial Sequence: Synthetic oligonucleotide
gtgagactacatctcaaaaaaaaaaaaaaaaaagaaagaaaaaaaagaaaagaaatgccc

SEQ ID NO: 398136 - DNA, 60 bp, Artificial Sequence
  Description of Artificial Sequence: Synthetic oligonucleotide
tgagactacatctcaaaaaaaaaaaaaaaaaagaaagaaaaaaaagaaaagaaatgccca

SEQ ID NO: 398137 - DNA, 60 bp, Artificial Sequence
  Description of Artificial Sequence: Synthetic oligonucleotide
gagactacatctcaaaaaaaaaaaaaaaaaagaaagaaaaaaaagaaaagaaatgcccac

SEQ ID NO: 398138 - DNA, 60 bp, Artificial Sequence
  Description of Artificial Sequence: Synthetic oligonucleotide
agactacatctcaaaaaaaaaaaaaaaaaagaaagaaaaaaaagaaaagaaatgcccacc

SEQ ID NO: 398139 - DNA, 60 bp, Artificial Sequence
  Description of Artificial Sequence: Synthetic oligonucleotide
gactacatctcaaaaaaaaaaaaaaaaaagaaagaaaaaaaagaaaagaaatgcccaccc

SEQ ID NO: 398140 - DNA, 60 bp, Artificial Sequence
  Description of Artificial Sequence: Synthetic oligonucleotide
actacatctcaaaaaaaaaaaaaaaaaagaaagaaaaaaaagaaaagaaatgcccacccc

SEQ ID NO: 398141 - DNA, 59 bp, Artificial Sequence
  Description of Artificial Sequence: Synthetic oligonucleotide
ctacatctcaaaaaaaaaaaaaaaaaagaaagaaaaaaaagaaaagaaatgcccacccc

SEQ ID NO: 398142 - DNA, 60 bp, Artificial Sequence
  Description of Artificial Sequence: Synthetic oligonucleotide
tacatctcaaaaaaaaaaaaaaaaaagaaagaaaaaaaagaaaagaaatgcccacccctc

SEQ ID NO: 398143 - DNA, 59 bp, Artificial Sequence
  Description of Artificial Sequence: Synthetic oligonucleotide
acatctcaaaaaaaaaaaaaaaaaagaaagaaaaaaaagaaaagaaatgcccacccctc

SEQ ID NO: 398144 - DNA, 58 bp, Artificial Sequence
  Description of Artificial Sequence: Synthetic oligonucleotide
catctcaaaaaaaaaaaaaaaaaagaaagaaaaaaaagaaaagaaatgcccacccctc

SEQ ID NO: 398145 - DNA, 60 bp, Artificial Sequence
  Description of Artificial Sequence: Synthetic oligonucleotide
atctcaaaaaaaaaaaaaaaaaagaaagaaaaaaaagaaaagaaatgcccacccctcttg

SEQ ID NO: 398146 - DNA, 59 bp, Artificial Sequence
  Description of Artificial Sequence: Synthetic oligonucleotide
tctcaaaaaaaaaaaaaaaaaagaaagaaaaaaaagaaaagaaatgcccacccctcttg

SEQ ID NO: 398147 - DNA, 58 bp, Artificial Sequence
  Description of Artificial Sequence: Synthetic oligonucleotide
ctcaaaaaaaaaaaaaaaaaagaaagaaaaaaaagaaaagaaatgcccacccctcttg

SEQ ID NO: 398148 - DNA, 58 bp, Artificial Sequence
  Description of Artificial Sequence: Synthetic oligonucleotide
tcaaaaaaaaaaaaaaaaaagaaagaaaaaaaagaaaagaaatgcccacccctcttgc

SEQ ID NO: 398149 - DNA, 57 bp, Artificial Sequence
  Description of Artificial Sequence: Synthetic oligonucleotide
caaaaaaaaaaaaaaaaaagaaagaaaaaaaagaaaagaaatgcccacccctcttgc

SEQ ID NO: 398150 - DNA, 57 bp, Artificial Sequence
  Description of Artificial Sequence: Synthetic oligonucleotide
aaaaaaaaaaaaaaaaaagaaagaaaaaaaagaaaagaaatgcccacccctcttgcc

SEQ ID NO: 398151 - DNA, 56 bp, Artificial Sequence
  Description of Artificial Sequence: Synthetic oligonucleotide
aaaaaaaaaaaaaaaaagaaagaaaaaaaagaaaagaaatgcccacccctcttgcc

SEQ ID NO: 398152 - DNA, 55 bp, Artificial Sequence
  Description of Artificial Sequence: Synthetic oligonucleotide
aaaaaaaaaaaaaaaagaaagaaaaaaaagaaaagaaatgcccacccctcttgcc

SEQ ID NO: 398153 - DNA, 54 bp, Artificial Sequence
  Description of Artificial Sequence: Synthetic oligonucleotide
aaaaaaaaaaaaaaagaaagaaaaaaaagaaaagaaatgcccacccctcttgcc

SEQ ID NO: 398154 - DNA, 53 bp, Artificial Sequence
  Description of Artificial Sequence: Synthetic oligonucleotide
aaaaaaaaaaaaaagaaagaaaaaaaagaaaagaaatgcccacccctcttgcc

SEQ ID NO: 398155 - DNA, 52 bp, Artificial Sequence
  Description of Artificial Sequence: Synthetic oligonucleotide
aaaaaaaaaaaaagaaagaaaaaaaagaaaagaaatgcccacccctcttgcc

SEQ ID NO: 398156 - DNA, 51 bp, Artificial Sequence
  Description of Artificial Sequence: Synthetic oligonucleotide
aaaaaaaaaaaagaaagaaaaaaaagaaaagaaatgcccacccctcttgcc

SEQ ID NO: 398157 - DNA, 50 bp, Artificial Sequence
  Description of Artificial Sequence: Synthetic oligonucleotide
aaaaaaaaaaagaaagaaaaaaaagaaaagaaatgcccacccctcttgcc

SEQ ID NO: 398158 - DNA, 49 bp, Artificial Sequence
  Description of Artificial Sequence: Synthetic oligonucleotide
aaaaaaaaaagaaagaaaaaaaagaaaagaaatgcccacccctcttgcc

SEQ ID NO: 398159 - DNA, 48 bp, Artificial Sequence
  Description of Artificial Sequence: Synthetic oligonucleotide
aaaaaaaaagaaagaaaaaaaagaaaagaaatgcccacccctcttgcc

SEQ ID NO: 398160 - DNA, 47 bp, Artificial Sequence
  Description of Artificial Sequence: Synthetic oligonucleotide
aaaaaaaagaaagaaaaaaaagaaaagaaatgcccacccctcttgcc

SEQ ID NO: 398161 - DNA, 46 bp, Artificial Sequence
  Description of Artificial Sequence: Synthetic oligonucleotide
aaaaaaagaaagaaaaaaaagaaaagaaatgcccacccctcttgcc

SEQ ID NO: 398162 - DNA, 45 bp, Artificial Sequence
  Description of Artificial Sequence: Synthetic oligonucleotide
aaaaaagaaagaaaaaaaagaaaagaaatgcccacccctcttgcc

SEQ ID NO: 398163 - DNA, 44 bp, Artificial Sequence
  Description of Artificial Sequence: Synthetic oligonucleotide
aaaaagaaagaaaaaaaagaaaagaaatgcccacccctcttgcc

SEQ ID NO: 398164 - DNA, 43 bp, Artificial Sequence
  Description of Artificial Sequence: Synthetic oligonucleotide
aaaagaaagaaaaaaaagaaaagaaatgcccacccctcttgcc

SEQ ID NO: 398165 - DNA, 42 bp, Artificial Sequence
  Description of Artificial Sequence: Synthetic oligonucleotide
aaagaaagaaaaaaaagaaaagaaatgcccacccctcttgcc

SEQ ID NO: 398166 - DNA, 41 bp, Artificial Sequence
  Description of Artificial Sequence: Synthetic oligonucleotide
aagaaagaaaaaaaagaaaagaaatgcccacccctcttgcc

SEQ ID NO: 398167 - DNA, 40 bp, Artificial Sequence
  Description of Artificial Sequence: Synthetic oligonucleotide
agaaagaaaaaaaagaaaagaaatgcccacccctcttgcc

SEQ ID NO: 398168 - DNA, 39 bp, Artificial Sequence
  Description of Artificial Sequence: Synthetic oligonucleotide
gaaagaaaaaaaagaaaagaaatgcccacccctcttgcc

SEQ ID NO: 398169 - DNA, 40 bp, Artificial Sequence
  Description of Artificial Sequence: Synthetic oligonucleotide
aaagaaaaaaaagaaaagaaatgcccacccctcttgccac

SEQ ID NO: 398170 - DNA, 39 bp, Artificial Sequence
  Description of Artificial Sequence: Synthetic oligonucleotide
aagaaaaaaaagaaaagaaatgcccacccctcttgccac

SEQ ID NO: 398171 - DNA, 38 bp, Artificial Sequence
  Description of Artificial Sequence: Synthetic oligonucleotide
agaaaaaaaagaaaagaaatgcccacccctcttgccac

SEQ ID NO: 398172 - DNA, 37 bp, Artificial Sequence
  Description of Artificial Sequence: Synthetic oligonucleotide
gaaaaaaaagaaaagaaatgcccacccctcttgccac

SEQ ID NO: 398173 - DNA, 38 bp, Artificial Sequence
  Description of Artificial Sequence: Synthetic oligonucleotide
aaaaaaaagaaaagaaatgcccacccctcttgccactg

SEQ ID NO: 398174 - DNA, 33 bp, Artificial Sequence
  Description of Artificial Sequence: Synthetic oligonucleotide
gatgatcctaaacaaagctctgatgctggggac

SEQ ID NO: 398175 - DNA, 33 bp, Artificial Sequence; identical to SEQ ID NO: 57735
  Description of Artificial Sequence: Synthetic oligonucleotide

SEQ ID NO: 398176 - DNA, 32 bp, Artificial Sequence; identical to SEQ ID NO: 57736
  Description of Artificial Sequence: Synthetic oligonucleotide

SEQ ID NO: 398177 - DNA, 31 bp, Artificial Sequence; identical to SEQ ID NO: 57737
  Description of Artificial Sequence: Synthetic oligonucleotide

SEQ ID NO: 398178 - DNA, 31 bp, Artificial Sequence; identical to SEQ ID NO: 57738
  Description of Artificial Sequence: Synthetic oligonucleotide

SEQ ID NO: 398179 - DNA, 30 bp, Artificial Sequence; identical to SEQ ID NO: 57739
  Description of Artificial Sequence: Synthetic oligonucleotide

SEQ ID NO: 398180 - DNA, 29 bp, Artificial Sequence
  Description of Artificial Sequence: Synthetic oligonucleotide
cctaaacaaagctctgatgctggggaccc

SEQ ID NO: 398181 - DNA, 31 bp, Artificial Sequence; identical to SEQ ID NO: 57741
  Description of Artificial Sequence: Synthetic oligonucleotide

SEQ ID NO: 398182 - DNA, 31 bp, Artificial Sequence; identical to SEQ ID NO: 57742
  Description of Artificial Sequence: Synthetic oligonucleotide

SEQ ID NO: 398183 - DNA, 30 bp, Artificial Sequence; identical to SEQ ID NO: 57743
  Description of Artificial Sequence: Synthetic oligonucleotide

SEQ ID NO: 398184 - DNA, 29 bp, Artificial Sequence
  Description of Artificial Sequence: Synthetic oligonucleotide
aacaaagctctgatgctggggacccttgc

SEQ ID NO: 398185 - DNA, 28 bp, Artificial Sequence
  Description of Artificial Sequence: Synthetic oligonucleotide
acaaagctctgatgctggggacccttgc

SEQ ID NO: 398186 - DNA, 27 bp, Artificial Sequence
  Description of Artificial Sequence: Synthetic oligonucleotide
caaagctctgatgctggggacccttgc

SEQ ID NO: 398187 - DNA, 27 bp, Artificial Sequence
  Description of Artificial Sequence: Synthetic oligonucleotide
aaagctctgatgctggggacccttgcc

SEQ ID NO: 398188 - DNA, 26 bp, Artificial Sequence
  Description of Artificial Sequence: Synthetic oligonucleotide
aagctctgatgctggggacccttgcc

SEQ ID NO: 398189 - DNA, 25 bp, Artificial Sequence
  Description of Artificial Sequence: Synthetic oligonucleotide
agctctgatgctggggacccttgcc

SEQ ID NO: 398190 - DNA, 24 bp, Artificial Sequence
  Description of Artificial Sequence: Synthetic oligonucleotide
gctctgatgctggggacccttgcc

SEQ ID NO: 398191 - DNA, 25 bp, Artificial Sequence
  Description of Artificial Sequence: Synthetic oligonucleotide
ctctgatgctggggacccttgccct

SEQ ID NO: 398192 - DNA, 26 bp, Artificial Sequence
  Description of Artificial Sequence: Synthetic oligonucleotide
tctgatgctggggacccttgccctga

SEQ ID NO: 398193 - DNA, 25 bp, Artificial Sequence
  Description of Artificial Sequence: Synthetic oligonucleotide
ctgatgctggggacccttgccctga

SEQ ID NO: 398194 - DNA, 25 bp, Artificial Sequence
  Description of Artificial Sequence: Synthetic oligonucleotide
tgatgctggggacccttgccctgac

SEQ ID NO: 398195 - DNA, 24 bp, Artificial Sequence
  Description of Artificial Sequence: Synthetic oligonucleotide
gatgctggggacccttgccctgac

SEQ ID NO: 398196 - DNA, 25 bp, Artificial Sequence
  Description of Artificial Sequence: Synthetic oligonucleotide
atgctggggacccttgccctgacca

SEQ ID NO: 398197 - DNA, 24 bp, Artificial Sequence
  Description of Artificial Sequence: Synthetic oligonucleotide
tgctggggacccttgccctgacca

SEQ ID NO: 398198 - DNA, 23 bp, Artificial Sequence
  Description of Artificial Sequence: Synthetic oligonucleotide
gctggggacccttgccctgacca

SEQ ID NO: 398199 - DNA, 23 bp, Artificial Sequence
  Description of Artificial Sequence: Synthetic oligonucleotide
ctggggacccttgccctgaccac

SEQ ID NO: 398200 - DNA, 23 bp, Artificial Sequence
  Description of Artificial Sequence: Synthetic oligonucleotide
tggggacccttgccctgaccacc

SEQ ID NO: 398201 - DNA, 22 bp, Artificial Sequence
  Description of Artificial Sequence: Synthetic oligonucleotide
ggggacccttgccctgaccacc

SEQ ID NO: 398202 - DNA, 23 bp, Artificial Sequence
  Description of Artificial Sequence: Synthetic oligonucleotide
gggacccttgccctgaccaccgt

SEQ ID NO: 398203 - DNA, 25 bp, Artificial Sequence
  Description of Artificial Sequence: Synthetic oligonucleotide
ggacccttgccctgaccaccgtgat

SEQ ID NO: 398204 - DNA, 26 bp, Artificial Sequence
  Description of Artificial Sequence: Synthetic oligonucleotide
gacccttgccctgaccaccgtgatga

SEQ ID NO: 398205 - DNA, 26 bp, Artificial Sequence
  Description of Artificial Sequence: Synthetic oligonucleotide
acccttgccctgaccaccgtgatgag

SEQ ID NO: 398206 - DNA, 29 bp, Artificial Sequence
  Description of Artificial Sequence: Synthetic oligonucleotide
ttatgactgcaaggtggagcactggggac

SEQ ID NO: 398207 - DNA, 28 bp, Artificial Sequence
  Description of Artificial Sequence: Synthetic oligonucleotide
tatgactgcaaggtggagcactggggac

SEQ ID NO: 398208 - DNA, 27 bp, Artificial Sequence
  Description of Artificial Sequence: Synthetic oligonucleotide
atgactgcaaggtggagcactggggac

SEQ ID NO: 398209 - DNA, 27 bp, Artificial Sequence
  Description of Artificial Sequence: Synthetic oligonucleotide
tgactgcaaggtggagcactggggact

SEQ ID NO: 398210 - DNA, 26 bp, Artificial Sequence
  Description of Artificial Sequence: Synthetic oligonucleotide
gactgcaaggtggagcactggggact

SEQ ID NO: 398211 - DNA, 26 bp, Artificial Sequence
  Description of Artificial Sequence: Synthetic oligonucleotide
actgcaaggtggagcactggggactg

SEQ ID NO: 398212 - DNA, 25 bp, Artificial Sequence
  Description of Artificial Sequence: Synthetic oligonucleotide
ctgcaaggtggagcactggggactg

SEQ ID NO: 398213 - DNA, 26 bp, Artificial Sequence
  Description of Artificial Sequence: Synthetic oligonucleotide
tgcaaggtggagcactggggactgga

SEQ ID NO: 398214 - DNA, 25 bp, Artificial Sequence
  Description of Artificial Sequence: Synthetic oligonucleotide
gcaaggtggagcactggggactgga

SEQ ID NO: 398215 - DNA, 27 bp, Artificial Sequence
  Description of Artificial Sequence: Synthetic oligonucleotide
caaggtggagcactggggactggacaa

SEQ ID NO: 398216 - DNA, 27 bp, Artificial Sequence
  Description of Artificial Sequence: Synthetic oligonucleotide
aaggtggagcactggggactggacaag

SEQ ID NO: 398217 - DNA, 26 bp, Artificial Sequence
  Description of Artificial Sequence: Synthetic oligonucleotide
aggtggagcactggggactggacaag

SEQ ID NO: 398218 - DNA, 25 bp, Artificial Sequence
  Description of Artificial Sequence: Synthetic oligonucleotide
ggtggagcactggggactggacaag

SEQ ID NO: 398219 - DNA, 25 bp, Artificial Sequence
  Description of Artificial Sequence: Synthetic oligonucleotide
gtggagcactggggactggacaagc

SEQ ID NO: 398220 - DNA, 26 bp, Artificial Sequence
  Description of Artificial Sequence: Synthetic oligonucleotide
tggagcactggggactggacaagcct

SEQ ID NO: 398221 - DNA, 25 bp, Artificial Sequence
  Description of Artificial Sequence: Synthetic oligonucleotide
ggagcactggggactggacaagcct

SEQ ID NO: 398222 - DNA, 27 bp, Artificial Sequence
  Description of Artificial Sequence: Synthetic oligonucleotide
gagcactggggactggacaagcctctt

SEQ ID NO: 398223 - DNA, 27 bp, Artificial Sequence
  Description of Artificial Sequence: Synthetic oligonucleotide
agcactggggactggacaagcctcttc

SEQ ID NO: 398224 - DNA, 27 bp, Artificial Sequence
  Description of Artificial Sequence: Synthetic oligonucleotide
gcactggggactggacaagcctcttct

SEQ ID NO: 398225 - DNA, 27 bp, Artificial Sequence
  Description of Artificial Sequence: Synthetic oligonucleotide
cactggggactggacaagcctcttctg

SEQ ID NO: 398226 - DNA, 30 bp, Artificial Sequence; identical to SEQ ID NO: 57786
  Description of Artificial Sequence: Synthetic oligonucleotide

SEQ ID NO: 398227 - DNA, 29 bp, Artificial Sequence
  Description of Artificial Sequence: Synthetic oligonucleotide
ctggggactggacaagcctcttctgaaac

SEQ ID NO: 398228 - DNA, 30 bp, Artificial Sequence; identical to SEQ ID NO: 57788
  Description of Artificial Sequence: Synthetic oligonucleotide

SEQ ID NO: 398229 - DNA, 29 bp, Artificial Sequence
  Description of Artificial Sequence: Synthetic oligonucleotide
ggggactggacaagcctcttctgaaacac

SEQ ID NO: 398230 - DNA, 30 bp, Artificial Sequence; identical to SEQ ID NO: 57790
  Description of Artificial Sequence: Synthetic oligonucleotide

SEQ ID NO: 398231 - DNA, 30 bp, Artificial Sequence; identical to SEQ ID NO: 57791
  Description of Artificial Sequence: Synthetic oligonucleotide

SEQ ID NO: 398232 - DNA, 30 bp, Artificial Sequence; identical to SEQ ID NO: 57792
  Description of Artificial Sequence: Synthetic oligonucleotide

SEQ ID NO: 398233 - DNA, 31 bp, Artificial Sequence; identical to SEQ ID NO: 57793
  Description of Artificial Sequence: Synthetic oligonucleotide

SEQ ID NO: 398234 - DNA, 31 bp, Artificial Sequence; identical to SEQ ID NO: 57794
  Description of Artificial Sequence: Synthetic oligonucleotide

SEQ ID NO: 398235 - DNA, 32 bp, Artificial Sequence; identical to SEQ ID NO: 57795
  Description of Artificial Sequence: Synthetic oligonucleotide

SEQ ID NO: 398236 - DNA, 31 bp, Artificial Sequence; identical to SEQ ID NO: 57796
  Description of Artificial Sequence: Synthetic oligonucleotide

SEQ ID NO: 398237 - DNA, 31 bp, Artificial Sequence; identical to SEQ ID NO: 57797
  Description of Artificial Sequence: Synthetic oligonucleotide

SEQ ID NO: 398238 - DNA, 30 bp, Artificial Sequence; identical to SEQ ID NO: 57798
  Description of Artificial Sequence: Synthetic oligonucleotide

SEQ ID NO: 398239 - DNA, 30 bp, Artificial Sequence; identical to SEQ ID NO: 57799
  Description of Artificial Sequence: Synthetic oligonucleotide

SEQ ID NO: 398240 - DNA, 29 bp, Artificial Sequence
  Description of Artificial Sequence: Synthetic oligonucleotide
gtgttttccaagtctcccgtgacagtggg

SEQ ID NO: 398241 - DNA, 30 bp, Artificial Sequence; identical to SEQ ID NO: 57801
  Description of Artificial Sequence: Synthetic oligonucleotide

SEQ ID NO: 398242 - DNA, 29 bp, Artificial Sequence
  Description of Artificial Sequence: Synthetic oligonucleotide
gttttccaagtctcccgtgacagtgggtc

SEQ ID NO: 398243 - DNA, 30 bp, Artificial Sequence; identical to SEQ ID NO: 57803
  Description of Artificial Sequence: Synthetic oligonucleotide

SEQ ID NO: 398244 - DNA, 29 bp, Artificial Sequence
  Description of Artificial Sequence: Synthetic oligonucleotide
tttccaagtctcccgtgacagtgggtcag

SEQ ID NO: 398245 - DNA, 28 bp, Artificial Sequence
  Description of Artificial Sequence: Synthetic oligonucleotide
ttccaagtctcccgtgacagtgggtcag

SEQ ID NO: 398246 - DNA, 27 bp, Artificial Sequence
  Description of Artificial Sequence: Synthetic oligonucleotide
tccaagtctcccgtgacagtgggtcag

SEQ ID NO: 398247 - DNA, 26 bp, Artificial Sequence
  Description of Artificial Sequence: Synthetic oligonucleotide
ccaagtctcccgtgacagtgggtcag

SEQ ID NO: 398248 - DNA, 26 bp, Artificial Sequence
  Description of Artificial Sequence: Synthetic oligonucleotide
caagtctcccgtgacagtgggtcagc

SEQ ID NO: 398249 - DNA, 26 bp, Artificial Sequence
  Description of Artificial Sequence: Synthetic oligonucleotide
aagtctcccgtgacagtgggtcagcc

SEQ ID NO: 398250 - DNA, 25 bp, Artificial Sequence
  Description of Artificial Sequence: Synthetic oligonucleotide
agtctcccgtgacagtgggtcagcc

SEQ ID NO: 398251 - DNA, 24 bp, Artificial Sequence
  Description of Artificial Sequence: Synthetic oligonucleotide
gtctcccgtgacagtgggtcagcc

SEQ ID NO: 398252 - DNA, 26 bp, Artificial Sequence
  Description of Artificial Sequence: Synthetic oligonucleotide
tctcccgtgacagtgggtcagcccaa

SEQ ID NO: 398253 - DNA, 25 bp, Artificial Sequence
  Description of Artificial Sequence: Synthetic oligonucleotide
ctcccgtgacagtgggtcagcccaa

SEQ ID NO: 398254 - DNA, 27 bp, Artificial Sequence
  Description of Artificial Sequence: Synthetic oligonucleotide
tcccgtgacagtgggtcagcccaacat

SEQ ID NO: 398255 - DNA, 26 bp, Artificial Sequence
  Description of Artificial Sequence: Synthetic oligonucleotide
cccgtgacagtgggtcagcccaacat

SEQ ID NO: 398256 - DNA, 26 bp, Artificial Sequence
  Description of Artificial Sequence: Synthetic oligonucleotide
ccgtgacagtgggtcagcccaacatc

SEQ ID NO: 398257 - DNA, 27 bp, Artificial Sequence
  Description of Artificial Sequence: Synthetic oligonucleotide
cgtgacagtgggtcagcccaacatcct

SEQ ID NO: 398258 - DNA, 27 bp, Artificial Sequence
  Description of Artificial Sequence: Synthetic oligonucleotide
gtgacagtgggtcagcccaacatcctc

SEQ ID NO: 398259 - DNA, 29 bp, Artificial Sequence
  Description of Artificial Sequence: Synthetic oligonucleotide
tgacagtgggtcagcccaacatcctcatc

SEQ ID NO: 398260 - DNA, 28 bp, Artificial Sequence
  Description of Artificial Sequence: Synthetic oligonucleotide
gacagtgggtcagcccaacatcctcatc

SEQ ID NO: 398261 - DNA, 29 bp, Artificial Sequence
  Description of Artificial Sequence: Synthetic oligonucleotide
acagtgggtcagcccaacatcctcatctg

SEQ ID NO: 398262 - DNA, 28 bp, Artificial Sequence
  Description of Artificial Sequence: Synthetic oligonucleotide
cagtgggtcagcccaacatcctcatctg

SEQ ID NO: 398263 - DNA, 29 bp, Artificial Sequence
  Description of Artificial Sequence: Synthetic oligonucleotide
agtgggtcagcccaacatcctcatctgtc

SEQ ID NO: 398264 - DNA, 28 bp, Artificial Sequence
  Description of Artificial Sequence: Synthetic oligonucleotide
gtgggtcagcccaacatcctcatctgtc

SEQ ID NO: 398265 - DNA, 26 bp, Artificial Sequence
  Description of Artificial Sequence: Synthetic oligonucleotide
cctgggattgtctgtgggcctcgtgt

SEQ ID NO: 398266 - DNA, 26 bp, Artificial Sequence
  Description of Artificial Sequence: Synthetic oligonucleotide
ctgggattgtctgtgggcctcgtgtg

SEQ ID NO: 398267 - DNA, 27 bp, Artificial Sequence
  Description of Artificial Sequence: Synthetic oligonucleotide
tgggattgtctgtgggcctcgtgtgca

SEQ ID NO: 398268 - DNA, 27 bp, Artificial Sequence
  Description of Artificial Sequence: Synthetic oligonucleotide
gggattgtctgtgggcctcgtgtgcat

SEQ ID NO: 398269 - DNA, 28 bp, Artificial Sequence
  Description of Artificial Sequence: Synthetic oligonucleotide
ggattgtctgtgggcctcgtgtgcattg

SEQ ID NO: 398270 - DNA, 29 bp, Artificial Sequence
  Description of Artificial Sequence: Synthetic oligonucleotide
gattgtctgtgggcctcgtgtgcattgtg

SEQ ID NO: 398271 - DNA, 29 bp, Artificial Sequence
  Description of Artificial Sequence: Synthetic oligonucleotide
attgtctgtgggcctcgtgtgcattgtgg

SEQ ID NO: 398272 - DNA, 28 bp, Artificial Sequence
  Description of Artificial Sequence: Synthetic oligonucleotide
ttgtctgtgggcctcgtgtgcattgtgg

SEQ ID NO: 398273 - DNA, 27 bp, Artificial Sequence
  Description of Artificial Sequence: Synthetic oligonucleotide
tgtctgtgggcctcgtgtgcattgtgg

SEQ ID NO: 398274 - DNA, 27 bp, Artificial Sequence
  Description of Artificial Sequence: Synthetic oligonucleotide
gtctgtgggcctcgtgtgcattgtggt

SEQ ID NO: 398275 - DNA, 27 bp, Artificial Sequence
  Description of Artificial Sequence: Synthetic oligonucleotide
tctgtgggcctcgtgtgcattgtggtg

SEQ ID NO: 398276 - DNA, 26 bp, Artificial Sequence
  Description of Artificial Sequence: Synthetic oligonucleotide
ctgtgggcctcgtgtgcattgtggtg

SEQ ID NO: 398277 - DNA, 26 bp, Artificial Sequence
  Description of Artificial Sequence: Synthetic oligonucleotide
tgtgggcctcgtgtgcattgtggtgg

SEQ ID NO: 398278 - DNA, 25 bp, Artificial Sequence
  Description of Artificial Sequence: Synthetic oligonucleotide
gtgggcctcgtgtgcattgtggtgg

SEQ ID NO: 398279 - DNA, 25 bp, Artificial Sequence
  Description of Artificial Sequence: Synthetic oligonucleotide
tgggcctcgtgtgcattgtggtggg

SEQ ID NO: 398280 - DNA, 24 bp, Artificial Sequence
  Description of Artificial Sequence: Synthetic oligonucleotide
gggcctcgtgtgcattgtggtggg

SEQ ID NO: 398281 - DNA, 25 bp, Artificial Sequence
  Description of Artificial Sequence: Synthetic oligonucleotide
ggcctcgtgtgcattgtggtgggca

SEQ ID NO: 398282 - DNA, 26 bp, Artificial Sequence
  Description of Artificial Sequence: Synthetic oligonucleotide
gcctcgtgtgcattgtggtgggcact

SEQ ID NO: 398283 - DNA, 27 bp, Artificial Sequence
  Description of Artificial Sequence: Synthetic oligonucleotide
cctcgtgtgcattgtggtgggcactgt

SEQ ID NO: 398284 - DNA, 27 bp, Artificial Sequence
  Description of Artificial Sequence: Synthetic oligonucleotide
ctcgtgtgcattgtggtgggcactgtc

SEQ ID NO: 398285 - DNA, 29 bp, Artificial Sequence
  Description of Artificial Sequence: Synthetic oligonucleotide
tcgtgtgcattgtggtgggcactgtcttc

SEQ ID NO: 398286 - DNA, 28 bp, Artificial Sequence
  Description of Artificial Sequence: Synthetic oligonucleotide
cgtgtgcattgtggtgggcactgtcttc

SEQ ID NO: 398287 - DNA, 30 bp, Artificial Sequence; identical to SEQ ID NO: 57847
  Description of Artificial Sequence: Synthetic oligonucleotide

SEQ ID NO: 398288 - DNA, 32 bp, Artificial Sequence; identical to SEQ ID NO: 57848
  Description of Artificial Sequence: Synthetic oligonucleotide

SEQ ID NO: 398289 - DNA, 31 bp, Artificial Sequence; identical to SEQ ID NO: 57849
  Description of Artificial Sequence: Synthetic oligonucleotide

SEQ ID NO: 398290 - DNA, 31 bp, Artificial Sequence; identical to SEQ ID NO: 57850
  Description of Artificial Sequence: Synthetic oligonucleotide

SEQ ID NO: 398291 - DNA, 33 bp, Artificial Sequence; identical to SEQ ID NO: 57851
  Description of Artificial Sequence: Synthetic oligonucleotide

SEQ ID NO: 398292 - DNA, 35 bp, Artificial Sequence; identical to SEQ ID NO: 57852
  Description of Artificial Sequence: Synthetic oligonucleotide

SEQ ID NO: 398293 - DNA, 34 bp, Artificial Sequence; identical to SEQ ID NO: 57853
  Description of Artificial Sequence: Synthetic oligonucleotide

SEQ ID NO: 398294 - DNA, 34 bp, Artificial Sequence; identical to SEQ ID NO: 57854
  Description of Artificial Sequence: Synthetic oligonucleotide

SEQ ID NO: 398295 - DNA, 33 bp, Artificial Sequence; identical to SEQ ID NO: 57855
  Description of Artificial Sequence: Synthetic oligonucleotide

SEQ ID NO: 398296 - DNA, 34 bp, Artificial Sequence; identical to SEQ ID NO: 57856
  Description of Artificial Sequence: Synthetic oligonucleotide

SEQ ID NO: 398297 - DNA, 33 bp, Artificial Sequence; identical to SEQ ID NO: 57857
  Description of Artificial Sequence: Synthetic oligonucleotide

SEQ ID NO: 398298 - DNA, 34 bp, Artificial Sequence; identical to SEQ ID NO: 57858
  Description of Artificial Sequence: Synthetic oligonucleotide

SEQ ID NO: 398299 - DNA, 33 bp, Artificial Sequence; identical to SEQ ID NO: 57859
  Description of Artificial Sequence: Synthetic oligonucleotide

SEQ ID NO: 398300 - DNA, 33 bp, Artificial Sequence; identical to SEQ ID NO: 57860
  Description of Artificial Sequence: Synthetic oligonucleotide

SEQ ID NO: 398301 - DNA, 32 bp, Artificial Sequence; identical to SEQ ID NO: 57861
  Description of Artificial Sequence: Synthetic oligonucleotide

SEQ ID NO: 398302 - DNA, 34 bp, Artificial Sequence; identical to SEQ ID NO: 57862
  Description of Artificial Sequence: Synthetic oligonucleotide

SEQ ID NO: 398303 - DNA, 33 bp, Artificial Sequence; identical to SEQ ID NO: 57863
  Description of Artificial Sequence: Synthetic oligonucleotide

SEQ ID NO: 398304 - DNA, 34 bp, Artificial Sequence; identical to SEQ ID NO: 57864
  Description of Artificial Sequence: Synthetic oligonucleotide

SEQ ID NO: 398305 - DNA, 33 bp, Artificial Sequence; identical to SEQ ID NO: 57865
  Description of Artificial Sequence: Synthetic oligonucleotide

SEQ ID NO: 398306 - DNA, 32 bp, Artificial Sequence; identical to SEQ ID NO: 57866
  Description of Artificial Sequence: Synthetic oligonucleotide

SEQ ID NO: 398307 - DNA, 33 bp, Artificial Sequence; identical to SEQ ID NO: 57867
  Description of Artificial Sequence: Synthetic oligonucleotide

SEQ ID NO: 398308 - DNA, 35 bp, Artificial Sequence; identical to SEQ ID NO: 57868
  Description of Artificial Sequence: Synthetic oligonucleotide

SEQ ID NO: 398309 - DNA, 34 bp, Artificial Sequence; identical to SEQ ID NO: 57869
  Description of Artificial Sequence: Synthetic oligonucleotide

SEQ ID NO: 398310 - DNA, 37 bp, Artificial Sequence; identical to SEQ ID NO: 57870
  Description of Artificial Sequence: Synthetic oligonucleotide

SEQ ID NO: 398311 - DNA, 36 bp, Artificial Sequence; identical to SEQ ID NO: 57871
  Description of Artificial Sequence: Synthetic oligonucleotide

SEQ ID NO: 398312 - DNA, 35 bp, Artificial Sequence; identical to SEQ ID NO: 57872
  Description of Artificial Sequence: Synthetic oligonucleotide

SEQ ID NO: 398313 - DNA, 34 bp, Artificial Sequence; identical to SEQ ID NO: 57873
  Description of Artificial Sequence: Synthetic oligonucleotide

SEQ ID NO: 398314 - DNA, 34 bp, Artificial Sequence; identical to SEQ ID NO: 57874
  Description of Artificial Sequence: Synthetic oligonucleotide

SEQ ID NO: 398315 - DNA, 33 bp, Artificial Sequence; identical to SEQ ID NO: 57875
  Description of Artificial Sequence: Synthetic oligonucleotide

SEQ ID NO: 398316 - DNA, 35 bp, Artificial Sequence; identical to SEQ ID NO: 57876
  Description of Artificial Sequence: Synthetic oligonucleotide

SEQ ID NO: 398317 - DNA, 34 bp, Artificial Sequence; identical to SEQ ID NO: 57877
  Description of Artificial Sequence: Synthetic oligonucleotide

SEQ ID NO: 398318 - DNA, 36 bp, Artificial Sequence; identical to SEQ ID NO: 57878
  Description of Artificial Sequence: Synthetic oligonucleotide

SEQ ID NO: 398319 - DNA, 35 bp, Artificial Sequence; identical to SEQ ID NO: 57879
  Description of Artificial Sequence: Synthetic oligonucleotide

SEQ ID NO: 398320 - DNA, 37 bp, Artificial Sequence; identical to SEQ ID NO: 57880
  Description of Artificial Sequence: Synthetic oligonucleotide

SEQ ID NO: 398321 - DNA, 39 bp, Artificial Sequence; identical to SEQ ID NO: 57881
  Description of Artificial Sequence: Synthetic oligonucleotide

SEQ ID NO: 398322 - DNA, 38 bp, Artificial Sequence; identical to SEQ ID NO: 57882
  Description of Artificial Sequence: Synthetic oligonucleotide

SEQ ID NO: 398323 - DNA, 27 bp, Artificial Sequence
  Description of Artificial Sequence: Synthetic oligonucleotide
caccgtgatgagcccctgtggaggtaa

SEQ ID NO: 398324 - DNA, 28 bp, Artificial Sequence
  Description of Artificial Sequence: Synthetic oligonucleotide
accgtgatgagcccctgtggaggtaaag

SEQ ID NO: 398325 - DNA, 27 bp, Artificial Sequence
  Description of Artificial Sequence: Synthetic oligonucleotide
ccgtgatgagcccctgtggaggtaaag

SEQ ID NO: 398326 - DNA, 28 bp, Artificial Sequence
  Description of Artificial Sequence: Synthetic oligonucleotide
cgtgatgagcccctgtggaggtaaagac

SEQ ID NO: 398327 - DNA, 31 bp, Artificial Sequence; identical to SEQ ID NO: 57887
  Description of Artificial Sequence: Synthetic oligonucleotide

SEQ ID NO: 398328 - DNA, 32 bp, Artificial Sequence; identical to SEQ ID NO: 57888
  Description of Artificial Sequence: Synthetic oligonucleotide

SEQ ID NO: 398329 - DNA, 31 bp, Artificial Sequence; identical to SEQ ID NO: 57889
  Description of Artificial Sequence: Synthetic oligonucleotide

SEQ ID NO: 398330 - DNA, 31 bp, Artificial Sequence; identical to SEQ ID NO: 57890
  Description of Artificial Sequence: Synthetic oligonucleotide

SEQ ID NO: 398331 - DNA, 30 bp, Artificial Sequence; identical to SEQ ID NO: 57891
  Description of Artificial Sequence: Synthetic oligonucleotide

SEQ ID NO: 398332 - DNA, 29 bp, Artificial Sequence
  Description of Artificial Sequence: Synthetic oligonucleotide
gagcccctgtggaggtaaagacattgtgg

SEQ ID NO: 398333 - DNA, 29 bp, Artificial Sequence
  Description of Artificial Sequence: Synthetic oligonucleotide
agcccctgtggaggtaaagacattgtggc

SEQ ID NO: 398334 - DNA, 28 bp, Artificial Sequence
  Description of Artificial Sequence: Synthetic oligonucleotide
gcccctgtggaggtaaagacattgtggc

SEQ ID NO: 398335 - DNA, 29 bp, Artificial Sequence
  Description of Artificial Sequence: Synthetic oligonucleotide
cccctgtggaggtaaagacattgtggctg

SEQ ID NO: 398336 - DNA, 30 bp, Artificial Sequence; identical to SEQ ID NO: 57896
  Description of Artificial Sequence: Synthetic oligonucleotide

SEQ ID NO: 398337 - DNA, 30 bp, Artificial Sequence; identical to SEQ ID NO: 57897
  Description of Artificial Sequence: Synthetic oligonucleotide

SEQ ID NO: 398338 - DNA, 31 bp, Artificial Sequence; identical to SEQ ID NO: 57898
  Description of Artificial Sequence: Synthetic oligonucleotide

SEQ ID NO: 398339 - DNA, 31 bp, Artificial Sequence; identical to SEQ ID NO: 57899
  Description of Artificial Sequence: Synthetic oligonucleotide

SEQ ID NO: 398340 - DNA, 30 bp, Artificial Sequence; identical to SEQ ID NO: 57900
  Description of Artificial Sequence: Synthetic oligonucleotide

SEQ ID NO: 398341 - DNA, 31 bp, Artificial Sequence; identical to SEQ ID NO: 57901
  Description of Artificial Sequence: Synthetic oligonucleotide

SEQ ID NO: 398342 - DNA, 30 bp, Artificial Sequence; identical to SEQ ID NO: 57902
  Description of Artificial Sequence: Synthetic oligonucleotide

SEQ ID NO: 398343 - DNA, 30 bp, Artificial Sequence; identical to SEQ ID NO: 57903
  Description of Artificial Sequence: Synthetic oligonucleotide

SEQ ID NO: 398344 - DNA, 30 bp, Artificial Sequence; identical to SEQ ID NO: 57904
  Description of Artificial Sequence: Synthetic oligonucleotide

SEQ ID NO: 398345 - DNA, 29 bp, Artificial Sequence
  Description of Artificial Sequence: Synthetic oligonucleotide
ggtaaagacattgtggctgaccacgtcgc

SEQ ID NO: 398346 - DNA, 29 bp, Artificial Sequence
  Description of Artificial Sequence: Synthetic oligonucleotide
gtaaagacattgtggctgaccacgtcgcc

SEQ ID NO: 398347 - DNA, 30 bp, Artificial Sequence; identical to SEQ ID NO: 57907
  Description of Artificial Sequence: Synthetic oligonucleotide

SEQ ID NO: 398348 - DNA, 29 bp, Artificial Sequence
  Description of Artificial Sequence: Synthetic oligonucleotide
aaagacattgtggctgaccacgtcgcctc

SEQ ID NO: 398349 - DNA, 40 bp, Artificial Sequence; identical to SEQ ID NO: 57909
  Description of Artificial Sequence: Synthetic oligonucleotide

SEQ ID NO: 398350 - DNA, 39 bp, Artificial Sequence; identical to SEQ ID NO: 57910
  Description of Artificial Sequence: Synthetic oligonucleotide

SEQ ID NO: 398351 - DNA, 44 bp, Artificial Sequence; identical to SEQ ID NO: 57911
  Description of Artificial Sequence: Synthetic oligonucleotide

SEQ ID NO: 398352 - DNA, 43 bp, Artificial Sequence; identical to SEQ ID NO: 57912
  Description of Artificial Sequence: Synthetic oligonucleotide

SEQ ID NO: 398353 - DNA, 42 bp, Artificial Sequence; identical to SEQ ID NO: 57913
  Description of Artificial Sequence: Synthetic oligonucleotide

SEQ ID NO: 398354 - DNA, 41 bp, Artificial Sequence; identical to SEQ ID NO: 57914
  Description of Artificial Sequence: Synthetic oligonucleotide

SEQ ID NO: 398355 - DNA, 41 bp, Artificial Sequence; identical to SEQ ID NO: 57915
  Description of Artificial Sequence: Synthetic oligonucleotide

SEQ ID NO: 398356 - DNA, 40 bp, Artificial Sequence; identical to SEQ ID NO: 57916
  Description of Artificial Sequence: Synthetic oligonucleotide

SEQ ID NO: 398357 - DNA, 39 bp, Artificial Sequence; identical to SEQ ID NO: 57917
  Description of Artificial Sequence: Synthetic oligonucleotide

SEQ ID NO: 398358 - DNA, 39 bp, Artificial Sequence; identical to SEQ ID NO: 57918
  Description of Artificial Sequence: Synthetic oligonucleotide

SEQ ID NO: 398359 - DNA, 40 bp, Artificial Sequence; identical to SEQ ID NO: 57919
  Description of Artificial Sequence: Synthetic oligonucleotide

SEQ ID NO: 398360 - DNA, 40 bp, Artificial Sequence; identical to SEQ ID NO: 57920
  Description of Artificial Sequence: Synthetic oligonucleotide

SEQ ID NO: 398361 - DNA, 39 bp, Artificial Sequence; identical to SEQ ID NO: 57921
  Description of Artificial Sequence: Synthetic oligonucleotide

SEQ ID NO: 398362 - DNA, 41 bp, Artificial Sequence; identical to SEQ ID NO: 57922
  Description of Artificial Sequence: Synthetic oligonucleotide

SEQ ID NO: 398363 - DNA, 40 bp, Artificial Sequence; identical to SEQ ID NO: 57923
  Description of Artificial Sequence: Synthetic oligonucleotide

SEQ ID NO: 398364 - DNA, 41 bp, Artificial Sequence; identical to SEQ ID NO: 57924
  Description of Artificial Sequence: Synthetic oligonucleotide

SEQ ID NO: 398365 - DNA, 43 bp, Artificial Sequence; identical to SEQ ID NO: 57925
  Description of Artificial Sequence: Synthetic oligonucleotide

SEQ ID NO: 398366 - DNA, 42 bp, Artificial Sequence; identical to SEQ ID NO: 57926
  Description of Artificial Sequence: Synthetic oligonucleotide

SEQ ID NO: 398367 - DNA, 41 bp, Artificial Sequence; identical to SEQ ID NO: 57927
  Description of Artificial Sequence: Synthetic oligonucleotide

SEQ ID NO: 398368 - DNA, 40 bp, Artificial Sequence; identical to SEQ ID NO: 57928
  Description of Artificial Sequence: Synthetic oligonucleotide

SEQ ID NO: 398369 - DNA, 39 bp, Artificial Sequence; identical to SEQ ID NO: 57929
  Description of Artificial Sequence: Synthetic oligonucleotide

SEQ ID NO: 398370 - DNA, 38 bp, Artificial Sequence; identical to SEQ ID NO: 57930
  Description of Artificial Sequence: Synthetic oligonucleotide

SEQ ID NO: 398371 - DNA, 38 bp, Artificial Sequence; identical to SEQ ID NO: 57931
  Description of Artificial Sequence: Synthetic oligonucleotide

SEQ ID NO: 398372 - DNA, 37 bp, Artificial Sequence; identical to SEQ ID NO: 57932
  Description of Artificial Sequence: Synthetic oligonucleotide

SEQ ID NO: 398373 - DNA, 36 bp, Artificial Sequence; identical to SEQ ID NO: 57933
  Description of Artificial Sequence: Synthetic oligonucleotide

SEQ ID NO: 398374 - DNA, 35 bp, Artificial Sequence; identical to SEQ ID NO: 57934
  Description of Artificial Sequence: Synthetic oligonucleotide

SEQ ID NO: 398375 - DNA, 34 bp, Artificial Sequence; identical to SEQ ID NO: 57935
  Description of Artificial Sequence: Synthetic oligonucleotide

SEQ ID NO: 398376 - DNA, 34 bp, Artificial Sequence; identical to SEQ ID NO: 57936
  Description of Artificial Sequence: Synthetic oligonucleotide

SEQ ID NO: 398377 - DNA, 33 bp, Artificial Sequence; identical to SEQ ID NO: 57937
  Description of Artificial Sequence: Synthetic oligonucleotide

SEQ ID NO: 398378 - DNA, 32 bp, Artificial Sequence; identical to SEQ ID NO: 57938
  Description of Artificial Sequence: Synthetic oligonucleotide

SEQ ID NO: 398379 - DNA, 32 bp, Artificial Sequence; identical to SEQ ID NO: 57939
  Description of Artificial Sequence: Synthetic oligonucleotide

SEQ ID NO: 398380 - DNA, 31 bp, Artificial Sequence; identical to SEQ ID NO: 57940
  Description of Artificial Sequence: Synthetic oligonucleotide

SEQ ID NO: 398381 - DNA, 30 bp, Artificial Sequence; identical to SEQ ID NO: 57941
  Description of Artificial Sequence: Synthetic oligonucleotide

SEQ ID NO: 398382 - DNA, 31 bp, Artificial Sequence; identical to SEQ ID NO: 57942
  Description of Artificial Sequence: Synthetic oligonucleotide

SEQ ID NO: 398383 - DNA, 30 bp, Artificial Sequence; identical to SEQ ID NO: 57943
  Description of Artificial Sequence: Synthetic oligonucleotide

SEQ ID NO: 398384 - DNA, 30 bp, Artificial Sequence; identical to SEQ ID NO: 57944
  Description of Artificial Sequence: Synthetic oligonucleotide

SEQ ID NO: 398385 - DNA, 29 bp, Artificial Sequence
  Description of Artificial Sequence: Synthetic oligonucleotide
ctggttaaacgctccaactctaccgctgc

SEQ ID NO: 398386 - DNA, 31 bp, Artificial Sequence; identical to SEQ ID NO: 57946
  Description of Artificial Sequence: Synthetic oligonucleotide

SEQ ID NO: 398387 - DNA, 30 bp, Artificial Sequence; identical to SEQ ID NO: 57947
  Description of Artificial Sequence: Synthetic oligonucleotide

SEQ ID NO: 398388 - DNA, 30 bp, Artificial Sequence; identical to SEQ ID NO: 57948
  Description of Artificial Sequence: Synthetic oligonucleotide

SEQ ID NO: 398389 - DNA, 29 bp, Artificial Sequence
  Description of Artificial Sequence: Synthetic oligonucleotide
attccagcccctatgtcagagctcacagg

SEQ ID NO: 398390 - DNA, 28 bp, Artificial Sequence
  Description of Artificial Sequence: Synthetic oligonucleotide
ttccagcccctatgtcagagctcacagg

SEQ ID NO: 398391 - DNA, 27 bp, Artificial Sequence
  Description of Artificial Sequence: Synthetic oligonucleotide
tccagcccctatgtcagagctcacagg

SEQ ID NO: 398392 - DNA, 26 bp, Artificial Sequence
  Description of Artificial Sequence: Synthetic oligonucleotide
ccagcccctatgtcagagctcacagg

SEQ ID NO: 398393 - DNA, 27 bp, Artificial Sequence
  Description of Artificial Sequence: Synthetic oligonucleotide
cagcccctatgtcagagctcacaggga

SEQ ID NO: 398394 - DNA, 27 bp, Artificial Sequence
  Description of Artificial Sequence: Synthetic oligonucleotide
agcccctatgtcagagctcacagggac

SEQ ID NO: 398395 - DNA, 27 bp, Artificial Sequence
  Description of Artificial Sequence: Synthetic oligonucleotide
gcccctatgtcagagctcacagggact

SEQ ID NO: 398396 - DNA, 27 bp, Artificial Sequence
  Description of Artificial Sequence: Synthetic oligonucleotide
cccctatgtcagagctcacagggactg

SEQ ID NO: 398397 - DNA, 28 bp, Artificial Sequence
  Description of Artificial Sequence: Synthetic oligonucleotide
ccctatgtcagagctcacagggactgtg

SEQ ID NO: 398398 - DNA, 28 bp, Artificial Sequence
  Description of Artificial Sequence: Synthetic oligonucleotide
cctatgtcagagctcacagggactgtgg

SEQ ID NO: 398399 - DNA, 29 bp, Artificial Sequence
  Description of Artificial Sequence: Synthetic oligonucleotide
ctatgtcagagctcacagggactgtggtc

SEQ ID NO: 398400 - DNA, 30 bp, Artificial Sequence
  Description of Artificial Sequence: Synthetic oligonucleotide
tatgtcagagctcacagggactgtggtctg

SEQ ID NO: 398401 - DNA, 29 bp, Artificial Sequence
  Description of Artificial Sequence: Synthetic oligonucleotide
atgtcagagctcacagggactgtggtctg

SEQ ID NO: 398402 - DNA, 28 bp, Artificial Sequence
  Description of Artificial Sequence: Synthetic oligonucleotide
tgtcagagctcacagggactgtggtctg

SEQ ID NO: 398403 - DNA, 27 bp, Artificial Sequence
  Description of Artificial Sequence: Synthetic oligonucleotide
gtcagagctcacagggactgtggtctg

SEQ ID NO: 398404 - DNA, 27 bp, Artificial Sequence
  Description of Artificial Sequence: Synthetic oligonucleotide
tcagagctcacagggactgtggtctgc

SEQ ID NO: 398405 - DNA, 26 bp, Artificial Sequence
  Description of Artificial Sequence: Synthetic oligonucleotide
cagagctcacagggactgtggtctgc

SEQ ID NO: 398406 - DNA, 26 bp, Artificial Sequence
  Description of Artificial Sequence: Synthetic oligonucleotide
agagctcacagggactgtggtctgcg

SEQ ID NO: 398407 - DNA, 25 bp, Artificial Sequence
  Description of Artificial Sequence: Synthetic oligonucleotide
gagctcacagggactgtggtctgcg

SEQ ID NO: 398408 - DNA, 25 bp, Artificial Sequence
  Description of Artificial Sequence: Synthetic oligonucleotide
agctcacagggactgtggtctgcgc

SEQ ID NO: 398409 - DNA, 24 bp, Artificial Sequence
  Description of Artificial Sequence: Synthetic oligonucleotide
gctcacagggactgtggtctgcgc

SEQ ID NO: 398410 - DNA, 24 bp, Artificial Sequence
  Description of Artificial Sequence: Synthetic oligonucleotide
ctcacagggactgtggtctgcgcc

SEQ ID NO: 398411 - DNA, 25 bp, Artificial Sequence
  Description of Artificial Sequence: Synthetic oligonucleotide
tcacagggactgtggtctgcgccct

SEQ ID NO: 398412 - DNA, 24 bp, Artificial Sequence
  Description of Artificial Sequence: Synthetic oligonucleotide
cacagggactgtggtctgcgccct

SEQ ID NO: 398413 - DNA, 24 bp, Artificial Sequence
  Description of Artificial Sequence: Synthetic oligonucleotide
acagggactgtggtctgcgccctg

SEQ ID NO: 398414 - DNA, 23 bp, Artificial Sequence
  Description of Artificial Sequence: Synthetic oligonucleotide
cagggactgtggtctgcgccctg

SEQ ID NO: 398415 - DNA, 23 bp, Artificial Sequence
  Description of Artificial Sequence: Synthetic oligonucleotide
agggactgtggtctgcgccctgg

SEQ ID NO: 398416 - DNA, 22 bp, Artificial Sequence
  Description of Artificial Sequence: Synthetic oligonucleotide
gggactgtggtctgcgccctgg

SEQ ID NO: 398417 - DNA, 22 bp, Artificial Sequence
  Description of Artificial Sequence: Synthetic oligonucleotide
ggactgtggtctgcgccctggg

SEQ ID NO: 398418 - DNA, 32 bp, Artificial Sequence; identical to SEQ ID NO: 57949
  Description of Artificial Sequence: Synthetic oligonucleotide

SEQ ID NO: 398419 - DNA, 33 bp, Artificial Sequence; identical to SEQ ID NO: 57950
  Description of Artificial Sequence: Synthetic oligonucleotide

SEQ ID NO: 398420 - DNA, 35 bp, Artificial Sequence; identical to SEQ ID NO: 57951
  Description of Artificial Sequence: Synthetic oligonucleotide

SEQ ID NO: 398421 - DNA, 34 bp, Artificial Sequence; identical to SEQ ID NO: 57952
  Description of Artificial Sequence: Synthetic oligonucleotide

SEQ ID NO: 398422 - DNA, 36 bp, Artificial Sequence; identical to SEQ ID NO: 57953
  Description of Artificial Sequence: Synthetic oligonucleotide

SEQ ID NO: 398423 - DNA, 35 bp, Artificial Sequence; identical to SEQ ID NO: 57954
  Description of Artificial Sequence: Synthetic oligonucleotide

SEQ ID NO: 398424 - DNA, 38 bp, Artificial Sequence; identical to SEQ ID NO: 57955
  Description of Artificial Sequence: Synthetic oligonucleotide

SEQ ID NO: 398425 - DNA, 37 bp, Artificial Sequence; identical to SEQ ID NO: 57956
  Description of Artificial Sequence: Synthetic oligonucleotide

SEQ ID NO: 398426 - DNA, 34 bp, Artificial Sequence; identical to SEQ ID NO: 57957
  Description of Artificial Sequence: Synthetic oligonucleotide

SEQ ID NO: 398427 - DNA, 33 bp, Artificial Sequence; identical to SEQ ID NO: 57958
  Description of Artificial Sequence: Synthetic oligonucleotide

SEQ ID NO: 398428 - DNA, 32 bp, Artificial Sequence; identical to SEQ ID NO: 57959
  Description of Artificial Sequence: Synthetic oligonucleotide

SEQ ID NO: 398429 - DNA, 31 bp, Artificial Sequence; identical to SEQ ID NO: 57960
  Description of Artificial Sequence: Synthetic oligonucleotide

SEQ ID NO: 398430 - DNA, 30 bp, Artificial Sequence; identical to SEQ ID NO: 57961
  Description of Artificial Sequence: Synthetic oligonucleotide

SEQ ID NO: 398431 - DNA, 30 bp, Artificial Sequence; identical to SEQ ID NO: 57962
  Description of Artificial Sequence: Synthetic oligonucleotide

SEQ ID NO: 398432 - DNA, 29 bp, Artificial Sequence
  Description of Artificial Sequence: Synthetic oligonucleotide
cccgcaatttgcactgacaaacatcgccg

SEQ ID NO: 398433 - DNA, 30 bp, Artificial Sequence; identical to SEQ ID NO: 57964
  Description of Artificial Sequence: Synthetic oligonucleotide

SEQ ID NO: 398434 - DNA, 31 bp, Artificial Sequence; identical to SEQ ID NO: 57965
  Description of Artificial Sequence: Synthetic oligonucleotide

SEQ ID NO: 398435 - DNA, 35 bp, Artificial Sequence; identical to SEQ ID NO: 57966
  Description of Artificial Sequence: Synthetic oligonucleotide

SEQ ID NO: 398436 - DNA, 36 bp, Artificial Sequence; identical to SEQ ID NO: 57967
  Description of Artificial Sequence: Synthetic oligonucleotide

SEQ ID NO: 398437 - DNA, 38 bp, Artificial Sequence; identical to SEQ ID NO: 57968
  Description of Artificial Sequence: Synthetic oligonucleotide

SEQ ID NO: 398438 - DNA, 37 bp, Artificial Sequence; identical to SEQ ID NO: 57969
  Description of Artificial Sequence: Synthetic oligonucleotide

SEQ ID NO: 398439 - DNA, 36 bp, Artificial Sequence; identical to SEQ ID NO: 57970
  Description of Artificial Sequence: Synthetic oligonucleotide

SEQ ID NO: 398440 - DNA, 35 bp, Artificial Sequence; identical to SEQ ID NO: 57971
  Description of Artificial Sequence: Synthetic oligonucleotide

SEQ ID NO: 398441 - DNA, 34 bp, Artificial Sequence; identical to SEQ ID NO: 57972
  Description of Artificial Sequence: Synthetic oligonucleotide

SEQ ID NO: 398442 - DNA, 33 bp, Artificial Sequence; identical to SEQ ID NO: 57973
  Description of Artificial Sequence: Synthetic oligonucleotide

SEQ ID NO: 398443 - DNA, 35 bp, Artificial Sequence; identical to SEQ ID NO: 57974
  Description of Artificial Sequence: Synthetic oligonucleotide

SEQ ID NO: 398444 - DNA, 37 bp, Artificial Sequence; identical to SEQ ID NO: 57975
  Description of Artificial Sequence: Synthetic oligonucleotide

SEQ ID NO: 398445 - DNA, 36 bp, Artificial Sequence; identical to SEQ ID NO: 57976
  Description of Artificial Sequence: Synthetic oligonucleotide

SEQ ID NO: 398446 - DNA, 38 bp, Artificial Sequence; identical to SEQ ID NO: 57977
  Description of Artificial Sequence: Synthetic oligonucleotide

SEQ ID NO: 398447 - DNA, 37 bp, Artificial Sequence; identical to SEQ ID NO: 57978
  Description of Artificial Sequence: Synthetic oligonucleotide

SEQ ID NO: 398448 - DNA, 37 bp, Artificial Sequence; identical to SEQ ID NO: 57979
  Description of Artificial Sequence: Synthetic oligonucleotide

SEQ ID NO: 398449 - DNA, 36 bp, Artificial Sequence; identical to SEQ ID NO: 57980
  Description of Artificial Sequence: Synthetic oligonucleotide

SEQ ID NO: 398450 - DNA, 37 bp, Artificial Sequence; identical to SEQ ID NO: 57981
  Description of Artificial Sequence: Synthetic oligonucleotide

SEQ ID NO: 398451 - DNA, 36 bp, Artificial Sequence; identical to SEQ ID NO: 57982
  Description of Artificial Sequence: Synthetic oligonucleotide

SEQ ID NO: 398452 - DNA, 35 bp, Artificial Sequence; identical to SEQ ID NO: 57983
  Description of Artificial Sequence: Synthetic oligonucleotide

SEQ ID NO: 398453 - DNA, 34 bp, Artificial Sequence; identical to SEQ ID NO: 57984
  Description of Artificial Sequence: Synthetic oligonucleotide

SEQ ID NO: 398454 - DNA, 40 bp, Artificial Sequence; identical to SEQ ID NO: 57985
  Description of Artificial Sequence: Synthetic oligonucleotide

SEQ ID NO: 398455 - DNA, 39 bp, Artificial Sequence; identical to SEQ ID NO: 57986
  Description of Artificial Sequence: Synthetic oligonucleotide

SEQ ID NO: 398456 - DNA, 38 bp, Artificial Sequence; identical to SEQ ID NO: 57987
  Description of Artificial Sequence: Synthetic oligonucleotide

SEQ ID NO: 398457 - DNA, 38 bp, Artificial Sequence; identical to SEQ ID NO: 57988
  Description of Artificial Sequence: Synthetic oligonucleotide

SEQ ID NO: 398458 - DNA, 38 bp, Artificial Sequence; identical to SEQ ID NO: 57989
  Description of Artificial Sequence: Synthetic oligonucleotide

SEQ ID NO: 398459 - DNA, 39 bp, Artificial Sequence; identical to SEQ ID NO: 57990
  Description of Artificial Sequence: Synthetic oligonucleotide

SEQ ID NO: 398460 - DNA, 31 bp, Artificial Sequence; identical to SEQ ID NO: 57991
  Description of Artificial Sequence: Synthetic oligonucleotide

SEQ ID NO: 398461 - DNA, 31 bp, Artificial Sequence; identical to SEQ ID NO: 57992
  Description of Artificial Sequence: Synthetic oligonucleotide

SEQ ID NO: 398462 - DNA, 30 bp, Artificial Sequence; identical to SEQ ID NO: 57993
  Description of Artificial Sequence: Synthetic oligonucleotide

SEQ ID NO: 398463 - DNA, 30 bp, Artificial Sequence; identical to SEQ ID NO: 57994
  Description of Artificial Sequence: Synthetic oligonucleotide

SEQ ID NO: 398464 - DNA, 29 bp, Artificial Sequence
  Description of Artificial Sequence: Synthetic oligonucleotide
cagtcacagaaggtgtttctgagacccgc

SEQ ID NO: 398465 - DNA, 31 bp, Artificial Sequence; identical to SEQ ID NO: 57996
  Description of Artificial Sequence: Synthetic oligonucleotide

SEQ ID NO: 398466 - DNA, 30 bp, Artificial Sequence; identical to SEQ ID NO: 57997
  Description of Artificial Sequence: Synthetic oligonucleotide

SEQ ID NO: 398467 - DNA, 30 bp, Artificial Sequence; identical to SEQ ID NO: 57998
  Description of Artificial Sequence: Synthetic oligonucleotide

SEQ ID NO: 398468 - DNA, 29 bp, Artificial Sequence
  Description of Artificial Sequence: Synthetic oligonucleotide
cacagaaggtgtttctgagacccgcttcc

SEQ ID NO: 398469 - DNA, 30 bp, Artificial Sequence; identical to SEQ ID NO: 58000
  Description of Artificial Sequence: Synthetic oligonucleotide

SEQ ID NO: 398470 - DNA, 29 bp, Artificial Sequence
  Description of Artificial Sequence: Synthetic oligonucleotide
cagaaggtgtttctgagacccgcttcctc

SEQ ID NO: 398471 - DNA, 30 bp, Artificial Sequence; identical to SEQ ID NO: 58002
  Description of Artificial Sequence: Synthetic oligonucleotide

SEQ ID NO: 398472 - DNA, 29 bp, Artificial Sequence
  Description of Artificial Sequence: Synthetic oligonucleotide
gaaggtgtttctgagacccgcttcctctc

SEQ ID NO: 398473 - DNA, 29 bp, Artificial Sequence
  Description of Artificial Sequence: Synthetic oligonucleotide
aaggtgtttctgagacccgcttcctctcc

SEQ ID NO: 398474 - DNA, 28 bp, Artificial Sequence
  Description of Artificial Sequence: Synthetic oligonucleotide
aggtgtttctgagacccgcttcctctcc

SEQ ID NO: 398475 - DNA, 27 bp, Artificial Sequence
  Description of Artificial Sequence: Synthetic oligonucleotide
ggtgtttctgagacccgcttcctctcc

SEQ ID NO: 398476 - DNA, 29 bp, Artificial Sequence
  Description of Artificial Sequence: Synthetic oligonucleotide
gtgtttctgagacccgcttcctctccaag

SEQ ID NO: 398477 - DNA, 30 bp, Artificial Sequence; identical to SEQ ID NO: 58008
  Description of Artificial Sequence: Synthetic oligonucleotide

SEQ ID NO: 398478 - DNA, 29 bp, Artificial Sequence
  Description of Artificial Sequence: Synthetic oligonucleotide
gtttctgagacccgcttcctctccaagag

SEQ ID NO: 398479 - DNA, 30 bp, Artificial Sequence; identical to SEQ ID NO: 58010
  Description of Artificial Sequence: Synthetic oligonucleotide

SEQ ID NO: 398480 - DNA, 29 bp, Artificial Sequence
  Description of Artificial Sequence: Synthetic oligonucleotide
ttctgagacccgcttcctctccaagagtg

SEQ ID NO: 398481 - DNA, 28 bp, Artificial Sequence
  Description of Artificial Sequence: Synthetic oligonucleotide
tctgagacccgcttcctctccaagagtg

SEQ ID NO: 398482 - DNA, 27 bp, Artificial Sequence
  Description of Artificial Sequence: Synthetic oligonucleotide
ctgagacccgcttcctctccaagagtg

SEQ ID NO: 398483 - DNA, 29 bp, Artificial Sequence
  Description of Artificial Sequence: Synthetic oligonucleotide
tgagacccgcttcctctccaagagtgatc

SEQ ID NO: 398484 - DNA, 28 bp, Artificial Sequence
  Description of Artificial Sequence: Synthetic oligonucleotide
gagacccgcttcctctccaagagtgatc

SEQ ID NO: 398485 - DNA, 31 bp, Artificial Sequence; identical to SEQ ID NO: 58016
  Description of Artificial Sequence: Synthetic oligonucleotide

SEQ ID NO: 398486 - DNA, 30 bp, Artificial Sequence; identical to SEQ ID NO: 58017
  Description of Artificial Sequence: Synthetic oligonucleotide

SEQ ID NO: 398487 - DNA, 30 bp, Artificial Sequence; identical to SEQ ID NO: 58018
  Description of Artificial Sequence: Synthetic oligonucleotide

SEQ ID NO: 398488 - DNA, 29 bp, Artificial Sequence
  Description of Artificial Sequence: Synthetic oligonucleotide
cccgcttcctctccaagagtgatcattcc

SEQ ID NO: 398489 - DNA, 31 bp, Artificial Sequence; identical to SEQ ID NO: 58020
  Description of Artificial Sequence: Synthetic oligonucleotide

SEQ ID NO: 398490 - DNA, 33 bp, Artificial Sequence; identical to SEQ ID NO: 58021
  Description of Artificial Sequence: Synthetic oligonucleotide

SEQ ID NO: 398491 - DNA, 42 bp, Artificial Sequence
  Description of Artificial Sequence: Synthetic oligonucleotide
ttctaagaactttgctcttttcaccaaaacttaaggctcctc

SEQ ID NO: 398492 - DNA, 41 bp, Artificial Sequence
  Description of Artificial Sequence: Synthetic oligonucleotide
tctaagaactttgctcttttcaccaaaacttaaggctcctc

SEQ ID NO: 398493 - DNA, 40 bp, Artificial Sequence
  Description of Artificial Sequence: Synthetic oligonucleotide
ctaagaactttgctcttttcaccaaaacttaaggctcctc

SEQ ID NO: 398494 - DNA, 41 bp, Artificial Sequence
  Description of Artificial Sequence: Synthetic oligonucleotide
taagaactttgctcttttcaccaaaacttaaggctcctcag

SEQ ID NO: 398495 - DNA, 40 bp, Artificial Sequence
  Description of Artificial Sequence: Synthetic oligonucleotide
aagaactttgctcttttcaccaaaacttaaggctcctcag

SEQ ID NO: 398496 - DNA, 39 bp, Artificial Sequence
  Description of Artificial Sequence: Synthetic oligonucleotide
agaactttgctcttttcaccaaaacttaaggctcctcag

SEQ ID NO: 398497 - DNA, 38 bp, Artificial Sequence
  Description of Artificial Sequence: Synthetic oligonucleotide
gaactttgctcttttcaccaaaacttaaggctcctcag

SEQ ID NO: 398498 - DNA, 38 bp, Artificial Sequence
  Description of Artificial Sequence: Synthetic oligonucleotide
aactttgctcttttcaccaaaacttaaggctcctcagg

SEQ ID NO: 398499 - DNA, 37 bp, Artificial Sequence
  Description of Artificial Sequence: Synthetic oligonucleotide
actttgctcttttcaccaaaacttaaggctcctcagg

SEQ ID NO: 398500 - DNA, 36 bp, Artificial Sequence
  Description of Artificial Sequence: Synthetic oligonucleotide
ctttgctcttttcaccaaaacttaaggctcctcagg

SEQ ID NO: 398501 - DNA, 36 bp, Artificial Sequence
  Description of Artificial Sequence: Synthetic oligonucleotide
tttgctcttttcaccaaaacttaaggctcctcaggg

SEQ ID NO: 398502 - DNA, 35 bp, Artificial Sequence
  Description of Artificial Sequence: Synthetic oligonucleotide
ttgctcttttcaccaaaacttaaggctcctcaggg

SEQ ID NO: 398503 - DNA, 34 bp, Artificial Sequence
  Description of Artificial Sequence: Synthetic oligonucleotide
tgctcttttcaccaaaacttaaggctcctcaggg

SEQ ID NO: 398504 - DNA, 33 bp, Artificial Sequence
  Description of Artificial Sequence: Synthetic oligonucleotide
gctcttttcaccaaaacttaaggctcctcaggg

SEQ ID NO: 398505 - DNA, 34 bp, Artificial Sequence
  Description of Artificial Sequence: Synthetic oligonucleotide
ctcttttcaccaaaacttaaggctcctcagggtg

SEQ ID NO: 398506 - DNA, 35 bp, Artificial Sequence
  Description of Artificial Sequence: Synthetic oligonucleotide
tcttttcaccaaaacttaaggctcctcagggtgtg

SEQ ID NO: 398507 - DNA, 34 bp, Artificial Sequence
  Description of Artificial Sequence: Synthetic oligonucleotide
cttttcaccaaaacttaaggctcctcagggtgtg

SEQ ID NO: 398508 - DNA, 35 bp, Artificial Sequence
  Description of Artificial Sequence: Synthetic oligonucleotide
ttttcaccaaaacttaaggctcctcagggtgtgtc

SEQ ID NO: 398509 - DNA, 34 bp, Artificial Sequence
  Description of Artificial Sequence: Synthetic oligonucleotide
tttcaccaaaacttaaggctcctcagggtgtgtc

SEQ ID NO: 398510 - DNA, 33 bp, Artificial Sequence
  Description of Artificial Sequence: Synthetic oligonucleotide
ttcaccaaaacttaaggctcctcagggtgtgtc

SEQ ID NO: 398511 - DNA, 32 bp, Artificial Sequence
  Description of Artificial Sequence: Synthetic oligonucleotide
tcaccaaaacttaaggctcctcagggtgtgtc

SEQ ID NO: 398512 - DNA, 31 bp, Artificial Sequence
  Description of Artificial Sequence: Synthetic oligonucleotide
caccaaaacttaaggctcctcagggtgtgtc

SEQ ID NO: 398513 - DNA, 34 bp, Artificial Sequence
  Description of Artificial Sequence: Synthetic oligonucleotide
accaaaacttaaggctcctcagggtgtgtctaag

SEQ ID NO: 398514 - DNA, 33 bp, Artificial Sequence
  Description of Artificial Sequence: Synthetic oligonucleotide
ccaaaacttaaggctcctcagggtgtgtctaag

SEQ ID NO: 398515 - DNA, 34 bp, Artificial Sequence
  Description of Artificial Sequence: Synthetic oligonucleotide
caaaacttaaggctcctcagggtgtgtctaagac

SEQ ID NO: 398516 - DNA, 36 bp, Artificial Sequence
  Description of Artificial Sequence: Synthetic oligonucleotide
aaaacttaaggctcctcagggtgtgtctaagacaac

SEQ ID NO: 398517 - DNA, 35 bp, Artificial Sequence
  Description of Artificial Sequence: Synthetic oligonucleotide
aaacttaaggctcctcagggtgtgtctaagacaac

SEQ ID NO: 398518 - DNA, 34 bp, Artificial Sequence
  Description of Artificial Sequence: Synthetic oligonucleotide
aacttaaggctcctcagggtgtgtctaagacaac

SEQ ID NO: 398519 - DNA, 33 bp, Artificial Sequence
  Description of Artificial Sequence: Synthetic oligonucleotide
acttaaggctcctcagggtgtgtctaagacaac

SEQ ID NO: 398520 - DNA, 32 bp, Artificial Sequence
  Description of Artificial Sequence: Synthetic oligonucleotide
cttaaggctcctcagggtgtgtctaagacaac

SEQ ID NO: 398521 - DNA, 33 bp, Artificial Sequence
  Description of Artificial Sequence: Synthetic oligonucleotide
ttaaggctcctcagggtgtgtctaagacaacag

SEQ ID NO: 398522 - DNA, 32 bp, Artificial Sequence
  Description of Artificial Sequence: Synthetic oligonucleotide
taaggctcctcagggtgtgtctaagacaacag

SEQ ID NO: 398523 - DNA, 31 bp, Artificial Sequence
  Description of Artificial Sequence: Synthetic oligonucleotide
aaggctcctcagggtgtgtctaagacaacag

SEQ ID NO: 398524 - DNA, 30 bp, Artificial Sequence
  Description of Artificial Sequence: Synthetic oligonucleotide
aggctcctcagggtgtgtctaagacaacag

SEQ ID NO: 398525 - DNA, 29 bp, Artificial Sequence
  Description of Artificial Sequence: Synthetic oligonucleotide
ggctcctcagggtgtgtctaagacaacag

SEQ ID NO: 398526 - DNA, 29 bp, Artificial Sequence
  Description of Artificial Sequence: Synthetic oligonucleotide
gctcctcagggtgtgtctaagacaacagc

SEQ ID NO: 398527 - DNA, 30 bp, Artificial Sequence
  Description of Artificial Sequence: Synthetic oligonucleotide
ctcctcagggtgtgtctaagacaacagcag

SEQ ID NO: 398528 - DNA, 37 bp, Artificial Sequence
  Description of Artificial Sequence: Synthetic oligonucleotide
tcctcagggtgtgtctaagacaacagcagtaaaaatg

SEQ ID NO: 398529 - DNA, 36 bp, Artificial Sequence
  Description of Artificial Sequence: Synthetic oligonucleotide
cctcagggtgtgtctaagacaacagcagtaaaaatg

SEQ ID NO: 398530 - DNA, 37 bp, Artificial Sequence
  Description of Artificial Sequence: Synthetic oligonucleotide
ctcagggtgtgtctaagacaacagcagtaaaaatgtc

SEQ ID NO: 398531 - DNA, 40 bp, Artificial Sequence
  Description of Artificial Sequence: Synthetic oligonucleotide
tcagggtgtgtctaagacaacagcagtaaaaatgtctatg

SEQ ID NO: 398532 - DNA, 39 bp, Artificial Sequence
  Description of Artificial Sequence: Synthetic oligonucleotide
cagggtgtgtctaagacaacagcagtaaaaatgtctatg

SEQ ID NO: 398533 - DNA, 40 bp, Artificial Sequence
  Description of Artificial Sequence: Synthetic oligonucleotide
agggtgtgtctaagacaacagcagtaaaaatgtctatgac

SEQ ID NO: 398534 - DNA, 39 bp, Artificial Sequence
  Description of Artificial Sequence: Synthetic oligonucleotide
gggtgtgtctaagacaacagcagtaaaaatgtctatgac

SEQ ID NO: 398535 - DNA, 40 bp, Artificial Sequence
  Description of Artificial Sequence: Synthetic oligonucleotide
ggtgtgtctaagacaacagcagtaaaaatgtctatgacag

SEQ ID NO: 398536 - DNA, 40 bp, Artificial Sequence
  Description of Artificial Sequence: Synthetic oligonucleotide
gtgtgtctaagacaacagcagtaaaaatgtctatgacagc

SEQ ID NO: 398537 - DNA, 46 bp, Artificial Sequence
  Description of Artificial Sequence: Synthetic oligonucleotide
tgtgtctaagacaacagcagtaaaaatgtctatgacagcaattttc

SEQ ID NO: 398538 - DNA, 45 bp, Artificial Sequence
  Description of Artificial Sequence: Synthetic oligonucleotide
gtgtctaagacaacagcagtaaaaatgtctatgacagcaattttc

SEQ ID NO: 398539 - DNA, 46 bp, Artificial Sequence
  Description of Artificial Sequence: Synthetic oligonucleotide
tgtctaagacaacagcagtaaaaatgtctatgacagcaattttctc

SEQ ID NO: 398540 - DNA, 45 bp, Artificial Sequence
  Description of Artificial Sequence: Synthetic oligonucleotide
gtctaagacaacagcagtaaaaatgtctatgacagcaattttctc

SEQ ID NO: 398541 - DNA, 46 bp, Artificial Sequence
  Description of Artificial Sequence: Synthetic oligonucleotide
tctaagacaacagcagtaaaaatgtctatgacagcaattttctctc

SEQ ID NO: 398542 - DNA, 45 bp, Artificial Sequence
  Description of Artificial Sequence: Synthetic oligonucleotide
ctaagacaacagcagtaaaaatgtctatgacagcaattttctctc

SEQ ID NO: 398543 - DNA, 45 bp, Artificial Sequence
  Description of Artificial Sequence: Synthetic oligonucleotide
taagacaacagcagtaaaaatgtctatgacagcaattttctctcc

SEQ ID NO: 398544 - DNA, 44 bp, Artificial Sequence
  Description of Artificial Sequence: Synthetic oligonucleotide
aagacaacagcagtaaaaatgtctatgacagcaattttctctcc

SEQ ID NO: 398545 - DNA, 43 bp, Artificial Sequence
  Description of Artificial Sequence: Synthetic oligonucleotide
agacaacagcagtaaaaatgtctatgacagcaattttctctcc

SEQ ID NO: 398546 - DNA, 42 bp, Artificial Sequence
  Description of Artificial Sequence: Synthetic oligonucleotide
gacaacagcagtaaaaatgtctatgacagcaattttctctcc

SEQ ID NO: 398547 - DNA, 42 bp, Artificial Sequence
  Description of Artificial Sequence: Synthetic oligonucleotide
acaacagcagtaaaaatgtctatgacagcaattttctctccc

SEQ ID NO: 398548 - DNA, 41 bp, Artificial Sequence
  Description of Artificial Sequence: Synthetic oligonucleotide
caacagcagtaaaaatgtctatgacagcaattttctctccc

SEQ ID NO: 398549 - DNA, 41 bp, Artificial Sequence
  Description of Artificial Sequence: Synthetic oligonucleotide
aacagcagtaaaaatgtctatgacagcaattttctctcccc

SEQ ID NO: 398550 - DNA, 40 bp, Artificial Sequence
  Description of Artificial Sequence: Synthetic oligonucleotide
acagcagtaaaaatgtctatgacagcaattttctctcccc

SEQ ID NO: 398551 - DNA, 39 bp, Artificial Sequence
  Description of Artificial Sequence: Synthetic oligonucleotide
cagcagtaaaaatgtctatgacagcaattttctctcccc

SEQ ID NO: 398552 - DNA, 40 bp, Artificial Sequence
  Description of Artificial Sequence: Synthetic oligonucleotide
agcagtaaaaatgtctatgacagcaattttctctcccctg

SEQ ID NO: 398553 - DNA, 39 bp, Artificial Sequence
  Description of Artificial Sequence: Synthetic oligonucleotide
gcagtaaaaatgtctatgacagcaattttctctcccctg

SEQ ID NO: 398554 - DNA, 45 bp, Artificial Sequence
  Description of Artificial Sequence: Synthetic oligonucleotide
cagtaaaaatgtctatgacagcaattttctctcccctgaaatatg

SEQ ID NO: 398555 - DNA, 47 bp, Artificial Sequence
  Description of Artificial Sequence: Synthetic oligonucleotide
agtaaaaatgtctatgacagcaattttctctcccctgaaatatgatc

SEQ ID NO: 398556 - DNA, 46 bp, Artificial Sequence
  Description of Artificial Sequence: Synthetic oligonucleotide
gtaaaaatgtctatgacagcaattttctctcccctgaaatatgatc

SEQ ID NO: 398557 - DNA, 46 bp, Artificial Sequence
  Description of Artificial Sequence: Synthetic oligonucleotide
taaaaatgtctatgacagcaattttctctcccctgaaatatgatcc

SEQ ID NO: 398558 - DNA, 45 bp, Artificial Sequence
  Description of Artificial Sequence: Synthetic oligonucleotide
aaaaatgtctatgacagcaattttctctcccctgaaatatgatcc

SEQ ID NO: 398559 - DNA, 44 bp, Artificial Sequence
  Description of Artificial Sequence: Synthetic oligonucleotide
aaaatgtctatgacagcaattttctctcccctgaaatatgatcc

SEQ ID NO: 398560 - DNA, 43 bp, Artificial Sequence
  Description of Artificial Sequence: Synthetic oligonucleotide
aaatgtctatgacagcaattttctctcccctgaaatatgatcc

SEQ ID NO: 398561 - DNA, 42 bp, Artificial Sequence
  Description of Artificial Sequence: Synthetic oligonucleotide
aatgtctatgacagcaattttctctcccctgaaatatgatcc

SEQ ID NO: 398562 - DNA, 41 bp, Artificial Sequence
  Description of Artificial Sequence: Synthetic oligonucleotide
atgtctatgacagcaattttctctcccctgaaatatgatcc

SEQ ID NO: 398563 - DNA, 40 bp, Artificial Sequence
  Description of Artificial Sequence: Synthetic oligonucleotide
tgtctatgacagcaattttctctcccctgaaatatgatcc

SEQ ID NO: 398564 - DNA, 39 bp, Artificial Sequence
  Description of Artificial Sequence: Synthetic oligonucleotide
gtctatgacagcaattttctctcccctgaaatatgatcc

SEQ ID NO: 398565 - DNA, 39 bp, Artificial Sequence
  Description of Artificial Sequence: Synthetic oligonucleotide
tctatgacagcaattttctctcccctgaaatatgatccc

SEQ ID NO: 398566 - DNA, 38 bp, Artificial Sequence
  Description of Artificial Sequence: Synthetic oligonucleotide
ctatgacagcaattttctctcccctgaaatatgatccc

SEQ ID NO: 398567 - DNA, 38 bp, Artificial Sequence
  Description of Artificial Sequence: Synthetic oligonucleotide
tatgacagcaattttctctcccctgaaatatgatcccc

SEQ ID NO: 398568 - DNA, 37 bp, Artificial Sequence
  Description of Artificial Sequence: Synthetic oligonucleotide
atgacagcaattttctctcccctgaaatatgatcccc

SEQ ID NO: 398569 - DNA, 36 bp, Artificial Sequence
  Description of Artificial Sequence: Synthetic oligonucleotide
tgacagcaattttctctcccctgaaatatgatcccc

SEQ ID NO: 398570 - DNA, 35 bp, Artificial Sequence
  Description of Artificial Sequence: Synthetic oligonucleotide
gacagcaattttctctcccctgaaatatgatcccc

SEQ ID NO: 398571 - DNA, 36 bp, Artificial Sequence
  Description of Artificial Sequence: Synthetic oligonucleotide
acagcaattttctctcccctgaaatatgatccccac

SEQ ID NO: 398572 - DNA, 35 bp, Artificial Sequence
  Description of Artificial Sequence: Synthetic oligonucleotide
cagcaattttctctcccctgaaatatgatccccac

SEQ ID NO: 398573 - DNA, 42 bp, Artificial Sequence
  Description of Artificial Sequence: Synthetic oligonucleotide
agcaattttctctcccctgaaatatgatccccacttaatttg

SEQ ID NO: 398574 - DNA, 41 bp, Artificial Sequence
  Description of Artificial Sequence: Synthetic oligonucleotide
gcaattttctctcccctgaaatatgatccccacttaatttg

SEQ ID NO: 398575 - DNA, 41 bp, Artificial Sequence
  Description of Artificial Sequence: Synthetic oligonucleotide
caattttctctcccctgaaatatgatccccacttaatttgc

SEQ ID NO: 398576 - DNA, 41 bp, Artificial Sequence
  Description of Artificial Sequence: Synthetic oligonucleotide
aattttctctcccctgaaatatgatccccacttaatttgcc

SEQ ID NO: 398577 - DNA, 40 bp, Artificial Sequence
  Description of Artificial Sequence: Synthetic oligonucleotide
attttctctcccctgaaatatgatccccacttaatttgcc

SEQ ID NO: 398578 - DNA, 39 bp, Artificial Sequence
  Description of Artificial Sequence: Synthetic oligonucleotide
ttttctctcccctgaaatatgatccccacttaatttgcc

SEQ ID NO: 398579 - DNA, 38 bp, Artificial Sequence
  Description of Artificial Sequence: Synthetic oligonucleotide
tttctctcccctgaaatatgatccccacttaatttgcc

SEQ ID NO: 398580 - DNA, 37 bp, Artificial Sequence
  Description of Artificial Sequence: Synthetic oligonucleotide
ttctctcccctgaaatatgatccccacttaatttgcc

SEQ ID NO: 398581 - DNA, 36 bp, Artificial Sequence
  Description of Artificial Sequence: Synthetic oligonucleotide
tctctcccctgaaatatgatccccacttaatttgcc

SEQ ID NO: 398582 - DNA, 35 bp, Artificial Sequence
  Description of Artificial Sequence: Synthetic oligonucleotide
ctctcccctgaaatatgatccccacttaatttgcc

SEQ ID NO: 398583 - DNA, 35 bp, Artificial Sequence
  Description of Artificial Sequence: Synthetic oligonucleotide
tctcccctgaaatatgatccccacttaatttgccc

SEQ ID NO: 398584 - DNA, 34 bp, Artificial Sequence
  Description of Artificial Sequence: Synthetic oligonucleotide
ctcccctgaaatatgatccccacttaatttgccc

SEQ ID NO: 398585 - DNA, 38 bp, Artificial Sequence
  Description of Artificial Sequence: Synthetic oligonucleotide
tcccctgaaatatgatccccacttaatttgccctattg

SEQ ID NO: 398586 - DNA, 37 bp, Artificial Sequence
  Description of Artificial Sequence: Synthetic oligonucleotide
cccctgaaatatgatccccacttaatttgccctattg

SEQ ID NO: 398587 - DNA, 40 bp, Artificial Sequence
  Description of Artificial Sequence: Synthetic oligonucleotide
ccctgaaatatgatccccacttaatttgccctattgaaag

SEQ ID NO: 398588 - DNA, 43 bp, Artificial Sequence
  Description of Artificial Sequence: Synthetic oligonucleotide
cctgaaatatgatccccacttaatttgccctattgaaagaatc

SEQ ID NO: 398589 - DNA, 43 bp, Artificial Sequence
  Description of Artificial Sequence: Synthetic oligonucleotide
ctgaaatatgatccccacttaatttgccctattgaaagaatcc

SEQ ID NO: 398590 - DNA, 43 bp, Artificial Sequence
  Description of Artificial Sequence: Synthetic oligonucleotide
tgaaatatgatccccacttaatttgccctattgaaagaatccc

SEQ ID NO: 398591 - DNA, 42 bp, Artificial Sequence
  Description of Artificial Sequence: Synthetic oligonucleotide
gaaatatgatccccacttaatttgccctattgaaagaatccc

SEQ ID NO: 398592 - DNA, 44 bp, Artificial Sequence
  Description of Artificial Sequence: Synthetic oligonucleotide
aaatatgatccccacttaatttgccctattgaaagaatcccaag

SEQ ID NO: 398593 - DNA, 43 bp, Artificial Sequence
  Description of Artificial Sequence: Synthetic oligonucleotide
aatatgatccccacttaatttgccctattgaaagaatcccaag

SEQ ID NO: 398594 - DNA, 42 bp, Artificial Sequence
  Description of Artificial Sequence: Synthetic oligonucleotide
atatgatccccacttaatttgccctattgaaagaatcccaag

SEQ ID NO: 398595 - DNA, 41 bp, Artificial Sequence
  Description of Artificial Sequence: Synthetic oligonucleotide
tatgatccccacttaatttgccctattgaaagaatcccaag

SEQ ID NO: 398596 - DNA, 40 bp, Artificial Sequence
  Description of Artificial Sequence: Synthetic oligonucleotide
atgatccccacttaatttgccctattgaaagaatcccaag

SEQ ID NO: 398597 - DNA, 39 bp, Artificial Sequence
  Description of Artificial Sequence: Synthetic oligonucleotide
tgatccccacttaatttgccctattgaaagaatcccaag

SEQ ID NO: 398598 - DNA, 38 bp, Artificial Sequence
  Description of Artificial Sequence: Synthetic oligonucleotide
gatccccacttaatttgccctattgaaagaatcccaag

SEQ ID NO: 398599 - DNA, 43 bp, Artificial Sequence
  Description of Artificial Sequence: Synthetic oligonucleotide
atccccacttaatttgccctattgaaagaatcccaagtataag

SEQ ID NO: 398600 - DNA, 42 bp, Artificial Sequence
  Description of Artificial Sequence: Synthetic oligonucleotide
tccccacttaatttgccctattgaaagaatcccaagtataag

SEQ ID NO: 398601 - DNA, 41 bp, Artificial Sequence
  Description of Artificial Sequence: Synthetic oligonucleotide
ccccacttaatttgccctattgaaagaatcccaagtataag

SEQ ID NO: 398602 - DNA, 43 bp, Artificial Sequence
  Description of Artificial Sequence: Synthetic oligonucleotide
cccacttaatttgccctattgaaagaatcccaagtataagaac

SEQ ID NO: 398603 - DNA, 45 bp, Artificial Sequence
  Description of Artificial Sequence: Synthetic oligonucleotide
ccacttaatttgccctattgaaagaatcccaagtataagaacaac

SEQ ID NO: 398604 - DNA, 46 bp, Artificial Sequence
  Description of Artificial Sequence: Synthetic oligonucleotide
cacttaatttgccctattgaaagaatcccaagtataagaacaactg

SEQ ID NO: 398605 - DNA, 46 bp, Artificial Sequence
  Description of Artificial Sequence: Synthetic oligonucleotide
acttaatttgccctattgaaagaatcccaagtataagaacaactgg

SEQ ID NO: 398606 - DNA, 45 bp, Artificial Sequence
  Description of Artificial Sequence: Synthetic oligonucleotide
cttaatttgccctattgaaagaatcccaagtataagaacaactgg

SEQ ID NO: 398607 - DNA, 53 bp, Artificial Sequence
  Description of Artificial Sequence: Synthetic oligonucleotide
ttaatttgccctattgaaagaatcccaagtataagaacaactggtttttaatc

SEQ ID NO: 398608 - DNA, 52 bp, Artificial Sequence
  Description of Artificial Sequence: Synthetic oligonucleotide
taatttgccctattgaaagaatcccaagtataagaacaactggtttttaatc

SEQ ID NO: 398609 - DNA, 51 bp, Artificial Sequence
  Description of Artificial Sequence: Synthetic oligonucleotide
aatttgccctattgaaagaatcccaagtataagaacaactggtttttaatc

SEQ ID NO: 398610 - DNA, 50 bp, Artificial Sequence
  Description of Artificial Sequence: Synthetic oligonucleotide
atttgccctattgaaagaatcccaagtataagaacaactggtttttaatc

SEQ ID NO: 398611 - DNA, 49 bp, Artificial Sequence
  Description of Artificial Sequence: Synthetic oligonucleotide
tttgccctattgaaagaatcccaagtataagaacaactggtttttaatc

SEQ ID NO: 398612 - DNA, 48 bp, Artificial Sequence
  Description of Artificial Sequence: Synthetic oligonucleotide
ttgccctattgaaagaatcccaagtataagaacaactggtttttaatc

SEQ ID NO: 398613 - DNA, 47 bp, Artificial Sequence
  Description of Artificial Sequence: Synthetic oligonucleotide
tgccctattgaaagaatcccaagtataagaacaactggtttttaatc

SEQ ID NO: 398614 - DNA, 46 bp, Artificial Sequence
  Description of Artificial Sequence: Synthetic oligonucleotide
gccctattgaaagaatcccaagtataagaacaactggtttttaatc

SEQ ID NO: 398615 - DNA, 53 bp, Artificial Sequence
  Description of Artificial Sequence: Synthetic oligonucleotide
ccctattgaaagaatcccaagtataagaacaactggtttttaatcaatattac

SEQ ID NO: 398616 - DNA, 56 bp, Artificial Sequence
  Description of Artificial Sequence: Synthetic oligonucleotide
cctattgaaagaatcccaagtataagaacaactggtttttaatcaatattacaaag

SEQ ID NO: 398617 - DNA, 58 bp, Artificial Sequence
  Description of Artificial Sequence: Synthetic oligonucleotide
ctattgaaagaatcccaagtataagaacaactggtttttaatcaatattacaaagatg

SEQ ID NO: 398618 - DNA, 60 bp, Artificial Sequence
  Description of Artificial Sequence: Synthetic oligonucleotide
tattgaaagaatcccaagtataagaacaactggtttttaatcaatattacaaagatgttt

SEQ ID NO: 398619 - DNA, 60 bp, Artificial Sequence
  Description of Artificial Sequence: Synthetic oligonucleotide
attgaaagaatcccaagtataagaacaactggtttttaatcaatattacaaagatgttta

SEQ ID NO: 398620 - DNA, 60 bp, Artificial Sequence
  Description of Artificial Sequence: Synthetic oligonucleotide
ttgaaagaatcccaagtataagaacaactggtttttaatcaatattacaaagatgtttac

SEQ ID NO: 398621 - DNA, 59 bp, Artificial Sequence
  Description of Artificial Sequence: Synthetic oligonucleotide
tgaaagaatcccaagtataagaacaactggtttttaatcaatattacaaagatgtttac

SEQ ID NO: 398622 - DNA, 58 bp, Artificial Sequence
  Description of Artificial Sequence: Synthetic oligonucleotide
gaaagaatcccaagtataagaacaactggtttttaatcaatattacaaagatgtttac

SEQ ID NO: 398623 - DNA, 59 bp, Artificial Sequence
  Description of Artificial Sequence: Synthetic oligonucleotide
aaagaatcccaagtataagaacaactggtttttaatcaatattacaaagatgtttactg

SEQ ID NO: 398624 - DNA, 58 bp, Artificial Sequence
  Description of Artificial Sequence: Synthetic oligonucleotide
aagaatcccaagtataagaacaactggtttttaatcaatattacaaagatgtttactg

SEQ ID NO: 398625 - DNA, 57 bp, Artificial Sequence
  Description of Artificial Sequence: Synthetic oligonucleotide
agaatcccaagtataagaacaactggtttttaatcaatattacaaagatgtttactg

SEQ ID NO: 398626 - DNA, 56 bp, Artificial Sequence
  Description of Artificial Sequence: Synthetic oligonucleotide
gaatcccaagtataagaacaactggtttttaatcaatattacaaagatgtttactg

SEQ ID NO: 398627 - DNA, 58 bp, Artificial Sequence
  Description of Artificial Sequence: Synthetic oligonucleotide
aatcccaagtataagaacaactggtttttaatcaatattacaaagatgtttactgttg

SEQ ID NO: 398628 - DNA, 57 bp, Artificial Sequence
  Description of Artificial Sequence: Synthetic oligonucleotide
atcccaagtataagaacaactggtttttaatcaatattacaaagatgtttactgttg

SEQ ID NO: 398629 - DNA, 56 bp, Artificial Sequence
  Description of Artificial Sequence: Synthetic oligonucleotide
tcccaagtataagaacaactggtttttaatcaatattacaaagatgtttactgttg

SEQ ID NO: 398630 - DNA, 55 bp, Artificial Sequence
  Description of Artificial Sequence: Synthetic oligonucleotide
cccaagtataagaacaactggtttttaatcaatattacaaagatgtttactgttg

SEQ ID NO: 398631 - DNA, 58 bp, Artificial Sequence
  Description of Artificial Sequence: Synthetic oligonucleotide
ccaagtataagaacaactggtttttaatcaatattacaaagatgtttactgttgaatc

SEQ ID NO: 398632 - DNA, 58 bp, Artificial Sequence
  Description of Artificial Sequence: Synthetic oligonucleotide
caagtataagaacaactggtttttaatcaatattacaaagatgtttactgttgaatcg

SEQ ID NO: 398633 - DNA, 58 bp, Artificial Sequence
  Description of Artificial Sequence: Synthetic oligonucleotide
aagtataagaacaactggtttttaatcaatattacaaagatgtttactgttgaatcgc

SEQ ID NO: 398634 - DNA, 57 bp, Artificial Sequence
  Description of Artificial Sequence: Synthetic oligonucleotide
agtataagaacaactggtttttaatcaatattacaaagatgtttactgttgaatcgc

SEQ ID NO: 398635 - DNA, 56 bp, Artificial Sequence
  Description of Artificial Sequence: Synthetic oligonucleotide
gtataagaacaactggtttttaatcaatattacaaagatgtttactgttgaatcgc

SEQ ID NO: 398636 - DNA, 60 bp, Artificial Sequence
  Description of Artificial Sequence: Synthetic oligonucleotide
tataagaacaactggtttttaatcaatattacaaagatgtttactgttgaatcgcatttt

SEQ ID NO: 398637 - DNA, 60 bp, Artificial Sequence
  Description of Artificial Sequence: Synthetic oligonucleotide
ataagaacaactggtttttaatcaatattacaaagatgtttactgttgaatcgcattttt

SEQ ID NO: 398638 - DNA, 60 bp, Artificial Sequence
  Description of Artificial Sequence: Synthetic oligonucleotide
taagaacaactggtttttaatcaatattacaaagatgtttactgttgaatcgcatttttc

SEQ ID NO: 398639 - DNA, 59 bp, Artificial Sequence
  Description of Artificial Sequence: Synthetic oligonucleotide
aagaacaactggtttttaatcaatattacaaagatgtttactgttgaatcgcatttttc

SEQ ID NO: 398640 - DNA, 58 bp, Artificial Sequence
  Description of Artificial Sequence: Synthetic oligonucleotide
agaacaactggtttttaatcaatattacaaagatgtttactgttgaatcgcatttttc

SEQ ID NO: 398641 - DNA, 57 bp, Artificial Sequence
  Description of Artificial Sequence: Synthetic oligonucleotide
gaacaactggtttttaatcaatattacaaagatgtttactgttgaatcgcatttttc

SEQ ID NO: 398642 - DNA, 60 bp, Artificial Sequence
  Description of Artificial Sequence: Synthetic oligonucleotide
aacaactggtttttaatcaatattacaaagatgtttactgttgaatcgcatttttctttg

SEQ ID NO: 398643 - DNA, 59 bp, Artificial Sequence
  Description of Artificial Sequence: Synthetic oligonucleotide
acaactggtttttaatcaatattacaaagatgtttactgttgaatcgcatttttctttg

SEQ ID NO: 398644 - DNA, 58 bp, Artificial Sequence
  Description of Artificial Sequence: Synthetic oligonucleotide
caactggtttttaatcaatattacaaagatgtttactgttgaatcgcatttttctttg

SEQ ID NO: 398645 - DNA, 58 bp, Artificial Sequence
  Description of Artificial Sequence: Synthetic oligonucleotide
aactggtttttaatcaatattacaaagatgtttactgttgaatcgcatttttctttgg

SEQ ID NO: 398646 - DNA, 57 bp, Artificial Sequence
  Description of Artificial Sequence: Synthetic oligonucleotide
actggtttttaatcaatattacaaagatgtttactgttgaatcgcatttttctttgg

SEQ ID NO: 398647 - DNA, 56 bp, Artificial Sequence
  Description of Artificial Sequence: Synthetic oligonucleotide
ctggtttttaatcaatattacaaagatgtttactgttgaatcgcatttttctttgg

SEQ ID NO: 398648 - DNA, 56 bp, Artificial Sequence
  Description of Artificial Sequence: Synthetic oligonucleotide
tggtttttaatcaatattacaaagatgtttactgttgaatcgcatttttctttggc

SEQ ID NO: 398649 - DNA, 55 bp, Artificial Sequence
  Description of Artificial Sequence: Synthetic oligonucleotide
ggtttttaatcaatattacaaagatgtttactgttgaatcgcatttttctttggc

SEQ ID NO: 398650 - DNA, 57 bp, Artificial Sequence
  Description of Artificial Sequence: Synthetic oligonucleotide
gtttttaatcaatattacaaagatgtttactgttgaatcgcatttttctttggcttc

SEQ ID NO: 398651 - DNA, 60 bp, Artificial Sequence
  Description of Artificial Sequence: Synthetic oligonucleotide
tttttaatcaatattacaaagatgtttactgttgaatcgcatttttctttggcttcttaa

SEQ ID NO: 398652 - DNA, 60 bp, Artificial Sequence
  Description of Artificial Sequence: Synthetic oligonucleotide
ttttaatcaatattacaaagatgtttactgttgaatcgcatttttctttggcttcttaaa

SEQ ID NO: 398653 - DNA, 60 bp, Artificial Sequence
  Description of Artificial Sequence: Synthetic oligonucleotide
tttaatcaatattacaaagatgtttactgttgaatcgcatttttctttggcttcttaaaa

SEQ ID NO: 398654 - DNA, 60 bp, Artificial Sequence
  Description of Artificial Sequence: Synthetic oligonucleotide
ttaatcaatattacaaagatgtttactgttgaatcgcatttttctttggcttcttaaaat

SEQ ID NO: 398655 - DNA, 60 bp, Artificial Sequence
  Description of Artificial Sequence: Synthetic oligonucleotide
taatcaatattacaaagatgtttactgttgaatcgcatttttctttggcttcttaaaatc

SEQ ID NO: 398656 - DNA, 59 bp, Artificial Sequence
  Description of Artificial Sequence: Synthetic oligonucleotide
aatcaatattacaaagatgtttactgttgaatcgcatttttctttggcttcttaaaatc

SEQ ID NO: 398657 - DNA, 58 bp, Artificial Sequence
  Description of Artificial Sequence: Synthetic oligonucleotide
atcaatattacaaagatgtttactgttgaatcgcatttttctttggcttcttaaaatc

SEQ ID NO: 398658 - DNA, 57 bp, Artificial Sequence
  Description of Artificial Sequence: Synthetic oligonucleotide
tcaatattacaaagatgtttactgttgaatcgcatttttctttggcttcttaaaatc

SEQ ID NO: 398659 - DNA, 56 bp, Artificial Sequence
  Description of Artificial Sequence: Synthetic oligonucleotide
caatattacaaagatgtttactgttgaatcgcatttttctttggcttcttaaaatc

SEQ ID NO: 398660 - DNA, 56 bp, Artificial Sequence
  Description of Artificial Sequence: Synthetic oligonucleotide
aatattacaaagatgtttactgttgaatcgcatttttctttggcttcttaaaatcc

SEQ ID NO: 398661 - DNA, 55 bp, Artificial Sequence
  Description of Artificial Sequence: Synthetic oligonucleotide
atattacaaagatgtttactgttgaatcgcatttttctttggcttcttaaaatcc

SEQ ID NO: 398662 - DNA, 54 bp, Artificial Sequence
  Description of Artificial Sequence: Synthetic oligonucleotide
tattacaaagatgtttactgttgaatcgcatttttctttggcttcttaaaatcc

SEQ ID NO: 398663 - DNA, 53 bp, Artificial Sequence
  Description of Artificial Sequence: Synthetic oligonucleotide
attacaaagatgtttactgttgaatcgcatttttctttggcttcttaaaatcc

SEQ ID NO: 398664 - DNA, 52 bp, Artificial Sequence
  Description of Artificial Sequence: Synthetic oligonucleotide
ttacaaagatgtttactgttgaatcgcatttttctttggcttcttaaaatcc

SEQ ID NO: 398665 - DNA, 51 bp, Artificial Sequence
  Description of Artificial Sequence: Synthetic oligonucleotide
tacaaagatgtttactgttgaatcgcatttttctttggcttcttaaaatcc

SEQ ID NO: 398666 - DNA, 50 bp, Artificial Sequence
  Description of Artificial Sequence: Synthetic oligonucleotide
acaaagatgtttactgttgaatcgcatttttctttggcttcttaaaatcc

SEQ ID NO: 398667 - DNA, 49 bp, Artificial Sequence
  Description of Artificial Sequence: Synthetic oligonucleotide
caaagatgtttactgttgaatcgcatttttctttggcttcttaaaatcc

SEQ ID NO: 398668 - DNA, 49 bp, Artificial Sequence
  Description of Artificial Sequence: Synthetic oligonucleotide
aaagatgtttactgttgaatcgcatttttctttggcttcttaaaatccc

SEQ ID NO: 398669 - DNA, 48 bp, Artificial Sequence
  Description of Artificial Sequence: Synthetic oligonucleotide
aagatgtttactgttgaatcgcatttttctttggcttcttaaaatccc

SEQ ID NO: 398670 - DNA, 47 bp, Artificial Sequence
  Description of Artificial Sequence: Synthetic oligonucleotide
agatgtttactgttgaatcgcatttttctttggcttcttaaaatccc

SEQ ID NO: 398671 - DNA, 46 bp, Artificial Sequence
  Description of Artificial Sequence: Synthetic oligonucleotide
gatgtttactgttgaatcgcatttttctttggcttcttaaaatccc

SEQ ID NO: 398672 - DNA, 49 bp, Artificial Sequence
  Description of Artificial Sequence: Synthetic oligonucleotide
atgtttactgttgaatcgcatttttctttggcttcttaaaatcccttag

SEQ ID NO: 398673 - DNA, 48 bp, Artificial Sequence
  Description of Artificial Sequence: Synthetic oligonucleotide
tgtttactgttgaatcgcatttttctttggcttcttaaaatcccttag

SEQ ID NO: 398674 - DNA, 47 bp, Artificial Sequence
  Description of Artificial Sequence: Synthetic oligonucleotide
gtttactgttgaatcgcatttttctttggcttcttaaaatcccttag

SEQ ID NO: 398675 - DNA, 47 bp, Artificial Sequence
  Description of Artificial Sequence: Synthetic oligonucleotide
tttactgttgaatcgcatttttctttggcttcttaaaatcccttagg

SEQ ID NO: 398676 - DNA, 46 bp, Artificial Sequence
  Description of Artificial Sequence: Synthetic oligonucleotide
ttactgttgaatcgcatttttctttggcttcttaaaatcccttagg

SEQ ID NO: 398677 - DNA, 45 bp, Artificial Sequence
  Description of Artificial Sequence: Synthetic oligonucleotide
tactgttgaatcgcatttttctttggcttcttaaaatcccttagg

SEQ ID NO: 398678 - DNA, 44 bp, Artificial Sequence
  Description of Artificial Sequence: Synthetic oligonucleotide
actgttgaatcgcatttttctttggcttcttaaaatcccttagg

SEQ ID NO: 398679 - DNA, 43 bp, Artificial Sequence
  Description of Artificial Sequence: Synthetic oligonucleotide
ctgttgaatcgcatttttctttggcttcttaaaatcccttagg

SEQ ID NO: 398680 - DNA, 43 bp, Artificial Sequence
  Description of Artificial Sequence: Synthetic oligonucleotide
tgttgaatcgcatttttctttggcttcttaaaatcccttaggc

SEQ ID NO: 398681 - DNA, 42 bp, Artificial Sequence
  Description of Artificial Sequence: Synthetic oligonucleotide
gttgaatcgcatttttctttggcttcttaaaatcccttaggc

SEQ ID NO: 398682 - DNA, 45 bp, Artificial Sequence
  Description of Artificial Sequence: Synthetic oligonucleotide
ttgaatcgcatttttctttggcttcttaaaatcccttaggcattc

SEQ ID NO: 398683 - DNA, 44 bp, Artificial Sequence
  Description of Artificial Sequence: Synthetic oligonucleotide
tgaatcgcatttttctttggcttcttaaaatcccttaggcattc

SEQ ID NO: 398684 - DNA, 43 bp, Artificial Sequence
  Description of Artificial Sequence: Synthetic oligonucleotide
gaatcgcatttttctttggcttcttaaaatcccttaggcattc

SEQ ID NO: 398685 - DNA, 46 bp, Artificial Sequence
  Description of Artificial Sequence: Synthetic oligonucleotide
aatcgcatttttctttggcttcttaaaatcccttaggcattcaatc

SEQ ID NO: 398686 - DNA, 45 bp, Artificial Sequence
  Description of Artificial Sequence: Synthetic oligonucleotide
atcgcatttttctttggcttcttaaaatcccttaggcattcaatc

SEQ ID NO: 398687 - DNA, 44 bp, Artificial Sequence
  Description of Artificial Sequence: Synthetic oligonucleotide
tcgcatttttctttggcttcttaaaatcccttaggcattcaatc

SEQ ID NO: 398688 - DNA, 43 bp, Artificial Sequence
  Description of Artificial Sequence: Synthetic oligonucleotide
cgcatttttctttggcttcttaaaatcccttaggcattcaatc

SEQ ID NO: 398689 - DNA, 45 bp, Artificial Sequence
  Description of Artificial Sequence: Synthetic oligonucleotide
gcatttttctttggcttcttaaaatcccttaggcattcaatcttc

SEQ ID NO: 398690 - DNA, 46 bp, Artificial Sequence
  Description of Artificial Sequence: Synthetic oligonucleotide
catttttctttggcttcttaaaatcccttaggcattcaatcttcag

SEQ ID NO: 398691 - DNA, 46 bp, Artificial Sequence
  Description of Artificial Sequence: Synthetic oligonucleotide
atttttctttggcttcttaaaatcccttaggcattcaatcttcagc

SEQ ID NO: 398692 - DNA, 45 bp, Artificial Sequence
  Description of Artificial Sequence: Synthetic oligonucleotide
tttttctttggcttcttaaaatcccttaggcattcaatcttcagc

SEQ ID NO: 398693 - DNA, 44 bp, Artificial Sequence
  Description of Artificial Sequence: Synthetic oligonucleotide
ttttctttggcttcttaaaatcccttaggcattcaatcttcagc

SEQ ID NO: 398694 - DNA, 43 bp, Artificial Sequence
  Description of Artificial Sequence: Synthetic oligonucleotide
tttctttggcttcttaaaatcccttaggcattcaatcttcagc

SEQ ID NO: 398695 - DNA, 42 bp, Artificial Sequence
  Description of Artificial Sequence: Synthetic oligonucleotide
ttctttggcttcttaaaatcccttaggcattcaatcttcagc

SEQ ID NO: 398696 - DNA, 41 bp, Artificial Sequence
  Description of Artificial Sequence: Synthetic oligonucleotide
tctttggcttcttaaaatcccttaggcattcaatcttcagc

SEQ ID NO: 398697 - DNA, 40 bp, Artificial Sequence
  Description of Artificial Sequence: Synthetic oligonucleotide
ctttggcttcttaaaatcccttaggcattcaatcttcagc

SEQ ID NO: 398698 - DNA, 41 bp, Artificial Sequence
  Description of Artificial Sequence: Synthetic oligonucleotide
tttggcttcttaaaatcccttaggcattcaatcttcagctc

SEQ ID NO: 398699 - DNA, 40 bp, Artificial Sequence
  Description of Artificial Sequence: Synthetic oligonucleotide
ttggcttcttaaaatcccttaggcattcaatcttcagctc

SEQ ID NO: 398700 - DNA, 39 bp, Artificial Sequence
  Description of Artificial Sequence: Synthetic oligonucleotide
tggcttcttaaaatcccttaggcattcaatcttcagctc

SEQ ID NO: 398701 - DNA, 38 bp, Artificial Sequence
  Description of Artificial Sequence: Synthetic oligonucleotide
ggcttcttaaaatcccttaggcattcaatcttcagctc

SEQ ID NO: 398702 - DNA, 40 bp, Artificial Sequence
  Description of Artificial Sequence: Synthetic oligonucleotide
gcttcttaaaatcccttaggcattcaatcttcagctcttc

SEQ ID NO: 398703 - DNA, 40 bp, Artificial Sequence
  Description of Artificial Sequence: Synthetic oligonucleotide
cttcttaaaatcccttaggcattcaatcttcagctcttcc

SEQ ID NO: 398704 - DNA, 46 bp, Artificial Sequence
  Description of Artificial Sequence: Synthetic oligonucleotide
ttcttaaaatcccttaggcattcaatcttcagctcttccataattg

SEQ ID NO: 398705 - DNA, 45 bp, Artificial Sequence
  Description of Artificial Sequence: Synthetic oligonucleotide
tcttaaaatcccttaggcattcaatcttcagctcttccataattg

SEQ ID NO: 398706 - DNA, 44 bp, Artificial Sequence
  Description of Artificial Sequence: Synthetic oligonucleotide
cttaaaatcccttaggcattcaatcttcagctcttccataattg

SEQ ID NO: 398707 - DNA, 45 bp, Artificial Sequence
  Description of Artificial Sequence: Synthetic oligonucleotide
ttaaaatcccttaggcattcaatcttcagctcttccataattgag

SEQ ID NO: 398708 - DNA, 44 bp, Artificial Sequence
  Description of Artificial Sequence: Synthetic oligonucleotide
taaaatcccttaggcattcaatcttcagctcttccataattgag

SEQ ID NO: 398709 - DNA, 43 bp, Artificial Sequence
  Description of Artificial Sequence: Synthetic oligonucleotide
aaaatcccttaggcattcaatcttcagctcttccataattgag

SEQ ID NO: 398710 - DNA, 42 bp, Artificial Sequence
  Description of Artificial Sequence: Synthetic oligonucleotide
aaatcccttaggcattcaatcttcagctcttccataattgag

SEQ ID NO: 398711 - DNA, 41 bp, Artificial Sequence
  Description of Artificial Sequence: Synthetic oligonucleotide
aatcccttaggcattcaatcttcagctcttccataattgag

SEQ ID NO: 398712 - DNA, 40 bp, Artificial Sequence
  Description of Artificial Sequence: Synthetic oligonucleotide
atcccttaggcattcaatcttcagctcttccataattgag

SEQ ID NO: 398713 - DNA, 39 bp, Artificial Sequence
  Description of Artificial Sequence: Synthetic oligonucleotide
tcccttaggcattcaatcttcagctcttccataattgag

SEQ ID NO: 398714 - DNA, 38 bp, Artificial Sequence
  Description of Artificial Sequence: Synthetic oligonucleotide
cccttaggcattcaatcttcagctcttccataattgag

SEQ ID NO: 398715 - DNA, 39 bp, Artificial Sequence
  Description of Artificial Sequence: Synthetic oligonucleotide
ccttaggcattcaatcttcagctcttccataattgagag

SEQ ID NO: 398716 - DNA, 39 bp, Artificial Sequence
  Description of Artificial Sequence: Synthetic oligonucleotide
cttaggcattcaatcttcagctcttccataattgagagg

SEQ ID NO: 398717 - DNA, 46 bp, Artificial Sequence
  Description of Artificial Sequence: Synthetic oligonucleotide
ttaggcattcaatcttcagctcttccataattgagaggaaattttc

SEQ ID NO: 398718 - DNA, 45 bp, Artificial Sequence
  Description of Artificial Sequence: Synthetic oligonucleotide
taggcattcaatcttcagctcttccataattgagaggaaattttc

SEQ ID NO: 398719 - DNA, 44 bp, Artificial Sequence
  Description of Artificial Sequence: Synthetic oligonucleotide
aggcattcaatcttcagctcttccataattgagaggaaattttc

SEQ ID NO: 398720 - DNA, 43 bp, Artificial Sequence
  Description of Artificial Sequence: Synthetic oligonucleotide
ggcattcaatcttcagctcttccataattgagaggaaattttc

SEQ ID NO: 398721 - DNA, 44 bp, Artificial Sequence
  Description of Artificial Sequence: Synthetic oligonucleotide
gcattcaatcttcagctcttccataattgagaggaaattttcac

SEQ ID NO: 398722 - DNA, 44 bp, Artificial Sequence
  Description of Artificial Sequence: Synthetic oligonucleotide
cattcaatcttcagctcttccataattgagaggaaattttcacc

SEQ ID NO: 398723 - DNA, 45 bp, Artificial Sequence
  Description of Artificial Sequence: Synthetic oligonucleotide
attcaatcttcagctcttccataattgagaggaaattttcacctc

SEQ ID NO: 398724 - DNA, 44 bp, Artificial Sequence
  Description of Artificial Sequence: Synthetic oligonucleotide
ttcaatcttcagctcttccataattgagaggaaattttcacctc

SEQ ID NO: 398725 - DNA, 43 bp, Artificial Sequence
  Description of Artificial Sequence: Synthetic oligonucleotide
tcaatcttcagctcttccataattgagaggaaattttcacctc

SEQ ID NO: 398726 - DNA, 42 bp, Artificial Sequence
  Description of Artificial Sequence: Synthetic oligonucleotide
caatcttcagctcttccataattgagaggaaattttcacctc

SEQ ID NO: 398727 - DNA, 46 bp, Artificial Sequence
  Description of Artificial Sequence: Synthetic oligonucleotide
aatcttcagctcttccataattgagaggaaattttcacctcaaatg

SEQ ID NO: 398728 - DNA, 45 bp, Artificial Sequence
  Description of Artificial Sequence: Synthetic oligonucleotide
atcttcagctcttccataattgagaggaaattttcacctcaaatg

SEQ ID NO: 398729 - DNA, 44 bp, Artificial Sequence
  Description of Artificial Sequence: Synthetic oligonucleotide
tcttcagctcttccataattgagaggaaattttcacctcaaatg

SEQ ID NO: 398730 - DNA, 43 bp, Artificial Sequence
  Description of Artificial Sequence: Synthetic oligonucleotide
cttcagctcttccataattgagaggaaattttcacctcaaatg

SEQ ID NO: 398731 - DNA, 45 bp, Artificial Sequence
  Description of Artificial Sequence: Synthetic oligonucleotide
ttcagctcttccataattgagaggaaattttcacctcaaatgttc

SEQ ID NO: 398732 - DNA, 44 bp, Artificial Sequence
  Description of Artificial Sequence: Synthetic oligonucleotide
tcagctcttccataattgagaggaaattttcacctcaaatgttc

SEQ ID NO: 398733 - DNA, 43 bp, Artificial Sequence
  Description of Artificial Sequence: Synthetic oligonucleotide
cagctcttccataattgagaggaaattttcacctcaaatgttc

SEQ ID NO: 398734 - DNA, 45 bp, Artificial Sequence
  Description of Artificial Sequence: Synthetic oligonucleotide
agctcttccataattgagaggaaattttcacctcaaatgttcatc

SEQ ID NO: 398735 - DNA, 44 bp, Artificial Sequence
  Description of Artificial Sequence: Synthetic oligonucleotide
gctcttccataattgagaggaaattttcacctcaaatgttcatc

SEQ ID NO: 398736 - DNA, 44 bp, Artificial Sequence
  Description of Artificial Sequence: Synthetic oligonucleotide
ctcttccataattgagaggaaattttcacctcaaatgttcatcc

SEQ ID NO: 398737 - DNA, 45 bp, Artificial Sequence
  Description of Artificial Sequence: Synthetic oligonucleotide
tcttccataattgagaggaaattttcacctcaaatgttcatccag

SEQ ID NO: 398738 - DNA, 44 bp, Artificial Sequence
  Description of Artificial Sequence: Synthetic oligonucleotide
cttccataattgagaggaaattttcacctcaaatgttcatccag

SEQ ID NO: 398739 - DNA, 45 bp, Artificial Sequence
  Description of Artificial Sequence: Synthetic oligonucleotide
ttccataattgagaggaaattttcacctcaaatgttcatccagtg

SEQ ID NO: 398740 - DNA, 44 bp, Artificial Sequence
  Description of Artificial Sequence: Synthetic oligonucleotide
tccataattgagaggaaattttcacctcaaatgttcatccagtg

SEQ ID NO: 398741 - DNA, 43 bp, Artificial Sequence
  Description of Artificial Sequence: Synthetic oligonucleotide
ccataattgagaggaaattttcacctcaaatgttcatccagtg

SEQ ID NO: 398742 - DNA, 43 bp, Artificial Sequence
  Description of Artificial Sequence: Synthetic oligonucleotide
cataattgagaggaaattttcacctcaaatgttcatccagtgc

SEQ ID NO: 398743 - DNA, 47 bp, Artificial Sequence
  Description of Artificial Sequence: Synthetic oligonucleotide
ataattgagaggaaattttcacctcaaatgttcatccagtgcaattg

SEQ ID NO: 398744 - DNA, 46 bp, Artificial Sequence
  Description of Artificial Sequence: Synthetic oligonucleotide
taattgagaggaaattttcacctcaaatgttcatccagtgcaattg

SEQ ID NO: 398745 - DNA, 45 bp, Artificial Sequence
  Description of Artificial Sequence: Synthetic oligonucleotide
aattgagaggaaattttcacctcaaatgttcatccagtgcaattg

SEQ ID NO: 398746 - DNA, 44 bp, Artificial Sequence
  Description of Artificial Sequence: Synthetic oligonucleotide
attgagaggaaattttcacctcaaatgttcatccagtgcaattg

SEQ ID NO: 398747 - DNA, 43 bp, Artificial Sequence
  Description of Artificial Sequence: Synthetic oligonucleotide
ttgagaggaaattttcacctcaaatgttcatccagtgcaattg

SEQ ID NO: 398748 - DNA, 42 bp, Artificial Sequence
  Description of Artificial Sequence: Synthetic oligonucleotide
tgagaggaaattttcacctcaaatgttcatccagtgcaattg

SEQ ID NO: 398749 - DNA, 41 bp, Artificial Sequence
  Description of Artificial Sequence: Synthetic oligonucleotide
gagaggaaattttcacctcaaatgttcatccagtgcaattg

SEQ ID NO: 398750 - DNA, 44 bp, Artificial Sequence
  Description of Artificial Sequence: Synthetic oligonucleotide
agaggaaattttcacctcaaatgttcatccagtgcaattgaaag

SEQ ID NO: 398751 - DNA, 43 bp, Artificial Sequence
  Description of Artificial Sequence: Synthetic oligonucleotide
gaggaaattttcacctcaaatgttcatccagtgcaattgaaag

SEQ ID NO: 398752 - DNA, 44 bp, Artificial Sequence
  Description of Artificial Sequence: Synthetic oligonucleotide
aggaaattttcacctcaaatgttcatccagtgcaattgaaagac

SEQ ID NO: 398753 - DNA, 43 bp, Artificial Sequence
  Description of Artificial Sequence: Synthetic oligonucleotide
ggaaattttcacctcaaatgttcatccagtgcaattgaaagac

SEQ ID NO: 398754 - DNA, 43 bp, Artificial Sequence
  Description of Artificial Sequence: Synthetic oligonucleotide
gaaattttcacctcaaatgttcatccagtgcaattgaaagacg

SEQ ID NO: 398755 - DNA, 44 bp, Artificial Sequence
  Description of Artificial Sequence: Synthetic oligonucleotide
aaattttcacctcaaatgttcatccagtgcaattgaaagacgtc

SEQ ID NO: 398756 - DNA, 43 bp, Artificial Sequence
  Description of Artificial Sequence: Synthetic oligonucleotide
aattttcacctcaaatgttcatccagtgcaattgaaagacgtc

SEQ ID NO: 398757 - DNA, 42 bp, Artificial Sequence
  Description of Artificial Sequence: Synthetic oligonucleotide
attttcacctcaaatgttcatccagtgcaattgaaagacgtc

SEQ ID NO: 398758 - DNA, 41 bp, Artificial Sequence
  Description of Artificial Sequence: Synthetic oligonucleotide
ttttcacctcaaatgttcatccagtgcaattgaaagacgtc

SEQ ID NO: 398759 - DNA, 40 bp, Artificial Sequence
  Description of Artificial Sequence: Synthetic oligonucleotide
tttcacctcaaatgttcatccagtgcaattgaaagacgtc

SEQ ID NO: 398760 - DNA, 39 bp, Artificial Sequence
  Description of Artificial Sequence: Synthetic oligonucleotide
ttcacctcaaatgttcatccagtgcaattgaaagacgtc

SEQ ID NO: 398761 - DNA, 38 bp, Artificial Sequence
  Description of Artificial Sequence: Synthetic oligonucleotide
tcacctcaaatgttcatccagtgcaattgaaagacgtc

SEQ ID NO: 398762 - DNA, 37 bp, Artificial Sequence
  Description of Artificial Sequence: Synthetic oligonucleotide
cacctcaaatgttcatccagtgcaattgaaagacgtc

SEQ ID NO: 398763 - DNA, 38 bp, Artificial Sequence
  Description of Artificial Sequence: Synthetic oligonucleotide
acctcaaatgttcatccagtgcaattgaaagacgtcac

SEQ ID NO: 398764 - DNA, 37 bp, Artificial Sequence
  Description of Artificial Sequence: Synthetic oligonucleotide
cctcaaatgttcatccagtgcaattgaaagacgtcac

SEQ ID NO: 398765 - DNA, 38 bp, Artificial Sequence
  Description of Artificial Sequence: Synthetic oligonucleotide
ctcaaatgttcatccagtgcaattgaaagacgtcacag

SEQ ID NO: 398766 - DNA, 39 bp, Artificial Sequence
  Description of Artificial Sequence: Synthetic oligonucleotide
tcaaatgttcatccagtgcaattgaaagacgtcacagtg

SEQ ID NO: 398767 - DNA, 38 bp, Artificial Sequence
  Description of Artificial Sequence: Synthetic oligonucleotide
caaatgttcatccagtgcaattgaaagacgtcacagtg

SEQ ID NO: 398768 - DNA, 38 bp, Artificial Sequence
  Description of Artificial Sequence: Synthetic oligonucleotide
aaatgttcatccagtgcaattgaaagacgtcacagtgc

SEQ ID NO: 398769 - DNA, 37 bp, Artificial Sequence
  Description of Artificial Sequence: Synthetic oligonucleotide
aatgttcatccagtgcaattgaaagacgtcacagtgc

SEQ ID NO: 398770 - DNA, 36 bp, Artificial Sequence
  Description of Artificial Sequence: Synthetic oligonucleotide
atgttcatccagtgcaattgaaagacgtcacagtgc

SEQ ID NO: 398771 - DNA, 35 bp, Artificial Sequence
  Description of Artificial Sequence: Synthetic oligonucleotide
tgttcatccagtgcaattgaaagacgtcacagtgc

SEQ ID NO: 398772 - DNA, 34 bp, Artificial Sequence
  Description of Artificial Sequence: Synthetic oligonucleotide
gttcatccagtgcaattgaaagacgtcacagtgc

SEQ ID NO: 398773 - DNA, 34 bp, Artificial Sequence
  Description of Artificial Sequence: Synthetic oligonucleotide
ttcatccagtgcaattgaaagacgtcacagtgcc

SEQ ID NO: 398774 - DNA, 33 bp, Artificial Sequence
  Description of Artificial Sequence: Synthetic oligonucleotide
tcatccagtgcaattgaaagacgtcacagtgcc

SEQ ID NO: 398775 - DNA, 32 bp, Artificial Sequence
  Description of Artificial Sequence: Synthetic oligonucleotide
catccagtgcaattgaaagacgtcacagtgcc

SEQ ID NO: 398776 - DNA, 33 bp, Artificial Sequence
  Description of Artificial Sequence: Synthetic oligonucleotide
atccagtgcaattgaaagacgtcacagtgccag

SEQ ID NO: 398777 - DNA, 32 bp, Artificial Sequence
  Description of Artificial Sequence: Synthetic oligonucleotide
tccagtgcaattgaaagacgtcacagtgccag

SEQ ID NO: 398778 - DNA, 31 bp, Artificial Sequence
  Description of Artificial Sequence: Synthetic oligonucleotide
ccagtgcaattgaaagacgtcacagtgccag

SEQ ID NO: 398779 - DNA, 31 bp, Artificial Sequence
  Description of Artificial Sequence: Synthetic oligonucleotide
cagtgcaattgaaagacgtcacagtgccagg

SEQ ID NO: 398780 - DNA, 31 bp, Artificial Sequence
  Description of Artificial Sequence: Synthetic oligonucleotide
agtgcaattgaaagacgtcacagtgccaggc

SEQ ID NO: 398781 - DNA, 30 bp, Artificial Sequence
  Description of Artificial Sequence: Synthetic oligonucleotide
gtgcaattgaaagacgtcacagtgccaggc

SEQ ID NO: 398782 - DNA, 31 bp, Artificial Sequence
  Description of Artificial Sequence: Synthetic oligonucleotide
tgcaattgaaagacgtcacagtgccaggcac

SEQ ID NO: 398783 - DNA, 30 bp, Artificial Sequence
  Description of Artificial Sequence: Synthetic oligonucleotide
gcaattgaaagacgtcacagtgccaggcac

SEQ ID NO: 398784 - DNA, 31 bp, Artificial Sequence
  Description of Artificial Sequence: Synthetic oligonucleotide
caattgaaagacgtcacagtgccaggcactg

SEQ ID NO: 398785 - DNA, 31 bp, Artificial Sequence
  Description of Artificial Sequence: Synthetic oligonucleotide
aattgaaagacgtcacagtgccaggcactgg

SEQ ID NO: 398786 - DNA, 30 bp, Artificial Sequence
  Description of Artificial Sequence: Synthetic oligonucleotide
attgaaagacgtcacagtgccaggcactgg

SEQ ID NO: 398787 - DNA, 29 bp, Artificial Sequence
  Description of Artificial Sequence: Synthetic oligonucleotide
ttgaaagacgtcacagtgccaggcactgg

SEQ ID NO: 398788 - DNA, 28 bp, Artificial Sequence
  Description of Artificial Sequence: Synthetic oligonucleotide
tgaaagacgtcacagtgccaggcactgg

SEQ ID NO: 398789 - DNA, 27 bp, Artificial Sequence
  Description of Artificial Sequence: Synthetic oligonucleotide
gaaagacgtcacagtgccaggcactgg

SEQ ID NO: 398790 - DNA, 30 bp, Artificial Sequence
  Description of Artificial Sequence: Synthetic oligonucleotide
aaagacgtcacagtgccaggcactggattc

SEQ ID NO: 398791 - DNA, 29 bp, Artificial Sequence
  Description of Artificial Sequence: Synthetic oligonucleotide
aagacgtcacagtgccaggcactggattc

SEQ ID NO: 398792 - DNA, 28 bp, Artificial Sequence
  Description of Artificial Sequence: Synthetic oligonucleotide
agacgtcacagtgccaggcactggattc

SEQ ID NO: 398793 - DNA, 27 bp, Artificial Sequence
  Description of Artificial Sequence: Synthetic oligonucleotide
gacgtcacagtgccaggcactggattc

SEQ ID NO: 398794 - DNA, 28 bp, Artificial Sequence
  Description of Artificial Sequence: Synthetic oligonucleotide
acgtcacagtgccaggcactggattcag

SEQ ID NO: 398795 - DNA, 27 bp, Artificial Sequence
  Description of Artificial Sequence: Synthetic oligonucleotide
cgtcacagtgccaggcactggattcag

SEQ ID NO: 398796 - DNA, 29 bp, Artificial Sequence
  Description of Artificial Sequence: Synthetic oligonucleotide
gtcacagtgccaggcactggattcagaac

SEQ ID NO: 398797 - DNA, 29 bp, Artificial Sequence
  Description of Artificial Sequence: Synthetic oligonucleotide
tcacagtgccaggcactggattcagaacc

SEQ ID NO: 398798 - DNA, 28 bp, Artificial Sequence
  Description of Artificial Sequence: Synthetic oligonucleotide
cacagtgccaggcactggattcagaacc

SEQ ID NO: 398799 - DNA, 30 bp, Artificial Sequence
  Description of Artificial Sequence: Synthetic oligonucleotide
acagtgccaggcactggattcagaaccttc

SEQ ID NO: 398800 - DNA, 29 bp, Artificial Sequence
  Description of Artificial Sequence: Synthetic oligonucleotide
cagtgccaggcactggattcagaaccttc

SEQ ID NO: 398801 - DNA, 30 bp, Artificial Sequence
  Description of Artificial Sequence: Synthetic oligonucleotide
agtgccaggcactggattcagaaccttcac

SEQ ID NO: 398802 - DNA, 29 bp, Artificial Sequence
  Description of Artificial Sequence: Synthetic oligonucleotide
gtgccaggcactggattcagaaccttcac

SEQ ID NO: 398803 - DNA, 40 bp, Artificial Sequence
  Description of Artificial Sequence: Synthetic oligonucleotide
tgccaggcactggattcagaaccttcacaaaaaaaaaatc

SEQ ID NO: 398804 - DNA, 39 bp, Artificial Sequence
  Description of Artificial Sequence: Synthetic oligonucleotide
gccaggcactggattcagaaccttcacaaaaaaaaaatc

SEQ ID NO: 398805 - DNA, 40 bp, Artificial Sequence
  Description of Artificial Sequence: Synthetic oligonucleotide
ccaggcactggattcagaaccttcacaaaaaaaaaatctg

SEQ ID NO: 398806 - DNA, 40 bp, Artificial Sequence
  Description of Artificial Sequence: Synthetic oligonucleotide
caggcactggattcagaaccttcacaaaaaaaaaatctgc

SEQ ID NO: 398807 - DNA, 40 bp, Artificial Sequence
  Description of Artificial Sequence: Synthetic oligonucleotide
aggcactggattcagaaccttcacaaaaaaaaaatctgcc

SEQ ID NO: 398808 - DNA, 39 bp, Artificial Sequence
  Description of Artificial Sequence: Synthetic oligonucleotide
ggcactggattcagaaccttcacaaaaaaaaaatctgcc

SEQ ID NO: 398809 - DNA, 39 bp, Artificial Sequence
  Description of Artificial Sequence: Synthetic oligonucleotide
gcactggattcagaaccttcacaaaaaaaaaatctgccc

SEQ ID NO: 398810 - DNA, 40 bp, Artificial Sequence
  Description of Artificial Sequence: Synthetic oligonucleotide
cactggattcagaaccttcacaaaaaaaaaatctgcccag

SEQ ID NO: 398811 - DNA, 41 bp, Artificial Sequence
  Description of Artificial Sequence: Synthetic oligonucleotide
actggattcagaaccttcacaaaaaaaaaatctgcccagag

SEQ ID NO: 398812 - DNA, 40 bp, Artificial Sequence
  Description of Artificial Sequence: Synthetic oligonucleotide
ctggattcagaaccttcacaaaaaaaaaatctgcccagag

SEQ ID NO: 398813 - DNA, 41 bp, Artificial Sequence
  Description of Artificial Sequence: Synthetic oligonucleotide
tggattcagaaccttcacaaaaaaaaaatctgcccagagac

SEQ ID NO: 398814 - DNA, 40 bp, Artificial Sequence
  Description of Artificial Sequence: Synthetic oligonucleotide
ggattcagaaccttcacaaaaaaaaaatctgcccagagac

SEQ ID NO: 398815 - DNA, 41 bp, Artificial Sequence
  Description of Artificial Sequence: Synthetic oligonucleotide
gattcagaaccttcacaaaaaaaaaatctgcccagagacag

SEQ ID NO: 398816 - DNA, 43 bp, Artificial Sequence
  Description of Artificial Sequence: Synthetic oligonucleotide
attcagaaccttcacaaaaaaaaaatctgcccagagacagatg

SEQ ID NO: 398817 - DNA, 42 bp, Artificial Sequence
  Description of Artificial Sequence: Synthetic oligonucleotide
ttcagaaccttcacaaaaaaaaaatctgcccagagacagatg

SEQ ID NO: 398818 - DNA, 41 bp, Artificial Sequence
  Description of Artificial Sequence: Synthetic oligonucleotide
tcagaaccttcacaaaaaaaaaatctgcccagagacagatg

SEQ ID NO: 398819 - DNA, 40 bp, Artificial Sequence
  Description of Artificial Sequence: Synthetic oligonucleotide
cagaaccttcacaaaaaaaaaatctgcccagagacagatg

SEQ ID NO: 398820 - DNA, 41 bp, Artificial Sequence
  Description of Artificial Sequence: Synthetic oligonucleotide
agaaccttcacaaaaaaaaaatctgcccagagacagatgag

SEQ ID NO: 398821 - DNA, 40 bp, Artificial Sequence
  Description of Artificial Sequence: Synthetic oligonucleotide
gaaccttcacaaaaaaaaaatctgcccagagacagatgag

SEQ ID NO: 398822 - DNA, 40 bp, Artificial Sequence
  Description of Artificial Sequence: Synthetic oligonucleotide
aaccttcacaaaaaaaaaatctgcccagagacagatgagg

SEQ ID NO: 398823 - DNA, 39 bp, Artificial Sequence
  Description of Artificial Sequence: Synthetic oligonucleotide
accttcacaaaaaaaaaatctgcccagagacagatgagg

SEQ ID NO: 398824 - DNA, 38 bp, Artificial Sequence
  Description of Artificial Sequence: Synthetic oligonucleotide
ccttcacaaaaaaaaaatctgcccagagacagatgagg

SEQ ID NO: 398825 - DNA, 39 bp, Artificial Sequence
  Description of Artificial Sequence: Synthetic oligonucleotide
cttcacaaaaaaaaaatctgcccagagacagatgaggtc

SEQ ID NO: 398826 - DNA, 39 bp, Artificial Sequence
  Description of Artificial Sequence: Synthetic oligonucleotide
ttcacaaaaaaaaaatctgcccagagacagatgaggtcc

SEQ ID NO: 398827 - DNA, 38 bp, Artificial Sequence
  Description of Artificial Sequence: Synthetic oligonucleotide
tcacaaaaaaaaaatctgcccagagacagatgaggtcc

SEQ ID NO: 398828 - DNA, 37 bp, Artificial Sequence
  Description of Artificial Sequence: Synthetic oligonucleotide
cacaaaaaaaaaatctgcccagagacagatgaggtcc

SEQ ID NO: 398829 - DNA, 39 bp, Artificial Sequence
  Description of Artificial Sequence: Synthetic oligonucleotide
acaaaaaaaaaatctgcccagagacagatgaggtccttc

SEQ ID NO: 398830 - DNA, 38 bp, Artificial Sequence
  Description of Artificial Sequence: Synthetic oligonucleotide
caaaaaaaaaatctgcccagagacagatgaggtccttc

SEQ ID NO: 398831 - DNA, 39 bp, Artificial Sequence
  Description of Artificial Sequence: Synthetic oligonucleotide
aaaaaaaaaatctgcccagagacagatgaggtccttcag

SEQ ID NO: 398832 - DNA, 38 bp, Artificial Sequence
  Description of Artificial Sequence: Synthetic oligonucleotide
aaaaaaaaatctgcccagagacagatgaggtccttcag

SEQ ID NO: 398833 - DNA, 37 bp, Artificial Sequence
  Description of Artificial Sequence: Synthetic oligonucleotide
aaaaaaaatctgcccagagacagatgaggtccttcag

SEQ ID NO: 398834 - DNA, 36 bp, Artificial Sequence
  Description of Artificial Sequence: Synthetic oligonucleotide
aaaaaaatctgcccagagacagatgaggtccttcag

SEQ ID NO: 398835 - DNA, 35 bp, Artificial Sequence
  Description of Artificial Sequence: Synthetic oligonucleotide
aaaaaatctgcccagagacagatgaggtccttcag

SEQ ID NO: 398836 - DNA, 34 bp, Artificial Sequence
  Description of Artificial Sequence: Synthetic oligonucleotide
aaaaatctgcccagagacagatgaggtccttcag

SEQ ID NO: 398837 - DNA, 33 bp, Artificial Sequence
  Description of Artificial Sequence: Synthetic oligonucleotide
aaaatctgcccagagacagatgaggtccttcag

SEQ ID NO: 398838 - DNA, 32 bp, Artificial Sequence
  Description of Artificial Sequence: Synthetic oligonucleotide
aaatctgcccagagacagatgaggtccttcag

SEQ ID NO: 398839 - DNA, 31 bp, Artificial Sequence
  Description of Artificial Sequence: Synthetic oligonucleotide
aatctgcccagagacagatgaggtccttcag

SEQ ID NO: 398840 - DNA, 30 bp, Artificial Sequence
  Description of Artificial Sequence: Synthetic oligonucleotide
atctgcccagagacagatgaggtccttcag

SEQ ID NO: 398841 - DNA, 29 bp, Artificial Sequence
  Description of Artificial Sequence: Synthetic oligonucleotide
tctgcccagagacagatgaggtccttcag

SEQ ID NO: 398842 - DNA, 28 bp, Artificial Sequence
  Description of Artificial Sequence: Synthetic oligonucleotide
ctgcccagagacagatgaggtccttcag

SEQ ID NO: 398843 - DNA, 28 bp, Artificial Sequence
  Description of Artificial Sequence: Synthetic oligonucleotide
tgcccagagacagatgaggtccttcagc

SEQ ID NO: 398844 - DNA, 27 bp, Artificial Sequence
  Description of Artificial Sequence: Synthetic oligonucleotide
gcccagagacagatgaggtccttcagc

SEQ ID NO: 398845 - DNA, 28 bp, Artificial Sequence
  Description of Artificial Sequence: Synthetic oligonucleotide
cccagagacagatgaggtccttcagctc

SEQ ID NO: 398846 - DNA, 28 bp, Artificial Sequence
  Description of Artificial Sequence: Synthetic oligonucleotide
ccagagacagatgaggtccttcagctcc

SEQ ID NO: 398847 - DNA, 29 bp, Artificial Sequence
  Description of Artificial Sequence: Synthetic oligonucleotide
cagagacagatgaggtccttcagctccag

SEQ ID NO: 398848 - DNA, 30 bp, Artificial Sequence
  Description of Artificial Sequence: Synthetic oligonucleotide
agagacagatgaggtccttcagctccagtg

SEQ ID NO: 398849 - DNA, 29 bp, Artificial Sequence
  Description of Artificial Sequence: Synthetic oligonucleotide
gagacagatgaggtccttcagctccagtg

SEQ ID NO: 398850 - DNA, 29 bp, Artificial Sequence
  Description of Artificial Sequence: Synthetic oligonucleotide
agacagatgaggtccttcagctccagtgc

SEQ ID NO: 398851 - DNA, 28 bp, Artificial Sequence
  Description of Artificial Sequence: Synthetic oligonucleotide
gacagatgaggtccttcagctccagtgc

SEQ ID NO: 398852 - DNA, 29 bp, Artificial Sequence
  Description of Artificial Sequence: Synthetic oligonucleotide
acagatgaggtccttcagctccagtgctg

SEQ ID NO: 398853 - DNA, 28 bp, Artificial Sequence
  Description of Artificial Sequence: Synthetic oligonucleotide
cagatgaggtccttcagctccagtgctg

SEQ ID NO: 398854 - DNA, 31 bp, Artificial Sequence
  Description of Artificial Sequence: Synthetic oligonucleotide
agatgaggtccttcagctccagtgctgattg

SEQ ID NO: 398855 - DNA, 30 bp, Artificial Sequence
  Description of Artificial Sequence: Synthetic oligonucleotide
gatgaggtccttcagctccagtgctgattg

SEQ ID NO: 398856 - DNA, 30 bp, Artificial Sequence
  Description of Artificial Sequence: Synthetic oligonucleotide
atgaggtccttcagctccagtgctgattgg

SEQ ID NO: 398857 - DNA, 29 bp, Artificial Sequence
  Description of Artificial Sequence: Synthetic oligonucleotide
tgaggtccttcagctccagtgctgattgg

SEQ ID NO: 398858 - DNA, 28 bp, Artificial Sequence
  Description of Artificial Sequence: Synthetic oligonucleotide
gaggtccttcagctccagtgctgattgg

SEQ ID NO: 398859 - DNA, 30 bp, Artificial Sequence
  Description of Artificial Sequence: Synthetic oligonucleotide
aggtccttcagctccagtgctgattggttc

SEQ ID NO: 398860 - DNA, 29 bp, Artificial Sequence
  Description of Artificial Sequence: Synthetic oligonucleotide
ggtccttcagctccagtgctgattggttc

SEQ ID NO: 398861 - DNA, 29 bp, Artificial Sequence
  Description of Artificial Sequence: Synthetic oligonucleotide
gtccttcagctccagtgctgattggttcc

SEQ ID NO: 398862 - DNA, 32 bp, Artificial Sequence
  Description of Artificial Sequence: Synthetic oligonucleotide
tccttcagctccagtgctgattggttcctttc

SEQ ID NO: 398863 - DNA, 31 bp, Artificial Sequence
  Description of Artificial Sequence: Synthetic oligonucleotide
ccttcagctccagtgctgattggttcctttc

SEQ ID NO: 398864 - DNA, 31 bp, Artificial Sequence
  Description of Artificial Sequence: Synthetic oligonucleotide
cttcagctccagtgctgattggttcctttcc

SEQ ID NO: 398865 - DNA, 33 bp, Artificial Sequence
  Description of Artificial Sequence: Synthetic oligonucleotide
ttcagctccagtgctgattggttcctttccaag

SEQ ID NO: 398866 - DNA, 32 bp, Artificial Sequence
  Description of Artificial Sequence: Synthetic oligonucleotide
tcagctccagtgctgattggttcctttccaag

SEQ ID NO: 398867 - DNA, 31 bp, Artificial Sequence
  Description of Artificial Sequence: Synthetic oligonucleotide
cagctccagtgctgattggttcctttccaag

SEQ ID NO: 398868 - DNA, 31 bp, Artificial Sequence
  Description of Artificial Sequence: Synthetic oligonucleotide
agctccagtgctgattggttcctttccaagg

SEQ ID NO: 398869 - DNA, 30 bp, Artificial Sequence
  Description of Artificial Sequence: Synthetic oligonucleotide
gctccagtgctgattggttcctttccaagg

SEQ ID NO: 398870 - DNA, 30 bp, Artificial Sequence
  Description of Artificial Sequence: Synthetic oligonucleotide
ctccagtgctgattggttcctttccaaggg

SEQ ID NO: 398871 - DNA, 31 bp, Artificial Sequence
  Description of Artificial Sequence: Synthetic oligonucleotide
tccagtgctgattggttcctttccaagggac

SEQ ID NO: 398872 - DNA, 30 bp, Artificial Sequence
  Description of Artificial Sequence: Synthetic oligonucleotide
ccagtgctgattggttcctttccaagggac

SEQ ID NO: 398873 - DNA, 30 bp, Artificial Sequence
  Description of Artificial Sequence: Synthetic oligonucleotide
cagtgctgattggttcctttccaagggacc

SEQ ID NO: 398874 - DNA, 32 bp, Artificial Sequence
  Description of Artificial Sequence: Synthetic oligonucleotide
agtgctgattggttcctttccaagggaccatc

SEQ ID NO: 398875 - DNA, 31 bp, Artificial Sequence
  Description of Artificial Sequence: Synthetic oligonucleotide
gtgctgattggttcctttccaagggaccatc

SEQ ID NO: 398876 - DNA, 31 bp, Artificial Sequence
  Description of Artificial Sequence: Synthetic oligonucleotide
tgctgattggttcctttccaagggaccatcc

SEQ ID NO: 398877 - DNA, 30 bp, Artificial Sequence
  Description of Artificial Sequence: Synthetic oligonucleotide
gctgattggttcctttccaagggaccatcc

SEQ ID NO: 398878 - DNA, 33 bp, Artificial Sequence
  Description of Artificial Sequence: Synthetic oligonucleotide
ctgattggttcctttccaagggaccatccaatc

SEQ ID NO: 398879 - DNA, 33 bp, Artificial Sequence
  Description of Artificial Sequence: Synthetic oligonucleotide
tgattggttcctttccaagggaccatccaatcc

SEQ ID NO: 398880 - DNA, 32 bp, Artificial Sequence
  Description of Artificial Sequence: Synthetic oligonucleotide
gattggttcctttccaagggaccatccaatcc

SEQ ID NO: 398881 - DNA, 34 bp, Artificial Sequence
  Description of Artificial Sequence: Synthetic oligonucleotide
attggttcctttccaagggaccatccaatcctac

SEQ ID NO: 398882 - DNA, 33 bp, Artificial Sequence
  Description of Artificial Sequence: Synthetic oligonucleotide
ttggttcctttccaagggaccatccaatcctac

SEQ ID NO: 398883 - DNA, 32 bp, Artificial Sequence
  Description of Artificial Sequence: Synthetic oligonucleotide
tggttcctttccaagggaccatccaatcctac

SEQ ID NO: 398884 - DNA, 31 bp, Artificial Sequence
  Description of Artificial Sequence: Synthetic oligonucleotide
ggttcctttccaagggaccatccaatcctac

SEQ ID NO: 398885 - DNA, 31 bp, Artificial Sequence
  Description of Artificial Sequence: Synthetic oligonucleotide
gttcctttccaagggaccatccaatcctacc

SEQ ID NO: 398886 - DNA, 32 bp, Artificial Sequence
  Description of Artificial Sequence: Synthetic oligonucleotide
ttcctttccaagggaccatccaatcctaccac

SEQ ID NO: 398887 - DNA, 31 bp, Artificial Sequence
  Description of Artificial Sequence: Synthetic oligonucleotide
tcctttccaagggaccatccaatcctaccac

SEQ ID NO: 398888 - DNA, 30 bp, Artificial Sequence
  Description of Artificial Sequence: Synthetic oligonucleotide
cctttccaagggaccatccaatcctaccac

SEQ ID NO: 398889 - DNA, 30 bp, Artificial Sequence
  Description of Artificial Sequence: Synthetic oligonucleotide
ctttccaagggaccatccaatcctaccacg

SEQ ID NO: 398890 - DNA, 30 bp, Artificial Sequence
  Description of Artificial Sequence: Synthetic oligonucleotide
tttccaagggaccatccaatcctaccacgc

SEQ ID NO: 398891 - DNA, 29 bp, Artificial Sequence
  Description of Artificial Sequence: Synthetic oligonucleotide
ttccaagggaccatccaatcctaccacgc

SEQ ID NO: 398892 - DNA, 28 bp, Artificial Sequence
  Description of Artificial Sequence: Synthetic oligonucleotide
tccaagggaccatccaatcctaccacgc

SEQ ID NO: 398893 - DNA, 27 bp, Artificial Sequence
  Description of Artificial Sequence: Synthetic oligonucleotide
ccaagggaccatccaatcctaccacgc

SEQ ID NO: 398894 - DNA, 29 bp, Artificial Sequence
  Description of Artificial Sequence: Synthetic oligonucleotide
caagggaccatccaatcctaccacgcatg

SEQ ID NO: 398895 - DNA, 29 bp, Artificial Sequence
  Description of Artificial Sequence: Synthetic oligonucleotide
aagggaccatccaatcctaccacgcatgg

SEQ ID NO: 398896 - DNA, 28 bp, Artificial Sequence
  Description of Artificial Sequence: Synthetic oligonucleotide
agggaccatccaatcctaccacgcatgg

SEQ ID NO: 398897 - DNA, 27 bp, Artificial Sequence
  Description of Artificial Sequence: Synthetic oligonucleotide
gggaccatccaatcctaccacgcatgg

SEQ ID NO: 398898 - DNA, 30 bp, Artificial Sequence
  Description of Artificial Sequence: Synthetic oligonucleotide
ggaccatccaatcctaccacgcatggaaac

SEQ ID NO: 398899 - DNA, 32 bp, Artificial Sequence
  Description of Artificial Sequence: Synthetic oligonucleotide
gaccatccaatcctaccacgcatggaaacatc

SEQ ID NO: 398900 - DNA, 32 bp, Artificial Sequence
  Description of Artificial Sequence: Synthetic oligonucleotide
accatccaatcctaccacgcatggaaacatcc

SEQ ID NO: 398901 - DNA, 31 bp, Artificial Sequence
  Description of Artificial Sequence: Synthetic oligonucleotide
ccatccaatcctaccacgcatggaaacatcc

SEQ ID NO: 398902 - DNA, 32 bp, Artificial Sequence
  Description of Artificial Sequence: Synthetic oligonucleotide
catccaatcctaccacgcatggaaacatccac

SEQ ID NO: 398903 - DNA, 33 bp, Artificial Sequence
  Description of Artificial Sequence: Synthetic oligonucleotide
atccaatcctaccacgcatggaaacatccacag

SEQ ID NO: 398904 - DNA, 32 bp, Artificial Sequence
  Description of Artificial Sequence: Synthetic oligonucleotide
tccaatcctaccacgcatggaaacatccacag

SEQ ID NO: 398905 - DNA, 31 bp, Artificial Sequence
  Description of Artificial Sequence: Synthetic oligonucleotide
ccaatcctaccacgcatggaaacatccacag

SEQ ID NO: 398906 - DNA, 40 bp, Artificial Sequence
  Description of Artificial Sequence: Synthetic oligonucleotide
caatcctaccacgcatggaaacatccacagatttttattc

SEQ ID NO: 398907 - DNA, 43 bp, Artificial Sequence
  Description of Artificial Sequence: Synthetic oligonucleotide
aatcctaccacgcatggaaacatccacagatttttattctttc

SEQ ID NO: 398908 - DNA, 42 bp, Artificial Sequence
  Description of Artificial Sequence: Synthetic oligonucleotide
atcctaccacgcatggaaacatccacagatttttattctttc

SEQ ID NO: 398909 - DNA, 41 bp, Artificial Sequence
  Description of Artificial Sequence: Synthetic oligonucleotide
tcctaccacgcatggaaacatccacagatttttattctttc

SEQ ID NO: 398910 - DNA, 40 bp, Artificial Sequence
  Description of Artificial Sequence: Synthetic oligonucleotide
cctaccacgcatggaaacatccacagatttttattctttc

SEQ ID NO: 398911 - DNA, 41 bp, Artificial Sequence
  Description of Artificial Sequence: Synthetic oligonucleotide
ctaccacgcatggaaacatccacagatttttattctttctg

SEQ ID NO: 398912 - DNA, 41 bp, Artificial Sequence
  Description of Artificial Sequence: Synthetic oligonucleotide
taccacgcatggaaacatccacagatttttattctttctgc

SEQ ID NO: 398913 - DNA, 40 bp, Artificial Sequence
  Description of Artificial Sequence: Synthetic oligonucleotide
accacgcatggaaacatccacagatttttattctttctgc

SEQ ID NO: 398914 - DNA, 39 bp, Artificial Sequence
  Description of Artificial Sequence: Synthetic oligonucleotide
ccacgcatggaaacatccacagatttttattctttctgc

SEQ ID NO: 398915 - DNA, 39 bp, Artificial Sequence
  Description of Artificial Sequence: Synthetic oligonucleotide
cacgcatggaaacatccacagatttttattctttctgcc

SEQ ID NO: 398916 - DNA, 40 bp, Artificial Sequence
  Description of Artificial Sequence: Synthetic oligonucleotide
acgcatggaaacatccacagatttttattctttctgccag

SEQ ID NO: 398917 - DNA, 39 bp, Artificial Sequence
  Description of Artificial Sequence: Synthetic oligonucleotide
cgcatggaaacatccacagatttttattctttctgccag

SEQ ID NO: 398918 - DNA, 39 bp, Artificial Sequence
  Description of Artificial Sequence: Synthetic oligonucleotide
gcatggaaacatccacagatttttattctttctgccagg

SEQ ID NO: 398919 - DNA, 41 bp, Artificial Sequence
  Description of Artificial Sequence: Synthetic oligonucleotide
catggaaacatccacagatttttattctttctgccaggtac

SEQ ID NO: 398920 - DNA, 43 bp, Artificial Sequence
  Description of Artificial Sequence: Synthetic oligonucleotide
atggaaacatccacagatttttattctttctgccaggtacatc

SEQ ID NO: 398921 - DNA, 42 bp, Artificial Sequence
  Description of Artificial Sequence: Synthetic oligonucleotide
tggaaacatccacagatttttattctttctgccaggtacatc

SEQ ID NO: 398922 - DNA, 41 bp, Artificial Sequence
  Description of Artificial Sequence: Synthetic oligonucleotide
ggaaacatccacagatttttattctttctgccaggtacatc

SEQ ID NO: 398923 - DNA, 42 bp, Artificial Sequence
  Description of Artificial Sequence: Synthetic oligonucleotide
gaaacatccacagatttttattctttctgccaggtacatcag

SEQ ID NO: 398924 - DNA, 44 bp, Artificial Sequence
  Description of Artificial Sequence: Synthetic oligonucleotide
aaacatccacagatttttattctttctgccaggtacatcagatc

SEQ ID NO: 398925 - DNA, 43 bp, Artificial Sequence
  Description of Artificial Sequence: Synthetic oligonucleotide
aacatccacagatttttattctttctgccaggtacatcagatc

SEQ ID NO: 398926 - DNA, 42 bp, Artificial Sequence
  Description of Artificial Sequence: Synthetic oligonucleotide
acatccacagatttttattctttctgccaggtacatcagatc

SEQ ID NO: 398927 - DNA, 41 bp, Artificial Sequence
  Description of Artificial Sequence: Synthetic oligonucleotide
catccacagatttttattctttctgccaggtacatcagatc

SEQ ID NO: 398928 - DNA, 41 bp, Artificial Sequence
  Description of Artificial Sequence: Synthetic oligonucleotide
atccacagatttttattctttctgccaggtacatcagatcc

SEQ ID NO: 398929 - DNA, 40 bp, Artificial Sequence
  Description of Artificial Sequence: Synthetic oligonucleotide
tccacagatttttattctttctgccaggtacatcagatcc

SEQ ID NO: 398930 - DNA, 39 bp, Artificial Sequence
  Description of Artificial Sequence: Synthetic oligonucleotide
ccacagatttttattctttctgccaggtacatcagatcc

SEQ ID NO: 398931 - DNA, 41 bp, Artificial Sequence
  Description of Artificial Sequence: Synthetic oligonucleotide
cacagatttttattctttctgccaggtacatcagatccatc

SEQ ID NO: 398932 - DNA, 42 bp, Artificial Sequence
  Description of Artificial Sequence: Synthetic oligonucleotide
acagatttttattctttctgccaggtacatcagatccatcag

SEQ ID NO: 398933 - DNA, 41 bp, Artificial Sequence
  Description of Artificial Sequence: Synthetic oligonucleotide
cagatttttattctttctgccaggtacatcagatccatcag

SEQ ID NO: 398934 - DNA, 41 bp, Artificial Sequence
  Description of Artificial Sequence: Synthetic oligonucleotide
agatttttattctttctgccaggtacatcagatccatcagg

SEQ ID NO: 398935 - DNA, 40 bp, Artificial Sequence
  Description of Artificial Sequence: Synthetic oligonucleotide
gatttttattctttctgccaggtacatcagatccatcagg

SEQ ID NO: 398936 - DNA, 41 bp, Artificial Sequence
  Description of Artificial Sequence: Synthetic oligonucleotide
atttttattctttctgccaggtacatcagatccatcaggtc

SEQ ID NO: 398937 - DNA, 40 bp, Artificial Sequence
  Description of Artificial Sequence: Synthetic oligonucleotide
tttttattctttctgccaggtacatcagatccatcaggtc

SEQ ID NO: 398938 - DNA, 39 bp, Artificial Sequence
  Description of Artificial Sequence: Synthetic oligonucleotide
ttttattctttctgccaggtacatcagatccatcaggtc

SEQ ID NO: 398939 - DNA, 38 bp, Artificial Sequence
  Description of Artificial Sequence: Synthetic oligonucleotide
tttattctttctgccaggtacatcagatccatcaggtc

SEQ ID NO: 398940 - DNA, 37 bp, Artificial Sequence
  Description of Artificial Sequence: Synthetic oligonucleotide
ttattctttctgccaggtacatcagatccatcaggtc

SEQ ID NO: 398941 - DNA, 36 bp, Artificial Sequence
  Description of Artificial Sequence: Synthetic oligonucleotide
tattctttctgccaggtacatcagatccatcaggtc

SEQ ID NO: 398942 - DNA, 35 bp, Artificial Sequence
  Description of Artificial Sequence: Synthetic oligonucleotide
attctttctgccaggtacatcagatccatcaggtc

SEQ ID NO: 398943 - DNA, 34 bp, Artificial Sequence
  Description of Artificial Sequence: Synthetic oligonucleotide
ttctttctgccaggtacatcagatccatcaggtc

SEQ ID NO: 398944 - DNA, 33 bp, Artificial Sequence
  Description of Artificial Sequence: Synthetic oligonucleotide
tctttctgccaggtacatcagatccatcaggtc

SEQ ID NO: 398945 - DNA, 32 bp, Artificial Sequence
  Description of Artificial Sequence: Synthetic oligonucleotide
ctttctgccaggtacatcagatccatcaggtc

SEQ ID NO: 398946 - DNA, 32 bp, Artificial Sequence
  Description of Artificial Sequence: Synthetic oligonucleotide
tttctgccaggtacatcagatccatcaggtcc

SEQ ID NO: 398947 - DNA, 31 bp, Artificial Sequence
  Description of Artificial Sequence: Synthetic oligonucleotide
ttctgccaggtacatcagatccatcaggtcc

SEQ ID NO: 398948 - DNA, 30 bp, Artificial Sequence
  Description of Artificial Sequence: Synthetic oligonucleotide
tctgccaggtacatcagatccatcaggtcc

SEQ ID NO: 398949 - DNA, 29 bp, Artificial Sequence
  Description of Artificial Sequence: Synthetic oligonucleotide
ctgccaggtacatcagatccatcaggtcc

SEQ ID NO: 398950 - DNA, 29 bp, Artificial Sequence
  Description of Artificial Sequence: Synthetic oligonucleotide
tgccaggtacatcagatccatcaggtccg

SEQ ID NO: 398951 - DNA, 28 bp, Artificial Sequence
  Description of Artificial Sequence: Synthetic oligonucleotide
gccaggtacatcagatccatcaggtccg

SEQ ID NO: 398952 - DNA, 29 bp, Artificial Sequence
  Description of Artificial Sequence: Synthetic oligonucleotide
ccaggtacatcagatccatcaggtccgag

SEQ ID NO: 398953 - DNA, 29 bp, Artificial Sequence
  Description of Artificial Sequence: Synthetic oligonucleotide
caggtacatcagatccatcaggtccgagc

SEQ ID NO: 398954 - DNA, 30 bp, Artificial Sequence
  Description of Artificial Sequence: Synthetic oligonucleotide
aggtacatcagatccatcaggtccgagctg

SEQ ID NO: 398955 - DNA, 29 bp, Artificial Sequence
  Description of Artificial Sequence: Synthetic oligonucleotide
ggtacatcagatccatcaggtccgagctg

SEQ ID NO: 398956 - DNA, 30 bp, Artificial Sequence
  Description of Artificial Sequence: Synthetic oligonucleotide
gtacatcagatccatcaggtccgagctgtg

SEQ ID NO: 398957 - DNA, 32 bp, Artificial Sequence
  Description of Artificial Sequence: Synthetic oligonucleotide
tacatcagatccatcaggtccgagctgtgttg

SEQ ID NO: 398958 - DNA, 31 bp, Artificial Sequence
  Description of Artificial Sequence: Synthetic oligonucleotide
acatcagatccatcaggtccgagctgtgttg

SEQ ID NO: 398959 - DNA, 30 bp, Artificial Sequence
  Description of Artificial Sequence: Synthetic oligonucleotide
catcagatccatcaggtccgagctgtgttg

SEQ ID NO: 398960 - DNA, 31 bp, Artificial Sequence
  Description of Artificial Sequence: Synthetic oligonucleotide
atcagatccatcaggtccgagctgtgttgac

SEQ ID NO: 398961 - DNA, 30 bp, Artificial Sequence
  Description of Artificial Sequence: Synthetic oligonucleotide
tcagatccatcaggtccgagctgtgttgac

SEQ ID NO: 398962 - DNA, 29 bp, Artificial Sequence
  Description of Artificial Sequence: Synthetic oligonucleotide
cagatccatcaggtccgagctgtgttgac

SEQ ID NO: 398963 - DNA, 31 bp, Artificial Sequence
  Description of Artificial Sequence: Synthetic oligonucleotide
agatccatcaggtccgagctgtgttgactac

SEQ ID NO: 398964 - DNA, 30 bp, Artificial Sequence
  Description of Artificial Sequence: Synthetic oligonucleotide
gatccatcaggtccgagctgtgttgactac

SEQ ID NO: 398965 - DNA, 30 bp, Artificial Sequence
  Description of Artificial Sequence: Synthetic oligonucleotide
atccatcaggtccgagctgtgttgactacc

SEQ ID NO: 398966 - DNA, 29 bp, Artificial Sequence
  Description of Artificial Sequence: Synthetic oligonucleotide
tccatcaggtccgagctgtgttgactacc

SEQ ID NO: 398967 - DNA, 28 bp, Artificial Sequence
  Description of Artificial Sequence: Synthetic oligonucleotide
ccatcaggtccgagctgtgttgactacc

SEQ ID NO: 398968 - DNA, 29 bp, Artificial Sequence
  Description of Artificial Sequence: Synthetic oligonucleotide
catcaggtccgagctgtgttgactaccac

SEQ ID NO: 398969 - DNA, 33 bp, Artificial Sequence
  Description of Artificial Sequence: Synthetic oligonucleotide
atcaggtccgagctgtgttgactaccacttttc

SEQ ID NO: 398970 - DNA, 32 bp, Artificial Sequence
  Description of Artificial Sequence: Synthetic oligonucleotide
tcaggtccgagctgtgttgactaccacttttc

SEQ ID NO: 398971 - DNA, 31 bp, Artificial Sequence
  Description of Artificial Sequence: Synthetic oligonucleotide
caggtccgagctgtgttgactaccacttttc

SEQ ID NO: 398972 - DNA, 31 bp, Artificial Sequence
  Description of Artificial Sequence: Synthetic oligonucleotide
aggtccgagctgtgttgactaccacttttcc

SEQ ID NO: 398973 - DNA, 30 bp, Artificial Sequence
  Description of Artificial Sequence: Synthetic oligonucleotide
ggtccgagctgtgttgactaccacttttcc

SEQ ID NO: 398974 - DNA, 30 bp, Artificial Sequence
  Description of Artificial Sequence: Synthetic oligonucleotide
gtccgagctgtgttgactaccacttttccc

SEQ ID NO: 398975 - DNA, 32 bp, Artificial Sequence
  Description of Artificial Sequence: Synthetic oligonucleotide
tccgagctgtgttgactaccacttttcccttc

SEQ ID NO: 398976 - DNA, 31 bp, Artificial Sequence
  Description of Artificial Sequence: Synthetic oligonucleotide
ccgagctgtgttgactaccacttttcccttc

SEQ ID NO: 398977 - DNA, 31 bp, Artificial Sequence
  Description of Artificial Sequence: Synthetic oligonucleotide
cgagctgtgttgactaccacttttcccttcg

SEQ ID NO: 398978 - DNA, 32 bp, Artificial Sequence
  Description of Artificial Sequence: Synthetic oligonucleotide
gagctgtgttgactaccacttttcccttcgtc

SEQ ID NO: 398979 - DNA, 33 bp, Artificial Sequence
  Description of Artificial Sequence: Synthetic oligonucleotide
agctgtgttgactaccacttttcccttcgtctc

SEQ ID NO: 398980 - DNA, 32 bp, Artificial Sequence
  Description of Artificial Sequence: Synthetic oligonucleotide
gctgtgttgactaccacttttcccttcgtctc

SEQ ID NO: 398981 - DNA, 38 bp, Artificial Sequence
  Description of Artificial Sequence: Synthetic oligonucleotide
ctgtgttgactaccacttttcccttcgtctcaattatg

SEQ ID NO: 398982 - DNA, 39 bp, Artificial Sequence
  Description of Artificial Sequence: Synthetic oligonucleotide
tgtgttgactaccacttttcccttcgtctcaattatgtc

SEQ ID NO: 398983 - DNA, 38 bp, Artificial Sequence
  Description of Artificial Sequence: Synthetic oligonucleotide
gtgttgactaccacttttcccttcgtctcaattatgtc

SEQ ID NO: 398984 - DNA, 40 bp, Artificial Sequence
  Description of Artificial Sequence: Synthetic oligonucleotide
tgttgactaccacttttcccttcgtctcaattatgtcttg

SEQ ID NO: 398985 - DNA, 39 bp, Artificial Sequence
  Description of Artificial Sequence: Synthetic oligonucleotide
gttgactaccacttttcccttcgtctcaattatgtcttg

SEQ ID NO: 398986 - DNA, 39 bp, Artificial Sequence
  Description of Artificial Sequence: Synthetic oligonucleotide
ttgactaccacttttcccttcgtctcaattatgtcttgg

SEQ ID NO: 398987 - DNA, 38 bp, Artificial Sequence
  Description of Artificial Sequence: Synthetic oligonucleotide
tgactaccacttttcccttcgtctcaattatgtcttgg

SEQ ID NO: 398988 - DNA, 37 bp, Artificial Sequence
  Description of Artificial Sequence: Synthetic oligonucleotide
gactaccacttttcccttcgtctcaattatgtcttgg

SEQ ID NO: 398989 - DNA, 42 bp, Artificial Sequence
  Description of Artificial Sequence: Synthetic oligonucleotide
actaccacttttcccttcgtctcaattatgtcttggaaaaag

SEQ ID NO: 398990 - DNA, 41 bp, Artificial Sequence
  Description of Artificial Sequence: Synthetic oligonucleotide
ctaccacttttcccttcgtctcaattatgtcttggaaaaag

SEQ ID NO: 398991 - DNA, 41 bp, Artificial Sequence
  Description of Artificial Sequence: Synthetic oligonucleotide
taccacttttcccttcgtctcaattatgtcttggaaaaagg

SEQ ID NO: 398992 - DNA, 40 bp, Artificial Sequence
  Description of Artificial Sequence: Synthetic oligonucleotide
accacttttcccttcgtctcaattatgtcttggaaaaagg

SEQ ID NO: 398993 - DNA, 39 bp, Artificial Sequence
  Description of Artificial Sequence: Synthetic oligonucleotide
ccacttttcccttcgtctcaattatgtcttggaaaaagg

SEQ ID NO: 398994 - DNA, 39 bp, Artificial Sequence
  Description of Artificial Sequence: Synthetic oligonucleotide
cacttttcccttcgtctcaattatgtcttggaaaaaggc

SEQ ID NO: 398995 - DNA, 42 bp, Artificial Sequence
  Description of Artificial Sequence: Synthetic oligonucleotide
acttttcccttcgtctcaattatgtcttggaaaaaggctttg

SEQ ID NO: 398996 - DNA, 41 bp, Artificial Sequence
  Description of Artificial Sequence: Synthetic oligonucleotide
cttttcccttcgtctcaattatgtcttggaaaaaggctttg

SEQ ID NO: 398997 - DNA, 41 bp, Artificial Sequence
  Description of Artificial Sequence: Synthetic oligonucleotide
ttttcccttcgtctcaattatgtcttggaaaaaggctttgc

SEQ ID NO: 398998 - DNA, 40 bp, Artificial Sequence
  Description of Artificial Sequence: Synthetic oligonucleotide
tttcccttcgtctcaattatgtcttggaaaaaggctttgc

SEQ ID NO: 398999 - DNA, 39 bp, Artificial Sequence
  Description of Artificial Sequence: Synthetic oligonucleotide
ttcccttcgtctcaattatgtcttggaaaaaggctttgc

SEQ ID NO: 399000 - DNA, 38 bp, Artificial Sequence
  Description of Artificial Sequence: Synthetic oligonucleotide
tcccttcgtctcaattatgtcttggaaaaaggctttgc

SEQ ID NO: 399001 - DNA, 37 bp, Artificial Sequence
  Description of Artificial Sequence: Synthetic oligonucleotide
cccttcgtctcaattatgtcttggaaaaaggctttgc

SEQ ID NO: 399002 - DNA, 37 bp, Artificial Sequence
  Description of Artificial Sequence: Synthetic oligonucleotide
ccttcgtctcaattatgtcttggaaaaaggctttgcg

SEQ ID NO: 399003 - DNA, 37 bp, Artificial Sequence
  Description of Artificial Sequence: Synthetic oligonucleotide
cttcgtctcaattatgtcttggaaaaaggctttgcgg

SEQ ID NO: 399004 - DNA, 39 bp, Artificial Sequence
  Description of Artificial Sequence: Synthetic oligonucleotide
ttcgtctcaattatgtcttggaaaaaggctttgcggatc

SEQ ID NO: 399005 - DNA, 38 bp, Artificial Sequence
  Description of Artificial Sequence: Synthetic oligonucleotide
tcgtctcaattatgtcttggaaaaaggctttgcggatc

SEQ ID NO: 399006 - DNA, 37 bp, Artificial Sequence
  Description of Artificial Sequence: Synthetic oligonucleotide
cgtctcaattatgtcttggaaaaaggctttgcggatc

SEQ ID NO: 399007 - DNA, 37 bp, Artificial Sequence
  Description of Artificial Sequence: Synthetic oligonucleotide
gtctcaattatgtcttggaaaaaggctttgcggatcc

SEQ ID NO: 399008 - DNA, 37 bp, Artificial Sequence
  Description of Artificial Sequence: Synthetic oligonucleotide
tctcaattatgtcttggaaaaaggctttgcggatccc

SEQ ID NO: 399009 - DNA, 36 bp, Artificial Sequence
  Description of Artificial Sequence: Synthetic oligonucleotide
ctcaattatgtcttggaaaaaggctttgcggatccc

SEQ ID NO: 399010 - DNA, 36 bp, Artificial Sequence
  Description of Artificial Sequence: Synthetic oligonucleotide
tcaattatgtcttggaaaaaggctttgcggatcccc

SEQ ID NO: 399011 - DNA, 35 bp, Artificial Sequence
  Description of Artificial Sequence: Synthetic oligonucleotide
caattatgtcttggaaaaaggctttgcggatcccc

SEQ ID NO: 399012 - DNA, 35 bp, Artificial Sequence
  Description of Artificial Sequence: Synthetic oligonucleotide
aattatgtcttggaaaaaggctttgcggatccccg

SEQ ID NO: 399013 - DNA, 34 bp, Artificial Sequence
  Description of Artificial Sequence: Synthetic oligonucleotide
attatgtcttggaaaaaggctttgcggatccccg

SEQ ID NO: 399014 - DNA, 33 bp, Artificial Sequence
  Description of Artificial Sequence: Synthetic oligonucleotide
ttatgtcttggaaaaaggctttgcggatccccg

SEQ ID NO: 399015 - DNA, 32 bp, Artificial Sequence
  Description of Artificial Sequence: Synthetic oligonucleotide
tatgtcttggaaaaaggctttgcggatccccg

SEQ ID NO: 399016 - DNA, 31 bp, Artificial Sequence; identical to SEQ ID NO: 58022
  Description of Artificial Sequence: Synthetic oligonucleotide

SEQ ID NO: 399017 - DNA, 30 bp, Artificial Sequence; identical to SEQ ID NO: 58023
  Description of Artificial Sequence: Synthetic oligonucleotide

SEQ ID NO: 399018 - DNA, 29 bp, Artificial Sequence
  Description of Artificial Sequence: Synthetic oligonucleotide
gtcttggaaaaaggctttgcggatccccg

SEQ ID NO: 399019 - DNA, 29 bp, Artificial Sequence
  Description of Artificial Sequence: Synthetic oligonucleotide
tcttggaaaaaggctttgcggatccccgg

SEQ ID NO: 399020 - DNA, 28 bp, Artificial Sequence
  Description of Artificial Sequence: Synthetic oligonucleotide
cttggaaaaaggctttgcggatccccgg

SEQ ID NO: 399021 - DNA, 29 bp, Artificial Sequence
  Description of Artificial Sequence: Synthetic oligonucleotide
ttggaaaaaggctttgcggatccccggag

SEQ ID NO: 399022 - DNA, 28 bp, Artificial Sequence
  Description of Artificial Sequence: Synthetic oligonucleotide
tggaaaaaggctttgcggatccccggag

SEQ ID NO: 399023 - DNA, 27 bp, Artificial Sequence
  Description of Artificial Sequence: Synthetic oligonucleotide
ggaaaaaggctttgcggatccccggag

SEQ ID NO: 399024 - DNA, 27 bp, Artificial Sequence
  Description of Artificial Sequence: Synthetic oligonucleotide
gaaaaaggctttgcggatccccggagg

SEQ ID NO: 399025 - DNA, 27 bp, Artificial Sequence
  Description of Artificial Sequence: Synthetic oligonucleotide
aaaaaggctttgcggatccccggaggc

SEQ ID NO: 399026 - DNA, 26 bp, Artificial Sequence
  Description of Artificial Sequence: Synthetic oligonucleotide
aaaaggctttgcggatccccggaggc

SEQ ID NO: 399027 - DNA, 25 bp, Artificial Sequence
  Description of Artificial Sequence: Synthetic oligonucleotide
aaaggctttgcggatccccggaggc

SEQ ID NO: 399028 - DNA, 24 bp, Artificial Sequence
  Description of Artificial Sequence: Synthetic oligonucleotide
aaggctttgcggatccccggaggc

SEQ ID NO: 399029 - DNA, 23 bp, Artificial Sequence
  Description of Artificial Sequence: Synthetic oligonucleotide
aggctttgcggatccccggaggc

SEQ ID NO: 399030 - DNA, 22 bp, Artificial Sequence
  Description of Artificial Sequence: Synthetic oligonucleotide
ggctttgcggatccccggaggc

SEQ ID NO: 399031 - DNA, 24 bp, Artificial Sequence
  Description of Artificial Sequence: Synthetic oligonucleotide
gctttgcggatccccggaggcctt

SEQ ID NO: 399032 - DNA, 24 bp, Artificial Sequence
  Description of Artificial Sequence: Synthetic oligonucleotide
ctttgcggatccccggaggccttc

SEQ ID NO: 399033 - DNA, 24 bp, Artificial Sequence
  Description of Artificial Sequence: Synthetic oligonucleotide
tttgcggatccccggaggccttcg

SEQ ID NO: 399034 - DNA, 23 bp, Artificial Sequence
  Description of Artificial Sequence: Synthetic oligonucleotide
ttgcggatccccggaggccttcg

SEQ ID NO: 399035 - DNA, 22 bp, Artificial Sequence
  Description of Artificial Sequence: Synthetic oligonucleotide
tgcggatccccggaggccttcg

SEQ ID NO: 399036 - DNA, 21 bp, Artificial Sequence
  Description of Artificial Sequence: Synthetic oligonucleotide
gcggatccccggaggccttcg

SEQ ID NO: 399037 - DNA, 21 bp, Artificial Sequence
  Description of Artificial Sequence: Synthetic oligonucleotide
cggatccccggaggccttcgg

SEQ ID NO: 399038 - DNA, 21 bp, Artificial Sequence
  Description of Artificial Sequence: Synthetic oligonucleotide
ggatccccggaggccttcggg

SEQ ID NO: 399039 - DNA, 22 bp, Artificial Sequence
  Description of Artificial Sequence: Synthetic oligonucleotide
gatccccggaggccttcgggca

SEQ ID NO: 399040 - DNA, 22 bp, Artificial Sequence
  Description of Artificial Sequence: Synthetic oligonucleotide
atccccggaggccttcgggcag

SEQ ID NO: 399041 - DNA, 21 bp, Artificial Sequence
  Description of Artificial Sequence: Synthetic oligonucleotide
tccccggaggccttcgggcag

SEQ ID NO: 399042 - DNA, 20 bp, Artificial Sequence
  Description of Artificial Sequence: Synthetic oligonucleotide
ccccggaggccttcgggcag

SEQ ID NO: 399043 - DNA, 22 bp, Artificial Sequence
  Description of Artificial Sequence: Synthetic oligonucleotide
cccggaggccttcgggcagcaa

SEQ ID NO: 399044 - DNA, 23 bp, Artificial Sequence
  Description of Artificial Sequence: Synthetic oligonucleotide
ccggaggccttcgggcagcaact

SEQ ID NO: 399045 - DNA, 24 bp, Artificial Sequence
  Description of Artificial Sequence: Synthetic oligonucleotide
cggaggccttcgggcagcaactgt

SEQ ID NO: 399046 - DNA, 25 bp, Artificial Sequence
  Description of Artificial Sequence: Synthetic oligonucleotide
ggaggccttcgggcagcaactgtga

SEQ ID NO: 399047 - DNA, 25 bp, Artificial Sequence
  Description of Artificial Sequence: Synthetic oligonucleotide
gaggccttcgggcagcaactgtgac

SEQ ID NO: 399048 - DNA, 27 bp, Artificial Sequence
  Description of Artificial Sequence: Synthetic oligonucleotide
aggccttcgggcagcaactgtgacctt

SEQ ID NO: 399049 - DNA, 26 bp, Artificial Sequence
  Description of Artificial Sequence: Synthetic oligonucleotide
ggccttcgggcagcaactgtgacctt

SEQ ID NO: 399050 - DNA, 27 bp, Artificial Sequence
  Description of Artificial Sequence: Synthetic oligonucleotide
gccttcgggcagcaactgtgaccttga

SEQ ID NO: 399051 - DNA, 28 bp, Artificial Sequence
  Description of Artificial Sequence: Synthetic oligonucleotide
ccttcgggcagcaactgtgaccttgatg

SEQ ID NO: 399052 - DNA, 28 bp, Artificial Sequence
  Description of Artificial Sequence: Synthetic oligonucleotide
cttcgggcagcaactgtgaccttgatgc

SEQ ID NO: 399053 - DNA, 29 bp, Artificial Sequence
  Description of Artificial Sequence: Synthetic oligonucleotide
ttcgggcagcaactgtgaccttgatgctg

SEQ ID NO: 399054 - DNA, 28 bp, Artificial Sequence
  Description of Artificial Sequence: Synthetic oligonucleotide
tcgggcagcaactgtgaccttgatgctg

SEQ ID NO: 399055 - DNA, 27 bp, Artificial Sequence
  Description of Artificial Sequence: Synthetic oligonucleotide
cgggcagcaactgtgaccttgatgctg

SEQ ID NO: 399056 - DNA, 28 bp, Artificial Sequence
  Description of Artificial Sequence: Synthetic oligonucleotide
gggcagcaactgtgaccttgatgctgtc

SEQ ID NO: 399057 - DNA, 28 bp, Artificial Sequence
  Description of Artificial Sequence: Synthetic oligonucleotide
ggcagcaactgtgaccttgatgctgtcg

SEQ ID NO: 399058 - DNA, 30 bp, Artificial Sequence; identical to SEQ ID NO: 58064
  Description of Artificial Sequence: Synthetic oligonucleotide

SEQ ID NO: 399059 - DNA, 30 bp, Artificial Sequence; identical to SEQ ID NO: 58065
  Description of Artificial Sequence: Synthetic oligonucleotide

SEQ ID NO: 399060 - DNA, 31 bp, Artificial Sequence; identical to SEQ ID NO: 58066
  Description of Artificial Sequence: Synthetic oligonucleotide

SEQ ID NO: 399061 - DNA, 30 bp, Artificial Sequence; identical to SEQ ID NO: 58067
  Description of Artificial Sequence: Synthetic oligonucleotide

SEQ ID NO: 399062 - DNA, 31 bp, Artificial Sequence; identical to SEQ ID NO: 58068
  Description of Artificial Sequence: Synthetic oligonucleotide

SEQ ID NO: 399063 - DNA, 31 bp, Artificial Sequence; identical to SEQ ID NO: 58069
  Description of Artificial Sequence: Synthetic oligonucleotide

SEQ ID NO: 399064 - DNA, 30 bp, Artificial Sequence; identical to SEQ ID NO: 58070
  Description of Artificial Sequence: Synthetic oligonucleotide

SEQ ID NO: 399065 - DNA, 29 bp, Artificial Sequence
  Description of Artificial Sequence: Synthetic oligonucleotide
ctgtgaccttgatgctgtcgatgctgagc

SEQ ID NO: 399066 - DNA, 30 bp, Artificial Sequence; identical to SEQ ID NO: 58072
  Description of Artificial Sequence: Synthetic oligonucleotide

SEQ ID NO: 399067 - DNA, 29 bp, Artificial Sequence
  Description of Artificial Sequence: Synthetic oligonucleotide
gtgaccttgatgctgtcgatgctgagcac

SEQ ID NO: 399068 - DNA, 29 bp, Artificial Sequence
  Description of Artificial Sequence: Synthetic oligonucleotide
tgaccttgatgctgtcgatgctgagcacc

SEQ ID NO: 399069 - DNA, 28 bp, Artificial Sequence
  Description of Artificial Sequence: Synthetic oligonucleotide
gaccttgatgctgtcgatgctgagcacc

SEQ ID NO: 399070 - DNA, 28 bp, Artificial Sequence
  Description of Artificial Sequence: Synthetic oligonucleotide
accttgatgctgtcgatgctgagcaccc

SEQ ID NO: 399071 - DNA, 27 bp, Artificial Sequence
  Description of Artificial Sequence: Synthetic oligonucleotide
ccttgatgctgtcgatgctgagcaccc

SEQ ID NO: 399072 - DNA, 27 bp, Artificial Sequence
  Description of Artificial Sequence: Synthetic oligonucleotide
cttgatgctgtcgatgctgagcacccc

SEQ ID NO: 399073 - DNA, 28 bp, Artificial Sequence
  Description of Artificial Sequence: Synthetic oligonucleotide
ttgatgctgtcgatgctgagcaccccag

SEQ ID NO: 399074 - DNA, 27 bp, Artificial Sequence
  Description of Artificial Sequence: Synthetic oligonucleotide
tgatgctgtcgatgctgagcaccccag

SEQ ID NO: 399075 - DNA, 27 bp, Artificial Sequence
  Description of Artificial Sequence: Synthetic oligonucleotide
gatgctgtcgatgctgagcaccccagt

SEQ ID NO: 399076 - DNA, 27 bp, Artificial Sequence
  Description of Artificial Sequence: Synthetic oligonucleotide
atgctgtcgatgctgagcaccccagtg

SEQ ID NO: 399077 - DNA, 26 bp, Artificial Sequence
  Description of Artificial Sequence: Synthetic oligonucleotide
tgctgtcgatgctgagcaccccagtg

SEQ ID NO: 399078 - DNA, 25 bp, Artificial Sequence
  Description of Artificial Sequence: Synthetic oligonucleotide
gctgtcgatgctgagcaccccagtg

SEQ ID NO: 399079 - DNA, 25 bp, Artificial Sequence
  Description of Artificial Sequence: Synthetic oligonucleotide
ctgtcgatgctgagcaccccagtgg

SEQ ID NO: 399080 - DNA, 26 bp, Artificial Sequence
  Description of Artificial Sequence: Synthetic oligonucleotide
tgtcgatgctgagcaccccagtggct

SEQ ID NO: 399081 - DNA, 25 bp, Artificial Sequence
  Description of Artificial Sequence: Synthetic oligonucleotide
gtcgatgctgagcaccccagtggct

SEQ ID NO: 399082 - DNA, 26 bp, Artificial Sequence
  Description of Artificial Sequence: Synthetic oligonucleotide
tcgatgctgagcaccccagtggctga

SEQ ID NO: 399083 - DNA, 25 bp, Artificial Sequence
  Description of Artificial Sequence: Synthetic oligonucleotide
cgatgctgagcaccccagtggctga

SEQ ID NO: 399084 - DNA, 25 bp, Artificial Sequence
  Description of Artificial Sequence: Synthetic oligonucleotide
gatgctgagcaccccagtggctgag

SEQ ID NO: 399085 - DNA, 25 bp, Artificial Sequence
  Description of Artificial Sequence: Synthetic oligonucleotide
atgctgagcaccccagtggctgagg

SEQ ID NO: 399086 - DNA, 24 bp, Artificial Sequence
  Description of Artificial Sequence: Synthetic oligonucleotide
tgctgagcaccccagtggctgagg

SEQ ID NO: 399087 - DNA, 23 bp, Artificial Sequence
  Description of Artificial Sequence: Synthetic oligonucleotide
gctgagcaccccagtggctgagg

SEQ ID NO: 399088 - DNA, 23 bp, Artificial Sequence
  Description of Artificial Sequence: Synthetic oligonucleotide
ctgagcaccccagtggctgaggg

SEQ ID NO: 399089 - DNA, 24 bp, Artificial Sequence
  Description of Artificial Sequence: Synthetic oligonucleotide
tgagcaccccagtggctgagggca

SEQ ID NO: 399090 - DNA, 23 bp, Artificial Sequence
  Description of Artificial Sequence: Synthetic oligonucleotide
gagcaccccagtggctgagggca

SEQ ID NO: 399091 - DNA, 24 bp, Artificial Sequence
  Description of Artificial Sequence: Synthetic oligonucleotide
agcaccccagtggctgagggcaga

SEQ ID NO: 399092 - DNA, 23 bp, Artificial Sequence
  Description of Artificial Sequence: Synthetic oligonucleotide
gcaccccagtggctgagggcaga

SEQ ID NO: 399093 - DNA, 24 bp, Artificial Sequence
  Description of Artificial Sequence: Synthetic oligonucleotide
caccccagtggctgagggcagaga

SEQ ID NO: 399094 - DNA, 25 bp, Artificial Sequence
  Description of Artificial Sequence: Synthetic oligonucleotide
accccagtggctgagggcagagact

SEQ ID NO: 399095 - DNA, 24 bp, Artificial Sequence
  Description of Artificial Sequence: Synthetic oligonucleotide
ccccagtggctgagggcagagact

SEQ ID NO: 399096 - DNA, 25 bp, Artificial Sequence
  Description of Artificial Sequence: Synthetic oligonucleotide
cccagtggctgagggcagagactct

SEQ ID NO: 399097 - DNA, 25 bp, Artificial Sequence
  Description of Artificial Sequence: Synthetic oligonucleotide
ccagtggctgagggcagagactctc

SEQ ID NO: 399098 - DNA, 25 bp, Artificial Sequence
  Description of Artificial Sequence: Synthetic oligonucleotide
cagtggctgagggcagagactctcc

SEQ ID NO: 399099 - DNA, 25 bp, Artificial Sequence
  Description of Artificial Sequence: Synthetic oligonucleotide
agtggctgagggcagagactctccc

SEQ ID NO: 399100 - DNA, 24 bp, Artificial Sequence
  Description of Artificial Sequence: Synthetic oligonucleotide
gtggctgagggcagagactctccc

SEQ ID NO: 399101 - DNA, 25 bp, Artificial Sequence
  Description of Artificial Sequence: Synthetic oligonucleotide
tggctgagggcagagactctcccga

SEQ ID NO: 399102 - DNA, 24 bp, Artificial Sequence
  Description of Artificial Sequence: Synthetic oligonucleotide
ggctgagggcagagactctcccga

SEQ ID NO: 399103 - DNA, 24 bp, Artificial Sequence
  Description of Artificial Sequence: Synthetic oligonucleotide
gctgagggcagagactctcccgag

SEQ ID NO: 399104 - DNA, 27 bp, Artificial Sequence
  Description of Artificial Sequence: Synthetic oligonucleotide
ctgagggcagagactctcccgaggatt

SEQ ID NO: 399105 - DNA, 28 bp, Artificial Sequence
  Description of Artificial Sequence: Synthetic oligonucleotide
tgagggcagagactctcccgaggatttc

SEQ ID NO: 399106 - DNA, 27 bp, Artificial Sequence
  Description of Artificial Sequence: Synthetic oligonucleotide
gagggcagagactctcccgaggatttc

SEQ ID NO: 399107 - DNA, 27 bp, Artificial Sequence
  Description of Artificial Sequence: Synthetic oligonucleotide
agggcagagactctcccgaggatttcg

SEQ ID NO: 399108 - DNA, 27 bp, Artificial Sequence
  Description of Artificial Sequence: Synthetic oligonucleotide
gggcagagactctcccgaggatttcgt

SEQ ID NO: 399109 - DNA, 27 bp, Artificial Sequence
  Description of Artificial Sequence: Synthetic oligonucleotide
ggcagagactctcccgaggatttcgtg

SEQ ID NO: 399110 - DNA, 29 bp, Artificial Sequence
  Description of Artificial Sequence: Synthetic oligonucleotide
gcagagactctcccgaggatttcgtgtac

SEQ ID NO: 399111 - DNA, 29 bp, Artificial Sequence
  Description of Artificial Sequence: Synthetic oligonucleotide
cagagactctcccgaggatttcgtgtacc

SEQ ID NO: 399112 - DNA, 30 bp, Artificial Sequence; identical to SEQ ID NO: 58118
  Description of Artificial Sequence: Synthetic oligonucleotide

SEQ ID NO: 399113 - DNA, 29 bp, Artificial Sequence
  Description of Artificial Sequence: Synthetic oligonucleotide
gagactctcccgaggatttcgtgtaccag

SEQ ID NO: 399114 - DNA, 34 bp, Artificial Sequence; identical to SEQ ID NO: 58120
  Description of Artificial Sequence: Synthetic oligonucleotide

SEQ ID NO: 399115 - DNA, 33 bp, Artificial Sequence; identical to SEQ ID NO: 58121
  Description of Artificial Sequence: Synthetic oligonucleotide

SEQ ID NO: 399116 - DNA, 33 bp, Artificial Sequence; identical to SEQ ID NO: 58122
  Description of Artificial Sequence: Synthetic oligonucleotide

SEQ ID NO: 399117 - DNA, 32 bp, Artificial Sequence; identical to SEQ ID NO: 58123
  Description of Artificial Sequence: Synthetic oligonucleotide

SEQ ID NO: 399118 - DNA, 32 bp, Artificial Sequence; identical to SEQ ID NO: 58124
  Description of Artificial Sequence: Synthetic oligonucleotide

SEQ ID NO: 399119 - DNA, 31 bp, Artificial Sequence; identical to SEQ ID NO: 58125
  Description of Artificial Sequence: Synthetic oligonucleotide

SEQ ID NO: 399120 - DNA, 31 bp, Artificial Sequence; identical to SEQ ID NO: 58126
  Description of Artificial Sequence: Synthetic oligonucleotide

SEQ ID NO: 399121 - DNA, 30 bp, Artificial Sequence; identical to SEQ ID NO: 58127
  Description of Artificial Sequence: Synthetic oligonucleotide

SEQ ID NO: 399122 - DNA, 32 bp, Artificial Sequence; identical to SEQ ID NO: 58128
  Description of Artificial Sequence: Synthetic oligonucleotide

SEQ ID NO: 399123 - DNA, 33 bp, Artificial Sequence; identical to SEQ ID NO: 58129
  Description of Artificial Sequence: Synthetic oligonucleotide

SEQ ID NO: 399124 - DNA, 33 bp, Artificial Sequence; identical to SEQ ID NO: 58130
  Description of Artificial Sequence: Synthetic oligonucleotide

SEQ ID NO: 399125 - DNA, 35 bp, Artificial Sequence; identical to SEQ ID NO: 58131
  Description of Artificial Sequence: Synthetic oligonucleotide

SEQ ID NO: 399126 - DNA, 34 bp, Artificial Sequence; identical to SEQ ID NO: 58132
  Description of Artificial Sequence: Synthetic oligonucleotide

SEQ ID NO: 399127 - DNA, 36 bp, Artificial Sequence; identical to SEQ ID NO: 58133
  Description of Artificial Sequence: Synthetic oligonucleotide

SEQ ID NO: 399128 - DNA, 37 bp, Artificial Sequence; identical to SEQ ID NO: 58134
  Description of Artificial Sequence: Synthetic oligonucleotide

SEQ ID NO: 399129 - DNA, 36 bp, Artificial Sequence; identical to SEQ ID NO: 58135
  Description of Artificial Sequence: Synthetic oligonucleotide

SEQ ID NO: 399130 - DNA, 35 bp, Artificial Sequence; identical to SEQ ID NO: 58136
  Description of Artificial Sequence: Synthetic oligonucleotide

SEQ ID NO: 399131 - DNA, 34 bp, Artificial Sequence; identical to SEQ ID NO: 58137
  Description of Artificial Sequence: Synthetic oligonucleotide

SEQ ID NO: 399132 - DNA, 33 bp, Artificial Sequence; identical to SEQ ID NO: 58138
  Description of Artificial Sequence: Synthetic oligonucleotide

SEQ ID NO: 399133 - DNA, 33 bp, Artificial Sequence; identical to SEQ ID NO: 58139
  Description of Artificial Sequence: Synthetic oligonucleotide

SEQ ID NO: 399134 - DNA, 35 bp, Artificial Sequence; identical to SEQ ID NO: 58140
  Description of Artificial Sequence: Synthetic oligonucleotide

SEQ ID NO: 399135 - DNA, 34 bp, Artificial Sequence; identical to SEQ ID NO: 58141
  Description of Artificial Sequence: Synthetic oligonucleotide

SEQ ID NO: 399136 - DNA, 34 bp, Artificial Sequence; identical to SEQ ID NO: 58142
  Description of Artificial Sequence: Synthetic oligonucleotide

SEQ ID NO: 399137 - DNA, 33 bp, Artificial Sequence; identical to SEQ ID NO: 58143
  Description of Artificial Sequence: Synthetic oligonucleotide

SEQ ID NO: 399138 - DNA, 32 bp, Artificial Sequence; identical to SEQ ID NO: 58144
  Description of Artificial Sequence: Synthetic oligonucleotide

SEQ ID NO: 399139 - DNA, 32 bp, Artificial Sequence; identical to SEQ ID NO: 58145
  Description of Artificial Sequence: Synthetic oligonucleotide

SEQ ID NO: 399140 - DNA, 32 bp, Artificial Sequence; identical to SEQ ID NO: 58146
  Description of Artificial Sequence: Synthetic oligonucleotide

SEQ ID NO: 399141 - DNA, 31 bp, Artificial Sequence; identical to SEQ ID NO: 58147
  Description of Artificial Sequence: Synthetic oligonucleotide

SEQ ID NO: 399142 - DNA, 32 bp, Artificial Sequence; identical to SEQ ID NO: 58148
  Description of Artificial Sequence: Synthetic oligonucleotide

SEQ ID NO: 399143 - DNA, 31 bp, Artificial Sequence; identical to SEQ ID NO: 58149
  Description of Artificial Sequence: Synthetic oligonucleotide

SEQ ID NO: 399144 - DNA, 30 bp, Artificial Sequence; identical to SEQ ID NO: 58150
  Description of Artificial Sequence: Synthetic oligonucleotide

SEQ ID NO: 399145 - DNA, 29 bp, Artificial Sequence
  Description of Artificial Sequence: Synthetic oligonucleotide
aagggcatgtgctacttcaccaacgggac

SEQ ID NO: 399146 - DNA, 28 bp, Artificial Sequence
  Description of Artificial Sequence: Synthetic oligonucleotide
agggcatgtgctacttcaccaacgggac

SEQ ID NO: 399147 - DNA, 27 bp, Artificial Sequence
  Description of Artificial Sequence: Synthetic oligonucleotide
gggcatgtgctacttcaccaacgggac

SEQ ID NO: 399148 - DNA, 28 bp, Artificial Sequence
  Description of Artificial Sequence: Synthetic oligonucleotide
ggcatgtgctacttcaccaacgggacag

SEQ ID NO: 399149 - DNA, 29 bp, Artificial Sequence
  Description of Artificial Sequence: Synthetic oligonucleotide
gcatgtgctacttcaccaacgggacagag

SEQ ID NO: 399150 - DNA, 29 bp, Artificial Sequence
  Description of Artificial Sequence: Synthetic oligonucleotide
catgtgctacttcaccaacgggacagagc

SEQ ID NO: 399151 - DNA, 29 bp, Artificial Sequence
  Description of Artificial Sequence: Synthetic oligonucleotide
atgtgctacttcaccaacgggacagagcg

SEQ ID NO: 399152 - DNA, 28 bp, Artificial Sequence
  Description of Artificial Sequence: Synthetic oligonucleotide
tgtgctacttcaccaacgggacagagcg

SEQ ID NO: 399153 - DNA, 27 bp, Artificial Sequence
  Description of Artificial Sequence: Synthetic oligonucleotide
gtgctacttcaccaacgggacagagcg

SEQ ID NO: 399154 - DNA, 27 bp, Artificial Sequence
  Description of Artificial Sequence: Synthetic oligonucleotide
tgctacttcaccaacgggacagagcgc

SEQ ID NO: 399155 - DNA, 26 bp, Artificial Sequence
  Description of Artificial Sequence: Synthetic oligonucleotide
gctacttcaccaacgggacagagcgc

SEQ ID NO: 399156 - DNA, 27 bp, Artificial Sequence
  Description of Artificial Sequence: Synthetic oligonucleotide
ctacttcaccaacgggacagagcgcgt

SEQ ID NO: 399157 - DNA, 27 bp, Artificial Sequence
  Description of Artificial Sequence: Synthetic oligonucleotide
tacttcaccaacgggacagagcgcgtg

SEQ ID NO: 399158 - DNA, 26 bp, Artificial Sequence
  Description of Artificial Sequence: Synthetic oligonucleotide
acttcaccaacgggacagagcgcgtg

SEQ ID NO: 399159 - DNA, 25 bp, Artificial Sequence
  Description of Artificial Sequence: Synthetic oligonucleotide
cttcaccaacgggacagagcgcgtg

SEQ ID NO: 399160 - DNA, 25 bp, Artificial Sequence
  Description of Artificial Sequence: Synthetic oligonucleotide
ttcaccaacgggacagagcgcgtgc

SEQ ID NO: 399161 - DNA, 24 bp, Artificial Sequence
  Description of Artificial Sequence: Synthetic oligonucleotide
tcaccaacgggacagagcgcgtgc

SEQ ID NO: 399162 - DNA, 23 bp, Artificial Sequence
  Description of Artificial Sequence: Synthetic oligonucleotide
caccaacgggacagagcgcgtgc

SEQ ID NO: 399163 - DNA, 24 bp, Artificial Sequence
  Description of Artificial Sequence: Synthetic oligonucleotide
accaacgggacagagcgcgtgcgt

SEQ ID NO: 399164 - DNA, 23 bp, Artificial Sequence
  Description of Artificial Sequence: Synthetic oligonucleotide
ccaacgggacagagcgcgtgcgt

SEQ ID NO: 399165 - DNA, 25 bp, Artificial Sequence
  Description of Artificial Sequence: Synthetic oligonucleotide
caacgggacagagcgcgtgcgtctt

SEQ ID NO: 399166 - DNA, 26 bp, Artificial Sequence
  Description of Artificial Sequence: Synthetic oligonucleotide
aacgggacagagcgcgtgcgtcttgt

SEQ ID NO: 399167 - DNA, 25 bp, Artificial Sequence
  Description of Artificial Sequence: Synthetic oligonucleotide
acgggacagagcgcgtgcgtcttgt

SEQ ID NO: 399168 - DNA, 24 bp, Artificial Sequence
  Description of Artificial Sequence: Synthetic oligonucleotide
cgggacagagcgcgtgcgtcttgt

SEQ ID NO: 399169 - DNA, 25 bp, Artificial Sequence
  Description of Artificial Sequence: Synthetic oligonucleotide
gggacagagcgcgtgcgtcttgtga

SEQ ID NO: 399170 - DNA, 25 bp, Artificial Sequence
  Description of Artificial Sequence: Synthetic oligonucleotide
ggacagagcgcgtgcgtcttgtgag

SEQ ID NO: 399171 - DNA, 26 bp, Artificial Sequence
  Description of Artificial Sequence: Synthetic oligonucleotide
gacagagcgcgtgcgtcttgtgagca

SEQ ID NO: 399172 - DNA, 27 bp, Artificial Sequence
  Description of Artificial Sequence: Synthetic oligonucleotide
acagagcgcgtgcgtcttgtgagcaga

SEQ ID NO: 399173 - DNA, 27 bp, Artificial Sequence
  Description of Artificial Sequence: Synthetic oligonucleotide
cagagcgcgtgcgtcttgtgagcagaa

SEQ ID NO: 399174 - DNA, 27 bp, Artificial Sequence
  Description of Artificial Sequence: Synthetic oligonucleotide
agagcgcgtgcgtcttgtgagcagaag

SEQ ID NO: 399175 - DNA, 26 bp, Artificial Sequence
  Description of Artificial Sequence: Synthetic oligonucleotide
gagcgcgtgcgtcttgtgagcagaag

SEQ ID NO: 399176 - DNA, 27 bp, Artificial Sequence
  Description of Artificial Sequence: Synthetic oligonucleotide
agcgcgtgcgtcttgtgagcagaagca

SEQ ID NO: 399177 - DNA, 27 bp, Artificial Sequence
  Description of Artificial Sequence: Synthetic oligonucleotide
gcgcgtgcgtcttgtgagcagaagcat

SEQ ID NO: 399178 - DNA, 27 bp, Artificial Sequence
  Description of Artificial Sequence: Synthetic oligonucleotide
cgcgtgcgtcttgtgagcagaagcatc

SEQ ID NO: 399179 - DNA, 32 bp, Artificial Sequence; identical to SEQ ID NO: 58185
  Description of Artificial Sequence: Synthetic oligonucleotide

SEQ ID NO: 399180 - DNA, 32 bp, Artificial Sequence; identical to SEQ ID NO: 58186
  Description of Artificial Sequence: Synthetic oligonucleotide

SEQ ID NO: 399181 - DNA, 32 bp, Artificial Sequence; identical to SEQ ID NO: 58187
  Description of Artificial Sequence: Synthetic oligonucleotide

SEQ ID NO: 399182 - DNA, 33 bp, Artificial Sequence; identical to SEQ ID NO: 58188
  Description of Artificial Sequence: Synthetic oligonucleotide

SEQ ID NO: 399183 - DNA, 32 bp, Artificial Sequence; identical to SEQ ID NO: 58189
  Description of Artificial Sequence: Synthetic oligonucleotide

SEQ ID NO: 399184 - DNA, 34 bp, Artificial Sequence; identical to SEQ ID NO: 58190
  Description of Artificial Sequence: Synthetic oligonucleotide

SEQ ID NO: 399185 - DNA, 35 bp, Artificial Sequence; identical to SEQ ID NO: 58191
  Description of Artificial Sequence: Synthetic oligonucleotide

SEQ ID NO: 399186 - DNA, 37 bp, Artificial Sequence; identical to SEQ ID NO: 58192
  Description of Artificial Sequence: Synthetic oligonucleotide

SEQ ID NO: 399187 - DNA, 36 bp, Artificial Sequence; identical to SEQ ID NO: 58193
  Description of Artificial Sequence: Synthetic oligonucleotide

SEQ ID NO: 399188 - DNA, 36 bp, Artificial Sequence; identical to SEQ ID NO: 58194
  Description of Artificial Sequence: Synthetic oligonucleotide

SEQ ID NO: 399189 - DNA, 35 bp, Artificial Sequence; identical to SEQ ID NO: 58195
  Description of Artificial Sequence: Synthetic oligonucleotide

SEQ ID NO: 399190 - DNA, 34 bp, Artificial Sequence; identical to SEQ ID NO: 58196
  Description of Artificial Sequence: Synthetic oligonucleotide

SEQ ID NO: 399191 - DNA, 35 bp, Artificial Sequence; identical to SEQ ID NO: 58197
  Description of Artificial Sequence: Synthetic oligonucleotide

SEQ ID NO: 399192 - DNA, 34 bp, Artificial Sequence; identical to SEQ ID NO: 58198
  Description of Artificial Sequence: Synthetic oligonucleotide

SEQ ID NO: 399193 - DNA, 34 bp, Artificial Sequence; identical to SEQ ID NO: 58199
  Description of Artificial Sequence: Synthetic oligonucleotide

SEQ ID NO: 399194 - DNA, 33 bp, Artificial Sequence; identical to SEQ ID NO: 58200
  Description of Artificial Sequence: Synthetic oligonucleotide

SEQ ID NO: 399195 - DNA, 33 bp, Artificial Sequence; identical to SEQ ID NO: 58201
  Description of Artificial Sequence: Synthetic oligonucleotide

SEQ ID NO: 399196 - DNA, 33 bp, Artificial Sequence; identical to SEQ ID NO: 58202
  Description of Artificial Sequence: Synthetic oligonucleotide

SEQ ID NO: 399197 - DNA, 32 bp, Artificial Sequence; identical to SEQ ID NO: 58203
  Description of Artificial Sequence: Synthetic oligonucleotide

SEQ ID NO: 399198 - DNA, 34 bp, Artificial Sequence; identical to SEQ ID NO: 58204
  Description of Artificial Sequence: Synthetic oligonucleotide

SEQ ID NO: 399199 - DNA, 33 bp, Artificial Sequence; identical to SEQ ID NO: 58205
  Description of Artificial Sequence: Synthetic oligonucleotide

SEQ ID NO: 399200 - DNA, 32 bp, Artificial Sequence; identical to SEQ ID NO: 58206
  Description of Artificial Sequence: Synthetic oligonucleotide

SEQ ID NO: 399201 - DNA, 32 bp, Artificial Sequence; identical to SEQ ID NO: 58207
  Description of Artificial Sequence: Synthetic oligonucleotide

SEQ ID NO: 399202 - DNA, 33 bp, Artificial Sequence; identical to SEQ ID NO: 58208
  Description of Artificial Sequence: Synthetic oligonucleotide

SEQ ID NO: 399203 - DNA, 32 bp, Artificial Sequence; identical to SEQ ID NO: 58209
  Description of Artificial Sequence: Synthetic oligonucleotide

SEQ ID NO: 399204 - DNA, 31 bp, Artificial Sequence; identical to SEQ ID NO: 58210
  Description of Artificial Sequence: Synthetic oligonucleotide

SEQ ID NO: 399205 - DNA, 32 bp, Artificial Sequence; identical to SEQ ID NO: 58211
  Description of Artificial Sequence: Synthetic oligonucleotide

SEQ ID NO: 399206 - DNA, 31 bp, Artificial Sequence; identical to SEQ ID NO: 58212
  Description of Artificial Sequence: Synthetic oligonucleotide

SEQ ID NO: 399207 - DNA, 30 bp, Artificial Sequence; identical to SEQ ID NO: 58213
  Description of Artificial Sequence: Synthetic oligonucleotide

SEQ ID NO: 399208 - DNA, 29 bp, Artificial Sequence
  Description of Artificial Sequence: Synthetic oligonucleotide
aaccgagaagagatcgtgcgcttcgacag

SEQ ID NO: 399209 - DNA, 28 bp, Artificial Sequence
  Description of Artificial Sequence: Synthetic oligonucleotide
accgagaagagatcgtgcgcttcgacag

SEQ ID NO: 399210 - DNA, 27 bp, Artificial Sequence
  Description of Artificial Sequence: Synthetic oligonucleotide
ccgagaagagatcgtgcgcttcgacag

SEQ ID NO: 399211 - DNA, 27 bp, Artificial Sequence
  Description of Artificial Sequence: Synthetic oligonucleotide
cgagaagagatcgtgcgcttcgacagc

SEQ ID NO: 399212 - DNA, 27 bp, Artificial Sequence
  Description of Artificial Sequence: Synthetic oligonucleotide
gagaagagatcgtgcgcttcgacagcg

SEQ ID NO: 399213 - DNA, 28 bp, Artificial Sequence
  Description of Artificial Sequence: Synthetic oligonucleotide
agaagagatcgtgcgcttcgacagcgac

SEQ ID NO: 399214 - DNA, 27 bp, Artificial Sequence
  Description of Artificial Sequence: Synthetic oligonucleotide
gaagagatcgtgcgcttcgacagcgac

SEQ ID NO: 399215 - DNA, 27 bp, Artificial Sequence
  Description of Artificial Sequence: Synthetic oligonucleotide
aagagatcgtgcgcttcgacagcgacg

SEQ ID NO: 399216 - DNA, 27 bp, Artificial Sequence
  Description of Artificial Sequence: Synthetic oligonucleotide
agagatcgtgcgcttcgacagcgacgt

SEQ ID NO: 399217 - DNA, 26 bp, Artificial Sequence
  Description of Artificial Sequence: Synthetic oligonucleotide
gagatcgtgcgcttcgacagcgacgt

SEQ ID NO: 399218 - DNA, 26 bp, Artificial Sequence
  Description of Artificial Sequence: Synthetic oligonucleotide
agatcgtgcgcttcgacagcgacgtg

SEQ ID NO: 399219 - DNA, 25 bp, Artificial Sequence
  Description of Artificial Sequence: Synthetic oligonucleotide
gatcgtgcgcttcgacagcgacgtg

SEQ ID NO: 399220 - DNA, 25 bp, Artificial Sequence
  Description of Artificial Sequence: Synthetic oligonucleotide
atcgtgcgcttcgacagcgacgtgg

SEQ ID NO: 399221 - DNA, 22 bp, Artificial Sequence
  Description of Artificial Sequence: Synthetic oligonucleotide
gggagttccgggcggtgacgct

SEQ ID NO: 399222 - DNA, 22 bp, Artificial Sequence
  Description of Artificial Sequence: Synthetic oligonucleotide
ggagttccgggcggtgacgctg

SEQ ID NO: 399223 - DNA, 23 bp, Artificial Sequence
  Description of Artificial Sequence: Synthetic oligonucleotide
gagttccgggcggtgacgctgct

SEQ ID NO: 399224 - DNA, 23 bp, Artificial Sequence
  Description of Artificial Sequence: Synthetic oligonucleotide
agttccgggcggtgacgctgctg

SEQ ID NO: 399225 - DNA, 22 bp, Artificial Sequence
  Description of Artificial Sequence: Synthetic oligonucleotide
gttccgggcggtgacgctgctg

SEQ ID NO: 399226 - DNA, 22 bp, Artificial Sequence
  Description of Artificial Sequence: Synthetic oligonucleotide
ttccgggcggtgacgctgctgg

SEQ ID NO: 399227 - DNA, 21 bp, Artificial Sequence
  Description of Artificial Sequence: Synthetic oligonucleotide
tccgggcggtgacgctgctgg

SEQ ID NO: 399228 - DNA, 20 bp, Artificial Sequence
  Description of Artificial Sequence: Synthetic oligonucleotide
ccgggcggtgacgctgctgg

SEQ ID NO: 399229 - DNA, 20 bp, Artificial Sequence
  Description of Artificial Sequence: Synthetic oligonucleotide
cgggcggtgacgctgctggg

SEQ ID NO: 399230 - DNA, 20 bp, Artificial Sequence
  Description of Artificial Sequence: Synthetic oligonucleotide
gggcggtgacgctgctgggg

SEQ ID NO: 399231 - DNA, 21 bp, Artificial Sequence
  Description of Artificial Sequence: Synthetic oligonucleotide
ggcggtgacgctgctggggct

SEQ ID NO: 399232 - DNA, 21 bp, Artificial Sequence
  Description of Artificial Sequence: Synthetic oligonucleotide
gcggtgacgctgctggggctg

SEQ ID NO: 399233 - DNA, 21 bp, Artificial Sequence
  Description of Artificial Sequence: Synthetic oligonucleotide
cggtgacgctgctggggctgc

SEQ ID NO: 399234 - DNA, 22 bp, Artificial Sequence
  Description of Artificial Sequence: Synthetic oligonucleotide
ggtgacgctgctggggctgcct

SEQ ID NO: 399235 - DNA, 22 bp, Artificial Sequence
  Description of Artificial Sequence: Synthetic oligonucleotide
gtgacgctgctggggctgcctg

SEQ ID NO: 399236 - DNA, 22 bp, Artificial Sequence
  Description of Artificial Sequence: Synthetic oligonucleotide
tgacgctgctggggctgcctgc

SEQ ID NO: 399237 - DNA, 21 bp, Artificial Sequence
  Description of Artificial Sequence: Synthetic oligonucleotide
gacgctgctggggctgcctgc

SEQ ID NO: 399238 - DNA, 21 bp, Artificial Sequence
  Description of Artificial Sequence: Synthetic oligonucleotide
acgctgctggggctgcctgcc

SEQ ID NO: 399239 - DNA, 20 bp, Artificial Sequence
  Description of Artificial Sequence: Synthetic oligonucleotide
cgctgctggggctgcctgcc

SEQ ID NO: 399240 - DNA, 20 bp, Artificial Sequence
  Description of Artificial Sequence: Synthetic oligonucleotide
gctgctggggctgcctgccg

SEQ ID NO: 399241 - DNA, 20 bp, Artificial Sequence
  Description of Artificial Sequence: Synthetic oligonucleotide
ctgctggggctgcctgccgc

SEQ ID NO: 399242 - DNA, 20 bp, Artificial Sequence
  Description of Artificial Sequence: Synthetic oligonucleotide
tgctggggctgcctgccgcc

SEQ ID NO: 399243 - DNA, 20 bp, Artificial Sequence
  Description of Artificial Sequence: Synthetic oligonucleotide
gctggggctgcctgccgcct

SEQ ID NO: 399244 - DNA, 20 bp, Artificial Sequence
  Description of Artificial Sequence: Synthetic oligonucleotide
ctggggctgcctgccgccga

SEQ ID NO: 399245 - DNA, 22 bp, Artificial Sequence
  Description of Artificial Sequence: Synthetic oligonucleotide
tggggctgcctgccgccgagta

SEQ ID NO: 399246 - DNA, 21 bp, Artificial Sequence
  Description of Artificial Sequence: Synthetic oligonucleotide
ggggctgcctgccgccgagta

SEQ ID NO: 399247 - DNA, 22 bp, Artificial Sequence
  Description of Artificial Sequence: Synthetic oligonucleotide
gggctgcctgccgccgagtact

SEQ ID NO: 399248 - DNA, 22 bp, Artificial Sequence
  Description of Artificial Sequence: Synthetic oligonucleotide
ggctgcctgccgccgagtactg

SEQ ID NO: 399249 - DNA, 24 bp, Artificial Sequence
  Description of Artificial Sequence: Synthetic oligonucleotide
gctgcctgccgccgagtactggaa

SEQ ID NO: 399250 - DNA, 25 bp, Artificial Sequence
  Description of Artificial Sequence: Synthetic oligonucleotide
ctgcctgccgccgagtactggaaca

SEQ ID NO: 399251 - DNA, 25 bp, Artificial Sequence
  Description of Artificial Sequence: Synthetic oligonucleotide
tgcctgccgccgagtactggaacag

SEQ ID NO: 399252 - DNA, 24 bp, Artificial Sequence
  Description of Artificial Sequence: Synthetic oligonucleotide
gcctgccgccgagtactggaacag

SEQ ID NO: 399253 - DNA, 24 bp, Artificial Sequence
  Description of Artificial Sequence: Synthetic oligonucleotide
cctgccgccgagtactggaacagc

SEQ ID NO: 399254 - DNA, 25 bp, Artificial Sequence
  Description of Artificial Sequence: Synthetic oligonucleotide
ctgccgccgagtactggaacagcca

SEQ ID NO: 399255 - DNA, 27 bp, Artificial Sequence
  Description of Artificial Sequence: Synthetic oligonucleotide
tgccgccgagtactggaacagccagaa

SEQ ID NO: 399256 - DNA, 26 bp, Artificial Sequence
  Description of Artificial Sequence: Synthetic oligonucleotide
gccgccgagtactggaacagccagaa

SEQ ID NO: 399257 - DNA, 26 bp, Artificial Sequence
  Description of Artificial Sequence: Synthetic oligonucleotide
ccgccgagtactggaacagccagaag

SEQ ID NO: 399258 - DNA, 27 bp, Artificial Sequence
  Description of Artificial Sequence: Synthetic oligonucleotide
cgccgagtactggaacagccagaagga

SEQ ID NO: 399259 - DNA, 27 bp, Artificial Sequence
  Description of Artificial Sequence: Synthetic oligonucleotide
gccgagtactggaacagccagaaggac

SEQ ID NO: 399260 - DNA, 29 bp, Artificial Sequence
  Description of Artificial Sequence: Synthetic oligonucleotide
ccgagtactggaacagccagaaggacatc

SEQ ID NO: 399261 - DNA, 29 bp, Artificial Sequence
  Description of Artificial Sequence: Synthetic oligonucleotide
cgagtactggaacagccagaaggacatcc

SEQ ID NO: 399262 - DNA, 29 bp, Artificial Sequence
  Description of Artificial Sequence: Synthetic oligonucleotide
tggaacagccagaaggacatcctggagag

SEQ ID NO: 399263 - DNA, 28 bp, Artificial Sequence
  Description of Artificial Sequence: Synthetic oligonucleotide
ggaacagccagaaggacatcctggagag

SEQ ID NO: 399264 - DNA, 28 bp, Artificial Sequence
  Description of Artificial Sequence: Synthetic oligonucleotide
gaacagccagaaggacatcctggagagg

SEQ ID NO: 399265 - DNA, 31 bp, Artificial Sequence; identical to SEQ ID NO: 58271
  Description of Artificial Sequence: Synthetic oligonucleotide

SEQ ID NO: 399266 - DNA, 30 bp, Artificial Sequence; identical to SEQ ID NO: 58272
  Description of Artificial Sequence: Synthetic oligonucleotide

SEQ ID NO: 399267 - DNA, 29 bp, Artificial Sequence
  Description of Artificial Sequence: Synthetic oligonucleotide
cagccagaaggacatcctggagaggaaac

SEQ ID NO: 399268 - DNA, 29 bp, Artificial Sequence
  Description of Artificial Sequence: Synthetic oligonucleotide
agccagaaggacatcctggagaggaaacg

SEQ ID NO: 399269 - DNA, 28 bp, Artificial Sequence
  Description of Artificial Sequence: Synthetic oligonucleotide
gccagaaggacatcctggagaggaaacg

SEQ ID NO: 399270 - DNA, 28 bp, Artificial Sequence
  Description of Artificial Sequence: Synthetic oligonucleotide
ccagaaggacatcctggagaggaaacgg

SEQ ID NO: 399271 - DNA, 28 bp, Artificial Sequence
  Description of Artificial Sequence: Synthetic oligonucleotide
cagaaggacatcctggagaggaaacggg

SEQ ID NO: 399272 - DNA, 28 bp, Artificial Sequence
  Description of Artificial Sequence: Synthetic oligonucleotide
agaaggacatcctggagaggaaacgggc

SEQ ID NO: 399273 - DNA, 27 bp, Artificial Sequence
  Description of Artificial Sequence: Synthetic oligonucleotide
gaaggacatcctggagaggaaacgggc

SEQ ID NO: 399274 - DNA, 27 bp, Artificial Sequence
  Description of Artificial Sequence: Synthetic oligonucleotide
aaggacatcctggagaggaaacgggcg

SEQ ID NO: 399275 - DNA, 26 bp, Artificial Sequence
  Description of Artificial Sequence: Synthetic oligonucleotide
aggacatcctggagaggaaacgggcg

SEQ ID NO: 399276 - DNA, 25 bp, Artificial Sequence
  Description of Artificial Sequence: Synthetic oligonucleotide
ggacatcctggagaggaaacgggcg

SEQ ID NO: 399277 - DNA, 25 bp, Artificial Sequence
  Description of Artificial Sequence: Synthetic oligonucleotide
gacatcctggagaggaaacgggcgg

SEQ ID NO: 399278 - DNA, 25 bp, Artificial Sequence
  Description of Artificial Sequence: Synthetic oligonucleotide
acatcctggagaggaaacgggcggc

SEQ ID NO: 399279 - DNA, 24 bp, Artificial Sequence
  Description of Artificial Sequence: Synthetic oligonucleotide
catcctggagaggaaacgggcggc

SEQ ID NO: 399280 - DNA, 24 bp, Artificial Sequence
  Description of Artificial Sequence: Synthetic oligonucleotide
atcctggagaggaaacgggcggcg

SEQ ID NO: 399281 - DNA, 23 bp, Artificial Sequence
  Description of Artificial Sequence: Synthetic oligonucleotide
tcctggagaggaaacgggcggcg

SEQ ID NO: 399282 - DNA, 22 bp, Artificial Sequence
  Description of Artificial Sequence: Synthetic oligonucleotide
cctggagaggaaacgggcggcg

SEQ ID NO: 399283 - DNA, 23 bp, Artificial Sequence
  Description of Artificial Sequence: Synthetic oligonucleotide
ctggagaggaaacgggcggcggt

SEQ ID NO: 399284 - DNA, 23 bp, Artificial Sequence
  Description of Artificial Sequence: Synthetic oligonucleotide
tggagaggaaacgggcggcggtg

SEQ ID NO: 399285 - DNA, 22 bp, Artificial Sequence
  Description of Artificial Sequence: Synthetic oligonucleotide
ggagaggaaacgggcggcggtg

SEQ ID NO: 399286 - DNA, 23 bp, Artificial Sequence
  Description of Artificial Sequence: Synthetic oligonucleotide
gagaggaaacgggcggcggtgga

SEQ ID NO: 399287 - DNA, 24 bp, Artificial Sequence
  Description of Artificial Sequence: Synthetic oligonucleotide
agaggaaacgggcggcggtggaca

SEQ ID NO: 399288 - DNA, 23 bp, Artificial Sequence
  Description of Artificial Sequence: Synthetic oligonucleotide
gaggaaacgggcggcggtggaca

SEQ ID NO: 399289 - DNA, 23 bp, Artificial Sequence
  Description of Artificial Sequence: Synthetic oligonucleotide
aggaaacgggcggcggtggacag

SEQ ID NO: 399290 - DNA, 22 bp, Artificial Sequence
  Description of Artificial Sequence: Synthetic oligonucleotide
ggaaacgggcggcggtggacag

SEQ ID NO: 399291 - DNA, 22 bp, Artificial Sequence
  Description of Artificial Sequence: Synthetic oligonucleotide
gaaacgggcggcggtggacagg

SEQ ID NO: 399292 - DNA, 23 bp, Artificial Sequence
  Description of Artificial Sequence: Synthetic oligonucleotide
aaacgggcggcggtggacagggt

SEQ ID NO: 399293 - DNA, 22 bp, Artificial Sequence
  Description of Artificial Sequence: Synthetic oligonucleotide
aacgggcggcggtggacagggt

SEQ ID NO: 399294 - DNA, 21 bp, Artificial Sequence
  Description of Artificial Sequence: Synthetic oligonucleotide
acgggcggcggtggacagggt

SEQ ID NO: 399295 - DNA, 20 bp, Artificial Sequence
  Description of Artificial Sequence: Synthetic oligonucleotide
cgggcggcggtggacagggt

SEQ ID NO: 399296 - DNA, 21 bp, Artificial Sequence
  Description of Artificial Sequence: Synthetic oligonucleotide
gggcggcggtggacagggtgt

SEQ ID NO: 399297 - DNA, 21 bp, Artificial Sequence
  Description of Artificial Sequence: Synthetic oligonucleotide
ggcggcggtggacagggtgtg

SEQ ID NO: 399298 - DNA, 22 bp, Artificial Sequence
  Description of Artificial Sequence: Synthetic oligonucleotide
gcggcggtggacagggtgtgca

SEQ ID NO: 399299 - DNA, 23 bp, Artificial Sequence
  Description of Artificial Sequence: Synthetic oligonucleotide
cggcggtggacagggtgtgcaga

SEQ ID NO: 399300 - DNA, 24 bp, Artificial Sequence
  Description of Artificial Sequence: Synthetic oligonucleotide
ggcggtggacagggtgtgcagaca

SEQ ID NO: 399301 - DNA, 26 bp, Artificial Sequence
  Description of Artificial Sequence: Synthetic oligonucleotide
gcggtggacagggtgtgcagacacaa

SEQ ID NO: 399302 - DNA, 27 bp, Artificial Sequence
  Description of Artificial Sequence: Synthetic oligonucleotide
cggtggacagggtgtgcagacacaact

SEQ ID NO: 399303 - DNA, 28 bp, Artificial Sequence
  Description of Artificial Sequence: Synthetic oligonucleotide
ggtggacagggtgtgcagacacaactac

SEQ ID NO: 399304 - DNA, 28 bp, Artificial Sequence
  Description of Artificial Sequence: Synthetic oligonucleotide
gtggacagggtgtgcagacacaactacc

SEQ ID NO: 399305 - DNA, 29 bp, Artificial Sequence
  Description of Artificial Sequence: Synthetic oligonucleotide
tggacagggtgtgcagacacaactaccag

SEQ ID NO: 399306 - DNA, 28 bp, Artificial Sequence
  Description of Artificial Sequence: Synthetic oligonucleotide
ggacagggtgtgcagacacaactaccag

SEQ ID NO: 399307 - DNA, 30 bp, Artificial Sequence; identical to SEQ ID NO: 58313
  Description of Artificial Sequence: Synthetic oligonucleotide

SEQ ID NO: 399308 - DNA, 30 bp, Artificial Sequence; identical to SEQ ID NO: 58314
  Description of Artificial Sequence: Synthetic oligonucleotide

SEQ ID NO: 399309 - DNA, 29 bp, Artificial Sequence
  Description of Artificial Sequence: Synthetic oligonucleotide
cagggtgtgcagacacaactaccagttgg

SEQ ID NO: 399310 - DNA, 30 bp, Artificial Sequence; identical to SEQ ID NO: 58316
  Description of Artificial Sequence: Synthetic oligonucleotide

SEQ ID NO: 399311 - DNA, 29 bp, Artificial Sequence
  Description of Artificial Sequence: Synthetic oligonucleotide
gggtgtgcagacacaactaccagttggag

SEQ ID NO: 399312 - DNA, 29 bp, Artificial Sequence
  Description of Artificial Sequence: Synthetic oligonucleotide
ggtgtgcagacacaactaccagttggagc

SEQ ID NO: 399313 - DNA, 30 bp, Artificial Sequence; identical to SEQ ID NO: 58319
  Description of Artificial Sequence: Synthetic oligonucleotide

SEQ ID NO: 399314 - DNA, 30 bp, Artificial Sequence; identical to SEQ ID NO: 58320
  Description of Artificial Sequence: Synthetic oligonucleotide

SEQ ID NO: 399315 - DNA, 29 bp, Artificial Sequence
  Description of Artificial Sequence: Synthetic oligonucleotide
gtgcagacacaactaccagttggagctcc

SEQ ID NO: 399316 - DNA, 29 bp, Artificial Sequence
  Description of Artificial Sequence: Synthetic oligonucleotide
tgcagacacaactaccagttggagctccg

SEQ ID NO: 399317 - DNA, 28 bp, Artificial Sequence
  Description of Artificial Sequence: Synthetic oligonucleotide
gcagacacaactaccagttggagctccg

SEQ ID NO: 399318 - DNA, 28 bp, Artificial Sequence
  Description of Artificial Sequence: Synthetic oligonucleotide
cagacacaactaccagttggagctccgc

SEQ ID NO: 399319 - DNA, 29 bp, Artificial Sequence
  Description of Artificial Sequence: Synthetic oligonucleotide
agacacaactaccagttggagctccgcac

SEQ ID NO: 399320 - DNA, 28 bp, Artificial Sequence
  Description of Artificial Sequence: Synthetic oligonucleotide
gacacaactaccagttggagctccgcac

SEQ ID NO: 399321 - DNA, 28 bp, Artificial Sequence
  Description of Artificial Sequence: Synthetic oligonucleotide
acacaactaccagttggagctccgcacg

SEQ ID NO: 399322 - DNA, 27 bp, Artificial Sequence
  Description of Artificial Sequence: Synthetic oligonucleotide
cacaactaccagttggagctccgcacg

SEQ ID NO: 399323 - DNA, 28 bp, Artificial Sequence
  Description of Artificial Sequence: Synthetic oligonucleotide
acaactaccagttggagctccgcacgac

SEQ ID NO: 399324 - DNA, 27 bp, Artificial Sequence
  Description of Artificial Sequence: Synthetic oligonucleotide
caactaccagttggagctccgcacgac

SEQ ID NO: 399325 - DNA, 27 bp, Artificial Sequence
  Description of Artificial Sequence: Synthetic oligonucleotide
aactaccagttggagctccgcacgacc

SEQ ID NO: 399326 - DNA, 27 bp, Artificial Sequence
  Description of Artificial Sequence: Synthetic oligonucleotide
actaccagttggagctccgcacgacct

SEQ ID NO: 399327 - DNA, 27 bp, Artificial Sequence
  Description of Artificial Sequence: Synthetic oligonucleotide
ctaccagttggagctccgcacgacctt

SEQ ID NO: 399328 - DNA, 27 bp, Artificial Sequence
  Description of Artificial Sequence: Synthetic oligonucleotide
taccagttggagctccgcacgaccttg

SEQ ID NO: 399329 - DNA, 26 bp, Artificial Sequence
  Description of Artificial Sequence: Synthetic oligonucleotide
accagttggagctccgcacgaccttg

SEQ ID NO: 399330 - DNA, 25 bp, Artificial Sequence
  Description of Artificial Sequence: Synthetic oligonucleotide
ccagttggagctccgcacgaccttg

SEQ ID NO: 399331 - DNA, 26 bp, Artificial Sequence
  Description of Artificial Sequence: Synthetic oligonucleotide
cagttggagctccgcacgaccttgca

SEQ ID NO: 399332 - DNA, 26 bp, Artificial Sequence
  Description of Artificial Sequence: Synthetic oligonucleotide
agttggagctccgcacgaccttgcag

SEQ ID NO: 399333 - DNA, 25 bp, Artificial Sequence
  Description of Artificial Sequence: Synthetic oligonucleotide
gttggagctccgcacgaccttgcag

SEQ ID NO: 399334 - DNA, 25 bp, Artificial Sequence
  Description of Artificial Sequence: Synthetic oligonucleotide
ttggagctccgcacgaccttgcagc

SEQ ID NO: 399335 - DNA, 24 bp, Artificial Sequence
  Description of Artificial Sequence: Synthetic oligonucleotide
tggagctccgcacgaccttgcagc

SEQ ID NO: 399336 - DNA, 23 bp, Artificial Sequence
  Description of Artificial Sequence: Synthetic oligonucleotide
ggagctccgcacgaccttgcagc

SEQ ID NO: 399337 - DNA, 23 bp, Artificial Sequence
  Description of Artificial Sequence: Synthetic oligonucleotide
gagctccgcacgaccttgcagcg

SEQ ID NO: 399338 - DNA, 23 bp, Artificial Sequence
  Description of Artificial Sequence: Synthetic oligonucleotide
agctccgcacgaccttgcagcgg

SEQ ID NO: 399339 - DNA, 22 bp, Artificial Sequence
  Description of Artificial Sequence: Synthetic oligonucleotide
gctccgcacgaccttgcagcgg

SEQ ID NO: 399340 - DNA, 22 bp, Artificial Sequence
  Description of Artificial Sequence: Synthetic oligonucleotide
ctccgcacgaccttgcagcggc

SEQ ID NO: 399341 - DNA, 23 bp, Artificial Sequence
  Description of Artificial Sequence: Synthetic oligonucleotide
tccgcacgaccttgcagcggcga

SEQ ID NO: 399342 - DNA, 22 bp, Artificial Sequence
  Description of Artificial Sequence: Synthetic oligonucleotide
ccgcacgaccttgcagcggcga

SEQ ID NO: 399343 - DNA, 23 bp, Artificial Sequence
  Description of Artificial Sequence: Synthetic oligonucleotide
cgcacgaccttgcagcggcgagt

SEQ ID NO: 399344 - DNA, 23 bp, Artificial Sequence
  Description of Artificial Sequence: Synthetic oligonucleotide
gcacgaccttgcagcggcgagtg

SEQ ID NO: 399345 - DNA, 24 bp, Artificial Sequence
  Description of Artificial Sequence: Synthetic oligonucleotide
cacgaccttgcagcggcgagtgga

SEQ ID NO: 399346 - DNA, 24 bp, Artificial Sequence
  Description of Artificial Sequence: Synthetic oligonucleotide
acgaccttgcagcggcgagtggag

SEQ ID NO: 399347 - DNA, 23 bp, Artificial Sequence
  Description of Artificial Sequence: Synthetic oligonucleotide
cgaccttgcagcggcgagtggag

SEQ ID NO: 399348 - DNA, 23 bp, Artificial Sequence
  Description of Artificial Sequence: Synthetic oligonucleotide
gaccttgcagcggcgagtggagc

SEQ ID NO: 399349 - DNA, 23 bp, Artificial Sequence
  Description of Artificial Sequence: Synthetic oligonucleotide
accttgcagcggcgagtggagcc

SEQ ID NO: 399350 - DNA, 22 bp, Artificial Sequence
  Description of Artificial Sequence: Synthetic oligonucleotide
ccttgcagcggcgagtggagcc

SEQ ID NO: 399351 - DNA, 23 bp, Artificial Sequence
  Description of Artificial Sequence: Synthetic oligonucleotide
cttgcagcggcgagtggagccca

SEQ ID NO: 399352 - DNA, 24 bp, Artificial Sequence
  Description of Artificial Sequence: Synthetic oligonucleotide
ttgcagcggcgagtggagcccaca

SEQ ID NO: 399353 - DNA, 23 bp, Artificial Sequence
  Description of Artificial Sequence: Synthetic oligonucleotide
tgcagcggcgagtggagcccaca

SEQ ID NO: 399354 - DNA, 22 bp, Artificial Sequence
  Description of Artificial Sequence: Synthetic oligonucleotide
gcagcggcgagtggagcccaca

SEQ ID NO: 399355 - DNA, 23 bp, Artificial Sequence
  Description of Artificial Sequence: Synthetic oligonucleotide
cagcggcgagtggagcccacagt

SEQ ID NO: 399356 - DNA, 24 bp, Artificial Sequence
  Description of Artificial Sequence: Synthetic oligonucleotide
agcggcgagtggagcccacagtga

SEQ ID NO: 399357 - DNA, 23 bp, Artificial Sequence
  Description of Artificial Sequence: Synthetic oligonucleotide
gcggcgagtggagcccacagtga

SEQ ID NO: 399358 - DNA, 23 bp, Artificial Sequence
  Description of Artificial Sequence: Synthetic oligonucleotide
cggcgagtggagcccacagtgac

SEQ ID NO: 399359 - DNA, 25 bp, Artificial Sequence
  Description of Artificial Sequence: Synthetic oligonucleotide
ggcgagtggagcccacagtgaccat

SEQ ID NO: 399360 - DNA, 26 bp, Artificial Sequence
  Description of Artificial Sequence: Synthetic oligonucleotide
gcgagtggagcccacagtgaccatct

SEQ ID NO: 399361 - DNA, 26 bp, Artificial Sequence
  Description of Artificial Sequence: Synthetic oligonucleotide
cgagtggagcccacagtgaccatctc

SEQ ID NO: 399362 - DNA, 26 bp, Artificial Sequence
  Description of Artificial Sequence: Synthetic oligonucleotide
gagtggagcccacagtgaccatctcc

SEQ ID NO: 399363 - DNA, 26 bp, Artificial Sequence
  Description of Artificial Sequence: Synthetic oligonucleotide
agtggagcccacagtgaccatctccc

SEQ ID NO: 399364 - DNA, 25 bp, Artificial Sequence
  Description of Artificial Sequence: Synthetic oligonucleotide
gtggagcccacagtgaccatctccc

SEQ ID NO: 399365 - DNA, 27 bp, Artificial Sequence
  Description of Artificial Sequence: Synthetic oligonucleotide
tggagcccacagtgaccatctccccat

SEQ ID NO: 399366 - DNA, 26 bp, Artificial Sequence
  Description of Artificial Sequence: Synthetic oligonucleotide
ggagcccacagtgaccatctccccat

SEQ ID NO: 399367 - DNA, 26 bp, Artificial Sequence
  Description of Artificial Sequence: Synthetic oligonucleotide
gagcccacagtgaccatctccccatc

SEQ ID NO: 399368 - DNA, 27 bp, Artificial Sequence
  Description of Artificial Sequence: Synthetic oligonucleotide
agcccacagtgaccatctccccatcca

SEQ ID NO: 399369 - DNA, 26 bp, Artificial Sequence
  Description of Artificial Sequence: Synthetic oligonucleotide
gcccacagtgaccatctccccatcca

SEQ ID NO: 399370 - DNA, 26 bp, Artificial Sequence
  Description of Artificial Sequence: Synthetic oligonucleotide
cccacagtgaccatctccccatccag

SEQ ID NO: 399371 - DNA, 27 bp, Artificial Sequence
  Description of Artificial Sequence: Synthetic oligonucleotide
ccacagtgaccatctccccatccagga

SEQ ID NO: 399372 - DNA, 27 bp, Artificial Sequence
  Description of Artificial Sequence: Synthetic oligonucleotide
cacagtgaccatctccccatccaggac

SEQ ID NO: 399373 - DNA, 28 bp, Artificial Sequence
  Description of Artificial Sequence: Synthetic oligonucleotide
acagtgaccatctccccatccaggacag

SEQ ID NO: 399374 - DNA, 27 bp, Artificial Sequence
  Description of Artificial Sequence: Synthetic oligonucleotide
cagtgaccatctccccatccaggacag

SEQ ID NO: 399375 - DNA, 28 bp, Artificial Sequence
  Description of Artificial Sequence: Synthetic oligonucleotide
agtgaccatctccccatccaggacagag

SEQ ID NO: 399376 - DNA, 27 bp, Artificial Sequence
  Description of Artificial Sequence: Synthetic oligonucleotide
gtgaccatctccccatccaggacagag

SEQ ID NO: 399377 - DNA, 27 bp, Artificial Sequence
  Description of Artificial Sequence: Synthetic oligonucleotide
tgaccatctccccatccaggacagagg

SEQ ID NO: 399378 - DNA, 26 bp, Artificial Sequence
  Description of Artificial Sequence: Synthetic oligonucleotide
gaccatctccccatccaggacagagg

SEQ ID NO: 399379 - DNA, 26 bp, Artificial Sequence
  Description of Artificial Sequence: Synthetic oligonucleotide
accatctccccatccaggacagaggc

SEQ ID NO: 399380 - DNA, 25 bp, Artificial Sequence
  Description of Artificial Sequence: Synthetic oligonucleotide
ccatctccccatccaggacagaggc

SEQ ID NO: 399381 - DNA, 25 bp, Artificial Sequence
  Description of Artificial Sequence: Synthetic oligonucleotide
catctccccatccaggacagaggcc

SEQ ID NO: 399382 - DNA, 26 bp, Artificial Sequence
  Description of Artificial Sequence: Synthetic oligonucleotide
atctccccatccaggacagaggccct

SEQ ID NO: 399383 - DNA, 25 bp, Artificial Sequence
  Description of Artificial Sequence: Synthetic oligonucleotide
tctccccatccaggacagaggccct

SEQ ID NO: 399384 - DNA, 24 bp, Artificial Sequence
  Description of Artificial Sequence: Synthetic oligonucleotide
ctccccatccaggacagaggccct

SEQ ID NO: 399385 - DNA, 26 bp, Artificial Sequence
  Description of Artificial Sequence: Synthetic oligonucleotide
tccccatccaggacagaggccctcaa

SEQ ID NO: 399386 - DNA, 25 bp, Artificial Sequence
  Description of Artificial Sequence: Synthetic oligonucleotide
ccccatccaggacagaggccctcaa

SEQ ID NO: 399387 - DNA, 25 bp, Artificial Sequence
  Description of Artificial Sequence: Synthetic oligonucleotide
cccatccaggacagaggccctcaac

SEQ ID NO: 399388 - DNA, 26 bp, Artificial Sequence
  Description of Artificial Sequence: Synthetic oligonucleotide
ccatccaggacagaggccctcaacca

SEQ ID NO: 399389 - DNA, 26 bp, Artificial Sequence
  Description of Artificial Sequence: Synthetic oligonucleotide
catccaggacagaggccctcaaccac

SEQ ID NO: 399390 - DNA, 27 bp, Artificial Sequence
  Description of Artificial Sequence: Synthetic oligonucleotide
atccaggacagaggccctcaaccacca

SEQ ID NO: 399391 - DNA, 26 bp, Artificial Sequence
  Description of Artificial Sequence: Synthetic oligonucleotide
tccaggacagaggccctcaaccacca

SEQ ID NO: 399392 - DNA, 25 bp, Artificial Sequence
  Description of Artificial Sequence: Synthetic oligonucleotide
ccaggacagaggccctcaaccacca

SEQ ID NO: 399393 - DNA, 27 bp, Artificial Sequence
  Description of Artificial Sequence: Synthetic oligonucleotide
caggacagaggccctcaaccaccacaa

SEQ ID NO: 399394 - DNA, 27 bp, Artificial Sequence
  Description of Artificial Sequence: Synthetic oligonucleotide
aggacagaggccctcaaccaccacaac

SEQ ID NO: 399395 - DNA, 26 bp, Artificial Sequence
  Description of Artificial Sequence: Synthetic oligonucleotide
ggacagaggccctcaaccaccacaac

SEQ ID NO: 399396 - DNA, 27 bp, Artificial Sequence
  Description of Artificial Sequence: Synthetic oligonucleotide
gacagaggccctcaaccaccacaacct

SEQ ID NO: 399397 - DNA, 27 bp, Artificial Sequence
  Description of Artificial Sequence: Synthetic oligonucleotide
acagaggccctcaaccaccacaacctg

SEQ ID NO: 399398 - DNA, 26 bp, Artificial Sequence
  Description of Artificial Sequence: Synthetic oligonucleotide
cagaggccctcaaccaccacaacctg

SEQ ID NO: 399399 - DNA, 27 bp, Artificial Sequence
  Description of Artificial Sequence: Synthetic oligonucleotide
agaggccctcaaccaccacaacctgct

SEQ ID NO: 399400 - DNA, 26 bp, Artificial Sequence
  Description of Artificial Sequence: Synthetic oligonucleotide
gaggccctcaaccaccacaacctgct

SEQ ID NO: 399401 - DNA, 26 bp, Artificial Sequence
  Description of Artificial Sequence: Synthetic oligonucleotide
aggccctcaaccaccacaacctgctg

SEQ ID NO: 399402 - DNA, 25 bp, Artificial Sequence
  Description of Artificial Sequence: Synthetic oligonucleotide
ggccctcaaccaccacaacctgctg

SEQ ID NO: 399403 - DNA, 26 bp, Artificial Sequence
  Description of Artificial Sequence: Synthetic oligonucleotide
gccctcaaccaccacaacctgctggt

SEQ ID NO: 399404 - DNA, 27 bp, Artificial Sequence
  Description of Artificial Sequence: Synthetic oligonucleotide
ccctcaaccaccacaacctgctggtct

SEQ ID NO: 399405 - DNA, 27 bp, Artificial Sequence
  Description of Artificial Sequence: Synthetic oligonucleotide
cctcaaccaccacaacctgctggtctg

SEQ ID NO: 399406 - DNA, 27 bp, Artificial Sequence
  Description of Artificial Sequence: Synthetic oligonucleotide
ctcaaccaccacaacctgctggtctgc

SEQ ID NO: 399407 - DNA, 28 bp, Artificial Sequence
  Description of Artificial Sequence: Synthetic oligonucleotide
tcaaccaccacaacctgctggtctgctc

SEQ ID NO: 399408 - DNA, 27 bp, Artificial Sequence
  Description of Artificial Sequence: Synthetic oligonucleotide
caaccaccacaacctgctggtctgctc

SEQ ID NO: 399409 - DNA, 27 bp, Artificial Sequence
  Description of Artificial Sequence: Synthetic oligonucleotide
aaccaccacaacctgctggtctgctcg

SEQ ID NO: 399410 - DNA, 26 bp, Artificial Sequence
  Description of Artificial Sequence: Synthetic oligonucleotide
accaccacaacctgctggtctgctcg

SEQ ID NO: 399411 - DNA, 25 bp, Artificial Sequence
  Description of Artificial Sequence: Synthetic oligonucleotide
ccaccacaacctgctggtctgctcg

SEQ ID NO: 399412 - DNA, 26 bp, Artificial Sequence
  Description of Artificial Sequence: Synthetic oligonucleotide
caccacaacctgctggtctgctcggt

SEQ ID NO: 399413 - DNA, 27 bp, Artificial Sequence
  Description of Artificial Sequence: Synthetic oligonucleotide
accacaacctgctggtctgctcggtga

SEQ ID NO: 399414 - DNA, 26 bp, Artificial Sequence
  Description of Artificial Sequence: Synthetic oligonucleotide
ccacaacctgctggtctgctcggtga

SEQ ID NO: 399415 - DNA, 27 bp, Artificial Sequence
  Description of Artificial Sequence: Synthetic oligonucleotide
cacaacctgctggtctgctcggtgaca

SEQ ID NO: 399416 - DNA, 27 bp, Artificial Sequence
  Description of Artificial Sequence: Synthetic oligonucleotide
acaacctgctggtctgctcggtgacag

SEQ ID NO: 399417 - DNA, 27 bp, Artificial Sequence
  Description of Artificial Sequence: Synthetic oligonucleotide
caacctgctggtctgctcggtgacaga

SEQ ID NO: 399418 - DNA, 30 bp, Artificial Sequence; identical to SEQ ID NO: 58424
  Description of Artificial Sequence: Synthetic oligonucleotide

SEQ ID NO: 399419 - DNA, 29 bp, Artificial Sequence
  Description of Artificial Sequence: Synthetic oligonucleotide
acctgctggtctgctcggtgacagatttc

SEQ ID NO: 399420 - DNA, 28 bp, Artificial Sequence
  Description of Artificial Sequence: Synthetic oligonucleotide
cctgctggtctgctcggtgacagatttc

SEQ ID NO: 399421 - DNA, 31 bp, Artificial Sequence; identical to SEQ ID NO: 58427
  Description of Artificial Sequence: Synthetic oligonucleotide

SEQ ID NO: 399422 - DNA, 31 bp, Artificial Sequence; identical to SEQ ID NO: 58428
  Description of Artificial Sequence: Synthetic oligonucleotide

SEQ ID NO: 399423 - DNA, 30 bp, Artificial Sequence; identical to SEQ ID NO: 58429
  Description of Artificial Sequence: Synthetic oligonucleotide

SEQ ID NO: 399424 - DNA, 31 bp, Artificial Sequence; identical to SEQ ID NO: 58430
  Description of Artificial Sequence: Synthetic oligonucleotide

SEQ ID NO: 399425 - DNA, 31 bp, Artificial Sequence; identical to SEQ ID NO: 58431
  Description of Artificial Sequence: Synthetic oligonucleotide

SEQ ID NO: 399426 - DNA, 30 bp, Artificial Sequence; identical to SEQ ID NO: 58432
  Description of Artificial Sequence: Synthetic oligonucleotide

SEQ ID NO: 399427 - DNA, 30 bp, Artificial Sequence; identical to SEQ ID NO: 58433
  Description of Artificial Sequence: Synthetic oligonucleotide

SEQ ID NO: 399428 - DNA, 30 bp, Artificial Sequence; identical to SEQ ID NO: 58434
  Description of Artificial Sequence: Synthetic oligonucleotide

SEQ ID NO: 399429 - DNA, 29 bp, Artificial Sequence
  Description of Artificial Sequence: Synthetic oligonucleotide
ctgctcggtgacagatttctatccagccc

SEQ ID NO: 399430 - DNA, 30 bp, Artificial Sequence; identical to SEQ ID NO: 58436
  Description of Artificial Sequence: Synthetic oligonucleotide

SEQ ID NO: 399431 - DNA, 29 bp, Artificial Sequence
  Description of Artificial Sequence: Synthetic oligonucleotide
gctcggtgacagatttctatccagcccag

SEQ ID NO: 399432 - DNA, 31 bp, Artificial Sequence; identical to SEQ ID NO: 58438
  Description of Artificial Sequence: Synthetic oligonucleotide

SEQ ID NO: 399433 - DNA, 34 bp, Artificial Sequence; identical to SEQ ID NO: 58439
  Description of Artificial Sequence: Synthetic oligonucleotide

SEQ ID NO: 399434 - DNA, 33 bp, Artificial Sequence; identical to SEQ ID NO: 58440
  Description of Artificial Sequence: Synthetic oligonucleotide

SEQ ID NO: 399435 - DNA, 34 bp, Artificial Sequence; identical to SEQ ID NO: 58441
  Description of Artificial Sequence: Synthetic oligonucleotide

SEQ ID NO: 399436 - DNA, 34 bp, Artificial Sequence; identical to SEQ ID NO: 58442
  Description of Artificial Sequence: Synthetic oligonucleotide

SEQ ID NO: 399437 - DNA, 34 bp, Artificial Sequence; identical to SEQ ID NO: 58443
  Description of Artificial Sequence: Synthetic oligonucleotide

SEQ ID NO: 399438 - DNA, 33 bp, Artificial Sequence; identical to SEQ ID NO: 58444
  Description of Artificial Sequence: Synthetic oligonucleotide

SEQ ID NO: 399439 - DNA, 33 bp, Artificial Sequence; identical to SEQ ID NO: 58445
  Description of Artificial Sequence: Synthetic oligonucleotide

SEQ ID NO: 399440 - DNA, 32 bp, Artificial Sequence; identical to SEQ ID NO: 58446
  Description of Artificial Sequence: Synthetic oligonucleotide

SEQ ID NO: 399441 - DNA, 33 bp, Artificial Sequence; identical to SEQ ID NO: 58447
  Description of Artificial Sequence: Synthetic oligonucleotide

SEQ ID NO: 399442 - DNA, 32 bp, Artificial Sequence; identical to SEQ ID NO: 58448
  Description of Artificial Sequence: Synthetic oligonucleotide

SEQ ID NO: 399443 - DNA, 32 bp, Artificial Sequence; identical to SEQ ID NO: 58449
  Description of Artificial Sequence: Synthetic oligonucleotide

SEQ ID NO: 399444 - DNA, 31 bp, Artificial Sequence; identical to SEQ ID NO: 58450
  Description of Artificial Sequence: Synthetic oligonucleotide

SEQ ID NO: 399445 - DNA, 30 bp, Artificial Sequence; identical to SEQ ID NO: 58451
  Description of Artificial Sequence: Synthetic oligonucleotide

SEQ ID NO: 399446 - DNA, 29 bp, Artificial Sequence
  Description of Artificial Sequence: Synthetic oligonucleotide
tctatccagcccagatcaaagtccggtgg

SEQ ID NO: 399447 - DNA, 28 bp, Artificial Sequence
  Description of Artificial Sequence: Synthetic oligonucleotide
ctatccagcccagatcaaagtccggtgg

SEQ ID NO: 399448 - DNA, 31 bp, Artificial Sequence; identical to SEQ ID NO: 58454
  Description of Artificial Sequence: Synthetic oligonucleotide

SEQ ID NO: 399449 - DNA, 30 bp, Artificial Sequence; identical to SEQ ID NO: 58455
  Description of Artificial Sequence: Synthetic oligonucleotide

SEQ ID NO: 399450 - DNA, 29 bp, Artificial Sequence
  Description of Artificial Sequence: Synthetic oligonucleotide
tccagcccagatcaaagtccggtggtttc

SEQ ID NO: 399451 - DNA, 28 bp, Artificial Sequence
  Description of Artificial Sequence: Synthetic oligonucleotide
ccagcccagatcaaagtccggtggtttc

SEQ ID NO: 399452 - DNA, 28 bp, Artificial Sequence
  Description of Artificial Sequence: Synthetic oligonucleotide
cagcccagatcaaagtccggtggtttcg

SEQ ID NO: 399453 - DNA, 28 bp, Artificial Sequence
  Description of Artificial Sequence: Synthetic oligonucleotide
agcccagatcaaagtccggtggtttcgg

SEQ ID NO: 399454 - DNA, 27 bp, Artificial Sequence
  Description of Artificial Sequence: Synthetic oligonucleotide
gcccagatcaaagtccggtggtttcgg

SEQ ID NO: 399455 - DNA, 30 bp, Artificial Sequence; identical to SEQ ID NO: 58461
  Description of Artificial Sequence: Synthetic oligonucleotide

SEQ ID NO: 399456 - DNA, 31 bp, Artificial Sequence; identical to SEQ ID NO: 58462
  Description of Artificial Sequence: Synthetic oligonucleotide

SEQ ID NO: 399457 - DNA, 31 bp, Artificial Sequence; identical to SEQ ID NO: 58463
  Description of Artificial Sequence: Synthetic oligonucleotide

SEQ ID NO: 399458 - DNA, 32 bp, Artificial Sequence; identical to SEQ ID NO: 58464
  Description of Artificial Sequence: Synthetic oligonucleotide

SEQ ID NO: 399459 - DNA, 31 bp, Artificial Sequence; identical to SEQ ID NO: 58465
  Description of Artificial Sequence: Synthetic oligonucleotide

SEQ ID NO: 399460 - DNA, 31 bp, Artificial Sequence; identical to SEQ ID NO: 58466
  Description of Artificial Sequence: Synthetic oligonucleotide

SEQ ID NO: 399461 - DNA, 30 bp, Artificial Sequence; identical to SEQ ID NO: 58467
  Description of Artificial Sequence: Synthetic oligonucleotide

SEQ ID NO: 399462 - DNA, 29 bp, Artificial Sequence
  Description of Artificial Sequence: Synthetic oligonucleotide
caaagtccggtggtttcggaatgaccagg

SEQ ID NO: 399463 - DNA, 30 bp, Artificial Sequence; identical to SEQ ID NO: 58469
  Description of Artificial Sequence: Synthetic oligonucleotide

SEQ ID NO: 399464 - DNA, 29 bp, Artificial Sequence
  Description of Artificial Sequence: Synthetic oligonucleotide
aagtccggtggtttcggaatgaccaggag

SEQ ID NO: 399465 - DNA, 28 bp, Artificial Sequence
  Description of Artificial Sequence: Synthetic oligonucleotide
agtccggtggtttcggaatgaccaggag

SEQ ID NO: 399466 - DNA, 27 bp, Artificial Sequence
  Description of Artificial Sequence: Synthetic oligonucleotide
gtccggtggtttcggaatgaccaggag

SEQ ID NO: 399467 - DNA, 27 bp, Artificial Sequence
  Description of Artificial Sequence: Synthetic oligonucleotide
tccggtggtttcggaatgaccaggagg

SEQ ID NO: 399468 - DNA, 27 bp, Artificial Sequence
  Description of Artificial Sequence: Synthetic oligonucleotide
ccggtggtttcggaatgaccaggagga

SEQ ID NO: 399469 - DNA, 27 bp, Artificial Sequence
  Description of Artificial Sequence: Synthetic oligonucleotide
cggtggtttcggaatgaccaggaggag

SEQ ID NO: 399470 - DNA, 28 bp, Artificial Sequence
  Description of Artificial Sequence: Synthetic oligonucleotide
ggtggtttcggaatgaccaggaggagac

SEQ ID NO: 399471 - DNA, 29 bp, Artificial Sequence
  Description of Artificial Sequence: Synthetic oligonucleotide
gtggtttcggaatgaccaggaggagacag

SEQ ID NO: 399472 - DNA, 29 bp, Artificial Sequence
  Description of Artificial Sequence: Synthetic oligonucleotide
tggtttcggaatgaccaggaggagacagc

SEQ ID NO: 399473 - DNA, 28 bp, Artificial Sequence
  Description of Artificial Sequence: Synthetic oligonucleotide
ggtttcggaatgaccaggaggagacagc

SEQ ID NO: 399474 - DNA, 29 bp, Artificial Sequence
  Description of Artificial Sequence: Synthetic oligonucleotide
gtttcggaatgaccaggaggagacagctg

SEQ ID NO: 399475 - DNA, 29 bp, Artificial Sequence
  Description of Artificial Sequence: Synthetic oligonucleotide
tttcggaatgaccaggaggagacagctgg

SEQ ID NO: 399476 - DNA, 28 bp, Artificial Sequence
  Description of Artificial Sequence: Synthetic oligonucleotide
ttcggaatgaccaggaggagacagctgg

SEQ ID NO: 399477 - DNA, 27 bp, Artificial Sequence
  Description of Artificial Sequence: Synthetic oligonucleotide
tcggaatgaccaggaggagacagctgg

SEQ ID NO: 399478 - DNA, 26 bp, Artificial Sequence
  Description of Artificial Sequence: Synthetic oligonucleotide
cggaatgaccaggaggagacagctgg

SEQ ID NO: 399479 - DNA, 26 bp, Artificial Sequence
  Description of Artificial Sequence: Synthetic oligonucleotide
ggaatgaccaggaggagacagctggc

SEQ ID NO: 399480 - DNA, 27 bp, Artificial Sequence
  Description of Artificial Sequence: Synthetic oligonucleotide
gaatgaccaggaggagacagctggcgt

SEQ ID NO: 399481 - DNA, 28 bp, Artificial Sequence
  Description of Artificial Sequence: Synthetic oligonucleotide
aatgaccaggaggagacagctggcgttg

SEQ ID NO: 399482 - DNA, 27 bp, Artificial Sequence
  Description of Artificial Sequence: Synthetic oligonucleotide
atgaccaggaggagacagctggcgttg

SEQ ID NO: 399483 - DNA, 27 bp, Artificial Sequence
  Description of Artificial Sequence: Synthetic oligonucleotide
tgaccaggaggagacagctggcgttgt

SEQ ID NO: 399484 - DNA, 26 bp, Artificial Sequence
  Description of Artificial Sequence: Synthetic oligonucleotide
gaccaggaggagacagctggcgttgt

SEQ ID NO: 399485 - DNA, 27 bp, Artificial Sequence
  Description of Artificial Sequence: Synthetic oligonucleotide
accaggaggagacagctggcgttgtgt

SEQ ID NO: 399486 - DNA, 26 bp, Artificial Sequence
  Description of Artificial Sequence: Synthetic oligonucleotide
ccaggaggagacagctggcgttgtgt

SEQ ID NO: 399487 - DNA, 26 bp, Artificial Sequence
  Description of Artificial Sequence: Synthetic oligonucleotide
caggaggagacagctggcgttgtgtc

SEQ ID NO: 399488 - DNA, 27 bp, Artificial Sequence
  Description of Artificial Sequence: Synthetic oligonucleotide
aggaggagacagctggcgttgtgtcca

SEQ ID NO: 399489 - DNA, 26 bp, Artificial Sequence
  Description of Artificial Sequence: Synthetic oligonucleotide
ggaggagacagctggcgttgtgtcca

SEQ ID NO: 399490 - DNA, 26 bp, Artificial Sequence
  Description of Artificial Sequence: Synthetic oligonucleotide
gaggagacagctggcgttgtgtccac

SEQ ID NO: 399491 - DNA, 26 bp, Artificial Sequence
  Description of Artificial Sequence: Synthetic oligonucleotide
aggagacagctggcgttgtgtccacc

SEQ ID NO: 399492 - DNA, 25 bp, Artificial Sequence
  Description of Artificial Sequence: Synthetic oligonucleotide
ggagacagctggcgttgtgtccacc

SEQ ID NO: 399493 - DNA, 25 bp, Artificial Sequence
  Description of Artificial Sequence: Synthetic oligonucleotide
gagacagctggcgttgtgtccaccc

SEQ ID NO: 399494 - DNA, 25 bp, Artificial Sequence
  Description of Artificial Sequence: Synthetic oligonucleotide
agacagctggcgttgtgtccacccc

SEQ ID NO: 399495 - DNA, 24 bp, Artificial Sequence
  Description of Artificial Sequence: Synthetic oligonucleotide
gacagctggcgttgtgtccacccc

SEQ ID NO: 399496 - DNA, 24 bp, Artificial Sequence
  Description of Artificial Sequence: Synthetic oligonucleotide
acagctggcgttgtgtccaccccc

SEQ ID NO: 399497 - DNA, 23 bp, Artificial Sequence
  Description of Artificial Sequence: Synthetic oligonucleotide
cagctggcgttgtgtccaccccc

SEQ ID NO: 399498 - DNA, 27 bp, Artificial Sequence
  Description of Artificial Sequence: Synthetic oligonucleotide
agctggcgttgtgtccaccccccttat

SEQ ID NO: 399499 - DNA, 27 bp, Artificial Sequence
  Description of Artificial Sequence: Synthetic oligonucleotide
gctggcgttgtgtccaccccccttatt

SEQ ID NO: 399500 - DNA, 28 bp, Artificial Sequence
  Description of Artificial Sequence: Synthetic oligonucleotide
ctggcgttgtgtccaccccccttattag

SEQ ID NO: 399501 - DNA, 28 bp, Artificial Sequence
  Description of Artificial Sequence: Synthetic oligonucleotide
tggcgttgtgtccaccccccttattagg

SEQ ID NO: 399502 - DNA, 27 bp, Artificial Sequence
  Description of Artificial Sequence: Synthetic oligonucleotide
ggcgttgtgtccaccccccttattagg

SEQ ID NO: 399503 - DNA, 30 bp, Artificial Sequence; identical to SEQ ID NO: 58509
  Description of Artificial Sequence: Synthetic oligonucleotide

SEQ ID NO: 399504 - DNA, 30 bp, Artificial Sequence; identical to SEQ ID NO: 58510
  Description of Artificial Sequence: Synthetic oligonucleotide

SEQ ID NO: 399505 - DNA, 31 bp, Artificial Sequence; identical to SEQ ID NO: 58511
  Description of Artificial Sequence: Synthetic oligonucleotide

SEQ ID NO: 399506 - DNA, 32 bp, Artificial Sequence; identical to SEQ ID NO: 58512
  Description of Artificial Sequence: Synthetic oligonucleotide

SEQ ID NO: 399507 - DNA, 31 bp, Artificial Sequence; identical to SEQ ID NO: 58513
  Description of Artificial Sequence: Synthetic oligonucleotide

SEQ ID NO: 399508 - DNA, 30 bp, Artificial Sequence; identical to SEQ ID NO: 58514
  Description of Artificial Sequence: Synthetic oligonucleotide

SEQ ID NO: 399509 - DNA, 31 bp, Artificial Sequence; identical to SEQ ID NO: 58515
  Description of Artificial Sequence: Synthetic oligonucleotide

SEQ ID NO: 399510 - DNA, 30 bp, Artificial Sequence; identical to SEQ ID NO: 58516
  Description of Artificial Sequence: Synthetic oligonucleotide

SEQ ID NO: 399511 - DNA, 30 bp, Artificial Sequence; identical to SEQ ID NO: 58517
  Description of Artificial Sequence: Synthetic oligonucleotide

SEQ ID NO: 399512 - DNA, 29 bp, Artificial Sequence
  Description of Artificial Sequence: Synthetic oligonucleotide
ccaccccccttattaggaatggtgactgg

SEQ ID NO: 399513 - DNA, 30 bp, Artificial Sequence; identical to SEQ ID NO: 58519
  Description of Artificial Sequence: Synthetic oligonucleotide

SEQ ID NO: 399514 - DNA, 30 bp, Artificial Sequence; identical to SEQ ID NO: 58520
  Description of Artificial Sequence: Synthetic oligonucleotide

SEQ ID NO: 399515 - DNA, 29 bp, Artificial Sequence
  Description of Artificial Sequence: Synthetic oligonucleotide
ccccccttattaggaatggtgactggacc

SEQ ID NO: 399516 - DNA, 31 bp, Artificial Sequence; identical to SEQ ID NO: 58522
  Description of Artificial Sequence: Synthetic oligonucleotide

SEQ ID NO: 399517 - DNA, 31 bp, Artificial Sequence; identical to SEQ ID NO: 58523
  Description of Artificial Sequence: Synthetic oligonucleotide

SEQ ID NO: 399518 - DNA, 32 bp, Artificial Sequence; identical to SEQ ID NO: 58524
  Description of Artificial Sequence: Synthetic oligonucleotide

SEQ ID NO: 399519 - DNA, 34 bp, Artificial Sequence; identical to SEQ ID NO: 58525
  Description of Artificial Sequence: Synthetic oligonucleotide

SEQ ID NO: 399520 - DNA, 34 bp, Artificial Sequence; identical to SEQ ID NO: 58526
  Description of Artificial Sequence: Synthetic oligonucleotide

SEQ ID NO: 399521 - DNA, 35 bp, Artificial Sequence; identical to SEQ ID NO: 58527
  Description of Artificial Sequence: Synthetic oligonucleotide

SEQ ID NO: 399522 - DNA, 34 bp, Artificial Sequence; identical to SEQ ID NO: 58528
  Description of Artificial Sequence: Synthetic oligonucleotide

SEQ ID NO: 399523 - DNA, 33 bp, Artificial Sequence; identical to SEQ ID NO: 58529
  Description of Artificial Sequence: Synthetic oligonucleotide

SEQ ID NO: 399524 - DNA, 32 bp, Artificial Sequence; identical to SEQ ID NO: 58530
  Description of Artificial Sequence: Synthetic oligonucleotide

SEQ ID NO: 399525 - DNA, 31 bp, Artificial Sequence; identical to SEQ ID NO: 58531
  Description of Artificial Sequence: Synthetic oligonucleotide

SEQ ID NO: 399526 - DNA, 30 bp, Artificial Sequence; identical to SEQ ID NO: 58532
  Description of Artificial Sequence: Synthetic oligonucleotide

SEQ ID NO: 399527 - DNA, 29 bp, Artificial Sequence
  Description of Artificial Sequence: Synthetic oligonucleotide
ggaatggtgactggaccttccagatcctg

SEQ ID NO: 399528 - DNA, 29 bp, Artificial Sequence
  Description of Artificial Sequence: Synthetic oligonucleotide
gaatggtgactggaccttccagatcctgg

SEQ ID NO: 399529 - DNA, 30 bp, Artificial Sequence; identical to SEQ ID NO: 58535
  Description of Artificial Sequence: Synthetic oligonucleotide

SEQ ID NO: 399530 - DNA, 29 bp, Artificial Sequence
  Description of Artificial Sequence: Synthetic oligonucleotide
atggtgactggaccttccagatcctggtg

SEQ ID NO: 399531 - DNA, 28 bp, Artificial Sequence
  Description of Artificial Sequence: Synthetic oligonucleotide
tggtgactggaccttccagatcctggtg

SEQ ID NO: 399532 - DNA, 27 bp, Artificial Sequence
  Description of Artificial Sequence: Synthetic oligonucleotide
ggtgactggaccttccagatcctggtg

SEQ ID NO: 399533 - DNA, 29 bp, Artificial Sequence
  Description of Artificial Sequence: Synthetic oligonucleotide
gtgactggaccttccagatcctggtgatg

SEQ ID NO: 399534 - DNA, 29 bp, Artificial Sequence
  Description of Artificial Sequence: Synthetic oligonucleotide
tgactggaccttccagatcctggtgatgc

SEQ ID NO: 399535 - DNA, 32 bp, Artificial Sequence; identical to SEQ ID NO: 58541
  Description of Artificial Sequence: Synthetic oligonucleotide

SEQ ID NO: 399536 - DNA, 32 bp, Artificial Sequence; identical to SEQ ID NO: 58542
  Description of Artificial Sequence: Synthetic oligonucleotide

SEQ ID NO: 399537 - DNA, 31 bp, Artificial Sequence; identical to SEQ ID NO: 58543
  Description of Artificial Sequence: Synthetic oligonucleotide

SEQ ID NO: 399538 - DNA, 30 bp, Artificial Sequence; identical to SEQ ID NO: 58544
  Description of Artificial Sequence: Synthetic oligonucleotide

SEQ ID NO: 399539 - DNA, 30 bp, Artificial Sequence; identical to SEQ ID NO: 58545
  Description of Artificial Sequence: Synthetic oligonucleotide

SEQ ID NO: 399540 - DNA, 30 bp, Artificial Sequence; identical to SEQ ID NO: 58546
  Description of Artificial Sequence: Synthetic oligonucleotide

SEQ ID NO: 399541 - DNA, 29 bp, Artificial Sequence
  Description of Artificial Sequence: Synthetic oligonucleotide
gatcctggtgatgctggaaatgactcccc

SEQ ID NO: 399542 - DNA, 30 bp, Artificial Sequence; identical to SEQ ID NO: 58548
  Description of Artificial Sequence: Synthetic oligonucleotide

SEQ ID NO: 399543 - DNA, 29 bp, Artificial Sequence
  Description of Artificial Sequence: Synthetic oligonucleotide
tcctggtgatgctggaaatgactccccag

SEQ ID NO: 399544 - DNA, 28 bp, Artificial Sequence
  Description of Artificial Sequence: Synthetic oligonucleotide
cctggtgatgctggaaatgactccccag

SEQ ID NO: 399545 - DNA, 28 bp, Artificial Sequence
  Description of Artificial Sequence: Synthetic oligonucleotide
ctggtgatgctggaaatgactccccagc

SEQ ID NO: 399546 - DNA, 28 bp, Artificial Sequence
  Description of Artificial Sequence: Synthetic oligonucleotide
tggtgatgctggaaatgactccccagcg

SEQ ID NO: 399547 - DNA, 27 bp, Artificial Sequence
  Description of Artificial Sequence: Synthetic oligonucleotide
ggtgatgctggaaatgactccccagcg

SEQ ID NO: 399548 - DNA, 28 bp, Artificial Sequence
  Description of Artificial Sequence: Synthetic oligonucleotide
gtgatgctggaaatgactccccagcgtg

SEQ ID NO: 399549 - DNA, 28 bp, Artificial Sequence
  Description of Artificial Sequence: Synthetic oligonucleotide
tgatgctggaaatgactccccagcgtgg

SEQ ID NO: 399550 - DNA, 27 bp, Artificial Sequence
  Description of Artificial Sequence: Synthetic oligonucleotide
gatgctggaaatgactccccagcgtgg

SEQ ID NO: 399551 - DNA, 28 bp, Artificial Sequence
  Description of Artificial Sequence: Synthetic oligonucleotide
atgctggaaatgactccccagcgtggag

SEQ ID NO: 399552 - DNA, 27 bp, Artificial Sequence
  Description of Artificial Sequence: Synthetic oligonucleotide
tgctggaaatgactccccagcgtggag

SEQ ID NO: 399553 - DNA, 27 bp, Artificial Sequence
  Description of Artificial Sequence: Synthetic oligonucleotide
gctggaaatgactccccagcgtggaga

SEQ ID NO: 399554 - DNA, 27 bp, Artificial Sequence
  Description of Artificial Sequence: Synthetic oligonucleotide
ctggaaatgactccccagcgtggagac

SEQ ID NO: 399555 - DNA, 27 bp, Artificial Sequence
  Description of Artificial Sequence: Synthetic oligonucleotide
tggaaatgactccccagcgtggagacg

SEQ ID NO: 399556 - DNA, 27 bp, Artificial Sequence
  Description of Artificial Sequence: Synthetic oligonucleotide
ggaaatgactccccagcgtggagacgt

SEQ ID NO: 399557 - DNA, 27 bp, Artificial Sequence
  Description of Artificial Sequence: Synthetic oligonucleotide
gaaatgactccccagcgtggagacgtc

SEQ ID NO: 399558 - DNA, 29 bp, Artificial Sequence
  Description of Artificial Sequence: Synthetic oligonucleotide
aaatgactccccagcgtggagacgtctac

SEQ ID NO: 399559 - DNA, 28 bp, Artificial Sequence
  Description of Artificial Sequence: Synthetic oligonucleotide
aatgactccccagcgtggagacgtctac

SEQ ID NO: 399560 - DNA, 27 bp, Artificial Sequence
  Description of Artificial Sequence: Synthetic oligonucleotide
atgactccccagcgtggagacgtctac

SEQ ID NO: 399561 - DNA, 27 bp, Artificial Sequence
  Description of Artificial Sequence: Synthetic oligonucleotide
tgactccccagcgtggagacgtctaca

SEQ ID NO: 399562 - DNA, 26 bp, Artificial Sequence
  Description of Artificial Sequence: Synthetic oligonucleotide
gactccccagcgtggagacgtctaca

SEQ ID NO: 399563 - DNA, 26 bp, Artificial Sequence
  Description of Artificial Sequence: Synthetic oligonucleotide
actccccagcgtggagacgtctacac

SEQ ID NO: 399564 - DNA, 25 bp, Artificial Sequence
  Description of Artificial Sequence: Synthetic oligonucleotide
ctccccagcgtggagacgtctacac

SEQ ID NO: 399565 - DNA, 26 bp, Artificial Sequence
  Description of Artificial Sequence: Synthetic oligonucleotide
tccccagcgtggagacgtctacacct

SEQ ID NO: 399566 - DNA, 25 bp, Artificial Sequence
  Description of Artificial Sequence: Synthetic oligonucleotide
ccccagcgtggagacgtctacacct

SEQ ID NO: 399567 - DNA, 25 bp, Artificial Sequence
  Description of Artificial Sequence: Synthetic oligonucleotide
cccagcgtggagacgtctacacctg

SEQ ID NO: 399568 - DNA, 25 bp, Artificial Sequence
  Description of Artificial Sequence: Synthetic oligonucleotide
ccagcgtggagacgtctacacctgc

SEQ ID NO: 399569 - DNA, 26 bp, Artificial Sequence
  Description of Artificial Sequence: Synthetic oligonucleotide
cagcgtggagacgtctacacctgcca

SEQ ID NO: 399570 - DNA, 26 bp, Artificial Sequence
  Description of Artificial Sequence: Synthetic oligonucleotide
agcgtggagacgtctacacctgccac

SEQ ID NO: 399571 - DNA, 25 bp, Artificial Sequence
  Description of Artificial Sequence: Synthetic oligonucleotide
gcgtggagacgtctacacctgccac

SEQ ID NO: 399572 - DNA, 26 bp, Artificial Sequence
  Description of Artificial Sequence: Synthetic oligonucleotide
cgtggagacgtctacacctgccacgt

SEQ ID NO: 399573 - DNA, 26 bp, Artificial Sequence
  Description of Artificial Sequence: Synthetic oligonucleotide
gtggagacgtctacacctgccacgtg

SEQ ID NO: 399574 - DNA, 27 bp, Artificial Sequence
  Description of Artificial Sequence: Synthetic oligonucleotide
tggagacgtctacacctgccacgtgga

SEQ ID NO: 399575 - DNA, 26 bp, Artificial Sequence
  Description of Artificial Sequence: Synthetic oligonucleotide
ggagacgtctacacctgccacgtgga

SEQ ID NO: 399576 - DNA, 26 bp, Artificial Sequence
  Description of Artificial Sequence: Synthetic oligonucleotide
gagacgtctacacctgccacgtggag

SEQ ID NO: 399577 - DNA, 27 bp, Artificial Sequence
  Description of Artificial Sequence: Synthetic oligonucleotide
agacgtctacacctgccacgtggagca

SEQ ID NO: 399578 - DNA, 26 bp, Artificial Sequence
  Description of Artificial Sequence: Synthetic oligonucleotide
gacgtctacacctgccacgtggagca

SEQ ID NO: 399579 - DNA, 26 bp, Artificial Sequence
  Description of Artificial Sequence: Synthetic oligonucleotide
acgtctacacctgccacgtggagcac

SEQ ID NO: 399580 - DNA, 25 bp, Artificial Sequence
  Description of Artificial Sequence: Synthetic oligonucleotide
cgtctacacctgccacgtggagcac

SEQ ID NO: 399581 - DNA, 25 bp, Artificial Sequence
  Description of Artificial Sequence: Synthetic oligonucleotide
gtctacacctgccacgtggagcacc

SEQ ID NO: 399582 - DNA, 25 bp, Artificial Sequence
  Description of Artificial Sequence: Synthetic oligonucleotide
tctacacctgccacgtggagcaccc

SEQ ID NO: 399583 - DNA, 24 bp, Artificial Sequence
  Description of Artificial Sequence: Synthetic oligonucleotide
ctacacctgccacgtggagcaccc

SEQ ID NO: 399584 - DNA, 25 bp, Artificial Sequence
  Description of Artificial Sequence: Synthetic oligonucleotide
tacacctgccacgtggagcacccca

SEQ ID NO: 399585 - DNA, 24 bp, Artificial Sequence
  Description of Artificial Sequence: Synthetic oligonucleotide
acacctgccacgtggagcacccca

SEQ ID NO: 399586 - DNA, 23 bp, Artificial Sequence
  Description of Artificial Sequence: Synthetic oligonucleotide
cacctgccacgtggagcacccca

SEQ ID NO: 399587 - DNA, 23 bp, Artificial Sequence
  Description of Artificial Sequence: Synthetic oligonucleotide
acctgccacgtggagcaccccag

SEQ ID NO: 399588 - DNA, 22 bp, Artificial Sequence
  Description of Artificial Sequence: Synthetic oligonucleotide
cctgccacgtggagcaccccag

SEQ ID NO: 399589 - DNA, 22 bp, Artificial Sequence
  Description of Artificial Sequence: Synthetic oligonucleotide
ctgccacgtggagcaccccagc

SEQ ID NO: 399590 - DNA, 23 bp, Artificial Sequence
  Description of Artificial Sequence: Synthetic oligonucleotide
tgccacgtggagcaccccagcct

SEQ ID NO: 399591 - DNA, 22 bp, Artificial Sequence
  Description of Artificial Sequence: Synthetic oligonucleotide
gccacgtggagcaccccagcct

SEQ ID NO: 399592 - DNA, 22 bp, Artificial Sequence
  Description of Artificial Sequence: Synthetic oligonucleotide
ccacgtggagcaccccagcctc

SEQ ID NO: 399593 - DNA, 23 bp, Artificial Sequence
  Description of Artificial Sequence: Synthetic oligonucleotide
cacgtggagcaccccagcctcca

SEQ ID NO: 399594 - DNA, 24 bp, Artificial Sequence
  Description of Artificial Sequence: Synthetic oligonucleotide
acgtggagcaccccagcctccaga

SEQ ID NO: 399595 - DNA, 23 bp, Artificial Sequence
  Description of Artificial Sequence: Synthetic oligonucleotide
cgtggagcaccccagcctccaga

SEQ ID NO: 399596 - DNA, 23 bp, Artificial Sequence
  Description of Artificial Sequence: Synthetic oligonucleotide
gtggagcaccccagcctccagag

SEQ ID NO: 399597 - DNA, 23 bp, Artificial Sequence
  Description of Artificial Sequence: Synthetic oligonucleotide
tggagcaccccagcctccagagc

SEQ ID NO: 399598 - DNA, 22 bp, Artificial Sequence
  Description of Artificial Sequence: Synthetic oligonucleotide
ggagcaccccagcctccagagc

SEQ ID NO: 399599 - DNA, 22 bp, Artificial Sequence
  Description of Artificial Sequence: Synthetic oligonucleotide
gagcaccccagcctccagagcc

SEQ ID NO: 399600 - DNA, 22 bp, Artificial Sequence
  Description of Artificial Sequence: Synthetic oligonucleotide
agcaccccagcctccagagccc

SEQ ID NO: 399601 - DNA, 21 bp, Artificial Sequence
  Description of Artificial Sequence: Synthetic oligonucleotide
gcaccccagcctccagagccc

SEQ ID NO: 399602 - DNA, 23 bp, Artificial Sequence
  Description of Artificial Sequence: Synthetic oligonucleotide
caccccagcctccagagccccat

SEQ ID NO: 399603 - DNA, 24 bp, Artificial Sequence
  Description of Artificial Sequence: Synthetic oligonucleotide
accccagcctccagagccccatca

SEQ ID NO: 399604 - DNA, 23 bp, Artificial Sequence
  Description of Artificial Sequence: Synthetic oligonucleotide
ccccagcctccagagccccatca

SEQ ID NO: 399605 - DNA, 23 bp, Artificial Sequence
  Description of Artificial Sequence: Synthetic oligonucleotide
cccagcctccagagccccatcac

SEQ ID NO: 399606 - DNA, 23 bp, Artificial Sequence
  Description of Artificial Sequence: Synthetic oligonucleotide
ccagcctccagagccccatcacc

SEQ ID NO: 399607 - DNA, 24 bp, Artificial Sequence
  Description of Artificial Sequence: Synthetic oligonucleotide
cagcctccagagccccatcaccgt

SEQ ID NO: 399608 - DNA, 24 bp, Artificial Sequence
  Description of Artificial Sequence: Synthetic oligonucleotide
agcctccagagccccatcaccgtg

SEQ ID NO: 399609 - DNA, 23 bp, Artificial Sequence
  Description of Artificial Sequence: Synthetic oligonucleotide
gcctccagagccccatcaccgtg

SEQ ID NO: 399610 - DNA, 24 bp, Artificial Sequence
  Description of Artificial Sequence: Synthetic oligonucleotide
cctccagagccccatcaccgtgga

SEQ ID NO: 399611 - DNA, 25 bp, Artificial Sequence
  Description of Artificial Sequence: Synthetic oligonucleotide
ctccagagccccatcaccgtggagt

SEQ ID NO: 399612 - DNA, 25 bp, Artificial Sequence
  Description of Artificial Sequence: Synthetic oligonucleotide
tccagagccccatcaccgtggagtg

SEQ ID NO: 399613 - DNA, 24 bp, Artificial Sequence
  Description of Artificial Sequence: Synthetic oligonucleotide
ccagagccccatcaccgtggagtg

SEQ ID NO: 399614 - DNA, 24 bp, Artificial Sequence
  Description of Artificial Sequence: Synthetic oligonucleotide
cagagccccatcaccgtggagtgg

SEQ ID NO: 399615 - DNA, 24 bp, Artificial Sequence
  Description of Artificial Sequence: Synthetic oligonucleotide
agagccccatcaccgtggagtggc

SEQ ID NO: 399616 - DNA, 23 bp, Artificial Sequence
  Description of Artificial Sequence: Synthetic oligonucleotide
gagccccatcaccgtggagtggc

SEQ ID NO: 399617 - DNA, 23 bp, Artificial Sequence
  Description of Artificial Sequence: Synthetic oligonucleotide
agccccatcaccgtggagtggcg

SEQ ID NO: 399618 - DNA, 22 bp, Artificial Sequence
  Description of Artificial Sequence: Synthetic oligonucleotide
gccccatcaccgtggagtggcg

SEQ ID NO: 399619 - DNA, 22 bp, Artificial Sequence
  Description of Artificial Sequence: Synthetic oligonucleotide
ccccatcaccgtggagtggcgg

SEQ ID NO: 399620 - DNA, 22 bp, Artificial Sequence
  Description of Artificial Sequence: Synthetic oligonucleotide
cccatcaccgtggagtggcggg

SEQ ID NO: 399621 - DNA, 23 bp, Artificial Sequence
  Description of Artificial Sequence: Synthetic oligonucleotide
ccatcaccgtggagtggcgggct

SEQ ID NO: 399622 - DNA, 26 bp, Artificial Sequence
  Description of Artificial Sequence: Synthetic oligonucleotide
catcaccgtggagtggcgggctcaat

SEQ ID NO: 399623 - DNA, 27 bp, Artificial Sequence
  Description of Artificial Sequence: Synthetic oligonucleotide
atcaccgtggagtggcgggctcaatct

SEQ ID NO: 399624 - DNA, 26 bp, Artificial Sequence
  Description of Artificial Sequence: Synthetic oligonucleotide
tcaccgtggagtggcgggctcaatct

SEQ ID NO: 399625 - DNA, 25 bp, Artificial Sequence
  Description of Artificial Sequence: Synthetic oligonucleotide
caccgtggagtggcgggctcaatct

SEQ ID NO: 399626 - DNA, 27 bp, Artificial Sequence
  Description of Artificial Sequence: Synthetic oligonucleotide
accgtggagtggcgggctcaatctgaa

SEQ ID NO: 399627 - DNA, 27 bp, Artificial Sequence
  Description of Artificial Sequence: Synthetic oligonucleotide
ccgtggagtggcgggctcaatctgaat

SEQ ID NO: 399628 - DNA, 27 bp, Artificial Sequence
  Description of Artificial Sequence: Synthetic oligonucleotide
cgtggagtggcgggctcaatctgaatc

SEQ ID NO: 399629 - DNA, 28 bp, Artificial Sequence
  Description of Artificial Sequence: Synthetic oligonucleotide
gtggagtggcgggctcaatctgaatctg

SEQ ID NO: 399630 - DNA, 28 bp, Artificial Sequence
  Description of Artificial Sequence: Synthetic oligonucleotide
tggagtggcgggctcaatctgaatctgc

SEQ ID NO: 399631 - DNA, 27 bp, Artificial Sequence
  Description of Artificial Sequence: Synthetic oligonucleotide
ggagtggcgggctcaatctgaatctgc

SEQ ID NO: 399632 - DNA, 27 bp, Artificial Sequence
  Description of Artificial Sequence: Synthetic oligonucleotide
gagtggcgggctcaatctgaatctgcc

SEQ ID NO: 399633 - DNA, 27 bp, Artificial Sequence
  Description of Artificial Sequence: Synthetic oligonucleotide
agtggcgggctcaatctgaatctgccc

SEQ ID NO: 399634 - DNA, 27 bp, Artificial Sequence
  Description of Artificial Sequence: Synthetic oligonucleotide
gtggcgggctcaatctgaatctgccca

SEQ ID NO: 399635 - DNA, 27 bp, Artificial Sequence
  Description of Artificial Sequence: Synthetic oligonucleotide
tggcgggctcaatctgaatctgcccag

SEQ ID NO: 399636 - DNA, 27 bp, Artificial Sequence
  Description of Artificial Sequence: Synthetic oligonucleotide
ggcgggctcaatctgaatctgcccaga

SEQ ID NO: 399637 - DNA, 27 bp, Artificial Sequence
  Description of Artificial Sequence: Synthetic oligonucleotide
gcgggctcaatctgaatctgcccagag

SEQ ID NO: 399638 - DNA, 27 bp, Artificial Sequence
  Description of Artificial Sequence: Synthetic oligonucleotide
cgggctcaatctgaatctgcccagagc

SEQ ID NO: 399639 - DNA, 29 bp, Artificial Sequence
  Description of Artificial Sequence: Synthetic oligonucleotide
gggctcaatctgaatctgcccagagcaag

SEQ ID NO: 399640 - DNA, 31 bp, Artificial Sequence; identical to SEQ ID NO: 58646
  Description of Artificial Sequence: Synthetic oligonucleotide

SEQ ID NO: 399641 - DNA, 31 bp, Artificial Sequence; identical to SEQ ID NO: 58647
  Description of Artificial Sequence: Synthetic oligonucleotide

SEQ ID NO: 399642 - DNA, 32 bp, Artificial Sequence; identical to SEQ ID NO: 58648
  Description of Artificial Sequence: Synthetic oligonucleotide

SEQ ID NO: 399643 - DNA, 33 bp, Artificial Sequence; identical to SEQ ID NO: 58649
  Description of Artificial Sequence: Synthetic oligonucleotide

SEQ ID NO: 399644 - DNA, 32 bp, Artificial Sequence; identical to SEQ ID NO: 58650
  Description of Artificial Sequence: Synthetic oligonucleotide

SEQ ID NO: 399645 - DNA, 33 bp, Artificial Sequence; identical to SEQ ID NO: 58651
  Description of Artificial Sequence: Synthetic oligonucleotide

SEQ ID NO: 399646 - DNA, 32 bp, Artificial Sequence; identical to SEQ ID NO: 58652
  Description of Artificial Sequence: Synthetic oligonucleotide

SEQ ID NO: 399647 - DNA, 31 bp, Artificial Sequence; identical to SEQ ID NO: 58653
  Description of Artificial Sequence: Synthetic oligonucleotide

SEQ ID NO: 399648 - DNA, 30 bp, Artificial Sequence; identical to SEQ ID NO: 58654
  Description of Artificial Sequence: Synthetic oligonucleotide

SEQ ID NO: 399649 - DNA, 30 bp, Artificial Sequence; identical to SEQ ID NO: 58655
  Description of Artificial Sequence: Synthetic oligonucleotide

SEQ ID NO: 399650 - DNA, 29 bp, Artificial Sequence
  Description of Artificial Sequence: Synthetic oligonucleotide
gaatctgcccagagcaagatgctgagtgg

SEQ ID NO: 399651 - DNA, 29 bp, Artificial Sequence
  Description of Artificial Sequence: Synthetic oligonucleotide
aatctgcccagagcaagatgctgagtggc

SEQ ID NO: 399652 - DNA, 28 bp, Artificial Sequence
  Description of Artificial Sequence: Synthetic oligonucleotide
atctgcccagagcaagatgctgagtggc

SEQ ID NO: 399653 - DNA, 27 bp, Artificial Sequence
  Description of Artificial Sequence: Synthetic oligonucleotide
tctgcccagagcaagatgctgagtggc

SEQ ID NO: 399654 - DNA, 27 bp, Artificial Sequence
  Description of Artificial Sequence: Synthetic oligonucleotide
ctgcccagagcaagatgctgagtggca

SEQ ID NO: 399655 - DNA, 29 bp, Artificial Sequence
  Description of Artificial Sequence: Synthetic oligonucleotide
tgcccagagcaagatgctgagtggcattg

SEQ ID NO: 399656 - DNA, 28 bp, Artificial Sequence
  Description of Artificial Sequence: Synthetic oligonucleotide
gcccagagcaagatgctgagtggcattg

SEQ ID NO: 399657 - DNA, 28 bp, Artificial Sequence
  Description of Artificial Sequence: Synthetic oligonucleotide
cccagagcaagatgctgagtggcattgg

SEQ ID NO: 399658 - DNA, 29 bp, Artificial Sequence
  Description of Artificial Sequence: Synthetic oligonucleotide
ccagagcaagatgctgagtggcattggag

SEQ ID NO: 399659 - DNA, 29 bp, Artificial Sequence
  Description of Artificial Sequence: Synthetic oligonucleotide
cagagcaagatgctgagtggcattggagg

SEQ ID NO: 399660 - DNA, 29 bp, Artificial Sequence
  Description of Artificial Sequence: Synthetic oligonucleotide
agagcaagatgctgagtggcattggaggc

SEQ ID NO: 399661 - DNA, 28 bp, Artificial Sequence
  Description of Artificial Sequence: Synthetic oligonucleotide
gagcaagatgctgagtggcattggaggc

SEQ ID NO: 399662 - DNA, 30 bp, Artificial Sequence; identical to SEQ ID NO: 58668
  Description of Artificial Sequence: Synthetic oligonucleotide

SEQ ID NO: 399663 - DNA, 29 bp, Artificial Sequence
  Description of Artificial Sequence: Synthetic oligonucleotide
gcaagatgctgagtggcattggaggcttc

SEQ ID NO: 399664 - DNA, 29 bp, Artificial Sequence
  Description of Artificial Sequence: Synthetic oligonucleotide
caagatgctgagtggcattggaggcttcg

SEQ ID NO: 399665 - DNA, 30 bp, Artificial Sequence; identical to SEQ ID NO: 58671
  Description of Artificial Sequence: Synthetic oligonucleotide

SEQ ID NO: 399666 - DNA, 29 bp, Artificial Sequence
  Description of Artificial Sequence: Synthetic oligonucleotide
agatgctgagtggcattggaggcttcgtg

SEQ ID NO: 399667 - DNA, 28 bp, Artificial Sequence
  Description of Artificial Sequence: Synthetic oligonucleotide
gatgctgagtggcattggaggcttcgtg

SEQ ID NO: 399668 - DNA, 28 bp, Artificial Sequence
  Description of Artificial Sequence: Synthetic oligonucleotide
atgctgagtggcattggaggcttcgtgc

SEQ ID NO: 399669 - DNA, 27 bp, Artificial Sequence
  Description of Artificial Sequence: Synthetic oligonucleotide
tgctgagtggcattggaggcttcgtgc

SEQ ID NO: 399670 - DNA, 27 bp, Artificial Sequence
  Description of Artificial Sequence: Synthetic oligonucleotide
gctgagtggcattggaggcttcgtgct

SEQ ID NO: 399671 - DNA, 27 bp, Artificial Sequence
  Description of Artificial Sequence: Synthetic oligonucleotide
ctgagtggcattggaggcttcgtgctg

SEQ ID NO: 399672 - DNA, 27 bp, Artificial Sequence
  Description of Artificial Sequence: Synthetic oligonucleotide
tgagtggcattggaggcttcgtgctgg

SEQ ID NO: 399673 - DNA, 26 bp, Artificial Sequence
  Description of Artificial Sequence: Synthetic oligonucleotide
gagtggcattggaggcttcgtgctgg

SEQ ID NO: 399674 - DNA, 26 bp, Artificial Sequence
  Description of Artificial Sequence: Synthetic oligonucleotide
agtggcattggaggcttcgtgctggg

SEQ ID NO: 399675 - DNA, 25 bp, Artificial Sequence
  Description of Artificial Sequence: Synthetic oligonucleotide
gtggcattggaggcttcgtgctggg

SEQ ID NO: 399676 - DNA, 25 bp, Artificial Sequence
  Description of Artificial Sequence: Synthetic oligonucleotide
tggcattggaggcttcgtgctgggg

SEQ ID NO: 399677 - DNA, 24 bp, Artificial Sequence
  Description of Artificial Sequence: Synthetic oligonucleotide
ggcattggaggcttcgtgctgggg

SEQ ID NO: 399678 - DNA, 25 bp, Artificial Sequence
  Description of Artificial Sequence: Synthetic oligonucleotide
gcattggaggcttcgtgctggggct

SEQ ID NO: 399679 - DNA, 27 bp, Artificial Sequence
  Description of Artificial Sequence: Synthetic oligonucleotide
cattggaggcttcgtgctggggctgat

SEQ ID NO: 399680 - DNA, 27 bp, Artificial Sequence
  Description of Artificial Sequence: Synthetic oligonucleotide
attggaggcttcgtgctggggctgatc

SEQ ID NO: 399681 - DNA, 27 bp, Artificial Sequence
  Description of Artificial Sequence: Synthetic oligonucleotide
ttggaggcttcgtgctggggctgatct

SEQ ID NO: 399682 - DNA, 27 bp, Artificial Sequence
  Description of Artificial Sequence: Synthetic oligonucleotide
tggaggcttcgtgctggggctgatctt

SEQ ID NO: 399683 - DNA, 26 bp, Artificial Sequence
  Description of Artificial Sequence: Synthetic oligonucleotide
ggaggcttcgtgctggggctgatctt

SEQ ID NO: 399684 - DNA, 26 bp, Artificial Sequence
  Description of Artificial Sequence: Synthetic oligonucleotide
gaggcttcgtgctggggctgatcttc

SEQ ID NO: 399685 - DNA, 27 bp, Artificial Sequence
  Description of Artificial Sequence: Synthetic oligonucleotide
aggcttcgtgctggggctgatcttcct

SEQ ID NO: 399686 - DNA, 26 bp, Artificial Sequence
  Description of Artificial Sequence: Synthetic oligonucleotide
ggcttcgtgctggggctgatcttcct

SEQ ID NO: 399687 - DNA, 26 bp, Artificial Sequence
  Description of Artificial Sequence: Synthetic oligonucleotide
gcttcgtgctggggctgatcttcctc

SEQ ID NO: 399688 - DNA, 26 bp, Artificial Sequence
  Description of Artificial Sequence: Synthetic oligonucleotide
cttcgtgctggggctgatcttcctcg

SEQ ID NO: 399689 - DNA, 26 bp, Artificial Sequence
  Description of Artificial Sequence: Synthetic oligonucleotide
ttcgtgctggggctgatcttcctcgg

SEQ ID NO: 399690 - DNA, 25 bp, Artificial Sequence
  Description of Artificial Sequence: Synthetic oligonucleotide
tcgtgctggggctgatcttcctcgg

SEQ ID NO: 399691 - DNA, 24 bp, Artificial Sequence
  Description of Artificial Sequence: Synthetic oligonucleotide
cgtgctggggctgatcttcctcgg

SEQ ID NO: 399692 - DNA, 24 bp, Artificial Sequence
  Description of Artificial Sequence: Synthetic oligonucleotide
gtgctggggctgatcttcctcggg

SEQ ID NO: 399693 - DNA, 25 bp, Artificial Sequence
  Description of Artificial Sequence: Synthetic oligonucleotide
tgctggggctgatcttcctcgggct

SEQ ID NO: 399694 - DNA, 24 bp, Artificial Sequence
  Description of Artificial Sequence: Synthetic oligonucleotide
gctggggctgatcttcctcgggct

SEQ ID NO: 399695 - DNA, 24 bp, Artificial Sequence
  Description of Artificial Sequence: Synthetic oligonucleotide
ctggggctgatcttcctcgggctg

SEQ ID NO: 399696 - DNA, 24 bp, Artificial Sequence
  Description of Artificial Sequence: Synthetic oligonucleotide
tggggctgatcttcctcgggctgg

SEQ ID NO: 399697 - DNA, 23 bp, Artificial Sequence
  Description of Artificial Sequence: Synthetic oligonucleotide
ggggctgatcttcctcgggctgg

SEQ ID NO: 399698 - DNA, 23 bp, Artificial Sequence
  Description of Artificial Sequence: Synthetic oligonucleotide
gggctgatcttcctcgggctggg

SEQ ID NO: 399699 - DNA, 23 bp, Artificial Sequence
  Description of Artificial Sequence: Synthetic oligonucleotide
ggctgatcttcctcgggctgggc

SEQ ID NO: 399700 - DNA, 27 bp, Artificial Sequence
  Description of Artificial Sequence: Synthetic oligonucleotide
gctgatcttcctcgggctgggccttat

SEQ ID NO: 399701 - DNA, 27 bp, Artificial Sequence
  Description of Artificial Sequence: Synthetic oligonucleotide
ctgatcttcctcgggctgggccttatc

SEQ ID NO: 399702 - DNA, 29 bp, Artificial Sequence
  Description of Artificial Sequence: Synthetic oligonucleotide
tgatcttcctcgggctgggccttatcatc

SEQ ID NO: 399703 - DNA, 28 bp, Artificial Sequence
  Description of Artificial Sequence: Synthetic oligonucleotide
gatcttcctcgggctgggccttatcatc

SEQ ID NO: 399704 - DNA, 28 bp, Artificial Sequence
  Description of Artificial Sequence: Synthetic oligonucleotide
atcttcctcgggctgggccttatcatcc

SEQ ID NO: 399705 - DNA, 27 bp, Artificial Sequence
  Description of Artificial Sequence: Synthetic oligonucleotide
tcttcctcgggctgggccttatcatcc

SEQ ID NO: 399706 - DNA, 27 bp, Artificial Sequence
  Description of Artificial Sequence: Synthetic oligonucleotide
cttcctcgggctgggccttatcatcca

SEQ ID NO: 399707 - DNA, 28 bp, Artificial Sequence
  Description of Artificial Sequence: Synthetic oligonucleotide
ttcctcgggctgggccttatcatccatc

SEQ ID NO: 399708 - DNA, 27 bp, Artificial Sequence
  Description of Artificial Sequence: Synthetic oligonucleotide
tcctcgggctgggccttatcatccatc

SEQ ID NO: 399709 - DNA, 27 bp, Artificial Sequence
  Description of Artificial Sequence: Synthetic oligonucleotide
cctcgggctgggccttatcatccatca

SEQ ID NO: 399710 - DNA, 27 bp, Artificial Sequence
  Description of Artificial Sequence: Synthetic oligonucleotide
ctcgggctgggccttatcatccatcac

SEQ ID NO: 399711 - DNA, 28 bp, Artificial Sequence
  Description of Artificial Sequence: Synthetic oligonucleotide
tcgggctgggccttatcatccatcacag

SEQ ID NO: 399712 - DNA, 27 bp, Artificial Sequence
  Description of Artificial Sequence: Synthetic oligonucleotide
cgggctgggccttatcatccatcacag

SEQ ID NO: 399713 - DNA, 27 bp, Artificial Sequence
  Description of Artificial Sequence: Synthetic oligonucleotide
gggctgggccttatcatccatcacagg

SEQ ID NO: 399714 - DNA, 28 bp, Artificial Sequence
  Description of Artificial Sequence: Synthetic oligonucleotide
ggctgggccttatcatccatcacaggag

SEQ ID NO: 399715 - DNA, 29 bp, Artificial Sequence
  Description of Artificial Sequence: Synthetic oligonucleotide
gctgggccttatcatccatcacaggagtc

SEQ ID NO: 399716 - DNA, 30 bp, Artificial Sequence; identical to SEQ ID NO: 58722
  Description of Artificial Sequence: Synthetic oligonucleotide

SEQ ID NO: 399717 - DNA, 33 bp, Artificial Sequence; identical to SEQ ID NO: 58723
  Description of Artificial Sequence: Synthetic oligonucleotide

SEQ ID NO: 399718 - DNA, 32 bp, Artificial Sequence; identical to SEQ ID NO: 58724
  Description of Artificial Sequence: Synthetic oligonucleotide

SEQ ID NO: 399719 - DNA, 32 bp, Artificial Sequence; identical to SEQ ID NO: 58725
  Description of Artificial Sequence: Synthetic oligonucleotide

SEQ ID NO: 399720 - DNA, 32 bp, Artificial Sequence; identical to SEQ ID NO: 58726
  Description of Artificial Sequence: Synthetic oligonucleotide

SEQ ID NO: 399721 - DNA, 32 bp, Artificial Sequence; identical to SEQ ID NO: 58727
  Description of Artificial Sequence: Synthetic oligonucleotide

SEQ ID NO: 399722 - DNA, 33 bp, Artificial Sequence; identical to SEQ ID NO: 58728
  Description of Artificial Sequence: Synthetic oligonucleotide

SEQ ID NO: 399723 - DNA, 33 bp, Artificial Sequence; identical to SEQ ID NO: 58729
  Description of Artificial Sequence: Synthetic oligonucleotide

SEQ ID NO: 399724 - DNA, 32 bp, Artificial Sequence; identical to SEQ ID NO: 58730
  Description of Artificial Sequence: Synthetic oligonucleotide

SEQ ID NO: 399725 - DNA, 31 bp, Artificial Sequence; identical to SEQ ID NO: 58731
  Description of Artificial Sequence: Synthetic oligonucleotide

SEQ ID NO: 399726 - DNA, 30 bp, Artificial Sequence; identical to SEQ ID NO: 58732
  Description of Artificial Sequence: Synthetic oligonucleotide

SEQ ID NO: 399727 - DNA, 29 bp, Artificial Sequence
  Description of Artificial Sequence: Synthetic oligonucleotide
catccatcacaggagtcagaaagggctcc

SEQ ID NO: 399728 - DNA, 30 bp, Artificial Sequence; identical to SEQ ID NO: 58734
  Description of Artificial Sequence: Synthetic oligonucleotide

SEQ ID NO: 399729 - DNA, 29 bp, Artificial Sequence
  Description of Artificial Sequence: Synthetic oligonucleotide
tccatcacaggagtcagaaagggctcctg

SEQ ID NO: 399730 - DNA, 28 bp, Artificial Sequence
  Description of Artificial Sequence: Synthetic oligonucleotide
ccatcacaggagtcagaaagggctcctg

SEQ ID NO: 399731 - DNA, 28 bp, Artificial Sequence
  Description of Artificial Sequence: Synthetic oligonucleotide
catcacaggagtcagaaagggctcctgc

SEQ ID NO: 399732 - DNA, 29 bp, Artificial Sequence
  Description of Artificial Sequence: Synthetic oligonucleotide
atcacaggagtcagaaagggctcctgcac

SEQ ID NO: 399733 - DNA, 28 bp, Artificial Sequence
  Description of Artificial Sequence: Synthetic oligonucleotide
tcacaggagtcagaaagggctcctgcac

SEQ ID NO: 399734 - DNA, 27 bp, Artificial Sequence
  Description of Artificial Sequence: Synthetic oligonucleotide
cacaggagtcagaaagggctcctgcac

SEQ ID NO: 399735 - DNA, 28 bp, Artificial Sequence
  Description of Artificial Sequence: Synthetic oligonucleotide
acaggagtcagaaagggctcctgcactg

SEQ ID NO: 399736 - DNA, 27 bp, Artificial Sequence
  Description of Artificial Sequence: Synthetic oligonucleotide
caggagtcagaaagggctcctgcactg

SEQ ID NO: 399737 - DNA, 24 bp, Artificial Sequence
  Description of Artificial Sequence: Synthetic oligonucleotide
tggggctgcctgccgccgagtatt

SEQ ID NO: 399738 - DNA, 23 bp, Artificial Sequence
  Description of Artificial Sequence: Synthetic oligonucleotide
ggggctgcctgccgccgagtatt

SEQ ID NO: 399739 - DNA, 23 bp, Artificial Sequence
  Description of Artificial Sequence: Synthetic oligonucleotide
gggctgcctgccgccgagtattg

SEQ ID NO: 399740 - DNA, 25 bp, Artificial Sequence
  Description of Artificial Sequence: Synthetic oligonucleotide
ggctgcctgccgccgagtattggaa

SEQ ID NO: 399741 - DNA, 26 bp, Artificial Sequence
  Description of Artificial Sequence: Synthetic oligonucleotide
gctgcctgccgccgagtattggaaca

SEQ ID NO: 399742 - DNA, 26 bp, Artificial Sequence
  Description of Artificial Sequence: Synthetic oligonucleotide
ctgcctgccgccgagtattggaacag

SEQ ID NO: 399743 - DNA, 26 bp, Artificial Sequence
  Description of Artificial Sequence: Synthetic oligonucleotide
tgcctgccgccgagtattggaacagc

SEQ ID NO: 399744 - DNA, 25 bp, Artificial Sequence
  Description of Artificial Sequence: Synthetic oligonucleotide
gcctgccgccgagtattggaacagc

SEQ ID NO: 399745 - DNA, 26 bp, Artificial Sequence
  Description of Artificial Sequence: Synthetic oligonucleotide
cctgccgccgagtattggaacagcca

SEQ ID NO: 399746 - DNA, 27 bp, Artificial Sequence
  Description of Artificial Sequence: Synthetic oligonucleotide
ctgccgccgagtattggaacagccaga

SEQ ID NO: 399747 - DNA, 28 bp, Artificial Sequence
  Description of Artificial Sequence: Synthetic oligonucleotide
tgccgccgagtattggaacagccagaag

SEQ ID NO: 399748 - DNA, 27 bp, Artificial Sequence
  Description of Artificial Sequence: Synthetic oligonucleotide
gccgccgagtattggaacagccagaag

SEQ ID NO: 399749 - DNA, 27 bp, Artificial Sequence
  Description of Artificial Sequence: Synthetic oligonucleotide
ccgccgagtattggaacagccagaagg

SEQ ID NO: 399750 - DNA, 28 bp, Artificial Sequence
  Description of Artificial Sequence: Synthetic oligonucleotide
cgccgagtattggaacagccagaaggac

SEQ ID NO: 399751 - DNA, 30 bp, Artificial Sequence; identical to SEQ ID NO: 58757
  Description of Artificial Sequence: Synthetic oligonucleotide

SEQ ID NO: 399752 - DNA, 30 bp, Artificial Sequence; identical to SEQ ID NO: 58758
  Description of Artificial Sequence: Synthetic oligonucleotide

SEQ ID NO: 399753 - DNA, 31 bp, Artificial Sequence; identical to SEQ ID NO: 58759
  Description of Artificial Sequence: Synthetic oligonucleotide

SEQ ID NO: 399754 - DNA, 31 bp, Artificial Sequence; identical to SEQ ID NO: 58760
  Description of Artificial Sequence: Synthetic oligonucleotide

SEQ ID NO: 399755 - DNA, 32 bp, Artificial Sequence; identical to SEQ ID NO: 58761
  Description of Artificial Sequence: Synthetic oligonucleotide

SEQ ID NO: 399756 - DNA, 31 bp, Artificial Sequence; identical to SEQ ID NO: 58762
  Description of Artificial Sequence: Synthetic oligonucleotide

SEQ ID NO: 399757 - DNA, 32 bp, Artificial Sequence; identical to SEQ ID NO: 58763
  Description of Artificial Sequence: Synthetic oligonucleotide

SEQ ID NO: 399758 - DNA, 31 bp, Artificial Sequence; identical to SEQ ID NO: 58764
  Description of Artificial Sequence: Synthetic oligonucleotide

SEQ ID NO: 399759 - DNA, 30 bp, Artificial Sequence; identical to SEQ ID NO: 58765
  Description of Artificial Sequence: Synthetic oligonucleotide

SEQ ID NO: 399760 - DNA, 22 bp, Artificial Sequence
  Description of Artificial Sequence: Synthetic oligonucleotide
cgcacgaccttgcagcggcgag

SEQ ID NO: 399761 - DNA, 22 bp, Artificial Sequence
  Description of Artificial Sequence: Synthetic oligonucleotide
cgacgtgggggagttccgggca

SEQ ID NO: 399762 - DNA, 23 bp, Artificial Sequence
  Description of Artificial Sequence: Synthetic oligonucleotide
gacgtgggggagttccgggcagt

SEQ ID NO: 399763 - DNA, 24 bp, Artificial Sequence
  Description of Artificial Sequence: Synthetic oligonucleotide
acgtgggggagttccgggcagtga

SEQ ID NO: 399764 - DNA, 23 bp, Artificial Sequence
  Description of Artificial Sequence: Synthetic oligonucleotide
cgtgggggagttccgggcagtga

SEQ ID NO: 399765 - DNA, 23 bp, Artificial Sequence
  Description of Artificial Sequence: Synthetic oligonucleotide
gtgggggagttccgggcagtgac

SEQ ID NO: 399766 - DNA, 23 bp, Artificial Sequence
  Description of Artificial Sequence: Synthetic oligonucleotide
tgggggagttccgggcagtgacg

SEQ ID NO: 399767 - DNA, 22 bp, Artificial Sequence
  Description of Artificial Sequence: Synthetic oligonucleotide
gggggagttccgggcagtgacg

SEQ ID NO: 399768 - DNA, 23 bp, Artificial Sequence
  Description of Artificial Sequence: Synthetic oligonucleotide
ggggagttccgggcagtgacgct

SEQ ID NO: 399769 - DNA, 23 bp, Artificial Sequence
  Description of Artificial Sequence: Synthetic oligonucleotide
gggagttccgggcagtgacgctg

SEQ ID NO: 399770 - DNA, 24 bp, Artificial Sequence
  Description of Artificial Sequence: Synthetic oligonucleotide
ggagttccgggcagtgacgctgct

SEQ ID NO: 399771 - DNA, 24 bp, Artificial Sequence
  Description of Artificial Sequence: Synthetic oligonucleotide
gagttccgggcagtgacgctgctg

SEQ ID NO: 399772 - DNA, 24 bp, Artificial Sequence
  Description of Artificial Sequence: Synthetic oligonucleotide
agttccgggcagtgacgctgctgg

SEQ ID NO: 399773 - DNA, 23 bp, Artificial Sequence
  Description of Artificial Sequence: Synthetic oligonucleotide
gttccgggcagtgacgctgctgg

SEQ ID NO: 399774 - DNA, 23 bp, Artificial Sequence
  Description of Artificial Sequence: Synthetic oligonucleotide
ttccgggcagtgacgctgctggg

SEQ ID NO: 399775 - DNA, 22 bp, Artificial Sequence
  Description of Artificial Sequence: Synthetic oligonucleotide
tccgggcagtgacgctgctggg

SEQ ID NO: 399776 - DNA, 21 bp, Artificial Sequence
  Description of Artificial Sequence: Synthetic oligonucleotide
ccgggcagtgacgctgctggg

SEQ ID NO: 399777 - DNA, 21 bp, Artificial Sequence
  Description of Artificial Sequence: Synthetic oligonucleotide
cgggcagtgacgctgctgggg

SEQ ID NO: 399778 - DNA, 22 bp, Artificial Sequence
  Description of Artificial Sequence: Synthetic oligonucleotide
gggcagtgacgctgctggggct

SEQ ID NO: 399779 - DNA, 22 bp, Artificial Sequence
  Description of Artificial Sequence: Synthetic oligonucleotide
ggcagtgacgctgctggggctg

SEQ ID NO: 399780 - DNA, 22 bp, Artificial Sequence
  Description of Artificial Sequence: Synthetic oligonucleotide
gcagtgacgctgctggggctgc

SEQ ID NO: 399781 - DNA, 23 bp, Artificial Sequence
  Description of Artificial Sequence: Synthetic oligonucleotide
cagtgacgctgctggggctgcct

SEQ ID NO: 399782 - DNA, 23 bp, Artificial Sequence
  Description of Artificial Sequence: Synthetic oligonucleotide
agtgacgctgctggggctgcctg

SEQ ID NO: 399783 - DNA, 32 bp, Artificial Sequence
  Description of Artificial Sequence: Synthetic oligonucleotide
tactggaacagccagaaggacatcctggaaag

SEQ ID NO: 399784 - DNA, 31 bp, Artificial Sequence
  Description of Artificial Sequence: Synthetic oligonucleotide
actggaacagccagaaggacatcctggaaag

SEQ ID NO: 399785 - DNA, 30 bp, Artificial Sequence
  Description of Artificial Sequence: Synthetic oligonucleotide
ctggaacagccagaaggacatcctggaaag

SEQ ID NO: 399786 - DNA, 30 bp, Artificial Sequence
  Description of Artificial Sequence: Synthetic oligonucleotide
tggaacagccagaaggacatcctggaaagg

SEQ ID NO: 399787 - DNA, 29 bp, Artificial Sequence
  Description of Artificial Sequence: Synthetic oligonucleotide
ggaacagccagaaggacatcctggaaagg

SEQ ID NO: 399788 - DNA, 32 bp, Artificial Sequence
  Description of Artificial Sequence: Synthetic oligonucleotide
gaacagccagaaggacatcctggaaaggaaac

SEQ ID NO: 399789 - DNA, 32 bp, Artificial Sequence
  Description of Artificial Sequence: Synthetic oligonucleotide
aacagccagaaggacatcctggaaaggaaacg

SEQ ID NO: 399790 - DNA, 31 bp, Artificial Sequence
  Description of Artificial Sequence: Synthetic oligonucleotide
acagccagaaggacatcctggaaaggaaacg

SEQ ID NO: 399791 - DNA, 30 bp, Artificial Sequence
  Description of Artificial Sequence: Synthetic oligonucleotide
cagccagaaggacatcctggaaaggaaacg

SEQ ID NO: 399792 - DNA, 30 bp, Artificial Sequence
  Description of Artificial Sequence: Synthetic oligonucleotide
agccagaaggacatcctggaaaggaaacgg

SEQ ID NO: 399793 - DNA, 29 bp, Artificial Sequence
  Description of Artificial Sequence: Synthetic oligonucleotide
gccagaaggacatcctggaaaggaaacgg

SEQ ID NO: 399794 - DNA, 29 bp, Artificial Sequence
  Description of Artificial Sequence: Synthetic oligonucleotide
ccagaaggacatcctggaaaggaaacggg

SEQ ID NO: 399795 - DNA, 29 bp, Artificial Sequence
  Description of Artificial Sequence: Synthetic oligonucleotide
cagaaggacatcctggaaaggaaacgggc

SEQ ID NO: 399796 - DNA, 29 bp, Artificial Sequence
  Description of Artificial Sequence: Synthetic oligonucleotide
agaaggacatcctggaaaggaaacgggcg

SEQ ID NO: 399797 - DNA, 28 bp, Artificial Sequence
  Description of Artificial Sequence: Synthetic oligonucleotide
gaaggacatcctggaaaggaaacgggcg

SEQ ID NO: 399798 - DNA, 28 bp, Artificial Sequence
  Description of Artificial Sequence: Synthetic oligonucleotide
aaggacatcctggaaaggaaacgggcgg

SEQ ID NO: 399799 - DNA, 27 bp, Artificial Sequence
  Description of Artificial Sequence: Synthetic oligonucleotide
aggacatcctggaaaggaaacgggcgg

SEQ ID NO: 399800 - DNA, 26 bp, Artificial Sequence
  Description of Artificial Sequence: Synthetic oligonucleotide
ggacatcctggaaaggaaacgggcgg

SEQ ID NO: 399801 - DNA, 26 bp, Artificial Sequence
  Description of Artificial Sequence: Synthetic oligonucleotide
gacatcctggaaaggaaacgggcggc

SEQ ID NO: 399802 - DNA, 26 bp, Artificial Sequence
  Description of Artificial Sequence: Synthetic oligonucleotide
acatcctggaaaggaaacgggcggcg

SEQ ID NO: 399803 - DNA, 25 bp, Artificial Sequence
  Description of Artificial Sequence: Synthetic oligonucleotide
catcctggaaaggaaacgggcggcg

SEQ ID NO: 399804 - DNA, 26 bp, Artificial Sequence
  Description of Artificial Sequence: Synthetic oligonucleotide
atcctggaaaggaaacgggcggcggt

SEQ ID NO: 399805 - DNA, 25 bp, Artificial Sequence
  Description of Artificial Sequence: Synthetic oligonucleotide
tcctggaaaggaaacgggcggcggt

SEQ ID NO: 399806 - DNA, 24 bp, Artificial Sequence
  Description of Artificial Sequence: Synthetic oligonucleotide
cctggaaaggaaacgggcggcggt

SEQ ID NO: 399807 - DNA, 24 bp, Artificial Sequence
  Description of Artificial Sequence: Synthetic oligonucleotide
ctggaaaggaaacgggcggcggtg

SEQ ID NO: 399808 - DNA, 25 bp, Artificial Sequence
  Description of Artificial Sequence: Synthetic oligonucleotide
tggaaaggaaacgggcggcggtgga

SEQ ID NO: 399809 - DNA, 24 bp, Artificial Sequence
  Description of Artificial Sequence: Synthetic oligonucleotide
ggaaaggaaacgggcggcggtgga

SEQ ID NO: 399810 - DNA, 25 bp, Artificial Sequence
  Description of Artificial Sequence: Synthetic oligonucleotide
gaaaggaaacgggcggcggtggaca

SEQ ID NO: 399811 - DNA, 25 bp, Artificial Sequence
  Description of Artificial Sequence: Synthetic oligonucleotide
aaaggaaacgggcggcggtggacag

SEQ ID NO: 399812 - DNA, 24 bp, Artificial Sequence
  Description of Artificial Sequence: Synthetic oligonucleotide
aaggaaacgggcggcggtggacag

SEQ ID NO: 399813 - DNA, 30 bp, Artificial Sequence
  Description of Artificial Sequence: Synthetic oligonucleotide
tgccaggcactggattcagaaccttcacac

SEQ ID NO: 399814 - DNA, 29 bp, Artificial Sequence
  Description of Artificial Sequence: Synthetic oligonucleotide
gccaggcactggattcagaaccttcacac

SEQ ID NO: 399815 - DNA, 38 bp, Artificial Sequence
  Description of Artificial Sequence: Synthetic oligonucleotide
ccaggcactggattcagaaccttcacacaaaaaaaatc

SEQ ID NO: 399816 - DNA, 39 bp, Artificial Sequence
  Description of Artificial Sequence: Synthetic oligonucleotide
caggcactggattcagaaccttcacacaaaaaaaatctg

SEQ ID NO: 399817 - DNA, 39 bp, Artificial Sequence
  Description of Artificial Sequence: Synthetic oligonucleotide
aggcactggattcagaaccttcacacaaaaaaaatctgc

SEQ ID NO: 399818 - DNA, 38 bp, Artificial Sequence
  Description of Artificial Sequence: Synthetic oligonucleotide
ggcactggattcagaaccttcacacaaaaaaaatctgc

SEQ ID NO: 399819 - DNA, 38 bp, Artificial Sequence
  Description of Artificial Sequence: Synthetic oligonucleotide
gcactggattcagaaccttcacacaaaaaaaatctgcc

SEQ ID NO: 399820 - DNA, 38 bp, Artificial Sequence
  Description of Artificial Sequence: Synthetic oligonucleotide
cactggattcagaaccttcacacaaaaaaaatctgccc

SEQ ID NO: 399821 - DNA, 39 bp, Artificial Sequence
  Description of Artificial Sequence: Synthetic oligonucleotide
actggattcagaaccttcacacaaaaaaaatctgcccag

SEQ ID NO: 399822 - DNA, 38 bp, Artificial Sequence
  Description of Artificial Sequence: Synthetic oligonucleotide
ctggattcagaaccttcacacaaaaaaaatctgcccag

SEQ ID NO: 399823 - DNA, 39 bp, Artificial Sequence
  Description of Artificial Sequence: Synthetic oligonucleotide
tggattcagaaccttcacacaaaaaaaatctgcccagag

SEQ ID NO: 399824 - DNA, 38 bp, Artificial Sequence
  Description of Artificial Sequence: Synthetic oligonucleotide
ggattcagaaccttcacacaaaaaaaatctgcccagag

SEQ ID NO: 399825 - DNA, 39 bp, Artificial Sequence
  Description of Artificial Sequence: Synthetic oligonucleotide
gattcagaaccttcacacaaaaaaaatctgcccagagac

SEQ ID NO: 399826 - DNA, 40 bp, Artificial Sequence
  Description of Artificial Sequence: Synthetic oligonucleotide
attcagaaccttcacacaaaaaaaatctgcccagagacag

SEQ ID NO: 399827 - DNA, 39 bp, Artificial Sequence
  Description of Artificial Sequence: Synthetic oligonucleotide
ttcagaaccttcacacaaaaaaaatctgcccagagacag

SEQ ID NO: 399828 - DNA, 38 bp, Artificial Sequence
  Description of Artificial Sequence: Synthetic oligonucleotide
tcagaaccttcacacaaaaaaaatctgcccagagacag

SEQ ID NO: 399829 - DNA, 37 bp, Artificial Sequence
  Description of Artificial Sequence: Synthetic oligonucleotide
cagaaccttcacacaaaaaaaatctgcccagagacag

SEQ ID NO: 399830 - DNA, 39 bp, Artificial Sequence
  Description of Artificial Sequence: Synthetic oligonucleotide
agaaccttcacacaaaaaaaatctgcccagagacagatg

SEQ ID NO: 399831 - DNA, 38 bp, Artificial Sequence
  Description of Artificial Sequence: Synthetic oligonucleotide
gaaccttcacacaaaaaaaatctgcccagagacagatg

SEQ ID NO: 399832 - DNA, 39 bp, Artificial Sequence
  Description of Artificial Sequence: Synthetic oligonucleotide
aaccttcacacaaaaaaaatctgcccagagacagatgag

SEQ ID NO: 399833 - DNA, 38 bp, Artificial Sequence
  Description of Artificial Sequence: Synthetic oligonucleotide
accttcacacaaaaaaaatctgcccagagacagatgag

SEQ ID NO: 399834 - DNA, 37 bp, Artificial Sequence
  Description of Artificial Sequence: Synthetic oligonucleotide
ccttcacacaaaaaaaatctgcccagagacagatgag

SEQ ID NO: 399835 - DNA, 37 bp, Artificial Sequence
  Description of Artificial Sequence: Synthetic oligonucleotide
cttcacacaaaaaaaatctgcccagagacagatgagg

SEQ ID NO: 399836 - DNA, 38 bp, Artificial Sequence
  Description of Artificial Sequence: Synthetic oligonucleotide
ttcacacaaaaaaaatctgcccagagacagatgaggtc

SEQ ID NO: 399837 - DNA, 37 bp, Artificial Sequence
  Description of Artificial Sequence: Synthetic oligonucleotide
tcacacaaaaaaaatctgcccagagacagatgaggtc

SEQ ID NO: 399838 - DNA, 36 bp, Artificial Sequence
  Description of Artificial Sequence: Synthetic oligonucleotide
cacacaaaaaaaatctgcccagagacagatgaggtc

SEQ ID NO: 399839 - DNA, 36 bp, Artificial Sequence
  Description of Artificial Sequence: Synthetic oligonucleotide
acacaaaaaaaatctgcccagagacagatgaggtcc

SEQ ID NO: 399840 - DNA, 35 bp, Artificial Sequence
  Description of Artificial Sequence: Synthetic oligonucleotide
cacaaaaaaaatctgcccagagacagatgaggtcc

SEQ ID NO: 399841 - DNA, 37 bp, Artificial Sequence
  Description of Artificial Sequence: Synthetic oligonucleotide
acaaaaaaaatctgcccagagacagatgaggtccttc

SEQ ID NO: 399842 - DNA, 36 bp, Artificial Sequence
  Description of Artificial Sequence: Synthetic oligonucleotide
caaaaaaaatctgcccagagacagatgaggtccttc

SEQ ID NO: 399843 - DNA, 30 bp, Artificial Sequence; identical to SEQ ID NO: 58767
  Description of Artificial Sequence: Synthetic oligonucleotide

SEQ ID NO: 399844 - DNA, 30 bp, Artificial Sequence; identical to SEQ ID NO: 58768
  Description of Artificial Sequence: Synthetic oligonucleotide

SEQ ID NO: 399845 - DNA, 30 bp, Artificial Sequence; identical to SEQ ID NO: 58769
  Description of Artificial Sequence: Synthetic oligonucleotide

SEQ ID NO: 399846 - DNA, 29 bp, Artificial Sequence
  Description of Artificial Sequence: Synthetic oligonucleotide
gatcaaagtccggtggtttcggaatggcc

SEQ ID NO: 399847 - DNA, 30 bp, Artificial Sequence; identical to SEQ ID NO: 58771
  Description of Artificial Sequence: Synthetic oligonucleotide

SEQ ID NO: 399848 - DNA, 29 bp, Artificial Sequence
  Description of Artificial Sequence: Synthetic oligonucleotide
tcaaagtccggtggtttcggaatggccag

SEQ ID NO: 399849 - DNA, 28 bp, Artificial Sequence
  Description of Artificial Sequence: Synthetic oligonucleotide
caaagtccggtggtttcggaatggccag

SEQ ID NO: 399850 - DNA, 28 bp, Artificial Sequence
  Description of Artificial Sequence: Synthetic oligonucleotide
aaagtccggtggtttcggaatggccagg

SEQ ID NO: 399851 - DNA, 27 bp, Artificial Sequence
  Description of Artificial Sequence: Synthetic oligonucleotide
aagtccggtggtttcggaatggccagg

SEQ ID NO: 399852 - DNA, 27 bp, Artificial Sequence
  Description of Artificial Sequence: Synthetic oligonucleotide
agtccggtggtttcggaatggccagga

SEQ ID NO: 399853 - DNA, 26 bp, Artificial Sequence
  Description of Artificial Sequence: Synthetic oligonucleotide
gtccggtggtttcggaatggccagga

SEQ ID NO: 399854 - DNA, 26 bp, Artificial Sequence
  Description of Artificial Sequence: Synthetic oligonucleotide
tccggtggtttcggaatggccaggag

SEQ ID NO: 399855 - DNA, 25 bp, Artificial Sequence
  Description of Artificial Sequence: Synthetic oligonucleotide
ccggtggtttcggaatggccaggag

SEQ ID NO: 399856 - DNA, 26 bp, Artificial Sequence
  Description of Artificial Sequence: Synthetic oligonucleotide
cggtggtttcggaatggccaggagga

SEQ ID NO: 399857 - DNA, 27 bp, Artificial Sequence
  Description of Artificial Sequence: Synthetic oligonucleotide
ggtggtttcggaatggccaggaggaga

SEQ ID NO: 399858 - DNA, 27 bp, Artificial Sequence
  Description of Artificial Sequence: Synthetic oligonucleotide
gtggtttcggaatggccaggaggagac

SEQ ID NO: 399859 - DNA, 28 bp, Artificial Sequence
  Description of Artificial Sequence: Synthetic oligonucleotide
tggtttcggaatggccaggaggagacag

SEQ ID NO: 399860 - DNA, 27 bp, Artificial Sequence
  Description of Artificial Sequence: Synthetic oligonucleotide
ggtttcggaatggccaggaggagacag

SEQ ID NO: 399861 - DNA, 27 bp, Artificial Sequence
  Description of Artificial Sequence: Synthetic oligonucleotide
gtttcggaatggccaggaggagacagc

SEQ ID NO: 399862 - DNA, 28 bp, Artificial Sequence
  Description of Artificial Sequence: Synthetic oligonucleotide
tttcggaatggccaggaggagacagctg

SEQ ID NO: 399863 - DNA, 27 bp, Artificial Sequence
  Description of Artificial Sequence: Synthetic oligonucleotide
ttcggaatggccaggaggagacagctg

SEQ ID NO: 399864 - DNA, 26 bp, Artificial Sequence
  Description of Artificial Sequence: Synthetic oligonucleotide
tcggaatggccaggaggagacagctg

SEQ ID NO: 399865 - DNA, 25 bp, Artificial Sequence
  Description of Artificial Sequence: Synthetic oligonucleotide
cggaatggccaggaggagacagctg

SEQ ID NO: 399866 - DNA, 25 bp, Artificial Sequence
  Description of Artificial Sequence: Synthetic oligonucleotide
ggaatggccaggaggagacagctgg

SEQ ID NO: 399867 - DNA, 25 bp, Artificial Sequence
  Description of Artificial Sequence: Synthetic oligonucleotide
gaatggccaggaggagacagctggc

SEQ ID NO: 399868 - DNA, 27 bp, Artificial Sequence
  Description of Artificial Sequence: Synthetic oligonucleotide
aatggccaggaggagacagctggcgtt

SEQ ID NO: 399869 - DNA, 26 bp, Artificial Sequence
  Description of Artificial Sequence: Synthetic oligonucleotide
atggccaggaggagacagctggcgtt

SEQ ID NO: 399870 - DNA, 25 bp, Artificial Sequence
  Description of Artificial Sequence: Synthetic oligonucleotide
tggccaggaggagacagctggcgtt

SEQ ID NO: 399871 - DNA, 24 bp, Artificial Sequence
  Description of Artificial Sequence: Synthetic oligonucleotide
ggccaggaggagacagctggcgtt

SEQ ID NO: 399872 - DNA, 25 bp, Artificial Sequence
  Description of Artificial Sequence: Synthetic oligonucleotide
gccaggaggagacagctggcgttgt

SEQ ID NO: 399873 - DNA, 23 bp, Artificial Sequence
  Description of Artificial Sequence: Synthetic oligonucleotide
gtgacgctgctggggctgcctga

SEQ ID NO: 399874 - DNA, 23 bp, Artificial Sequence
  Description of Artificial Sequence: Synthetic oligonucleotide
tgacgctgctggggctgcctgac

SEQ ID NO: 399875 - DNA, 22 bp, Artificial Sequence
  Description of Artificial Sequence: Synthetic oligonucleotide
gacgctgctggggctgcctgac

SEQ ID NO: 399876 - DNA, 22 bp, Artificial Sequence
  Description of Artificial Sequence: Synthetic oligonucleotide
acgctgctggggctgcctgacg

SEQ ID NO: 399877 - DNA, 21 bp, Artificial Sequence
  Description of Artificial Sequence: Synthetic oligonucleotide
cgctgctggggctgcctgacg

SEQ ID NO: 399878 - DNA, 21 bp, Artificial Sequence
  Description of Artificial Sequence: Synthetic oligonucleotide
gctgctggggctgcctgacgc

SEQ ID NO: 399879 - DNA, 21 bp, Artificial Sequence
  Description of Artificial Sequence: Synthetic oligonucleotide
ctgctggggctgcctgacgcc

SEQ ID NO: 399880 - DNA, 22 bp, Artificial Sequence
  Description of Artificial Sequence: Synthetic oligonucleotide
tgctggggctgcctgacgccga

SEQ ID NO: 399881 - DNA, 21 bp, Artificial Sequence
  Description of Artificial Sequence: Synthetic oligonucleotide
gctggggctgcctgacgccga

SEQ ID NO: 399882 - DNA, 23 bp, Artificial Sequence
  Description of Artificial Sequence: Synthetic oligonucleotide
ctggggctgcctgacgccgagta

SEQ ID NO: 399883 - DNA, 24 bp, Artificial Sequence
  Description of Artificial Sequence: Synthetic oligonucleotide
tggggctgcctgacgccgagtact

SEQ ID NO: 399884 - DNA, 23 bp, Artificial Sequence
  Description of Artificial Sequence: Synthetic oligonucleotide
ggggctgcctgacgccgagtact

SEQ ID NO: 399885 - DNA, 23 bp, Artificial Sequence
  Description of Artificial Sequence: Synthetic oligonucleotide
gggctgcctgacgccgagtactg

SEQ ID NO: 399886 - DNA, 25 bp, Artificial Sequence
  Description of Artificial Sequence: Synthetic oligonucleotide
ggctgcctgacgccgagtactggaa

SEQ ID NO: 399887 - DNA, 26 bp, Artificial Sequence
  Description of Artificial Sequence: Synthetic oligonucleotide
gctgcctgacgccgagtactggaaca

SEQ ID NO: 399888 - DNA, 26 bp, Artificial Sequence
  Description of Artificial Sequence: Synthetic oligonucleotide
ctgcctgacgccgagtactggaacag

SEQ ID NO: 399889 - DNA, 26 bp, Artificial Sequence
  Description of Artificial Sequence: Synthetic oligonucleotide
tgcctgacgccgagtactggaacagc

SEQ ID NO: 399890 - DNA, 25 bp, Artificial Sequence
  Description of Artificial Sequence: Synthetic oligonucleotide
gcctgacgccgagtactggaacagc

SEQ ID NO: 399891 - DNA, 26 bp, Artificial Sequence
  Description of Artificial Sequence: Synthetic oligonucleotide
cctgacgccgagtactggaacagcca

SEQ ID NO: 399892 - DNA, 27 bp, Artificial Sequence
  Description of Artificial Sequence: Synthetic oligonucleotide
ctgacgccgagtactggaacagccaga

SEQ ID NO: 399893 - DNA, 28 bp, Artificial Sequence
  Description of Artificial Sequence: Synthetic oligonucleotide
tgacgccgagtactggaacagccagaag

SEQ ID NO: 399894 - DNA, 27 bp, Artificial Sequence
  Description of Artificial Sequence: Synthetic oligonucleotide
gacgccgagtactggaacagccagaag

SEQ ID NO: 399895 - DNA, 27 bp, Artificial Sequence
  Description of Artificial Sequence: Synthetic oligonucleotide
acgccgagtactggaacagccagaagg

SEQ ID NO: 399896 - DNA, 31 bp, Artificial Sequence; identical to SEQ ID NO: 58820
  Description of Artificial Sequence: Synthetic oligonucleotide

SEQ ID NO: 399897 - DNA, 32 bp, Artificial Sequence; identical to SEQ ID NO: 58821
  Description of Artificial Sequence: Synthetic oligonucleotide

SEQ ID NO: 399898 - DNA, 31 bp, Artificial Sequence; identical to SEQ ID NO: 58822
  Description of Artificial Sequence: Synthetic oligonucleotide

SEQ ID NO: 399899 - DNA, 31 bp, Artificial Sequence; identical to SEQ ID NO: 58823
  Description of Artificial Sequence: Synthetic oligonucleotide

SEQ ID NO: 399900 - DNA, 30 bp, Artificial Sequence; identical to SEQ ID NO: 58824
  Description of Artificial Sequence: Synthetic oligonucleotide

SEQ ID NO: 399901 - DNA, 29 bp, Artificial Sequence
  Description of Artificial Sequence: Synthetic oligonucleotide
caaagtccggtggtttcggaatgacgagg

SEQ ID NO: 399902 - DNA, 30 bp, Artificial Sequence; identical to SEQ ID NO: 58826
  Description of Artificial Sequence: Synthetic oligonucleotide

SEQ ID NO: 399903 - DNA, 29 bp, Artificial Sequence
  Description of Artificial Sequence: Synthetic oligonucleotide
aagtccggtggtttcggaatgacgaggag

SEQ ID NO: 399904 - DNA, 28 bp, Artificial Sequence
  Description of Artificial Sequence: Synthetic oligonucleotide
agtccggtggtttcggaatgacgaggag

SEQ ID NO: 399905 - DNA, 27 bp, Artificial Sequence
  Description of Artificial Sequence: Synthetic oligonucleotide
gtccggtggtttcggaatgacgaggag

SEQ ID NO: 399906 - DNA, 27 bp, Artificial Sequence
  Description of Artificial Sequence: Synthetic oligonucleotide
tccggtggtttcggaatgacgaggagg

SEQ ID NO: 399907 - DNA, 27 bp, Artificial Sequence
  Description of Artificial Sequence: Synthetic oligonucleotide
ccggtggtttcggaatgacgaggagga

SEQ ID NO: 399908 - DNA, 27 bp, Artificial Sequence
  Description of Artificial Sequence: Synthetic oligonucleotide
cggtggtttcggaatgacgaggaggag

SEQ ID NO: 399909 - DNA, 28 bp, Artificial Sequence
  Description of Artificial Sequence: Synthetic oligonucleotide
ggtggtttcggaatgacgaggaggagac

SEQ ID NO: 399910 - DNA, 29 bp, Artificial Sequence
  Description of Artificial Sequence: Synthetic oligonucleotide
gtggtttcggaatgacgaggaggagacag

SEQ ID NO: 399911 - DNA, 29 bp, Artificial Sequence
  Description of Artificial Sequence: Synthetic oligonucleotide
tggtttcggaatgacgaggaggagacagc

SEQ ID NO: 399912 - DNA, 28 bp, Artificial Sequence
  Description of Artificial Sequence: Synthetic oligonucleotide
ggtttcggaatgacgaggaggagacagc

SEQ ID NO: 399913 - DNA, 29 bp, Artificial Sequence
  Description of Artificial Sequence: Synthetic oligonucleotide
gtttcggaatgacgaggaggagacagctg

SEQ ID NO: 399914 - DNA, 29 bp, Artificial Sequence
  Description of Artificial Sequence: Synthetic oligonucleotide
tttcggaatgacgaggaggagacagctgg

SEQ ID NO: 399915 - DNA, 28 bp, Artificial Sequence
  Description of Artificial Sequence: Synthetic oligonucleotide
ttcggaatgacgaggaggagacagctgg

SEQ ID NO: 399916 - DNA, 27 bp, Artificial Sequence
  Description of Artificial Sequence: Synthetic oligonucleotide
tcggaatgacgaggaggagacagctgg

SEQ ID NO: 399917 - DNA, 26 bp, Artificial Sequence
  Description of Artificial Sequence: Synthetic oligonucleotide
cggaatgacgaggaggagacagctgg

SEQ ID NO: 399918 - DNA, 26 bp, Artificial Sequence
  Description of Artificial Sequence: Synthetic oligonucleotide
ggaatgacgaggaggagacagctggc

SEQ ID NO: 399919 - DNA, 27 bp, Artificial Sequence
  Description of Artificial Sequence: Synthetic oligonucleotide
gaatgacgaggaggagacagctggcgt

SEQ ID NO: 399920 - DNA, 28 bp, Artificial Sequence
  Description of Artificial Sequence: Synthetic oligonucleotide
aatgacgaggaggagacagctggcgttg

SEQ ID NO: 399921 - DNA, 27 bp, Artificial Sequence
  Description of Artificial Sequence: Synthetic oligonucleotide
atgacgaggaggagacagctggcgttg

SEQ ID NO: 399922 - DNA, 27 bp, Artificial Sequence
  Description of Artificial Sequence: Synthetic oligonucleotide
tgacgaggaggagacagctggcgttgt

SEQ ID NO: 399923 - DNA, 26 bp, Artificial Sequence
  Description of Artificial Sequence: Synthetic oligonucleotide
gacgaggaggagacagctggcgttgt

SEQ ID NO: 399924 - DNA, 27 bp, Artificial Sequence
  Description of Artificial Sequence: Synthetic oligonucleotide
acgaggaggagacagctggcgttgtgt

SEQ ID NO: 399925 - DNA, 26 bp, Artificial Sequence
  Description of Artificial Sequence: Synthetic oligonucleotide
cgaggaggagacagctggcgttgtgt

SEQ ID NO: 399926 - DNA, 26 bp, Artificial Sequence
  Description of Artificial Sequence: Synthetic oligonucleotide
gaggaggagacagctggcgttgtgtc

SEQ ID NO: 399927 - DNA, 23 bp, Artificial Sequence
  Description of Artificial Sequence: Synthetic oligonucleotide
aggaaacgggcggcggtggacac

SEQ ID NO: 399928 - DNA, 22 bp, Artificial Sequence
  Description of Artificial Sequence: Synthetic oligonucleotide
ggaaacgggcggcggtggacac

SEQ ID NO: 399929 - DNA, 22 bp, Artificial Sequence
  Description of Artificial Sequence: Synthetic oligonucleotide
gaaacgggcggcggtggacacg

SEQ ID NO: 399930 - DNA, 23 bp, Artificial Sequence
  Description of Artificial Sequence: Synthetic oligonucleotide
aaacgggcggcggtggacacggt

SEQ ID NO: 399931 - DNA, 22 bp, Artificial Sequence
  Description of Artificial Sequence: Synthetic oligonucleotide
aacgggcggcggtggacacggt

SEQ ID NO: 399932 - DNA, 21 bp, Artificial Sequence
  Description of Artificial Sequence: Synthetic oligonucleotide
acgggcggcggtggacacggt

SEQ ID NO: 399933 - DNA, 20 bp, Artificial Sequence
  Description of Artificial Sequence: Synthetic oligonucleotide
cgggcggcggtggacacggt

SEQ ID NO: 399934 - DNA, 21 bp, Artificial Sequence
  Description of Artificial Sequence: Synthetic oligonucleotide
gggcggcggtggacacggtgt

SEQ ID NO: 399935 - DNA, 21 bp, Artificial Sequence
  Description of Artificial Sequence: Synthetic oligonucleotide
ggcggcggtggacacggtgtg

SEQ ID NO: 399936 - DNA, 22 bp, Artificial Sequence
  Description of Artificial Sequence: Synthetic oligonucleotide
gcggcggtggacacggtgtgca

SEQ ID NO: 399937 - DNA, 23 bp, Artificial Sequence
  Description of Artificial Sequence: Synthetic oligonucleotide
cggcggtggacacggtgtgcaga

SEQ ID NO: 399938 - DNA, 24 bp, Artificial Sequence
  Description of Artificial Sequence: Synthetic oligonucleotide
ggcggtggacacggtgtgcagaca

SEQ ID NO: 399939 - DNA, 26 bp, Artificial Sequence
  Description of Artificial Sequence: Synthetic oligonucleotide
gcggtggacacggtgtgcagacacaa

SEQ ID NO: 399940 - DNA, 27 bp, Artificial Sequence
  Description of Artificial Sequence: Synthetic oligonucleotide
cggtggacacggtgtgcagacacaact

SEQ ID NO: 399941 - DNA, 28 bp, Artificial Sequence
  Description of Artificial Sequence: Synthetic oligonucleotide
ggtggacacggtgtgcagacacaactac

SEQ ID NO: 399942 - DNA, 28 bp, Artificial Sequence
  Description of Artificial Sequence: Synthetic oligonucleotide
gtggacacggtgtgcagacacaactacc

SEQ ID NO: 399943 - DNA, 29 bp, Artificial Sequence
  Description of Artificial Sequence: Synthetic oligonucleotide
tggacacggtgtgcagacacaactaccag

SEQ ID NO: 399944 - DNA, 28 bp, Artificial Sequence
  Description of Artificial Sequence: Synthetic oligonucleotide
ggacacggtgtgcagacacaactaccag

SEQ ID NO: 399945 - DNA, 30 bp, Artificial Sequence; identical to SEQ ID NO: 58869
  Description of Artificial Sequence: Synthetic oligonucleotide

SEQ ID NO: 399946 - DNA, 30 bp, Artificial Sequence; identical to SEQ ID NO: 58870
  Description of Artificial Sequence: Synthetic oligonucleotide

SEQ ID NO: 399947 - DNA, 29 bp, Artificial Sequence
  Description of Artificial Sequence: Synthetic oligonucleotide
cacggtgtgcagacacaactaccagttgg

SEQ ID NO: 399948 - DNA, 30 bp, Artificial Sequence; identical to SEQ ID NO: 58872
  Description of Artificial Sequence: Synthetic oligonucleotide

SEQ ID NO: 399949 - DNA, 29 bp, Artificial Sequence
  Description of Artificial Sequence: Synthetic oligonucleotide
cggtgtgcagacacaactaccagttggag

SEQ ID NO: 399950 - DNA, 29 bp, Artificial Sequence
  Description of Artificial Sequence: Synthetic oligonucleotide
tggaaatgactccccagcgtggagacatc

SEQ ID NO: 399951 - DNA, 28 bp, Artificial Sequence
  Description of Artificial Sequence: Synthetic oligonucleotide
ggaaatgactccccagcgtggagacatc

SEQ ID NO: 399952 - DNA, 30 bp, Artificial Sequence
  Description of Artificial Sequence: Synthetic oligonucleotide
gaaatgactccccagcgtggagacatctac

SEQ ID NO: 399953 - DNA, 31 bp, Artificial Sequence
  Description of Artificial Sequence: Synthetic oligonucleotide
aaatgactccccagcgtggagacatctacac

SEQ ID NO: 399954 - DNA, 30 bp, Artificial Sequence
  Description of Artificial Sequence: Synthetic oligonucleotide
aatgactccccagcgtggagacatctacac

SEQ ID NO: 399955 - DNA, 29 bp, Artificial Sequence
  Description of Artificial Sequence: Synthetic oligonucleotide
atgactccccagcgtggagacatctacac

SEQ ID NO: 399956 - DNA, 28 bp, Artificial Sequence
  Description of Artificial Sequence: Synthetic oligonucleotide
tgactccccagcgtggagacatctacac

SEQ ID NO: 399957 - DNA, 27 bp, Artificial Sequence
  Description of Artificial Sequence: Synthetic oligonucleotide
gactccccagcgtggagacatctacac

SEQ ID NO: 399958 - DNA, 27 bp, Artificial Sequence
  Description of Artificial Sequence: Synthetic oligonucleotide
actccccagcgtggagacatctacacc

SEQ ID NO: 399959 - DNA, 27 bp, Artificial Sequence
  Description of Artificial Sequence: Synthetic oligonucleotide
ctccccagcgtggagacatctacacct

SEQ ID NO: 399960 - DNA, 27 bp, Artificial Sequence
  Description of Artificial Sequence: Synthetic oligonucleotide
tccccagcgtggagacatctacacctg

SEQ ID NO: 399961 - DNA, 26 bp, Artificial Sequence
  Description of Artificial Sequence: Synthetic oligonucleotide
ccccagcgtggagacatctacacctg

SEQ ID NO: 399962 - DNA, 26 bp, Artificial Sequence
  Description of Artificial Sequence: Synthetic oligonucleotide
cccagcgtggagacatctacacctgc

SEQ ID NO: 399963 - DNA, 27 bp, Artificial Sequence
  Description of Artificial Sequence: Synthetic oligonucleotide
ccagcgtggagacatctacacctgcca

SEQ ID NO: 399964 - DNA, 27 bp, Artificial Sequence
  Description of Artificial Sequence: Synthetic oligonucleotide
cagcgtggagacatctacacctgccac

SEQ ID NO: 399965 - DNA, 27 bp, Artificial Sequence
  Description of Artificial Sequence: Synthetic oligonucleotide
agcgtggagacatctacacctgccacg

SEQ ID NO: 399966 - DNA, 27 bp, Artificial Sequence
  Description of Artificial Sequence: Synthetic oligonucleotide
gcgtggagacatctacacctgccacgt

SEQ ID NO: 399967 - DNA, 27 bp, Artificial Sequence
  Description of Artificial Sequence: Synthetic oligonucleotide
cgtggagacatctacacctgccacgtg

SEQ ID NO: 399968 - DNA, 27 bp, Artificial Sequence
  Description of Artificial Sequence: Synthetic oligonucleotide
gtggagacatctacacctgccacgtgg

SEQ ID NO: 399969 - DNA, 28 bp, Artificial Sequence
  Description of Artificial Sequence: Synthetic oligonucleotide
tggagacatctacacctgccacgtggag

SEQ ID NO: 399970 - DNA, 27 bp, Artificial Sequence
  Description of Artificial Sequence: Synthetic oligonucleotide
ggagacatctacacctgccacgtggag

SEQ ID NO: 399971 - DNA, 27 bp, Artificial Sequence
  Description of Artificial Sequence: Synthetic oligonucleotide
gagacatctacacctgccacgtggagc

SEQ ID NO: 399972 - DNA, 28 bp, Artificial Sequence
  Description of Artificial Sequence: Synthetic oligonucleotide
agacatctacacctgccacgtggagcac

SEQ ID NO: 399973 - DNA, 27 bp, Artificial Sequence
  Description of Artificial Sequence: Synthetic oligonucleotide
gacatctacacctgccacgtggagcac

SEQ ID NO: 399974 - DNA, 27 bp, Artificial Sequence
  Description of Artificial Sequence: Synthetic oligonucleotide
acatctacacctgccacgtggagcacc

SEQ ID NO: 399975 - DNA, 26 bp, Artificial Sequence
  Description of Artificial Sequence: Synthetic oligonucleotide
catctacacctgccacgtggagcacc

SEQ ID NO: 399976 - DNA, 26 bp, Artificial Sequence
  Description of Artificial Sequence: Synthetic oligonucleotide
atctacacctgccacgtggagcaccc

SEQ ID NO: 399977 - DNA, 42 bp, Artificial Sequence
  Description of Artificial Sequence: Synthetic oligonucleotide
ttctaagaaccttgcttttttcaccaaaacttaaggctcctc

SEQ ID NO: 399978 - DNA, 41 bp, Artificial Sequence
  Description of Artificial Sequence: Synthetic oligonucleotide
tctaagaaccttgcttttttcaccaaaacttaaggctcctc

SEQ ID NO: 399979 - DNA, 40 bp, Artificial Sequence
  Description of Artificial Sequence: Synthetic oligonucleotide
ctaagaaccttgcttttttcaccaaaacttaaggctcctc

SEQ ID NO: 399980 - DNA, 43 bp, Artificial Sequence
  Description of Artificial Sequence: Synthetic oligonucleotide
taagaaccttgcttttttcaccaaaacttaaggctcctcaaag

SEQ ID NO: 399981 - DNA, 42 bp, Artificial Sequence
  Description of Artificial Sequence: Synthetic oligonucleotide
aagaaccttgcttttttcaccaaaacttaaggctcctcaaag

SEQ ID NO: 399982 - DNA, 41 bp, Artificial Sequence
  Description of Artificial Sequence: Synthetic oligonucleotide
agaaccttgcttttttcaccaaaacttaaggctcctcaaag

SEQ ID NO: 399983 - DNA, 40 bp, Artificial Sequence
  Description of Artificial Sequence: Synthetic oligonucleotide
gaaccttgcttttttcaccaaaacttaaggctcctcaaag

SEQ ID NO: 399984 - DNA, 41 bp, Artificial Sequence
  Description of Artificial Sequence: Synthetic oligonucleotide
aaccttgcttttttcaccaaaacttaaggctcctcaaagtg

SEQ ID NO: 399985 - DNA, 40 bp, Artificial Sequence
  Description of Artificial Sequence: Synthetic oligonucleotide
accttgcttttttcaccaaaacttaaggctcctcaaagtg

SEQ ID NO: 399986 - DNA, 39 bp, Artificial Sequence
  Description of Artificial Sequence: Synthetic oligonucleotide
ccttgcttttttcaccaaaacttaaggctcctcaaagtg

SEQ ID NO: 399987 - DNA, 40 bp, Artificial Sequence
  Description of Artificial Sequence: Synthetic oligonucleotide
cttgcttttttcaccaaaacttaaggctcctcaaagtgtg

SEQ ID NO: 399988 - DNA, 41 bp, Artificial Sequence
  Description of Artificial Sequence: Synthetic oligonucleotide
ttgcttttttcaccaaaacttaaggctcctcaaagtgtgtc

SEQ ID NO: 399989 - DNA, 40 bp, Artificial Sequence
  Description of Artificial Sequence: Synthetic oligonucleotide
tgcttttttcaccaaaacttaaggctcctcaaagtgtgtc

SEQ ID NO: 399990 - DNA, 39 bp, Artificial Sequence
  Description of Artificial Sequence: Synthetic oligonucleotide
gcttttttcaccaaaacttaaggctcctcaaagtgtgtc

SEQ ID NO: 399991 - DNA, 42 bp, Artificial Sequence
  Description of Artificial Sequence: Synthetic oligonucleotide
cttttttcaccaaaacttaaggctcctcaaagtgtgtctaag

SEQ ID NO: 399992 - DNA, 43 bp, Artificial Sequence
  Description of Artificial Sequence: Synthetic oligonucleotide
ttttttcaccaaaacttaaggctcctcaaagtgtgtctaagac

SEQ ID NO: 399993 - DNA, 42 bp, Artificial Sequence
  Description of Artificial Sequence: Synthetic oligonucleotide
tttttcaccaaaacttaaggctcctcaaagtgtgtctaagac

SEQ ID NO: 399994 - DNA, 41 bp, Artificial Sequence
  Description of Artificial Sequence: Synthetic oligonucleotide
ttttcaccaaaacttaaggctcctcaaagtgtgtctaagac

SEQ ID NO: 399995 - DNA, 40 bp, Artificial Sequence
  Description of Artificial Sequence: Synthetic oligonucleotide
tttcaccaaaacttaaggctcctcaaagtgtgtctaagac

SEQ ID NO: 399996 - DNA, 39 bp, Artificial Sequence
  Description of Artificial Sequence: Synthetic oligonucleotide
ttcaccaaaacttaaggctcctcaaagtgtgtctaagac

SEQ ID NO: 399997 - DNA, 38 bp, Artificial Sequence
  Description of Artificial Sequence: Synthetic oligonucleotide
tcaccaaaacttaaggctcctcaaagtgtgtctaagac

SEQ ID NO: 399998 - DNA, 37 bp, Artificial Sequence
  Description of Artificial Sequence: Synthetic oligonucleotide
caccaaaacttaaggctcctcaaagtgtgtctaagac

SEQ ID NO: 399999 - DNA, 39 bp, Artificial Sequence
  Description of Artificial Sequence: Synthetic oligonucleotide
accaaaacttaaggctcctcaaagtgtgtctaagacaac

SEQ ID NO: 400000 - DNA, 38 bp, Artificial Sequence
  Description of Artificial Sequence: Synthetic oligonucleotide
ccaaaacttaaggctcctcaaagtgtgtctaagacaac

SEQ ID NO: 400001 - DNA, 39 bp, Artificial Sequence
  Description of Artificial Sequence: Synthetic oligonucleotide
caaaacttaaggctcctcaaagtgtgtctaagacaacag

SEQ ID NO: 400002 - DNA, 39 bp, Artificial Sequence
  Description of Artificial Sequence: Synthetic oligonucleotide
aaaacttaaggctcctcaaagtgtgtctaagacaacagc

SEQ ID NO: 400003 - DNA, 38 bp, Artificial Sequence
  Description of Artificial Sequence: Synthetic oligonucleotide
aaacttaaggctcctcaaagtgtgtctaagacaacagc

SEQ ID NO: 400004 - DNA, 37 bp, Artificial Sequence
  Description of Artificial Sequence: Synthetic oligonucleotide
aacttaaggctcctcaaagtgtgtctaagacaacagc

SEQ ID NO: 400005 - DNA, 36 bp, Artificial Sequence
  Description of Artificial Sequence: Synthetic oligonucleotide
acttaaggctcctcaaagtgtgtctaagacaacagc

SEQ ID NO: 400006 - DNA, 35 bp, Artificial Sequence
  Description of Artificial Sequence: Synthetic oligonucleotide
cttaaggctcctcaaagtgtgtctaagacaacagc

SEQ ID NO: 400007 - DNA, 36 bp, Artificial Sequence
  Description of Artificial Sequence: Synthetic oligonucleotide
ttaaggctcctcaaagtgtgtctaagacaacagcag

SEQ ID NO: 400008 - DNA, 35 bp, Artificial Sequence
  Description of Artificial Sequence: Synthetic oligonucleotide
taaggctcctcaaagtgtgtctaagacaacagcag

SEQ ID NO: 400009 - DNA, 34 bp, Artificial Sequence
  Description of Artificial Sequence: Synthetic oligonucleotide
aaggctcctcaaagtgtgtctaagacaacagcag

SEQ ID NO: 400010 - DNA, 33 bp, Artificial Sequence
  Description of Artificial Sequence: Synthetic oligonucleotide
aggctcctcaaagtgtgtctaagacaacagcag

SEQ ID NO: 400011 - DNA, 32 bp, Artificial Sequence
  Description of Artificial Sequence: Synthetic oligonucleotide
ggctcctcaaagtgtgtctaagacaacagcag

SEQ ID NO: 400012 - DNA, 39 bp, Artificial Sequence
  Description of Artificial Sequence: Synthetic oligonucleotide
gctcctcaaagtgtgtctaagacaacagcagtaaaaatg

SEQ ID NO: 400013 - DNA, 40 bp, Artificial Sequence
  Description of Artificial Sequence: Synthetic oligonucleotide
ctcctcaaagtgtgtctaagacaacagcagtaaaaatgtc

SEQ ID NO: 400014 - DNA, 43 bp, Artificial Sequence
  Description of Artificial Sequence: Synthetic oligonucleotide
tcctcaaagtgtgtctaagacaacagcagtaaaaatgtctatg

SEQ ID NO: 400015 - DNA, 42 bp, Artificial Sequence
  Description of Artificial Sequence: Synthetic oligonucleotide
cctcaaagtgtgtctaagacaacagcagtaaaaatgtctatg

SEQ ID NO: 400016 - DNA, 43 bp, Artificial Sequence
  Description of Artificial Sequence: Synthetic oligonucleotide
ctcaaagtgtgtctaagacaacagcagtaaaaatgtctatgac

SEQ ID NO: 400017 - DNA, 44 bp, Artificial Sequence
  Description of Artificial Sequence: Synthetic oligonucleotide
tcaaagtgtgtctaagacaacagcagtaaaaatgtctatgacag

SEQ ID NO: 400018 - DNA, 43 bp, Artificial Sequence
  Description of Artificial Sequence: Synthetic oligonucleotide
caaagtgtgtctaagacaacagcagtaaaaatgtctatgacag

SEQ ID NO: 400019 - DNA, 43 bp, Artificial Sequence
  Description of Artificial Sequence: Synthetic oligonucleotide
aaagtgtgtctaagacaacagcagtaaaaatgtctatgacagc

SEQ ID NO: 400020 - DNA, 42 bp, Artificial Sequence
  Description of Artificial Sequence: Synthetic oligonucleotide
aagtgtgtctaagacaacagcagtaaaaatgtctatgacagc

SEQ ID NO: 400021 - DNA, 41 bp, Artificial Sequence
  Description of Artificial Sequence: Synthetic oligonucleotide
agtgtgtctaagacaacagcagtaaaaatgtctatgacagc

SEQ ID NO: 400022 - DNA, 41 bp, Artificial Sequence
  Description of Artificial Sequence: Synthetic oligonucleotide
atccccacttaatttgccctattgaaagaatcccaagtatg

SEQ ID NO: 400023 - DNA, 40 bp, Artificial Sequence
  Description of Artificial Sequence: Synthetic oligonucleotide
tccccacttaatttgccctattgaaagaatcccaagtatg

SEQ ID NO: 400024 - DNA, 39 bp, Artificial Sequence
  Description of Artificial Sequence: Synthetic oligonucleotide
ccccacttaatttgccctattgaaagaatcccaagtatg

SEQ ID NO: 400025 - DNA, 43 bp, Artificial Sequence
  Description of Artificial Sequence: Synthetic oligonucleotide
cccacttaatttgccctattgaaagaatcccaagtatgaaaac

SEQ ID NO: 400026 - DNA, 45 bp, Artificial Sequence
  Description of Artificial Sequence: Synthetic oligonucleotide
ccacttaatttgccctattgaaagaatcccaagtatgaaaacaac

SEQ ID NO: 400027 - DNA, 46 bp, Artificial Sequence
  Description of Artificial Sequence: Synthetic oligonucleotide
cacttaatttgccctattgaaagaatcccaagtatgaaaacaactg

SEQ ID NO: 400028 - DNA, 46 bp, Artificial Sequence
  Description of Artificial Sequence: Synthetic oligonucleotide
acttaatttgccctattgaaagaatcccaagtatgaaaacaactgg

SEQ ID NO: 400029 - DNA, 45 bp, Artificial Sequence
  Description of Artificial Sequence: Synthetic oligonucleotide
cttaatttgccctattgaaagaatcccaagtatgaaaacaactgg

SEQ ID NO: 400030 - DNA, 53 bp, Artificial Sequence
  Description of Artificial Sequence: Synthetic oligonucleotide
ttaatttgccctattgaaagaatcccaagtatgaaaacaactggtttttaatc

SEQ ID NO: 400031 - DNA, 52 bp, Artificial Sequence
  Description of Artificial Sequence: Synthetic oligonucleotide
taatttgccctattgaaagaatcccaagtatgaaaacaactggtttttaatc

SEQ ID NO: 400032 - DNA, 51 bp, Artificial Sequence
  Description of Artificial Sequence: Synthetic oligonucleotide
aatttgccctattgaaagaatcccaagtatgaaaacaactggtttttaatc

SEQ ID NO: 400033 - DNA, 50 bp, Artificial Sequence
  Description of Artificial Sequence: Synthetic oligonucleotide
atttgccctattgaaagaatcccaagtatgaaaacaactggtttttaatc

SEQ ID NO: 400034 - DNA, 49 bp, Artificial Sequence
  Description of Artificial Sequence: Synthetic oligonucleotide
tttgccctattgaaagaatcccaagtatgaaaacaactggtttttaatc

SEQ ID NO: 400035 - DNA, 48 bp, Artificial Sequence
  Description of Artificial Sequence: Synthetic oligonucleotide
ttgccctattgaaagaatcccaagtatgaaaacaactggtttttaatc

SEQ ID NO: 400036 - DNA, 47 bp, Artificial Sequence
  Description of Artificial Sequence: Synthetic oligonucleotide
tgccctattgaaagaatcccaagtatgaaaacaactggtttttaatc

SEQ ID NO: 400037 - DNA, 46 bp, Artificial Sequence
  Description of Artificial Sequence: Synthetic oligonucleotide
gccctattgaaagaatcccaagtatgaaaacaactggtttttaatc

SEQ ID NO: 400038 - DNA, 53 bp, Artificial Sequence
  Description of Artificial Sequence: Synthetic oligonucleotide
ccctattgaaagaatcccaagtatgaaaacaactggtttttaatcaatattac

SEQ ID NO: 400039 - DNA, 56 bp, Artificial Sequence
  Description of Artificial Sequence: Synthetic oligonucleotide
cctattgaaagaatcccaagtatgaaaacaactggtttttaatcaatattacaaag

SEQ ID NO: 400040 - DNA, 58 bp, Artificial Sequence
  Description of Artificial Sequence: Synthetic oligonucleotide
ctattgaaagaatcccaagtatgaaaacaactggtttttaatcaatattacaaagatg

SEQ ID NO: 400041 - DNA, 60 bp, Artificial Sequence
  Description of Artificial Sequence: Synthetic oligonucleotide
tattgaaagaatcccaagtatgaaaacaactggtttttaatcaatattacaaagatgttt

SEQ ID NO: 400042 - DNA, 60 bp, Artificial Sequence
  Description of Artificial Sequence: Synthetic oligonucleotide
attgaaagaatcccaagtatgaaaacaactggtttttaatcaatattacaaagatgttta

SEQ ID NO: 400043 - DNA, 60 bp, Artificial Sequence
  Description of Artificial Sequence: Synthetic oligonucleotide
ttgaaagaatcccaagtatgaaaacaactggtttttaatcaatattacaaagatgtttac

SEQ ID NO: 400044 - DNA, 59 bp, Artificial Sequence
  Description of Artificial Sequence: Synthetic oligonucleotide
tgaaagaatcccaagtatgaaaacaactggtttttaatcaatattacaaagatgtttac

SEQ ID NO: 400045 - DNA, 58 bp, Artificial Sequence
  Description of Artificial Sequence: Synthetic oligonucleotide
gaaagaatcccaagtatgaaaacaactggtttttaatcaatattacaaagatgtttac

SEQ ID NO: 400046 - DNA, 59 bp, Artificial Sequence
  Description of Artificial Sequence: Synthetic oligonucleotide
aaagaatcccaagtatgaaaacaactggtttttaatcaatattacaaagatgtttactg

SEQ ID NO: 400047 - DNA, 58 bp, Artificial Sequence
  Description of Artificial Sequence: Synthetic oligonucleotide
aagaatcccaagtatgaaaacaactggtttttaatcaatattacaaagatgtttactg

SEQ ID NO: 400048 - DNA, 57 bp, Artificial Sequence
  Description of Artificial Sequence: Synthetic oligonucleotide
agaatcccaagtatgaaaacaactggtttttaatcaatattacaaagatgtttactg

SEQ ID NO: 400049 - DNA, 56 bp, Artificial Sequence
  Description of Artificial Sequence: Synthetic oligonucleotide
gaatcccaagtatgaaaacaactggtttttaatcaatattacaaagatgtttactg

SEQ ID NO: 400050 - DNA, 58 bp, Artificial Sequence
  Description of Artificial Sequence: Synthetic oligonucleotide
aatcccaagtatgaaaacaactggtttttaatcaatattacaaagatgtttactgttg

SEQ ID NO: 400051 - DNA, 57 bp, Artificial Sequence
  Description of Artificial Sequence: Synthetic oligonucleotide
atcccaagtatgaaaacaactggtttttaatcaatattacaaagatgtttactgttg

SEQ ID NO: 400052 - DNA, 56 bp, Artificial Sequence
  Description of Artificial Sequence: Synthetic oligonucleotide
tcccaagtatgaaaacaactggtttttaatcaatattacaaagatgtttactgttg

SEQ ID NO: 400053 - DNA, 55 bp, Artificial Sequence
  Description of Artificial Sequence: Synthetic oligonucleotide
cccaagtatgaaaacaactggtttttaatcaatattacaaagatgtttactgttg

SEQ ID NO: 400054 - DNA, 58 bp, Artificial Sequence
  Description of Artificial Sequence: Synthetic oligonucleotide
ccaagtatgaaaacaactggtttttaatcaatattacaaagatgtttactgttgaatc

SEQ ID NO: 400055 - DNA, 58 bp, Artificial Sequence
  Description of Artificial Sequence: Synthetic oligonucleotide
caagtatgaaaacaactggtttttaatcaatattacaaagatgtttactgttgaatcg

SEQ ID NO: 400056 - DNA, 58 bp, Artificial Sequence
  Description of Artificial Sequence: Synthetic oligonucleotide
aagtatgaaaacaactggtttttaatcaatattacaaagatgtttactgttgaatcgc

SEQ ID NO: 400057 - DNA, 57 bp, Artificial Sequence
  Description of Artificial Sequence: Synthetic oligonucleotide
agtatgaaaacaactggtttttaatcaatattacaaagatgtttactgttgaatcgc

SEQ ID NO: 400058 - DNA, 56 bp, Artificial Sequence
  Description of Artificial Sequence: Synthetic oligonucleotide
gtatgaaaacaactggtttttaatcaatattacaaagatgtttactgttgaatcgc

SEQ ID NO: 400059 - DNA, 60 bp, Artificial Sequence
  Description of Artificial Sequence: Synthetic oligonucleotide
tatgaaaacaactggtttttaatcaatattacaaagatgtttactgttgaatcgcatttt

SEQ ID NO: 400060 - DNA, 60 bp, Artificial Sequence
  Description of Artificial Sequence: Synthetic oligonucleotide
atgaaaacaactggtttttaatcaatattacaaagatgtttactgttgaatcgcattttt

SEQ ID NO: 400061 - DNA, 60 bp, Artificial Sequence
  Description of Artificial Sequence: Synthetic oligonucleotide
tgaaaacaactggtttttaatcaatattacaaagatgtttactgttgaatcgcatttttt

SEQ ID NO: 400062 - DNA, 60 bp, Artificial Sequence
  Description of Artificial Sequence: Synthetic oligonucleotide
gaaaacaactggtttttaatcaatattacaaagatgtttactgttgaatcgcattttttt

SEQ ID NO: 400063 - DNA, 60 bp, Artificial Sequence
  Description of Artificial Sequence: Synthetic oligonucleotide
aaaacaactggtttttaatcaatattacaaagatgtttactgttgaatcgcatttttttt

SEQ ID NO: 400064 - DNA, 60 bp, Artificial Sequence
  Description of Artificial Sequence: Synthetic oligonucleotide
aaacaactggtttttaatcaatattacaaagatgtttactgttgaatcgcattttttttg

SEQ ID NO: 400065 - DNA, 60 bp, Artificial Sequence
  Description of Artificial Sequence: Synthetic oligonucleotide
aacaactggtttttaatcaatattacaaagatgtttactgttgaatcgcattttttttgg

SEQ ID NO: 400066 - DNA, 59 bp, Artificial Sequence
  Description of Artificial Sequence: Synthetic oligonucleotide
acaactggtttttaatcaatattacaaagatgtttactgttgaatcgcattttttttgg

SEQ ID NO: 400067 - DNA, 58 bp, Artificial Sequence
  Description of Artificial Sequence: Synthetic oligonucleotide
caactggtttttaatcaatattacaaagatgtttactgttgaatcgcattttttttgg

SEQ ID NO: 400068 - DNA, 58 bp, Artificial Sequence
  Description of Artificial Sequence: Synthetic oligonucleotide
aactggtttttaatcaatattacaaagatgtttactgttgaatcgcattttttttggc

SEQ ID NO: 400069 - DNA, 57 bp, Artificial Sequence
  Description of Artificial Sequence: Synthetic oligonucleotide
actggtttttaatcaatattacaaagatgtttactgttgaatcgcattttttttggc

SEQ ID NO: 400070 - DNA, 56 bp, Artificial Sequence
  Description of Artificial Sequence: Synthetic oligonucleotide
ctggtttttaatcaatattacaaagatgtttactgttgaatcgcattttttttggc

SEQ ID NO: 400071 - DNA, 58 bp, Artificial Sequence
  Description of Artificial Sequence: Synthetic oligonucleotide
tggtttttaatcaatattacaaagatgtttactgttgaatcgcattttttttggcttc

SEQ ID NO: 400072 - DNA, 57 bp, Artificial Sequence
  Description of Artificial Sequence: Synthetic oligonucleotide
ggtttttaatcaatattacaaagatgtttactgttgaatcgcattttttttggcttc

SEQ ID NO: 400073 - DNA, 60 bp, Artificial Sequence
  Description of Artificial Sequence: Synthetic oligonucleotide
gtttttaatcaatattacaaagatgtttactgttgaatcgcattttttttggcttcttaa

SEQ ID NO: 400074 - DNA, 60 bp, Artificial Sequence
  Description of Artificial Sequence: Synthetic oligonucleotide
tttttaatcaatattacaaagatgtttactgttgaatcgcattttttttggcttcttaaa

SEQ ID NO: 400075 - DNA, 60 bp, Artificial Sequence
  Description of Artificial Sequence: Synthetic oligonucleotide
ttttaatcaatattacaaagatgtttactgttgaatcgcattttttttggcttcttaaaa

SEQ ID NO: 400076 - DNA, 60 bp, Artificial Sequence
  Description of Artificial Sequence: Synthetic oligonucleotide
tttaatcaatattacaaagatgtttactgttgaatcgcattttttttggcttcttaaaat

SEQ ID NO: 400077 - DNA, 60 bp, Artificial Sequence
  Description of Artificial Sequence: Synthetic oligonucleotide
ttaatcaatattacaaagatgtttactgttgaatcgcattttttttggcttcttaaaatc

SEQ ID NO: 400078 - DNA, 60 bp, Artificial Sequence
  Description of Artificial Sequence: Synthetic oligonucleotide
taatcaatattacaaagatgtttactgttgaatcgcattttttttggcttcttaaaatcc

SEQ ID NO: 400079 - DNA, 59 bp, Artificial Sequence
  Description of Artificial Sequence: Synthetic oligonucleotide
aatcaatattacaaagatgtttactgttgaatcgcattttttttggcttcttaaaatcc

SEQ ID NO: 400080 - DNA, 58 bp, Artificial Sequence
  Description of Artificial Sequence: Synthetic oligonucleotide
atcaatattacaaagatgtttactgttgaatcgcattttttttggcttcttaaaatcc

SEQ ID NO: 400081 - DNA, 57 bp, Artificial Sequence
  Description of Artificial Sequence: Synthetic oligonucleotide
tcaatattacaaagatgtttactgttgaatcgcattttttttggcttcttaaaatcc

SEQ ID NO: 400082 - DNA, 56 bp, Artificial Sequence
  Description of Artificial Sequence: Synthetic oligonucleotide
caatattacaaagatgtttactgttgaatcgcattttttttggcttcttaaaatcc

SEQ ID NO: 400083 - DNA, 56 bp, Artificial Sequence
  Description of Artificial Sequence: Synthetic oligonucleotide
aatattacaaagatgtttactgttgaatcgcattttttttggcttcttaaaatccc

SEQ ID NO: 400084 - DNA, 55 bp, Artificial Sequence
  Description of Artificial Sequence: Synthetic oligonucleotide
atattacaaagatgtttactgttgaatcgcattttttttggcttcttaaaatccc

SEQ ID NO: 400085 - DNA, 54 bp, Artificial Sequence
  Description of Artificial Sequence: Synthetic oligonucleotide
tattacaaagatgtttactgttgaatcgcattttttttggcttcttaaaatccc

SEQ ID NO: 400086 - DNA, 53 bp, Artificial Sequence
  Description of Artificial Sequence: Synthetic oligonucleotide
attacaaagatgtttactgttgaatcgcattttttttggcttcttaaaatccc

SEQ ID NO: 400087 - DNA, 52 bp, Artificial Sequence
  Description of Artificial Sequence: Synthetic oligonucleotide
ttacaaagatgtttactgttgaatcgcattttttttggcttcttaaaatccc

SEQ ID NO: 400088 - DNA, 51 bp, Artificial Sequence
  Description of Artificial Sequence: Synthetic oligonucleotide
tacaaagatgtttactgttgaatcgcattttttttggcttcttaaaatccc

SEQ ID NO: 400089 - DNA, 50 bp, Artificial Sequence
  Description of Artificial Sequence: Synthetic oligonucleotide
acaaagatgtttactgttgaatcgcattttttttggcttcttaaaatccc

SEQ ID NO: 400090 - DNA, 49 bp, Artificial Sequence
  Description of Artificial Sequence: Synthetic oligonucleotide
caaagatgtttactgttgaatcgcattttttttggcttcttaaaatccc

SEQ ID NO: 400091 - DNA, 52 bp, Artificial Sequence
  Description of Artificial Sequence: Synthetic oligonucleotide
aaagatgtttactgttgaatcgcattttttttggcttcttaaaatcccttag

SEQ ID NO: 400092 - DNA, 51 bp, Artificial Sequence
  Description of Artificial Sequence: Synthetic oligonucleotide
aagatgtttactgttgaatcgcattttttttggcttcttaaaatcccttag

SEQ ID NO: 400093 - DNA, 50 bp, Artificial Sequence
  Description of Artificial Sequence: Synthetic oligonucleotide
agatgtttactgttgaatcgcattttttttggcttcttaaaatcccttag

SEQ ID NO: 400094 - DNA, 49 bp, Artificial Sequence
  Description of Artificial Sequence: Synthetic oligonucleotide
gatgtttactgttgaatcgcattttttttggcttcttaaaatcccttag

SEQ ID NO: 400095 - DNA, 49 bp, Artificial Sequence
  Description of Artificial Sequence: Synthetic oligonucleotide
atgtttactgttgaatcgcattttttttggcttcttaaaatcccttagg

SEQ ID NO: 400096 - DNA, 48 bp, Artificial Sequence
  Description of Artificial Sequence: Synthetic oligonucleotide
tgtttactgttgaatcgcattttttttggcttcttaaaatcccttagg

SEQ ID NO: 400097 - DNA, 47 bp, Artificial Sequence
  Description of Artificial Sequence: Synthetic oligonucleotide
gtttactgttgaatcgcattttttttggcttcttaaaatcccttagg

SEQ ID NO: 400098 - DNA, 47 bp, Artificial Sequence
  Description of Artificial Sequence: Synthetic oligonucleotide
tttactgttgaatcgcattttttttggcttcttaaaatcccttaggc

SEQ ID NO: 400099 - DNA, 46 bp, Artificial Sequence
  Description of Artificial Sequence: Synthetic oligonucleotide
ttactgttgaatcgcattttttttggcttcttaaaatcccttaggc

SEQ ID NO: 400100 - DNA, 45 bp, Artificial Sequence
  Description of Artificial Sequence: Synthetic oligonucleotide
tactgttgaatcgcattttttttggcttcttaaaatcccttaggc

SEQ ID NO: 400101 - DNA, 44 bp, Artificial Sequence
  Description of Artificial Sequence: Synthetic oligonucleotide
actgttgaatcgcattttttttggcttcttaaaatcccttaggc

SEQ ID NO: 400102 - DNA, 43 bp, Artificial Sequence
  Description of Artificial Sequence: Synthetic oligonucleotide
ctgttgaatcgcattttttttggcttcttaaaatcccttaggc

SEQ ID NO: 400103 - DNA, 46 bp, Artificial Sequence
  Description of Artificial Sequence: Synthetic oligonucleotide
tgttgaatcgcattttttttggcttcttaaaatcccttaggcattc

SEQ ID NO: 400104 - DNA, 45 bp, Artificial Sequence
  Description of Artificial Sequence: Synthetic oligonucleotide
gttgaatcgcattttttttggcttcttaaaatcccttaggcattc

SEQ ID NO: 400105 - DNA, 46 bp, Artificial Sequence
  Description of Artificial Sequence: Synthetic oligonucleotide
ttgaatcgcattttttttggcttcttaaaatcccttaggcattcag

SEQ ID NO: 400106 - DNA, 45 bp, Artificial Sequence
  Description of Artificial Sequence: Synthetic oligonucleotide
tgaatcgcattttttttggcttcttaaaatcccttaggcattcag

SEQ ID NO: 400107 - DNA, 44 bp, Artificial Sequence
  Description of Artificial Sequence: Synthetic oligonucleotide
gaatcgcattttttttggcttcttaaaatcccttaggcattcag

SEQ ID NO: 400108 - DNA, 45 bp, Artificial Sequence
  Description of Artificial Sequence: Synthetic oligonucleotide
aatcgcattttttttggcttcttaaaatcccttaggcattcagtc

SEQ ID NO: 400109 - DNA, 44 bp, Artificial Sequence
  Description of Artificial Sequence: Synthetic oligonucleotide
atcgcattttttttggcttcttaaaatcccttaggcattcagtc

SEQ ID NO: 400110 - DNA, 43 bp, Artificial Sequence
  Description of Artificial Sequence: Synthetic oligonucleotide
tcgcattttttttggcttcttaaaatcccttaggcattcagtc

SEQ ID NO: 400111 - DNA, 42 bp, Artificial Sequence
  Description of Artificial Sequence: Synthetic oligonucleotide
cgcattttttttggcttcttaaaatcccttaggcattcagtc

SEQ ID NO: 400112 - DNA, 44 bp, Artificial Sequence
  Description of Artificial Sequence: Synthetic oligonucleotide
gcattttttttggcttcttaaaatcccttaggcattcagtcttc

SEQ ID NO: 400113 - DNA, 45 bp, Artificial Sequence
  Description of Artificial Sequence: Synthetic oligonucleotide
cattttttttggcttcttaaaatcccttaggcattcagtcttcag

SEQ ID NO: 400114 - DNA, 45 bp, Artificial Sequence
  Description of Artificial Sequence: Synthetic oligonucleotide
attttttttggcttcttaaaatcccttaggcattcagtcttcagc

SEQ ID NO: 400115 - DNA, 44 bp, Artificial Sequence
  Description of Artificial Sequence: Synthetic oligonucleotide
ttttttttggcttcttaaaatcccttaggcattcagtcttcagc

SEQ ID NO: 400116 - DNA, 43 bp, Artificial Sequence
  Description of Artificial Sequence: Synthetic oligonucleotide
tttttttggcttcttaaaatcccttaggcattcagtcttcagc

SEQ ID NO: 400117 - DNA, 42 bp, Artificial Sequence
  Description of Artificial Sequence: Synthetic oligonucleotide
ttttttggcttcttaaaatcccttaggcattcagtcttcagc

SEQ ID NO: 400118 - DNA, 41 bp, Artificial Sequence
  Description of Artificial Sequence: Synthetic oligonucleotide
tttttggcttcttaaaatcccttaggcattcagtcttcagc

SEQ ID NO: 400119 - DNA, 40 bp, Artificial Sequence
  Description of Artificial Sequence: Synthetic oligonucleotide
ttttggcttcttaaaatcccttaggcattcagtcttcagc

SEQ ID NO: 400120 - DNA, 39 bp, Artificial Sequence
  Description of Artificial Sequence: Synthetic oligonucleotide
tttggcttcttaaaatcccttaggcattcagtcttcagc

SEQ ID NO: 400121 - DNA, 38 bp, Artificial Sequence
  Description of Artificial Sequence: Synthetic oligonucleotide
ttggcttcttaaaatcccttaggcattcagtcttcagc

SEQ ID NO: 400122 - DNA, 37 bp, Artificial Sequence
  Description of Artificial Sequence: Synthetic oligonucleotide
tggcttcttaaaatcccttaggcattcagtcttcagc

SEQ ID NO: 400123 - DNA, 36 bp, Artificial Sequence
  Description of Artificial Sequence: Synthetic oligonucleotide
ggcttcttaaaatcccttaggcattcagtcttcagc

SEQ ID NO: 400124 - DNA, 37 bp, Artificial Sequence
  Description of Artificial Sequence: Synthetic oligonucleotide
gcttcttaaaatcccttaggcattcagtcttcagctc

SEQ ID NO: 400125 - DNA, 39 bp, Artificial Sequence
  Description of Artificial Sequence: Synthetic oligonucleotide
cttcttaaaatcccttaggcattcagtcttcagctcttc

SEQ ID NO: 400126 - DNA, 39 bp, Artificial Sequence
  Description of Artificial Sequence: Synthetic oligonucleotide
ttcttaaaatcccttaggcattcagtcttcagctcttcc

SEQ ID NO: 400127 - DNA, 38 bp, Artificial Sequence
  Description of Artificial Sequence: Synthetic oligonucleotide
tcttaaaatcccttaggcattcagtcttcagctcttcc

SEQ ID NO: 400128 - DNA, 37 bp, Artificial Sequence
  Description of Artificial Sequence: Synthetic oligonucleotide
cttaaaatcccttaggcattcagtcttcagctcttcc

SEQ ID NO: 400129 - DNA, 43 bp, Artificial Sequence
  Description of Artificial Sequence: Synthetic oligonucleotide
ttaaaatcccttaggcattcagtcttcagctcttccataattg

SEQ ID NO: 400130 - DNA, 42 bp, Artificial Sequence
  Description of Artificial Sequence: Synthetic oligonucleotide
taaaatcccttaggcattcagtcttcagctcttccataattg

SEQ ID NO: 400131 - DNA, 41 bp, Artificial Sequence
  Description of Artificial Sequence: Synthetic oligonucleotide
aaaatcccttaggcattcagtcttcagctcttccataattg

SEQ ID NO: 400132 - DNA, 40 bp, Artificial Sequence
  Description of Artificial Sequence: Synthetic oligonucleotide
aaatcccttaggcattcagtcttcagctcttccataattg

SEQ ID NO: 400133 - DNA, 39 bp, Artificial Sequence
  Description of Artificial Sequence: Synthetic oligonucleotide
aatcccttaggcattcagtcttcagctcttccataattg

SEQ ID NO: 400134 - DNA, 38 bp, Artificial Sequence
  Description of Artificial Sequence: Synthetic oligonucleotide
atcccttaggcattcagtcttcagctcttccataattg

SEQ ID NO: 400135 - DNA, 37 bp, Artificial Sequence
  Description of Artificial Sequence: Synthetic oligonucleotide
tcccttaggcattcagtcttcagctcttccataattg

SEQ ID NO: 400136 - DNA, 36 bp, Artificial Sequence
  Description of Artificial Sequence: Synthetic oligonucleotide
cccttaggcattcagtcttcagctcttccataattg

SEQ ID NO: 400137 - DNA, 37 bp, Artificial Sequence
  Description of Artificial Sequence: Synthetic oligonucleotide
ccttaggcattcagtcttcagctcttccataattgag

SEQ ID NO: 400138 - DNA, 38 bp, Artificial Sequence
  Description of Artificial Sequence: Synthetic oligonucleotide
cttaggcattcagtcttcagctcttccataattgagag

SEQ ID NO: 400139 - DNA, 38 bp, Artificial Sequence
  Description of Artificial Sequence: Synthetic oligonucleotide
ttaggcattcagtcttcagctcttccataattgagagg

SEQ ID NO: 400140 - DNA, 37 bp, Artificial Sequence
  Description of Artificial Sequence: Synthetic oligonucleotide
taggcattcagtcttcagctcttccataattgagagg

SEQ ID NO: 400141 - DNA, 36 bp, Artificial Sequence
  Description of Artificial Sequence: Synthetic oligonucleotide
aggcattcagtcttcagctcttccataattgagagg

SEQ ID NO: 400142 - DNA, 35 bp, Artificial Sequence
  Description of Artificial Sequence: Synthetic oligonucleotide
ggcattcagtcttcagctcttccataattgagagg

SEQ ID NO: 400143 - DNA, 42 bp, Artificial Sequence
  Description of Artificial Sequence: Synthetic oligonucleotide
gcattcagtcttcagctcttccataattgagaggaaattttc

SEQ ID NO: 400144 - DNA, 43 bp, Artificial Sequence
  Description of Artificial Sequence: Synthetic oligonucleotide
cattcagtcttcagctcttccataattgagaggaaattttcac

SEQ ID NO: 400145 - DNA, 43 bp, Artificial Sequence
  Description of Artificial Sequence: Synthetic oligonucleotide
attcagtcttcagctcttccataattgagaggaaattttcacc

SEQ ID NO: 400146 - DNA, 42 bp, Artificial Sequence
  Description of Artificial Sequence: Synthetic oligonucleotide
ttcagtcttcagctcttccataattgagaggaaattttcacc

SEQ ID NO: 400147 - DNA, 41 bp, Artificial Sequence
  Description of Artificial Sequence: Synthetic oligonucleotide
tcagtcttcagctcttccataattgagaggaaattttcacc

SEQ ID NO: 400148 - DNA, 40 bp, Artificial Sequence
  Description of Artificial Sequence: Synthetic oligonucleotide
cagtcttcagctcttccataattgagaggaaattttcacc

SEQ ID NO: 400149 - DNA, 41 bp, Artificial Sequence
  Description of Artificial Sequence: Synthetic oligonucleotide
agtcttcagctcttccataattgagaggaaattttcacctc

SEQ ID NO: 400150 - DNA, 40 bp, Artificial Sequence
  Description of Artificial Sequence: Synthetic oligonucleotide
gtcttcagctcttccataattgagaggaaattttcacctc

SEQ ID NO: 400151 - DNA, 41 bp, Artificial Sequence
  Description of Artificial Sequence: Synthetic oligonucleotide
agaggaaattttcacctcaaatgttcatccagtgcaattgg

SEQ ID NO: 400152 - DNA, 40 bp, Artificial Sequence
  Description of Artificial Sequence: Synthetic oligonucleotide
gaggaaattttcacctcaaatgttcatccagtgcaattgg

SEQ ID NO: 400153 - DNA, 42 bp, Artificial Sequence
  Description of Artificial Sequence: Synthetic oligonucleotide
aggaaattttcacctcaaatgttcatccagtgcaattggaag

SEQ ID NO: 400154 - DNA, 41 bp, Artificial Sequence
  Description of Artificial Sequence: Synthetic oligonucleotide
ggaaattttcacctcaaatgttcatccagtgcaattggaag

SEQ ID NO: 400155 - DNA, 42 bp, Artificial Sequence
  Description of Artificial Sequence: Synthetic oligonucleotide
gaaattttcacctcaaatgttcatccagtgcaattggaagac

SEQ ID NO: 400156 - DNA, 42 bp, Artificial Sequence
  Description of Artificial Sequence: Synthetic oligonucleotide
aaattttcacctcaaatgttcatccagtgcaattggaagacg

SEQ ID NO: 400157 - DNA, 41 bp, Artificial Sequence
  Description of Artificial Sequence: Synthetic oligonucleotide
aattttcacctcaaatgttcatccagtgcaattggaagacg

SEQ ID NO: 400158 - DNA, 40 bp, Artificial Sequence
  Description of Artificial Sequence: Synthetic oligonucleotide
attttcacctcaaatgttcatccagtgcaattggaagacg

SEQ ID NO: 400159 - DNA, 39 bp, Artificial Sequence
  Description of Artificial Sequence: Synthetic oligonucleotide
ttttcacctcaaatgttcatccagtgcaattggaagacg

SEQ ID NO: 400160 - DNA, 38 bp, Artificial Sequence
  Description of Artificial Sequence: Synthetic oligonucleotide
tttcacctcaaatgttcatccagtgcaattggaagacg

SEQ ID NO: 400161 - DNA, 37 bp, Artificial Sequence
  Description of Artificial Sequence: Synthetic oligonucleotide
ttcacctcaaatgttcatccagtgcaattggaagacg

SEQ ID NO: 400162 - DNA, 36 bp, Artificial Sequence
  Description of Artificial Sequence: Synthetic oligonucleotide
tcacctcaaatgttcatccagtgcaattggaagacg

SEQ ID NO: 400163 - DNA, 35 bp, Artificial Sequence
  Description of Artificial Sequence: Synthetic oligonucleotide
cacctcaaatgttcatccagtgcaattggaagacg

SEQ ID NO: 400164 - DNA, 36 bp, Artificial Sequence
  Description of Artificial Sequence: Synthetic oligonucleotide
acctcaaatgttcatccagtgcaattggaagacgtc

SEQ ID NO: 400165 - DNA, 35 bp, Artificial Sequence
  Description of Artificial Sequence: Synthetic oligonucleotide
cctcaaatgttcatccagtgcaattggaagacgtc

SEQ ID NO: 400166 - DNA, 36 bp, Artificial Sequence
  Description of Artificial Sequence: Synthetic oligonucleotide
ctcaaatgttcatccagtgcaattggaagacgtcac

SEQ ID NO: 400167 - DNA, 37 bp, Artificial Sequence
  Description of Artificial Sequence: Synthetic oligonucleotide
tcaaatgttcatccagtgcaattggaagacgtcacag

SEQ ID NO: 400168 - DNA, 36 bp, Artificial Sequence
  Description of Artificial Sequence: Synthetic oligonucleotide
caaatgttcatccagtgcaattggaagacgtcacag

SEQ ID NO: 400169 - DNA, 37 bp, Artificial Sequence
  Description of Artificial Sequence: Synthetic oligonucleotide
aaatgttcatccagtgcaattggaagacgtcacagtg

SEQ ID NO: 400170 - DNA, 36 bp, Artificial Sequence
  Description of Artificial Sequence: Synthetic oligonucleotide
aatgttcatccagtgcaattggaagacgtcacagtg

SEQ ID NO: 400171 - DNA, 35 bp, Artificial Sequence
  Description of Artificial Sequence: Synthetic oligonucleotide
atgttcatccagtgcaattggaagacgtcacagtg

SEQ ID NO: 400172 - DNA, 34 bp, Artificial Sequence
  Description of Artificial Sequence: Synthetic oligonucleotide
tgttcatccagtgcaattggaagacgtcacagtg

SEQ ID NO: 400173 - DNA, 33 bp, Artificial Sequence
  Description of Artificial Sequence: Synthetic oligonucleotide
gttcatccagtgcaattggaagacgtcacagtg

SEQ ID NO: 400174 - DNA, 33 bp, Artificial Sequence
  Description of Artificial Sequence: Synthetic oligonucleotide
ttcatccagtgcaattggaagacgtcacagtgc

SEQ ID NO: 400175 - DNA, 32 bp, Artificial Sequence
  Description of Artificial Sequence: Synthetic oligonucleotide
tcatccagtgcaattggaagacgtcacagtgc

SEQ ID NO: 400176 - DNA, 31 bp, Artificial Sequence
  Description of Artificial Sequence: Synthetic oligonucleotide
catccagtgcaattggaagacgtcacagtgc

SEQ ID NO: 400177 - DNA, 31 bp, Artificial Sequence
  Description of Artificial Sequence: Synthetic oligonucleotide
atccagtgcaattggaagacgtcacagtgcc

SEQ ID NO: 400178 - DNA, 30 bp, Artificial Sequence
  Description of Artificial Sequence: Synthetic oligonucleotide
tccagtgcaattggaagacgtcacagtgcc

SEQ ID NO: 400179 - DNA, 29 bp, Artificial Sequence
  Description of Artificial Sequence: Synthetic oligonucleotide
ccagtgcaattggaagacgtcacagtgcc

SEQ ID NO: 400180 - DNA, 30 bp, Artificial Sequence
  Description of Artificial Sequence: Synthetic oligonucleotide
cagtgcaattggaagacgtcacagtgccag

SEQ ID NO: 400181 - DNA, 30 bp, Artificial Sequence
  Description of Artificial Sequence: Synthetic oligonucleotide
agtgcaattggaagacgtcacagtgccagg

SEQ ID NO: 400182 - DNA, 29 bp, Artificial Sequence
  Description of Artificial Sequence: Synthetic oligonucleotide
gtgcaattggaagacgtcacagtgccagg

SEQ ID NO: 400183 - DNA, 29 bp, Artificial Sequence
  Description of Artificial Sequence: Synthetic oligonucleotide
tgcaattggaagacgtcacagtgccaggc

SEQ ID NO: 400184 - DNA, 28 bp, Artificial Sequence
  Description of Artificial Sequence: Synthetic oligonucleotide
gcaattggaagacgtcacagtgccaggc

SEQ ID NO: 400185 - DNA, 29 bp, Artificial Sequence
  Description of Artificial Sequence: Synthetic oligonucleotide
caattggaagacgtcacagtgccaggcac

SEQ ID NO: 400186 - DNA, 30 bp, Artificial Sequence
  Description of Artificial Sequence: Synthetic oligonucleotide
aattggaagacgtcacagtgccaggcactg

SEQ ID NO: 400187 - DNA, 29 bp, Artificial Sequence
  Description of Artificial Sequence: Synthetic oligonucleotide
attggaagacgtcacagtgccaggcactg

SEQ ID NO: 400188 - DNA, 28 bp, Artificial Sequence
  Description of Artificial Sequence: Synthetic oligonucleotide
ttggaagacgtcacagtgccaggcactg

SEQ ID NO: 400189 - DNA, 27 bp, Artificial Sequence
  Description of Artificial Sequence: Synthetic oligonucleotide
tggaagacgtcacagtgccaggcactg

SEQ ID NO: 400190 - DNA, 26 bp, Artificial Sequence
  Description of Artificial Sequence: Synthetic oligonucleotide
ggaagacgtcacagtgccaggcactg

SEQ ID NO: 400191 - DNA, 27 bp, Artificial Sequence
  Description of Artificial Sequence: Synthetic oligonucleotide
gaagacgtcacagtgccaggcactgga

SEQ ID NO: 400192 - DNA, 29 bp, Artificial Sequence
  Description of Artificial Sequence: Synthetic oligonucleotide
aagacgtcacagtgccaggcactggattg

SEQ ID NO: 400193 - DNA, 28 bp, Artificial Sequence
  Description of Artificial Sequence: Synthetic oligonucleotide
agacgtcacagtgccaggcactggattg

SEQ ID NO: 400194 - DNA, 27 bp, Artificial Sequence
  Description of Artificial Sequence: Synthetic oligonucleotide
gacgtcacagtgccaggcactggattg

SEQ ID NO: 400195 - DNA, 28 bp, Artificial Sequence
  Description of Artificial Sequence: Synthetic oligonucleotide
acgtcacagtgccaggcactggattgag

SEQ ID NO: 400196 - DNA, 27 bp, Artificial Sequence
  Description of Artificial Sequence: Synthetic oligonucleotide
cgtcacagtgccaggcactggattgag

SEQ ID NO: 400197 - DNA, 29 bp, Artificial Sequence
  Description of Artificial Sequence: Synthetic oligonucleotide
gtcacagtgccaggcactggattgagaac

SEQ ID NO: 400198 - DNA, 29 bp, Artificial Sequence
  Description of Artificial Sequence: Synthetic oligonucleotide
tcacagtgccaggcactggattgagaacc

SEQ ID NO: 400199 - DNA, 28 bp, Artificial Sequence
  Description of Artificial Sequence: Synthetic oligonucleotide
cacagtgccaggcactggattgagaacc

SEQ ID NO: 400200 - DNA, 30 bp, Artificial Sequence
  Description of Artificial Sequence: Synthetic oligonucleotide
acagtgccaggcactggattgagaaccttc

SEQ ID NO: 400201 - DNA, 29 bp, Artificial Sequence
  Description of Artificial Sequence: Synthetic oligonucleotide
cagtgccaggcactggattgagaaccttc

SEQ ID NO: 400202 - DNA, 30 bp, Artificial Sequence
  Description of Artificial Sequence: Synthetic oligonucleotide
agtgccaggcactggattgagaaccttcac

SEQ ID NO: 400203 - DNA, 29 bp, Artificial Sequence
  Description of Artificial Sequence: Synthetic oligonucleotide
gtgccaggcactggattgagaaccttcac

SEQ ID NO: 400204 - DNA, 39 bp, Artificial Sequence
  Description of Artificial Sequence: Synthetic oligonucleotide
tgccaggcactggattgagaaccttcacaaaaaaaaatc

SEQ ID NO: 400205 - DNA, 38 bp, Artificial Sequence
  Description of Artificial Sequence: Synthetic oligonucleotide
gccaggcactggattgagaaccttcacaaaaaaaaatc

SEQ ID NO: 400206 - DNA, 39 bp, Artificial Sequence
  Description of Artificial Sequence: Synthetic oligonucleotide
ccaggcactggattgagaaccttcacaaaaaaaaatctg

SEQ ID NO: 400207 - DNA, 39 bp, Artificial Sequence
  Description of Artificial Sequence: Synthetic oligonucleotide
caggcactggattgagaaccttcacaaaaaaaaatctgc

SEQ ID NO: 400208 - DNA, 39 bp, Artificial Sequence
  Description of Artificial Sequence: Synthetic oligonucleotide
aggcactggattgagaaccttcacaaaaaaaaatctgcc

SEQ ID NO: 400209 - DNA, 38 bp, Artificial Sequence
  Description of Artificial Sequence: Synthetic oligonucleotide
ggcactggattgagaaccttcacaaaaaaaaatctgcc

SEQ ID NO: 400210 - DNA, 38 bp, Artificial Sequence
  Description of Artificial Sequence: Synthetic oligonucleotide
gcactggattgagaaccttcacaaaaaaaaatctgccc

SEQ ID NO: 400211 - DNA, 39 bp, Artificial Sequence
  Description of Artificial Sequence: Synthetic oligonucleotide
cactggattgagaaccttcacaaaaaaaaatctgcccag

SEQ ID NO: 400212 - DNA, 40 bp, Artificial Sequence
  Description of Artificial Sequence: Synthetic oligonucleotide
actggattgagaaccttcacaaaaaaaaatctgcccagag

SEQ ID NO: 400213 - DNA, 39 bp, Artificial Sequence
  Description of Artificial Sequence: Synthetic oligonucleotide
ctggattgagaaccttcacaaaaaaaaatctgcccagag

SEQ ID NO: 400214 - DNA, 40 bp, Artificial Sequence
  Description of Artificial Sequence: Synthetic oligonucleotide
tggattgagaaccttcacaaaaaaaaatctgcccagagac

SEQ ID NO: 400215 - DNA, 39 bp, Artificial Sequence
  Description of Artificial Sequence: Synthetic oligonucleotide
ggattgagaaccttcacaaaaaaaaatctgcccagagac

SEQ ID NO: 400216 - DNA, 40 bp, Artificial Sequence
  Description of Artificial Sequence: Synthetic oligonucleotide
gattgagaaccttcacaaaaaaaaatctgcccagagacag

SEQ ID NO: 400217 - DNA, 42 bp, Artificial Sequence
  Description of Artificial Sequence: Synthetic oligonucleotide
attgagaaccttcacaaaaaaaaatctgcccagagacagatg

SEQ ID NO: 400218 - DNA, 41 bp, Artificial Sequence
  Description of Artificial Sequence: Synthetic oligonucleotide
ttgagaaccttcacaaaaaaaaatctgcccagagacagatg

SEQ ID NO: 400219 - DNA, 40 bp, Artificial Sequence
  Description of Artificial Sequence: Synthetic oligonucleotide
tgagaaccttcacaaaaaaaaatctgcccagagacagatg

SEQ ID NO: 400220 - DNA, 39 bp, Artificial Sequence
  Description of Artificial Sequence: Synthetic oligonucleotide
gagaaccttcacaaaaaaaaatctgcccagagacagatg

SEQ ID NO: 400221 - DNA, 40 bp, Artificial Sequence
  Description of Artificial Sequence: Synthetic oligonucleotide
agaaccttcacaaaaaaaaatctgcccagagacagatgag

SEQ ID NO: 400222 - DNA, 39 bp, Artificial Sequence
  Description of Artificial Sequence: Synthetic oligonucleotide
gaaccttcacaaaaaaaaatctgcccagagacagatgag

SEQ ID NO: 400223 - DNA, 39 bp, Artificial Sequence
  Description of Artificial Sequence: Synthetic oligonucleotide
aaccttcacaaaaaaaaatctgcccagagacagatgagg

SEQ ID NO: 400224 - DNA, 38 bp, Artificial Sequence
  Description of Artificial Sequence: Synthetic oligonucleotide
accttcacaaaaaaaaatctgcccagagacagatgagg

SEQ ID NO: 400225 - DNA, 37 bp, Artificial Sequence
  Description of Artificial Sequence: Synthetic oligonucleotide
ccttcacaaaaaaaaatctgcccagagacagatgagg

SEQ ID NO: 400226 - DNA, 38 bp, Artificial Sequence
  Description of Artificial Sequence: Synthetic oligonucleotide
cttcacaaaaaaaaatctgcccagagacagatgaggtc

SEQ ID NO: 400227 - DNA, 38 bp, Artificial Sequence
  Description of Artificial Sequence: Synthetic oligonucleotide
ttcacaaaaaaaaatctgcccagagacagatgaggtcc

SEQ ID NO: 400228 - DNA, 37 bp, Artificial Sequence
  Description of Artificial Sequence: Synthetic oligonucleotide
tcacaaaaaaaaatctgcccagagacagatgaggtcc

SEQ ID NO: 400229 - DNA, 36 bp, Artificial Sequence
  Description of Artificial Sequence: Synthetic oligonucleotide
cacaaaaaaaaatctgcccagagacagatgaggtcc

SEQ ID NO: 400230 - DNA, 38 bp, Artificial Sequence
  Description of Artificial Sequence: Synthetic oligonucleotide
acaaaaaaaaatctgcccagagacagatgaggtccttc

SEQ ID NO: 400231 - DNA, 37 bp, Artificial Sequence
  Description of Artificial Sequence: Synthetic oligonucleotide
caaaaaaaaatctgcccagagacagatgaggtccttc

SEQ ID NO: 400232 - DNA, 31 bp, Artificial Sequence
  Description of Artificial Sequence: Synthetic oligonucleotide
caatcctaccacgcatggaaacatccacagg

SEQ ID NO: 400233 - DNA, 39 bp, Artificial Sequence
  Description of Artificial Sequence: Synthetic oligonucleotide
aatcctaccacgcatggaaacatccacaggtttttattc

SEQ ID NO: 400234 - DNA, 38 bp, Artificial Sequence
  Description of Artificial Sequence: Synthetic oligonucleotide
atcctaccacgcatggaaacatccacaggtttttattc

SEQ ID NO: 400235 - DNA, 37 bp, Artificial Sequence
  Description of Artificial Sequence: Synthetic oligonucleotide
tcctaccacgcatggaaacatccacaggtttttattc

SEQ ID NO: 400236 - DNA, 36 bp, Artificial Sequence
  Description of Artificial Sequence: Synthetic oligonucleotide
cctaccacgcatggaaacatccacaggtttttattc

SEQ ID NO: 400237 - DNA, 39 bp, Artificial Sequence
  Description of Artificial Sequence: Synthetic oligonucleotide
ctaccacgcatggaaacatccacaggtttttattctttc

SEQ ID NO: 400238 - DNA, 40 bp, Artificial Sequence
  Description of Artificial Sequence: Synthetic oligonucleotide
taccacgcatggaaacatccacaggtttttattctttctg

SEQ ID NO: 400239 - DNA, 39 bp, Artificial Sequence
  Description of Artificial Sequence: Synthetic oligonucleotide
accacgcatggaaacatccacaggtttttattctttctg

SEQ ID NO: 400240 - DNA, 38 bp, Artificial Sequence
  Description of Artificial Sequence: Synthetic oligonucleotide
ccacgcatggaaacatccacaggtttttattctttctg

SEQ ID NO: 400241 - DNA, 38 bp, Artificial Sequence
  Description of Artificial Sequence: Synthetic oligonucleotide
cacgcatggaaacatccacaggtttttattctttctgc

SEQ ID NO: 400242 - DNA, 38 bp, Artificial Sequence
  Description of Artificial Sequence: Synthetic oligonucleotide
acgcatggaaacatccacaggtttttattctttctgcc

SEQ ID NO: 400243 - DNA, 37 bp, Artificial Sequence
  Description of Artificial Sequence: Synthetic oligonucleotide
cgcatggaaacatccacaggtttttattctttctgcc

SEQ ID NO: 400244 - DNA, 38 bp, Artificial Sequence
  Description of Artificial Sequence: Synthetic oligonucleotide
gcatggaaacatccacaggtttttattctttctgccag

SEQ ID NO: 400245 - DNA, 38 bp, Artificial Sequence
  Description of Artificial Sequence: Synthetic oligonucleotide
catggaaacatccacaggtttttattctttctgccagg

SEQ ID NO: 400246 - DNA, 40 bp, Artificial Sequence
  Description of Artificial Sequence: Synthetic oligonucleotide
atggaaacatccacaggtttttattctttctgccaggtac

SEQ ID NO: 400247 - DNA, 39 bp, Artificial Sequence
  Description of Artificial Sequence: Synthetic oligonucleotide
tggaaacatccacaggtttttattctttctgccaggtac

SEQ ID NO: 400248 - DNA, 38 bp, Artificial Sequence
  Description of Artificial Sequence: Synthetic oligonucleotide
ggaaacatccacaggtttttattctttctgccaggtac

SEQ ID NO: 400249 - DNA, 40 bp, Artificial Sequence
  Description of Artificial Sequence: Synthetic oligonucleotide
gaaacatccacaggtttttattctttctgccaggtacatc

SEQ ID NO: 400250 - DNA, 41 bp, Artificial Sequence
  Description of Artificial Sequence: Synthetic oligonucleotide
aaacatccacaggtttttattctttctgccaggtacatcag

SEQ ID NO: 400251 - DNA, 40 bp, Artificial Sequence
  Description of Artificial Sequence: Synthetic oligonucleotide
aacatccacaggtttttattctttctgccaggtacatcag

SEQ ID NO: 400252 - DNA, 39 bp, Artificial Sequence
  Description of Artificial Sequence: Synthetic oligonucleotide
acatccacaggtttttattctttctgccaggtacatcag

SEQ ID NO: 400253 - DNA, 38 bp, Artificial Sequence
  Description of Artificial Sequence: Synthetic oligonucleotide
catccacaggtttttattctttctgccaggtacatcag

SEQ ID NO: 400254 - DNA, 40 bp, Artificial Sequence
  Description of Artificial Sequence: Synthetic oligonucleotide
atccacaggtttttattctttctgccaggtacatcagatc

SEQ ID NO: 400255 - DNA, 39 bp, Artificial Sequence
  Description of Artificial Sequence: Synthetic oligonucleotide
tccacaggtttttattctttctgccaggtacatcagatc

SEQ ID NO: 400256 - DNA, 38 bp, Artificial Sequence
  Description of Artificial Sequence: Synthetic oligonucleotide
ccacaggtttttattctttctgccaggtacatcagatc

SEQ ID NO: 400257 - DNA, 38 bp, Artificial Sequence
  Description of Artificial Sequence: Synthetic oligonucleotide
cacaggtttttattctttctgccaggtacatcagatcc

SEQ ID NO: 400258 - DNA, 40 bp, Artificial Sequence
  Description of Artificial Sequence: Synthetic oligonucleotide
acaggtttttattctttctgccaggtacatcagatccatc

SEQ ID NO: 400259 - DNA, 39 bp, Artificial Sequence
  Description of Artificial Sequence: Synthetic oligonucleotide
caggtttttattctttctgccaggtacatcagatccatc

SEQ ID NO: 400260 - DNA, 40 bp, Artificial Sequence
  Description of Artificial Sequence: Synthetic oligonucleotide
aggtttttattctttctgccaggtacatcagatccatcag

SEQ ID NO: 400261 - DNA, 39 bp, Artificial Sequence
  Description of Artificial Sequence: Synthetic oligonucleotide
ggtttttattctttctgccaggtacatcagatccatcag

SEQ ID NO: 400262 - DNA, 39 bp, Artificial Sequence
  Description of Artificial Sequence: Synthetic oligonucleotide
gtttttattctttctgccaggtacatcagatccatcagg

SEQ ID NO: 400263 - DNA, 31 bp, Artificial Sequence
  Description of Artificial Sequence: Synthetic oligonucleotide
atcaggtccgagctgtgttgactaccactac

SEQ ID NO: 400264 - DNA, 30 bp, Artificial Sequence
  Description of Artificial Sequence: Synthetic oligonucleotide
tcaggtccgagctgtgttgactaccactac

SEQ ID NO: 400265 - DNA, 29 bp, Artificial Sequence
  Description of Artificial Sequence: Synthetic oligonucleotide
caggtccgagctgtgttgactaccactac

SEQ ID NO: 400266 - DNA, 33 bp, Artificial Sequence
  Description of Artificial Sequence: Synthetic oligonucleotide
aggtccgagctgtgttgactaccactacttttc

SEQ ID NO: 400267 - DNA, 32 bp, Artificial Sequence
  Description of Artificial Sequence: Synthetic oligonucleotide
ggtccgagctgtgttgactaccactacttttc

SEQ ID NO: 400268 - DNA, 32 bp, Artificial Sequence
  Description of Artificial Sequence: Synthetic oligonucleotide
gtccgagctgtgttgactaccactacttttcc

SEQ ID NO: 400269 - DNA, 32 bp, Artificial Sequence
  Description of Artificial Sequence: Synthetic oligonucleotide
tccgagctgtgttgactaccactacttttccc

SEQ ID NO: 400270 - DNA, 31 bp, Artificial Sequence
  Description of Artificial Sequence: Synthetic oligonucleotide
ccgagctgtgttgactaccactacttttccc

SEQ ID NO: 400271 - DNA, 33 bp, Artificial Sequence
  Description of Artificial Sequence: Synthetic oligonucleotide
cgagctgtgttgactaccactacttttcccttc

SEQ ID NO: 400272 - DNA, 33 bp, Artificial Sequence
  Description of Artificial Sequence: Synthetic oligonucleotide
gagctgtgttgactaccactacttttcccttcg

SEQ ID NO: 400273 - DNA, 34 bp, Artificial Sequence
  Description of Artificial Sequence: Synthetic oligonucleotide
agctgtgttgactaccactacttttcccttcgtc

SEQ ID NO: 400274 - DNA, 33 bp, Artificial Sequence
  Description of Artificial Sequence: Synthetic oligonucleotide
gctgtgttgactaccactacttttcccttcgtc

SEQ ID NO: 400275 - DNA, 34 bp, Artificial Sequence
  Description of Artificial Sequence: Synthetic oligonucleotide
ctgtgttgactaccactacttttcccttcgtctc

SEQ ID NO: 400276 - DNA, 40 bp, Artificial Sequence
  Description of Artificial Sequence: Synthetic oligonucleotide
tgtgttgactaccactacttttcccttcgtctcaattatg

SEQ ID NO: 400277 - DNA, 39 bp, Artificial Sequence
  Description of Artificial Sequence: Synthetic oligonucleotide
gtgttgactaccactacttttcccttcgtctcaattatg

SEQ ID NO: 400278 - DNA, 40 bp, Artificial Sequence
  Description of Artificial Sequence: Synthetic oligonucleotide
tgttgactaccactacttttcccttcgtctcaattatgtc

SEQ ID NO: 400279 - DNA, 39 bp, Artificial Sequence
  Description of Artificial Sequence: Synthetic oligonucleotide
gttgactaccactacttttcccttcgtctcaattatgtc

SEQ ID NO: 400280 - DNA, 41 bp, Artificial Sequence
  Description of Artificial Sequence: Synthetic oligonucleotide
ttgactaccactacttttcccttcgtctcaattatgtcttg

SEQ ID NO: 400281 - DNA, 40 bp, Artificial Sequence
  Description of Artificial Sequence: Synthetic oligonucleotide
tgactaccactacttttcccttcgtctcaattatgtcttg

SEQ ID NO: 400282 - DNA, 39 bp, Artificial Sequence
  Description of Artificial Sequence: Synthetic oligonucleotide
gactaccactacttttcccttcgtctcaattatgtcttg

SEQ ID NO: 400283 - DNA, 39 bp, Artificial Sequence
  Description of Artificial Sequence: Synthetic oligonucleotide
actaccactacttttcccttcgtctcaattatgtcttgg

SEQ ID NO: 400284 - DNA, 38 bp, Artificial Sequence
  Description of Artificial Sequence: Synthetic oligonucleotide
ctaccactacttttcccttcgtctcaattatgtcttgg

SEQ ID NO: 400285 - DNA, 43 bp, Artificial Sequence
  Description of Artificial Sequence: Synthetic oligonucleotide
taccactacttttcccttcgtctcaattatgtcttggaaaaag

SEQ ID NO: 400286 - DNA, 42 bp, Artificial Sequence
  Description of Artificial Sequence: Synthetic oligonucleotide
accactacttttcccttcgtctcaattatgtcttggaaaaag

SEQ ID NO: 400287 - DNA, 41 bp, Artificial Sequence
  Description of Artificial Sequence: Synthetic oligonucleotide
ccactacttttcccttcgtctcaattatgtcttggaaaaag

SEQ ID NO: 400288 - DNA, 41 bp, Artificial Sequence
  Description of Artificial Sequence: Synthetic oligonucleotide
cactacttttcccttcgtctcaattatgtcttggaaaaagg

SEQ ID NO: 400289 - DNA, 41 bp, Artificial Sequence
  Description of Artificial Sequence: Synthetic oligonucleotide
actacttttcccttcgtctcaattatgtcttggaaaaaggc

SEQ ID NO: 400290 - DNA, 40 bp, Artificial Sequence
  Description of Artificial Sequence: Synthetic oligonucleotide
ctacttttcccttcgtctcaattatgtcttggaaaaaggc

SEQ ID NO: 400291 - DNA, 43 bp, Artificial Sequence
  Description of Artificial Sequence: Synthetic oligonucleotide
tacttttcccttcgtctcaattatgtcttggaaaaaggctttg

SEQ ID NO: 400292 - DNA, 26 bp, Artificial Sequence
  Description of Artificial Sequence: Synthetic oligonucleotide
cggaggccttcgggcagcaactgtta

SEQ ID NO: 400293 - DNA, 26 bp, Artificial Sequence
  Description of Artificial Sequence: Synthetic oligonucleotide
ggaggccttcgggcagcaactgttac

SEQ ID NO: 400294 - DNA, 27 bp, Artificial Sequence
  Description of Artificial Sequence: Synthetic oligonucleotide
gaggccttcgggcagcaactgttacct

SEQ ID NO: 400295 - DNA, 28 bp, Artificial Sequence
  Description of Artificial Sequence: Synthetic oligonucleotide
aggccttcgggcagcaactgttaccttg

SEQ ID NO: 400296 - DNA, 27 bp, Artificial Sequence
  Description of Artificial Sequence: Synthetic oligonucleotide
ggccttcgggcagcaactgttaccttg

SEQ ID NO: 400297 - DNA, 29 bp, Artificial Sequence
  Description of Artificial Sequence: Synthetic oligonucleotide
gccttcgggcagcaactgttaccttgatg

SEQ ID NO: 400298 - DNA, 29 bp, Artificial Sequence
  Description of Artificial Sequence: Synthetic oligonucleotide
ccttcgggcagcaactgttaccttgatgc

SEQ ID NO: 400299 - DNA, 30 bp, Artificial Sequence; identical to SEQ ID NO: 58881
  Description of Artificial Sequence: Synthetic oligonucleotide

SEQ ID NO: 400300 - DNA, 30 bp, Artificial Sequence; identical to SEQ ID NO: 58882
  Description of Artificial Sequence: Synthetic oligonucleotide

SEQ ID NO: 400301 - DNA, 29 bp, Artificial Sequence
  Description of Artificial Sequence: Synthetic oligonucleotide
tcgggcagcaactgttaccttgatgctgg

SEQ ID NO: 400302 - DNA, 28 bp, Artificial Sequence
  Description of Artificial Sequence: Synthetic oligonucleotide
cgggcagcaactgttaccttgatgctgg

SEQ ID NO: 400303 - DNA, 28 bp, Artificial Sequence
  Description of Artificial Sequence: Synthetic oligonucleotide
gggcagcaactgttaccttgatgctggc

SEQ ID NO: 400304 - DNA, 28 bp, Artificial Sequence
  Description of Artificial Sequence: Synthetic oligonucleotide
ggcagcaactgttaccttgatgctggcg

SEQ ID NO: 400305 - DNA, 30 bp, Artificial Sequence; identical to SEQ ID NO: 58887
  Description of Artificial Sequence: Synthetic oligonucleotide

SEQ ID NO: 400306 - DNA, 30 bp, Artificial Sequence; identical to SEQ ID NO: 58888
  Description of Artificial Sequence: Synthetic oligonucleotide

SEQ ID NO: 400307 - DNA, 31 bp, Artificial Sequence; identical to SEQ ID NO: 58889
  Description of Artificial Sequence: Synthetic oligonucleotide

SEQ ID NO: 400308 - DNA, 30 bp, Artificial Sequence; identical to SEQ ID NO: 58890
  Description of Artificial Sequence: Synthetic oligonucleotide

SEQ ID NO: 400309 - DNA, 31 bp, Artificial Sequence; identical to SEQ ID NO: 58891
  Description of Artificial Sequence: Synthetic oligonucleotide

SEQ ID NO: 400310 - DNA, 31 bp, Artificial Sequence; identical to SEQ ID NO: 58892
  Description of Artificial Sequence: Synthetic oligonucleotide

SEQ ID NO: 400311 - DNA, 30 bp, Artificial Sequence; identical to SEQ ID NO: 58893
  Description of Artificial Sequence: Synthetic oligonucleotide

SEQ ID NO: 400312 - DNA, 29 bp, Artificial Sequence
  Description of Artificial Sequence: Synthetic oligonucleotide
ctgttaccttgatgctggcgatgctgagc

SEQ ID NO: 400313 - DNA, 30 bp, Artificial Sequence; identical to SEQ ID NO: 58895
  Description of Artificial Sequence: Synthetic oligonucleotide

SEQ ID NO: 400314 - DNA, 29 bp, Artificial Sequence
  Description of Artificial Sequence: Synthetic oligonucleotide
gttaccttgatgctggcgatgctgagcac

SEQ ID NO: 400315 - DNA, 29 bp, Artificial Sequence
  Description of Artificial Sequence: Synthetic oligonucleotide
ttaccttgatgctggcgatgctgagcacc

SEQ ID NO: 400316 - DNA, 28 bp, Artificial Sequence
  Description of Artificial Sequence: Synthetic oligonucleotide
taccttgatgctggcgatgctgagcacc

SEQ ID NO: 400317 - DNA, 27 bp, Artificial Sequence
  Description of Artificial Sequence: Synthetic oligonucleotide
accttgatgctggcgatgctgagcacc

SEQ ID NO: 400318 - DNA, 26 bp, Artificial Sequence
  Description of Artificial Sequence: Synthetic oligonucleotide
ccttgatgctggcgatgctgagcacc

SEQ ID NO: 400319 - DNA, 26 bp, Artificial Sequence
  Description of Artificial Sequence: Synthetic oligonucleotide
cttgatgctggcgatgctgagcaccc

SEQ ID NO: 400320 - DNA, 27 bp, Artificial Sequence
  Description of Artificial Sequence: Synthetic oligonucleotide
ttgatgctggcgatgctgagcacccca

SEQ ID NO: 400321 - DNA, 26 bp, Artificial Sequence
  Description of Artificial Sequence: Synthetic oligonucleotide
tgatgctggcgatgctgagcacccca

SEQ ID NO: 400322 - DNA, 25 bp, Artificial Sequence
  Description of Artificial Sequence: Synthetic oligonucleotide
gatgctggcgatgctgagcacccca

SEQ ID NO: 400323 - DNA, 26 bp, Artificial Sequence
  Description of Artificial Sequence: Synthetic oligonucleotide
atgctggcgatgctgagcaccccagt

SEQ ID NO: 400324 - DNA, 25 bp, Artificial Sequence
  Description of Artificial Sequence: Synthetic oligonucleotide
tgctggcgatgctgagcaccccagt

SEQ ID NO: 400325 - DNA, 24 bp, Artificial Sequence
  Description of Artificial Sequence: Synthetic oligonucleotide
gctggcgatgctgagcaccccagt

SEQ ID NO: 400326 - DNA, 24 bp, Artificial Sequence
  Description of Artificial Sequence: Synthetic oligonucleotide
ctggcgatgctgagcaccccagtg

SEQ ID NO: 400327 - DNA, 24 bp, Artificial Sequence
  Description of Artificial Sequence: Synthetic oligonucleotide
tggcgatgctgagcaccccagtgg

SEQ ID NO: 400328 - DNA, 23 bp, Artificial Sequence
  Description of Artificial Sequence: Synthetic oligonucleotide
ggcgatgctgagcaccccagtgg

SEQ ID NO: 400329 - DNA, 24 bp, Artificial Sequence
  Description of Artificial Sequence: Synthetic oligonucleotide
gcgatgctgagcaccccagtggct

SEQ ID NO: 400330 - DNA, 32 bp, Artificial Sequence; identical to SEQ ID NO: 58912
  Description of Artificial Sequence: Synthetic oligonucleotide

SEQ ID NO: 400331 - DNA, 31 bp, Artificial Sequence; identical to SEQ ID NO: 58913
  Description of Artificial Sequence: Synthetic oligonucleotide

SEQ ID NO: 400332 - DNA, 31 bp, Artificial Sequence; identical to SEQ ID NO: 58914
  Description of Artificial Sequence: Synthetic oligonucleotide

SEQ ID NO: 400333 - DNA, 30 bp, Artificial Sequence; identical to SEQ ID NO: 58915
  Description of Artificial Sequence: Synthetic oligonucleotide

SEQ ID NO: 400334 - DNA, 32 bp, Artificial Sequence; identical to SEQ ID NO: 58916
  Description of Artificial Sequence: Synthetic oligonucleotide

SEQ ID NO: 400335 - DNA, 33 bp, Artificial Sequence; identical to SEQ ID NO: 58917
  Description of Artificial Sequence: Synthetic oligonucleotide

SEQ ID NO: 400336 - DNA, 33 bp, Artificial Sequence; identical to SEQ ID NO: 58918
  Description of Artificial Sequence: Synthetic oligonucleotide

SEQ ID NO: 400337 - DNA, 35 bp, Artificial Sequence; identical to SEQ ID NO: 58919
  Description of Artificial Sequence: Synthetic oligonucleotide

SEQ ID NO: 400338 - DNA, 34 bp, Artificial Sequence; identical to SEQ ID NO: 58920
  Description of Artificial Sequence: Synthetic oligonucleotide

SEQ ID NO: 400339 - DNA, 36 bp, Artificial Sequence; identical to SEQ ID NO: 58921
  Description of Artificial Sequence: Synthetic oligonucleotide

SEQ ID NO: 400340 - DNA, 37 bp, Artificial Sequence; identical to SEQ ID NO: 58922
  Description of Artificial Sequence: Synthetic oligonucleotide

SEQ ID NO: 400341 - DNA, 36 bp, Artificial Sequence; identical to SEQ ID NO: 58923
  Description of Artificial Sequence: Synthetic oligonucleotide

SEQ ID NO: 400342 - DNA, 35 bp, Artificial Sequence; identical to SEQ ID NO: 58924
  Description of Artificial Sequence: Synthetic oligonucleotide

SEQ ID NO: 400343 - DNA, 34 bp, Artificial Sequence; identical to SEQ ID NO: 58925
  Description of Artificial Sequence: Synthetic oligonucleotide

SEQ ID NO: 400344 - DNA, 33 bp, Artificial Sequence; identical to SEQ ID NO: 58926
  Description of Artificial Sequence: Synthetic oligonucleotide

SEQ ID NO: 400345 - DNA, 33 bp, Artificial Sequence; identical to SEQ ID NO: 58927
  Description of Artificial Sequence: Synthetic oligonucleotide

SEQ ID NO: 400346 - DNA, 35 bp, Artificial Sequence; identical to SEQ ID NO: 58928
  Description of Artificial Sequence: Synthetic oligonucleotide

SEQ ID NO: 400347 - DNA, 34 bp, Artificial Sequence; identical to SEQ ID NO: 58929
  Description of Artificial Sequence: Synthetic oligonucleotide

SEQ ID NO: 400348 - DNA, 34 bp, Artificial Sequence; identical to SEQ ID NO: 58930
  Description of Artificial Sequence: Synthetic oligonucleotide

SEQ ID NO: 400349 - DNA, 33 bp, Artificial Sequence; identical to SEQ ID NO: 58931
  Description of Artificial Sequence: Synthetic oligonucleotide

SEQ ID NO: 400350 - DNA, 32 bp, Artificial Sequence; identical to SEQ ID NO: 58932
  Description of Artificial Sequence: Synthetic oligonucleotide

SEQ ID NO: 400351 - DNA, 32 bp, Artificial Sequence; identical to SEQ ID NO: 58933
  Description of Artificial Sequence: Synthetic oligonucleotide

SEQ ID NO: 400352 - DNA, 32 bp, Artificial Sequence; identical to SEQ ID NO: 58934
  Description of Artificial Sequence: Synthetic oligonucleotide

SEQ ID NO: 400353 - DNA, 31 bp, Artificial Sequence; identical to SEQ ID NO: 58935
  Description of Artificial Sequence: Synthetic oligonucleotide

SEQ ID NO: 400354 - DNA, 32 bp, Artificial Sequence; identical to SEQ ID NO: 58936
  Description of Artificial Sequence: Synthetic oligonucleotide

SEQ ID NO: 400355 - DNA, 31 bp, Artificial Sequence; identical to SEQ ID NO: 58937
  Description of Artificial Sequence: Synthetic oligonucleotide

SEQ ID NO: 400356 - DNA, 30 bp, Artificial Sequence; identical to SEQ ID NO: 58938
  Description of Artificial Sequence: Synthetic oligonucleotide

SEQ ID NO: 400357 - DNA, 29 bp, Artificial Sequence
  Description of Artificial Sequence: Synthetic oligonucleotide
aaggccatgtgctacttcaccaacgggac

SEQ ID NO: 400358 - DNA, 28 bp, Artificial Sequence
  Description of Artificial Sequence: Synthetic oligonucleotide
aggccatgtgctacttcaccaacgggac

SEQ ID NO: 400359 - DNA, 27 bp, Artificial Sequence
  Description of Artificial Sequence: Synthetic oligonucleotide
ggccatgtgctacttcaccaacgggac

SEQ ID NO: 400360 - DNA, 27 bp, Artificial Sequence
  Description of Artificial Sequence: Synthetic oligonucleotide
gccatgtgctacttcaccaacgggacg

SEQ ID NO: 400361 - DNA, 27 bp, Artificial Sequence
  Description of Artificial Sequence: Synthetic oligonucleotide
ccatgtgctacttcaccaacgggacgg

SEQ ID NO: 400362 - DNA, 28 bp, Artificial Sequence
  Description of Artificial Sequence: Synthetic oligonucleotide
catgtgctacttcaccaacgggacggag

SEQ ID NO: 400363 - DNA, 28 bp, Artificial Sequence
  Description of Artificial Sequence: Synthetic oligonucleotide
atgtgctacttcaccaacgggacggagc

SEQ ID NO: 400364 - DNA, 27 bp, Artificial Sequence
  Description of Artificial Sequence: Synthetic oligonucleotide
tgtgctacttcaccaacgggacggagc

SEQ ID NO: 400365 - DNA, 26 bp, Artificial Sequence
  Description of Artificial Sequence: Synthetic oligonucleotide
gtgctacttcaccaacgggacggagc

SEQ ID NO: 400366 - DNA, 26 bp, Artificial Sequence
  Description of Artificial Sequence: Synthetic oligonucleotide
tgctacttcaccaacgggacggagcg

SEQ ID NO: 400367 - DNA, 25 bp, Artificial Sequence
  Description of Artificial Sequence: Synthetic oligonucleotide
gctacttcaccaacgggacggagcg

SEQ ID NO: 400368 - DNA, 25 bp, Artificial Sequence
  Description of Artificial Sequence: Synthetic oligonucleotide
ctacttcaccaacgggacggagcgc

SEQ ID NO: 400369 - DNA, 26 bp, Artificial Sequence
  Description of Artificial Sequence: Synthetic oligonucleotide
tacttcaccaacgggacggagcgcgt

SEQ ID NO: 400370 - DNA, 25 bp, Artificial Sequence
  Description of Artificial Sequence: Synthetic oligonucleotide
acttcaccaacgggacggagcgcgt

SEQ ID NO: 400371 - DNA, 24 bp, Artificial Sequence
  Description of Artificial Sequence: Synthetic oligonucleotide
cttcaccaacgggacggagcgcgt

SEQ ID NO: 400372 - DNA, 24 bp, Artificial Sequence
  Description of Artificial Sequence: Synthetic oligonucleotide
ttcaccaacgggacggagcgcgtg

SEQ ID NO: 400373 - DNA, 23 bp, Artificial Sequence
  Description of Artificial Sequence: Synthetic oligonucleotide
tcaccaacgggacggagcgcgtg

SEQ ID NO: 400374 - DNA, 22 bp, Artificial Sequence
  Description of Artificial Sequence: Synthetic oligonucleotide
caccaacgggacggagcgcgtg

SEQ ID NO: 400375 - DNA, 22 bp, Artificial Sequence
  Description of Artificial Sequence: Synthetic oligonucleotide
accaacgggacggagcgcgtgc

SEQ ID NO: 400376 - DNA, 21 bp, Artificial Sequence
  Description of Artificial Sequence: Synthetic oligonucleotide
ccaacgggacggagcgcgtgc

SEQ ID NO: 400377 - DNA, 25 bp, Artificial Sequence
  Description of Artificial Sequence: Synthetic oligonucleotide
caacgggacggagcgcgtgcgttat

SEQ ID NO: 400378 - DNA, 26 bp, Artificial Sequence
  Description of Artificial Sequence: Synthetic oligonucleotide
aacgggacggagcgcgtgcgttatgt

SEQ ID NO: 400379 - DNA, 25 bp, Artificial Sequence
  Description of Artificial Sequence: Synthetic oligonucleotide
acgggacggagcgcgtgcgttatgt

SEQ ID NO: 400380 - DNA, 24 bp, Artificial Sequence
  Description of Artificial Sequence: Synthetic oligonucleotide
cgggacggagcgcgtgcgttatgt

SEQ ID NO: 400381 - DNA, 25 bp, Artificial Sequence
  Description of Artificial Sequence: Synthetic oligonucleotide
gggacggagcgcgtgcgttatgtga

SEQ ID NO: 400382 - DNA, 25 bp, Artificial Sequence
  Description of Artificial Sequence: Synthetic oligonucleotide
ggacggagcgcgtgcgttatgtgac

SEQ ID NO: 400383 - DNA, 26 bp, Artificial Sequence
  Description of Artificial Sequence: Synthetic oligonucleotide
gacggagcgcgtgcgttatgtgacca

SEQ ID NO: 400384 - DNA, 27 bp, Artificial Sequence
  Description of Artificial Sequence: Synthetic oligonucleotide
acggagcgcgtgcgttatgtgaccaga

SEQ ID NO: 400385 - DNA, 27 bp, Artificial Sequence
  Description of Artificial Sequence: Synthetic oligonucleotide
cggagcgcgtgcgttatgtgaccagat

SEQ ID NO: 400386 - DNA, 28 bp, Artificial Sequence
  Description of Artificial Sequence: Synthetic oligonucleotide
ggagcgcgtgcgttatgtgaccagatac

SEQ ID NO: 400387 - DNA, 30 bp, Artificial Sequence; identical to SEQ ID NO: 58969
  Description of Artificial Sequence: Synthetic oligonucleotide

SEQ ID NO: 400388 - DNA, 35 bp, Artificial Sequence; identical to SEQ ID NO: 58970
  Description of Artificial Sequence: Synthetic oligonucleotide

SEQ ID NO: 400389 - DNA, 34 bp, Artificial Sequence; identical to SEQ ID NO: 58971
  Description of Artificial Sequence: Synthetic oligonucleotide

SEQ ID NO: 400390 - DNA, 34 bp, Artificial Sequence; identical to SEQ ID NO: 58972
  Description of Artificial Sequence: Synthetic oligonucleotide

SEQ ID NO: 400391 - DNA, 34 bp, Artificial Sequence; identical to SEQ ID NO: 58973
  Description of Artificial Sequence: Synthetic oligonucleotide

SEQ ID NO: 400392 - DNA, 35 bp, Artificial Sequence; identical to SEQ ID NO: 58974
  Description of Artificial Sequence: Synthetic oligonucleotide

SEQ ID NO: 400393 - DNA, 36 bp, Artificial Sequence; identical to SEQ ID NO: 58975
  Description of Artificial Sequence: Synthetic oligonucleotide

SEQ ID NO: 400394 - DNA, 36 bp, Artificial Sequence; identical to SEQ ID NO: 58976
  Description of Artificial Sequence: Synthetic oligonucleotide

SEQ ID NO: 400395 - DNA, 35 bp, Artificial Sequence; identical to SEQ ID NO: 58977
  Description of Artificial Sequence: Synthetic oligonucleotide

SEQ ID NO: 400396 - DNA, 36 bp, Artificial Sequence; identical to SEQ ID NO: 58978
  Description of Artificial Sequence: Synthetic oligonucleotide

SEQ ID NO: 400397 - DNA, 38 bp, Artificial Sequence; identical to SEQ ID NO: 58979
  Description of Artificial Sequence: Synthetic oligonucleotide

SEQ ID NO: 400398 - DNA, 38 bp, Artificial Sequence; identical to SEQ ID NO: 58980
  Description of Artificial Sequence: Synthetic oligonucleotide

SEQ ID NO: 400399 - DNA, 37 bp, Artificial Sequence; identical to SEQ ID NO: 58981
  Description of Artificial Sequence: Synthetic oligonucleotide

SEQ ID NO: 400400 - DNA, 36 bp, Artificial Sequence; identical to SEQ ID NO: 58982
  Description of Artificial Sequence: Synthetic oligonucleotide

SEQ ID NO: 400401 - DNA, 35 bp, Artificial Sequence; identical to SEQ ID NO: 58983
  Description of Artificial Sequence: Synthetic oligonucleotide

SEQ ID NO: 400402 - DNA, 34 bp, Artificial Sequence; identical to SEQ ID NO: 58984
  Description of Artificial Sequence: Synthetic oligonucleotide

SEQ ID NO: 400403 - DNA, 34 bp, Artificial Sequence; identical to SEQ ID NO: 58985
  Description of Artificial Sequence: Synthetic oligonucleotide

SEQ ID NO: 400404 - DNA, 33 bp, Artificial Sequence; identical to SEQ ID NO: 58986
  Description of Artificial Sequence: Synthetic oligonucleotide

SEQ ID NO: 400405 - DNA, 34 bp, Artificial Sequence; identical to SEQ ID NO: 58987
  Description of Artificial Sequence: Synthetic oligonucleotide

SEQ ID NO: 400406 - DNA, 33 bp, Artificial Sequence; identical to SEQ ID NO: 58988
  Description of Artificial Sequence: Synthetic oligonucleotide

SEQ ID NO: 400407 - DNA, 33 bp, Artificial Sequence; identical to SEQ ID NO: 58989
  Description of Artificial Sequence: Synthetic oligonucleotide

SEQ ID NO: 400408 - DNA, 33 bp, Artificial Sequence; identical to SEQ ID NO: 58990
  Description of Artificial Sequence: Synthetic oligonucleotide

SEQ ID NO: 400409 - DNA, 32 bp, Artificial Sequence; identical to SEQ ID NO: 58991
  Description of Artificial Sequence: Synthetic oligonucleotide

SEQ ID NO: 400410 - DNA, 34 bp, Artificial Sequence; identical to SEQ ID NO: 58992
  Description of Artificial Sequence: Synthetic oligonucleotide

SEQ ID NO: 400411 - DNA, 33 bp, Artificial Sequence; identical to SEQ ID NO: 58993
  Description of Artificial Sequence: Synthetic oligonucleotide

SEQ ID NO: 400412 - DNA, 32 bp, Artificial Sequence; identical to SEQ ID NO: 58994
  Description of Artificial Sequence: Synthetic oligonucleotide

SEQ ID NO: 400413 - DNA, 31 bp, Artificial Sequence; identical to SEQ ID NO: 58995
  Description of Artificial Sequence: Synthetic oligonucleotide

SEQ ID NO: 400414 - DNA, 31 bp, Artificial Sequence; identical to SEQ ID NO: 58996
  Description of Artificial Sequence: Synthetic oligonucleotide

SEQ ID NO: 400415 - DNA, 30 bp, Artificial Sequence; identical to SEQ ID NO: 58997
  Description of Artificial Sequence: Synthetic oligonucleotide

SEQ ID NO: 400416 - DNA, 29 bp, Artificial Sequence
  Description of Artificial Sequence: Synthetic oligonucleotide
ctataaccgagaggagtacgcacgcttcg

SEQ ID NO: 400417 - DNA, 30 bp, Artificial Sequence; identical to SEQ ID NO: 58999
  Description of Artificial Sequence: Synthetic oligonucleotide

SEQ ID NO: 400418 - DNA, 29 bp, Artificial Sequence
  Description of Artificial Sequence: Synthetic oligonucleotide
ataaccgagaggagtacgcacgcttcgac

SEQ ID NO: 400419 - DNA, 28 bp, Artificial Sequence
  Description of Artificial Sequence: Synthetic oligonucleotide
taaccgagaggagtacgcacgcttcgac

SEQ ID NO: 400420 - DNA, 27 bp, Artificial Sequence
  Description of Artificial Sequence: Synthetic oligonucleotide
aaccgagaggagtacgcacgcttcgac

SEQ ID NO: 400421 - DNA, 27 bp, Artificial Sequence
  Description of Artificial Sequence: Synthetic oligonucleotide
accgagaggagtacgcacgcttcgaca

SEQ ID NO: 400422 - DNA, 26 bp, Artificial Sequence
  Description of Artificial Sequence: Synthetic oligonucleotide
ccgagaggagtacgcacgcttcgaca

SEQ ID NO: 400423 - DNA, 26 bp, Artificial Sequence
  Description of Artificial Sequence: Synthetic oligonucleotide
cgagaggagtacgcacgcttcgacag

SEQ ID NO: 400424 - DNA, 26 bp, Artificial Sequence
  Description of Artificial Sequence: Synthetic oligonucleotide
gagaggagtacgcacgcttcgacagc

SEQ ID NO: 400425 - DNA, 27 bp, Artificial Sequence
  Description of Artificial Sequence: Synthetic oligonucleotide
agaggagtacgcacgcttcgacagcga

SEQ ID NO: 400426 - DNA, 26 bp, Artificial Sequence
  Description of Artificial Sequence: Synthetic oligonucleotide
gaggagtacgcacgcttcgacagcga

SEQ ID NO: 400427 - DNA, 26 bp, Artificial Sequence
  Description of Artificial Sequence: Synthetic oligonucleotide
aggagtacgcacgcttcgacagcgac

SEQ ID NO: 400428 - DNA, 25 bp, Artificial Sequence
  Description of Artificial Sequence: Synthetic oligonucleotide
ggagtacgcacgcttcgacagcgac

SEQ ID NO: 400429 - DNA, 26 bp, Artificial Sequence
  Description of Artificial Sequence: Synthetic oligonucleotide
gagtacgcacgcttcgacagcgacgt

SEQ ID NO: 400430 - DNA, 26 bp, Artificial Sequence
  Description of Artificial Sequence: Synthetic oligonucleotide
agtacgcacgcttcgacagcgacgtg

SEQ ID NO: 400431 - DNA, 25 bp, Artificial Sequence
  Description of Artificial Sequence: Synthetic oligonucleotide
gtacgcacgcttcgacagcgacgtg

SEQ ID NO: 400432 - DNA, 26 bp, Artificial Sequence
  Description of Artificial Sequence: Synthetic oligonucleotide
tacgcacgcttcgacagcgacgtgga

SEQ ID NO: 400433 - DNA, 25 bp, Artificial Sequence
  Description of Artificial Sequence: Synthetic oligonucleotide
acgcacgcttcgacagcgacgtgga

SEQ ID NO: 400434 - DNA, 24 bp, Artificial Sequence
  Description of Artificial Sequence: Synthetic oligonucleotide
cgcacgcttcgacagcgacgtgga

SEQ ID NO: 400435 - DNA, 24 bp, Artificial Sequence
  Description of Artificial Sequence: Synthetic oligonucleotide
gcacgcttcgacagcgacgtggag

SEQ ID NO: 400436 - DNA, 25 bp, Artificial Sequence
  Description of Artificial Sequence: Synthetic oligonucleotide
cacgcttcgacagcgacgtggaggt

SEQ ID NO: 400437 - DNA, 27 bp, Artificial Sequence
  Description of Artificial Sequence: Synthetic oligonucleotide
acgcttcgacagcgacgtggaggtgta

SEQ ID NO: 400438 - DNA, 26 bp, Artificial Sequence
  Description of Artificial Sequence: Synthetic oligonucleotide
cgcttcgacagcgacgtggaggtgta

SEQ ID NO: 400439 - DNA, 26 bp, Artificial Sequence
  Description of Artificial Sequence: Synthetic oligonucleotide
gcttcgacagcgacgtggaggtgtac

SEQ ID NO: 400440 - DNA, 26 bp, Artificial Sequence
  Description of Artificial Sequence: Synthetic oligonucleotide
cttcgacagcgacgtggaggtgtacc

SEQ ID NO: 400441 - DNA, 26 bp, Artificial Sequence
  Description of Artificial Sequence: Synthetic oligonucleotide
ttcgacagcgacgtggaggtgtaccg

SEQ ID NO: 400442 - DNA, 25 bp, Artificial Sequence
  Description of Artificial Sequence: Synthetic oligonucleotide
tcgacagcgacgtggaggtgtaccg

SEQ ID NO: 400443 - DNA, 24 bp, Artificial Sequence
  Description of Artificial Sequence: Synthetic oligonucleotide
cgacagcgacgtggaggtgtaccg

SEQ ID NO: 400444 - DNA, 24 bp, Artificial Sequence
  Description of Artificial Sequence: Synthetic oligonucleotide
gacagcgacgtggaggtgtaccgg

SEQ ID NO: 400445 - DNA, 24 bp, Artificial Sequence
  Description of Artificial Sequence: Synthetic oligonucleotide
acagcgacgtggaggtgtaccggg

SEQ ID NO: 400446 - DNA, 23 bp, Artificial Sequence
  Description of Artificial Sequence: Synthetic oligonucleotide
cagcgacgtggaggtgtaccggg

SEQ ID NO: 400447 - DNA, 23 bp, Artificial Sequence
  Description of Artificial Sequence: Synthetic oligonucleotide
agcgacgtggaggtgtaccgggc

SEQ ID NO: 400448 - DNA, 22 bp, Artificial Sequence
  Description of Artificial Sequence: Synthetic oligonucleotide
gcgacgtggaggtgtaccgggc

SEQ ID NO: 400449 - DNA, 22 bp, Artificial Sequence
  Description of Artificial Sequence: Synthetic oligonucleotide
cgacgtggaggtgtaccgggcg

SEQ ID NO: 400450 - DNA, 23 bp, Artificial Sequence
  Description of Artificial Sequence: Synthetic oligonucleotide
gacgtggaggtgtaccgggcggt

SEQ ID NO: 400451 - DNA, 24 bp, Artificial Sequence
  Description of Artificial Sequence: Synthetic oligonucleotide
acgtggaggtgtaccgggcggtga

SEQ ID NO: 400452 - DNA, 23 bp, Artificial Sequence
  Description of Artificial Sequence: Synthetic oligonucleotide
cgtggaggtgtaccgggcggtga

SEQ ID NO: 400453 - DNA, 23 bp, Artificial Sequence
  Description of Artificial Sequence: Synthetic oligonucleotide
gtggaggtgtaccgggcggtgac

SEQ ID NO: 400454 - DNA, 23 bp, Artificial Sequence
  Description of Artificial Sequence: Synthetic oligonucleotide
tggaggtgtaccgggcggtgacg

SEQ ID NO: 400455 - DNA, 22 bp, Artificial Sequence
  Description of Artificial Sequence: Synthetic oligonucleotide
ggaggtgtaccgggcggtgacg

SEQ ID NO: 400456 - DNA, 22 bp, Artificial Sequence
  Description of Artificial Sequence: Synthetic oligonucleotide
gaggtgtaccgggcggtgacgc

SEQ ID NO: 400457 - DNA, 22 bp, Artificial Sequence
  Description of Artificial Sequence: Synthetic oligonucleotide
aggtgtaccgggcggtgacgcc

SEQ ID NO: 400458 - DNA, 21 bp, Artificial Sequence
  Description of Artificial Sequence: Synthetic oligonucleotide
ggtgtaccgggcggtgacgcc

SEQ ID NO: 400459 - DNA, 21 bp, Artificial Sequence
  Description of Artificial Sequence: Synthetic oligonucleotide
gtgtaccgggcggtgacgccg

SEQ ID NO: 400460 - DNA, 22 bp, Artificial Sequence
  Description of Artificial Sequence: Synthetic oligonucleotide
tgtaccgggcggtgacgccgct

SEQ ID NO: 400461 - DNA, 21 bp, Artificial Sequence
  Description of Artificial Sequence: Synthetic oligonucleotide
gtaccgggcggtgacgccgct

SEQ ID NO: 400462 - DNA, 21 bp, Artificial Sequence
  Description of Artificial Sequence: Synthetic oligonucleotide
taccgggcggtgacgccgctg

SEQ ID NO: 400463 - DNA, 20 bp, Artificial Sequence
  Description of Artificial Sequence: Synthetic oligonucleotide
accgggcggtgacgccgctg

SEQ ID NO: 400464 - DNA, 20 bp, Artificial Sequence
  Description of Artificial Sequence: Synthetic oligonucleotide
ccgggcggtgacgccgctgt

SEQ ID NO: 400465 - DNA, 20 bp, Artificial Sequence
  Description of Artificial Sequence: Synthetic oligonucleotide
cgggcggtgacgccgctggt

SEQ ID NO: 400466 - DNA, 20 bp, Artificial Sequence
  Description of Artificial Sequence: Synthetic oligonucleotide
gggcggtgacgccgctgggt

SEQ ID NO: 400467 - DNA, 20 bp, Artificial Sequence
  Description of Artificial Sequence: Synthetic oligonucleotide
ggcggtgacgccgctggggt

SEQ ID NO: 400468 - DNA, 20 bp, Artificial Sequence
  Description of Artificial Sequence: Synthetic oligonucleotide
gcggtgacgccgctggggct

SEQ ID NO: 400469 - DNA, 20 bp, Artificial Sequence
  Description of Artificial Sequence: Synthetic oligonucleotide
cggtgacgccgctggggcct

SEQ ID NO: 400470 - DNA, 20 bp, Artificial Sequence
  Description of Artificial Sequence: Synthetic oligonucleotide
ggtgacgccgctggggccgt

SEQ ID NO: 400471 - DNA, 20 bp, Artificial Sequence
  Description of Artificial Sequence: Synthetic oligonucleotide
gtgacgccgctggggccgct

SEQ ID NO: 400472 - DNA, 20 bp, Artificial Sequence
  Description of Artificial Sequence: Synthetic oligonucleotide
tgacgccgctggggccgcct

SEQ ID NO: 400473 - DNA, 20 bp, Artificial Sequence
  Description of Artificial Sequence: Synthetic oligonucleotide
gacgccgctggggccgcctt

SEQ ID NO: 400474 - DNA, 20 bp, Artificial Sequence
  Description of Artificial Sequence: Synthetic oligonucleotide
acgccgctggggccgcctga

SEQ ID NO: 400475 - DNA, 20 bp, Artificial Sequence
  Description of Artificial Sequence: Synthetic oligonucleotide
cgccgctggggccgcctgat

SEQ ID NO: 400476 - DNA, 20 bp, Artificial Sequence
  Description of Artificial Sequence: Synthetic oligonucleotide
gccgctggggccgcctgact

SEQ ID NO: 400477 - DNA, 20 bp, Artificial Sequence
  Description of Artificial Sequence: Synthetic oligonucleotide
ccgctggggccgcctgacgt

SEQ ID NO: 400478 - DNA, 20 bp, Artificial Sequence
  Description of Artificial Sequence: Synthetic oligonucleotide
cgctggggccgcctgacgct

SEQ ID NO: 400479 - DNA, 20 bp, Artificial Sequence
  Description of Artificial Sequence: Synthetic oligonucleotide
gctggggccgcctgacgcct

SEQ ID NO: 400480 - DNA, 20 bp, Artificial Sequence
  Description of Artificial Sequence: Synthetic oligonucleotide
ctggggccgcctgacgccga

SEQ ID NO: 400481 - DNA, 22 bp, Artificial Sequence
  Description of Artificial Sequence: Synthetic oligonucleotide
tggggccgcctgacgccgagta

SEQ ID NO: 400482 - DNA, 21 bp, Artificial Sequence
  Description of Artificial Sequence: Synthetic oligonucleotide
ggggccgcctgacgccgagta

SEQ ID NO: 400483 - DNA, 22 bp, Artificial Sequence
  Description of Artificial Sequence: Synthetic oligonucleotide
gggccgcctgacgccgagtact

SEQ ID NO: 400484 - DNA, 22 bp, Artificial Sequence
  Description of Artificial Sequence: Synthetic oligonucleotide
ggccgcctgacgccgagtactg

SEQ ID NO: 400485 - DNA, 24 bp, Artificial Sequence
  Description of Artificial Sequence: Synthetic oligonucleotide
gccgcctgacgccgagtactggaa

SEQ ID NO: 400486 - DNA, 25 bp, Artificial Sequence
  Description of Artificial Sequence: Synthetic oligonucleotide
ccgcctgacgccgagtactggaaca

SEQ ID NO: 400487 - DNA, 25 bp, Artificial Sequence
  Description of Artificial Sequence: Synthetic oligonucleotide
cgcctgacgccgagtactggaacag

SEQ ID NO: 400488 - DNA, 28 bp, Artificial Sequence
  Description of Artificial Sequence: Synthetic oligonucleotide
gccgagtactggaacagccagaaggaag

SEQ ID NO: 400489 - DNA, 29 bp, Artificial Sequence
  Description of Artificial Sequence: Synthetic oligonucleotide
ccgagtactggaacagccagaaggaagtc

SEQ ID NO: 400490 - DNA, 29 bp, Artificial Sequence
  Description of Artificial Sequence: Synthetic oligonucleotide
cgagtactggaacagccagaaggaagtcc

SEQ ID NO: 400491 - DNA, 30 bp, Artificial Sequence; identical to SEQ ID NO: 59073
  Description of Artificial Sequence: Synthetic oligonucleotide

SEQ ID NO: 400492 - DNA, 30 bp, Artificial Sequence; identical to SEQ ID NO: 59074
  Description of Artificial Sequence: Synthetic oligonucleotide

SEQ ID NO: 400493 - DNA, 29 bp, Artificial Sequence
  Description of Artificial Sequence: Synthetic oligonucleotide
gtactggaacagccagaaggaagtcctgg

SEQ ID NO: 400494 - DNA, 30 bp, Artificial Sequence; identical to SEQ ID NO: 59076
  Description of Artificial Sequence: Synthetic oligonucleotide

SEQ ID NO: 400495 - DNA, 29 bp, Artificial Sequence
  Description of Artificial Sequence: Synthetic oligonucleotide
actggaacagccagaaggaagtcctggag

SEQ ID NO: 400496 - DNA, 28 bp, Artificial Sequence
  Description of Artificial Sequence: Synthetic oligonucleotide
ctggaacagccagaaggaagtcctggag

SEQ ID NO: 400497 - DNA, 29 bp, Artificial Sequence
  Description of Artificial Sequence: Synthetic oligonucleotide
tggaacagccagaaggaagtcctggagag

SEQ ID NO: 400498 - DNA, 28 bp, Artificial Sequence
  Description of Artificial Sequence: Synthetic oligonucleotide
ggaacagccagaaggaagtcctggagag

SEQ ID NO: 400499 - DNA, 28 bp, Artificial Sequence
  Description of Artificial Sequence: Synthetic oligonucleotide
gaacagccagaaggaagtcctggagagg

SEQ ID NO: 400500 - DNA, 29 bp, Artificial Sequence
  Description of Artificial Sequence: Synthetic oligonucleotide
aacagccagaaggaagtcctggagaggac

SEQ ID NO: 400501 - DNA, 28 bp, Artificial Sequence
  Description of Artificial Sequence: Synthetic oligonucleotide
acagccagaaggaagtcctggagaggac

SEQ ID NO: 400502 - DNA, 27 bp, Artificial Sequence
  Description of Artificial Sequence: Synthetic oligonucleotide
cagccagaaggaagtcctggagaggac

SEQ ID NO: 400503 - DNA, 27 bp, Artificial Sequence
  Description of Artificial Sequence: Synthetic oligonucleotide
agccagaaggaagtcctggagaggacc

SEQ ID NO: 400504 - DNA, 26 bp, Artificial Sequence
  Description of Artificial Sequence: Synthetic oligonucleotide
gccagaaggaagtcctggagaggacc

SEQ ID NO: 400505 - DNA, 26 bp, Artificial Sequence
  Description of Artificial Sequence: Synthetic oligonucleotide
ccagaaggaagtcctggagaggaccc

SEQ ID NO: 400506 - DNA, 26 bp, Artificial Sequence
  Description of Artificial Sequence: Synthetic oligonucleotide
cagaaggaagtcctggagaggacccg

SEQ ID NO: 400507 - DNA, 26 bp, Artificial Sequence
  Description of Artificial Sequence: Synthetic oligonucleotide
agaaggaagtcctggagaggacccgg

SEQ ID NO: 400508 - DNA, 25 bp, Artificial Sequence
  Description of Artificial Sequence: Synthetic oligonucleotide
gaaggaagtcctggagaggacccgg

SEQ ID NO: 400509 - DNA, 25 bp, Artificial Sequence
  Description of Artificial Sequence: Synthetic oligonucleotide
aaggaagtcctggagaggacccggg

SEQ ID NO: 400510 - DNA, 24 bp, Artificial Sequence
  Description of Artificial Sequence: Synthetic oligonucleotide
aggaagtcctggagaggacccggg

SEQ ID NO: 400511 - DNA, 23 bp, Artificial Sequence
  Description of Artificial Sequence: Synthetic oligonucleotide
ggaagtcctggagaggacccggg

SEQ ID NO: 400512 - DNA, 23 bp, Artificial Sequence
  Description of Artificial Sequence: Synthetic oligonucleotide
gaagtcctggagaggacccgggc

SEQ ID NO: 400513 - DNA, 23 bp, Artificial Sequence
  Description of Artificial Sequence: Synthetic oligonucleotide
aagtcctggagaggacccgggcg

SEQ ID NO: 400514 - DNA, 22 bp, Artificial Sequence
  Description of Artificial Sequence: Synthetic oligonucleotide
agtcctggagaggacccgggcg

SEQ ID NO: 400515 - DNA, 21 bp, Artificial Sequence
  Description of Artificial Sequence: Synthetic oligonucleotide
gtcctggagaggacccgggcg

SEQ ID NO: 400516 - DNA, 22 bp, Artificial Sequence
  Description of Artificial Sequence: Synthetic oligonucleotide
tcctggagaggacccgggcgga

SEQ ID NO: 400517 - DNA, 21 bp, Artificial Sequence
  Description of Artificial Sequence: Synthetic oligonucleotide
cctggagaggacccgggcgga

SEQ ID NO: 400518 - DNA, 23 bp, Artificial Sequence
  Description of Artificial Sequence: Synthetic oligonucleotide
ctggagaggacccgggcggagtt

SEQ ID NO: 400519 - DNA, 23 bp, Artificial Sequence
  Description of Artificial Sequence: Synthetic oligonucleotide
tggagaggacccgggcggagttg

SEQ ID NO: 400520 - DNA, 22 bp, Artificial Sequence
  Description of Artificial Sequence: Synthetic oligonucleotide
ggagaggacccgggcggagttg

SEQ ID NO: 400521 - DNA, 23 bp, Artificial Sequence
  Description of Artificial Sequence: Synthetic oligonucleotide
gagaggacccgggcggagttgga

SEQ ID NO: 400522 - DNA, 24 bp, Artificial Sequence
  Description of Artificial Sequence: Synthetic oligonucleotide
agaggacccgggcggagttggaca

SEQ ID NO: 400523 - DNA, 23 bp, Artificial Sequence
  Description of Artificial Sequence: Synthetic oligonucleotide
gaggacccgggcggagttggaca

SEQ ID NO: 400524 - DNA, 23 bp, Artificial Sequence
  Description of Artificial Sequence: Synthetic oligonucleotide
aggacccgggcggagttggacac

SEQ ID NO: 400525 - DNA, 22 bp, Artificial Sequence
  Description of Artificial Sequence: Synthetic oligonucleotide
ggacccgggcggagttggacac

SEQ ID NO: 400526 - DNA, 22 bp, Artificial Sequence
  Description of Artificial Sequence: Synthetic oligonucleotide
gacccgggcggagttggacacg

SEQ ID NO: 400527 - DNA, 23 bp, Artificial Sequence
  Description of Artificial Sequence: Synthetic oligonucleotide
acccgggcggagttggacacggt

SEQ ID NO: 400528 - DNA, 22 bp, Artificial Sequence
  Description of Artificial Sequence: Synthetic oligonucleotide
cccgggcggagttggacacggt

SEQ ID NO: 400529 - DNA, 23 bp, Artificial Sequence
  Description of Artificial Sequence: Synthetic oligonucleotide
ccgggcggagttggacacggtgt

SEQ ID NO: 400530 - DNA, 23 bp, Artificial Sequence
  Description of Artificial Sequence: Synthetic oligonucleotide
cgggcggagttggacacggtgtg

SEQ ID NO: 400531 - DNA, 24 bp, Artificial Sequence
  Description of Artificial Sequence: Synthetic oligonucleotide
gggcggagttggacacggtgtgca

SEQ ID NO: 400532 - DNA, 25 bp, Artificial Sequence
  Description of Artificial Sequence: Synthetic oligonucleotide
ggcggagttggacacggtgtgcaga

SEQ ID NO: 400533 - DNA, 26 bp, Artificial Sequence
  Description of Artificial Sequence: Synthetic oligonucleotide
gcggagttggacacggtgtgcagaca

SEQ ID NO: 400534 - DNA, 27 bp, Artificial Sequence
  Description of Artificial Sequence: Synthetic oligonucleotide
cggagttggacacggtgtgcagacaca

SEQ ID NO: 400535 - DNA, 28 bp, Artificial Sequence
  Description of Artificial Sequence: Synthetic oligonucleotide
ggagttggacacggtgtgcagacacaac

SEQ ID NO: 400536 - DNA, 30 bp, Artificial Sequence; identical to SEQ ID NO: 59118
  Description of Artificial Sequence: Synthetic oligonucleotide

SEQ ID NO: 400537 - DNA, 30 bp, Artificial Sequence; identical to SEQ ID NO: 59119
  Description of Artificial Sequence: Synthetic oligonucleotide

SEQ ID NO: 400538 - DNA, 29 bp, Artificial Sequence
  Description of Artificial Sequence: Synthetic oligonucleotide
gttggacacggtgtgcagacacaactacc

SEQ ID NO: 400539 - DNA, 30 bp, Artificial Sequence; identical to SEQ ID NO: 59121
  Description of Artificial Sequence: Synthetic oligonucleotide

SEQ ID NO: 400540 - DNA, 28 bp, Artificial Sequence
  Description of Artificial Sequence: Synthetic oligonucleotide
aaccaccacaacctgctggtctgctcag

SEQ ID NO: 400541 - DNA, 27 bp, Artificial Sequence
  Description of Artificial Sequence: Synthetic oligonucleotide
accaccacaacctgctggtctgctcag

SEQ ID NO: 400542 - DNA, 27 bp, Artificial Sequence
  Description of Artificial Sequence: Synthetic oligonucleotide
ccaccacaacctgctggtctgctcagt

SEQ ID NO: 400543 - DNA, 27 bp, Artificial Sequence
  Description of Artificial Sequence: Synthetic oligonucleotide
caccacaacctgctggtctgctcagtg

SEQ ID NO: 400544 - DNA, 28 bp, Artificial Sequence
  Description of Artificial Sequence: Synthetic oligonucleotide
accacaacctgctggtctgctcagtgac

SEQ ID NO: 400545 - DNA, 27 bp, Artificial Sequence
  Description of Artificial Sequence: Synthetic oligonucleotide
ccacaacctgctggtctgctcagtgac

SEQ ID NO: 400546 - DNA, 28 bp, Artificial Sequence
  Description of Artificial Sequence: Synthetic oligonucleotide
cacaacctgctggtctgctcagtgacag

SEQ ID NO: 400547 - DNA, 32 bp, Artificial Sequence; identical to SEQ ID NO: 59129
  Description of Artificial Sequence: Synthetic oligonucleotide

SEQ ID NO: 400548 - DNA, 31 bp, Artificial Sequence; identical to SEQ ID NO: 59130
  Description of Artificial Sequence: Synthetic oligonucleotide

SEQ ID NO: 400549 - DNA, 34 bp, Artificial Sequence; identical to SEQ ID NO: 59131
  Description of Artificial Sequence: Synthetic oligonucleotide

SEQ ID NO: 400550 - DNA, 33 bp, Artificial Sequence; identical to SEQ ID NO: 59132
  Description of Artificial Sequence: Synthetic oligonucleotide

SEQ ID NO: 400551 - DNA, 32 bp, Artificial Sequence; identical to SEQ ID NO: 59133
  Description of Artificial Sequence: Synthetic oligonucleotide

SEQ ID NO: 400552 - DNA, 32 bp, Artificial Sequence; identical to SEQ ID NO: 59134
  Description of Artificial Sequence: Synthetic oligonucleotide

SEQ ID NO: 400553 - DNA, 33 bp, Artificial Sequence; identical to SEQ ID NO: 59135
  Description of Artificial Sequence: Synthetic oligonucleotide

SEQ ID NO: 400554 - DNA, 32 bp, Artificial Sequence; identical to SEQ ID NO: 59136
  Description of Artificial Sequence: Synthetic oligonucleotide

SEQ ID NO: 400555 - DNA, 32 bp, Artificial Sequence; identical to SEQ ID NO: 59137
  Description of Artificial Sequence: Synthetic oligonucleotide

SEQ ID NO: 400556 - DNA, 32 bp, Artificial Sequence; identical to SEQ ID NO: 59138
  Description of Artificial Sequence: Synthetic oligonucleotide

SEQ ID NO: 400557 - DNA, 31 bp, Artificial Sequence; identical to SEQ ID NO: 59139
  Description of Artificial Sequence: Synthetic oligonucleotide

SEQ ID NO: 400558 - DNA, 31 bp, Artificial Sequence; identical to SEQ ID NO: 59140
  Description of Artificial Sequence: Synthetic oligonucleotide

SEQ ID NO: 400559 - DNA, 32 bp, Artificial Sequence; identical to SEQ ID NO: 59141
  Description of Artificial Sequence: Synthetic oligonucleotide

SEQ ID NO: 400560 - DNA, 31 bp, Artificial Sequence; identical to SEQ ID NO: 59142
  Description of Artificial Sequence: Synthetic oligonucleotide

SEQ ID NO: 400561 - DNA, 33 bp, Artificial Sequence; identical to SEQ ID NO: 59143
  Description of Artificial Sequence: Synthetic oligonucleotide

SEQ ID NO: 400562 - DNA, 32 bp, Artificial Sequence; identical to SEQ ID NO: 59144
  Description of Artificial Sequence: Synthetic oligonucleotide

SEQ ID NO: 400563 - DNA, 35 bp, Artificial Sequence; identical to SEQ ID NO: 59145
  Description of Artificial Sequence: Synthetic oligonucleotide

SEQ ID NO: 400564 - DNA, 36 bp, Artificial Sequence; identical to SEQ ID NO: 59146
  Description of Artificial Sequence: Synthetic oligonucleotide

SEQ ID NO: 400565 - DNA, 35 bp, Artificial Sequence; identical to SEQ ID NO: 59147
  Description of Artificial Sequence: Synthetic oligonucleotide

SEQ ID NO: 400566 - DNA, 35 bp, Artificial Sequence; identical to SEQ ID NO: 59148
  Description of Artificial Sequence: Synthetic oligonucleotide

SEQ ID NO: 400567 - DNA, 30 bp, Artificial Sequence; identical to SEQ ID NO: 59149
  Description of Artificial Sequence: Synthetic oligonucleotide

SEQ ID NO: 400568 - DNA, 30 bp, Artificial Sequence; identical to SEQ ID NO: 59150
  Description of Artificial Sequence: Synthetic oligonucleotide

SEQ ID NO: 400569 - DNA, 29 bp, Artificial Sequence
  Description of Artificial Sequence: Synthetic oligonucleotide
ggtttcggaatgaccaggaggagacaacc

SEQ ID NO: 400570 - DNA, 29 bp, Artificial Sequence
  Description of Artificial Sequence: Synthetic oligonucleotide
gtttcggaatgaccaggaggagacaaccg

SEQ ID NO: 400571 - DNA, 29 bp, Artificial Sequence
  Description of Artificial Sequence: Synthetic oligonucleotide
tttcggaatgaccaggaggagacaaccgg

SEQ ID NO: 400572 - DNA, 28 bp, Artificial Sequence
  Description of Artificial Sequence: Synthetic oligonucleotide
ttcggaatgaccaggaggagacaaccgg

SEQ ID NO: 400573 - DNA, 27 bp, Artificial Sequence
  Description of Artificial Sequence: Synthetic oligonucleotide
tcggaatgaccaggaggagacaaccgg

SEQ ID NO: 400574 - DNA, 26 bp, Artificial Sequence
  Description of Artificial Sequence: Synthetic oligonucleotide
cggaatgaccaggaggagacaaccgg

SEQ ID NO: 400575 - DNA, 26 bp, Artificial Sequence
  Description of Artificial Sequence: Synthetic oligonucleotide
ggaatgaccaggaggagacaaccggc

SEQ ID NO: 400576 - DNA, 27 bp, Artificial Sequence
  Description of Artificial Sequence: Synthetic oligonucleotide
gaatgaccaggaggagacaaccggcgt

SEQ ID NO: 400577 - DNA, 28 bp, Artificial Sequence
  Description of Artificial Sequence: Synthetic oligonucleotide
aatgaccaggaggagacaaccggcgttg

SEQ ID NO: 400578 - DNA, 27 bp, Artificial Sequence
  Description of Artificial Sequence: Synthetic oligonucleotide
atgaccaggaggagacaaccggcgttg

SEQ ID NO: 400579 - DNA, 27 bp, Artificial Sequence
  Description of Artificial Sequence: Synthetic oligonucleotide
tgaccaggaggagacaaccggcgttgt

SEQ ID NO: 400580 - DNA, 26 bp, Artificial Sequence
  Description of Artificial Sequence: Synthetic oligonucleotide
gaccaggaggagacaaccggcgttgt

SEQ ID NO: 400581 - DNA, 27 bp, Artificial Sequence
  Description of Artificial Sequence: Synthetic oligonucleotide
accaggaggagacaaccggcgttgtgt

SEQ ID NO: 400582 - DNA, 26 bp, Artificial Sequence
  Description of Artificial Sequence: Synthetic oligonucleotide
ccaggaggagacaaccggcgttgtgt

SEQ ID NO: 400583 - DNA, 26 bp, Artificial Sequence
  Description of Artificial Sequence: Synthetic oligonucleotide
caggaggagacaaccggcgttgtgtc

SEQ ID NO: 400584 - DNA, 27 bp, Artificial Sequence
  Description of Artificial Sequence: Synthetic oligonucleotide
aggaggagacaaccggcgttgtgtcca

SEQ ID NO: 400585 - DNA, 26 bp, Artificial Sequence
  Description of Artificial Sequence: Synthetic oligonucleotide
ggaggagacaaccggcgttgtgtcca

SEQ ID NO: 400586 - DNA, 26 bp, Artificial Sequence
  Description of Artificial Sequence: Synthetic oligonucleotide
gaggagacaaccggcgttgtgtccac

SEQ ID NO: 400587 - DNA, 26 bp, Artificial Sequence
  Description of Artificial Sequence: Synthetic oligonucleotide
aggagacaaccggcgttgtgtccacc

SEQ ID NO: 400588 - DNA, 25 bp, Artificial Sequence
  Description of Artificial Sequence: Synthetic oligonucleotide
ggagacaaccggcgttgtgtccacc

SEQ ID NO: 400589 - DNA, 25 bp, Artificial Sequence
  Description of Artificial Sequence: Synthetic oligonucleotide
gagacaaccggcgttgtgtccaccc

SEQ ID NO: 400590 - DNA, 25 bp, Artificial Sequence
  Description of Artificial Sequence: Synthetic oligonucleotide
agacaaccggcgttgtgtccacccc

SEQ ID NO: 400591 - DNA, 24 bp, Artificial Sequence
  Description of Artificial Sequence: Synthetic oligonucleotide
gacaaccggcgttgtgtccacccc

SEQ ID NO: 400592 - DNA, 24 bp, Artificial Sequence
  Description of Artificial Sequence: Synthetic oligonucleotide
acaaccggcgttgtgtccaccccc

SEQ ID NO: 400593 - DNA, 23 bp, Artificial Sequence
  Description of Artificial Sequence: Synthetic oligonucleotide
caaccggcgttgtgtccaccccc

SEQ ID NO: 400594 - DNA, 27 bp, Artificial Sequence
  Description of Artificial Sequence: Synthetic oligonucleotide
aaccggcgttgtgtccaccccccttat

SEQ ID NO: 400595 - DNA, 27 bp, Artificial Sequence
  Description of Artificial Sequence: Synthetic oligonucleotide
accggcgttgtgtccaccccccttatt

SEQ ID NO: 400596 - DNA, 27 bp, Artificial Sequence
  Description of Artificial Sequence: Synthetic oligonucleotide
ccggcgttgtgtccaccccccttatta

SEQ ID NO: 400597 - DNA, 27 bp, Artificial Sequence
  Description of Artificial Sequence: Synthetic oligonucleotide
cggcgttgtgtccaccccccttattag

SEQ ID NO: 400598 - DNA, 29 bp, Artificial Sequence
  Description of Artificial Sequence: Synthetic oligonucleotide
gcgttgtgtccaccccccttattaggaac

SEQ ID NO: 400599 - DNA, 29 bp, Artificial Sequence
  Description of Artificial Sequence: Synthetic oligonucleotide
cgttgtgtccaccccccttattaggaacg

SEQ ID NO: 400600 - DNA, 29 bp, Artificial Sequence
  Description of Artificial Sequence: Synthetic oligonucleotide
gttgtgtccaccccccttattaggaacgg

SEQ ID NO: 400601 - DNA, 30 bp, Artificial Sequence; identical to SEQ ID NO: 59183
  Description of Artificial Sequence: Synthetic oligonucleotide

SEQ ID NO: 400602 - DNA, 29 bp, Artificial Sequence
  Description of Artificial Sequence: Synthetic oligonucleotide
tgtgtccaccccccttattaggaacggtg

SEQ ID NO: 400603 - DNA, 28 bp, Artificial Sequence
  Description of Artificial Sequence: Synthetic oligonucleotide
gtgtccaccccccttattaggaacggtg

SEQ ID NO: 400604 - DNA, 29 bp, Artificial Sequence
  Description of Artificial Sequence: Synthetic oligonucleotide
tgtccaccccccttattaggaacggtgac

SEQ ID NO: 400605 - DNA, 28 bp, Artificial Sequence
  Description of Artificial Sequence: Synthetic oligonucleotide
gtccaccccccttattaggaacggtgac

SEQ ID NO: 400606 - DNA, 29 bp, Artificial Sequence
  Description of Artificial Sequence: Synthetic oligonucleotide
tccaccccccttattaggaacggtgactg

SEQ ID NO: 400607 - DNA, 28 bp, Artificial Sequence
  Description of Artificial Sequence: Synthetic oligonucleotide
ccaccccccttattaggaacggtgactg

SEQ ID NO: 400608 - DNA, 28 bp, Artificial Sequence
  Description of Artificial Sequence: Synthetic oligonucleotide
caccccccttattaggaacggtgactgg

SEQ ID NO: 400609 - DNA, 29 bp, Artificial Sequence
  Description of Artificial Sequence: Synthetic oligonucleotide
accccccttattaggaacggtgactggac

SEQ ID NO: 400610 - DNA, 28 bp, Artificial Sequence
  Description of Artificial Sequence: Synthetic oligonucleotide
ccccccttattaggaacggtgactggac

SEQ ID NO: 400611 - DNA, 28 bp, Artificial Sequence
  Description of Artificial Sequence: Synthetic oligonucleotide
cccccttattaggaacggtgactggacc

SEQ ID NO: 400612 - DNA, 30 bp, Artificial Sequence; identical to SEQ ID NO: 59194
  Description of Artificial Sequence: Synthetic oligonucleotide

SEQ ID NO: 400613 - DNA, 30 bp, Artificial Sequence; identical to SEQ ID NO: 59195
  Description of Artificial Sequence: Synthetic oligonucleotide

SEQ ID NO: 400614 - DNA, 31 bp, Artificial Sequence; identical to SEQ ID NO: 59196
  Description of Artificial Sequence: Synthetic oligonucleotide

SEQ ID NO: 400615 - DNA, 33 bp, Artificial Sequence; identical to SEQ ID NO: 59197
  Description of Artificial Sequence: Synthetic oligonucleotide

SEQ ID NO: 400616 - DNA, 33 bp, Artificial Sequence; identical to SEQ ID NO: 59198
  Description of Artificial Sequence: Synthetic oligonucleotide

SEQ ID NO: 400617 - DNA, 32 bp, Artificial Sequence; identical to SEQ ID NO: 59199
  Description of Artificial Sequence: Synthetic oligonucleotide

SEQ ID NO: 400618 - DNA, 31 bp, Artificial Sequence; identical to SEQ ID NO: 59200
  Description of Artificial Sequence: Synthetic oligonucleotide

SEQ ID NO: 400619 - DNA, 30 bp, Artificial Sequence; identical to SEQ ID NO: 59201
  Description of Artificial Sequence: Synthetic oligonucleotide

SEQ ID NO: 400620 - DNA, 29 bp, Artificial Sequence
  Description of Artificial Sequence: Synthetic oligonucleotide
taggaacggtgactggaccttccagatcc

SEQ ID NO: 400621 - DNA, 28 bp, Artificial Sequence
  Description of Artificial Sequence: Synthetic oligonucleotide
aggaacggtgactggaccttccagatcc

SEQ ID NO: 400622 - DNA, 27 bp, Artificial Sequence
  Description of Artificial Sequence: Synthetic oligonucleotide
ggaacggtgactggaccttccagatcc

SEQ ID NO: 400623 - DNA, 28 bp, Artificial Sequence
  Description of Artificial Sequence: Synthetic oligonucleotide
gaacggtgactggaccttccagatcctg

SEQ ID NO: 400624 - DNA, 28 bp, Artificial Sequence
  Description of Artificial Sequence: Synthetic oligonucleotide
aacggtgactggaccttccagatcctgg

SEQ ID NO: 400625 - DNA, 27 bp, Artificial Sequence
  Description of Artificial Sequence: Synthetic oligonucleotide
acggtgactggaccttccagatcctgg

SEQ ID NO: 400626 - DNA, 27 bp, Artificial Sequence
  Description of Artificial Sequence: Synthetic oligonucleotide
cggtgactggaccttccagatcctggt

SEQ ID NO: 400627 - DNA, 30 bp, Artificial Sequence; identical to SEQ ID NO: 59209
  Description of Artificial Sequence: Synthetic oligonucleotide

SEQ ID NO: 400628 - DNA, 29 bp, Artificial Sequence
  Description of Artificial Sequence: Synthetic oligonucleotide
ggtgatgctggaaatgactccccagcatg

SEQ ID NO: 400629 - DNA, 29 bp, Artificial Sequence
  Description of Artificial Sequence: Synthetic oligonucleotide
gtgatgctggaaatgactccccagcatgg

SEQ ID NO: 400630 - DNA, 30 bp, Artificial Sequence; identical to SEQ ID NO: 59212
  Description of Artificial Sequence: Synthetic oligonucleotide

SEQ ID NO: 400631 - DNA, 29 bp, Artificial Sequence
  Description of Artificial Sequence: Synthetic oligonucleotide
gatgctggaaatgactccccagcatggag

SEQ ID NO: 400632 - DNA, 30 bp, Artificial Sequence; identical to SEQ ID NO: 59214
  Description of Artificial Sequence: Synthetic oligonucleotide

SEQ ID NO: 400633 - DNA, 29 bp, Artificial Sequence
  Description of Artificial Sequence: Synthetic oligonucleotide
tgctggaaatgactccccagcatggagac

SEQ ID NO: 400634 - DNA, 28 bp, Artificial Sequence
  Description of Artificial Sequence: Synthetic oligonucleotide
gctggaaatgactccccagcatggagac

SEQ ID NO: 400635 - DNA, 28 bp, Artificial Sequence
  Description of Artificial Sequence: Synthetic oligonucleotide
ctggaaatgactccccagcatggagacg

SEQ ID NO: 400636 - DNA, 29 bp, Artificial Sequence
  Description of Artificial Sequence: Synthetic oligonucleotide
tggaaatgactccccagcatggagacgtc

SEQ ID NO: 400637 - DNA, 28 bp, Artificial Sequence
  Description of Artificial Sequence: Synthetic oligonucleotide
ggaaatgactccccagcatggagacgtc

SEQ ID NO: 400638 - DNA, 30 bp, Artificial Sequence; identical to SEQ ID NO: 59220
  Description of Artificial Sequence: Synthetic oligonucleotide

SEQ ID NO: 400639 - DNA, 31 bp, Artificial Sequence; identical to SEQ ID NO: 59221
  Description of Artificial Sequence: Synthetic oligonucleotide

SEQ ID NO: 400640 - DNA, 30 bp, Artificial Sequence; identical to SEQ ID NO: 59222
  Description of Artificial Sequence: Synthetic oligonucleotide

SEQ ID NO: 400641 - DNA, 29 bp, Artificial Sequence
  Description of Artificial Sequence: Synthetic oligonucleotide
atgactccccagcatggagacgtctacac

SEQ ID NO: 400642 - DNA, 28 bp, Artificial Sequence
  Description of Artificial Sequence: Synthetic oligonucleotide
tgactccccagcatggagacgtctacac

SEQ ID NO: 400643 - DNA, 27 bp, Artificial Sequence
  Description of Artificial Sequence: Synthetic oligonucleotide
gactccccagcatggagacgtctacac

SEQ ID NO: 400644 - DNA, 27 bp, Artificial Sequence
  Description of Artificial Sequence: Synthetic oligonucleotide
actccccagcatggagacgtctacacc

SEQ ID NO: 400645 - DNA, 27 bp, Artificial Sequence
  Description of Artificial Sequence: Synthetic oligonucleotide
ctccccagcatggagacgtctacacct

SEQ ID NO: 400646 - DNA, 27 bp, Artificial Sequence
  Description of Artificial Sequence: Synthetic oligonucleotide
tccccagcatggagacgtctacacctg

SEQ ID NO: 400647 - DNA, 26 bp, Artificial Sequence
  Description of Artificial Sequence: Synthetic oligonucleotide
ccccagcatggagacgtctacacctg

SEQ ID NO: 400648 - DNA, 26 bp, Artificial Sequence
  Description of Artificial Sequence: Synthetic oligonucleotide
cccagcatggagacgtctacacctgc

SEQ ID NO: 400649 - DNA, 27 bp, Artificial Sequence
  Description of Artificial Sequence: Synthetic oligonucleotide
ccagcatggagacgtctacacctgcca

SEQ ID NO: 400650 - DNA, 27 bp, Artificial Sequence
  Description of Artificial Sequence: Synthetic oligonucleotide
cagcatggagacgtctacacctgccac

SEQ ID NO: 400651 - DNA, 27 bp, Artificial Sequence
  Description of Artificial Sequence: Synthetic oligonucleotide
agcatggagacgtctacacctgccacg

SEQ ID NO: 400652 - DNA, 27 bp, Artificial Sequence
  Description of Artificial Sequence: Synthetic oligonucleotide
gcatggagacgtctacacctgccacgt

SEQ ID NO: 400653 - DNA, 27 bp, Artificial Sequence
  Description of Artificial Sequence: Synthetic oligonucleotide
catggagacgtctacacctgccacgtg

SEQ ID NO: 400654 - DNA, 27 bp, Artificial Sequence
  Description of Artificial Sequence: Synthetic oligonucleotide
atggagacgtctacacctgccacgtgg

SEQ ID NO: 400655 - DNA, 25 bp, Artificial Sequence
  Description of Artificial Sequence: Synthetic oligonucleotide
acgtggagcaccccagcctccagaa

SEQ ID NO: 400656 - DNA, 24 bp, Artificial Sequence
  Description of Artificial Sequence: Synthetic oligonucleotide
cgtggagcaccccagcctccagaa

SEQ ID NO: 400657 - DNA, 24 bp, Artificial Sequence
  Description of Artificial Sequence: Synthetic oligonucleotide
gtggagcaccccagcctccagaac

SEQ ID NO: 400658 - DNA, 24 bp, Artificial Sequence
  Description of Artificial Sequence: Synthetic oligonucleotide
tggagcaccccagcctccagaacc

SEQ ID NO: 400659 - DNA, 23 bp, Artificial Sequence
  Description of Artificial Sequence: Synthetic oligonucleotide
ggagcaccccagcctccagaacc

SEQ ID NO: 400660 - DNA, 23 bp, Artificial Sequence
  Description of Artificial Sequence: Synthetic oligonucleotide
gagcaccccagcctccagaaccc

SEQ ID NO: 400661 - DNA, 25 bp, Artificial Sequence
  Description of Artificial Sequence: Synthetic oligonucleotide
agcaccccagcctccagaaccccat

SEQ ID NO: 400662 - DNA, 24 bp, Artificial Sequence
  Description of Artificial Sequence: Synthetic oligonucleotide
gcaccccagcctccagaaccccat

SEQ ID NO: 400663 - DNA, 25 bp, Artificial Sequence
  Description of Artificial Sequence: Synthetic oligonucleotide
caccccagcctccagaaccccatca

SEQ ID NO: 400664 - DNA, 25 bp, Artificial Sequence
  Description of Artificial Sequence: Synthetic oligonucleotide
accccagcctccagaaccccatcac

SEQ ID NO: 400665 - DNA, 24 bp, Artificial Sequence
  Description of Artificial Sequence: Synthetic oligonucleotide
ccccagcctccagaaccccatcac

SEQ ID NO: 400666 - DNA, 24 bp, Artificial Sequence
  Description of Artificial Sequence: Synthetic oligonucleotide
cccagcctccagaaccccatcacc

SEQ ID NO: 400667 - DNA, 25 bp, Artificial Sequence
  Description of Artificial Sequence: Synthetic oligonucleotide
ccagcctccagaaccccatcaccgt

SEQ ID NO: 400668 - DNA, 25 bp, Artificial Sequence
  Description of Artificial Sequence: Synthetic oligonucleotide
cagcctccagaaccccatcaccgtg

SEQ ID NO: 400669 - DNA, 26 bp, Artificial Sequence
  Description of Artificial Sequence: Synthetic oligonucleotide
agcctccagaaccccatcaccgtgga

SEQ ID NO: 400670 - DNA, 25 bp, Artificial Sequence
  Description of Artificial Sequence: Synthetic oligonucleotide
gcctccagaaccccatcaccgtgga

SEQ ID NO: 400671 - DNA, 26 bp, Artificial Sequence
  Description of Artificial Sequence: Synthetic oligonucleotide
cctccagaaccccatcaccgtggagt

SEQ ID NO: 400672 - DNA, 26 bp, Artificial Sequence
  Description of Artificial Sequence: Synthetic oligonucleotide
ctccagaaccccatcaccgtggagtg

SEQ ID NO: 400673 - DNA, 26 bp, Artificial Sequence
  Description of Artificial Sequence: Synthetic oligonucleotide
tccagaaccccatcaccgtggagtgg

SEQ ID NO: 400674 - DNA, 25 bp, Artificial Sequence
  Description of Artificial Sequence: Synthetic oligonucleotide
ccagaaccccatcaccgtggagtgg

SEQ ID NO: 400675 - DNA, 25 bp, Artificial Sequence
  Description of Artificial Sequence: Synthetic oligonucleotide
cagaaccccatcaccgtggagtggc

SEQ ID NO: 400676 - DNA, 25 bp, Artificial Sequence
  Description of Artificial Sequence: Synthetic oligonucleotide
agaaccccatcaccgtggagtggcg

SEQ ID NO: 400677 - DNA, 24 bp, Artificial Sequence
  Description of Artificial Sequence: Synthetic oligonucleotide
gaaccccatcaccgtggagtggcg

SEQ ID NO: 400678 - DNA, 24 bp, Artificial Sequence
  Description of Artificial Sequence: Synthetic oligonucleotide
aaccccatcaccgtggagtggcgg

SEQ ID NO: 400679 - DNA, 23 bp, Artificial Sequence
  Description of Artificial Sequence: Synthetic oligonucleotide
accccatcaccgtggagtggcgg

SEQ ID NO: 400680 - DNA, 24 bp, Artificial Sequence
  Description of Artificial Sequence: Synthetic oligonucleotide
catcaccgtggagtggcgggctca

SEQ ID NO: 400681 - DNA, 25 bp, Artificial Sequence
  Description of Artificial Sequence: Synthetic oligonucleotide
atcaccgtggagtggcgggctcagt

SEQ ID NO: 400682 - DNA, 24 bp, Artificial Sequence
  Description of Artificial Sequence: Synthetic oligonucleotide
tcaccgtggagtggcgggctcagt

SEQ ID NO: 400683 - DNA, 23 bp, Artificial Sequence
  Description of Artificial Sequence: Synthetic oligonucleotide
caccgtggagtggcgggctcagt

SEQ ID NO: 400684 - DNA, 24 bp, Artificial Sequence
  Description of Artificial Sequence: Synthetic oligonucleotide
accgtggagtggcgggctcagtct

SEQ ID NO: 400685 - DNA, 23 bp, Artificial Sequence
  Description of Artificial Sequence: Synthetic oligonucleotide
ccgtggagtggcgggctcagtct

SEQ ID NO: 400686 - DNA, 26 bp, Artificial Sequence
  Description of Artificial Sequence: Synthetic oligonucleotide
cgtggagtggcgggctcagtctgaat

SEQ ID NO: 400687 - DNA, 27 bp, Artificial Sequence
  Description of Artificial Sequence: Synthetic oligonucleotide
gtggagtggcgggctcagtctgaatct

SEQ ID NO: 400688 - DNA, 27 bp, Artificial Sequence
  Description of Artificial Sequence: Synthetic oligonucleotide
tggagtggcgggctcagtctgaatctg

SEQ ID NO: 400689 - DNA, 26 bp, Artificial Sequence
  Description of Artificial Sequence: Synthetic oligonucleotide
ggagtggcgggctcagtctgaatctg

SEQ ID NO: 400690 - DNA, 26 bp, Artificial Sequence
  Description of Artificial Sequence: Synthetic oligonucleotide
gagtggcgggctcagtctgaatctgc

SEQ ID NO: 400691 - DNA, 26 bp, Artificial Sequence
  Description of Artificial Sequence: Synthetic oligonucleotide
agtggcgggctcagtctgaatctgcc

SEQ ID NO: 400692 - DNA, 25 bp, Artificial Sequence
  Description of Artificial Sequence: Synthetic oligonucleotide
gtggcgggctcagtctgaatctgcc

SEQ ID NO: 400693 - DNA, 26 bp, Artificial Sequence
  Description of Artificial Sequence: Synthetic oligonucleotide
tggcgggctcagtctgaatctgccca

SEQ ID NO: 400694 - DNA, 25 bp, Artificial Sequence
  Description of Artificial Sequence: Synthetic oligonucleotide
ggcgggctcagtctgaatctgccca

SEQ ID NO: 400695 - DNA, 26 bp, Artificial Sequence
  Description of Artificial Sequence: Synthetic oligonucleotide
gcgggctcagtctgaatctgcccaga

SEQ ID NO: 400696 - DNA, 26 bp, Artificial Sequence
  Description of Artificial Sequence: Synthetic oligonucleotide
cgggctcagtctgaatctgcccagag

SEQ ID NO: 400697 - DNA, 27 bp, Artificial Sequence
  Description of Artificial Sequence: Synthetic oligonucleotide
gggctcagtctgaatctgcccagagca

SEQ ID NO: 400698 - DNA, 28 bp, Artificial Sequence
  Description of Artificial Sequence: Synthetic oligonucleotide
ggctcagtctgaatctgcccagagcaag

SEQ ID NO: 400699 - DNA, 30 bp, Artificial Sequence; identical to SEQ ID NO: 59281
  Description of Artificial Sequence: Synthetic oligonucleotide

SEQ ID NO: 400700 - DNA, 30 bp, Artificial Sequence; identical to SEQ ID NO: 59282
  Description of Artificial Sequence: Synthetic oligonucleotide

SEQ ID NO: 400701 - DNA, 31 bp, Artificial Sequence; identical to SEQ ID NO: 59283
  Description of Artificial Sequence: Synthetic oligonucleotide

SEQ ID NO: 400702 - DNA, 30 bp, Artificial Sequence; identical to SEQ ID NO: 59284
  Description of Artificial Sequence: Synthetic oligonucleotide

SEQ ID NO: 400703 - DNA, 31 bp, Artificial Sequence; identical to SEQ ID NO: 59285
  Description of Artificial Sequence: Synthetic oligonucleotide

SEQ ID NO: 400704 - DNA, 30 bp, Artificial Sequence; identical to SEQ ID NO: 59286
  Description of Artificial Sequence: Synthetic oligonucleotide

SEQ ID NO: 400705 - DNA, 27 bp, Artificial Sequence
  Description of Artificial Sequence: Synthetic oligonucleotide
cattggaggcttcgtgctggggctcat

SEQ ID NO: 400706 - DNA, 27 bp, Artificial Sequence
  Description of Artificial Sequence: Synthetic oligonucleotide
attggaggcttcgtgctggggctcatc

SEQ ID NO: 400707 - DNA, 27 bp, Artificial Sequence
  Description of Artificial Sequence: Synthetic oligonucleotide
ttggaggcttcgtgctggggctcatct

SEQ ID NO: 400708 - DNA, 27 bp, Artificial Sequence
  Description of Artificial Sequence: Synthetic oligonucleotide
tggaggcttcgtgctggggctcatctt

SEQ ID NO: 400709 - DNA, 26 bp, Artificial Sequence
  Description of Artificial Sequence: Synthetic oligonucleotide
ggaggcttcgtgctggggctcatctt

SEQ ID NO: 400710 - DNA, 26 bp, Artificial Sequence
  Description of Artificial Sequence: Synthetic oligonucleotide
gaggcttcgtgctggggctcatcttc

SEQ ID NO: 400711 - DNA, 27 bp, Artificial Sequence
  Description of Artificial Sequence: Synthetic oligonucleotide
aggcttcgtgctggggctcatcttcct

SEQ ID NO: 400712 - DNA, 26 bp, Artificial Sequence
  Description of Artificial Sequence: Synthetic oligonucleotide
ggcttcgtgctggggctcatcttcct

SEQ ID NO: 400713 - DNA, 26 bp, Artificial Sequence
  Description of Artificial Sequence: Synthetic oligonucleotide
gcttcgtgctggggctcatcttcctc

SEQ ID NO: 400714 - DNA, 26 bp, Artificial Sequence
  Description of Artificial Sequence: Synthetic oligonucleotide
cttcgtgctggggctcatcttcctcg

SEQ ID NO: 400715 - DNA, 26 bp, Artificial Sequence
  Description of Artificial Sequence: Synthetic oligonucleotide
ttcgtgctggggctcatcttcctcgg

SEQ ID NO: 400716 - DNA, 25 bp, Artificial Sequence
  Description of Artificial Sequence: Synthetic oligonucleotide
tcgtgctggggctcatcttcctcgg

SEQ ID NO: 400717 - DNA, 24 bp, Artificial Sequence
  Description of Artificial Sequence: Synthetic oligonucleotide
cgtgctggggctcatcttcctcgg

SEQ ID NO: 400718 - DNA, 24 bp, Artificial Sequence
  Description of Artificial Sequence: Synthetic oligonucleotide
gtgctggggctcatcttcctcggg

SEQ ID NO: 400719 - DNA, 25 bp, Artificial Sequence
  Description of Artificial Sequence: Synthetic oligonucleotide
tgctggggctcatcttcctcgggct

SEQ ID NO: 400720 - DNA, 24 bp, Artificial Sequence
  Description of Artificial Sequence: Synthetic oligonucleotide
gctggggctcatcttcctcgggct

SEQ ID NO: 400721 - DNA, 24 bp, Artificial Sequence
  Description of Artificial Sequence: Synthetic oligonucleotide
ctggggctcatcttcctcgggctg

SEQ ID NO: 400722 - DNA, 24 bp, Artificial Sequence
  Description of Artificial Sequence: Synthetic oligonucleotide
tggggctcatcttcctcgggctgg

SEQ ID NO: 400723 - DNA, 23 bp, Artificial Sequence
  Description of Artificial Sequence: Synthetic oligonucleotide
ggggctcatcttcctcgggctgg

SEQ ID NO: 400724 - DNA, 23 bp, Artificial Sequence
  Description of Artificial Sequence: Synthetic oligonucleotide
gggctcatcttcctcgggctggg

SEQ ID NO: 400725 - DNA, 23 bp, Artificial Sequence
  Description of Artificial Sequence: Synthetic oligonucleotide
ggctcatcttcctcgggctgggc

SEQ ID NO: 400726 - DNA, 27 bp, Artificial Sequence
  Description of Artificial Sequence: Synthetic oligonucleotide
gctcatcttcctcgggctgggccttat

SEQ ID NO: 400727 - DNA, 30 bp, Artificial Sequence; identical to SEQ ID NO: 59309
  Description of Artificial Sequence: Synthetic oligonucleotide

SEQ ID NO: 400728 - DNA, 30 bp, Artificial Sequence; identical to SEQ ID NO: 59310
  Description of Artificial Sequence: Synthetic oligonucleotide

SEQ ID NO: 400729 - DNA, 29 bp, Artificial Sequence
  Description of Artificial Sequence: Synthetic oligonucleotide
catcttcctcgggctgggccttattatcc

SEQ ID NO: 400730 - DNA, 31 bp, Artificial Sequence; identical to SEQ ID NO: 59312
  Description of Artificial Sequence: Synthetic oligonucleotide

SEQ ID NO: 400731 - DNA, 30 bp, Artificial Sequence; identical to SEQ ID NO: 59313
  Description of Artificial Sequence: Synthetic oligonucleotide

SEQ ID NO: 400732 - DNA, 29 bp, Artificial Sequence
  Description of Artificial Sequence: Synthetic oligonucleotide
cttcctcgggctgggccttattatccatc

SEQ ID NO: 400733 - DNA, 30 bp, Artificial Sequence; identical to SEQ ID NO: 59315
  Description of Artificial Sequence: Synthetic oligonucleotide

SEQ ID NO: 400734 - DNA, 29 bp, Artificial Sequence
  Description of Artificial Sequence: Synthetic oligonucleotide
tcctcgggctgggccttattatccatcac

SEQ ID NO: 400735 - DNA, 28 bp, Artificial Sequence
  Description of Artificial Sequence: Synthetic oligonucleotide
cctcgggctgggccttattatccatcac

SEQ ID NO: 400736 - DNA, 29 bp, Artificial Sequence
  Description of Artificial Sequence: Synthetic oligonucleotide
ctcgggctgggccttattatccatcacag

SEQ ID NO: 400737 - DNA, 29 bp, Artificial Sequence
  Description of Artificial Sequence: Synthetic oligonucleotide
tcgggctgggccttattatccatcacagg

SEQ ID NO: 400738 - DNA, 28 bp, Artificial Sequence
  Description of Artificial Sequence: Synthetic oligonucleotide
cgggctgggccttattatccatcacagg

SEQ ID NO: 400739 - DNA, 29 bp, Artificial Sequence
  Description of Artificial Sequence: Synthetic oligonucleotide
gggctgggccttattatccatcacaggag

SEQ ID NO: 400740 - DNA, 30 bp, Artificial Sequence; identical to SEQ ID NO: 59322
  Description of Artificial Sequence: Synthetic oligonucleotide

SEQ ID NO: 400741 - DNA, 31 bp, Artificial Sequence; identical to SEQ ID NO: 59323
  Description of Artificial Sequence: Synthetic oligonucleotide

SEQ ID NO: 400742 - DNA, 34 bp, Artificial Sequence; identical to SEQ ID NO: 59324
  Description of Artificial Sequence: Synthetic oligonucleotide

SEQ ID NO: 400743 - DNA, 34 bp, Artificial Sequence; identical to SEQ ID NO: 59325
  Description of Artificial Sequence: Synthetic oligonucleotide

SEQ ID NO: 400744 - DNA, 33 bp, Artificial Sequence; identical to SEQ ID NO: 59326
  Description of Artificial Sequence: Synthetic oligonucleotide

SEQ ID NO: 400745 - DNA, 33 bp, Artificial Sequence; identical to SEQ ID NO: 59327
  Description of Artificial Sequence: Synthetic oligonucleotide

SEQ ID NO: 400746 - DNA, 33 bp, Artificial Sequence; identical to SEQ ID NO: 59328
  Description of Artificial Sequence: Synthetic oligonucleotide

SEQ ID NO: 400747 - DNA, 34 bp, Artificial Sequence; identical to SEQ ID NO: 59329
  Description of Artificial Sequence: Synthetic oligonucleotide

SEQ ID NO: 400748 - DNA, 34 bp, Artificial Sequence; identical to SEQ ID NO: 59330
  Description of Artificial Sequence: Synthetic oligonucleotide

SEQ ID NO: 400749 - DNA, 35 bp, Artificial Sequence; identical to SEQ ID NO: 59331
  Description of Artificial Sequence: Synthetic oligonucleotide

SEQ ID NO: 400750 - DNA, 34 bp, Artificial Sequence; identical to SEQ ID NO: 59332
  Description of Artificial Sequence: Synthetic oligonucleotide

SEQ ID NO: 400751 - DNA, 33 bp, Artificial Sequence; identical to SEQ ID NO: 59333
  Description of Artificial Sequence: Synthetic oligonucleotide

SEQ ID NO: 400752 - DNA, 32 bp, Artificial Sequence; identical to SEQ ID NO: 59334
  Description of Artificial Sequence: Synthetic oligonucleotide

SEQ ID NO: 400753 - DNA, 31 bp, Artificial Sequence; identical to SEQ ID NO: 59335
  Description of Artificial Sequence: Synthetic oligonucleotide

SEQ ID NO: 400754 - DNA, 38 bp, Artificial Sequence
  Description of Artificial Sequence: Synthetic oligonucleotide
tgccaggcactggattgagaaccttcacaaaaaaaatc

SEQ ID NO: 400755 - DNA, 37 bp, Artificial Sequence
  Description of Artificial Sequence: Synthetic oligonucleotide
gccaggcactggattgagaaccttcacaaaaaaaatc

SEQ ID NO: 400756 - DNA, 38 bp, Artificial Sequence
  Description of Artificial Sequence: Synthetic oligonucleotide
ccaggcactggattgagaaccttcacaaaaaaaatctg

SEQ ID NO: 400757 - DNA, 38 bp, Artificial Sequence
  Description of Artificial Sequence: Synthetic oligonucleotide
caggcactggattgagaaccttcacaaaaaaaatctgc

SEQ ID NO: 400758 - DNA, 38 bp, Artificial Sequence
  Description of Artificial Sequence: Synthetic oligonucleotide
aggcactggattgagaaccttcacaaaaaaaatctgcc

SEQ ID NO: 400759 - DNA, 37 bp, Artificial Sequence
  Description of Artificial Sequence: Synthetic oligonucleotide
ggcactggattgagaaccttcacaaaaaaaatctgcc

SEQ ID NO: 400760 - DNA, 37 bp, Artificial Sequence
  Description of Artificial Sequence: Synthetic oligonucleotide
gcactggattgagaaccttcacaaaaaaaatctgccc

SEQ ID NO: 400761 - DNA, 38 bp, Artificial Sequence
  Description of Artificial Sequence: Synthetic oligonucleotide
cactggattgagaaccttcacaaaaaaaatctgcccag

SEQ ID NO: 400762 - DNA, 39 bp, Artificial Sequence
  Description of Artificial Sequence: Synthetic oligonucleotide
actggattgagaaccttcacaaaaaaaatctgcccagag

SEQ ID NO: 400763 - DNA, 38 bp, Artificial Sequence
  Description of Artificial Sequence: Synthetic oligonucleotide
ctggattgagaaccttcacaaaaaaaatctgcccagag

SEQ ID NO: 400764 - DNA, 39 bp, Artificial Sequence
  Description of Artificial Sequence: Synthetic oligonucleotide
tggattgagaaccttcacaaaaaaaatctgcccagagac

SEQ ID NO: 400765 - DNA, 38 bp, Artificial Sequence
  Description of Artificial Sequence: Synthetic oligonucleotide
ggattgagaaccttcacaaaaaaaatctgcccagagac

SEQ ID NO: 400766 - DNA, 39 bp, Artificial Sequence
  Description of Artificial Sequence: Synthetic oligonucleotide
gattgagaaccttcacaaaaaaaatctgcccagagacag

SEQ ID NO: 400767 - DNA, 41 bp, Artificial Sequence
  Description of Artificial Sequence: Synthetic oligonucleotide
attgagaaccttcacaaaaaaaatctgcccagagacagatg

SEQ ID NO: 400768 - DNA, 40 bp, Artificial Sequence
  Description of Artificial Sequence: Synthetic oligonucleotide
ttgagaaccttcacaaaaaaaatctgcccagagacagatg

SEQ ID NO: 400769 - DNA, 39 bp, Artificial Sequence
  Description of Artificial Sequence: Synthetic oligonucleotide
tgagaaccttcacaaaaaaaatctgcccagagacagatg

SEQ ID NO: 400770 - DNA, 38 bp, Artificial Sequence
  Description of Artificial Sequence: Synthetic oligonucleotide
gagaaccttcacaaaaaaaatctgcccagagacagatg

SEQ ID NO: 400771 - DNA, 39 bp, Artificial Sequence
  Description of Artificial Sequence: Synthetic oligonucleotide
agaaccttcacaaaaaaaatctgcccagagacagatgag

SEQ ID NO: 400772 - DNA, 38 bp, Artificial Sequence
  Description of Artificial Sequence: Synthetic oligonucleotide
gaaccttcacaaaaaaaatctgcccagagacagatgag

SEQ ID NO: 400773 - DNA, 38 bp, Artificial Sequence
  Description of Artificial Sequence: Synthetic oligonucleotide
aaccttcacaaaaaaaatctgcccagagacagatgagg

SEQ ID NO: 400774 - DNA, 37 bp, Artificial Sequence
  Description of Artificial Sequence: Synthetic oligonucleotide
accttcacaaaaaaaatctgcccagagacagatgagg

SEQ ID NO: 400775 - DNA, 36 bp, Artificial Sequence
  Description of Artificial Sequence: Synthetic oligonucleotide
ccttcacaaaaaaaatctgcccagagacagatgagg

SEQ ID NO: 400776 - DNA, 37 bp, Artificial Sequence
  Description of Artificial Sequence: Synthetic oligonucleotide
cttcacaaaaaaaatctgcccagagacagatgaggtc

SEQ ID NO: 400777 - DNA, 37 bp, Artificial Sequence
  Description of Artificial Sequence: Synthetic oligonucleotide
ttcacaaaaaaaatctgcccagagacagatgaggtcc

SEQ ID NO: 400778 - DNA, 36 bp, Artificial Sequence
  Description of Artificial Sequence: Synthetic oligonucleotide
tcacaaaaaaaatctgcccagagacagatgaggtcc

SEQ ID NO: 400779 - DNA, 33 bp, Artificial Sequence; identical to SEQ ID NO: 59336
  Description of Artificial Sequence: Synthetic oligonucleotide

SEQ ID NO: 400780 - DNA, 32 bp, Artificial Sequence; identical to SEQ ID NO: 59337
  Description of Artificial Sequence: Synthetic oligonucleotide

SEQ ID NO: 400781 - DNA, 32 bp, Artificial Sequence; identical to SEQ ID NO: 59338
  Description of Artificial Sequence: Synthetic oligonucleotide

SEQ ID NO: 400782 - DNA, 32 bp, Artificial Sequence; identical to SEQ ID NO: 59339
  Description of Artificial Sequence: Synthetic oligonucleotide

SEQ ID NO: 400783 - DNA, 31 bp, Artificial Sequence; identical to SEQ ID NO: 59340
  Description of Artificial Sequence: Synthetic oligonucleotide

SEQ ID NO: 400784 - DNA, 31 bp, Artificial Sequence; identical to SEQ ID NO: 59341
  Description of Artificial Sequence: Synthetic oligonucleotide

SEQ ID NO: 400785 - DNA, 30 bp, Artificial Sequence; identical to SEQ ID NO: 59342
  Description of Artificial Sequence: Synthetic oligonucleotide

SEQ ID NO: 400786 - DNA, 29 bp, Artificial Sequence
  Description of Artificial Sequence: Synthetic oligonucleotide
acatctataaccgagaggagtacgcgcgc

SEQ ID NO: 400787 - DNA, 28 bp, Artificial Sequence
  Description of Artificial Sequence: Synthetic oligonucleotide
catctataaccgagaggagtacgcgcgc

SEQ ID NO: 400788 - DNA, 30 bp, Artificial Sequence; identical to SEQ ID NO: 59345
  Description of Artificial Sequence: Synthetic oligonucleotide

SEQ ID NO: 400789 - DNA, 29 bp, Artificial Sequence
  Description of Artificial Sequence: Synthetic oligonucleotide
tctataaccgagaggagtacgcgcgcttc

SEQ ID NO: 400790 - DNA, 28 bp, Artificial Sequence
  Description of Artificial Sequence: Synthetic oligonucleotide
ctataaccgagaggagtacgcgcgcttc

SEQ ID NO: 400791 - DNA, 28 bp, Artificial Sequence
  Description of Artificial Sequence: Synthetic oligonucleotide
tataaccgagaggagtacgcgcgcttcg

SEQ ID NO: 400792 - DNA, 27 bp, Artificial Sequence
  Description of Artificial Sequence: Synthetic oligonucleotide
ataaccgagaggagtacgcgcgcttcg

SEQ ID NO: 400793 - DNA, 27 bp, Artificial Sequence
  Description of Artificial Sequence: Synthetic oligonucleotide
taaccgagaggagtacgcgcgcttcga

SEQ ID NO: 400794 - DNA, 26 bp, Artificial Sequence
  Description of Artificial Sequence: Synthetic oligonucleotide
aaccgagaggagtacgcgcgcttcga

SEQ ID NO: 400795 - DNA, 25 bp, Artificial Sequence
  Description of Artificial Sequence: Synthetic oligonucleotide
accgagaggagtacgcgcgcttcga

SEQ ID NO: 400796 - DNA, 24 bp, Artificial Sequence
  Description of Artificial Sequence: Synthetic oligonucleotide
ccgagaggagtacgcgcgcttcga

SEQ ID NO: 400797 - DNA, 25 bp, Artificial Sequence
  Description of Artificial Sequence: Synthetic oligonucleotide
cgagaggagtacgcgcgcttcgaca

SEQ ID NO: 400798 - DNA, 25 bp, Artificial Sequence
  Description of Artificial Sequence: Synthetic oligonucleotide
gagaggagtacgcgcgcttcgacag

SEQ ID NO: 400799 - DNA, 25 bp, Artificial Sequence
  Description of Artificial Sequence: Synthetic oligonucleotide
agaggagtacgcgcgcttcgacagc

SEQ ID NO: 400800 - DNA, 23 bp, Artificial Sequence
  Description of Artificial Sequence: Synthetic oligonucleotide
gcgcgcttcgacagcgacgtgga

SEQ ID NO: 400801 - DNA, 23 bp, Artificial Sequence
  Description of Artificial Sequence: Synthetic oligonucleotide
cgcgcttcgacagcgacgtggag

SEQ ID NO: 400802 - DNA, 24 bp, Artificial Sequence
  Description of Artificial Sequence: Synthetic oligonucleotide
gcgcttcgacagcgacgtggaggt

SEQ ID NO: 400803 - DNA, 20 bp, Artificial Sequence
  Description of Artificial Sequence: Synthetic oligonucleotide
ggtgacgccgctggggccct

SEQ ID NO: 400804 - DNA, 20 bp, Artificial Sequence
  Description of Artificial Sequence: Synthetic oligonucleotide
gtgacgccgctggggcccct

SEQ ID NO: 400805 - DNA, 20 bp, Artificial Sequence
  Description of Artificial Sequence: Synthetic oligonucleotide
tgacgccgctggggccccct

SEQ ID NO: 400806 - DNA, 20 bp, Artificial Sequence
  Description of Artificial Sequence: Synthetic oligonucleotide
gacgccgctggggccccctt

SEQ ID NO: 400807 - DNA, 20 bp, Artificial Sequence
  Description of Artificial Sequence: Synthetic oligonucleotide
acgccgctggggccccctga

SEQ ID NO: 400808 - DNA, 20 bp, Artificial Sequence
  Description of Artificial Sequence: Synthetic oligonucleotide
cgccgctggggccccctgat

SEQ ID NO: 400809 - DNA, 20 bp, Artificial Sequence
  Description of Artificial Sequence: Synthetic oligonucleotide
gccgctggggccccctgact

SEQ ID NO: 400810 - DNA, 20 bp, Artificial Sequence
  Description of Artificial Sequence: Synthetic oligonucleotide
ccgctggggccccctgacgt

SEQ ID NO: 400811 - DNA, 20 bp, Artificial Sequence
  Description of Artificial Sequence: Synthetic oligonucleotide
cgctggggccccctgacgct

SEQ ID NO: 400812 - DNA, 20 bp, Artificial Sequence
  Description of Artificial Sequence: Synthetic oligonucleotide
gctggggccccctgacgcct

SEQ ID NO: 400813 - DNA, 20 bp, Artificial Sequence
  Description of Artificial Sequence: Synthetic oligonucleotide
ctggggccccctgacgccga

SEQ ID NO: 400814 - DNA, 22 bp, Artificial Sequence
  Description of Artificial Sequence: Synthetic oligonucleotide
tggggccccctgacgccgagta

SEQ ID NO: 400815 - DNA, 21 bp, Artificial Sequence
  Description of Artificial Sequence: Synthetic oligonucleotide
ggggccccctgacgccgagta

SEQ ID NO: 400816 - DNA, 22 bp, Artificial Sequence
  Description of Artificial Sequence: Synthetic oligonucleotide
gggccccctgacgccgagtact

SEQ ID NO: 400817 - DNA, 22 bp, Artificial Sequence
  Description of Artificial Sequence: Synthetic oligonucleotide
ggccccctgacgccgagtactg

SEQ ID NO: 400818 - DNA, 24 bp, Artificial Sequence
  Description of Artificial Sequence: Synthetic oligonucleotide
gccccctgacgccgagtactggaa

SEQ ID NO: 400819 - DNA, 25 bp, Artificial Sequence
  Description of Artificial Sequence: Synthetic oligonucleotide
ccccctgacgccgagtactggaaca

SEQ ID NO: 400820 - DNA, 25 bp, Artificial Sequence
  Description of Artificial Sequence: Synthetic oligonucleotide
cccctgacgccgagtactggaacag

SEQ ID NO: 400821 - DNA, 25 bp, Artificial Sequence
  Description of Artificial Sequence: Synthetic oligonucleotide
ccctgacgccgagtactggaacagc

SEQ ID NO: 400822 - DNA, 31 bp, Artificial Sequence; identical to SEQ ID NO: 59379
  Description of Artificial Sequence: Synthetic oligonucleotide

SEQ ID NO: 400823 - DNA, 30 bp, Artificial Sequence; identical to SEQ ID NO: 59380
  Description of Artificial Sequence: Synthetic oligonucleotide

SEQ ID NO: 400824 - DNA, 29 bp, Artificial Sequence
  Description of Artificial Sequence: Synthetic oligonucleotide
gctggaaatgactccccagcatggagatg

SEQ ID NO: 400825 - DNA, 30 bp, Artificial Sequence; identical to SEQ ID NO: 59382
  Description of Artificial Sequence: Synthetic oligonucleotide

SEQ ID NO: 400826 - DNA, 32 bp, Artificial Sequence; identical to SEQ ID NO: 59383
  Description of Artificial Sequence: Synthetic oligonucleotide

SEQ ID NO: 400827 - DNA, 31 bp, Artificial Sequence; identical to SEQ ID NO: 59384
  Description of Artificial Sequence: Synthetic oligonucleotide

SEQ ID NO: 400828 - DNA, 32 bp, Artificial Sequence; identical to SEQ ID NO: 59385
  Description of Artificial Sequence: Synthetic oligonucleotide

SEQ ID NO: 400829 - DNA, 32 bp, Artificial Sequence; identical to SEQ ID NO: 59386
  Description of Artificial Sequence: Synthetic oligonucleotide

SEQ ID NO: 400830 - DNA, 31 bp, Artificial Sequence; identical to SEQ ID NO: 59387
  Description of Artificial Sequence: Synthetic oligonucleotide

SEQ ID NO: 400831 - DNA, 30 bp, Artificial Sequence; identical to SEQ ID NO: 59388
  Description of Artificial Sequence: Synthetic oligonucleotide

SEQ ID NO: 400832 - DNA, 29 bp, Artificial Sequence
  Description of Artificial Sequence: Synthetic oligonucleotide
tgactccccagcatggagatgtctacacc

SEQ ID NO: 400833 - DNA, 28 bp, Artificial Sequence
  Description of Artificial Sequence: Synthetic oligonucleotide
gactccccagcatggagatgtctacacc

SEQ ID NO: 400834 - DNA, 29 bp, Artificial Sequence
  Description of Artificial Sequence: Synthetic oligonucleotide
actccccagcatggagatgtctacacctg

SEQ ID NO: 400835 - DNA, 28 bp, Artificial Sequence
  Description of Artificial Sequence: Synthetic oligonucleotide
ctccccagcatggagatgtctacacctg

SEQ ID NO: 400836 - DNA, 28 bp, Artificial Sequence
  Description of Artificial Sequence: Synthetic oligonucleotide
tccccagcatggagatgtctacacctgc

SEQ ID NO: 400837 - DNA, 27 bp, Artificial Sequence
  Description of Artificial Sequence: Synthetic oligonucleotide
ccccagcatggagatgtctacacctgc

SEQ ID NO: 400838 - DNA, 27 bp, Artificial Sequence
  Description of Artificial Sequence: Synthetic oligonucleotide
cccagcatggagatgtctacacctgcc

SEQ ID NO: 400839 - DNA, 28 bp, Artificial Sequence
  Description of Artificial Sequence: Synthetic oligonucleotide
ccagcatggagatgtctacacctgccac

SEQ ID NO: 400840 - DNA, 28 bp, Artificial Sequence
  Description of Artificial Sequence: Synthetic oligonucleotide
cagcatggagatgtctacacctgccacg

SEQ ID NO: 400841 - DNA, 29 bp, Artificial Sequence
  Description of Artificial Sequence: Synthetic oligonucleotide
agcatggagatgtctacacctgccacgtg

SEQ ID NO: 400842 - DNA, 28 bp, Artificial Sequence
  Description of Artificial Sequence: Synthetic oligonucleotide
gcatggagatgtctacacctgccacgtg

SEQ ID NO: 400843 - DNA, 28 bp, Artificial Sequence
  Description of Artificial Sequence: Synthetic oligonucleotide
catggagatgtctacacctgccacgtgg

SEQ ID NO: 400844 - DNA, 29 bp, Artificial Sequence
  Description of Artificial Sequence: Synthetic oligonucleotide
atggagatgtctacacctgccacgtggag

SEQ ID NO: 400845 - DNA, 28 bp, Artificial Sequence
  Description of Artificial Sequence: Synthetic oligonucleotide
tggagatgtctacacctgccacgtggag

SEQ ID NO: 400846 - DNA, 27 bp, Artificial Sequence
  Description of Artificial Sequence: Synthetic oligonucleotide
ggagatgtctacacctgccacgtggag

SEQ ID NO: 400847 - DNA, 27 bp, Artificial Sequence
  Description of Artificial Sequence: Synthetic oligonucleotide
gagatgtctacacctgccacgtggagc

SEQ ID NO: 400848 - DNA, 28 bp, Artificial Sequence
  Description of Artificial Sequence: Synthetic oligonucleotide
agatgtctacacctgccacgtggagcac

SEQ ID NO: 400849 - DNA, 27 bp, Artificial Sequence
  Description of Artificial Sequence: Synthetic oligonucleotide
gatgtctacacctgccacgtggagcac

SEQ ID NO: 400850 - DNA, 27 bp, Artificial Sequence
  Description of Artificial Sequence: Synthetic oligonucleotide
atgtctacacctgccacgtggagcacc

SEQ ID NO: 400851 - DNA, 26 bp, Artificial Sequence
  Description of Artificial Sequence: Synthetic oligonucleotide
tgtctacacctgccacgtggagcacc

SEQ ID NO: 400852 - DNA, 27 bp, Artificial Sequence
  Description of Artificial Sequence: Synthetic oligonucleotide
cggaatgaccaggaggagacaaccggt

SEQ ID NO: 400853 - DNA, 27 bp, Artificial Sequence
  Description of Artificial Sequence: Synthetic oligonucleotide
ggaatgaccaggaggagacaaccggtg

SEQ ID NO: 400854 - DNA, 29 bp, Artificial Sequence
  Description of Artificial Sequence: Synthetic oligonucleotide
gaatgaccaggaggagacaaccggtgttg

SEQ ID NO: 400855 - DNA, 30 bp, Artificial Sequence
  Description of Artificial Sequence: Synthetic oligonucleotide
aatgaccaggaggagacaaccggtgttgtg

SEQ ID NO: 400856 - DNA, 29 bp, Artificial Sequence
  Description of Artificial Sequence: Synthetic oligonucleotide
atgaccaggaggagacaaccggtgttgtg

SEQ ID NO: 400857 - DNA, 28 bp, Artificial Sequence
  Description of Artificial Sequence: Synthetic oligonucleotide
tgaccaggaggagacaaccggtgttgtg

SEQ ID NO: 400858 - DNA, 27 bp, Artificial Sequence
  Description of Artificial Sequence: Synthetic oligonucleotide
gaccaggaggagacaaccggtgttgtg

SEQ ID NO: 400859 - DNA, 28 bp, Artificial Sequence
  Description of Artificial Sequence: Synthetic oligonucleotide
accaggaggagacaaccggtgttgtgtc

SEQ ID NO: 400860 - DNA, 27 bp, Artificial Sequence
  Description of Artificial Sequence: Synthetic oligonucleotide
ccaggaggagacaaccggtgttgtgtc

SEQ ID NO: 400861 - DNA, 27 bp, Artificial Sequence
  Description of Artificial Sequence: Synthetic oligonucleotide
caggaggagacaaccggtgttgtgtcc

SEQ ID NO: 400862 - DNA, 28 bp, Artificial Sequence
  Description of Artificial Sequence: Synthetic oligonucleotide
aggaggagacaaccggtgttgtgtccac

SEQ ID NO: 400863 - DNA, 27 bp, Artificial Sequence
  Description of Artificial Sequence: Synthetic oligonucleotide
ggaggagacaaccggtgttgtgtccac

SEQ ID NO: 400864 - DNA, 27 bp, Artificial Sequence
  Description of Artificial Sequence: Synthetic oligonucleotide
gaggagacaaccggtgttgtgtccacc

SEQ ID NO: 400865 - DNA, 27 bp, Artificial Sequence
  Description of Artificial Sequence: Synthetic oligonucleotide
aggagacaaccggtgttgtgtccaccc

SEQ ID NO: 400866 - DNA, 26 bp, Artificial Sequence
  Description of Artificial Sequence: Synthetic oligonucleotide
ggagacaaccggtgttgtgtccaccc

SEQ ID NO: 400867 - DNA, 26 bp, Artificial Sequence
  Description of Artificial Sequence: Synthetic oligonucleotide
gagacaaccggtgttgtgtccacccc

SEQ ID NO: 400868 - DNA, 26 bp, Artificial Sequence
  Description of Artificial Sequence: Synthetic oligonucleotide
agacaaccggtgttgtgtccaccccc

SEQ ID NO: 400869 - DNA, 25 bp, Artificial Sequence
  Description of Artificial Sequence: Synthetic oligonucleotide
gacaaccggtgttgtgtccaccccc

SEQ ID NO: 400870 - DNA, 27 bp, Artificial Sequence
  Description of Artificial Sequence: Synthetic oligonucleotide
acaaccggtgttgtgtccacccccctt

SEQ ID NO: 400871 - DNA, 27 bp, Artificial Sequence
  Description of Artificial Sequence: Synthetic oligonucleotide
caaccggtgttgtgtccacccccctta

SEQ ID NO: 400872 - DNA, 30 bp, Artificial Sequence
  Description of Artificial Sequence: Synthetic oligonucleotide
aaccggtgttgtgtccaccccccttattag

SEQ ID NO: 400873 - DNA, 29 bp, Artificial Sequence
  Description of Artificial Sequence: Synthetic oligonucleotide
accggtgttgtgtccaccccccttattag

SEQ ID NO: 400874 - DNA, 28 bp, Artificial Sequence
  Description of Artificial Sequence: Synthetic oligonucleotide
ccggtgttgtgtccaccccccttattag

SEQ ID NO: 400875 - DNA, 28 bp, Artificial Sequence
  Description of Artificial Sequence: Synthetic oligonucleotide
cggtgttgtgtccaccccccttattagg

SEQ ID NO: 400876 - DNA, 30 bp, Artificial Sequence
  Description of Artificial Sequence: Synthetic oligonucleotide
ggtgttgtgtccaccccccttattaggaac

SEQ ID NO: 400877 - DNA, 30 bp, Artificial Sequence
  Description of Artificial Sequence: Synthetic oligonucleotide
gtgttgtgtccaccccccttattaggaacg

SEQ ID NO: 400878 - DNA, 30 bp, Artificial Sequence
  Description of Artificial Sequence: Synthetic oligonucleotide
tgttgtgtccaccccccttattaggaacgg

SEQ ID NO: 400879 - DNA, 25 bp, Artificial Sequence
  Description of Artificial Sequence: Synthetic oligonucleotide
cgggcggagttggacacggtgtgta

SEQ ID NO: 400880 - DNA, 26 bp, Artificial Sequence
  Description of Artificial Sequence: Synthetic oligonucleotide
gggcggagttggacacggtgtgtaga

SEQ ID NO: 400881 - DNA, 27 bp, Artificial Sequence
  Description of Artificial Sequence: Synthetic oligonucleotide
ggcggagttggacacggtgtgtagaca

SEQ ID NO: 400882 - DNA, 27 bp, Artificial Sequence
  Description of Artificial Sequence: Synthetic oligonucleotide
gcggagttggacacggtgtgtagacac

SEQ ID NO: 400883 - DNA, 29 bp, Artificial Sequence
  Description of Artificial Sequence: Synthetic oligonucleotide
cggagttggacacggtgtgtagacacaac

SEQ ID NO: 400884 - DNA, 31 bp, Artificial Sequence
  Description of Artificial Sequence: Synthetic oligonucleotide
ggagttggacacggtgtgtagacacaactac

SEQ ID NO: 400885 - DNA, 31 bp, Artificial Sequence
  Description of Artificial Sequence: Synthetic oligonucleotide
gagttggacacggtgtgtagacacaactacc

SEQ ID NO: 400886 - DNA, 32 bp, Artificial Sequence
  Description of Artificial Sequence: Synthetic oligonucleotide
agttggacacggtgtgtagacacaactaccag

SEQ ID NO: 400887 - DNA, 31 bp, Artificial Sequence
  Description of Artificial Sequence: Synthetic oligonucleotide
gttggacacggtgtgtagacacaactaccag

SEQ ID NO: 400888 - DNA, 33 bp, Artificial Sequence
  Description of Artificial Sequence: Synthetic oligonucleotide
ttggacacggtgtgtagacacaactaccagttg

SEQ ID NO: 400889 - DNA, 32 bp, Artificial Sequence
  Description of Artificial Sequence: Synthetic oligonucleotide
tggacacggtgtgtagacacaactaccagttg

SEQ ID NO: 400890 - DNA, 31 bp, Artificial Sequence
  Description of Artificial Sequence: Synthetic oligonucleotide
ggacacggtgtgtagacacaactaccagttg

SEQ ID NO: 400891 - DNA, 31 bp, Artificial Sequence
  Description of Artificial Sequence: Synthetic oligonucleotide
gacacggtgtgtagacacaactaccagttgg

SEQ ID NO: 400892 - DNA, 32 bp, Artificial Sequence
  Description of Artificial Sequence: Synthetic oligonucleotide
acacggtgtgtagacacaactaccagttggag

SEQ ID NO: 400893 - DNA, 31 bp, Artificial Sequence
  Description of Artificial Sequence: Synthetic oligonucleotide
cacggtgtgtagacacaactaccagttggag

SEQ ID NO: 400894 - DNA, 31 bp, Artificial Sequence
  Description of Artificial Sequence: Synthetic oligonucleotide
acggtgtgtagacacaactaccagttggagc

SEQ ID NO: 400895 - DNA, 30 bp, Artificial Sequence
  Description of Artificial Sequence: Synthetic oligonucleotide
cggtgtgtagacacaactaccagttggagc

SEQ ID NO: 400896 - DNA, 31 bp, Artificial Sequence
  Description of Artificial Sequence: Synthetic oligonucleotide
ggtgtgtagacacaactaccagttggagctc

SEQ ID NO: 400897 - DNA, 31 bp, Artificial Sequence
  Description of Artificial Sequence: Synthetic oligonucleotide
gtgtgtagacacaactaccagttggagctcc

SEQ ID NO: 400898 - DNA, 31 bp, Artificial Sequence
  Description of Artificial Sequence: Synthetic oligonucleotide
tgtgtagacacaactaccagttggagctccg

SEQ ID NO: 400899 - DNA, 30 bp, Artificial Sequence
  Description of Artificial Sequence: Synthetic oligonucleotide
gtgtagacacaactaccagttggagctccg

SEQ ID NO: 400900 - DNA, 30 bp, Artificial Sequence
  Description of Artificial Sequence: Synthetic oligonucleotide
tgtagacacaactaccagttggagctccgc

SEQ ID NO: 400901 - DNA, 29 bp, Artificial Sequence
  Description of Artificial Sequence: Synthetic oligonucleotide
gtagacacaactaccagttggagctccgc

SEQ ID NO: 400902 - DNA, 30 bp, Artificial Sequence
  Description of Artificial Sequence: Synthetic oligonucleotide
tagacacaactaccagttggagctccgcac

SEQ ID NO: 400903 - DNA, 40 bp, Artificial Sequence
  Description of Artificial Sequence: Synthetic oligonucleotide
ttctaagaactttgctcttctcaccaaaacttaaggctcc

SEQ ID NO: 400904 - DNA, 39 bp, Artificial Sequence
  Description of Artificial Sequence: Synthetic oligonucleotide
tctaagaactttgctcttctcaccaaaacttaaggctcc

SEQ ID NO: 400905 - DNA, 38 bp, Artificial Sequence
  Description of Artificial Sequence: Synthetic oligonucleotide
ctaagaactttgctcttctcaccaaaacttaaggctcc

SEQ ID NO: 400906 - DNA, 39 bp, Artificial Sequence
  Description of Artificial Sequence: Synthetic oligonucleotide
taagaactttgctcttctcaccaaaacttaaggctcctc

SEQ ID NO: 400907 - DNA, 38 bp, Artificial Sequence
  Description of Artificial Sequence: Synthetic oligonucleotide
aagaactttgctcttctcaccaaaacttaaggctcctc

SEQ ID NO: 400908 - DNA, 37 bp, Artificial Sequence
  Description of Artificial Sequence: Synthetic oligonucleotide
agaactttgctcttctcaccaaaacttaaggctcctc

SEQ ID NO: 400909 - DNA, 36 bp, Artificial Sequence
  Description of Artificial Sequence: Synthetic oligonucleotide
gaactttgctcttctcaccaaaacttaaggctcctc

SEQ ID NO: 400910 - DNA, 37 bp, Artificial Sequence
  Description of Artificial Sequence: Synthetic oligonucleotide
aactttgctcttctcaccaaaacttaaggctcctcag

SEQ ID NO: 400911 - DNA, 36 bp, Artificial Sequence
  Description of Artificial Sequence: Synthetic oligonucleotide
actttgctcttctcaccaaaacttaaggctcctcag

SEQ ID NO: 400912 - DNA, 35 bp, Artificial Sequence
  Description of Artificial Sequence: Synthetic oligonucleotide
ctttgctcttctcaccaaaacttaaggctcctcag

SEQ ID NO: 400913 - DNA, 35 bp, Artificial Sequence
  Description of Artificial Sequence: Synthetic oligonucleotide
tttgctcttctcaccaaaacttaaggctcctcagg

SEQ ID NO: 400914 - DNA, 34 bp, Artificial Sequence
  Description of Artificial Sequence: Synthetic oligonucleotide
ttgctcttctcaccaaaacttaaggctcctcagg

SEQ ID NO: 400915 - DNA, 33 bp, Artificial Sequence
  Description of Artificial Sequence: Synthetic oligonucleotide
tgctcttctcaccaaaacttaaggctcctcagg

SEQ ID NO: 400916 - DNA, 32 bp, Artificial Sequence
  Description of Artificial Sequence: Synthetic oligonucleotide
gctcttctcaccaaaacttaaggctcctcagg

SEQ ID NO: 400917 - DNA, 32 bp, Artificial Sequence
  Description of Artificial Sequence: Synthetic oligonucleotide
ctcttctcaccaaaacttaaggctcctcaggg

SEQ ID NO: 400918 - DNA, 33 bp, Artificial Sequence
  Description of Artificial Sequence: Synthetic oligonucleotide
tcttctcaccaaaacttaaggctcctcagggtg

SEQ ID NO: 400919 - DNA, 32 bp, Artificial Sequence
  Description of Artificial Sequence: Synthetic oligonucleotide
cttctcaccaaaacttaaggctcctcagggtg

SEQ ID NO: 400920 - DNA, 33 bp, Artificial Sequence
  Description of Artificial Sequence: Synthetic oligonucleotide
ttctcaccaaaacttaaggctcctcagggtgtg

SEQ ID NO: 400921 - DNA, 32 bp, Artificial Sequence
  Description of Artificial Sequence: Synthetic oligonucleotide
tctcaccaaaacttaaggctcctcagggtgtg

SEQ ID NO: 400922 - DNA, 31 bp, Artificial Sequence
  Description of Artificial Sequence: Synthetic oligonucleotide
ctcaccaaaacttaaggctcctcagggtgtg

SEQ ID NO: 400923 - DNA, 36 bp, Artificial Sequence
  Description of Artificial Sequence: Synthetic oligonucleotide
tcccctgaaatatgatccccacttaatttgccctac

SEQ ID NO: 400924 - DNA, 35 bp, Artificial Sequence
  Description of Artificial Sequence: Synthetic oligonucleotide
cccctgaaatatgatccccacttaatttgccctac

SEQ ID NO: 400925 - DNA, 36 bp, Artificial Sequence
  Description of Artificial Sequence: Synthetic oligonucleotide
ccctgaaatatgatccccacttaatttgccctactg

SEQ ID NO: 400926 - DNA, 39 bp, Artificial Sequence
  Description of Artificial Sequence: Synthetic oligonucleotide
cctgaaatatgatccccacttaatttgccctactgaaag

SEQ ID NO: 400927 - DNA, 42 bp, Artificial Sequence
  Description of Artificial Sequence: Synthetic oligonucleotide
ctgaaatatgatccccacttaatttgccctactgaaagaatc

SEQ ID NO: 400928 - DNA, 42 bp, Artificial Sequence
  Description of Artificial Sequence: Synthetic oligonucleotide
tgaaatatgatccccacttaatttgccctactgaaagaatcc

SEQ ID NO: 400929 - DNA, 41 bp, Artificial Sequence
  Description of Artificial Sequence: Synthetic oligonucleotide
gaaatatgatccccacttaatttgccctactgaaagaatcc

SEQ ID NO: 400930 - DNA, 41 bp, Artificial Sequence
  Description of Artificial Sequence: Synthetic oligonucleotide
aaatatgatccccacttaatttgccctactgaaagaatccc

SEQ ID NO: 400931 - DNA, 40 bp, Artificial Sequence
  Description of Artificial Sequence: Synthetic oligonucleotide
aatatgatccccacttaatttgccctactgaaagaatccc

SEQ ID NO: 400932 - DNA, 39 bp, Artificial Sequence
  Description of Artificial Sequence: Synthetic oligonucleotide
atatgatccccacttaatttgccctactgaaagaatccc

SEQ ID NO: 400933 - DNA, 38 bp, Artificial Sequence
  Description of Artificial Sequence: Synthetic oligonucleotide
tatgatccccacttaatttgccctactgaaagaatccc

SEQ ID NO: 400934 - DNA, 37 bp, Artificial Sequence
  Description of Artificial Sequence: Synthetic oligonucleotide
atgatccccacttaatttgccctactgaaagaatccc

SEQ ID NO: 400935 - DNA, 36 bp, Artificial Sequence
  Description of Artificial Sequence: Synthetic oligonucleotide
tgatccccacttaatttgccctactgaaagaatccc

SEQ ID NO: 400936 - DNA, 35 bp, Artificial Sequence
  Description of Artificial Sequence: Synthetic oligonucleotide
gatccccacttaatttgccctactgaaagaatccc

SEQ ID NO: 400937 - DNA, 37 bp, Artificial Sequence
  Description of Artificial Sequence: Synthetic oligonucleotide
atccccacttaatttgccctactgaaagaatcccaag

SEQ ID NO: 400938 - DNA, 36 bp, Artificial Sequence
  Description of Artificial Sequence: Synthetic oligonucleotide
tccccacttaatttgccctactgaaagaatcccaag

SEQ ID NO: 400939 - DNA, 35 bp, Artificial Sequence
  Description of Artificial Sequence: Synthetic oligonucleotide
ccccacttaatttgccctactgaaagaatcccaag

SEQ ID NO: 400940 - DNA, 43 bp, Artificial Sequence
  Description of Artificial Sequence: Synthetic oligonucleotide
cccacttaatttgccctactgaaagaatcccaagtataaaaac

SEQ ID NO: 400941 - DNA, 45 bp, Artificial Sequence
  Description of Artificial Sequence: Synthetic oligonucleotide
ccacttaatttgccctactgaaagaatcccaagtataaaaacaac

SEQ ID NO: 400942 - DNA, 45 bp, Artificial Sequence
  Description of Artificial Sequence: Synthetic oligonucleotide
cacttaatttgccctactgaaagaatcccaagtataaaaacaacc

SEQ ID NO: 400943 - DNA, 46 bp, Artificial Sequence
  Description of Artificial Sequence: Synthetic oligonucleotide
acttaatttgccctactgaaagaatcccaagtataaaaacaaccag

SEQ ID NO: 400944 - DNA, 45 bp, Artificial Sequence
  Description of Artificial Sequence: Synthetic oligonucleotide
cttaatttgccctactgaaagaatcccaagtataaaaacaaccag

SEQ ID NO: 400945 - DNA, 53 bp, Artificial Sequence
  Description of Artificial Sequence: Synthetic oligonucleotide
ttaatttgccctactgaaagaatcccaagtataaaaacaaccagtttttaatc

SEQ ID NO: 400946 - DNA, 52 bp, Artificial Sequence
  Description of Artificial Sequence: Synthetic oligonucleotide
taatttgccctactgaaagaatcccaagtataaaaacaaccagtttttaatc

SEQ ID NO: 400947 - DNA, 51 bp, Artificial Sequence
  Description of Artificial Sequence: Synthetic oligonucleotide
aatttgccctactgaaagaatcccaagtataaaaacaaccagtttttaatc

SEQ ID NO: 400948 - DNA, 50 bp, Artificial Sequence
  Description of Artificial Sequence: Synthetic oligonucleotide
atttgccctactgaaagaatcccaagtataaaaacaaccagtttttaatc

SEQ ID NO: 400949 - DNA, 49 bp, Artificial Sequence
  Description of Artificial Sequence: Synthetic oligonucleotide
tttgccctactgaaagaatcccaagtataaaaacaaccagtttttaatc

SEQ ID NO: 400950 - DNA, 48 bp, Artificial Sequence
  Description of Artificial Sequence: Synthetic oligonucleotide
ttgccctactgaaagaatcccaagtataaaaacaaccagtttttaatc

SEQ ID NO: 400951 - DNA, 47 bp, Artificial Sequence
  Description of Artificial Sequence: Synthetic oligonucleotide
tgccctactgaaagaatcccaagtataaaaacaaccagtttttaatc

SEQ ID NO: 400952 - DNA, 46 bp, Artificial Sequence
  Description of Artificial Sequence: Synthetic oligonucleotide
gccctactgaaagaatcccaagtataaaaacaaccagtttttaatc

SEQ ID NO: 400953 - DNA, 53 bp, Artificial Sequence
  Description of Artificial Sequence: Synthetic oligonucleotide
ccctactgaaagaatcccaagtataaaaacaaccagtttttaatcaatattac

SEQ ID NO: 400954 - DNA, 56 bp, Artificial Sequence
  Description of Artificial Sequence: Synthetic oligonucleotide
cctactgaaagaatcccaagtataaaaacaaccagtttttaatcaatattacaaag

SEQ ID NO: 400955 - DNA, 58 bp, Artificial Sequence
  Description of Artificial Sequence: Synthetic oligonucleotide
ctactgaaagaatcccaagtataaaaacaaccagtttttaatcaatattacaaagatg

SEQ ID NO: 400956 - DNA, 60 bp, Artificial Sequence
  Description of Artificial Sequence: Synthetic oligonucleotide
tactgaaagaatcccaagtataaaaacaaccagtttttaatcaatattacaaagatgttt

SEQ ID NO: 400957 - DNA, 60 bp, Artificial Sequence
  Description of Artificial Sequence: Synthetic oligonucleotide
actgaaagaatcccaagtataaaaacaaccagtttttaatcaatattacaaagatgttta

SEQ ID NO: 400958 - DNA, 60 bp, Artificial Sequence
  Description of Artificial Sequence: Synthetic oligonucleotide
ctgaaagaatcccaagtataaaaacaaccagtttttaatcaatattacaaagatgtttac

SEQ ID NO: 400959 - DNA, 60 bp, Artificial Sequence
  Description of Artificial Sequence: Synthetic oligonucleotide
tgaaagaatcccaagtataaaaacaaccagtttttaatcaatattacaaagatgtttact

SEQ ID NO: 400960 - DNA, 60 bp, Artificial Sequence
  Description of Artificial Sequence: Synthetic oligonucleotide
gaaagaatcccaagtataaaaacaaccagtttttaatcaatattacaaagatgtttactg

SEQ ID NO: 400961 - DNA, 60 bp, Artificial Sequence
  Description of Artificial Sequence: Synthetic oligonucleotide
aaagaatcccaagtataaaaacaaccagtttttaatcaatattacaaagatgtttactgt

SEQ ID NO: 400962 - DNA, 60 bp, Artificial Sequence
  Description of Artificial Sequence: Synthetic oligonucleotide
aagaatcccaagtataaaaacaaccagtttttaatcaatattacaaagatgtttactgtt

SEQ ID NO: 400963 - DNA, 60 bp, Artificial Sequence
  Description of Artificial Sequence: Synthetic oligonucleotide
agaatcccaagtataaaaacaaccagtttttaatcaatattacaaagatgtttactgttg

SEQ ID NO: 400964 - DNA, 59 bp, Artificial Sequence
  Description of Artificial Sequence: Synthetic oligonucleotide
gaatcccaagtataaaaacaaccagtttttaatcaatattacaaagatgtttactgttg

SEQ ID NO: 400965 - DNA, 60 bp, Artificial Sequence
  Description of Artificial Sequence: Synthetic oligonucleotide
aatcccaagtataaaaacaaccagtttttaatcaatattacaaagatgtttactgttgaa

SEQ ID NO: 400966 - DNA, 60 bp, Artificial Sequence
  Description of Artificial Sequence: Synthetic oligonucleotide
atcccaagtataaaaacaaccagtttttaatcaatattacaaagatgtttactgttgaat

SEQ ID NO: 400967 - DNA, 60 bp, Artificial Sequence
  Description of Artificial Sequence: Synthetic oligonucleotide
tcccaagtataaaaacaaccagtttttaatcaatattacaaagatgtttactgttgaatc

SEQ ID NO: 400968 - DNA, 59 bp, Artificial Sequence
  Description of Artificial Sequence: Synthetic oligonucleotide
cccaagtataaaaacaaccagtttttaatcaatattacaaagatgtttactgttgaatc

SEQ ID NO: 400969 - DNA, 59 bp, Artificial Sequence
  Description of Artificial Sequence: Synthetic oligonucleotide
ccaagtataaaaacaaccagtttttaatcaatattacaaagatgtttactgttgaatcg

SEQ ID NO: 400970 - DNA, 59 bp, Artificial Sequence
  Description of Artificial Sequence: Synthetic oligonucleotide
caagtataaaaacaaccagtttttaatcaatattacaaagatgtttactgttgaatcgc

SEQ ID NO: 400971 - DNA, 60 bp, Artificial Sequence
  Description of Artificial Sequence: Synthetic oligonucleotide
aagtataaaaacaaccagtttttaatcaatattacaaagatgtttactgttgaatcgcat

SEQ ID NO: 400972 - DNA, 60 bp, Artificial Sequence
  Description of Artificial Sequence: Synthetic oligonucleotide
agtataaaaacaaccagtttttaatcaatattacaaagatgtttactgttgaatcgcatt

SEQ ID NO: 400973 - DNA, 60 bp, Artificial Sequence
  Description of Artificial Sequence: Synthetic oligonucleotide
gtataaaaacaaccagtttttaatcaatattacaaagatgtttactgttgaatcgcattt

SEQ ID NO: 400974 - DNA, 60 bp, Artificial Sequence
  Description of Artificial Sequence: Synthetic oligonucleotide
tataaaaacaaccagtttttaatcaatattacaaagatgtttactgttgaatcgcatttt

SEQ ID NO: 400975 - DNA, 60 bp, Artificial Sequence
  Description of Artificial Sequence: Synthetic oligonucleotide
ataaaaacaaccagtttttaatcaatattacaaagatgtttactgttgaatcgcattttt

SEQ ID NO: 400976 - DNA, 60 bp, Artificial Sequence
  Description of Artificial Sequence: Synthetic oligonucleotide
taaaaacaaccagtttttaatcaatattacaaagatgtttactgttgaatcgcatttttc

SEQ ID NO: 400977 - DNA, 60 bp, Artificial Sequence
  Description of Artificial Sequence: Synthetic oligonucleotide
aaaaacaaccagtttttaatcaatattacaaagatgtttactgttgaatcgcatttttct

SEQ ID NO: 400978 - DNA, 60 bp, Artificial Sequence
  Description of Artificial Sequence: Synthetic oligonucleotide
aaaacaaccagtttttaatcaatattacaaagatgtttactgttgaatcgcatttttctt

SEQ ID NO: 400979 - DNA, 60 bp, Artificial Sequence
  Description of Artificial Sequence: Synthetic oligonucleotide
aaacaaccagtttttaatcaatattacaaagatgtttactgttgaatcgcatttttcttt

SEQ ID NO: 400980 - DNA, 60 bp, Artificial Sequence
  Description of Artificial Sequence: Synthetic oligonucleotide
aacaaccagtttttaatcaatattacaaagatgtttactgttgaatcgcatttttctttg

SEQ ID NO: 400981 - DNA, 59 bp, Artificial Sequence
  Description of Artificial Sequence: Synthetic oligonucleotide
acaaccagtttttaatcaatattacaaagatgtttactgttgaatcgcatttttctttg

SEQ ID NO: 400982 - DNA, 58 bp, Artificial Sequence
  Description of Artificial Sequence: Synthetic oligonucleotide
caaccagtttttaatcaatattacaaagatgtttactgttgaatcgcatttttctttg

SEQ ID NO: 400983 - DNA, 58 bp, Artificial Sequence
  Description of Artificial Sequence: Synthetic oligonucleotide
aaccagtttttaatcaatattacaaagatgtttactgttgaatcgcatttttctttgg

SEQ ID NO: 400984 - DNA, 57 bp, Artificial Sequence
  Description of Artificial Sequence: Synthetic oligonucleotide
accagtttttaatcaatattacaaagatgtttactgttgaatcgcatttttctttgg

SEQ ID NO: 400985 - DNA, 56 bp, Artificial Sequence
  Description of Artificial Sequence: Synthetic oligonucleotide
ccagtttttaatcaatattacaaagatgtttactgttgaatcgcatttttctttgg

SEQ ID NO: 400986 - DNA, 56 bp, Artificial Sequence
  Description of Artificial Sequence: Synthetic oligonucleotide
cagtttttaatcaatattacaaagatgtttactgttgaatcgcatttttctttggc

SEQ ID NO: 400987 - DNA, 58 bp, Artificial Sequence
  Description of Artificial Sequence: Synthetic oligonucleotide
agtttttaatcaatattacaaagatgtttactgttgaatcgcatttttctttggcttc

SEQ ID NO: 400988 - DNA, 47 bp, Artificial Sequence
  Description of Artificial Sequence: Synthetic oligonucleotide
cttcttaaaatcccttaggcattcaatcttcagctcttctataattg

SEQ ID NO: 400989 - DNA, 48 bp, Artificial Sequence
  Description of Artificial Sequence: Synthetic oligonucleotide
ttcttaaaatcccttaggcattcaatcttcagctcttctataattgag

SEQ ID NO: 400990 - DNA, 47 bp, Artificial Sequence
  Description of Artificial Sequence: Synthetic oligonucleotide
tcttaaaatcccttaggcattcaatcttcagctcttctataattgag

SEQ ID NO: 400991 - DNA, 46 bp, Artificial Sequence
  Description of Artificial Sequence: Synthetic oligonucleotide
cttaaaatcccttaggcattcaatcttcagctcttctataattgag

SEQ ID NO: 400992 - DNA, 47 bp, Artificial Sequence
  Description of Artificial Sequence: Synthetic oligonucleotide
ttaaaatcccttaggcattcaatcttcagctcttctataattgagag

SEQ ID NO: 400993 - DNA, 46 bp, Artificial Sequence
  Description of Artificial Sequence: Synthetic oligonucleotide
taaaatcccttaggcattcaatcttcagctcttctataattgagag

SEQ ID NO: 400994 - DNA, 45 bp, Artificial Sequence
  Description of Artificial Sequence: Synthetic oligonucleotide
aaaatcccttaggcattcaatcttcagctcttctataattgagag

SEQ ID NO: 400995 - DNA, 44 bp, Artificial Sequence
  Description of Artificial Sequence: Synthetic oligonucleotide
aaatcccttaggcattcaatcttcagctcttctataattgagag

SEQ ID NO: 400996 - DNA, 43 bp, Artificial Sequence
  Description of Artificial Sequence: Synthetic oligonucleotide
aatcccttaggcattcaatcttcagctcttctataattgagag

SEQ ID NO: 400997 - DNA, 42 bp, Artificial Sequence
  Description of Artificial Sequence: Synthetic oligonucleotide
atcccttaggcattcaatcttcagctcttctataattgagag

SEQ ID NO: 400998 - DNA, 41 bp, Artificial Sequence
  Description of Artificial Sequence: Synthetic oligonucleotide
tcccttaggcattcaatcttcagctcttctataattgagag

SEQ ID NO: 400999 - DNA, 40 bp, Artificial Sequence
  Description of Artificial Sequence: Synthetic oligonucleotide
cccttaggcattcaatcttcagctcttctataattgagag

SEQ ID NO: 401000 - DNA, 40 bp, Artificial Sequence
  Description of Artificial Sequence: Synthetic oligonucleotide
ccttaggcattcaatcttcagctcttctataattgagagg

SEQ ID NO: 401001 - DNA, 42 bp, Artificial Sequence
  Description of Artificial Sequence: Synthetic oligonucleotide
cttaggcattcaatcttcagctcttctataattgagaggaag

SEQ ID NO: 401002 - DNA, 46 bp, Artificial Sequence
  Description of Artificial Sequence: Synthetic oligonucleotide
ttaggcattcaatcttcagctcttctataattgagaggaagttttc

SEQ ID NO: 401003 - DNA, 45 bp, Artificial Sequence
  Description of Artificial Sequence: Synthetic oligonucleotide
taggcattcaatcttcagctcttctataattgagaggaagttttc

SEQ ID NO: 401004 - DNA, 44 bp, Artificial Sequence
  Description of Artificial Sequence: Synthetic oligonucleotide
aggcattcaatcttcagctcttctataattgagaggaagttttc

SEQ ID NO: 401005 - DNA, 43 bp, Artificial Sequence
  Description of Artificial Sequence: Synthetic oligonucleotide
ggcattcaatcttcagctcttctataattgagaggaagttttc

SEQ ID NO: 401006 - DNA, 44 bp, Artificial Sequence
  Description of Artificial Sequence: Synthetic oligonucleotide
gcattcaatcttcagctcttctataattgagaggaagttttcac

SEQ ID NO: 401007 - DNA, 44 bp, Artificial Sequence
  Description of Artificial Sequence: Synthetic oligonucleotide
cattcaatcttcagctcttctataattgagaggaagttttcacc

SEQ ID NO: 401008 - DNA, 45 bp, Artificial Sequence
  Description of Artificial Sequence: Synthetic oligonucleotide
attcaatcttcagctcttctataattgagaggaagttttcacctc

SEQ ID NO: 401009 - DNA, 44 bp, Artificial Sequence
  Description of Artificial Sequence: Synthetic oligonucleotide
ttcaatcttcagctcttctataattgagaggaagttttcacctc

SEQ ID NO: 401010 - DNA, 43 bp, Artificial Sequence
  Description of Artificial Sequence: Synthetic oligonucleotide
tcaatcttcagctcttctataattgagaggaagttttcacctc

SEQ ID NO: 401011 - DNA, 42 bp, Artificial Sequence
  Description of Artificial Sequence: Synthetic oligonucleotide
caatcttcagctcttctataattgagaggaagttttcacctc

SEQ ID NO: 401012 - DNA, 46 bp, Artificial Sequence
  Description of Artificial Sequence: Synthetic oligonucleotide
aatcttcagctcttctataattgagaggaagttttcacctcaaatg

SEQ ID NO: 401013 - DNA, 45 bp, Artificial Sequence
  Description of Artificial Sequence: Synthetic oligonucleotide
atcttcagctcttctataattgagaggaagttttcacctcaaatg

SEQ ID NO: 401014 - DNA, 44 bp, Artificial Sequence
  Description of Artificial Sequence: Synthetic oligonucleotide
tcttcagctcttctataattgagaggaagttttcacctcaaatg

SEQ ID NO: 401015 - DNA, 43 bp, Artificial Sequence
  Description of Artificial Sequence: Synthetic oligonucleotide
cttcagctcttctataattgagaggaagttttcacctcaaatg

SEQ ID NO: 401016 - DNA, 45 bp, Artificial Sequence
  Description of Artificial Sequence: Synthetic oligonucleotide
ttcagctcttctataattgagaggaagttttcacctcaaatgttc

SEQ ID NO: 401017 - DNA, 44 bp, Artificial Sequence
  Description of Artificial Sequence: Synthetic oligonucleotide
tcagctcttctataattgagaggaagttttcacctcaaatgttc

SEQ ID NO: 401018 - DNA, 43 bp, Artificial Sequence
  Description of Artificial Sequence: Synthetic oligonucleotide
cagctcttctataattgagaggaagttttcacctcaaatgttc

SEQ ID NO: 401019 - DNA, 45 bp, Artificial Sequence
  Description of Artificial Sequence: Synthetic oligonucleotide
agctcttctataattgagaggaagttttcacctcaaatgttcatc

SEQ ID NO: 401020 - DNA, 44 bp, Artificial Sequence
  Description of Artificial Sequence: Synthetic oligonucleotide
gctcttctataattgagaggaagttttcacctcaaatgttcatc

SEQ ID NO: 401021 - DNA, 44 bp, Artificial Sequence
  Description of Artificial Sequence: Synthetic oligonucleotide
ctcttctataattgagaggaagttttcacctcaaatgttcatcc

SEQ ID NO: 401022 - DNA, 45 bp, Artificial Sequence
  Description of Artificial Sequence: Synthetic oligonucleotide
tcttctataattgagaggaagttttcacctcaaatgttcatccag

SEQ ID NO: 401023 - DNA, 44 bp, Artificial Sequence
  Description of Artificial Sequence: Synthetic oligonucleotide
cttctataattgagaggaagttttcacctcaaatgttcatccag

SEQ ID NO: 401024 - DNA, 45 bp, Artificial Sequence
  Description of Artificial Sequence: Synthetic oligonucleotide
ttctataattgagaggaagttttcacctcaaatgttcatccagtg

SEQ ID NO: 401025 - DNA, 44 bp, Artificial Sequence
  Description of Artificial Sequence: Synthetic oligonucleotide
tctataattgagaggaagttttcacctcaaatgttcatccagtg

SEQ ID NO: 401026 - DNA, 43 bp, Artificial Sequence
  Description of Artificial Sequence: Synthetic oligonucleotide
ctataattgagaggaagttttcacctcaaatgttcatccagtg

SEQ ID NO: 401027 - DNA, 43 bp, Artificial Sequence
  Description of Artificial Sequence: Synthetic oligonucleotide
tataattgagaggaagttttcacctcaaatgttcatccagtgc

SEQ ID NO: 401028 - DNA, 42 bp, Artificial Sequence
  Description of Artificial Sequence: Synthetic oligonucleotide
ataattgagaggaagttttcacctcaaatgttcatccagtgc

SEQ ID NO: 401029 - DNA, 41 bp, Artificial Sequence
  Description of Artificial Sequence: Synthetic oligonucleotide
taattgagaggaagttttcacctcaaatgttcatccagtgc

SEQ ID NO: 401030 - DNA, 40 bp, Artificial Sequence
  Description of Artificial Sequence: Synthetic oligonucleotide
aattgagaggaagttttcacctcaaatgttcatccagtgc

SEQ ID NO: 401031 - DNA, 39 bp, Artificial Sequence
  Description of Artificial Sequence: Synthetic oligonucleotide
attgagaggaagttttcacctcaaatgttcatccagtgc

SEQ ID NO: 401032 - DNA, 38 bp, Artificial Sequence
  Description of Artificial Sequence: Synthetic oligonucleotide
ttgagaggaagttttcacctcaaatgttcatccagtgc

SEQ ID NO: 401033 - DNA, 37 bp, Artificial Sequence
  Description of Artificial Sequence: Synthetic oligonucleotide
tgagaggaagttttcacctcaaatgttcatccagtgc

SEQ ID NO: 401034 - DNA, 36 bp, Artificial Sequence
  Description of Artificial Sequence: Synthetic oligonucleotide
gagaggaagttttcacctcaaatgttcatccagtgc

SEQ ID NO: 401035 - DNA, 41 bp, Artificial Sequence
  Description of Artificial Sequence: Synthetic oligonucleotide
agaggaagttttcacctcaaatgttcatccagtgcaatttg

SEQ ID NO: 401036 - DNA, 40 bp, Artificial Sequence
  Description of Artificial Sequence: Synthetic oligonucleotide
gaggaagttttcacctcaaatgttcatccagtgcaatttg

SEQ ID NO: 401037 - DNA, 42 bp, Artificial Sequence
  Description of Artificial Sequence: Synthetic oligonucleotide
aggaagttttcacctcaaatgttcatccagtgcaatttgaag

SEQ ID NO: 401038 - DNA, 41 bp, Artificial Sequence
  Description of Artificial Sequence: Synthetic oligonucleotide
ggaagttttcacctcaaatgttcatccagtgcaatttgaag

SEQ ID NO: 401039 - DNA, 42 bp, Artificial Sequence
  Description of Artificial Sequence: Synthetic oligonucleotide
gaagttttcacctcaaatgttcatccagtgcaatttgaagac

SEQ ID NO: 401040 - DNA, 42 bp, Artificial Sequence
  Description of Artificial Sequence: Synthetic oligonucleotide
aagttttcacctcaaatgttcatccagtgcaatttgaagacg

SEQ ID NO: 401041 - DNA, 41 bp, Artificial Sequence
  Description of Artificial Sequence: Synthetic oligonucleotide
agttttcacctcaaatgttcatccagtgcaatttgaagacg

SEQ ID NO: 401042 - DNA, 40 bp, Artificial Sequence
  Description of Artificial Sequence: Synthetic oligonucleotide
gttttcacctcaaatgttcatccagtgcaatttgaagacg

SEQ ID NO: 401043 - DNA, 41 bp, Artificial Sequence
  Description of Artificial Sequence: Synthetic oligonucleotide
ttttcacctcaaatgttcatccagtgcaatttgaagacgtc

SEQ ID NO: 401044 - DNA, 40 bp, Artificial Sequence
  Description of Artificial Sequence: Synthetic oligonucleotide
tttcacctcaaatgttcatccagtgcaatttgaagacgtc

SEQ ID NO: 401045 - DNA, 39 bp, Artificial Sequence
  Description of Artificial Sequence: Synthetic oligonucleotide
ttcacctcaaatgttcatccagtgcaatttgaagacgtc

SEQ ID NO: 401046 - DNA, 38 bp, Artificial Sequence
  Description of Artificial Sequence: Synthetic oligonucleotide
tcacctcaaatgttcatccagtgcaatttgaagacgtc

SEQ ID NO: 401047 - DNA, 37 bp, Artificial Sequence
  Description of Artificial Sequence: Synthetic oligonucleotide
cacctcaaatgttcatccagtgcaatttgaagacgtc

SEQ ID NO: 401048 - DNA, 38 bp, Artificial Sequence
  Description of Artificial Sequence: Synthetic oligonucleotide
acctcaaatgttcatccagtgcaatttgaagacgtcac

SEQ ID NO: 401049 - DNA, 37 bp, Artificial Sequence
  Description of Artificial Sequence: Synthetic oligonucleotide
cctcaaatgttcatccagtgcaatttgaagacgtcac

SEQ ID NO: 401050 - DNA, 38 bp, Artificial Sequence
  Description of Artificial Sequence: Synthetic oligonucleotide
ctcaaatgttcatccagtgcaatttgaagacgtcacag

SEQ ID NO: 401051 - DNA, 39 bp, Artificial Sequence
  Description of Artificial Sequence: Synthetic oligonucleotide
tcaaatgttcatccagtgcaatttgaagacgtcacagtg

SEQ ID NO: 401052 - DNA, 38 bp, Artificial Sequence
  Description of Artificial Sequence: Synthetic oligonucleotide
caaatgttcatccagtgcaatttgaagacgtcacagtg

SEQ ID NO: 401053 - DNA, 38 bp, Artificial Sequence
  Description of Artificial Sequence: Synthetic oligonucleotide
aaatgttcatccagtgcaatttgaagacgtcacagtgc

SEQ ID NO: 401054 - DNA, 37 bp, Artificial Sequence
  Description of Artificial Sequence: Synthetic oligonucleotide
aatgttcatccagtgcaatttgaagacgtcacagtgc

SEQ ID NO: 401055 - DNA, 36 bp, Artificial Sequence
  Description of Artificial Sequence: Synthetic oligonucleotide
atgttcatccagtgcaatttgaagacgtcacagtgc

SEQ ID NO: 401056 - DNA, 35 bp, Artificial Sequence
  Description of Artificial Sequence: Synthetic oligonucleotide
tgttcatccagtgcaatttgaagacgtcacagtgc

SEQ ID NO: 401057 - DNA, 34 bp, Artificial Sequence
  Description of Artificial Sequence: Synthetic oligonucleotide
gttcatccagtgcaatttgaagacgtcacagtgc

SEQ ID NO: 401058 - DNA, 34 bp, Artificial Sequence
  Description of Artificial Sequence: Synthetic oligonucleotide
ttcatccagtgcaatttgaagacgtcacagtgcc

SEQ ID NO: 401059 - DNA, 33 bp, Artificial Sequence
  Description of Artificial Sequence: Synthetic oligonucleotide
tcatccagtgcaatttgaagacgtcacagtgcc

SEQ ID NO: 401060 - DNA, 32 bp, Artificial Sequence
  Description of Artificial Sequence: Synthetic oligonucleotide
catccagtgcaatttgaagacgtcacagtgcc

SEQ ID NO: 401061 - DNA, 33 bp, Artificial Sequence
  Description of Artificial Sequence: Synthetic oligonucleotide
atccagtgcaatttgaagacgtcacagtgccag

SEQ ID NO: 401062 - DNA, 32 bp, Artificial Sequence
  Description of Artificial Sequence: Synthetic oligonucleotide
tccagtgcaatttgaagacgtcacagtgccag

SEQ ID NO: 401063 - DNA, 31 bp, Artificial Sequence
  Description of Artificial Sequence: Synthetic oligonucleotide
ccagtgcaatttgaagacgtcacagtgccag

SEQ ID NO: 401064 - DNA, 31 bp, Artificial Sequence
  Description of Artificial Sequence: Synthetic oligonucleotide
cagtgcaatttgaagacgtcacagtgccagg

SEQ ID NO: 401065 - DNA, 31 bp, Artificial Sequence
  Description of Artificial Sequence: Synthetic oligonucleotide
agtgcaatttgaagacgtcacagtgccaggg

SEQ ID NO: 401066 - DNA, 30 bp, Artificial Sequence
  Description of Artificial Sequence: Synthetic oligonucleotide
gtgcaatttgaagacgtcacagtgccaggg

SEQ ID NO: 401067 - DNA, 31 bp, Artificial Sequence
  Description of Artificial Sequence: Synthetic oligonucleotide
tgcaatttgaagacgtcacagtgccagggac

SEQ ID NO: 401068 - DNA, 30 bp, Artificial Sequence
  Description of Artificial Sequence: Synthetic oligonucleotide
gcaatttgaagacgtcacagtgccagggac

SEQ ID NO: 401069 - DNA, 31 bp, Artificial Sequence
  Description of Artificial Sequence: Synthetic oligonucleotide
caatttgaagacgtcacagtgccagggactg

SEQ ID NO: 401070 - DNA, 31 bp, Artificial Sequence
  Description of Artificial Sequence: Synthetic oligonucleotide
aatttgaagacgtcacagtgccagggactgg

SEQ ID NO: 401071 - DNA, 30 bp, Artificial Sequence
  Description of Artificial Sequence: Synthetic oligonucleotide
atttgaagacgtcacagtgccagggactgg

SEQ ID NO: 401072 - DNA, 29 bp, Artificial Sequence
  Description of Artificial Sequence: Synthetic oligonucleotide
tttgaagacgtcacagtgccagggactgg

SEQ ID NO: 401073 - DNA, 28 bp, Artificial Sequence
  Description of Artificial Sequence: Synthetic oligonucleotide
ttgaagacgtcacagtgccagggactgg

SEQ ID NO: 401074 - DNA, 27 bp, Artificial Sequence
  Description of Artificial Sequence: Synthetic oligonucleotide
tgaagacgtcacagtgccagggactgg

SEQ ID NO: 401075 - DNA, 27 bp, Artificial Sequence
  Description of Artificial Sequence: Synthetic oligonucleotide
gaagacgtcacagtgccagggactgga

SEQ ID NO: 401076 - DNA, 29 bp, Artificial Sequence
  Description of Artificial Sequence: Synthetic oligonucleotide
aagacgtcacagtgccagggactggattg

SEQ ID NO: 401077 - DNA, 28 bp, Artificial Sequence
  Description of Artificial Sequence: Synthetic oligonucleotide
agacgtcacagtgccagggactggattg

SEQ ID NO: 401078 - DNA, 27 bp, Artificial Sequence
  Description of Artificial Sequence: Synthetic oligonucleotide
gacgtcacagtgccagggactggattg

SEQ ID NO: 401079 - DNA, 28 bp, Artificial Sequence
  Description of Artificial Sequence: Synthetic oligonucleotide
acgtcacagtgccagggactggattgag

SEQ ID NO: 401080 - DNA, 27 bp, Artificial Sequence
  Description of Artificial Sequence: Synthetic oligonucleotide
cgtcacagtgccagggactggattgag

SEQ ID NO: 401081 - DNA, 29 bp, Artificial Sequence
  Description of Artificial Sequence: Synthetic oligonucleotide
gtcacagtgccagggactggattgagaac

SEQ ID NO: 401082 - DNA, 29 bp, Artificial Sequence
  Description of Artificial Sequence: Synthetic oligonucleotide
tcacagtgccagggactggattgagaacc

SEQ ID NO: 401083 - DNA, 28 bp, Artificial Sequence
  Description of Artificial Sequence: Synthetic oligonucleotide
cacagtgccagggactggattgagaacc

SEQ ID NO: 401084 - DNA, 30 bp, Artificial Sequence
  Description of Artificial Sequence: Synthetic oligonucleotide
acagtgccagggactggattgagaaccttc

SEQ ID NO: 401085 - DNA, 29 bp, Artificial Sequence
  Description of Artificial Sequence: Synthetic oligonucleotide
cagtgccagggactggattgagaaccttc

SEQ ID NO: 401086 - DNA, 30 bp, Artificial Sequence
  Description of Artificial Sequence: Synthetic oligonucleotide
agtgccagggactggattgagaaccttcac

SEQ ID NO: 401087 - DNA, 29 bp, Artificial Sequence
  Description of Artificial Sequence: Synthetic oligonucleotide
gtgccagggactggattgagaaccttcac

SEQ ID NO: 401088 - DNA, 39 bp, Artificial Sequence
  Description of Artificial Sequence: Synthetic oligonucleotide
tgccagggactggattgagaaccttcacaaaaaaaaatg

SEQ ID NO: 401089 - DNA, 38 bp, Artificial Sequence
  Description of Artificial Sequence: Synthetic oligonucleotide
gccagggactggattgagaaccttcacaaaaaaaaatg

SEQ ID NO: 401090 - DNA, 39 bp, Artificial Sequence
  Description of Artificial Sequence: Synthetic oligonucleotide
ccagggactggattgagaaccttcacaaaaaaaaatgtc

SEQ ID NO: 401091 - DNA, 40 bp, Artificial Sequence
  Description of Artificial Sequence: Synthetic oligonucleotide
cagggactggattgagaaccttcacaaaaaaaaatgtctg

SEQ ID NO: 401092 - DNA, 40 bp, Artificial Sequence
  Description of Artificial Sequence: Synthetic oligonucleotide
agggactggattgagaaccttcacaaaaaaaaatgtctgc

SEQ ID NO: 401093 - DNA, 39 bp, Artificial Sequence
  Description of Artificial Sequence: Synthetic oligonucleotide
gggactggattgagaaccttcacaaaaaaaaatgtctgc

SEQ ID NO: 401094 - DNA, 39 bp, Artificial Sequence
  Description of Artificial Sequence: Synthetic oligonucleotide
ggactggattgagaaccttcacaaaaaaaaatgtctgcc

SEQ ID NO: 401095 - DNA, 41 bp, Artificial Sequence
  Description of Artificial Sequence: Synthetic oligonucleotide
gactggattgagaaccttcacaaaaaaaaatgtctgcctag

SEQ ID NO: 401096 - DNA, 42 bp, Artificial Sequence
  Description of Artificial Sequence: Synthetic oligonucleotide
actggattgagaaccttcacaaaaaaaaatgtctgcctagag

SEQ ID NO: 401097 - DNA, 41 bp, Artificial Sequence
  Description of Artificial Sequence: Synthetic oligonucleotide
ctggattgagaaccttcacaaaaaaaaatgtctgcctagag

SEQ ID NO: 401098 - DNA, 42 bp, Artificial Sequence
  Description of Artificial Sequence: Synthetic oligonucleotide
tggattgagaaccttcacaaaaaaaaatgtctgcctagagac

SEQ ID NO: 401099 - DNA, 41 bp, Artificial Sequence
  Description of Artificial Sequence: Synthetic oligonucleotide
ggattgagaaccttcacaaaaaaaaatgtctgcctagagac

SEQ ID NO: 401100 - DNA, 42 bp, Artificial Sequence
  Description of Artificial Sequence: Synthetic oligonucleotide
gattgagaaccttcacaaaaaaaaatgtctgcctagagacag

SEQ ID NO: 401101 - DNA, 46 bp, Artificial Sequence
  Description of Artificial Sequence: Synthetic oligonucleotide
attgagaaccttcacaaaaaaaaatgtctgcctagagacagattag

SEQ ID NO: 401102 - DNA, 45 bp, Artificial Sequence
  Description of Artificial Sequence: Synthetic oligonucleotide
ttgagaaccttcacaaaaaaaaatgtctgcctagagacagattag

SEQ ID NO: 401103 - DNA, 44 bp, Artificial Sequence
  Description of Artificial Sequence: Synthetic oligonucleotide
tgagaaccttcacaaaaaaaaatgtctgcctagagacagattag

SEQ ID NO: 401104 - DNA, 43 bp, Artificial Sequence
  Description of Artificial Sequence: Synthetic oligonucleotide
gagaaccttcacaaaaaaaaatgtctgcctagagacagattag

SEQ ID NO: 401105 - DNA, 43 bp, Artificial Sequence
  Description of Artificial Sequence: Synthetic oligonucleotide
agaaccttcacaaaaaaaaatgtctgcctagagacagattagg

SEQ ID NO: 401106 - DNA, 42 bp, Artificial Sequence
  Description of Artificial Sequence: Synthetic oligonucleotide
gaaccttcacaaaaaaaaatgtctgcctagagacagattagg

SEQ ID NO: 401107 - DNA, 43 bp, Artificial Sequence
  Description of Artificial Sequence: Synthetic oligonucleotide
aaccttcacaaaaaaaaatgtctgcctagagacagattaggtc

SEQ ID NO: 401108 - DNA, 42 bp, Artificial Sequence
  Description of Artificial Sequence: Synthetic oligonucleotide
accttcacaaaaaaaaatgtctgcctagagacagattaggtc

SEQ ID NO: 401109 - DNA, 41 bp, Artificial Sequence
  Description of Artificial Sequence: Synthetic oligonucleotide
ccttcacaaaaaaaaatgtctgcctagagacagattaggtc

SEQ ID NO: 401110 - DNA, 41 bp, Artificial Sequence
  Description of Artificial Sequence: Synthetic oligonucleotide
cttcacaaaaaaaaatgtctgcctagagacagattaggtcc

SEQ ID NO: 401111 - DNA, 43 bp, Artificial Sequence
  Description of Artificial Sequence: Synthetic oligonucleotide
ttcacaaaaaaaaatgtctgcctagagacagattaggtccttc

SEQ ID NO: 401112 - DNA, 42 bp, Artificial Sequence
  Description of Artificial Sequence: Synthetic oligonucleotide
tcacaaaaaaaaatgtctgcctagagacagattaggtccttc

SEQ ID NO: 401113 - DNA, 41 bp, Artificial Sequence
  Description of Artificial Sequence: Synthetic oligonucleotide
cacaaaaaaaaatgtctgcctagagacagattaggtccttc

SEQ ID NO: 401114 - DNA, 42 bp, Artificial Sequence
  Description of Artificial Sequence: Synthetic oligonucleotide
acaaaaaaaaatgtctgcctagagacagattaggtccttcag

SEQ ID NO: 401115 - DNA, 41 bp, Artificial Sequence
  Description of Artificial Sequence: Synthetic oligonucleotide
caaaaaaaaatgtctgcctagagacagattaggtccttcag

SEQ ID NO: 401116 - DNA, 41 bp, Artificial Sequence
  Description of Artificial Sequence: Synthetic oligonucleotide
aaaaaaaaatgtctgcctagagacagattaggtccttcagc

SEQ ID NO: 401117 - DNA, 40 bp, Artificial Sequence
  Description of Artificial Sequence: Synthetic oligonucleotide
aaaaaaaatgtctgcctagagacagattaggtccttcagc

SEQ ID NO: 401118 - DNA, 39 bp, Artificial Sequence
  Description of Artificial Sequence: Synthetic oligonucleotide
aaaaaaatgtctgcctagagacagattaggtccttcagc

SEQ ID NO: 401119 - DNA, 38 bp, Artificial Sequence
  Description of Artificial Sequence: Synthetic oligonucleotide
aaaaaatgtctgcctagagacagattaggtccttcagc

SEQ ID NO: 401120 - DNA, 37 bp, Artificial Sequence
  Description of Artificial Sequence: Synthetic oligonucleotide
aaaaatgtctgcctagagacagattaggtccttcagc

SEQ ID NO: 401121 - DNA, 36 bp, Artificial Sequence
  Description of Artificial Sequence: Synthetic oligonucleotide
aaaatgtctgcctagagacagattaggtccttcagc

SEQ ID NO: 401122 - DNA, 35 bp, Artificial Sequence
  Description of Artificial Sequence: Synthetic oligonucleotide
aaatgtctgcctagagacagattaggtccttcagc

SEQ ID NO: 401123 - DNA, 34 bp, Artificial Sequence
  Description of Artificial Sequence: Synthetic oligonucleotide
aatgtctgcctagagacagattaggtccttcagc

SEQ ID NO: 401124 - DNA, 33 bp, Artificial Sequence
  Description of Artificial Sequence: Synthetic oligonucleotide
atgtctgcctagagacagattaggtccttcagc

SEQ ID NO: 401125 - DNA, 32 bp, Artificial Sequence
  Description of Artificial Sequence: Synthetic oligonucleotide
tgtctgcctagagacagattaggtccttcagc

SEQ ID NO: 401126 - DNA, 31 bp, Artificial Sequence
  Description of Artificial Sequence: Synthetic oligonucleotide
gtctgcctagagacagattaggtccttcagc

SEQ ID NO: 401127 - DNA, 32 bp, Artificial Sequence
  Description of Artificial Sequence: Synthetic oligonucleotide
tctgcctagagacagattaggtccttcagctc

SEQ ID NO: 401128 - DNA, 31 bp, Artificial Sequence
  Description of Artificial Sequence: Synthetic oligonucleotide
ctgcctagagacagattaggtccttcagctc

SEQ ID NO: 401129 - DNA, 31 bp, Artificial Sequence
  Description of Artificial Sequence: Synthetic oligonucleotide
tgcctagagacagattaggtccttcagctcc

SEQ ID NO: 401130 - DNA, 30 bp, Artificial Sequence
  Description of Artificial Sequence: Synthetic oligonucleotide
gcctagagacagattaggtccttcagctcc

SEQ ID NO: 401131 - DNA, 31 bp, Artificial Sequence
  Description of Artificial Sequence: Synthetic oligonucleotide
cctagagacagattaggtccttcagctccag

SEQ ID NO: 401132 - DNA, 32 bp, Artificial Sequence
  Description of Artificial Sequence: Synthetic oligonucleotide
ctagagacagattaggtccttcagctccagtg

SEQ ID NO: 401133 - DNA, 32 bp, Artificial Sequence
  Description of Artificial Sequence: Synthetic oligonucleotide
tagagacagattaggtccttcagctccagtgc

SEQ ID NO: 401134 - DNA, 31 bp, Artificial Sequence
  Description of Artificial Sequence: Synthetic oligonucleotide
agagacagattaggtccttcagctccagtgc

SEQ ID NO: 401135 - DNA, 30 bp, Artificial Sequence
  Description of Artificial Sequence: Synthetic oligonucleotide
gagacagattaggtccttcagctccagtgc

SEQ ID NO: 401136 - DNA, 31 bp, Artificial Sequence
  Description of Artificial Sequence: Synthetic oligonucleotide
agacagattaggtccttcagctccagtgctg

SEQ ID NO: 401137 - DNA, 30 bp, Artificial Sequence
  Description of Artificial Sequence: Synthetic oligonucleotide
gacagattaggtccttcagctccagtgctg

SEQ ID NO: 401138 - DNA, 33 bp, Artificial Sequence
  Description of Artificial Sequence: Synthetic oligonucleotide
acagattaggtccttcagctccagtgctgattg

SEQ ID NO: 401139 - DNA, 32 bp, Artificial Sequence
  Description of Artificial Sequence: Synthetic oligonucleotide
cagattaggtccttcagctccagtgctgattg

SEQ ID NO: 401140 - DNA, 32 bp, Artificial Sequence
  Description of Artificial Sequence: Synthetic oligonucleotide
agattaggtccttcagctccagtgctgattgg

SEQ ID NO: 401141 - DNA, 31 bp, Artificial Sequence
  Description of Artificial Sequence: Synthetic oligonucleotide
gattaggtccttcagctccagtgctgattgg

SEQ ID NO: 401142 - DNA, 33 bp, Artificial Sequence
  Description of Artificial Sequence: Synthetic oligonucleotide
attaggtccttcagctccagtgctgattggttc

SEQ ID NO: 401143 - DNA, 32 bp, Artificial Sequence
  Description of Artificial Sequence: Synthetic oligonucleotide
ttaggtccttcagctccagtgctgattggttc

SEQ ID NO: 401144 - DNA, 31 bp, Artificial Sequence
  Description of Artificial Sequence: Synthetic oligonucleotide
taggtccttcagctccagtgctgattggttc

SEQ ID NO: 401145 - DNA, 34 bp, Artificial Sequence
  Description of Artificial Sequence: Synthetic oligonucleotide
ttcagctccagtgctgattggttcctttccaaag

SEQ ID NO: 401146 - DNA, 33 bp, Artificial Sequence
  Description of Artificial Sequence: Synthetic oligonucleotide
tcagctccagtgctgattggttcctttccaaag

SEQ ID NO: 401147 - DNA, 32 bp, Artificial Sequence
  Description of Artificial Sequence: Synthetic oligonucleotide
cagctccagtgctgattggttcctttccaaag

SEQ ID NO: 401148 - DNA, 32 bp, Artificial Sequence
  Description of Artificial Sequence: Synthetic oligonucleotide
agctccagtgctgattggttcctttccaaagg

SEQ ID NO: 401149 - DNA, 31 bp, Artificial Sequence
  Description of Artificial Sequence: Synthetic oligonucleotide
gctccagtgctgattggttcctttccaaagg

SEQ ID NO: 401150 - DNA, 32 bp, Artificial Sequence
  Description of Artificial Sequence: Synthetic oligonucleotide
ctccagtgctgattggttcctttccaaaggac

SEQ ID NO: 401151 - DNA, 32 bp, Artificial Sequence
  Description of Artificial Sequence: Synthetic oligonucleotide
tccagtgctgattggttcctttccaaaggacc

SEQ ID NO: 401152 - DNA, 31 bp, Artificial Sequence
  Description of Artificial Sequence: Synthetic oligonucleotide
ccagtgctgattggttcctttccaaaggacc

SEQ ID NO: 401153 - DNA, 33 bp, Artificial Sequence
  Description of Artificial Sequence: Synthetic oligonucleotide
cagtgctgattggttcctttccaaaggaccatc

SEQ ID NO: 401154 - DNA, 33 bp, Artificial Sequence
  Description of Artificial Sequence: Synthetic oligonucleotide
agtgctgattggttcctttccaaaggaccatcc

SEQ ID NO: 401155 - DNA, 32 bp, Artificial Sequence
  Description of Artificial Sequence: Synthetic oligonucleotide
gtgctgattggttcctttccaaaggaccatcc

SEQ ID NO: 401156 - DNA, 35 bp, Artificial Sequence
  Description of Artificial Sequence: Synthetic oligonucleotide
tgctgattggttcctttccaaaggaccatccaatc

SEQ ID NO: 401157 - DNA, 34 bp, Artificial Sequence
  Description of Artificial Sequence: Synthetic oligonucleotide
gctgattggttcctttccaaaggaccatccaatc

SEQ ID NO: 401158 - DNA, 34 bp, Artificial Sequence
  Description of Artificial Sequence: Synthetic oligonucleotide
ctgattggttcctttccaaaggaccatccaatcc

SEQ ID NO: 401159 - DNA, 35 bp, Artificial Sequence
  Description of Artificial Sequence: Synthetic oligonucleotide
tgattggttcctttccaaaggaccatccaatcctg

SEQ ID NO: 401160 - DNA, 34 bp, Artificial Sequence
  Description of Artificial Sequence: Synthetic oligonucleotide
gattggttcctttccaaaggaccatccaatcctg

SEQ ID NO: 401161 - DNA, 34 bp, Artificial Sequence
  Description of Artificial Sequence: Synthetic oligonucleotide
attggttcctttccaaaggaccatccaatcctgc

SEQ ID NO: 401162 - DNA, 33 bp, Artificial Sequence
  Description of Artificial Sequence: Synthetic oligonucleotide
ttggttcctttccaaaggaccatccaatcctgc

SEQ ID NO: 401163 - DNA, 32 bp, Artificial Sequence
  Description of Artificial Sequence: Synthetic oligonucleotide
tggttcctttccaaaggaccatccaatcctgc

SEQ ID NO: 401164 - DNA, 31 bp, Artificial Sequence
  Description of Artificial Sequence: Synthetic oligonucleotide
ggttcctttccaaaggaccatccaatcctgc

SEQ ID NO: 401165 - DNA, 31 bp, Artificial Sequence
  Description of Artificial Sequence: Synthetic oligonucleotide
gttcctttccaaaggaccatccaatcctgcc

SEQ ID NO: 401166 - DNA, 32 bp, Artificial Sequence
  Description of Artificial Sequence: Synthetic oligonucleotide
ttcctttccaaaggaccatccaatcctgccac

SEQ ID NO: 401167 - DNA, 31 bp, Artificial Sequence
  Description of Artificial Sequence: Synthetic oligonucleotide
tcctttccaaaggaccatccaatcctgccac

SEQ ID NO: 401168 - DNA, 30 bp, Artificial Sequence
  Description of Artificial Sequence: Synthetic oligonucleotide
cctttccaaaggaccatccaatcctgccac

SEQ ID NO: 401169 - DNA, 30 bp, Artificial Sequence
  Description of Artificial Sequence: Synthetic oligonucleotide
ctttccaaaggaccatccaatcctgccacg

SEQ ID NO: 401170 - DNA, 30 bp, Artificial Sequence
  Description of Artificial Sequence: Synthetic oligonucleotide
tttccaaaggaccatccaatcctgccacgc

SEQ ID NO: 401171 - DNA, 29 bp, Artificial Sequence
  Description of Artificial Sequence: Synthetic oligonucleotide
ttccaaaggaccatccaatcctgccacgc

SEQ ID NO: 401172 - DNA, 28 bp, Artificial Sequence
  Description of Artificial Sequence: Synthetic oligonucleotide
tccaaaggaccatccaatcctgccacgc

SEQ ID NO: 401173 - DNA, 27 bp, Artificial Sequence
  Description of Artificial Sequence: Synthetic oligonucleotide
ccaaaggaccatccaatcctgccacgc

SEQ ID NO: 401174 - DNA, 28 bp, Artificial Sequence
  Description of Artificial Sequence: Synthetic oligonucleotide
caaaggaccatccaatcctgccacgcag

SEQ ID NO: 401175 - DNA, 28 bp, Artificial Sequence
  Description of Artificial Sequence: Synthetic oligonucleotide
aaaggaccatccaatcctgccacgcagg

SEQ ID NO: 401176 - DNA, 27 bp, Artificial Sequence
  Description of Artificial Sequence: Synthetic oligonucleotide
aaggaccatccaatcctgccacgcagg

SEQ ID NO: 401177 - DNA, 26 bp, Artificial Sequence
  Description of Artificial Sequence: Synthetic oligonucleotide
aggaccatccaatcctgccacgcagg

SEQ ID NO: 401178 - DNA, 25 bp, Artificial Sequence
  Description of Artificial Sequence: Synthetic oligonucleotide
ggaccatccaatcctgccacgcagg

SEQ ID NO: 401179 - DNA, 27 bp, Artificial Sequence
  Description of Artificial Sequence: Synthetic oligonucleotide
gaccatccaatcctgccacgcagggaa

SEQ ID NO: 401180 - DNA, 28 bp, Artificial Sequence
  Description of Artificial Sequence: Synthetic oligonucleotide
accatccaatcctgccacgcagggaaac

SEQ ID NO: 401181 - DNA, 27 bp, Artificial Sequence
  Description of Artificial Sequence: Synthetic oligonucleotide
ccatccaatcctgccacgcagggaaac

SEQ ID NO: 401182 - DNA, 29 bp, Artificial Sequence
  Description of Artificial Sequence: Synthetic oligonucleotide
catccaatcctgccacgcagggaaacatc

SEQ ID NO: 401183 - DNA, 29 bp, Artificial Sequence
  Description of Artificial Sequence: Synthetic oligonucleotide
atccaatcctgccacgcagggaaacatcc

SEQ ID NO: 401184 - DNA, 28 bp, Artificial Sequence
  Description of Artificial Sequence: Synthetic oligonucleotide
tccaatcctgccacgcagggaaacatcc

SEQ ID NO: 401185 - DNA, 27 bp, Artificial Sequence
  Description of Artificial Sequence: Synthetic oligonucleotide
ccaatcctgccacgcagggaaacatcc

SEQ ID NO: 401186 - DNA, 28 bp, Artificial Sequence
  Description of Artificial Sequence: Synthetic oligonucleotide
caatcctgccacgcagggaaacatccac

SEQ ID NO: 401187 - DNA, 29 bp, Artificial Sequence
  Description of Artificial Sequence: Synthetic oligonucleotide
aatcctgccacgcagggaaacatccacag

SEQ ID NO: 401188 - DNA, 28 bp, Artificial Sequence
  Description of Artificial Sequence: Synthetic oligonucleotide
atcctgccacgcagggaaacatccacag

SEQ ID NO: 401189 - DNA, 27 bp, Artificial Sequence
  Description of Artificial Sequence: Synthetic oligonucleotide
tcctgccacgcagggaaacatccacag

SEQ ID NO: 401190 - DNA, 26 bp, Artificial Sequence
  Description of Artificial Sequence: Synthetic oligonucleotide
cctgccacgcagggaaacatccacag

SEQ ID NO: 401191 - DNA, 27 bp, Artificial Sequence
  Description of Artificial Sequence: Synthetic oligonucleotide
ctgccacgcagggaaacatccacaggt

SEQ ID NO: 401192 - DNA, 34 bp, Artificial Sequence
  Description of Artificial Sequence: Synthetic oligonucleotide
tgccacgcagggaaacatccacaggtttttattc

SEQ ID NO: 401193 - DNA, 33 bp, Artificial Sequence
  Description of Artificial Sequence: Synthetic oligonucleotide
gccacgcagggaaacatccacaggtttttattc

SEQ ID NO: 401194 - DNA, 36 bp, Artificial Sequence
  Description of Artificial Sequence: Synthetic oligonucleotide
ccacgcagggaaacatccacaggtttttattctttc

SEQ ID NO: 401195 - DNA, 37 bp, Artificial Sequence
  Description of Artificial Sequence: Synthetic oligonucleotide
cacgcagggaaacatccacaggtttttattctttctg

SEQ ID NO: 401196 - DNA, 37 bp, Artificial Sequence
  Description of Artificial Sequence: Synthetic oligonucleotide
acgcagggaaacatccacaggtttttattctttctgc

SEQ ID NO: 401197 - DNA, 36 bp, Artificial Sequence
  Description of Artificial Sequence: Synthetic oligonucleotide
cgcagggaaacatccacaggtttttattctttctgc

SEQ ID NO: 401198 - DNA, 36 bp, Artificial Sequence
  Description of Artificial Sequence: Synthetic oligonucleotide
gcagggaaacatccacaggtttttattctttctgcc

SEQ ID NO: 401199 - DNA, 37 bp, Artificial Sequence
  Description of Artificial Sequence: Synthetic oligonucleotide
cagggaaacatccacaggtttttattctttctgccag

SEQ ID NO: 401200 - DNA, 37 bp, Artificial Sequence
  Description of Artificial Sequence: Synthetic oligonucleotide
agggaaacatccacaggtttttattctttctgccagg

SEQ ID NO: 401201 - DNA, 36 bp, Artificial Sequence
  Description of Artificial Sequence: Synthetic oligonucleotide
gggaaacatccacaggtttttattctttctgccagg

SEQ ID NO: 401202 - DNA, 31 bp, Artificial Sequence
  Description of Artificial Sequence: Synthetic oligonucleotide
tgccaggtacatcagatccatcaggtccaag

SEQ ID NO: 401203 - DNA, 30 bp, Artificial Sequence
  Description of Artificial Sequence: Synthetic oligonucleotide
gccaggtacatcagatccatcaggtccaag

SEQ ID NO: 401204 - DNA, 30 bp, Artificial Sequence
  Description of Artificial Sequence: Synthetic oligonucleotide
ccaggtacatcagatccatcaggtccaagc

SEQ ID NO: 401205 - DNA, 31 bp, Artificial Sequence
  Description of Artificial Sequence: Synthetic oligonucleotide
caggtacatcagatccatcaggtccaagctg

SEQ ID NO: 401206 - DNA, 32 bp, Artificial Sequence
  Description of Artificial Sequence: Synthetic oligonucleotide
aggtacatcagatccatcaggtccaagctgtg

SEQ ID NO: 401207 - DNA, 31 bp, Artificial Sequence
  Description of Artificial Sequence: Synthetic oligonucleotide
ggtacatcagatccatcaggtccaagctgtg

SEQ ID NO: 401208 - DNA, 33 bp, Artificial Sequence
  Description of Artificial Sequence: Synthetic oligonucleotide
gtacatcagatccatcaggtccaagctgtgttg

SEQ ID NO: 401209 - DNA, 34 bp, Artificial Sequence
  Description of Artificial Sequence: Synthetic oligonucleotide
tacatcagatccatcaggtccaagctgtgttgac

SEQ ID NO: 401210 - DNA, 33 bp, Artificial Sequence
  Description of Artificial Sequence: Synthetic oligonucleotide
acatcagatccatcaggtccaagctgtgttgac

SEQ ID NO: 401211 - DNA, 32 bp, Artificial Sequence
  Description of Artificial Sequence: Synthetic oligonucleotide
catcagatccatcaggtccaagctgtgttgac

SEQ ID NO: 401212 - DNA, 34 bp, Artificial Sequence
  Description of Artificial Sequence: Synthetic oligonucleotide
atcagatccatcaggtccaagctgtgttgactac

SEQ ID NO: 401213 - DNA, 33 bp, Artificial Sequence
  Description of Artificial Sequence: Synthetic oligonucleotide
tcagatccatcaggtccaagctgtgttgactac

SEQ ID NO: 401214 - DNA, 32 bp, Artificial Sequence
  Description of Artificial Sequence: Synthetic oligonucleotide
cagatccatcaggtccaagctgtgttgactac

SEQ ID NO: 401215 - DNA, 32 bp, Artificial Sequence
  Description of Artificial Sequence: Synthetic oligonucleotide
agatccatcaggtccaagctgtgttgactacc

SEQ ID NO: 401216 - DNA, 31 bp, Artificial Sequence
  Description of Artificial Sequence: Synthetic oligonucleotide
gatccatcaggtccaagctgtgttgactacc

SEQ ID NO: 401217 - DNA, 32 bp, Artificial Sequence
  Description of Artificial Sequence: Synthetic oligonucleotide
atccatcaggtccaagctgtgttgactaccac

SEQ ID NO: 401218 - DNA, 31 bp, Artificial Sequence
  Description of Artificial Sequence: Synthetic oligonucleotide
tccatcaggtccaagctgtgttgactaccac

SEQ ID NO: 401219 - DNA, 30 bp, Artificial Sequence
  Description of Artificial Sequence: Synthetic oligonucleotide
ccatcaggtccaagctgtgttgactaccac

SEQ ID NO: 401220 - DNA, 32 bp, Artificial Sequence
  Description of Artificial Sequence: Synthetic oligonucleotide
catcaggtccaagctgtgttgactaccactac

SEQ ID NO: 401221 - DNA, 36 bp, Artificial Sequence
  Description of Artificial Sequence: Synthetic oligonucleotide
atcaggtccaagctgtgttgactaccactacttttc

SEQ ID NO: 401222 - DNA, 35 bp, Artificial Sequence
  Description of Artificial Sequence: Synthetic oligonucleotide
tcaggtccaagctgtgttgactaccactacttttc

SEQ ID NO: 401223 - DNA, 34 bp, Artificial Sequence
  Description of Artificial Sequence: Synthetic oligonucleotide
caggtccaagctgtgttgactaccactacttttc

SEQ ID NO: 401224 - DNA, 34 bp, Artificial Sequence
  Description of Artificial Sequence: Synthetic oligonucleotide
aggtccaagctgtgttgactaccactacttttcc

SEQ ID NO: 401225 - DNA, 33 bp, Artificial Sequence
  Description of Artificial Sequence: Synthetic oligonucleotide
ggtccaagctgtgttgactaccactacttttcc

SEQ ID NO: 401226 - DNA, 33 bp, Artificial Sequence
  Description of Artificial Sequence: Synthetic oligonucleotide
gtccaagctgtgttgactaccactacttttccc

SEQ ID NO: 401227 - DNA, 35 bp, Artificial Sequence
  Description of Artificial Sequence: Synthetic oligonucleotide
tccaagctgtgttgactaccactacttttcccttc

SEQ ID NO: 401228 - DNA, 34 bp, Artificial Sequence
  Description of Artificial Sequence: Synthetic oligonucleotide
ccaagctgtgttgactaccactacttttcccttc

SEQ ID NO: 401229 - DNA, 34 bp, Artificial Sequence
  Description of Artificial Sequence: Synthetic oligonucleotide
caagctgtgttgactaccactacttttcccttcg

SEQ ID NO: 401230 - DNA, 35 bp, Artificial Sequence
  Description of Artificial Sequence: Synthetic oligonucleotide
aagctgtgttgactaccactacttttcccttcgtc

SEQ ID NO: 401231 - DNA, 40 bp, Artificial Sequence
  Description of Artificial Sequence: Synthetic oligonucleotide
taccactacttttcccttcgtctcaattatgtcttggaag

SEQ ID NO: 401232 - DNA, 39 bp, Artificial Sequence
  Description of Artificial Sequence: Synthetic oligonucleotide
accactacttttcccttcgtctcaattatgtcttggaag

SEQ ID NO: 401233 - DNA, 38 bp, Artificial Sequence
  Description of Artificial Sequence: Synthetic oligonucleotide
ccactacttttcccttcgtctcaattatgtcttggaag

SEQ ID NO: 401234 - DNA, 40 bp, Artificial Sequence
  Description of Artificial Sequence: Synthetic oligonucleotide
cactacttttcccttcgtctcaattatgtcttggaagaag

SEQ ID NO: 401235 - DNA, 40 bp, Artificial Sequence
  Description of Artificial Sequence: Synthetic oligonucleotide
actacttttcccttcgtctcaattatgtcttggaagaagg

SEQ ID NO: 401236 - DNA, 39 bp, Artificial Sequence
  Description of Artificial Sequence: Synthetic oligonucleotide
ctacttttcccttcgtctcaattatgtcttggaagaagg

SEQ ID NO: 401237 - DNA, 39 bp, Artificial Sequence
  Description of Artificial Sequence: Synthetic oligonucleotide
tacttttcccttcgtctcaattatgtcttggaagaaggc

SEQ ID NO: 401238 - DNA, 38 bp, Artificial Sequence
  Description of Artificial Sequence: Synthetic oligonucleotide
acttttcccttcgtctcaattatgtcttggaagaaggc

SEQ ID NO: 401239 - DNA, 37 bp, Artificial Sequence
  Description of Artificial Sequence: Synthetic oligonucleotide
cttttcccttcgtctcaattatgtcttggaagaaggc

SEQ ID NO: 401240 - DNA, 40 bp, Artificial Sequence
  Description of Artificial Sequence: Synthetic oligonucleotide
ttttcccttcgtctcaattatgtcttggaagaaggctttg

SEQ ID NO: 401241 - DNA, 39 bp, Artificial Sequence
  Description of Artificial Sequence: Synthetic oligonucleotide
tttcccttcgtctcaattatgtcttggaagaaggctttg

SEQ ID NO: 401242 - DNA, 38 bp, Artificial Sequence
  Description of Artificial Sequence: Synthetic oligonucleotide
ttcccttcgtctcaattatgtcttggaagaaggctttg

SEQ ID NO: 401243 - DNA, 37 bp, Artificial Sequence
  Description of Artificial Sequence: Synthetic oligonucleotide
tcccttcgtctcaattatgtcttggaagaaggctttg

SEQ ID NO: 401244 - DNA, 36 bp, Artificial Sequence
  Description of Artificial Sequence: Synthetic oligonucleotide
cccttcgtctcaattatgtcttggaagaaggctttg

SEQ ID NO: 401245 - DNA, 36 bp, Artificial Sequence
  Description of Artificial Sequence: Synthetic oligonucleotide
ccttcgtctcaattatgtcttggaagaaggctttgc

SEQ ID NO: 401246 - DNA, 36 bp, Artificial Sequence
  Description of Artificial Sequence: Synthetic oligonucleotide
cttcgtctcaattatgtcttggaagaaggctttgcg

SEQ ID NO: 401247 - DNA, 36 bp, Artificial Sequence
  Description of Artificial Sequence: Synthetic oligonucleotide
ttcgtctcaattatgtcttggaagaaggctttgcgg

SEQ ID NO: 401248 - DNA, 35 bp, Artificial Sequence
  Description of Artificial Sequence: Synthetic oligonucleotide
tcgtctcaattatgtcttggaagaaggctttgcgg

SEQ ID NO: 401249 - DNA, 34 bp, Artificial Sequence
  Description of Artificial Sequence: Synthetic oligonucleotide
cgtctcaattatgtcttggaagaaggctttgcgg

SEQ ID NO: 401250 - DNA, 36 bp, Artificial Sequence
  Description of Artificial Sequence: Synthetic oligonucleotide
gtctcaattatgtcttggaagaaggctttgcggatc

SEQ ID NO: 401251 - DNA, 36 bp, Artificial Sequence
  Description of Artificial Sequence: Synthetic oligonucleotide
tctcaattatgtcttggaagaaggctttgcggatcc

SEQ ID NO: 401252 - DNA, 35 bp, Artificial Sequence
  Description of Artificial Sequence: Synthetic oligonucleotide
ctcaattatgtcttggaagaaggctttgcggatcc

SEQ ID NO: 401253 - DNA, 35 bp, Artificial Sequence
  Description of Artificial Sequence: Synthetic oligonucleotide
tcaattatgtcttggaagaaggctttgcggatccc

SEQ ID NO: 401254 - DNA, 34 bp, Artificial Sequence
  Description of Artificial Sequence: Synthetic oligonucleotide
caattatgtcttggaagaaggctttgcggatccc

SEQ ID NO: 401255 - DNA, 35 bp, Artificial Sequence
  Description of Artificial Sequence: Synthetic oligonucleotide
aattatgtcttggaagaaggctttgcggatccctg

SEQ ID NO: 401256 - DNA, 34 bp, Artificial Sequence
  Description of Artificial Sequence: Synthetic oligonucleotide
attatgtcttggaagaaggctttgcggatccctg

SEQ ID NO: 401257 - DNA, 33 bp, Artificial Sequence
  Description of Artificial Sequence: Synthetic oligonucleotide
ttatgtcttggaagaaggctttgcggatccctg

SEQ ID NO: 401258 - DNA, 32 bp, Artificial Sequence
  Description of Artificial Sequence: Synthetic oligonucleotide
tatgtcttggaagaaggctttgcggatccctg

SEQ ID NO: 401259 - DNA, 31 bp, Artificial Sequence; identical to SEQ ID NO: 59409
  Description of Artificial Sequence: Synthetic oligonucleotide

SEQ ID NO: 401260 - DNA, 30 bp, Artificial Sequence; identical to SEQ ID NO: 59410
  Description of Artificial Sequence: Synthetic oligonucleotide

SEQ ID NO: 401261 - DNA, 29 bp, Artificial Sequence
  Description of Artificial Sequence: Synthetic oligonucleotide
gtcttggaagaaggctttgcggatccctg

SEQ ID NO: 401262 - DNA, 29 bp, Artificial Sequence
  Description of Artificial Sequence: Synthetic oligonucleotide
tcttggaagaaggctttgcggatccctgg

SEQ ID NO: 401263 - DNA, 28 bp, Artificial Sequence
  Description of Artificial Sequence: Synthetic oligonucleotide
cttggaagaaggctttgcggatccctgg

SEQ ID NO: 401264 - DNA, 29 bp, Artificial Sequence
  Description of Artificial Sequence: Synthetic oligonucleotide
ttggaagaaggctttgcggatccctggag

SEQ ID NO: 401265 - DNA, 28 bp, Artificial Sequence
  Description of Artificial Sequence: Synthetic oligonucleotide
tggaagaaggctttgcggatccctggag

SEQ ID NO: 401266 - DNA, 27 bp, Artificial Sequence
  Description of Artificial Sequence: Synthetic oligonucleotide
ggaagaaggctttgcggatccctggag

SEQ ID NO: 401267 - DNA, 27 bp, Artificial Sequence
  Description of Artificial Sequence: Synthetic oligonucleotide
gaagaaggctttgcggatccctggagg

SEQ ID NO: 401268 - DNA, 27 bp, Artificial Sequence
  Description of Artificial Sequence: Synthetic oligonucleotide
aagaaggctttgcggatccctggaggc

SEQ ID NO: 401269 - DNA, 26 bp, Artificial Sequence
  Description of Artificial Sequence: Synthetic oligonucleotide
agaaggctttgcggatccctggaggc

SEQ ID NO: 401270 - DNA, 25 bp, Artificial Sequence
  Description of Artificial Sequence: Synthetic oligonucleotide
gaaggctttgcggatccctggaggc

SEQ ID NO: 401271 - DNA, 27 bp, Artificial Sequence
  Description of Artificial Sequence: Synthetic oligonucleotide
aaggctttgcggatccctggaggcctt

SEQ ID NO: 401272 - DNA, 26 bp, Artificial Sequence
  Description of Artificial Sequence: Synthetic oligonucleotide
aggctttgcggatccctggaggcctt

SEQ ID NO: 401273 - DNA, 25 bp, Artificial Sequence
  Description of Artificial Sequence: Synthetic oligonucleotide
ggctttgcggatccctggaggcctt

SEQ ID NO: 401274 - DNA, 25 bp, Artificial Sequence
  Description of Artificial Sequence: Synthetic oligonucleotide
gctttgcggatccctggaggccttc

SEQ ID NO: 401275 - DNA, 25 bp, Artificial Sequence
  Description of Artificial Sequence: Synthetic oligonucleotide
ctttgcggatccctggaggccttcg

SEQ ID NO: 401276 - DNA, 25 bp, Artificial Sequence
  Description of Artificial Sequence: Synthetic oligonucleotide
tttgcggatccctggaggccttcgg

SEQ ID NO: 401277 - DNA, 24 bp, Artificial Sequence
  Description of Artificial Sequence: Synthetic oligonucleotide
ttgcggatccctggaggccttcgg

SEQ ID NO: 401278 - DNA, 23 bp, Artificial Sequence
  Description of Artificial Sequence: Synthetic oligonucleotide
tgcggatccctggaggccttcgg

SEQ ID NO: 401279 - DNA, 22 bp, Artificial Sequence
  Description of Artificial Sequence: Synthetic oligonucleotide
gcggatccctggaggccttcgg

SEQ ID NO: 401280 - DNA, 24 bp, Artificial Sequence
  Description of Artificial Sequence: Synthetic oligonucleotide
cggatccctggaggccttcgggta

SEQ ID NO: 401281 - DNA, 24 bp, Artificial Sequence
  Description of Artificial Sequence: Synthetic oligonucleotide
ggatccctggaggccttcgggtag

SEQ ID NO: 401282 - DNA, 26 bp, Artificial Sequence
  Description of Artificial Sequence: Synthetic oligonucleotide
gatccctggaggccttcgggtagcaa

SEQ ID NO: 401283 - DNA, 27 bp, Artificial Sequence
  Description of Artificial Sequence: Synthetic oligonucleotide
atccctggaggccttcgggtagcaact

SEQ ID NO: 401284 - DNA, 26 bp, Artificial Sequence
  Description of Artificial Sequence: Synthetic oligonucleotide
tccctggaggccttcgggtagcaact

SEQ ID NO: 401285 - DNA, 25 bp, Artificial Sequence
  Description of Artificial Sequence: Synthetic oligonucleotide
ccctggaggccttcgggtagcaact

SEQ ID NO: 401286 - DNA, 26 bp, Artificial Sequence
  Description of Artificial Sequence: Synthetic oligonucleotide
cctggaggccttcgggtagcaactgt

SEQ ID NO: 401287 - DNA, 27 bp, Artificial Sequence
  Description of Artificial Sequence: Synthetic oligonucleotide
ctggaggccttcgggtagcaactgtga

SEQ ID NO: 401288 - DNA, 27 bp, Artificial Sequence
  Description of Artificial Sequence: Synthetic oligonucleotide
tggaggccttcgggtagcaactgtgac

SEQ ID NO: 401289 - DNA, 26 bp, Artificial Sequence
  Description of Artificial Sequence: Synthetic oligonucleotide
ggaggccttcgggtagcaactgtgac

SEQ ID NO: 401290 - DNA, 27 bp, Artificial Sequence
  Description of Artificial Sequence: Synthetic oligonucleotide
gaggccttcgggtagcaactgtgacct

SEQ ID NO: 401291 - DNA, 28 bp, Artificial Sequence
  Description of Artificial Sequence: Synthetic oligonucleotide
aggccttcgggtagcaactgtgaccttg

SEQ ID NO: 401292 - DNA, 27 bp, Artificial Sequence
  Description of Artificial Sequence: Synthetic oligonucleotide
ggccttcgggtagcaactgtgaccttg

SEQ ID NO: 401293 - DNA, 29 bp, Artificial Sequence
  Description of Artificial Sequence: Synthetic oligonucleotide
gccttcgggtagcaactgtgaccttgatg

SEQ ID NO: 401294 - DNA, 29 bp, Artificial Sequence
  Description of Artificial Sequence: Synthetic oligonucleotide
ccttcgggtagcaactgtgaccttgatgc

SEQ ID NO: 401295 - DNA, 30 bp, Artificial Sequence; identical to SEQ ID NO: 59445
  Description of Artificial Sequence: Synthetic oligonucleotide

SEQ ID NO: 401296 - DNA, 30 bp, Artificial Sequence; identical to SEQ ID NO: 59446
  Description of Artificial Sequence: Synthetic oligonucleotide

SEQ ID NO: 401297 - DNA, 29 bp, Artificial Sequence
  Description of Artificial Sequence: Synthetic oligonucleotide
tcgggtagcaactgtgaccttgatgctgg

SEQ ID NO: 401298 - DNA, 28 bp, Artificial Sequence
  Description of Artificial Sequence: Synthetic oligonucleotide
cgggtagcaactgtgaccttgatgctgg

SEQ ID NO: 401299 - DNA, 28 bp, Artificial Sequence
  Description of Artificial Sequence: Synthetic oligonucleotide
gggtagcaactgtgaccttgatgctggc

SEQ ID NO: 401300 - DNA, 28 bp, Artificial Sequence
  Description of Artificial Sequence: Synthetic oligonucleotide
ggtagcaactgtgaccttgatgctggcg

SEQ ID NO: 401301 - DNA, 30 bp, Artificial Sequence; identical to SEQ ID NO: 59451
  Description of Artificial Sequence: Synthetic oligonucleotide

SEQ ID NO: 401302 - DNA, 30 bp, Artificial Sequence; identical to SEQ ID NO: 59452
  Description of Artificial Sequence: Synthetic oligonucleotide

SEQ ID NO: 401303 - DNA, 29 bp, Artificial Sequence
  Description of Artificial Sequence: Synthetic oligonucleotide
agcaactgtgaccttgatgctggcgatgc

SEQ ID NO: 401304 - DNA, 28 bp, Artificial Sequence
  Description of Artificial Sequence: Synthetic oligonucleotide
gcaactgtgaccttgatgctggcgatgc

SEQ ID NO: 401305 - DNA, 29 bp, Artificial Sequence
  Description of Artificial Sequence: Synthetic oligonucleotide
caactgtgaccttgatgctggcgatgctg

SEQ ID NO: 401306 - DNA, 30 bp, Artificial Sequence; identical to SEQ ID NO: 59456
  Description of Artificial Sequence: Synthetic oligonucleotide

SEQ ID NO: 401307 - DNA, 29 bp, Artificial Sequence
  Description of Artificial Sequence: Synthetic oligonucleotide
actgtgaccttgatgctggcgatgctgag

SEQ ID NO: 401308 - DNA, 28 bp, Artificial Sequence
  Description of Artificial Sequence: Synthetic oligonucleotide
ctgtgaccttgatgctggcgatgctgag

SEQ ID NO: 401309 - DNA, 28 bp, Artificial Sequence
  Description of Artificial Sequence: Synthetic oligonucleotide
tgtgaccttgatgctggcgatgctgagc

SEQ ID NO: 401310 - DNA, 27 bp, Artificial Sequence
  Description of Artificial Sequence: Synthetic oligonucleotide
gtgaccttgatgctggcgatgctgagc

SEQ ID NO: 401311 - DNA, 28 bp, Artificial Sequence
  Description of Artificial Sequence: Synthetic oligonucleotide
tgaccttgatgctggcgatgctgagcac

SEQ ID NO: 401312 - DNA, 27 bp, Artificial Sequence
  Description of Artificial Sequence: Synthetic oligonucleotide
gaccttgatgctggcgatgctgagcac

SEQ ID NO: 401313 - DNA, 26 bp, Artificial Sequence
  Description of Artificial Sequence: Synthetic oligonucleotide
ttgatgctggcgatgctgagcacccc

SEQ ID NO: 401314 - DNA, 25 bp, Artificial Sequence
  Description of Artificial Sequence: Synthetic oligonucleotide
tgatgctggcgatgctgagcacccc

SEQ ID NO: 401315 - DNA, 24 bp, Artificial Sequence
  Description of Artificial Sequence: Synthetic oligonucleotide
gatgctggcgatgctgagcacccc

SEQ ID NO: 401316 - DNA, 24 bp, Artificial Sequence
  Description of Artificial Sequence: Synthetic oligonucleotide
atgctggcgatgctgagcaccccg

SEQ ID NO: 401317 - DNA, 23 bp, Artificial Sequence
  Description of Artificial Sequence: Synthetic oligonucleotide
tgctggcgatgctgagcaccccg

SEQ ID NO: 401318 - DNA, 22 bp, Artificial Sequence
  Description of Artificial Sequence: Synthetic oligonucleotide
gctggcgatgctgagcaccccg

SEQ ID NO: 401319 - DNA, 23 bp, Artificial Sequence
  Description of Artificial Sequence: Synthetic oligonucleotide
ctggcgatgctgagcaccccggt

SEQ ID NO: 401320 - DNA, 23 bp, Artificial Sequence
  Description of Artificial Sequence: Synthetic oligonucleotide
tggcgatgctgagcaccccggtg

SEQ ID NO: 401321 - DNA, 22 bp, Artificial Sequence
  Description of Artificial Sequence: Synthetic oligonucleotide
ggcgatgctgagcaccccggtg

SEQ ID NO: 401322 - DNA, 22 bp, Artificial Sequence
  Description of Artificial Sequence: Synthetic oligonucleotide
gcgatgctgagcaccccggtgg

SEQ ID NO: 401323 - DNA, 23 bp, Artificial Sequence
  Description of Artificial Sequence: Synthetic oligonucleotide
cgatgctgagcaccccggtggct

SEQ ID NO: 401324 - DNA, 24 bp, Artificial Sequence
  Description of Artificial Sequence: Synthetic oligonucleotide
gatgctgagcaccccggtggctga

SEQ ID NO: 401325 - DNA, 24 bp, Artificial Sequence
  Description of Artificial Sequence: Synthetic oligonucleotide
atgctgagcaccccggtggctgag

SEQ ID NO: 401326 - DNA, 23 bp, Artificial Sequence
  Description of Artificial Sequence: Synthetic oligonucleotide
tgctgagcaccccggtggctgag

SEQ ID NO: 401327 - DNA, 22 bp, Artificial Sequence
  Description of Artificial Sequence: Synthetic oligonucleotide
gctgagcaccccggtggctgag

SEQ ID NO: 401328 - DNA, 22 bp, Artificial Sequence
  Description of Artificial Sequence: Synthetic oligonucleotide
ctgagcaccccggtggctgagg

SEQ ID NO: 401329 - DNA, 22 bp, Artificial Sequence
  Description of Artificial Sequence: Synthetic oligonucleotide
tgagcaccccggtggctgaggg

SEQ ID NO: 401330 - DNA, 21 bp, Artificial Sequence
  Description of Artificial Sequence: Synthetic oligonucleotide
gagcaccccggtggctgaggg

SEQ ID NO: 401331 - DNA, 22 bp, Artificial Sequence
  Description of Artificial Sequence: Synthetic oligonucleotide
agcaccccggtggctgagggca

SEQ ID NO: 401332 - DNA, 21 bp, Artificial Sequence
  Description of Artificial Sequence: Synthetic oligonucleotide
gcaccccggtggctgagggca

SEQ ID NO: 401333 - DNA, 22 bp, Artificial Sequence
  Description of Artificial Sequence: Synthetic oligonucleotide
caccccggtggctgagggcaga

SEQ ID NO: 401334 - DNA, 23 bp, Artificial Sequence
  Description of Artificial Sequence: Synthetic oligonucleotide
accccggtggctgagggcagaga

SEQ ID NO: 401335 - DNA, 22 bp, Artificial Sequence
  Description of Artificial Sequence: Synthetic oligonucleotide
ccccggtggctgagggcagaga

SEQ ID NO: 401336 - DNA, 23 bp, Artificial Sequence
  Description of Artificial Sequence: Synthetic oligonucleotide
cccggtggctgagggcagagact

SEQ ID NO: 401337 - DNA, 24 bp, Artificial Sequence
  Description of Artificial Sequence: Synthetic oligonucleotide
ccggtggctgagggcagagactct

SEQ ID NO: 401338 - DNA, 24 bp, Artificial Sequence
  Description of Artificial Sequence: Synthetic oligonucleotide
cggtggctgagggcagagactctc

SEQ ID NO: 401339 - DNA, 24 bp, Artificial Sequence
  Description of Artificial Sequence: Synthetic oligonucleotide
ggtggctgagggcagagactctcc

SEQ ID NO: 401340 - DNA, 27 bp, Artificial Sequence
  Description of Artificial Sequence: Synthetic oligonucleotide
ggcatgtgctacttcaccaacgggacg

SEQ ID NO: 401341 - DNA, 27 bp, Artificial Sequence
  Description of Artificial Sequence: Synthetic oligonucleotide
gcatgtgctacttcaccaacgggacgg

SEQ ID NO: 401342 - DNA, 22 bp, Artificial Sequence
  Description of Artificial Sequence: Synthetic oligonucleotide
caacgggacggagcgcgtgcgt

SEQ ID NO: 401343 - DNA, 24 bp, Artificial Sequence
  Description of Artificial Sequence: Synthetic oligonucleotide
aacgggacggagcgcgtgcgtctt

SEQ ID NO: 401344 - DNA, 23 bp, Artificial Sequence
  Description of Artificial Sequence: Synthetic oligonucleotide
acgggacggagcgcgtgcgtctt

SEQ ID NO: 401345 - DNA, 22 bp, Artificial Sequence
  Description of Artificial Sequence: Synthetic oligonucleotide
cgggacggagcgcgtgcgtctt

SEQ ID NO: 401346 - DNA, 23 bp, Artificial Sequence
  Description of Artificial Sequence: Synthetic oligonucleotide
gggacggagcgcgtgcgtcttgt

SEQ ID NO: 401347 - DNA, 24 bp, Artificial Sequence
  Description of Artificial Sequence: Synthetic oligonucleotide
ggacggagcgcgtgcgtcttgtga

SEQ ID NO: 401348 - DNA, 24 bp, Artificial Sequence
  Description of Artificial Sequence: Synthetic oligonucleotide
gacggagcgcgtgcgtcttgtgac

SEQ ID NO: 401349 - DNA, 25 bp, Artificial Sequence
  Description of Artificial Sequence: Synthetic oligonucleotide
acggagcgcgtgcgtcttgtgacca

SEQ ID NO: 401350 - DNA, 24 bp, Artificial Sequence
  Description of Artificial Sequence: Synthetic oligonucleotide
cggagcgcgtgcgtcttgtgacca

SEQ ID NO: 401351 - DNA, 27 bp, Artificial Sequence
  Description of Artificial Sequence: Synthetic oligonucleotide
ggagcgcgtgcgtcttgtgaccagata

SEQ ID NO: 401352 - DNA, 27 bp, Artificial Sequence
  Description of Artificial Sequence: Synthetic oligonucleotide
gagcgcgtgcgtcttgtgaccagatac

SEQ ID NO: 401353 - DNA, 29 bp, Artificial Sequence
  Description of Artificial Sequence: Synthetic oligonucleotide
agcgcgtgcgtcttgtgaccagatacatc

SEQ ID NO: 401354 - DNA, 28 bp, Artificial Sequence
  Description of Artificial Sequence: Synthetic oligonucleotide
gcgcgtgcgtcttgtgaccagatacatc

SEQ ID NO: 401355 - DNA, 33 bp, Artificial Sequence; identical to SEQ ID NO: 59505
  Description of Artificial Sequence: Synthetic oligonucleotide

SEQ ID NO: 401356 - DNA, 33 bp, Artificial Sequence; identical to SEQ ID NO: 59506
  Description of Artificial Sequence: Synthetic oligonucleotide

SEQ ID NO: 401357 - DNA, 33 bp, Artificial Sequence; identical to SEQ ID NO: 59507
  Description of Artificial Sequence: Synthetic oligonucleotide

SEQ ID NO: 401358 - DNA, 34 bp, Artificial Sequence; identical to SEQ ID NO: 59508
  Description of Artificial Sequence: Synthetic oligonucleotide

SEQ ID NO: 401359 - DNA, 35 bp, Artificial Sequence; identical to SEQ ID NO: 59509
  Description of Artificial Sequence: Synthetic oligonucleotide

SEQ ID NO: 401360 - DNA, 34 bp, Artificial Sequence; identical to SEQ ID NO: 59510
  Description of Artificial Sequence: Synthetic oligonucleotide

SEQ ID NO: 401361 - DNA, 34 bp, Artificial Sequence; identical to SEQ ID NO: 59511
  Description of Artificial Sequence: Synthetic oligonucleotide

SEQ ID NO: 401362 - DNA, 35 bp, Artificial Sequence; identical to SEQ ID NO: 59512
  Description of Artificial Sequence: Synthetic oligonucleotide

SEQ ID NO: 401363 - DNA, 37 bp, Artificial Sequence; identical to SEQ ID NO: 59513
  Description of Artificial Sequence: Synthetic oligonucleotide

SEQ ID NO: 401364 - DNA, 36 bp, Artificial Sequence; identical to SEQ ID NO: 59514
  Description of Artificial Sequence: Synthetic oligonucleotide

SEQ ID NO: 401365 - DNA, 36 bp, Artificial Sequence; identical to SEQ ID NO: 59515
  Description of Artificial Sequence: Synthetic oligonucleotide

SEQ ID NO: 401366 - DNA, 25 bp, Artificial Sequence
  Description of Artificial Sequence: Synthetic oligonucleotide
tacgcacgcttcgacagcgacgtgg

SEQ ID NO: 401367 - DNA, 24 bp, Artificial Sequence
  Description of Artificial Sequence: Synthetic oligonucleotide
acgcacgcttcgacagcgacgtgg

SEQ ID NO: 401368 - DNA, 23 bp, Artificial Sequence
  Description of Artificial Sequence: Synthetic oligonucleotide
cgcacgcttcgacagcgacgtgg

SEQ ID NO: 401369 - DNA, 23 bp, Artificial Sequence
  Description of Artificial Sequence: Synthetic oligonucleotide
gcacgcttcgacagcgacgtggg

SEQ ID NO: 401370 - DNA, 23 bp, Artificial Sequence
  Description of Artificial Sequence: Synthetic oligonucleotide
cacgcttcgacagcgacgtgggg

SEQ ID NO: 401371 - DNA, 24 bp, Artificial Sequence
  Description of Artificial Sequence: Synthetic oligonucleotide
acgcttcgacagcgacgtgggggt

SEQ ID NO: 401372 - DNA, 23 bp, Artificial Sequence
  Description of Artificial Sequence: Synthetic oligonucleotide
cgcttcgacagcgacgtgggggt

SEQ ID NO: 401373 - DNA, 26 bp, Artificial Sequence
  Description of Artificial Sequence: Synthetic oligonucleotide
gcttcgacagcgacgtgggggtgtat

SEQ ID NO: 401374 - DNA, 26 bp, Artificial Sequence
  Description of Artificial Sequence: Synthetic oligonucleotide
cttcgacagcgacgtgggggtgtatc

SEQ ID NO: 401375 - DNA, 26 bp, Artificial Sequence
  Description of Artificial Sequence: Synthetic oligonucleotide
ttcgacagcgacgtgggggtgtatcg

SEQ ID NO: 401376 - DNA, 25 bp, Artificial Sequence
  Description of Artificial Sequence: Synthetic oligonucleotide
tcgacagcgacgtgggggtgtatcg

SEQ ID NO: 401377 - DNA, 24 bp, Artificial Sequence
  Description of Artificial Sequence: Synthetic oligonucleotide
cgacagcgacgtgggggtgtatcg

SEQ ID NO: 401378 - DNA, 24 bp, Artificial Sequence
  Description of Artificial Sequence: Synthetic oligonucleotide
gacagcgacgtgggggtgtatcgg

SEQ ID NO: 401379 - DNA, 24 bp, Artificial Sequence
  Description of Artificial Sequence: Synthetic oligonucleotide
acagcgacgtgggggtgtatcggg

SEQ ID NO: 401380 - DNA, 23 bp, Artificial Sequence
  Description of Artificial Sequence: Synthetic oligonucleotide
cagcgacgtgggggtgtatcggg

SEQ ID NO: 401381 - DNA, 23 bp, Artificial Sequence
  Description of Artificial Sequence: Synthetic oligonucleotide
agcgacgtgggggtgtatcgggc

SEQ ID NO: 401382 - DNA, 22 bp, Artificial Sequence
  Description of Artificial Sequence: Synthetic oligonucleotide
gcgacgtgggggtgtatcgggc

SEQ ID NO: 401383 - DNA, 22 bp, Artificial Sequence
  Description of Artificial Sequence: Synthetic oligonucleotide
cgacgtgggggtgtatcgggcg

SEQ ID NO: 401384 - DNA, 23 bp, Artificial Sequence
  Description of Artificial Sequence: Synthetic oligonucleotide
gacgtgggggtgtatcgggcggt

SEQ ID NO: 401385 - DNA, 24 bp, Artificial Sequence
  Description of Artificial Sequence: Synthetic oligonucleotide
acgtgggggtgtatcgggcggtga

SEQ ID NO: 401386 - DNA, 23 bp, Artificial Sequence
  Description of Artificial Sequence: Synthetic oligonucleotide
cgtgggggtgtatcgggcggtga

SEQ ID NO: 401387 - DNA, 23 bp, Artificial Sequence
  Description of Artificial Sequence: Synthetic oligonucleotide
gtgggggtgtatcgggcggtgac

SEQ ID NO: 401388 - DNA, 23 bp, Artificial Sequence
  Description of Artificial Sequence: Synthetic oligonucleotide
tgggggtgtatcgggcggtgacg

SEQ ID NO: 401389 - DNA, 22 bp, Artificial Sequence
  Description of Artificial Sequence: Synthetic oligonucleotide
gggggtgtatcgggcggtgacg

SEQ ID NO: 401390 - DNA, 22 bp, Artificial Sequence
  Description of Artificial Sequence: Synthetic oligonucleotide
ggggtgtatcgggcggtgacgc

SEQ ID NO: 401391 - DNA, 22 bp, Artificial Sequence
  Description of Artificial Sequence: Synthetic oligonucleotide
gggtgtatcgggcggtgacgcc

SEQ ID NO: 401392 - DNA, 22 bp, Artificial Sequence
  Description of Artificial Sequence: Synthetic oligonucleotide
ggtgtatcgggcggtgacgccg

SEQ ID NO: 401393 - DNA, 23 bp, Artificial Sequence
  Description of Artificial Sequence: Synthetic oligonucleotide
gtgtatcgggcggtgacgccgct

SEQ ID NO: 401394 - DNA, 23 bp, Artificial Sequence
  Description of Artificial Sequence: Synthetic oligonucleotide
tgtatcgggcggtgacgccgctg

SEQ ID NO: 401395 - DNA, 22 bp, Artificial Sequence
  Description of Artificial Sequence: Synthetic oligonucleotide
gtatcgggcggtgacgccgctg

SEQ ID NO: 401396 - DNA, 22 bp, Artificial Sequence
  Description of Artificial Sequence: Synthetic oligonucleotide
tatcgggcggtgacgccgctgg

SEQ ID NO: 401397 - DNA, 21 bp, Artificial Sequence
  Description of Artificial Sequence: Synthetic oligonucleotide
atcgggcggtgacgccgctgg

SEQ ID NO: 401398 - DNA, 20 bp, Artificial Sequence
  Description of Artificial Sequence: Synthetic oligonucleotide
tcgggcggtgacgccgctgg

SEQ ID NO: 401399 - DNA, 20 bp, Artificial Sequence
  Description of Artificial Sequence: Synthetic oligonucleotide
acgccgctggggccgcctgt

SEQ ID NO: 401400 - DNA, 20 bp, Artificial Sequence
  Description of Artificial Sequence: Synthetic oligonucleotide
cgccgctggggccgcctgtt

SEQ ID NO: 401401 - DNA, 20 bp, Artificial Sequence
  Description of Artificial Sequence: Synthetic oligonucleotide
gccgctggggccgcctgctt

SEQ ID NO: 401402 - DNA, 20 bp, Artificial Sequence
  Description of Artificial Sequence: Synthetic oligonucleotide
ccgctggggccgcctgcctt

SEQ ID NO: 401403 - DNA, 20 bp, Artificial Sequence
  Description of Artificial Sequence: Synthetic oligonucleotide
cgctggggccgcctgccgtt

SEQ ID NO: 401404 - DNA, 20 bp, Artificial Sequence
  Description of Artificial Sequence: Synthetic oligonucleotide
gctggggccgcctgccgctt

SEQ ID NO: 401405 - DNA, 20 bp, Artificial Sequence
  Description of Artificial Sequence: Synthetic oligonucleotide
ctggggccgcctgccgcctt

SEQ ID NO: 401406 - DNA, 20 bp, Artificial Sequence
  Description of Artificial Sequence: Synthetic oligonucleotide
tggggccgcctgccgccgat

SEQ ID NO: 401407 - DNA, 20 bp, Artificial Sequence
  Description of Artificial Sequence: Synthetic oligonucleotide
ggggccgcctgccgccgatt

SEQ ID NO: 401408 - DNA, 20 bp, Artificial Sequence
  Description of Artificial Sequence: Synthetic oligonucleotide
gggccgcctgccgccgagta

SEQ ID NO: 401409 - DNA, 21 bp, Artificial Sequence
  Description of Artificial Sequence: Synthetic oligonucleotide
ggccgcctgccgccgagtact

SEQ ID NO: 401410 - DNA, 21 bp, Artificial Sequence
  Description of Artificial Sequence: Synthetic oligonucleotide
gccgcctgccgccgagtactg

SEQ ID NO: 401411 - DNA, 23 bp, Artificial Sequence
  Description of Artificial Sequence: Synthetic oligonucleotide
ccgcctgccgccgagtactggaa

SEQ ID NO: 401412 - DNA, 24 bp, Artificial Sequence
  Description of Artificial Sequence: Synthetic oligonucleotide
cgcctgccgccgagtactggaaca

SEQ ID NO: 401413 - DNA, 31 bp, Artificial Sequence; identical to SEQ ID NO: 59563
  Description of Artificial Sequence: Synthetic oligonucleotide

SEQ ID NO: 401414 - DNA, 30 bp, Artificial Sequence; identical to SEQ ID NO: 59564
  Description of Artificial Sequence: Synthetic oligonucleotide

SEQ ID NO: 401415 - DNA, 30 bp, Artificial Sequence; identical to SEQ ID NO: 59565
  Description of Artificial Sequence: Synthetic oligonucleotide

SEQ ID NO: 401416 - DNA, 30 bp, Artificial Sequence; identical to SEQ ID NO: 59566
  Description of Artificial Sequence: Synthetic oligonucleotide

SEQ ID NO: 401417 - DNA, 29 bp, Artificial Sequence
  Description of Artificial Sequence: Synthetic oligonucleotide
ttcggaatgaccaggaggagacaactggc

SEQ ID NO: 401418 - DNA, 28 bp, Artificial Sequence
  Description of Artificial Sequence: Synthetic oligonucleotide
tcggaatgaccaggaggagacaactggc

SEQ ID NO: 401419 - DNA, 27 bp, Artificial Sequence
  Description of Artificial Sequence: Synthetic oligonucleotide
cggaatgaccaggaggagacaactggc

SEQ ID NO: 401420 - DNA, 27 bp, Artificial Sequence
  Description of Artificial Sequence: Synthetic oligonucleotide
ggaatgaccaggaggagacaactggcg

SEQ ID NO: 401421 - DNA, 29 bp, Artificial Sequence
  Description of Artificial Sequence: Synthetic oligonucleotide
gaatgaccaggaggagacaactggcgttg

SEQ ID NO: 401422 - DNA, 30 bp, Artificial Sequence; identical to SEQ ID NO: 59572
  Description of Artificial Sequence: Synthetic oligonucleotide

SEQ ID NO: 401423 - DNA, 29 bp, Artificial Sequence
  Description of Artificial Sequence: Synthetic oligonucleotide
atgaccaggaggagacaactggcgttgtg

SEQ ID NO: 401424 - DNA, 28 bp, Artificial Sequence
  Description of Artificial Sequence: Synthetic oligonucleotide
tgaccaggaggagacaactggcgttgtg

SEQ ID NO: 401425 - DNA, 27 bp, Artificial Sequence
  Description of Artificial Sequence: Synthetic oligonucleotide
gaccaggaggagacaactggcgttgtg

SEQ ID NO: 401426 - DNA, 28 bp, Artificial Sequence
  Description of Artificial Sequence: Synthetic oligonucleotide
accaggaggagacaactggcgttgtgtc

SEQ ID NO: 401427 - DNA, 27 bp, Artificial Sequence
  Description of Artificial Sequence: Synthetic oligonucleotide
ccaggaggagacaactggcgttgtgtc

SEQ ID NO: 401428 - DNA, 27 bp, Artificial Sequence
  Description of Artificial Sequence: Synthetic oligonucleotide
caggaggagacaactggcgttgtgtcc

SEQ ID NO: 401429 - DNA, 28 bp, Artificial Sequence
  Description of Artificial Sequence: Synthetic oligonucleotide
aggaggagacaactggcgttgtgtccac

SEQ ID NO: 401430 - DNA, 27 bp, Artificial Sequence
  Description of Artificial Sequence: Synthetic oligonucleotide
ggaggagacaactggcgttgtgtccac

SEQ ID NO: 401431 - DNA, 27 bp, Artificial Sequence
  Description of Artificial Sequence: Synthetic oligonucleotide
gaggagacaactggcgttgtgtccacc

SEQ ID NO: 401432 - DNA, 27 bp, Artificial Sequence
  Description of Artificial Sequence: Synthetic oligonucleotide
aggagacaactggcgttgtgtccaccc

SEQ ID NO: 401433 - DNA, 26 bp, Artificial Sequence
  Description of Artificial Sequence: Synthetic oligonucleotide
ggagacaactggcgttgtgtccaccc

SEQ ID NO: 401434 - DNA, 26 bp, Artificial Sequence
  Description of Artificial Sequence: Synthetic oligonucleotide
gagacaactggcgttgtgtccacccc

SEQ ID NO: 401435 - DNA, 26 bp, Artificial Sequence
  Description of Artificial Sequence: Synthetic oligonucleotide
agacaactggcgttgtgtccaccccc

SEQ ID NO: 401436 - DNA, 25 bp, Artificial Sequence
  Description of Artificial Sequence: Synthetic oligonucleotide
gacaactggcgttgtgtccaccccc

SEQ ID NO: 401437 - DNA, 27 bp, Artificial Sequence
  Description of Artificial Sequence: Synthetic oligonucleotide
acaactggcgttgtgtccacccccctt

SEQ ID NO: 401438 - DNA, 27 bp, Artificial Sequence
  Description of Artificial Sequence: Synthetic oligonucleotide
caactggcgttgtgtccacccccctta

SEQ ID NO: 401439 - DNA, 30 bp, Artificial Sequence; identical to SEQ ID NO: 59589
  Description of Artificial Sequence: Synthetic oligonucleotide

SEQ ID NO: 401440 - DNA, 29 bp, Artificial Sequence
  Description of Artificial Sequence: Synthetic oligonucleotide
actggcgttgtgtccaccccccttattag

SEQ ID NO: 401441 - DNA, 26 bp, Artificial Sequence
  Description of Artificial Sequence: Synthetic oligonucleotide
caccccagcctccagaaccccatcat

SEQ ID NO: 401442 - DNA, 26 bp, Artificial Sequence
  Description of Artificial Sequence: Synthetic oligonucleotide
accccagcctccagaaccccatcatc

SEQ ID NO: 401443 - DNA, 25 bp, Artificial Sequence
  Description of Artificial Sequence: Synthetic oligonucleotide
ccccagcctccagaaccccatcatc

SEQ ID NO: 401444 - DNA, 26 bp, Artificial Sequence
  Description of Artificial Sequence: Synthetic oligonucleotide
cccagcctccagaaccccatcatcgt

SEQ ID NO: 401445 - DNA, 26 bp, Artificial Sequence
  Description of Artificial Sequence: Synthetic oligonucleotide
ccagcctccagaaccccatcatcgtg

SEQ ID NO: 401446 - DNA, 27 bp, Artificial Sequence
  Description of Artificial Sequence: Synthetic oligonucleotide
cagcctccagaaccccatcatcgtgga

SEQ ID NO: 401447 - DNA, 27 bp, Artificial Sequence
  Description of Artificial Sequence: Synthetic oligonucleotide
agcctccagaaccccatcatcgtggag

SEQ ID NO: 401448 - DNA, 27 bp, Artificial Sequence
  Description of Artificial Sequence: Synthetic oligonucleotide
gcctccagaaccccatcatcgtggagt

SEQ ID NO: 401449 - DNA, 27 bp, Artificial Sequence
  Description of Artificial Sequence: Synthetic oligonucleotide
cctccagaaccccatcatcgtggagtg

SEQ ID NO: 401450 - DNA, 27 bp, Artificial Sequence
  Description of Artificial Sequence: Synthetic oligonucleotide
ctccagaaccccatcatcgtggagtgg

SEQ ID NO: 401451 - DNA, 27 bp, Artificial Sequence
  Description of Artificial Sequence: Synthetic oligonucleotide
tccagaaccccatcatcgtggagtggc

SEQ ID NO: 401452 - DNA, 26 bp, Artificial Sequence
  Description of Artificial Sequence: Synthetic oligonucleotide
ccagaaccccatcatcgtggagtggc

SEQ ID NO: 401453 - DNA, 26 bp, Artificial Sequence
  Description of Artificial Sequence: Synthetic oligonucleotide
cagaaccccatcatcgtggagtggcg

SEQ ID NO: 401454 - DNA, 26 bp, Artificial Sequence
  Description of Artificial Sequence: Synthetic oligonucleotide
agaaccccatcatcgtggagtggcgg

SEQ ID NO: 401455 - DNA, 25 bp, Artificial Sequence
  Description of Artificial Sequence: Synthetic oligonucleotide
gaaccccatcatcgtggagtggcgg

SEQ ID NO: 401456 - DNA, 25 bp, Artificial Sequence
  Description of Artificial Sequence: Synthetic oligonucleotide
aaccccatcatcgtggagtggcggg

SEQ ID NO: 401457 - DNA, 24 bp, Artificial Sequence
  Description of Artificial Sequence: Synthetic oligonucleotide
accccatcatcgtggagtggcggg

SEQ ID NO: 401458 - DNA, 23 bp, Artificial Sequence
  Description of Artificial Sequence: Synthetic oligonucleotide
ccccatcatcgtggagtggcggg

SEQ ID NO: 401459 - DNA, 24 bp, Artificial Sequence
  Description of Artificial Sequence: Synthetic oligonucleotide
cccatcatcgtggagtggcgggct

SEQ ID NO: 401460 - DNA, 25 bp, Artificial Sequence
  Description of Artificial Sequence: Synthetic oligonucleotide
ccatcatcgtggagtggcgggctca

SEQ ID NO: 401461 - DNA, 26 bp, Artificial Sequence
  Description of Artificial Sequence: Synthetic oligonucleotide
catcatcgtggagtggcgggctcagt

SEQ ID NO: 401462 - DNA, 27 bp, Artificial Sequence
  Description of Artificial Sequence: Synthetic oligonucleotide
atcatcgtggagtggcgggctcagtct

SEQ ID NO: 401463 - DNA, 26 bp, Artificial Sequence
  Description of Artificial Sequence: Synthetic oligonucleotide
tcatcgtggagtggcgggctcagtct

SEQ ID NO: 401464 - DNA, 25 bp, Artificial Sequence
  Description of Artificial Sequence: Synthetic oligonucleotide
catcgtggagtggcgggctcagtct

SEQ ID NO: 401465 - DNA, 27 bp, Artificial Sequence
  Description of Artificial Sequence: Synthetic oligonucleotide
atcgtggagtggcgggctcagtctgaa

SEQ ID NO: 401466 - DNA, 27 bp, Artificial Sequence
  Description of Artificial Sequence: Synthetic oligonucleotide
tcgtggagtggcgggctcagtctgaat

SEQ ID NO: 401467 - DNA, 30 bp, Artificial Sequence; identical to SEQ ID NO: 59617
  Description of Artificial Sequence: Synthetic oligonucleotide

SEQ ID NO: 401468 - DNA, 30 bp, Artificial Sequence; identical to SEQ ID NO: 59618
  Description of Artificial Sequence: Synthetic oligonucleotide

SEQ ID NO: 401469 - DNA, 29 bp, Artificial Sequence
  Description of Artificial Sequence: Synthetic oligonucleotide
gatcttcctcgggctgggccttattatcc

SEQ ID NO: 401470 - DNA, 21 bp, Artificial Sequence
  Description of Artificial Sequence: Synthetic oligonucleotide
ctggagaggacccgggcggag

SEQ ID NO: 401471 - DNA, 22 bp, Artificial Sequence
  Description of Artificial Sequence: Synthetic oligonucleotide
tggagaggacccgggcggagct

SEQ ID NO: 401472 - DNA, 21 bp, Artificial Sequence
  Description of Artificial Sequence: Synthetic oligonucleotide
ggagaggacccgggcggagct

SEQ ID NO: 401473 - DNA, 21 bp, Artificial Sequence
  Description of Artificial Sequence: Synthetic oligonucleotide
gagaggacccgggcggagctg

SEQ ID NO: 401474 - DNA, 22 bp, Artificial Sequence
  Description of Artificial Sequence: Synthetic oligonucleotide
agaggacccgggcggagctgga

SEQ ID NO: 401475 - DNA, 21 bp, Artificial Sequence
  Description of Artificial Sequence: Synthetic oligonucleotide
gaggacccgggcggagctgga

SEQ ID NO: 401476 - DNA, 22 bp, Artificial Sequence
  Description of Artificial Sequence: Synthetic oligonucleotide
aggacccgggcggagctggaca

SEQ ID NO: 401477 - DNA, 21 bp, Artificial Sequence
  Description of Artificial Sequence: Synthetic oligonucleotide
ggacccgggcggagctggaca

SEQ ID NO: 401478 - DNA, 21 bp, Artificial Sequence
  Description of Artificial Sequence: Synthetic oligonucleotide
gacccgggcggagctggacac

SEQ ID NO: 401479 - DNA, 21 bp, Artificial Sequence
  Description of Artificial Sequence: Synthetic oligonucleotide
acccgggcggagctggacacg

SEQ ID NO: 401480 - DNA, 20 bp, Artificial Sequence
  Description of Artificial Sequence: Synthetic oligonucleotide
cccgggcggagctggacacg

SEQ ID NO: 401481 - DNA, 21 bp, Artificial Sequence
  Description of Artificial Sequence: Synthetic oligonucleotide
ccgggcggagctggacacggt

SEQ ID NO: 401482 - DNA, 22 bp, Artificial Sequence
  Description of Artificial Sequence: Synthetic oligonucleotide
cgggcggagctggacacggtgt

SEQ ID NO: 401483 - DNA, 22 bp, Artificial Sequence
  Description of Artificial Sequence: Synthetic oligonucleotide
gggcggagctggacacggtgtg

SEQ ID NO: 401484 - DNA, 23 bp, Artificial Sequence
  Description of Artificial Sequence: Synthetic oligonucleotide
ggcggagctggacacggtgtgca

SEQ ID NO: 401485 - DNA, 24 bp, Artificial Sequence
  Description of Artificial Sequence: Synthetic oligonucleotide
gcggagctggacacggtgtgcaga

SEQ ID NO: 401486 - DNA, 25 bp, Artificial Sequence
  Description of Artificial Sequence: Synthetic oligonucleotide
cggagctggacacggtgtgcagaca

SEQ ID NO: 401487 - DNA, 27 bp, Artificial Sequence
  Description of Artificial Sequence: Synthetic oligonucleotide
ggagctggacacggtgtgcagacacaa

SEQ ID NO: 401488 - DNA, 27 bp, Artificial Sequence
  Description of Artificial Sequence: Synthetic oligonucleotide
gagctggacacggtgtgcagacacaac

SEQ ID NO: 401489 - DNA, 29 bp, Artificial Sequence
  Description of Artificial Sequence: Synthetic oligonucleotide
agctggacacggtgtgcagacacaactac

SEQ ID NO: 401490 - DNA, 28 bp, Artificial Sequence
  Description of Artificial Sequence: Synthetic oligonucleotide
gctggacacggtgtgcagacacaactac

SEQ ID NO: 401491 - DNA, 28 bp, Artificial Sequence
  Description of Artificial Sequence: Synthetic oligonucleotide
ctggacacggtgtgcagacacaactacc

SEQ ID NO: 401492 - DNA, 34 bp, Artificial Sequence; identical to SEQ ID NO: 59642
  Description of Artificial Sequence: Synthetic oligonucleotide

SEQ ID NO: 401493 - DNA, 34 bp, Artificial Sequence; identical to SEQ ID NO: 59643
  Description of Artificial Sequence: Synthetic oligonucleotide

SEQ ID NO: 401494 - DNA, 35 bp, Artificial Sequence; identical to SEQ ID NO: 59644
  Description of Artificial Sequence: Synthetic oligonucleotide

SEQ ID NO: 401495 - DNA, 36 bp, Artificial Sequence; identical to SEQ ID NO: 59645
  Description of Artificial Sequence: Synthetic oligonucleotide

SEQ ID NO: 401496 - DNA, 36 bp, Artificial Sequence; identical to SEQ ID NO: 59646
  Description of Artificial Sequence: Synthetic oligonucleotide

SEQ ID NO: 401497 - DNA, 35 bp, Artificial Sequence; identical to SEQ ID NO: 59647
  Description of Artificial Sequence: Synthetic oligonucleotide

SEQ ID NO: 401498 - DNA, 36 bp, Artificial Sequence; identical to SEQ ID NO: 59648
  Description of Artificial Sequence: Synthetic oligonucleotide

SEQ ID NO: 401499 - DNA, 38 bp, Artificial Sequence; identical to SEQ ID NO: 59649
  Description of Artificial Sequence: Synthetic oligonucleotide

SEQ ID NO: 401500 - DNA, 38 bp, Artificial Sequence; identical to SEQ ID NO: 59650
  Description of Artificial Sequence: Synthetic oligonucleotide

SEQ ID NO: 401501 - DNA, 37 bp, Artificial Sequence; identical to SEQ ID NO: 59651
  Description of Artificial Sequence: Synthetic oligonucleotide

SEQ ID NO: 401502 - DNA, 37 bp, Artificial Sequence; identical to SEQ ID NO: 59652
  Description of Artificial Sequence: Synthetic oligonucleotide

SEQ ID NO: 401503 - DNA, 36 bp, Artificial Sequence; identical to SEQ ID NO: 59653
  Description of Artificial Sequence: Synthetic oligonucleotide

SEQ ID NO: 401504 - DNA, 35 bp, Artificial Sequence; identical to SEQ ID NO: 59654
  Description of Artificial Sequence: Synthetic oligonucleotide

SEQ ID NO: 401505 - DNA, 36 bp, Artificial Sequence; identical to SEQ ID NO: 59655
  Description of Artificial Sequence: Synthetic oligonucleotide

SEQ ID NO: 401506 - DNA, 35 bp, Artificial Sequence; identical to SEQ ID NO: 59656
  Description of Artificial Sequence: Synthetic oligonucleotide

SEQ ID NO: 401507 - DNA, 35 bp, Artificial Sequence; identical to SEQ ID NO: 59657
  Description of Artificial Sequence: Synthetic oligonucleotide

SEQ ID NO: 401508 - DNA, 34 bp, Artificial Sequence; identical to SEQ ID NO: 59658
  Description of Artificial Sequence: Synthetic oligonucleotide

SEQ ID NO: 401509 - DNA, 34 bp, Artificial Sequence; identical to SEQ ID NO: 59659
  Description of Artificial Sequence: Synthetic oligonucleotide

SEQ ID NO: 401510 - DNA, 36 bp, Artificial Sequence; identical to SEQ ID NO: 59660
  Description of Artificial Sequence: Synthetic oligonucleotide

SEQ ID NO: 401511 - DNA, 35 bp, Artificial Sequence; identical to SEQ ID NO: 59661
  Description of Artificial Sequence: Synthetic oligonucleotide

SEQ ID NO: 401512 - DNA, 35 bp, Artificial Sequence; identical to SEQ ID NO: 59662
  Description of Artificial Sequence: Synthetic oligonucleotide

SEQ ID NO: 401513 - DNA, 34 bp, Artificial Sequence; identical to SEQ ID NO: 59663
  Description of Artificial Sequence: Synthetic oligonucleotide

SEQ ID NO: 401514 - DNA, 33 bp, Artificial Sequence; identical to SEQ ID NO: 59664
  Description of Artificial Sequence: Synthetic oligonucleotide

SEQ ID NO: 401515 - DNA, 32 bp, Artificial Sequence; identical to SEQ ID NO: 59665
  Description of Artificial Sequence: Synthetic oligonucleotide

SEQ ID NO: 401516 - DNA, 33 bp, Artificial Sequence; identical to SEQ ID NO: 59666
  Description of Artificial Sequence: Synthetic oligonucleotide

SEQ ID NO: 401517 - DNA, 32 bp, Artificial Sequence; identical to SEQ ID NO: 59667
  Description of Artificial Sequence: Synthetic oligonucleotide

SEQ ID NO: 401518 - DNA, 31 bp, Artificial Sequence; identical to SEQ ID NO: 59668
  Description of Artificial Sequence: Synthetic oligonucleotide

SEQ ID NO: 401519 - DNA, 32 bp, Artificial Sequence; identical to SEQ ID NO: 59669
  Description of Artificial Sequence: Synthetic oligonucleotide

SEQ ID NO: 401520 - DNA, 31 bp, Artificial Sequence; identical to SEQ ID NO: 59670
  Description of Artificial Sequence: Synthetic oligonucleotide

SEQ ID NO: 401521 - DNA, 30 bp, Artificial Sequence; identical to SEQ ID NO: 59671
  Description of Artificial Sequence: Synthetic oligonucleotide

SEQ ID NO: 401522 - DNA, 29 bp, Artificial Sequence
  Description of Artificial Sequence: Synthetic oligonucleotide
aatcgagaggagtacgcacgcttcgacag

SEQ ID NO: 401523 - DNA, 28 bp, Artificial Sequence
  Description of Artificial Sequence: Synthetic oligonucleotide
atcgagaggagtacgcacgcttcgacag

SEQ ID NO: 401524 - DNA, 27 bp, Artificial Sequence
  Description of Artificial Sequence: Synthetic oligonucleotide
tcgagaggagtacgcacgcttcgacag

SEQ ID NO: 401525 - DNA, 25 bp, Artificial Sequence
  Description of Artificial Sequence: Synthetic oligonucleotide
gcttcgacagcgacgtgggggtgta

SEQ ID NO: 401526 - DNA, 25 bp, Artificial Sequence
  Description of Artificial Sequence: Synthetic oligonucleotide
cttcgacagcgacgtgggggtgtac

SEQ ID NO: 401527 - DNA, 25 bp, Artificial Sequence
  Description of Artificial Sequence: Synthetic oligonucleotide
ttcgacagcgacgtgggggtgtacc

SEQ ID NO: 401528 - DNA, 24 bp, Artificial Sequence
  Description of Artificial Sequence: Synthetic oligonucleotide
tcgacagcgacgtgggggtgtacc

SEQ ID NO: 401529 - DNA, 23 bp, Artificial Sequence
  Description of Artificial Sequence: Synthetic oligonucleotide
cgacagcgacgtgggggtgtacc

SEQ ID NO: 401530 - DNA, 23 bp, Artificial Sequence
  Description of Artificial Sequence: Synthetic oligonucleotide
gacagcgacgtgggggtgtaccg

SEQ ID NO: 401531 - DNA, 23 bp, Artificial Sequence
  Description of Artificial Sequence: Synthetic oligonucleotide
acagcgacgtgggggtgtaccgc

SEQ ID NO: 401532 - DNA, 22 bp, Artificial Sequence
  Description of Artificial Sequence: Synthetic oligonucleotide
cagcgacgtgggggtgtaccgc

SEQ ID NO: 401533 - DNA, 22 bp, Artificial Sequence
  Description of Artificial Sequence: Synthetic oligonucleotide
agcgacgtgggggtgtaccgcg

SEQ ID NO: 401534 - DNA, 21 bp, Artificial Sequence
  Description of Artificial Sequence: Synthetic oligonucleotide
gcgacgtgggggtgtaccgcg

SEQ ID NO: 401535 - DNA, 21 bp, Artificial Sequence
  Description of Artificial Sequence: Synthetic oligonucleotide
cgacgtgggggtgtaccgcgc

SEQ ID NO: 401536 - DNA, 21 bp, Artificial Sequence
  Description of Artificial Sequence: Synthetic oligonucleotide
gacgtgggggtgtaccgcgcg

SEQ ID NO: 401537 - DNA, 22 bp, Artificial Sequence
  Description of Artificial Sequence: Synthetic oligonucleotide
acgtgggggtgtaccgcgcggt

SEQ ID NO: 401538 - DNA, 21 bp, Artificial Sequence
  Description of Artificial Sequence: Synthetic oligonucleotide
cgtgggggtgtaccgcgcggt

SEQ ID NO: 401539 - DNA, 22 bp, Artificial Sequence
  Description of Artificial Sequence: Synthetic oligonucleotide
gtgggggtgtaccgcgcggtga

SEQ ID NO: 401540 - DNA, 22 bp, Artificial Sequence
  Description of Artificial Sequence: Synthetic oligonucleotide
tgggggtgtaccgcgcggtgac

SEQ ID NO: 401541 - DNA, 21 bp, Artificial Sequence
  Description of Artificial Sequence: Synthetic oligonucleotide
gggggtgtaccgcgcggtgac

SEQ ID NO: 401542 - DNA, 21 bp, Artificial Sequence
  Description of Artificial Sequence: Synthetic oligonucleotide
ggggtgtaccgcgcggtgacg

SEQ ID NO: 401543 - DNA, 21 bp, Artificial Sequence
  Description of Artificial Sequence: Synthetic oligonucleotide
gggtgtaccgcgcggtgacgc

SEQ ID NO: 401544 - DNA, 21 bp, Artificial Sequence
  Description of Artificial Sequence: Synthetic oligonucleotide
ggtgtaccgcgcggtgacgcc

SEQ ID NO: 401545 - DNA, 21 bp, Artificial Sequence
  Description of Artificial Sequence: Synthetic oligonucleotide
gtgtaccgcgcggtgacgccg

SEQ ID NO: 401546 - DNA, 22 bp, Artificial Sequence
  Description of Artificial Sequence: Synthetic oligonucleotide
tgtaccgcgcggtgacgccgct

SEQ ID NO: 401547 - DNA, 21 bp, Artificial Sequence
  Description of Artificial Sequence: Synthetic oligonucleotide
gtaccgcgcggtgacgccgct

SEQ ID NO: 401548 - DNA, 21 bp, Artificial Sequence
  Description of Artificial Sequence: Synthetic oligonucleotide
taccgcgcggtgacgccgctg

SEQ ID NO: 401549 - DNA, 20 bp, Artificial Sequence
  Description of Artificial Sequence: Synthetic oligonucleotide
accgcgcggtgacgccgctg

SEQ ID NO: 401550 - DNA, 20 bp, Artificial Sequence
  Description of Artificial Sequence: Synthetic oligonucleotide
ccgcgcggtgacgccgctgt

SEQ ID NO: 401551 - DNA, 20 bp, Artificial Sequence
  Description of Artificial Sequence: Synthetic oligonucleotide
cgcgcggtgacgccgctggt

SEQ ID NO: 401552 - DNA, 20 bp, Artificial Sequence
  Description of Artificial Sequence: Synthetic oligonucleotide
gcgcggtgacgccgctgggt

SEQ ID NO: 401553 - DNA, 20 bp, Artificial Sequence
  Description of Artificial Sequence: Synthetic oligonucleotide
cgcggtgacgccgctggggt

SEQ ID NO: 401554 - DNA, 40 bp, Artificial Sequence
  Description of Artificial Sequence: Synthetic oligonucleotide
tgccagggactggattgagaaccttcacaaaaaaaaaatg

SEQ ID NO: 401555 - DNA, 39 bp, Artificial Sequence
  Description of Artificial Sequence: Synthetic oligonucleotide
gccagggactggattgagaaccttcacaaaaaaaaaatg

SEQ ID NO: 401556 - DNA, 40 bp, Artificial Sequence
  Description of Artificial Sequence: Synthetic oligonucleotide
ccagggactggattgagaaccttcacaaaaaaaaaatgtc

SEQ ID NO: 401557 - DNA, 41 bp, Artificial Sequence
  Description of Artificial Sequence: Synthetic oligonucleotide
cagggactggattgagaaccttcacaaaaaaaaaatgtctg

SEQ ID NO: 401558 - DNA, 41 bp, Artificial Sequence
  Description of Artificial Sequence: Synthetic oligonucleotide
agggactggattgagaaccttcacaaaaaaaaaatgtctgc

SEQ ID NO: 401559 - DNA, 40 bp, Artificial Sequence
  Description of Artificial Sequence: Synthetic oligonucleotide
gggactggattgagaaccttcacaaaaaaaaaatgtctgc

SEQ ID NO: 401560 - DNA, 40 bp, Artificial Sequence
  Description of Artificial Sequence: Synthetic oligonucleotide
ggactggattgagaaccttcacaaaaaaaaaatgtctgcc

SEQ ID NO: 401561 - DNA, 42 bp, Artificial Sequence
  Description of Artificial Sequence: Synthetic oligonucleotide
gactggattgagaaccttcacaaaaaaaaaatgtctgcctag

SEQ ID NO: 401562 - DNA, 43 bp, Artificial Sequence
  Description of Artificial Sequence: Synthetic oligonucleotide
actggattgagaaccttcacaaaaaaaaaatgtctgcctagag

SEQ ID NO: 401563 - DNA, 42 bp, Artificial Sequence
  Description of Artificial Sequence: Synthetic oligonucleotide
ctggattgagaaccttcacaaaaaaaaaatgtctgcctagag

SEQ ID NO: 401564 - DNA, 43 bp, Artificial Sequence
  Description of Artificial Sequence: Synthetic oligonucleotide
tggattgagaaccttcacaaaaaaaaaatgtctgcctagagac

SEQ ID NO: 401565 - DNA, 42 bp, Artificial Sequence
  Description of Artificial Sequence: Synthetic oligonucleotide
ggattgagaaccttcacaaaaaaaaaatgtctgcctagagac

SEQ ID NO: 401566 - DNA, 43 bp, Artificial Sequence
  Description of Artificial Sequence: Synthetic oligonucleotide
gattgagaaccttcacaaaaaaaaaatgtctgcctagagacag

SEQ ID NO: 401567 - DNA, 47 bp, Artificial Sequence
  Description of Artificial Sequence: Synthetic oligonucleotide
attgagaaccttcacaaaaaaaaaatgtctgcctagagacagattag

SEQ ID NO: 401568 - DNA, 46 bp, Artificial Sequence
  Description of Artificial Sequence: Synthetic oligonucleotide
ttgagaaccttcacaaaaaaaaaatgtctgcctagagacagattag

SEQ ID NO: 401569 - DNA, 45 bp, Artificial Sequence
  Description of Artificial Sequence: Synthetic oligonucleotide
tgagaaccttcacaaaaaaaaaatgtctgcctagagacagattag

SEQ ID NO: 401570 - DNA, 44 bp, Artificial Sequence
  Description of Artificial Sequence: Synthetic oligonucleotide
gagaaccttcacaaaaaaaaaatgtctgcctagagacagattag

SEQ ID NO: 401571 - DNA, 44 bp, Artificial Sequence
  Description of Artificial Sequence: Synthetic oligonucleotide
agaaccttcacaaaaaaaaaatgtctgcctagagacagattagg

SEQ ID NO: 401572 - DNA, 43 bp, Artificial Sequence
  Description of Artificial Sequence: Synthetic oligonucleotide
gaaccttcacaaaaaaaaaatgtctgcctagagacagattagg

SEQ ID NO: 401573 - DNA, 44 bp, Artificial Sequence
  Description of Artificial Sequence: Synthetic oligonucleotide
aaccttcacaaaaaaaaaatgtctgcctagagacagattaggtc

SEQ ID NO: 401574 - DNA, 43 bp, Artificial Sequence
  Description of Artificial Sequence: Synthetic oligonucleotide
accttcacaaaaaaaaaatgtctgcctagagacagattaggtc

SEQ ID NO: 401575 - DNA, 42 bp, Artificial Sequence
  Description of Artificial Sequence: Synthetic oligonucleotide
ccttcacaaaaaaaaaatgtctgcctagagacagattaggtc

SEQ ID NO: 401576 - DNA, 42 bp, Artificial Sequence
  Description of Artificial Sequence: Synthetic oligonucleotide
cttcacaaaaaaaaaatgtctgcctagagacagattaggtcc

SEQ ID NO: 401577 - DNA, 44 bp, Artificial Sequence
  Description of Artificial Sequence: Synthetic oligonucleotide
ttcacaaaaaaaaaatgtctgcctagagacagattaggtccttc

SEQ ID NO: 401578 - DNA, 43 bp, Artificial Sequence
  Description of Artificial Sequence: Synthetic oligonucleotide
tcacaaaaaaaaaatgtctgcctagagacagattaggtccttc

SEQ ID NO: 401579 - DNA, 42 bp, Artificial Sequence
  Description of Artificial Sequence: Synthetic oligonucleotide
cacaaaaaaaaaatgtctgcctagagacagattaggtccttc

SEQ ID NO: 401580 - DNA, 43 bp, Artificial Sequence
  Description of Artificial Sequence: Synthetic oligonucleotide
acaaaaaaaaaatgtctgcctagagacagattaggtccttcag

SEQ ID NO: 401581 - DNA, 42 bp, Artificial Sequence
  Description of Artificial Sequence: Synthetic oligonucleotide
caaaaaaaaaatgtctgcctagagacagattaggtccttcag

SEQ ID NO: 401582 - DNA, 42 bp, Artificial Sequence
  Description of Artificial Sequence: Synthetic oligonucleotide
aaaaaaaaaatgtctgcctagagacagattaggtccttcagc

SEQ ID NO: 401583 - DNA, 28 bp, Artificial Sequence
  Description of Artificial Sequence: Synthetic oligonucleotide
ctggaaatgactccccagcgtggagatg

SEQ ID NO: 401584 - DNA, 29 bp, Artificial Sequence
  Description of Artificial Sequence: Synthetic oligonucleotide
tggaaatgactccccagcgtggagatgtc

SEQ ID NO: 401585 - DNA, 28 bp, Artificial Sequence
  Description of Artificial Sequence: Synthetic oligonucleotide
ggaaatgactccccagcgtggagatgtc

SEQ ID NO: 401586 - DNA, 30 bp, Artificial Sequence; identical to SEQ ID NO: 60769
  Description of Artificial Sequence: Synthetic oligonucleotide

SEQ ID NO: 401587 - DNA, 31 bp, Artificial Sequence; identical to SEQ ID NO: 60770
  Description of Artificial Sequence: Synthetic oligonucleotide

SEQ ID NO: 401588 - DNA, 30 bp, Artificial Sequence; identical to SEQ ID NO: 60771
  Description of Artificial Sequence: Synthetic oligonucleotide

SEQ ID NO: 401589 - DNA, 29 bp, Artificial Sequence
  Description of Artificial Sequence: Synthetic oligonucleotide
atgactccccagcgtggagatgtctacac

SEQ ID NO: 401590 - DNA, 28 bp, Artificial Sequence
  Description of Artificial Sequence: Synthetic oligonucleotide
tgactccccagcgtggagatgtctacac

SEQ ID NO: 401591 - DNA, 27 bp, Artificial Sequence
  Description of Artificial Sequence: Synthetic oligonucleotide
gactccccagcgtggagatgtctacac

SEQ ID NO: 401592 - DNA, 27 bp, Artificial Sequence
  Description of Artificial Sequence: Synthetic oligonucleotide
actccccagcgtggagatgtctacacc

SEQ ID NO: 401593 - DNA, 27 bp, Artificial Sequence
  Description of Artificial Sequence: Synthetic oligonucleotide
ctccccagcgtggagatgtctacacct

SEQ ID NO: 401594 - DNA, 27 bp, Artificial Sequence
  Description of Artificial Sequence: Synthetic oligonucleotide
tccccagcgtggagatgtctacacctg

SEQ ID NO: 401595 - DNA, 26 bp, Artificial Sequence
  Description of Artificial Sequence: Synthetic oligonucleotide
ccccagcgtggagatgtctacacctg

SEQ ID NO: 401596 - DNA, 26 bp, Artificial Sequence
  Description of Artificial Sequence: Synthetic oligonucleotide
cccagcgtggagatgtctacacctgc

SEQ ID NO: 401597 - DNA, 27 bp, Artificial Sequence
  Description of Artificial Sequence: Synthetic oligonucleotide
ccagcgtggagatgtctacacctgcca

SEQ ID NO: 401598 - DNA, 27 bp, Artificial Sequence
  Description of Artificial Sequence: Synthetic oligonucleotide
cagcgtggagatgtctacacctgccac

SEQ ID NO: 401599 - DNA, 27 bp, Artificial Sequence
  Description of Artificial Sequence: Synthetic oligonucleotide
agcgtggagatgtctacacctgccacg

SEQ ID NO: 401600 - DNA, 27 bp, Artificial Sequence
  Description of Artificial Sequence: Synthetic oligonucleotide
gcgtggagatgtctacacctgccacgt

SEQ ID NO: 401601 - DNA, 27 bp, Artificial Sequence
  Description of Artificial Sequence: Synthetic oligonucleotide
cgtggagatgtctacacctgccacgtg

SEQ ID NO: 401602 - DNA, 27 bp, Artificial Sequence
  Description of Artificial Sequence: Synthetic oligonucleotide
gtggagatgtctacacctgccacgtgg

SEQ ID NO: 401603 - DNA, 27 bp, Artificial Sequence
  Description of Artificial Sequence: Synthetic oligonucleotide
ggcatgtgctacttcaccaacgggacc

SEQ ID NO: 401604 - DNA, 27 bp, Artificial Sequence
  Description of Artificial Sequence: Synthetic oligonucleotide
gcatgtgctacttcaccaacgggaccg

SEQ ID NO: 401605 - DNA, 28 bp, Artificial Sequence
  Description of Artificial Sequence: Synthetic oligonucleotide
catgtgctacttcaccaacgggaccgag

SEQ ID NO: 401606 - DNA, 28 bp, Artificial Sequence
  Description of Artificial Sequence: Synthetic oligonucleotide
atgtgctacttcaccaacgggaccgagc

SEQ ID NO: 401607 - DNA, 27 bp, Artificial Sequence
  Description of Artificial Sequence: Synthetic oligonucleotide
tgtgctacttcaccaacgggaccgagc

SEQ ID NO: 401608 - DNA, 26 bp, Artificial Sequence
  Description of Artificial Sequence: Synthetic oligonucleotide
gtgctacttcaccaacgggaccgagc

SEQ ID NO: 401609 - DNA, 26 bp, Artificial Sequence
  Description of Artificial Sequence: Synthetic oligonucleotide
tgctacttcaccaacgggaccgagcg

SEQ ID NO: 401610 - DNA, 25 bp, Artificial Sequence
  Description of Artificial Sequence: Synthetic oligonucleotide
gctacttcaccaacgggaccgagcg

SEQ ID NO: 401611 - DNA, 25 bp, Artificial Sequence
  Description of Artificial Sequence: Synthetic oligonucleotide
ctacttcaccaacgggaccgagcgc

SEQ ID NO: 401612 - DNA, 26 bp, Artificial Sequence
  Description of Artificial Sequence: Synthetic oligonucleotide
tacttcaccaacgggaccgagcgcgt

SEQ ID NO: 401613 - DNA, 25 bp, Artificial Sequence
  Description of Artificial Sequence: Synthetic oligonucleotide
acttcaccaacgggaccgagcgcgt

SEQ ID NO: 401614 - DNA, 24 bp, Artificial Sequence
  Description of Artificial Sequence: Synthetic oligonucleotide
cttcaccaacgggaccgagcgcgt

SEQ ID NO: 401615 - DNA, 24 bp, Artificial Sequence
  Description of Artificial Sequence: Synthetic oligonucleotide
ttcaccaacgggaccgagcgcgtg

SEQ ID NO: 401616 - DNA, 23 bp, Artificial Sequence
  Description of Artificial Sequence: Synthetic oligonucleotide
tcaccaacgggaccgagcgcgtg

SEQ ID NO: 401617 - DNA, 22 bp, Artificial Sequence
  Description of Artificial Sequence: Synthetic oligonucleotide
caccaacgggaccgagcgcgtg

SEQ ID NO: 401618 - DNA, 22 bp, Artificial Sequence
  Description of Artificial Sequence: Synthetic oligonucleotide
accaacgggaccgagcgcgtgc

SEQ ID NO: 401619 - DNA, 21 bp, Artificial Sequence
  Description of Artificial Sequence: Synthetic oligonucleotide
ccaacgggaccgagcgcgtgc

SEQ ID NO: 401620 - DNA, 21 bp, Artificial Sequence
  Description of Artificial Sequence: Synthetic oligonucleotide
caacgggaccgagcgcgtgcg

SEQ ID NO: 401621 - DNA, 21 bp, Artificial Sequence
  Description of Artificial Sequence: Synthetic oligonucleotide
aacgggaccgagcgcgtgcgg

SEQ ID NO: 401622 - DNA, 20 bp, Artificial Sequence
  Description of Artificial Sequence: Synthetic oligonucleotide
acgggaccgagcgcgtgcgg

SEQ ID NO: 401623 - DNA, 20 bp, Artificial Sequence
  Description of Artificial Sequence: Synthetic oligonucleotide
cgggaccgagcgcgtgcggt

SEQ ID NO: 401624 - DNA, 20 bp, Artificial Sequence
  Description of Artificial Sequence: Synthetic oligonucleotide
gggaccgagcgcgtgcgggt

SEQ ID NO: 401625 - DNA, 20 bp, Artificial Sequence
  Description of Artificial Sequence: Synthetic oligonucleotide
ggaccgagcgcgtgcggggt

SEQ ID NO: 401626 - DNA, 21 bp, Artificial Sequence
  Description of Artificial Sequence: Synthetic oligonucleotide
gaccgagcgcgtgcggggtgt

SEQ ID NO: 401627 - DNA, 22 bp, Artificial Sequence
  Description of Artificial Sequence: Synthetic oligonucleotide
accgagcgcgtgcggggtgtga

SEQ ID NO: 401628 - DNA, 21 bp, Artificial Sequence
  Description of Artificial Sequence: Synthetic oligonucleotide
ccgagcgcgtgcggggtgtga

SEQ ID NO: 401629 - DNA, 21 bp, Artificial Sequence
  Description of Artificial Sequence: Synthetic oligonucleotide
cgagcgcgtgcggggtgtgac

SEQ ID NO: 401630 - DNA, 22 bp, Artificial Sequence
  Description of Artificial Sequence: Synthetic oligonucleotide
gagcgcgtgcggggtgtgacca

SEQ ID NO: 401631 - DNA, 25 bp, Artificial Sequence
  Description of Artificial Sequence: Synthetic oligonucleotide
agcgcgtgcggggtgtgaccagata

SEQ ID NO: 401632 - DNA, 24 bp, Artificial Sequence
  Description of Artificial Sequence: Synthetic oligonucleotide
gcgcgtgcggggtgtgaccagata

SEQ ID NO: 401633 - DNA, 26 bp, Artificial Sequence
  Description of Artificial Sequence: Synthetic oligonucleotide
cgcgtgcggggtgtgaccagatacat

SEQ ID NO: 401634 - DNA, 27 bp, Artificial Sequence
  Description of Artificial Sequence: Synthetic oligonucleotide
gcgtgcggggtgtgaccagatacatct

SEQ ID NO: 401635 - DNA, 31 bp, Artificial Sequence; identical to SEQ ID NO: 59736
  Description of Artificial Sequence: Synthetic oligonucleotide

SEQ ID NO: 401636 - DNA, 31 bp, Artificial Sequence; identical to SEQ ID NO: 59737
  Description of Artificial Sequence: Synthetic oligonucleotide

SEQ ID NO: 401637 - DNA, 31 bp, Artificial Sequence; identical to SEQ ID NO: 59738
  Description of Artificial Sequence: Synthetic oligonucleotide

SEQ ID NO: 401638 - DNA, 30 bp, Artificial Sequence; identical to SEQ ID NO: 59739
  Description of Artificial Sequence: Synthetic oligonucleotide

SEQ ID NO: 401639 - DNA, 31 bp, Artificial Sequence; identical to SEQ ID NO: 59740
  Description of Artificial Sequence: Synthetic oligonucleotide

SEQ ID NO: 401640 - DNA, 32 bp, Artificial Sequence; identical to SEQ ID NO: 59741
  Description of Artificial Sequence: Synthetic oligonucleotide

SEQ ID NO: 401641 - DNA, 32 bp, Artificial Sequence; identical to SEQ ID NO: 59742
  Description of Artificial Sequence: Synthetic oligonucleotide

SEQ ID NO: 401642 - DNA, 33 bp, Artificial Sequence; identical to SEQ ID NO: 59743
  Description of Artificial Sequence: Synthetic oligonucleotide

SEQ ID NO: 401643 - DNA, 35 bp, Artificial Sequence; identical to SEQ ID NO: 59744
  Description of Artificial Sequence: Synthetic oligonucleotide

SEQ ID NO: 401644 - DNA, 21 bp, Artificial Sequence
  Description of Artificial Sequence: Synthetic oligonucleotide
caacgggacggagcgcgtgcg

SEQ ID NO: 401645 - DNA, 21 bp, Artificial Sequence
  Description of Artificial Sequence: Synthetic oligonucleotide
aacgggacggagcgcgtgcgg

SEQ ID NO: 401646 - DNA, 20 bp, Artificial Sequence
  Description of Artificial Sequence: Synthetic oligonucleotide
acgggacggagcgcgtgcgg

SEQ ID NO: 401647 - DNA, 20 bp, Artificial Sequence
  Description of Artificial Sequence: Synthetic oligonucleotide
cgggacggagcgcgtgcggt

SEQ ID NO: 401648 - DNA, 20 bp, Artificial Sequence
  Description of Artificial Sequence: Synthetic oligonucleotide
gggacggagcgcgtgcgggt

SEQ ID NO: 401649 - DNA, 20 bp, Artificial Sequence
  Description of Artificial Sequence: Synthetic oligonucleotide
ggacggagcgcgtgcggggt

SEQ ID NO: 401650 - DNA, 21 bp, Artificial Sequence
  Description of Artificial Sequence: Synthetic oligonucleotide
gacggagcgcgtgcggggtgt

SEQ ID NO: 401651 - DNA, 22 bp, Artificial Sequence
  Description of Artificial Sequence: Synthetic oligonucleotide
acggagcgcgtgcggggtgtga

SEQ ID NO: 401652 - DNA, 21 bp, Artificial Sequence
  Description of Artificial Sequence: Synthetic oligonucleotide
cggagcgcgtgcggggtgtga

SEQ ID NO: 401653 - DNA, 21 bp, Artificial Sequence
  Description of Artificial Sequence: Synthetic oligonucleotide
ggagcgcgtgcggggtgtgac

SEQ ID NO: 401654 - DNA, 26 bp, Artificial Sequence
  Description of Artificial Sequence: Synthetic oligonucleotide
gccgcctgacgccgagtactggaata

SEQ ID NO: 401655 - DNA, 26 bp, Artificial Sequence
  Description of Artificial Sequence: Synthetic oligonucleotide
ccgcctgacgccgagtactggaatag

SEQ ID NO: 401656 - DNA, 26 bp, Artificial Sequence
  Description of Artificial Sequence: Synthetic oligonucleotide
cgcctgacgccgagtactggaatagc

SEQ ID NO: 401657 - DNA, 27 bp, Artificial Sequence
  Description of Artificial Sequence: Synthetic oligonucleotide
gcctgacgccgagtactggaatagcca

SEQ ID NO: 401658 - DNA, 27 bp, Artificial Sequence
  Description of Artificial Sequence: Synthetic oligonucleotide
cctgacgccgagtactggaatagccag

SEQ ID NO: 401659 - DNA, 29 bp, Artificial Sequence
  Description of Artificial Sequence: Synthetic oligonucleotide
ctgacgccgagtactggaatagccagaag

SEQ ID NO: 401660 - DNA, 29 bp, Artificial Sequence
  Description of Artificial Sequence: Synthetic oligonucleotide
tgacgccgagtactggaatagccagaagg

SEQ ID NO: 401661 - DNA, 28 bp, Artificial Sequence
  Description of Artificial Sequence: Synthetic oligonucleotide
gacgccgagtactggaatagccagaagg

SEQ ID NO: 401662 - DNA, 29 bp, Artificial Sequence
  Description of Artificial Sequence: Synthetic oligonucleotide
acgccgagtactggaatagccagaaggac

SEQ ID NO: 401663 - DNA, 28 bp, Artificial Sequence
  Description of Artificial Sequence: Synthetic oligonucleotide
cgccgagtactggaatagccagaaggac

SEQ ID NO: 401664 - DNA, 30 bp, Artificial Sequence; identical to SEQ ID NO: 59765
  Description of Artificial Sequence: Synthetic oligonucleotide

SEQ ID NO: 401665 - DNA, 30 bp, Artificial Sequence; identical to SEQ ID NO: 59766
  Description of Artificial Sequence: Synthetic oligonucleotide

SEQ ID NO: 401666 - DNA, 31 bp, Artificial Sequence; identical to SEQ ID NO: 59767
  Description of Artificial Sequence: Synthetic oligonucleotide

SEQ ID NO: 401667 - DNA, 31 bp, Artificial Sequence; identical to SEQ ID NO: 59768
  Description of Artificial Sequence: Synthetic oligonucleotide

SEQ ID NO: 401668 - DNA, 32 bp, Artificial Sequence; identical to SEQ ID NO: 59769
  Description of Artificial Sequence: Synthetic oligonucleotide

SEQ ID NO: 401669 - DNA, 31 bp, Artificial Sequence; identical to SEQ ID NO: 59770
  Description of Artificial Sequence: Synthetic oligonucleotide

SEQ ID NO: 401670 - DNA, 31 bp, Artificial Sequence; identical to SEQ ID NO: 59771
  Description of Artificial Sequence: Synthetic oligonucleotide

SEQ ID NO: 401671 - DNA, 30 bp, Artificial Sequence; identical to SEQ ID NO: 59772
  Description of Artificial Sequence: Synthetic oligonucleotide

SEQ ID NO: 401672 - DNA, 29 bp, Artificial Sequence
  Description of Artificial Sequence: Synthetic oligonucleotide
ctggaatagccagaaggacatcctggagg

SEQ ID NO: 401673 - DNA, 30 bp, Artificial Sequence; identical to SEQ ID NO: 59774
  Description of Artificial Sequence: Synthetic oligonucleotide

SEQ ID NO: 401674 - DNA, 29 bp, Artificial Sequence
  Description of Artificial Sequence: Synthetic oligonucleotide
ggaatagccagaaggacatcctggaggag

SEQ ID NO: 401675 - DNA, 29 bp, Artificial Sequence
  Description of Artificial Sequence: Synthetic oligonucleotide
gaatagccagaaggacatcctggaggagg

SEQ ID NO: 401676 - DNA, 30 bp, Artificial Sequence; identical to SEQ ID NO: 59777
  Description of Artificial Sequence: Synthetic oligonucleotide

SEQ ID NO: 401677 - DNA, 29 bp, Artificial Sequence
  Description of Artificial Sequence: Synthetic oligonucleotide
atagccagaaggacatcctggaggaggac

SEQ ID NO: 401678 - DNA, 28 bp, Artificial Sequence
  Description of Artificial Sequence: Synthetic oligonucleotide
tagccagaaggacatcctggaggaggac

SEQ ID NO: 401679 - DNA, 27 bp, Artificial Sequence
  Description of Artificial Sequence: Synthetic oligonucleotide
agccagaaggacatcctggaggaggac

SEQ ID NO: 401680 - DNA, 26 bp, Artificial Sequence
  Description of Artificial Sequence: Synthetic oligonucleotide
gccagaaggacatcctggaggaggac

SEQ ID NO: 401681 - DNA, 26 bp, Artificial Sequence
  Description of Artificial Sequence: Synthetic oligonucleotide
ccagaaggacatcctggaggaggacc

SEQ ID NO: 401682 - DNA, 26 bp, Artificial Sequence
  Description of Artificial Sequence: Synthetic oligonucleotide
cagaaggacatcctggaggaggaccg

SEQ ID NO: 401683 - DNA, 26 bp, Artificial Sequence
  Description of Artificial Sequence: Synthetic oligonucleotide
agaaggacatcctggaggaggaccgg

SEQ ID NO: 401684 - DNA, 25 bp, Artificial Sequence
  Description of Artificial Sequence: Synthetic oligonucleotide
gaaggacatcctggaggaggaccgg

SEQ ID NO: 401685 - DNA, 25 bp, Artificial Sequence
  Description of Artificial Sequence: Synthetic oligonucleotide
aaggacatcctggaggaggaccggg

SEQ ID NO: 401686 - DNA, 24 bp, Artificial Sequence
  Description of Artificial Sequence: Synthetic oligonucleotide
aggacatcctggaggaggaccggg

SEQ ID NO: 401687 - DNA, 23 bp, Artificial Sequence
  Description of Artificial Sequence: Synthetic oligonucleotide
ggacatcctggaggaggaccggg

SEQ ID NO: 401688 - DNA, 23 bp, Artificial Sequence
  Description of Artificial Sequence: Synthetic oligonucleotide
gacatcctggaggaggaccgggc

SEQ ID NO: 401689 - DNA, 24 bp, Artificial Sequence
  Description of Artificial Sequence: Synthetic oligonucleotide
acatcctggaggaggaccgggcgt

SEQ ID NO: 401690 - DNA, 23 bp, Artificial Sequence
  Description of Artificial Sequence: Synthetic oligonucleotide
catcctggaggaggaccgggcgt

SEQ ID NO: 401691 - DNA, 23 bp, Artificial Sequence
  Description of Artificial Sequence: Synthetic oligonucleotide
atcctggaggaggaccgggcgtc

SEQ ID NO: 401692 - DNA, 22 bp, Artificial Sequence
  Description of Artificial Sequence: Synthetic oligonucleotide
tcctggaggaggaccgggcgtc

SEQ ID NO: 401693 - DNA, 21 bp, Artificial Sequence
  Description of Artificial Sequence: Synthetic oligonucleotide
cctggaggaggaccgggcgtc

SEQ ID NO: 401694 - DNA, 21 bp, Artificial Sequence
  Description of Artificial Sequence: Synthetic oligonucleotide
ctggaggaggaccgggcgtcg

SEQ ID NO: 401695 - DNA, 22 bp, Artificial Sequence
  Description of Artificial Sequence: Synthetic oligonucleotide
tggaggaggaccgggcgtcggt

SEQ ID NO: 401696 - DNA, 21 bp, Artificial Sequence
  Description of Artificial Sequence: Synthetic oligonucleotide
ggaggaggaccgggcgtcggt

SEQ ID NO: 401697 - DNA, 21 bp, Artificial Sequence
  Description of Artificial Sequence: Synthetic oligonucleotide
gaggaggaccgggcgtcggtg

SEQ ID NO: 401698 - DNA, 22 bp, Artificial Sequence
  Description of Artificial Sequence: Synthetic oligonucleotide
aggaggaccgggcgtcggtgga

SEQ ID NO: 401699 - DNA, 21 bp, Artificial Sequence
  Description of Artificial Sequence: Synthetic oligonucleotide
ggaggaccgggcgtcggtgga

SEQ ID NO: 401700 - DNA, 22 bp, Artificial Sequence
  Description of Artificial Sequence: Synthetic oligonucleotide
gaggaccgggcgtcggtggaca

SEQ ID NO: 401701 - DNA, 22 bp, Artificial Sequence
  Description of Artificial Sequence: Synthetic oligonucleotide
aggaccgggcgtcggtggacac

SEQ ID NO: 401702 - DNA, 21 bp, Artificial Sequence
  Description of Artificial Sequence: Synthetic oligonucleotide
ggaccgggcgtcggtggacac

SEQ ID NO: 401703 - DNA, 21 bp, Artificial Sequence
  Description of Artificial Sequence: Synthetic oligonucleotide
gaccgggcgtcggtggacacc

SEQ ID NO: 401704 - DNA, 24 bp, Artificial Sequence
  Description of Artificial Sequence: Synthetic oligonucleotide
accgggcgtcggtggacaccgtat

SEQ ID NO: 401705 - DNA, 23 bp, Artificial Sequence
  Description of Artificial Sequence: Synthetic oligonucleotide
ccgggcgtcggtggacaccgtat

SEQ ID NO: 401706 - DNA, 23 bp, Artificial Sequence
  Description of Artificial Sequence: Synthetic oligonucleotide
cgggcgtcggtggacaccgtatg

SEQ ID NO: 401707 - DNA, 24 bp, Artificial Sequence
  Description of Artificial Sequence: Synthetic oligonucleotide
gggcgtcggtggacaccgtatgca

SEQ ID NO: 401708 - DNA, 25 bp, Artificial Sequence
  Description of Artificial Sequence: Synthetic oligonucleotide
ggcgtcggtggacaccgtatgcaga

SEQ ID NO: 401709 - DNA, 26 bp, Artificial Sequence
  Description of Artificial Sequence: Synthetic oligonucleotide
gcgtcggtggacaccgtatgcagaca

SEQ ID NO: 401710 - DNA, 27 bp, Artificial Sequence
  Description of Artificial Sequence: Synthetic oligonucleotide
cgtcggtggacaccgtatgcagacaca

SEQ ID NO: 401711 - DNA, 28 bp, Artificial Sequence
  Description of Artificial Sequence: Synthetic oligonucleotide
gtcggtggacaccgtatgcagacacaac

SEQ ID NO: 401712 - DNA, 30 bp, Artificial Sequence; identical to SEQ ID NO: 59813
  Description of Artificial Sequence: Synthetic oligonucleotide

SEQ ID NO: 401713 - DNA, 29 bp, Artificial Sequence
  Description of Artificial Sequence: Synthetic oligonucleotide
cggtggacaccgtatgcagacacaactac

SEQ ID NO: 401714 - DNA, 29 bp, Artificial Sequence
  Description of Artificial Sequence: Synthetic oligonucleotide
ggtggacaccgtatgcagacacaactacc

SEQ ID NO: 401715 - DNA, 30 bp, Artificial Sequence; identical to SEQ ID NO: 59816
  Description of Artificial Sequence: Synthetic oligonucleotide

SEQ ID NO: 401716 - DNA, 32 bp, Artificial Sequence; identical to SEQ ID NO: 59817
  Description of Artificial Sequence: Synthetic oligonucleotide

SEQ ID NO: 401717 - DNA, 31 bp, Artificial Sequence; identical to SEQ ID NO: 59818
  Description of Artificial Sequence: Synthetic oligonucleotide

SEQ ID NO: 401718 - DNA, 31 bp, Artificial Sequence; identical to SEQ ID NO: 59819
  Description of Artificial Sequence: Synthetic oligonucleotide

SEQ ID NO: 401719 - DNA, 32 bp, Artificial Sequence; identical to SEQ ID NO: 59820
  Description of Artificial Sequence: Synthetic oligonucleotide

SEQ ID NO: 401720 - DNA, 31 bp, Artificial Sequence; identical to SEQ ID NO: 59821
  Description of Artificial Sequence: Synthetic oligonucleotide

SEQ ID NO: 401721 - DNA, 31 bp, Artificial Sequence; identical to SEQ ID NO: 59822
  Description of Artificial Sequence: Synthetic oligonucleotide

SEQ ID NO: 401722 - DNA, 30 bp, Artificial Sequence; identical to SEQ ID NO: 59823
  Description of Artificial Sequence: Synthetic oligonucleotide

SEQ ID NO: 401723 - DNA, 31 bp, Artificial Sequence; identical to SEQ ID NO: 59824
  Description of Artificial Sequence: Synthetic oligonucleotide

SEQ ID NO: 401724 - DNA, 31 bp, Artificial Sequence; identical to SEQ ID NO: 59825
  Description of Artificial Sequence: Synthetic oligonucleotide

SEQ ID NO: 401725 - DNA, 31 bp, Artificial Sequence; identical to SEQ ID NO: 59826
  Description of Artificial Sequence: Synthetic oligonucleotide

SEQ ID NO: 401726 - DNA, 30 bp, Artificial Sequence; identical to SEQ ID NO: 59827
  Description of Artificial Sequence: Synthetic oligonucleotide

SEQ ID NO: 401727 - DNA, 25 bp, Artificial Sequence
  Description of Artificial Sequence: Synthetic oligonucleotide
acagcgacgtgggggtgtatcgggt

SEQ ID NO: 401728 - DNA, 24 bp, Artificial Sequence
  Description of Artificial Sequence: Synthetic oligonucleotide
cagcgacgtgggggtgtatcgggt

SEQ ID NO: 401729 - DNA, 24 bp, Artificial Sequence
  Description of Artificial Sequence: Synthetic oligonucleotide
agcgacgtgggggtgtatcgggtg

SEQ ID NO: 401730 - DNA, 23 bp, Artificial Sequence
  Description of Artificial Sequence: Synthetic oligonucleotide
gcgacgtgggggtgtatcgggtg

SEQ ID NO: 401731 - DNA, 24 bp, Artificial Sequence
  Description of Artificial Sequence: Synthetic oligonucleotide
cgacgtgggggtgtatcgggtggt

SEQ ID NO: 401732 - DNA, 25 bp, Artificial Sequence
  Description of Artificial Sequence: Synthetic oligonucleotide
gacgtgggggtgtatcgggtggtga

SEQ ID NO: 401733 - DNA, 25 bp, Artificial Sequence
  Description of Artificial Sequence: Synthetic oligonucleotide
acgtgggggtgtatcgggtggtgac

SEQ ID NO: 401734 - DNA, 24 bp, Artificial Sequence
  Description of Artificial Sequence: Synthetic oligonucleotide
cgtgggggtgtatcgggtggtgac

SEQ ID NO: 401735 - DNA, 24 bp, Artificial Sequence
  Description of Artificial Sequence: Synthetic oligonucleotide
gtgggggtgtatcgggtggtgacg

SEQ ID NO: 401736 - DNA, 24 bp, Artificial Sequence
  Description of Artificial Sequence: Synthetic oligonucleotide
tgggggtgtatcgggtggtgacgc

SEQ ID NO: 401737 - DNA, 23 bp, Artificial Sequence
  Description of Artificial Sequence: Synthetic oligonucleotide
gggggtgtatcgggtggtgacgc

SEQ ID NO: 401738 - DNA, 23 bp, Artificial Sequence
  Description of Artificial Sequence: Synthetic oligonucleotide
ggggtgtatcgggtggtgacgcc

SEQ ID NO: 401739 - DNA, 23 bp, Artificial Sequence
  Description of Artificial Sequence: Synthetic oligonucleotide
gggtgtatcgggtggtgacgccg

SEQ ID NO: 401740 - DNA, 24 bp, Artificial Sequence
  Description of Artificial Sequence: Synthetic oligonucleotide
ggtgtatcgggtggtgacgccgct

SEQ ID NO: 401741 - DNA, 24 bp, Artificial Sequence
  Description of Artificial Sequence: Synthetic oligonucleotide
gtgtatcgggtggtgacgccgctg

SEQ ID NO: 401742 - DNA, 24 bp, Artificial Sequence
  Description of Artificial Sequence: Synthetic oligonucleotide
tgtatcgggtggtgacgccgctgg

SEQ ID NO: 401743 - DNA, 23 bp, Artificial Sequence
  Description of Artificial Sequence: Synthetic oligonucleotide
gtatcgggtggtgacgccgctgg

SEQ ID NO: 401744 - DNA, 23 bp, Artificial Sequence
  Description of Artificial Sequence: Synthetic oligonucleotide
tatcgggtggtgacgccgctggg

SEQ ID NO: 401745 - DNA, 22 bp, Artificial Sequence
  Description of Artificial Sequence: Synthetic oligonucleotide
atcgggtggtgacgccgctggg

SEQ ID NO: 401746 - DNA, 21 bp, Artificial Sequence
  Description of Artificial Sequence: Synthetic oligonucleotide
tcgggtggtgacgccgctggg

SEQ ID NO: 401747 - DNA, 20 bp, Artificial Sequence
  Description of Artificial Sequence: Synthetic oligonucleotide
cgggtggtgacgccgctggg

SEQ ID NO: 401748 - DNA, 20 bp, Artificial Sequence
  Description of Artificial Sequence: Synthetic oligonucleotide
gggtggtgacgccgctgggg

SEQ ID NO: 401749 - DNA, 20 bp, Artificial Sequence
  Description of Artificial Sequence: Synthetic oligonucleotide
ggtggtgacgccgctggggc

SEQ ID NO: 401750 - DNA, 20 bp, Artificial Sequence
  Description of Artificial Sequence: Synthetic oligonucleotide
gtggtgacgccgctggggcc

SEQ ID NO: 401751 - DNA, 20 bp, Artificial Sequence
  Description of Artificial Sequence: Synthetic oligonucleotide
tggtgacgccgctggggccg

SEQ ID NO: 401752 - DNA, 28 bp, Artificial Sequence
  Description of Artificial Sequence: Synthetic oligonucleotide
tggaacagccagaaggaagtcctggagg

SEQ ID NO: 401753 - DNA, 27 bp, Artificial Sequence
  Description of Artificial Sequence: Synthetic oligonucleotide
ggaacagccagaaggaagtcctggagg

SEQ ID NO: 401754 - DNA, 27 bp, Artificial Sequence
  Description of Artificial Sequence: Synthetic oligonucleotide
gaacagccagaaggaagtcctggaggg

SEQ ID NO: 401755 - DNA, 27 bp, Artificial Sequence
  Description of Artificial Sequence: Synthetic oligonucleotide
aacagccagaaggaagtcctggagggg

SEQ ID NO: 401756 - DNA, 27 bp, Artificial Sequence
  Description of Artificial Sequence: Synthetic oligonucleotide
acagccagaaggaagtcctggagggga

SEQ ID NO: 401757 - DNA, 26 bp, Artificial Sequence
  Description of Artificial Sequence: Synthetic oligonucleotide
cagccagaaggaagtcctggagggga

SEQ ID NO: 401758 - DNA, 26 bp, Artificial Sequence
  Description of Artificial Sequence: Synthetic oligonucleotide
agccagaaggaagtcctggaggggac

SEQ ID NO: 401759 - DNA, 25 bp, Artificial Sequence
  Description of Artificial Sequence: Synthetic oligonucleotide
gccagaaggaagtcctggaggggac

SEQ ID NO: 401760 - DNA, 25 bp, Artificial Sequence
  Description of Artificial Sequence: Synthetic oligonucleotide
ccagaaggaagtcctggaggggacc

SEQ ID NO: 401761 - DNA, 25 bp, Artificial Sequence
  Description of Artificial Sequence: Synthetic oligonucleotide
cagaaggaagtcctggaggggaccc

SEQ ID NO: 401762 - DNA, 25 bp, Artificial Sequence
  Description of Artificial Sequence: Synthetic oligonucleotide
agaaggaagtcctggaggggacccg

SEQ ID NO: 401763 - DNA, 24 bp, Artificial Sequence
  Description of Artificial Sequence: Synthetic oligonucleotide
gaaggaagtcctggaggggacccg

SEQ ID NO: 401764 - DNA, 24 bp, Artificial Sequence
  Description of Artificial Sequence: Synthetic oligonucleotide
aaggaagtcctggaggggacccgg

SEQ ID NO: 401765 - DNA, 23 bp, Artificial Sequence
  Description of Artificial Sequence: Synthetic oligonucleotide
aggaagtcctggaggggacccgg

SEQ ID NO: 401766 - DNA, 22 bp, Artificial Sequence
  Description of Artificial Sequence: Synthetic oligonucleotide
ggaagtcctggaggggacccgg

SEQ ID NO: 401767 - DNA, 22 bp, Artificial Sequence
  Description of Artificial Sequence: Synthetic oligonucleotide
gaagtcctggaggggacccggg

SEQ ID NO: 401768 - DNA, 22 bp, Artificial Sequence
  Description of Artificial Sequence: Synthetic oligonucleotide
aagtcctggaggggacccgggc

SEQ ID NO: 401769 - DNA, 21 bp, Artificial Sequence
  Description of Artificial Sequence: Synthetic oligonucleotide
agtcctggaggggacccgggc

SEQ ID NO: 401770 - DNA, 20 bp, Artificial Sequence
  Description of Artificial Sequence: Synthetic oligonucleotide
gtcctggaggggacccgggc

SEQ ID NO: 401771 - DNA, 20 bp, Artificial Sequence
  Description of Artificial Sequence: Synthetic oligonucleotide
tcctggaggggacccgggcg

SEQ ID NO: 401772 - DNA, 20 bp, Artificial Sequence
  Description of Artificial Sequence: Synthetic oligonucleotide
cctggaggggacccgggcgt

SEQ ID NO: 401773 - DNA, 20 bp, Artificial Sequence
  Description of Artificial Sequence: Synthetic oligonucleotide
ctggaggggacccgggcgga

SEQ ID NO: 401774 - DNA, 22 bp, Artificial Sequence
  Description of Artificial Sequence: Synthetic oligonucleotide
tggaggggacccgggcggagtt

SEQ ID NO: 401775 - DNA, 21 bp, Artificial Sequence
  Description of Artificial Sequence: Synthetic oligonucleotide
ggaggggacccgggcggagtt

SEQ ID NO: 401776 - DNA, 21 bp, Artificial Sequence
  Description of Artificial Sequence: Synthetic oligonucleotide
gaggggacccgggcggagttg

SEQ ID NO: 401777 - DNA, 22 bp, Artificial Sequence
  Description of Artificial Sequence: Synthetic oligonucleotide
aggggacccgggcggagttgga

SEQ ID NO: 401778 - DNA, 21 bp, Artificial Sequence
  Description of Artificial Sequence: Synthetic oligonucleotide
ggggacccgggcggagttgga

SEQ ID NO: 401779 - DNA, 22 bp, Artificial Sequence
  Description of Artificial Sequence: Synthetic oligonucleotide
gggacccgggcggagttggaca

SEQ ID NO: 401780 - DNA, 29 bp, Artificial Sequence
  Description of Artificial Sequence: Synthetic oligonucleotide
gtgatgctggaaatgactccccagcatgc

SEQ ID NO: 401781 - DNA, 29 bp, Artificial Sequence
  Description of Artificial Sequence: Synthetic oligonucleotide
tgatgctggaaatgactccccagcatgcc

SEQ ID NO: 401782 - DNA, 28 bp, Artificial Sequence
  Description of Artificial Sequence: Synthetic oligonucleotide
gatgctggaaatgactccccagcatgcc

SEQ ID NO: 401783 - DNA, 28 bp, Artificial Sequence
  Description of Artificial Sequence: Synthetic oligonucleotide
atgctggaaatgactccccagcatgccg

SEQ ID NO: 401784 - DNA, 27 bp, Artificial Sequence
  Description of Artificial Sequence: Synthetic oligonucleotide
tgctggaaatgactccccagcatgccg

SEQ ID NO: 401785 - DNA, 27 bp, Artificial Sequence
  Description of Artificial Sequence: Synthetic oligonucleotide
gctggaaatgactccccagcatgccgt

SEQ ID NO: 401786 - DNA, 27 bp, Artificial Sequence
  Description of Artificial Sequence: Synthetic oligonucleotide
ctggaaatgactccccagcatgccgtc

SEQ ID NO: 401787 - DNA, 29 bp, Artificial Sequence
  Description of Artificial Sequence: Synthetic oligonucleotide
tggaaatgactccccagcatgccgtctac

SEQ ID NO: 401788 - DNA, 28 bp, Artificial Sequence
  Description of Artificial Sequence: Synthetic oligonucleotide
ggaaatgactccccagcatgccgtctac

SEQ ID NO: 401789 - DNA, 29 bp, Artificial Sequence
  Description of Artificial Sequence: Synthetic oligonucleotide
gaaatgactccccagcatgccgtctacac

SEQ ID NO: 401790 - DNA, 29 bp, Artificial Sequence
  Description of Artificial Sequence: Synthetic oligonucleotide
aaatgactccccagcatgccgtctacacc

SEQ ID NO: 401791 - DNA, 28 bp, Artificial Sequence
  Description of Artificial Sequence: Synthetic oligonucleotide
aatgactccccagcatgccgtctacacc

SEQ ID NO: 401792 - DNA, 27 bp, Artificial Sequence
  Description of Artificial Sequence: Synthetic oligonucleotide
atgactccccagcatgccgtctacacc

SEQ ID NO: 401793 - DNA, 27 bp, Artificial Sequence
  Description of Artificial Sequence: Synthetic oligonucleotide
tgactccccagcatgccgtctacacct

SEQ ID NO: 401794 - DNA, 26 bp, Artificial Sequence
  Description of Artificial Sequence: Synthetic oligonucleotide
gactccccagcatgccgtctacacct

SEQ ID NO: 401795 - DNA, 26 bp, Artificial Sequence
  Description of Artificial Sequence: Synthetic oligonucleotide
actccccagcatgccgtctacacctg

SEQ ID NO: 401796 - DNA, 25 bp, Artificial Sequence
  Description of Artificial Sequence: Synthetic oligonucleotide
ctccccagcatgccgtctacacctg

SEQ ID NO: 401797 - DNA, 25 bp, Artificial Sequence
  Description of Artificial Sequence: Synthetic oligonucleotide
tccccagcatgccgtctacacctgc

SEQ ID NO: 401798 - DNA, 24 bp, Artificial Sequence
  Description of Artificial Sequence: Synthetic oligonucleotide
ccccagcatgccgtctacacctgc

SEQ ID NO: 401799 - DNA, 25 bp, Artificial Sequence
  Description of Artificial Sequence: Synthetic oligonucleotide
cccagcatgccgtctacacctgcca

SEQ ID NO: 401800 - DNA, 25 bp, Artificial Sequence
  Description of Artificial Sequence: Synthetic oligonucleotide
ccagcatgccgtctacacctgccac

SEQ ID NO: 401801 - DNA, 26 bp, Artificial Sequence
  Description of Artificial Sequence: Synthetic oligonucleotide
cagcatgccgtctacacctgccacgt

SEQ ID NO: 401802 - DNA, 26 bp, Artificial Sequence
  Description of Artificial Sequence: Synthetic oligonucleotide
agcatgccgtctacacctgccacgtg

SEQ ID NO: 401803 - DNA, 25 bp, Artificial Sequence
  Description of Artificial Sequence: Synthetic oligonucleotide
gcatgccgtctacacctgccacgtg

SEQ ID NO: 401804 - DNA, 26 bp, Artificial Sequence
  Description of Artificial Sequence: Synthetic oligonucleotide
catgccgtctacacctgccacgtgga

SEQ ID NO: 401805 - DNA, 26 bp, Artificial Sequence
  Description of Artificial Sequence: Synthetic oligonucleotide
atgccgtctacacctgccacgtggag

SEQ ID NO: 401806 - DNA, 25 bp, Artificial Sequence
  Description of Artificial Sequence: Synthetic oligonucleotide
tgccgtctacacctgccacgtggag

SEQ ID NO: 401807 - DNA, 24 bp, Artificial Sequence
  Description of Artificial Sequence: Synthetic oligonucleotide
gccgtctacacctgccacgtggag

SEQ ID NO: 401808 - DNA, 25 bp, Artificial Sequence
  Description of Artificial Sequence: Synthetic oligonucleotide
ccgtctacacctgccacgtggagca

SEQ ID NO: 401809 - DNA, 32 bp, Artificial Sequence; identical to SEQ ID NO: 59910
  Description of Artificial Sequence: Synthetic oligonucleotide

SEQ ID NO: 401810 - DNA, 31 bp, Artificial Sequence; identical to SEQ ID NO: 59911
  Description of Artificial Sequence: Synthetic oligonucleotide

SEQ ID NO: 401811 - DNA, 33 bp, Artificial Sequence; identical to SEQ ID NO: 59912
  Description of Artificial Sequence: Synthetic oligonucleotide

SEQ ID NO: 401812 - DNA, 35 bp, Artificial Sequence; identical to SEQ ID NO: 59913
  Description of Artificial Sequence: Synthetic oligonucleotide

SEQ ID NO: 401813 - DNA, 34 bp, Artificial Sequence; identical to SEQ ID NO: 59914
  Description of Artificial Sequence: Synthetic oligonucleotide

SEQ ID NO: 401814 - DNA, 33 bp, Artificial Sequence; identical to SEQ ID NO: 59915
  Description of Artificial Sequence: Synthetic oligonucleotide

SEQ ID NO: 401815 - DNA, 32 bp, Artificial Sequence; identical to SEQ ID NO: 59916
  Description of Artificial Sequence: Synthetic oligonucleotide

SEQ ID NO: 401816 - DNA, 31 bp, Artificial Sequence; identical to SEQ ID NO: 59917
  Description of Artificial Sequence: Synthetic oligonucleotide

SEQ ID NO: 401817 - DNA, 32 bp, Artificial Sequence; identical to SEQ ID NO: 59918
  Description of Artificial Sequence: Synthetic oligonucleotide

SEQ ID NO: 401818 - DNA, 32 bp, Artificial Sequence; identical to SEQ ID NO: 59919
  Description of Artificial Sequence: Synthetic oligonucleotide

SEQ ID NO: 401819 - DNA, 31 bp, Artificial Sequence; identical to SEQ ID NO: 59920
  Description of Artificial Sequence: Synthetic oligonucleotide

SEQ ID NO: 401820 - DNA, 33 bp, Artificial Sequence; identical to SEQ ID NO: 59921
  Description of Artificial Sequence: Synthetic oligonucleotide

SEQ ID NO: 401821 - DNA, 32 bp, Artificial Sequence; identical to SEQ ID NO: 59922
  Description of Artificial Sequence: Synthetic oligonucleotide

SEQ ID NO: 401822 - DNA, 31 bp, Artificial Sequence; identical to SEQ ID NO: 59923
  Description of Artificial Sequence: Synthetic oligonucleotide

SEQ ID NO: 401823 - DNA, 31 bp, Artificial Sequence; identical to SEQ ID NO: 59924
  Description of Artificial Sequence: Synthetic oligonucleotide

SEQ ID NO: 401824 - DNA, 31 bp, Artificial Sequence; identical to SEQ ID NO: 59925
  Description of Artificial Sequence: Synthetic oligonucleotide

SEQ ID NO: 401825 - DNA, 30 bp, Artificial Sequence; identical to SEQ ID NO: 59926
  Description of Artificial Sequence: Synthetic oligonucleotide

SEQ ID NO: 401826 - DNA, 30 bp, Artificial Sequence; identical to SEQ ID NO: 59927
  Description of Artificial Sequence: Synthetic oligonucleotide

SEQ ID NO: 401827 - DNA, 29 bp, Artificial Sequence
  Description of Artificial Sequence: Synthetic oligonucleotide
ttaagggcctgtgctacttcaccaacggg

SEQ ID NO: 401828 - DNA, 28 bp, Artificial Sequence
  Description of Artificial Sequence: Synthetic oligonucleotide
taagggcctgtgctacttcaccaacggg

SEQ ID NO: 401829 - DNA, 27 bp, Artificial Sequence
  Description of Artificial Sequence: Synthetic oligonucleotide
aagggcctgtgctacttcaccaacggg

SEQ ID NO: 401830 - DNA, 27 bp, Artificial Sequence
  Description of Artificial Sequence: Synthetic oligonucleotide
agggcctgtgctacttcaccaacggga

SEQ ID NO: 401831 - DNA, 26 bp, Artificial Sequence
  Description of Artificial Sequence: Synthetic oligonucleotide
gggcctgtgctacttcaccaacggga

SEQ ID NO: 401832 - DNA, 26 bp, Artificial Sequence
  Description of Artificial Sequence: Synthetic oligonucleotide
ggcctgtgctacttcaccaacgggac

SEQ ID NO: 401833 - DNA, 26 bp, Artificial Sequence
  Description of Artificial Sequence: Synthetic oligonucleotide
gcctgtgctacttcaccaacgggacg

SEQ ID NO: 401834 - DNA, 27 bp, Artificial Sequence
  Description of Artificial Sequence: Synthetic oligonucleotide
cctgtgctacttcaccaacgggacgga

SEQ ID NO: 401835 - DNA, 27 bp, Artificial Sequence
  Description of Artificial Sequence: Synthetic oligonucleotide
ctgtgctacttcaccaacgggacggag

SEQ ID NO: 401836 - DNA, 29 bp, Artificial Sequence
  Description of Artificial Sequence: Synthetic oligonucleotide
ccgagtactggaacagccagaaggaagac

SEQ ID NO: 401837 - DNA, 29 bp, Artificial Sequence
  Description of Artificial Sequence: Synthetic oligonucleotide
cgagtactggaacagccagaaggaagacc

SEQ ID NO: 401838 - DNA, 30 bp, Artificial Sequence; identical to SEQ ID NO: 59939
  Description of Artificial Sequence: Synthetic oligonucleotide

SEQ ID NO: 401839 - DNA, 30 bp, Artificial Sequence; identical to SEQ ID NO: 59940
  Description of Artificial Sequence: Synthetic oligonucleotide

SEQ ID NO: 401840 - DNA, 29 bp, Artificial Sequence
  Description of Artificial Sequence: Synthetic oligonucleotide
gtactggaacagccagaaggaagacctgg

SEQ ID NO: 401841 - DNA, 30 bp, Artificial Sequence; identical to SEQ ID NO: 59942
  Description of Artificial Sequence: Synthetic oligonucleotide

SEQ ID NO: 401842 - DNA, 29 bp, Artificial Sequence
  Description of Artificial Sequence: Synthetic oligonucleotide
actggaacagccagaaggaagacctggag

SEQ ID NO: 401843 - DNA, 28 bp, Artificial Sequence
  Description of Artificial Sequence: Synthetic oligonucleotide
ctggaacagccagaaggaagacctggag

SEQ ID NO: 401844 - DNA, 29 bp, Artificial Sequence
  Description of Artificial Sequence: Synthetic oligonucleotide
tggaacagccagaaggaagacctggagag

SEQ ID NO: 401845 - DNA, 28 bp, Artificial Sequence
  Description of Artificial Sequence: Synthetic oligonucleotide
ggaacagccagaaggaagacctggagag

SEQ ID NO: 401846 - DNA, 28 bp, Artificial Sequence
  Description of Artificial Sequence: Synthetic oligonucleotide
gaacagccagaaggaagacctggagagg

SEQ ID NO: 401847 - DNA, 29 bp, Artificial Sequence
  Description of Artificial Sequence: Synthetic oligonucleotide
aacagccagaaggaagacctggagaggac

SEQ ID NO: 401848 - DNA, 28 bp, Artificial Sequence
  Description of Artificial Sequence: Synthetic oligonucleotide
acagccagaaggaagacctggagaggac

SEQ ID NO: 401849 - DNA, 27 bp, Artificial Sequence
  Description of Artificial Sequence: Synthetic oligonucleotide
cagccagaaggaagacctggagaggac

SEQ ID NO: 401850 - DNA, 27 bp, Artificial Sequence
  Description of Artificial Sequence: Synthetic oligonucleotide
agccagaaggaagacctggagaggacc

SEQ ID NO: 401851 - DNA, 26 bp, Artificial Sequence
  Description of Artificial Sequence: Synthetic oligonucleotide
gccagaaggaagacctggagaggacc

SEQ ID NO: 401852 - DNA, 26 bp, Artificial Sequence
  Description of Artificial Sequence: Synthetic oligonucleotide
ccagaaggaagacctggagaggaccc

SEQ ID NO: 401853 - DNA, 26 bp, Artificial Sequence
  Description of Artificial Sequence: Synthetic oligonucleotide
cagaaggaagacctggagaggacccg

SEQ ID NO: 401854 - DNA, 26 bp, Artificial Sequence
  Description of Artificial Sequence: Synthetic oligonucleotide
agaaggaagacctggagaggacccgg

SEQ ID NO: 401855 - DNA, 25 bp, Artificial Sequence
  Description of Artificial Sequence: Synthetic oligonucleotide
gaaggaagacctggagaggacccgg

SEQ ID NO: 401856 - DNA, 25 bp, Artificial Sequence
  Description of Artificial Sequence: Synthetic oligonucleotide
aaggaagacctggagaggacccggg

SEQ ID NO: 401857 - DNA, 24 bp, Artificial Sequence
  Description of Artificial Sequence: Synthetic oligonucleotide
aggaagacctggagaggacccggg

SEQ ID NO: 401858 - DNA, 23 bp, Artificial Sequence
  Description of Artificial Sequence: Synthetic oligonucleotide
ggaagacctggagaggacccggg

SEQ ID NO: 401859 - DNA, 23 bp, Artificial Sequence
  Description of Artificial Sequence: Synthetic oligonucleotide
gaagacctggagaggacccgggc

SEQ ID NO: 401860 - DNA, 23 bp, Artificial Sequence
  Description of Artificial Sequence: Synthetic oligonucleotide
aagacctggagaggacccgggcg

SEQ ID NO: 401861 - DNA, 22 bp, Artificial Sequence
  Description of Artificial Sequence: Synthetic oligonucleotide
agacctggagaggacccgggcg

SEQ ID NO: 401862 - DNA, 21 bp, Artificial Sequence
  Description of Artificial Sequence: Synthetic oligonucleotide
gacctggagaggacccgggcg

SEQ ID NO: 401863 - DNA, 22 bp, Artificial Sequence
  Description of Artificial Sequence: Synthetic oligonucleotide
acctggagaggacccgggcgga

SEQ ID NO: 401864 - DNA, 23 bp, Artificial Sequence
  Description of Artificial Sequence: Synthetic oligonucleotide
acagcgacgtgggggtgtaccgg

SEQ ID NO: 401865 - DNA, 22 bp, Artificial Sequence
  Description of Artificial Sequence: Synthetic oligonucleotide
cagcgacgtgggggtgtaccgg

SEQ ID NO: 401866 - DNA, 22 bp, Artificial Sequence
  Description of Artificial Sequence: Synthetic oligonucleotide
agcgacgtgggggtgtaccggg

SEQ ID NO: 401867 - DNA, 21 bp, Artificial Sequence
  Description of Artificial Sequence: Synthetic oligonucleotide
gcgacgtgggggtgtaccggg

SEQ ID NO: 401868 - DNA, 21 bp, Artificial Sequence
  Description of Artificial Sequence: Synthetic oligonucleotide
cgacgtgggggtgtaccgggc

SEQ ID NO: 401869 - DNA, 21 bp, Artificial Sequence
  Description of Artificial Sequence: Synthetic oligonucleotide
gacgtgggggtgtaccgggcg

SEQ ID NO: 401870 - DNA, 22 bp, Artificial Sequence
  Description of Artificial Sequence: Synthetic oligonucleotide
acgtgggggtgtaccgggcggt

SEQ ID NO: 401871 - DNA, 21 bp, Artificial Sequence
  Description of Artificial Sequence: Synthetic oligonucleotide
cgtgggggtgtaccgggcggt

SEQ ID NO: 401872 - DNA, 22 bp, Artificial Sequence
  Description of Artificial Sequence: Synthetic oligonucleotide
gtgggggtgtaccgggcggtga

SEQ ID NO: 401873 - DNA, 22 bp, Artificial Sequence
  Description of Artificial Sequence: Synthetic oligonucleotide
tgggggtgtaccgggcggtgac

SEQ ID NO: 401874 - DNA, 21 bp, Artificial Sequence
  Description of Artificial Sequence: Synthetic oligonucleotide
gggggtgtaccgggcggtgac

SEQ ID NO: 401875 - DNA, 21 bp, Artificial Sequence
  Description of Artificial Sequence: Synthetic oligonucleotide
ggggtgtaccgggcggtgacg

SEQ ID NO: 401876 - DNA, 21 bp, Artificial Sequence
  Description of Artificial Sequence: Synthetic oligonucleotide
gggtgtaccgggcggtgacgc

SEQ ID NO: 401877 - DNA, 25 bp, Artificial Sequence
  Description of Artificial Sequence: Synthetic oligonucleotide
gcctgacgccgagtactggaacagg

SEQ ID NO: 401878 - DNA, 26 bp, Artificial Sequence
  Description of Artificial Sequence: Synthetic oligonucleotide
cctgacgccgagtactggaacaggca

SEQ ID NO: 401879 - DNA, 27 bp, Artificial Sequence
  Description of Artificial Sequence: Synthetic oligonucleotide
ctgacgccgagtactggaacaggcaga

SEQ ID NO: 401880 - DNA, 28 bp, Artificial Sequence
  Description of Artificial Sequence: Synthetic oligonucleotide
tgacgccgagtactggaacaggcagaag

SEQ ID NO: 401881 - DNA, 27 bp, Artificial Sequence
  Description of Artificial Sequence: Synthetic oligonucleotide
gacgccgagtactggaacaggcagaag

SEQ ID NO: 401882 - DNA, 27 bp, Artificial Sequence
  Description of Artificial Sequence: Synthetic oligonucleotide
acgccgagtactggaacaggcagaagg

SEQ ID NO: 401883 - DNA, 27 bp, Artificial Sequence
  Description of Artificial Sequence: Synthetic oligonucleotide
cgccgagtactggaacaggcagaagga

SEQ ID NO: 401884 - DNA, 28 bp, Artificial Sequence
  Description of Artificial Sequence: Synthetic oligonucleotide
gccgagtactggaacaggcagaaggaag

SEQ ID NO: 401885 - DNA, 29 bp, Artificial Sequence
  Description of Artificial Sequence: Synthetic oligonucleotide
ccgagtactggaacaggcagaaggaagtc

SEQ ID NO: 401886 - DNA, 29 bp, Artificial Sequence
  Description of Artificial Sequence: Synthetic oligonucleotide
cgagtactggaacaggcagaaggaagtcc

SEQ ID NO: 401887 - DNA, 30 bp, Artificial Sequence; identical to SEQ ID NO: 59988
  Description of Artificial Sequence: Synthetic oligonucleotide

SEQ ID NO: 401888 - DNA, 30 bp, Artificial Sequence; identical to SEQ ID NO: 59989
  Description of Artificial Sequence: Synthetic oligonucleotide

SEQ ID NO: 401889 - DNA, 29 bp, Artificial Sequence
  Description of Artificial Sequence: Synthetic oligonucleotide
gtactggaacaggcagaaggaagtcctgg

SEQ ID NO: 401890 - DNA, 30 bp, Artificial Sequence; identical to SEQ ID NO: 59991
  Description of Artificial Sequence: Synthetic oligonucleotide

SEQ ID NO: 401891 - DNA, 29 bp, Artificial Sequence
  Description of Artificial Sequence: Synthetic oligonucleotide
actggaacaggcagaaggaagtcctggag

SEQ ID NO: 401892 - DNA, 28 bp, Artificial Sequence
  Description of Artificial Sequence: Synthetic oligonucleotide
ctggaacaggcagaaggaagtcctggag

SEQ ID NO: 401893 - DNA, 29 bp, Artificial Sequence
  Description of Artificial Sequence: Synthetic oligonucleotide
tggaacaggcagaaggaagtcctggagag

SEQ ID NO: 401894 - DNA, 28 bp, Artificial Sequence
  Description of Artificial Sequence: Synthetic oligonucleotide
ggaacaggcagaaggaagtcctggagag

SEQ ID NO: 401895 - DNA, 28 bp, Artificial Sequence
  Description of Artificial Sequence: Synthetic oligonucleotide
gaacaggcagaaggaagtcctggagagg

SEQ ID NO: 401896 - DNA, 29 bp, Artificial Sequence
  Description of Artificial Sequence: Synthetic oligonucleotide
aacaggcagaaggaagtcctggagaggac

SEQ ID NO: 401897 - DNA, 28 bp, Artificial Sequence
  Description of Artificial Sequence: Synthetic oligonucleotide
acaggcagaaggaagtcctggagaggac

SEQ ID NO: 401898 - DNA, 27 bp, Artificial Sequence
  Description of Artificial Sequence: Synthetic oligonucleotide
caggcagaaggaagtcctggagaggac

SEQ ID NO: 401899 - DNA, 27 bp, Artificial Sequence
  Description of Artificial Sequence: Synthetic oligonucleotide
aggcagaaggaagtcctggagaggacc

SEQ ID NO: 401900 - DNA, 26 bp, Artificial Sequence
  Description of Artificial Sequence: Synthetic oligonucleotide
ggcagaaggaagtcctggagaggacc

SEQ ID NO: 401901 - DNA, 26 bp, Artificial Sequence
  Description of Artificial Sequence: Synthetic oligonucleotide
gcagaaggaagtcctggagaggaccc

SEQ ID NO: 401902 - DNA, 20 bp, Artificial Sequence
  Description of Artificial Sequence: Synthetic oligonucleotide
gcggtgacgccgctggggca

SEQ ID NO: 401903 - DNA, 20 bp, Artificial Sequence
  Description of Artificial Sequence: Synthetic oligonucleotide
cggtgacgccgctggggcag

SEQ ID NO: 401904 - DNA, 20 bp, Artificial Sequence
  Description of Artificial Sequence: Synthetic oligonucleotide
ggtgacgccgctggggcagc

SEQ ID NO: 401905 - DNA, 21 bp, Artificial Sequence
  Description of Artificial Sequence: Synthetic oligonucleotide
gtgacgccgctggggcagcct

SEQ ID NO: 401906 - DNA, 22 bp, Artificial Sequence
  Description of Artificial Sequence: Synthetic oligonucleotide
tgacgccgctggggcagcctga

SEQ ID NO: 401907 - DNA, 21 bp, Artificial Sequence
  Description of Artificial Sequence: Synthetic oligonucleotide
gacgccgctggggcagcctga

SEQ ID NO: 401908 - DNA, 21 bp, Artificial Sequence
  Description of Artificial Sequence: Synthetic oligonucleotide
acgccgctggggcagcctgac

SEQ ID NO: 401909 - DNA, 20 bp, Artificial Sequence
  Description of Artificial Sequence: Synthetic oligonucleotide
cgccgctggggcagcctgac

SEQ ID NO: 401910 - DNA, 20 bp, Artificial Sequence
  Description of Artificial Sequence: Synthetic oligonucleotide
gccgctggggcagcctgacg

SEQ ID NO: 401911 - DNA, 20 bp, Artificial Sequence
  Description of Artificial Sequence: Synthetic oligonucleotide
ccgctggggcagcctgacgc

SEQ ID NO: 401912 - DNA, 20 bp, Artificial Sequence
  Description of Artificial Sequence: Synthetic oligonucleotide
cgctggggcagcctgacgcc

SEQ ID NO: 401913 - DNA, 21 bp, Artificial Sequence
  Description of Artificial Sequence: Synthetic oligonucleotide
gctggggcagcctgacgccga

SEQ ID NO: 401914 - DNA, 23 bp, Artificial Sequence
  Description of Artificial Sequence: Synthetic oligonucleotide
ctggggcagcctgacgccgagta

SEQ ID NO: 401915 - DNA, 24 bp, Artificial Sequence
  Description of Artificial Sequence: Synthetic oligonucleotide
tggggcagcctgacgccgagtact

SEQ ID NO: 401916 - DNA, 23 bp, Artificial Sequence
  Description of Artificial Sequence: Synthetic oligonucleotide
ggggcagcctgacgccgagtact

SEQ ID NO: 401917 - DNA, 23 bp, Artificial Sequence
  Description of Artificial Sequence: Synthetic oligonucleotide
gggcagcctgacgccgagtactg

SEQ ID NO: 401918 - DNA, 25 bp, Artificial Sequence
  Description of Artificial Sequence: Synthetic oligonucleotide
ggcagcctgacgccgagtactggaa

SEQ ID NO: 401919 - DNA, 26 bp, Artificial Sequence
  Description of Artificial Sequence: Synthetic oligonucleotide
gcagcctgacgccgagtactggaaca

SEQ ID NO: 401920 - DNA, 26 bp, Artificial Sequence
  Description of Artificial Sequence: Synthetic oligonucleotide
cagcctgacgccgagtactggaacag

SEQ ID NO: 401921 - DNA, 26 bp, Artificial Sequence
  Description of Artificial Sequence: Synthetic oligonucleotide
agcctgacgccgagtactggaacagc

SEQ ID NO: 401922 - DNA, 23 bp, Artificial Sequence
  Description of Artificial Sequence: Synthetic oligonucleotide
gggacggagcgcgtgcgtcttct

SEQ ID NO: 401923 - DNA, 24 bp, Artificial Sequence
  Description of Artificial Sequence: Synthetic oligonucleotide
ggacggagcgcgtgcgtcttctga

SEQ ID NO: 401924 - DNA, 24 bp, Artificial Sequence
  Description of Artificial Sequence: Synthetic oligonucleotide
gacggagcgcgtgcgtcttctgac

SEQ ID NO: 401925 - DNA, 25 bp, Artificial Sequence
  Description of Artificial Sequence: Synthetic oligonucleotide
acggagcgcgtgcgtcttctgacca

SEQ ID NO: 401926 - DNA, 24 bp, Artificial Sequence
  Description of Artificial Sequence: Synthetic oligonucleotide
cggagcgcgtgcgtcttctgacca

SEQ ID NO: 401927 - DNA, 27 bp, Artificial Sequence
  Description of Artificial Sequence: Synthetic oligonucleotide
ggagcgcgtgcgtcttctgaccagata

SEQ ID NO: 401928 - DNA, 27 bp, Artificial Sequence
  Description of Artificial Sequence: Synthetic oligonucleotide
gagcgcgtgcgtcttctgaccagatac

SEQ ID NO: 401929 - DNA, 29 bp, Artificial Sequence
  Description of Artificial Sequence: Synthetic oligonucleotide
agcgcgtgcgtcttctgaccagatacatc

SEQ ID NO: 401930 - DNA, 28 bp, Artificial Sequence
  Description of Artificial Sequence: Synthetic oligonucleotide
gcgcgtgcgtcttctgaccagatacatc

SEQ ID NO: 401931 - DNA, 33 bp, Artificial Sequence; identical to SEQ ID NO: 60032
  Description of Artificial Sequence: Synthetic oligonucleotide

SEQ ID NO: 401932 - DNA, 33 bp, Artificial Sequence; identical to SEQ ID NO: 60033
  Description of Artificial Sequence: Synthetic oligonucleotide

SEQ ID NO: 401933 - DNA, 33 bp, Artificial Sequence; identical to SEQ ID NO: 60034
  Description of Artificial Sequence: Synthetic oligonucleotide

SEQ ID NO: 401934 - DNA, 34 bp, Artificial Sequence; identical to SEQ ID NO: 60035
  Description of Artificial Sequence: Synthetic oligonucleotide

SEQ ID NO: 401935 - DNA, 35 bp, Artificial Sequence; identical to SEQ ID NO: 60036
  Description of Artificial Sequence: Synthetic oligonucleotide

SEQ ID NO: 401936 - DNA, 34 bp, Artificial Sequence; identical to SEQ ID NO: 60037
  Description of Artificial Sequence: Synthetic oligonucleotide

SEQ ID NO: 401937 - DNA, 34 bp, Artificial Sequence; identical to SEQ ID NO: 60038
  Description of Artificial Sequence: Synthetic oligonucleotide

SEQ ID NO: 401938 - DNA, 35 bp, Artificial Sequence; identical to SEQ ID NO: 60039
  Description of Artificial Sequence: Synthetic oligonucleotide

SEQ ID NO: 401939 - DNA, 37 bp, Artificial Sequence; identical to SEQ ID NO: 60040
  Description of Artificial Sequence: Synthetic oligonucleotide

SEQ ID NO: 401940 - DNA, 36 bp, Artificial Sequence; identical to SEQ ID NO: 60041
  Description of Artificial Sequence: Synthetic oligonucleotide

SEQ ID NO: 401941 - DNA, 36 bp, Artificial Sequence; identical to SEQ ID NO: 60042
  Description of Artificial Sequence: Synthetic oligonucleotide

SEQ ID NO: 401942 - DNA, 35 bp, Artificial Sequence; identical to SEQ ID NO: 60043
  Description of Artificial Sequence: Synthetic oligonucleotide

SEQ ID NO: 401943 - DNA, 34 bp, Artificial Sequence; identical to SEQ ID NO: 60044
  Description of Artificial Sequence: Synthetic oligonucleotide

SEQ ID NO: 401944 - DNA, 37 bp, Artificial Sequence; identical to SEQ ID NO: 60045
  Description of Artificial Sequence: Synthetic oligonucleotide

SEQ ID NO: 401945 - DNA, 36 bp, Artificial Sequence; identical to SEQ ID NO: 60046
  Description of Artificial Sequence: Synthetic oligonucleotide

SEQ ID NO: 401946 - DNA, 35 bp, Artificial Sequence; identical to SEQ ID NO: 60047
  Description of Artificial Sequence: Synthetic oligonucleotide

SEQ ID NO: 401947 - DNA, 36 bp, Artificial Sequence; identical to SEQ ID NO: 60048
  Description of Artificial Sequence: Synthetic oligonucleotide

SEQ ID NO: 401948 - DNA, 35 bp, Artificial Sequence; identical to SEQ ID NO: 60049
  Description of Artificial Sequence: Synthetic oligonucleotide

SEQ ID NO: 401949 - DNA, 35 bp, Artificial Sequence; identical to SEQ ID NO: 60050
  Description of Artificial Sequence: Synthetic oligonucleotide

SEQ ID NO: 401950 - DNA, 34 bp, Artificial Sequence; identical to SEQ ID NO: 60051
  Description of Artificial Sequence: Synthetic oligonucleotide

SEQ ID NO: 401951 - DNA, 34 bp, Artificial Sequence; identical to SEQ ID NO: 60052
  Description of Artificial Sequence: Synthetic oligonucleotide

SEQ ID NO: 401952 - DNA, 36 bp, Artificial Sequence; identical to SEQ ID NO: 60053
  Description of Artificial Sequence: Synthetic oligonucleotide

SEQ ID NO: 401953 - DNA, 35 bp, Artificial Sequence; identical to SEQ ID NO: 60054
  Description of Artificial Sequence: Synthetic oligonucleotide

SEQ ID NO: 401954 - DNA, 35 bp, Artificial Sequence; identical to SEQ ID NO: 60055
  Description of Artificial Sequence: Synthetic oligonucleotide

SEQ ID NO: 401955 - DNA, 34 bp, Artificial Sequence; identical to SEQ ID NO: 60056
  Description of Artificial Sequence: Synthetic oligonucleotide

SEQ ID NO: 401956 - DNA, 33 bp, Artificial Sequence; identical to SEQ ID NO: 60057
  Description of Artificial Sequence: Synthetic oligonucleotide

SEQ ID NO: 401957 - DNA, 32 bp, Artificial Sequence; identical to SEQ ID NO: 60058
  Description of Artificial Sequence: Synthetic oligonucleotide

SEQ ID NO: 401958 - DNA, 33 bp, Artificial Sequence; identical to SEQ ID NO: 60059
  Description of Artificial Sequence: Synthetic oligonucleotide

SEQ ID NO: 401959 - DNA, 32 bp, Artificial Sequence; identical to SEQ ID NO: 60060
  Description of Artificial Sequence: Synthetic oligonucleotide

SEQ ID NO: 401960 - DNA, 31 bp, Artificial Sequence; identical to SEQ ID NO: 60061
  Description of Artificial Sequence: Synthetic oligonucleotide

SEQ ID NO: 401961 - DNA, 32 bp, Artificial Sequence; identical to SEQ ID NO: 60062
  Description of Artificial Sequence: Synthetic oligonucleotide

SEQ ID NO: 401962 - DNA, 31 bp, Artificial Sequence; identical to SEQ ID NO: 60063
  Description of Artificial Sequence: Synthetic oligonucleotide

SEQ ID NO: 401963 - DNA, 30 bp, Artificial Sequence; identical to SEQ ID NO: 60064
  Description of Artificial Sequence: Synthetic oligonucleotide

SEQ ID NO: 401964 - DNA, 29 bp, Artificial Sequence
  Description of Artificial Sequence: Synthetic oligonucleotide
aaccgagaggagtacacacgcttcgacag

SEQ ID NO: 401965 - DNA, 28 bp, Artificial Sequence
  Description of Artificial Sequence: Synthetic oligonucleotide
accgagaggagtacacacgcttcgacag

SEQ ID NO: 401966 - DNA, 27 bp, Artificial Sequence
  Description of Artificial Sequence: Synthetic oligonucleotide
ccgagaggagtacacacgcttcgacag

SEQ ID NO: 401967 - DNA, 27 bp, Artificial Sequence
  Description of Artificial Sequence: Synthetic oligonucleotide
cgagaggagtacacacgcttcgacagc

SEQ ID NO: 401968 - DNA, 27 bp, Artificial Sequence
  Description of Artificial Sequence: Synthetic oligonucleotide
gagaggagtacacacgcttcgacagcg

SEQ ID NO: 401969 - DNA, 28 bp, Artificial Sequence
  Description of Artificial Sequence: Synthetic oligonucleotide
agaggagtacacacgcttcgacagcgac

SEQ ID NO: 401970 - DNA, 27 bp, Artificial Sequence
  Description of Artificial Sequence: Synthetic oligonucleotide
gaggagtacacacgcttcgacagcgac

SEQ ID NO: 401971 - DNA, 27 bp, Artificial Sequence
  Description of Artificial Sequence: Synthetic oligonucleotide
aggagtacacacgcttcgacagcgacg

SEQ ID NO: 401972 - DNA, 27 bp, Artificial Sequence
  Description of Artificial Sequence: Synthetic oligonucleotide
ggagtacacacgcttcgacagcgacgt

SEQ ID NO: 401973 - DNA, 27 bp, Artificial Sequence
  Description of Artificial Sequence: Synthetic oligonucleotide
gagtacacacgcttcgacagcgacgtg

SEQ ID NO: 401974 - DNA, 27 bp, Artificial Sequence
  Description of Artificial Sequence: Synthetic oligonucleotide
agtacacacgcttcgacagcgacgtgg

SEQ ID NO: 401975 - DNA, 26 bp, Artificial Sequence
  Description of Artificial Sequence: Synthetic oligonucleotide
gtacacacgcttcgacagcgacgtgg

SEQ ID NO: 401976 - DNA, 26 bp, Artificial Sequence
  Description of Artificial Sequence: Synthetic oligonucleotide
tacacacgcttcgacagcgacgtggg

SEQ ID NO: 401977 - DNA, 25 bp, Artificial Sequence
  Description of Artificial Sequence: Synthetic oligonucleotide
acacacgcttcgacagcgacgtggg

SEQ ID NO: 401978 - DNA, 24 bp, Artificial Sequence
  Description of Artificial Sequence: Synthetic oligonucleotide
cacacgcttcgacagcgacgtggg

SEQ ID NO: 401979 - DNA, 24 bp, Artificial Sequence
  Description of Artificial Sequence: Synthetic oligonucleotide
acacgcttcgacagcgacgtgggg

SEQ ID NO: 401980 - DNA, 32 bp, Artificial Sequence; identical to SEQ ID NO: 60081
  Description of Artificial Sequence: Synthetic oligonucleotide

SEQ ID NO: 401981 - DNA, 31 bp, Artificial Sequence; identical to SEQ ID NO: 60082
  Description of Artificial Sequence: Synthetic oligonucleotide

SEQ ID NO: 401982 - DNA, 30 bp, Artificial Sequence; identical to SEQ ID NO: 60083
  Description of Artificial Sequence: Synthetic oligonucleotide

SEQ ID NO: 401983 - DNA, 29 bp, Artificial Sequence
  Description of Artificial Sequence: Synthetic oligonucleotide
ccagcccagatcaaagtccggtggttttg

SEQ ID NO: 401984 - DNA, 29 bp, Artificial Sequence
  Description of Artificial Sequence: Synthetic oligonucleotide
cagcccagatcaaagtccggtggttttgg

SEQ ID NO: 401985 - DNA, 32 bp, Artificial Sequence; identical to SEQ ID NO: 60086
  Description of Artificial Sequence: Synthetic oligonucleotide

SEQ ID NO: 401986 - DNA, 31 bp, Artificial Sequence; identical to SEQ ID NO: 60087
  Description of Artificial Sequence: Synthetic oligonucleotide

SEQ ID NO: 401987 - DNA, 32 bp, Artificial Sequence; identical to SEQ ID NO: 60088
  Description of Artificial Sequence: Synthetic oligonucleotide

SEQ ID NO: 401988 - DNA, 32 bp, Artificial Sequence; identical to SEQ ID NO: 60089
  Description of Artificial Sequence: Synthetic oligonucleotide

SEQ ID NO: 401989 - DNA, 33 bp, Artificial Sequence; identical to SEQ ID NO: 60090
  Description of Artificial Sequence: Synthetic oligonucleotide

SEQ ID NO: 401990 - DNA, 33 bp, Artificial Sequence; identical to SEQ ID NO: 60091
  Description of Artificial Sequence: Synthetic oligonucleotide

SEQ ID NO: 401991 - DNA, 32 bp, Artificial Sequence; identical to SEQ ID NO: 60092
  Description of Artificial Sequence: Synthetic oligonucleotide

SEQ ID NO: 401992 - DNA, 33 bp, Artificial Sequence; identical to SEQ ID NO: 60093
  Description of Artificial Sequence: Synthetic oligonucleotide

SEQ ID NO: 401993 - DNA, 32 bp, Artificial Sequence; identical to SEQ ID NO: 60094
  Description of Artificial Sequence: Synthetic oligonucleotide

SEQ ID NO: 401994 - DNA, 31 bp, Artificial Sequence; identical to SEQ ID NO: 60095
  Description of Artificial Sequence: Synthetic oligonucleotide

SEQ ID NO: 401995 - DNA, 31 bp, Artificial Sequence; identical to SEQ ID NO: 60096
  Description of Artificial Sequence: Synthetic oligonucleotide

SEQ ID NO: 401996 - DNA, 30 bp, Artificial Sequence; identical to SEQ ID NO: 60097
  Description of Artificial Sequence: Synthetic oligonucleotide

SEQ ID NO: 401997 - DNA, 29 bp, Artificial Sequence
  Description of Artificial Sequence: Synthetic oligonucleotide
agtccggtggttttggaatgaccaggagg

SEQ ID NO: 401998 - DNA, 28 bp, Artificial Sequence
  Description of Artificial Sequence: Synthetic oligonucleotide
gtccggtggttttggaatgaccaggagg

SEQ ID NO: 401999 - DNA, 29 bp, Artificial Sequence
  Description of Artificial Sequence: Synthetic oligonucleotide
tccggtggttttggaatgaccaggaggag

SEQ ID NO: 402000 - DNA, 28 bp, Artificial Sequence
  Description of Artificial Sequence: Synthetic oligonucleotide
ccggtggttttggaatgaccaggaggag

SEQ ID NO: 402001 - DNA, 29 bp, Artificial Sequence
  Description of Artificial Sequence: Synthetic oligonucleotide
cggtggttttggaatgaccaggaggagac

SEQ ID NO: 402002 - DNA, 31 bp, Artificial Sequence; identical to SEQ ID NO: 60103
  Description of Artificial Sequence: Synthetic oligonucleotide

SEQ ID NO: 402003 - DNA, 31 bp, Artificial Sequence; identical to SEQ ID NO: 60104
  Description of Artificial Sequence: Synthetic oligonucleotide

SEQ ID NO: 402004 - DNA, 31 bp, Artificial Sequence; identical to SEQ ID NO: 60105
  Description of Artificial Sequence: Synthetic oligonucleotide

SEQ ID NO: 402005 - DNA, 30 bp, Artificial Sequence; identical to SEQ ID NO: 60106
  Description of Artificial Sequence: Synthetic oligonucleotide

SEQ ID NO: 402006 - DNA, 30 bp, Artificial Sequence; identical to SEQ ID NO: 60107
  Description of Artificial Sequence: Synthetic oligonucleotide

SEQ ID NO: 402007 - DNA, 30 bp, Artificial Sequence; identical to SEQ ID NO: 60108
  Description of Artificial Sequence: Synthetic oligonucleotide

SEQ ID NO: 402008 - DNA, 29 bp, Artificial Sequence
  Description of Artificial Sequence: Synthetic oligonucleotide
tttggaatgaccaggaggagacaaccggc

SEQ ID NO: 402009 - DNA, 28 bp, Artificial Sequence
  Description of Artificial Sequence: Synthetic oligonucleotide
ttggaatgaccaggaggagacaaccggc

SEQ ID NO: 402010 - DNA, 27 bp, Artificial Sequence
  Description of Artificial Sequence: Synthetic oligonucleotide
tggaatgaccaggaggagacaaccggc

SEQ ID NO: 402011 - DNA, 35 bp, Artificial Sequence; identical to SEQ ID NO: 60112
  Description of Artificial Sequence: Synthetic oligonucleotide

SEQ ID NO: 402012 - DNA, 34 bp, Artificial Sequence; identical to SEQ ID NO: 60113
  Description of Artificial Sequence: Synthetic oligonucleotide

SEQ ID NO: 402013 - DNA, 35 bp, Artificial Sequence; identical to SEQ ID NO: 60114
  Description of Artificial Sequence: Synthetic oligonucleotide

SEQ ID NO: 402014 - DNA, 34 bp, Artificial Sequence; identical to SEQ ID NO: 60115
  Description of Artificial Sequence: Synthetic oligonucleotide

SEQ ID NO: 402015 - DNA, 34 bp, Artificial Sequence; identical to SEQ ID NO: 60116
  Description of Artificial Sequence: Synthetic oligonucleotide

SEQ ID NO: 402016 - DNA, 33 bp, Artificial Sequence; identical to SEQ ID NO: 60117
  Description of Artificial Sequence: Synthetic oligonucleotide

SEQ ID NO: 402017 - DNA, 36 bp, Artificial Sequence; identical to SEQ ID NO: 60118
  Description of Artificial Sequence: Synthetic oligonucleotide

SEQ ID NO: 402018 - DNA, 35 bp, Artificial Sequence; identical to SEQ ID NO: 60119
  Description of Artificial Sequence: Synthetic oligonucleotide

SEQ ID NO: 402019 - DNA, 34 bp, Artificial Sequence; identical to SEQ ID NO: 60120
  Description of Artificial Sequence: Synthetic oligonucleotide

SEQ ID NO: 402020 - DNA, 33 bp, Artificial Sequence; identical to SEQ ID NO: 60121
  Description of Artificial Sequence: Synthetic oligonucleotide

SEQ ID NO: 402021 - DNA, 32 bp, Artificial Sequence; identical to SEQ ID NO: 60122
  Description of Artificial Sequence: Synthetic oligonucleotide

SEQ ID NO: 402022 - DNA, 32 bp, Artificial Sequence; identical to SEQ ID NO: 60123
  Description of Artificial Sequence: Synthetic oligonucleotide

SEQ ID NO: 402023 - DNA, 31 bp, Artificial Sequence; identical to SEQ ID NO: 60124
  Description of Artificial Sequence: Synthetic oligonucleotide

SEQ ID NO: 402024 - DNA, 30 bp, Artificial Sequence; identical to SEQ ID NO: 60125
  Description of Artificial Sequence: Synthetic oligonucleotide

SEQ ID NO: 402025 - DNA, 29 bp, Artificial Sequence
  Description of Artificial Sequence: Synthetic oligonucleotide
ccagcccagatcaaagtccagtggtttcg

SEQ ID NO: 402026 - DNA, 29 bp, Artificial Sequence
  Description of Artificial Sequence: Synthetic oligonucleotide
cagcccagatcaaagtccagtggtttcgg

SEQ ID NO: 402027 - DNA, 32 bp, Artificial Sequence; identical to SEQ ID NO: 60128
  Description of Artificial Sequence: Synthetic oligonucleotide

SEQ ID NO: 402028 - DNA, 31 bp, Artificial Sequence; identical to SEQ ID NO: 60129
  Description of Artificial Sequence: Synthetic oligonucleotide

SEQ ID NO: 402029 - DNA, 32 bp, Artificial Sequence; identical to SEQ ID NO: 60130
  Description of Artificial Sequence: Synthetic oligonucleotide

SEQ ID NO: 402030 - DNA, 32 bp, Artificial Sequence; identical to SEQ ID NO: 60131
  Description of Artificial Sequence: Synthetic oligonucleotide

SEQ ID NO: 402031 - DNA, 33 bp, Artificial Sequence; identical to SEQ ID NO: 60132
  Description of Artificial Sequence: Synthetic oligonucleotide

SEQ ID NO: 402032 - DNA, 33 bp, Artificial Sequence; identical to SEQ ID NO: 60133
  Description of Artificial Sequence: Synthetic oligonucleotide

SEQ ID NO: 402033 - DNA, 32 bp, Artificial Sequence; identical to SEQ ID NO: 60134
  Description of Artificial Sequence: Synthetic oligonucleotide

SEQ ID NO: 402034 - DNA, 33 bp, Artificial Sequence; identical to SEQ ID NO: 60135
  Description of Artificial Sequence: Synthetic oligonucleotide

SEQ ID NO: 402035 - DNA, 32 bp, Artificial Sequence; identical to SEQ ID NO: 60136
  Description of Artificial Sequence: Synthetic oligonucleotide

SEQ ID NO: 402036 - DNA, 31 bp, Artificial Sequence; identical to SEQ ID NO: 60137
  Description of Artificial Sequence: Synthetic oligonucleotide

SEQ ID NO: 402037 - DNA, 31 bp, Artificial Sequence; identical to SEQ ID NO: 60138
  Description of Artificial Sequence: Synthetic oligonucleotide

SEQ ID NO: 402038 - DNA, 30 bp, Artificial Sequence; identical to SEQ ID NO: 60139
  Description of Artificial Sequence: Synthetic oligonucleotide

SEQ ID NO: 402039 - DNA, 29 bp, Artificial Sequence
  Description of Artificial Sequence: Synthetic oligonucleotide
agtccagtggtttcggaatgaccaggagg

SEQ ID NO: 402040 - DNA, 28 bp, Artificial Sequence
  Description of Artificial Sequence: Synthetic oligonucleotide
gtccagtggtttcggaatgaccaggagg

SEQ ID NO: 402041 - DNA, 29 bp, Artificial Sequence
  Description of Artificial Sequence: Synthetic oligonucleotide
tccagtggtttcggaatgaccaggaggag

SEQ ID NO: 402042 - DNA, 28 bp, Artificial Sequence
  Description of Artificial Sequence: Synthetic oligonucleotide
ccagtggtttcggaatgaccaggaggag

SEQ ID NO: 402043 - DNA, 29 bp, Artificial Sequence
  Description of Artificial Sequence: Synthetic oligonucleotide
cagtggtttcggaatgaccaggaggagac

SEQ ID NO: 402044 - DNA, 31 bp, Artificial Sequence; identical to SEQ ID NO: 60145
  Description of Artificial Sequence: Synthetic oligonucleotide

SEQ ID NO: 402045 - DNA, 22 bp, Artificial Sequence
  Description of Artificial Sequence: Synthetic oligonucleotide
tgtaccgcgcggtgacgccgca

SEQ ID NO: 402046 - DNA, 21 bp, Artificial Sequence
  Description of Artificial Sequence: Synthetic oligonucleotide
gtaccgcgcggtgacgccgca

SEQ ID NO: 402047 - DNA, 21 bp, Artificial Sequence
  Description of Artificial Sequence: Synthetic oligonucleotide
taccgcgcggtgacgccgcag

SEQ ID NO: 402048 - DNA, 20 bp, Artificial Sequence
  Description of Artificial Sequence: Synthetic oligonucleotide
accgcgcggtgacgccgcag

SEQ ID NO: 402049 - DNA, 20 bp, Artificial Sequence
  Description of Artificial Sequence: Synthetic oligonucleotide
ccgcgcggtgacgccgcagt

SEQ ID NO: 402050 - DNA, 20 bp, Artificial Sequence
  Description of Artificial Sequence: Synthetic oligonucleotide
cgcgcggtgacgccgcaggt

SEQ ID NO: 402051 - DNA, 20 bp, Artificial Sequence
  Description of Artificial Sequence: Synthetic oligonucleotide
gcgcggtgacgccgcagggt

SEQ ID NO: 402052 - DNA, 20 bp, Artificial Sequence
  Description of Artificial Sequence: Synthetic oligonucleotide
cgcggtgacgccgcaggggt

SEQ ID NO: 402053 - DNA, 20 bp, Artificial Sequence
  Description of Artificial Sequence: Synthetic oligonucleotide
gcggtgacgccgcaggggct

SEQ ID NO: 402054 - DNA, 20 bp, Artificial Sequence
  Description of Artificial Sequence: Synthetic oligonucleotide
cggtgacgccgcaggggcgt

SEQ ID NO: 402055 - DNA, 20 bp, Artificial Sequence
  Description of Artificial Sequence: Synthetic oligonucleotide
ggtgacgccgcaggggcggt

SEQ ID NO: 402056 - DNA, 20 bp, Artificial Sequence
  Description of Artificial Sequence: Synthetic oligonucleotide
gtgacgccgcaggggcggct

SEQ ID NO: 402057 - DNA, 20 bp, Artificial Sequence
  Description of Artificial Sequence: Synthetic oligonucleotide
tgacgccgcaggggcggcct

SEQ ID NO: 402058 - DNA, 20 bp, Artificial Sequence
  Description of Artificial Sequence: Synthetic oligonucleotide
gacgccgcaggggcggcctt

SEQ ID NO: 402059 - DNA, 21 bp, Artificial Sequence
  Description of Artificial Sequence: Synthetic oligonucleotide
acgccgcaggggcggcctgat

SEQ ID NO: 402060 - DNA, 20 bp, Artificial Sequence
  Description of Artificial Sequence: Synthetic oligonucleotide
cgccgcaggggcggcctgat

SEQ ID NO: 402061 - DNA, 20 bp, Artificial Sequence
  Description of Artificial Sequence: Synthetic oligonucleotide
gccgcaggggcggcctgatg

SEQ ID NO: 402062 - DNA, 20 bp, Artificial Sequence
  Description of Artificial Sequence: Synthetic oligonucleotide
ccgcaggggcggcctgatgc

SEQ ID NO: 402063 - DNA, 20 bp, Artificial Sequence
  Description of Artificial Sequence: Synthetic oligonucleotide
cgcaggggcggcctgatgcc

SEQ ID NO: 402064 - DNA, 21 bp, Artificial Sequence
  Description of Artificial Sequence: Synthetic oligonucleotide
gcaggggcggcctgatgccga

SEQ ID NO: 402065 - DNA, 23 bp, Artificial Sequence
  Description of Artificial Sequence: Synthetic oligonucleotide
caggggcggcctgatgccgagta

SEQ ID NO: 402066 - DNA, 24 bp, Artificial Sequence
  Description of Artificial Sequence: Synthetic oligonucleotide
aggggcggcctgatgccgagtact

SEQ ID NO: 402067 - DNA, 23 bp, Artificial Sequence
  Description of Artificial Sequence: Synthetic oligonucleotide
ggggcggcctgatgccgagtact

SEQ ID NO: 402068 - DNA, 23 bp, Artificial Sequence
  Description of Artificial Sequence: Synthetic oligonucleotide
gggcggcctgatgccgagtactg

SEQ ID NO: 402069 - DNA, 25 bp, Artificial Sequence
  Description of Artificial Sequence: Synthetic oligonucleotide
ggcggcctgatgccgagtactggaa

SEQ ID NO: 402070 - DNA, 26 bp, Artificial Sequence
  Description of Artificial Sequence: Synthetic oligonucleotide
gcggcctgatgccgagtactggaaca

SEQ ID NO: 402071 - DNA, 26 bp, Artificial Sequence
  Description of Artificial Sequence: Synthetic oligonucleotide
cggcctgatgccgagtactggaacag

SEQ ID NO: 402072 - DNA, 26 bp, Artificial Sequence
  Description of Artificial Sequence: Synthetic oligonucleotide
ggcctgatgccgagtactggaacagc

SEQ ID NO: 402073 - DNA, 27 bp, Artificial Sequence
  Description of Artificial Sequence: Synthetic oligonucleotide
gcctgatgccgagtactggaacagcca

SEQ ID NO: 402074 - DNA, 27 bp, Artificial Sequence
  Description of Artificial Sequence: Synthetic oligonucleotide
cctgatgccgagtactggaacagccag

SEQ ID NO: 402075 - DNA, 29 bp, Artificial Sequence
  Description of Artificial Sequence: Synthetic oligonucleotide
ctgatgccgagtactggaacagccagaag

SEQ ID NO: 402076 - DNA, 29 bp, Artificial Sequence
  Description of Artificial Sequence: Synthetic oligonucleotide
tgatgccgagtactggaacagccagaagg

SEQ ID NO: 402077 - DNA, 28 bp, Artificial Sequence
  Description of Artificial Sequence: Synthetic oligonucleotide
gatgccgagtactggaacagccagaagg

SEQ ID NO: 402078 - DNA, 30 bp, Artificial Sequence; identical to SEQ ID NO: 60179
  Description of Artificial Sequence: Synthetic oligonucleotide

SEQ ID NO: 402079 - DNA, 29 bp, Artificial Sequence
  Description of Artificial Sequence: Synthetic oligonucleotide
tgccgagtactggaacagccagaaggaag

SEQ ID NO: 402080 - DNA, 30 bp, Artificial Sequence; identical to SEQ ID NO: 60181
  Description of Artificial Sequence: Synthetic oligonucleotide

SEQ ID NO: 402081 - DNA, 32 bp, Artificial Sequence; identical to SEQ ID NO: 60182
  Description of Artificial Sequence: Synthetic oligonucleotide

SEQ ID NO: 402082 - DNA, 31 bp, Artificial Sequence; identical to SEQ ID NO: 60183
  Description of Artificial Sequence: Synthetic oligonucleotide

SEQ ID NO: 402083 - DNA, 32 bp, Artificial Sequence; identical to SEQ ID NO: 60184
  Description of Artificial Sequence: Synthetic oligonucleotide

SEQ ID NO: 402084 - DNA, 32 bp, Artificial Sequence; identical to SEQ ID NO: 60185
  Description of Artificial Sequence: Synthetic oligonucleotide

SEQ ID NO: 402085 - DNA, 31 bp, Artificial Sequence; identical to SEQ ID NO: 60186
  Description of Artificial Sequence: Synthetic oligonucleotide

SEQ ID NO: 402086 - DNA, 30 bp, Artificial Sequence; identical to SEQ ID NO: 60187
  Description of Artificial Sequence: Synthetic oligonucleotide

SEQ ID NO: 402087 - DNA, 29 bp, Artificial Sequence
  Description of Artificial Sequence: Synthetic oligonucleotide
tgactccccagcatggagacatctacacc

SEQ ID NO: 402088 - DNA, 28 bp, Artificial Sequence
  Description of Artificial Sequence: Synthetic oligonucleotide
gactccccagcatggagacatctacacc

SEQ ID NO: 402089 - DNA, 29 bp, Artificial Sequence
  Description of Artificial Sequence: Synthetic oligonucleotide
actccccagcatggagacatctacacctg

SEQ ID NO: 402090 - DNA, 28 bp, Artificial Sequence
  Description of Artificial Sequence: Synthetic oligonucleotide
ctccccagcatggagacatctacacctg

SEQ ID NO: 402091 - DNA, 28 bp, Artificial Sequence
  Description of Artificial Sequence: Synthetic oligonucleotide
tccccagcatggagacatctacacctgc

SEQ ID NO: 402092 - DNA, 27 bp, Artificial Sequence
  Description of Artificial Sequence: Synthetic oligonucleotide
ccccagcatggagacatctacacctgc

SEQ ID NO: 402093 - DNA, 27 bp, Artificial Sequence
  Description of Artificial Sequence: Synthetic oligonucleotide
cccagcatggagacatctacacctgcc

SEQ ID NO: 402094 - DNA, 28 bp, Artificial Sequence
  Description of Artificial Sequence: Synthetic oligonucleotide
ccagcatggagacatctacacctgccac

SEQ ID NO: 402095 - DNA, 28 bp, Artificial Sequence
  Description of Artificial Sequence: Synthetic oligonucleotide
cagcatggagacatctacacctgccacg

SEQ ID NO: 402096 - DNA, 29 bp, Artificial Sequence
  Description of Artificial Sequence: Synthetic oligonucleotide
agcatggagacatctacacctgccacgtg

SEQ ID NO: 402097 - DNA, 28 bp, Artificial Sequence
  Description of Artificial Sequence: Synthetic oligonucleotide
gcatggagacatctacacctgccacgtg

SEQ ID NO: 402098 - DNA, 28 bp, Artificial Sequence
  Description of Artificial Sequence: Synthetic oligonucleotide
catggagacatctacacctgccacgtgg

SEQ ID NO: 402099 - DNA, 29 bp, Artificial Sequence
  Description of Artificial Sequence: Synthetic oligonucleotide
atggagacatctacacctgccacgtggag

SEQ ID NO: 402100 - DNA, 20 bp, Artificial Sequence
  Description of Artificial Sequence: Synthetic oligonucleotide
cggtgacgccgctggggcgt

SEQ ID NO: 402101 - DNA, 20 bp, Artificial Sequence
  Description of Artificial Sequence: Synthetic oligonucleotide
ggtgacgccgctggggcggt

SEQ ID NO: 402102 - DNA, 21 bp, Artificial Sequence
  Description of Artificial Sequence: Synthetic oligonucleotide
gtgacgccgctggggcggctt

SEQ ID NO: 402103 - DNA, 22 bp, Artificial Sequence
  Description of Artificial Sequence: Synthetic oligonucleotide
tgacgccgctggggcggcttga

SEQ ID NO: 402104 - DNA, 21 bp, Artificial Sequence
  Description of Artificial Sequence: Synthetic oligonucleotide
gacgccgctggggcggcttga

SEQ ID NO: 402105 - DNA, 21 bp, Artificial Sequence
  Description of Artificial Sequence: Synthetic oligonucleotide
acgccgctggggcggcttgac

SEQ ID NO: 402106 - DNA, 20 bp, Artificial Sequence
  Description of Artificial Sequence: Synthetic oligonucleotide
cgccgctggggcggcttgac

SEQ ID NO: 402107 - DNA, 20 bp, Artificial Sequence
  Description of Artificial Sequence: Synthetic oligonucleotide
gccgctggggcggcttgacg

SEQ ID NO: 402108 - DNA, 20 bp, Artificial Sequence
  Description of Artificial Sequence: Synthetic oligonucleotide
ccgctggggcggcttgacgc

SEQ ID NO: 402109 - DNA, 20 bp, Artificial Sequence
  Description of Artificial Sequence: Synthetic oligonucleotide
cgctggggcggcttgacgcc

SEQ ID NO: 402110 - DNA, 21 bp, Artificial Sequence
  Description of Artificial Sequence: Synthetic oligonucleotide
gctggggcggcttgacgccga

SEQ ID NO: 402111 - DNA, 23 bp, Artificial Sequence
  Description of Artificial Sequence: Synthetic oligonucleotide
ctggggcggcttgacgccgagta

SEQ ID NO: 402112 - DNA, 24 bp, Artificial Sequence
  Description of Artificial Sequence: Synthetic oligonucleotide
tggggcggcttgacgccgagtact

SEQ ID NO: 402113 - DNA, 23 bp, Artificial Sequence
  Description of Artificial Sequence: Synthetic oligonucleotide
ggggcggcttgacgccgagtact

SEQ ID NO: 402114 - DNA, 23 bp, Artificial Sequence
  Description of Artificial Sequence: Synthetic oligonucleotide
gggcggcttgacgccgagtactg

SEQ ID NO: 402115 - DNA, 27 bp, Artificial Sequence
  Description of Artificial Sequence: Synthetic oligonucleotide
ggcggcttgacgccgagtactggaata

SEQ ID NO: 402116 - DNA, 27 bp, Artificial Sequence
  Description of Artificial Sequence: Synthetic oligonucleotide
gcggcttgacgccgagtactggaatag

SEQ ID NO: 402117 - DNA, 27 bp, Artificial Sequence
  Description of Artificial Sequence: Synthetic oligonucleotide
cggcttgacgccgagtactggaatagc

SEQ ID NO: 402118 - DNA, 27 bp, Artificial Sequence
  Description of Artificial Sequence: Synthetic oligonucleotide
ggcttgacgccgagtactggaatagcc

SEQ ID NO: 402119 - DNA, 28 bp, Artificial Sequence
  Description of Artificial Sequence: Synthetic oligonucleotide
gcttgacgccgagtactggaatagccag

SEQ ID NO: 402120 - DNA, 30 bp, Artificial Sequence; identical to SEQ ID NO: 60229
  Description of Artificial Sequence: Synthetic oligonucleotide

SEQ ID NO: 402121 - DNA, 30 bp, Artificial Sequence; identical to SEQ ID NO: 60230
  Description of Artificial Sequence: Synthetic oligonucleotide

SEQ ID NO: 402122 - DNA, 28 bp, Artificial Sequence
  Description of Artificial Sequence: Synthetic oligonucleotide
gagttggacacggtgtgcagacacaacc

SEQ ID NO: 402123 - DNA, 29 bp, Artificial Sequence
  Description of Artificial Sequence: Synthetic oligonucleotide
agttggacacggtgtgcagacacaaccac

SEQ ID NO: 402124 - DNA, 28 bp, Artificial Sequence
  Description of Artificial Sequence: Synthetic oligonucleotide
gttggacacggtgtgcagacacaaccac

SEQ ID NO: 402125 - DNA, 28 bp, Artificial Sequence
  Description of Artificial Sequence: Synthetic oligonucleotide
ttggacacggtgtgcagacacaaccacc

SEQ ID NO: 402126 - DNA, 27 bp, Artificial Sequence
  Description of Artificial Sequence: Synthetic oligonucleotide
tggacacggtgtgcagacacaaccacc

SEQ ID NO: 402127 - DNA, 27 bp, Artificial Sequence
  Description of Artificial Sequence: Synthetic oligonucleotide
ggacacggtgtgcagacacaaccacca

SEQ ID NO: 402128 - DNA, 27 bp, Artificial Sequence
  Description of Artificial Sequence: Synthetic oligonucleotide
gacacggtgtgcagacacaaccaccag

SEQ ID NO: 402129 - DNA, 29 bp, Artificial Sequence
  Description of Artificial Sequence: Synthetic oligonucleotide
acacggtgtgcagacacaaccaccagttg

SEQ ID NO: 402130 - DNA, 28 bp, Artificial Sequence
  Description of Artificial Sequence: Synthetic oligonucleotide
cacggtgtgcagacacaaccaccagttg

SEQ ID NO: 402131 - DNA, 28 bp, Artificial Sequence
  Description of Artificial Sequence: Synthetic oligonucleotide
acggtgtgcagacacaaccaccagttgg

SEQ ID NO: 402132 - DNA, 27 bp, Artificial Sequence
  Description of Artificial Sequence: Synthetic oligonucleotide
cggtgtgcagacacaaccaccagttgg

SEQ ID NO: 402133 - DNA, 28 bp, Artificial Sequence
  Description of Artificial Sequence: Synthetic oligonucleotide
ggtgtgcagacacaaccaccagttggag

SEQ ID NO: 402134 - DNA, 28 bp, Artificial Sequence
  Description of Artificial Sequence: Synthetic oligonucleotide
gtgtgcagacacaaccaccagttggagc

SEQ ID NO: 402135 - DNA, 29 bp, Artificial Sequence
  Description of Artificial Sequence: Synthetic oligonucleotide
tgtgcagacacaaccaccagttggagctc

SEQ ID NO: 402136 - DNA, 28 bp, Artificial Sequence
  Description of Artificial Sequence: Synthetic oligonucleotide
gtgcagacacaaccaccagttggagctc

SEQ ID NO: 402137 - DNA, 28 bp, Artificial Sequence
  Description of Artificial Sequence: Synthetic oligonucleotide
tgcagacacaaccaccagttggagctcc

SEQ ID NO: 402138 - DNA, 27 bp, Artificial Sequence
  Description of Artificial Sequence: Synthetic oligonucleotide
gcagacacaaccaccagttggagctcc

SEQ ID NO: 402139 - DNA, 27 bp, Artificial Sequence
  Description of Artificial Sequence: Synthetic oligonucleotide
cagacacaaccaccagttggagctccg

SEQ ID NO: 402140 - DNA, 27 bp, Artificial Sequence
  Description of Artificial Sequence: Synthetic oligonucleotide
agacacaaccaccagttggagctccgc

SEQ ID NO: 402141 - DNA, 27 bp, Artificial Sequence
  Description of Artificial Sequence: Synthetic oligonucleotide
gacacaaccaccagttggagctccgca

SEQ ID NO: 402142 - DNA, 27 bp, Artificial Sequence
  Description of Artificial Sequence: Synthetic oligonucleotide
acacaaccaccagttggagctccgcac

SEQ ID NO: 402143 - DNA, 26 bp, Artificial Sequence
  Description of Artificial Sequence: Synthetic oligonucleotide
cacaaccaccagttggagctccgcac

SEQ ID NO: 402144 - DNA, 27 bp, Artificial Sequence
  Description of Artificial Sequence: Synthetic oligonucleotide
acaaccaccagttggagctccgcacga

SEQ ID NO: 402145 - DNA, 26 bp, Artificial Sequence
  Description of Artificial Sequence: Synthetic oligonucleotide
caaccaccagttggagctccgcacga

SEQ ID NO: 402146 - DNA, 26 bp, Artificial Sequence
  Description of Artificial Sequence: Synthetic oligonucleotide
aaccaccagttggagctccgcacgac

SEQ ID NO: 402147 - DNA, 25 bp, Artificial Sequence
  Description of Artificial Sequence: Synthetic oligonucleotide
accaccagttggagctccgcacgac

SEQ ID NO: 402148 - DNA, 24 bp, Artificial Sequence
  Description of Artificial Sequence: Synthetic oligonucleotide
ccaccagttggagctccgcacgac

SEQ ID NO: 402149 - DNA, 26 bp, Artificial Sequence
  Description of Artificial Sequence: Synthetic oligonucleotide
caccagttggagctccgcacgacctt

SEQ ID NO: 402150 - DNA, 23 bp, Artificial Sequence
  Description of Artificial Sequence: Synthetic oligonucleotide
agaggacccgggcggagttggac

SEQ ID NO: 402151 - DNA, 22 bp, Artificial Sequence
  Description of Artificial Sequence: Synthetic oligonucleotide
gaggacccgggcggagttggac

SEQ ID NO: 402152 - DNA, 22 bp, Artificial Sequence
  Description of Artificial Sequence: Synthetic oligonucleotide
aggacccgggcggagttggacg

SEQ ID NO: 402153 - DNA, 21 bp, Artificial Sequence
  Description of Artificial Sequence: Synthetic oligonucleotide
ggacccgggcggagttggacg

SEQ ID NO: 402154 - DNA, 21 bp, Artificial Sequence
  Description of Artificial Sequence: Synthetic oligonucleotide
gacccgggcggagttggacgc

SEQ ID NO: 402155 - DNA, 21 bp, Artificial Sequence
  Description of Artificial Sequence: Synthetic oligonucleotide
acccgggcggagttggacgcg

SEQ ID NO: 402156 - DNA, 20 bp, Artificial Sequence
  Description of Artificial Sequence: Synthetic oligonucleotide
cccgggcggagttggacgcg

SEQ ID NO: 402157 - DNA, 21 bp, Artificial Sequence
  Description of Artificial Sequence: Synthetic oligonucleotide
ccgggcggagttggacgcggt

SEQ ID NO: 402158 - DNA, 22 bp, Artificial Sequence
  Description of Artificial Sequence: Synthetic oligonucleotide
cgggcggagttggacgcggtgt

SEQ ID NO: 402159 - DNA, 22 bp, Artificial Sequence
  Description of Artificial Sequence: Synthetic oligonucleotide
gggcggagttggacgcggtgtg

SEQ ID NO: 402160 - DNA, 23 bp, Artificial Sequence
  Description of Artificial Sequence: Synthetic oligonucleotide
ggcggagttggacgcggtgtgca

SEQ ID NO: 402161 - DNA, 24 bp, Artificial Sequence
  Description of Artificial Sequence: Synthetic oligonucleotide
gcggagttggacgcggtgtgcaga

SEQ ID NO: 402162 - DNA, 25 bp, Artificial Sequence
  Description of Artificial Sequence: Synthetic oligonucleotide
cggagttggacgcggtgtgcagaca

SEQ ID NO: 402163 - DNA, 27 bp, Artificial Sequence
  Description of Artificial Sequence: Synthetic oligonucleotide
ggagttggacgcggtgtgcagacacaa

SEQ ID NO: 402164 - DNA, 27 bp, Artificial Sequence
  Description of Artificial Sequence: Synthetic oligonucleotide
gagttggacgcggtgtgcagacacaac

SEQ ID NO: 402165 - DNA, 29 bp, Artificial Sequence
  Description of Artificial Sequence: Synthetic oligonucleotide
agttggacgcggtgtgcagacacaactac

SEQ ID NO: 402166 - DNA, 28 bp, Artificial Sequence
  Description of Artificial Sequence: Synthetic oligonucleotide
gttggacgcggtgtgcagacacaactac

SEQ ID NO: 402167 - DNA, 28 bp, Artificial Sequence
  Description of Artificial Sequence: Synthetic oligonucleotide
ttggacgcggtgtgcagacacaactacc

SEQ ID NO: 402168 - DNA, 27 bp, Artificial Sequence
  Description of Artificial Sequence: Synthetic oligonucleotide
tggacgcggtgtgcagacacaactacc

SEQ ID NO: 402169 - DNA, 27 bp, Artificial Sequence
  Description of Artificial Sequence: Synthetic oligonucleotide
ggacgcggtgtgcagacacaactacca

SEQ ID NO: 402170 - DNA, 27 bp, Artificial Sequence
  Description of Artificial Sequence: Synthetic oligonucleotide
gacgcggtgtgcagacacaactaccag

SEQ ID NO: 402171 - DNA, 29 bp, Artificial Sequence
  Description of Artificial Sequence: Synthetic oligonucleotide
acgcggtgtgcagacacaactaccagttg

SEQ ID NO: 402172 - DNA, 28 bp, Artificial Sequence
  Description of Artificial Sequence: Synthetic oligonucleotide
cgcggtgtgcagacacaactaccagttg

SEQ ID NO: 402173 - DNA, 28 bp, Artificial Sequence
  Description of Artificial Sequence: Synthetic oligonucleotide
gcggtgtgcagacacaactaccagttgg

SEQ ID NO: 402174 - DNA, 35 bp, Artificial Sequence; identical to SEQ ID NO: 60301
  Description of Artificial Sequence: Synthetic oligonucleotide

SEQ ID NO: 402175 - DNA, 34 bp, Artificial Sequence; identical to SEQ ID NO: 60302
  Description of Artificial Sequence: Synthetic oligonucleotide

SEQ ID NO: 402176 - DNA, 36 bp, Artificial Sequence; identical to SEQ ID NO: 60303
  Description of Artificial Sequence: Synthetic oligonucleotide

SEQ ID NO: 402177 - DNA, 37 bp, Artificial Sequence; identical to SEQ ID NO: 60304
  Description of Artificial Sequence: Synthetic oligonucleotide

SEQ ID NO: 402178 - DNA, 36 bp, Artificial Sequence; identical to SEQ ID NO: 60305
  Description of Artificial Sequence: Synthetic oligonucleotide

SEQ ID NO: 402179 - DNA, 35 bp, Artificial Sequence; identical to SEQ ID NO: 60306
  Description of Artificial Sequence: Synthetic oligonucleotide

SEQ ID NO: 402180 - DNA, 34 bp, Artificial Sequence; identical to SEQ ID NO: 60307
  Description of Artificial Sequence: Synthetic oligonucleotide

SEQ ID NO: 402181 - DNA, 33 bp, Artificial Sequence; identical to SEQ ID NO: 60308
  Description of Artificial Sequence: Synthetic oligonucleotide

SEQ ID NO: 402182 - DNA, 33 bp, Artificial Sequence; identical to SEQ ID NO: 60309
  Description of Artificial Sequence: Synthetic oligonucleotide

SEQ ID NO: 402183 - DNA, 35 bp, Artificial Sequence; identical to SEQ ID NO: 60310
  Description of Artificial Sequence: Synthetic oligonucleotide

SEQ ID NO: 402184 - DNA, 34 bp, Artificial Sequence; identical to SEQ ID NO: 60311
  Description of Artificial Sequence: Synthetic oligonucleotide

SEQ ID NO: 402185 - DNA, 34 bp, Artificial Sequence; identical to SEQ ID NO: 60312
  Description of Artificial Sequence: Synthetic oligonucleotide

SEQ ID NO: 402186 - DNA, 33 bp, Artificial Sequence; identical to SEQ ID NO: 60313
  Description of Artificial Sequence: Synthetic oligonucleotide

SEQ ID NO: 402187 - DNA, 27 bp, Artificial Sequence
  Description of Artificial Sequence: Synthetic oligonucleotide
aggccctcaaccaccacaacctgctga

SEQ ID NO: 402188 - DNA, 27 bp, Artificial Sequence
  Description of Artificial Sequence: Synthetic oligonucleotide
ggccctcaaccaccacaacctgctgat

SEQ ID NO: 402189 - DNA, 27 bp, Artificial Sequence
  Description of Artificial Sequence: Synthetic oligonucleotide
gccctcaaccaccacaacctgctgatc

SEQ ID NO: 402190 - DNA, 28 bp, Artificial Sequence
  Description of Artificial Sequence: Synthetic oligonucleotide
ccctcaaccaccacaacctgctgatctg

SEQ ID NO: 402191 - DNA, 28 bp, Artificial Sequence
  Description of Artificial Sequence: Synthetic oligonucleotide
cctcaaccaccacaacctgctgatctgc

SEQ ID NO: 402192 - DNA, 29 bp, Artificial Sequence
  Description of Artificial Sequence: Synthetic oligonucleotide
ctcaaccaccacaacctgctgatctgctc

SEQ ID NO: 402193 - DNA, 30 bp, Artificial Sequence
  Description of Artificial Sequence: Synthetic oligonucleotide
tcaaccaccacaacctgctgatctgctcag

SEQ ID NO: 402194 - DNA, 29 bp, Artificial Sequence
  Description of Artificial Sequence: Synthetic oligonucleotide
caaccaccacaacctgctgatctgctcag

SEQ ID NO: 402195 - DNA, 30 bp, Artificial Sequence
  Description of Artificial Sequence: Synthetic oligonucleotide
aaccaccacaacctgctgatctgctcagtg

SEQ ID NO: 402196 - DNA, 29 bp, Artificial Sequence
  Description of Artificial Sequence: Synthetic oligonucleotide
accaccacaacctgctgatctgctcagtg

SEQ ID NO: 402197 - DNA, 28 bp, Artificial Sequence
  Description of Artificial Sequence: Synthetic oligonucleotide
ccaccacaacctgctgatctgctcagtg

SEQ ID NO: 402198 - DNA, 29 bp, Artificial Sequence
  Description of Artificial Sequence: Synthetic oligonucleotide
caccacaacctgctgatctgctcagtgac

SEQ ID NO: 402199 - DNA, 30 bp, Artificial Sequence
  Description of Artificial Sequence: Synthetic oligonucleotide
accacaacctgctgatctgctcagtgacag

SEQ ID NO: 402200 - DNA, 29 bp, Artificial Sequence
  Description of Artificial Sequence: Synthetic oligonucleotide
ccacaacctgctgatctgctcagtgacag

SEQ ID NO: 402201 - DNA, 33 bp, Artificial Sequence
  Description of Artificial Sequence: Synthetic oligonucleotide
cacaacctgctgatctgctcagtgacagatttc

SEQ ID NO: 402202 - DNA, 36 bp, Artificial Sequence
  Description of Artificial Sequence: Synthetic oligonucleotide
acaacctgctgatctgctcagtgacagatttctatc

SEQ ID NO: 402203 - DNA, 35 bp, Artificial Sequence
  Description of Artificial Sequence: Synthetic oligonucleotide
caacctgctgatctgctcagtgacagatttctatc

SEQ ID NO: 402204 - DNA, 35 bp, Artificial Sequence
  Description of Artificial Sequence: Synthetic oligonucleotide
aacctgctgatctgctcagtgacagatttctatcc

SEQ ID NO: 402205 - DNA, 34 bp, Artificial Sequence
  Description of Artificial Sequence: Synthetic oligonucleotide
acctgctgatctgctcagtgacagatttctatcc

SEQ ID NO: 402206 - DNA, 33 bp, Artificial Sequence
  Description of Artificial Sequence: Synthetic oligonucleotide
cctgctgatctgctcagtgacagatttctatcc

SEQ ID NO: 402207 - DNA, 34 bp, Artificial Sequence
  Description of Artificial Sequence: Synthetic oligonucleotide
ctgctgatctgctcagtgacagatttctatccag

SEQ ID NO: 402208 - DNA, 34 bp, Artificial Sequence
  Description of Artificial Sequence: Synthetic oligonucleotide
tgctgatctgctcagtgacagatttctatccagc

SEQ ID NO: 402209 - DNA, 33 bp, Artificial Sequence
  Description of Artificial Sequence: Synthetic oligonucleotide
gctgatctgctcagtgacagatttctatccagc

SEQ ID NO: 402210 - DNA, 33 bp, Artificial Sequence
  Description of Artificial Sequence: Synthetic oligonucleotide
ctgatctgctcagtgacagatttctatccagcc

SEQ ID NO: 402211 - DNA, 33 bp, Artificial Sequence
  Description of Artificial Sequence: Synthetic oligonucleotide
tgatctgctcagtgacagatttctatccagccc

SEQ ID NO: 402212 - DNA, 32 bp, Artificial Sequence
  Description of Artificial Sequence: Synthetic oligonucleotide
gatctgctcagtgacagatttctatccagccc

SEQ ID NO: 402213 - DNA, 33 bp, Artificial Sequence
  Description of Artificial Sequence: Synthetic oligonucleotide
atctgctcagtgacagatttctatccagcccag

SEQ ID NO: 402214 - DNA, 26 bp, Artificial Sequence
  Description of Artificial Sequence: Synthetic oligonucleotide
cattggaggcttcgtgctggggctga

SEQ ID NO: 402215 - DNA, 32 bp, Artificial Sequence
  Description of Artificial Sequence: Synthetic oligonucleotide
tggtttcggaatgaccaggaggagacaactag

SEQ ID NO: 402216 - DNA, 31 bp, Artificial Sequence
  Description of Artificial Sequence: Synthetic oligonucleotide
ggtttcggaatgaccaggaggagacaactag

SEQ ID NO: 402217 - DNA, 31 bp, Artificial Sequence
  Description of Artificial Sequence: Synthetic oligonucleotide
gtttcggaatgaccaggaggagacaactagc

SEQ ID NO: 402218 - DNA, 31 bp, Artificial Sequence
  Description of Artificial Sequence: Synthetic oligonucleotide
tttcggaatgaccaggaggagacaactagcg

SEQ ID NO: 402219 - DNA, 30 bp, Artificial Sequence
  Description of Artificial Sequence: Synthetic oligonucleotide
ttcggaatgaccaggaggagacaactagcg

SEQ ID NO: 402220 - DNA, 29 bp, Artificial Sequence
  Description of Artificial Sequence: Synthetic oligonucleotide
tcggaatgaccaggaggagacaactagcg

SEQ ID NO: 402221 - DNA, 28 bp, Artificial Sequence
  Description of Artificial Sequence: Synthetic oligonucleotide
cggaatgaccaggaggagacaactagcg

SEQ ID NO: 402222 - DNA, 30 bp, Artificial Sequence
  Description of Artificial Sequence: Synthetic oligonucleotide
ggaatgaccaggaggagacaactagcgttg

SEQ ID NO: 402223 - DNA, 31 bp, Artificial Sequence
  Description of Artificial Sequence: Synthetic oligonucleotide
gaatgaccaggaggagacaactagcgttgtg

SEQ ID NO: 402224 - DNA, 32 bp, Artificial Sequence
  Description of Artificial Sequence: Synthetic oligonucleotide
aatgaccaggaggagacaactagcgttgtgtc

SEQ ID NO: 402225 - DNA, 31 bp, Artificial Sequence
  Description of Artificial Sequence: Synthetic oligonucleotide
atgaccaggaggagacaactagcgttgtgtc

SEQ ID NO: 402226 - DNA, 30 bp, Artificial Sequence
  Description of Artificial Sequence: Synthetic oligonucleotide
tgaccaggaggagacaactagcgttgtgtc

SEQ ID NO: 402227 - DNA, 29 bp, Artificial Sequence
  Description of Artificial Sequence: Synthetic oligonucleotide
gaccaggaggagacaactagcgttgtgtc

SEQ ID NO: 402228 - DNA, 29 bp, Artificial Sequence
  Description of Artificial Sequence: Synthetic oligonucleotide
accaggaggagacaactagcgttgtgtcc

SEQ ID NO: 402229 - DNA, 28 bp, Artificial Sequence
  Description of Artificial Sequence: Synthetic oligonucleotide
ccaggaggagacaactagcgttgtgtcc

SEQ ID NO: 402230 - DNA, 29 bp, Artificial Sequence
  Description of Artificial Sequence: Synthetic oligonucleotide
caggaggagacaactagcgttgtgtccac

SEQ ID NO: 402231 - DNA, 29 bp, Artificial Sequence
  Description of Artificial Sequence: Synthetic oligonucleotide
aggaggagacaactagcgttgtgtccacc

SEQ ID NO: 402232 - DNA, 28 bp, Artificial Sequence
  Description of Artificial Sequence: Synthetic oligonucleotide
ggaggagacaactagcgttgtgtccacc

SEQ ID NO: 402233 - DNA, 28 bp, Artificial Sequence
  Description of Artificial Sequence: Synthetic oligonucleotide
gaggagacaactagcgttgtgtccaccc

SEQ ID NO: 402234 - DNA, 28 bp, Artificial Sequence
  Description of Artificial Sequence: Synthetic oligonucleotide
aggagacaactagcgttgtgtccacccc

SEQ ID NO: 402235 - DNA, 27 bp, Artificial Sequence
  Description of Artificial Sequence: Synthetic oligonucleotide
ggagacaactagcgttgtgtccacccc

SEQ ID NO: 402236 - DNA, 27 bp, Artificial Sequence
  Description of Artificial Sequence: Synthetic oligonucleotide
gagacaactagcgttgtgtccaccccc

SEQ ID NO: 402237 - DNA, 27 bp, Artificial Sequence
  Description of Artificial Sequence: Synthetic oligonucleotide
agacaactagcgttgtgtccacccccc

SEQ ID NO: 402238 - DNA, 27 bp, Artificial Sequence
  Description of Artificial Sequence: Synthetic oligonucleotide
gacaactagcgttgtgtccacccccct

SEQ ID NO: 402239 - DNA, 32 bp, Artificial Sequence
  Description of Artificial Sequence: Synthetic oligonucleotide
acaactagcgttgtgtccaccccccttattag

SEQ ID NO: 402240 - DNA, 31 bp, Artificial Sequence
  Description of Artificial Sequence: Synthetic oligonucleotide
caactagcgttgtgtccaccccccttattag

SEQ ID NO: 402241 - DNA, 31 bp, Artificial Sequence
  Description of Artificial Sequence: Synthetic oligonucleotide
aactagcgttgtgtccaccccccttattagg

SEQ ID NO: 402242 - DNA, 30 bp, Artificial Sequence
  Description of Artificial Sequence: Synthetic oligonucleotide
actagcgttgtgtccaccccccttattagg

SEQ ID NO: 402243 - DNA, 29 bp, Artificial Sequence
  Description of Artificial Sequence: Synthetic oligonucleotide
ctagcgttgtgtccaccccccttattagg

SEQ ID NO: 402244 - DNA, 31 bp, Artificial Sequence
  Description of Artificial Sequence: Synthetic oligonucleotide
tagcgttgtgtccaccccccttattaggaac

SEQ ID NO: 402245 - DNA, 30 bp, Artificial Sequence
  Description of Artificial Sequence: Synthetic oligonucleotide
agcgttgtgtccaccccccttattaggaac

SEQ ID NO: 402246 - DNA, 27 bp, Artificial Sequence
  Description of Artificial Sequence: Synthetic oligonucleotide
agacaactggcgttgtgtccaccccct

SEQ ID NO: 402247 - DNA, 27 bp, Artificial Sequence
  Description of Artificial Sequence: Synthetic oligonucleotide
gacaactggcgttgtgtccaccccctt

SEQ ID NO: 402248 - DNA, 32 bp, Artificial Sequence
  Description of Artificial Sequence: Synthetic oligonucleotide
acaactggcgttgtgtccaccccctttattag

SEQ ID NO: 402249 - DNA, 31 bp, Artificial Sequence
  Description of Artificial Sequence: Synthetic oligonucleotide
caactggcgttgtgtccaccccctttattag

SEQ ID NO: 402250 - DNA, 31 bp, Artificial Sequence
  Description of Artificial Sequence: Synthetic oligonucleotide
aactggcgttgtgtccaccccctttattagg

SEQ ID NO: 402251 - DNA, 30 bp, Artificial Sequence
  Description of Artificial Sequence: Synthetic oligonucleotide
actggcgttgtgtccaccccctttattagg

SEQ ID NO: 402252 - DNA, 29 bp, Artificial Sequence
  Description of Artificial Sequence: Synthetic oligonucleotide
ctggcgttgtgtccaccccctttattagg

SEQ ID NO: 402253 - DNA, 31 bp, Artificial Sequence
  Description of Artificial Sequence: Synthetic oligonucleotide
tggcgttgtgtccaccccctttattaggaac

SEQ ID NO: 402254 - DNA, 30 bp, Artificial Sequence
  Description of Artificial Sequence: Synthetic oligonucleotide
ggcgttgtgtccaccccctttattaggaac

SEQ ID NO: 402255 - DNA, 30 bp, Artificial Sequence
  Description of Artificial Sequence: Synthetic oligonucleotide
gcgttgtgtccaccccctttattaggaacg

SEQ ID NO: 402256 - DNA, 30 bp, Artificial Sequence
  Description of Artificial Sequence: Synthetic oligonucleotide
cgttgtgtccaccccctttattaggaacgg

SEQ ID NO: 402257 - DNA, 31 bp, Artificial Sequence
  Description of Artificial Sequence: Synthetic oligonucleotide
gttgtgtccaccccctttattaggaacggtg

SEQ ID NO: 402258 - DNA, 32 bp, Artificial Sequence
  Description of Artificial Sequence: Synthetic oligonucleotide
ttgtgtccaccccctttattaggaacggtgac

SEQ ID NO: 402259 - DNA, 31 bp, Artificial Sequence
  Description of Artificial Sequence: Synthetic oligonucleotide
tgtgtccaccccctttattaggaacggtgac

SEQ ID NO: 402260 - DNA, 30 bp, Artificial Sequence
  Description of Artificial Sequence: Synthetic oligonucleotide
gtgtccaccccctttattaggaacggtgac

SEQ ID NO: 402261 - DNA, 31 bp, Artificial Sequence
  Description of Artificial Sequence: Synthetic oligonucleotide
tgtccaccccctttattaggaacggtgactg

SEQ ID NO: 402262 - DNA, 30 bp, Artificial Sequence
  Description of Artificial Sequence: Synthetic oligonucleotide
gtccaccccctttattaggaacggtgactg

SEQ ID NO: 402263 - DNA, 30 bp, Artificial Sequence
  Description of Artificial Sequence: Synthetic oligonucleotide
tccaccccctttattaggaacggtgactgg

SEQ ID NO: 402264 - DNA, 29 bp, Artificial Sequence
  Description of Artificial Sequence: Synthetic oligonucleotide
ccaccccctttattaggaacggtgactgg

SEQ ID NO: 402265 - DNA, 30 bp, Artificial Sequence
  Description of Artificial Sequence: Synthetic oligonucleotide
caccccctttattaggaacggtgactggac

SEQ ID NO: 402266 - DNA, 30 bp, Artificial Sequence
  Description of Artificial Sequence: Synthetic oligonucleotide
accccctttattaggaacggtgactggacc

SEQ ID NO: 402267 - DNA, 29 bp, Artificial Sequence
  Description of Artificial Sequence: Synthetic oligonucleotide
ccccctttattaggaacggtgactggacc

SEQ ID NO: 402268 - DNA, 31 bp, Artificial Sequence
  Description of Artificial Sequence: Synthetic oligonucleotide
cccctttattaggaacggtgactggaccttc

SEQ ID NO: 402269 - DNA, 31 bp, Artificial Sequence
  Description of Artificial Sequence: Synthetic oligonucleotide
ccctttattaggaacggtgactggaccttcc

SEQ ID NO: 402270 - DNA, 32 bp, Artificial Sequence
  Description of Artificial Sequence: Synthetic oligonucleotide
cctttattaggaacggtgactggaccttccag

SEQ ID NO: 402271 - DNA, 34 bp, Artificial Sequence
  Description of Artificial Sequence: Synthetic oligonucleotide
ctttattaggaacggtgactggaccttccagatc

SEQ ID NO: 402272 - DNA, 34 bp, Artificial Sequence
  Description of Artificial Sequence: Synthetic oligonucleotide
tttattaggaacggtgactggaccttccagatcc

SEQ ID NO: 402273 - DNA, 35 bp, Artificial Sequence
  Description of Artificial Sequence: Synthetic oligonucleotide
taccagtttaagggcatgtgctacttcaccaacag

SEQ ID NO: 402274 - DNA, 34 bp, Artificial Sequence
  Description of Artificial Sequence: Synthetic oligonucleotide
accagtttaagggcatgtgctacttcaccaacag

SEQ ID NO: 402275 - DNA, 33 bp, Artificial Sequence
  Description of Artificial Sequence: Synthetic oligonucleotide
ccagtttaagggcatgtgctacttcaccaacag

SEQ ID NO: 402276 - DNA, 33 bp, Artificial Sequence
  Description of Artificial Sequence: Synthetic oligonucleotide
cagtttaagggcatgtgctacttcaccaacagg

SEQ ID NO: 402277 - DNA, 34 bp, Artificial Sequence
  Description of Artificial Sequence: Synthetic oligonucleotide
agtttaagggcatgtgctacttcaccaacaggac

SEQ ID NO: 402278 - DNA, 33 bp, Artificial Sequence
  Description of Artificial Sequence: Synthetic oligonucleotide
gtttaagggcatgtgctacttcaccaacaggac

SEQ ID NO: 402279 - DNA, 33 bp, Artificial Sequence
  Description of Artificial Sequence: Synthetic oligonucleotide
tttaagggcatgtgctacttcaccaacaggacg

SEQ ID NO: 402280 - DNA, 32 bp, Artificial Sequence
  Description of Artificial Sequence: Synthetic oligonucleotide
ttaagggcatgtgctacttcaccaacaggacg

SEQ ID NO: 402281 - DNA, 31 bp, Artificial Sequence
  Description of Artificial Sequence: Synthetic oligonucleotide
taagggcatgtgctacttcaccaacaggacg

SEQ ID NO: 402282 - DNA, 30 bp, Artificial Sequence
  Description of Artificial Sequence: Synthetic oligonucleotide
aagggcatgtgctacttcaccaacaggacg

SEQ ID NO: 402283 - DNA, 29 bp, Artificial Sequence
  Description of Artificial Sequence: Synthetic oligonucleotide
agggcatgtgctacttcaccaacaggacg

SEQ ID NO: 402284 - DNA, 28 bp, Artificial Sequence
  Description of Artificial Sequence: Synthetic oligonucleotide
gggcatgtgctacttcaccaacaggacg

SEQ ID NO: 402285 - DNA, 28 bp, Artificial Sequence
  Description of Artificial Sequence: Synthetic oligonucleotide
ggcatgtgctacttcaccaacaggacgg

SEQ ID NO: 402286 - DNA, 29 bp, Artificial Sequence
  Description of Artificial Sequence: Synthetic oligonucleotide
gcatgtgctacttcaccaacaggacggag

SEQ ID NO: 402287 - DNA, 29 bp, Artificial Sequence
  Description of Artificial Sequence: Synthetic oligonucleotide
catgtgctacttcaccaacaggacggagc

SEQ ID NO: 402288 - DNA, 29 bp, Artificial Sequence
  Description of Artificial Sequence: Synthetic oligonucleotide
atgtgctacttcaccaacaggacggagcg

SEQ ID NO: 402289 - DNA, 28 bp, Artificial Sequence
  Description of Artificial Sequence: Synthetic oligonucleotide
tgtgctacttcaccaacaggacggagcg

SEQ ID NO: 402290 - DNA, 27 bp, Artificial Sequence
  Description of Artificial Sequence: Synthetic oligonucleotide
gtgctacttcaccaacaggacggagcg

SEQ ID NO: 402291 - DNA, 27 bp, Artificial Sequence
  Description of Artificial Sequence: Synthetic oligonucleotide
tgctacttcaccaacaggacggagcgc

SEQ ID NO: 402292 - DNA, 26 bp, Artificial Sequence
  Description of Artificial Sequence: Synthetic oligonucleotide
gctacttcaccaacaggacggagcgc

SEQ ID NO: 402293 - DNA, 27 bp, Artificial Sequence
  Description of Artificial Sequence: Synthetic oligonucleotide
ctacttcaccaacaggacggagcgcgt

SEQ ID NO: 402294 - DNA, 27 bp, Artificial Sequence
  Description of Artificial Sequence: Synthetic oligonucleotide
tacttcaccaacaggacggagcgcgtg

SEQ ID NO: 402295 - DNA, 26 bp, Artificial Sequence
  Description of Artificial Sequence: Synthetic oligonucleotide
acttcaccaacaggacggagcgcgtg

SEQ ID NO: 402296 - DNA, 25 bp, Artificial Sequence
  Description of Artificial Sequence: Synthetic oligonucleotide
cttcaccaacaggacggagcgcgtg

SEQ ID NO: 402297 - DNA, 25 bp, Artificial Sequence
  Description of Artificial Sequence: Synthetic oligonucleotide
ttcaccaacaggacggagcgcgtgc

SEQ ID NO: 402298 - DNA, 24 bp, Artificial Sequence
  Description of Artificial Sequence: Synthetic oligonucleotide
tcaccaacaggacggagcgcgtgc

SEQ ID NO: 402299 - DNA, 23 bp, Artificial Sequence
  Description of Artificial Sequence: Synthetic oligonucleotide
caccaacaggacggagcgcgtgc

SEQ ID NO: 402300 - DNA, 24 bp, Artificial Sequence
  Description of Artificial Sequence: Synthetic oligonucleotide
accaacaggacggagcgcgtgcgt

SEQ ID NO: 402301 - DNA, 23 bp, Artificial Sequence
  Description of Artificial Sequence: Synthetic oligonucleotide
ccaacaggacggagcgcgtgcgt

SEQ ID NO: 402302 - DNA, 25 bp, Artificial Sequence
  Description of Artificial Sequence: Synthetic oligonucleotide
caacaggacggagcgcgtgcgtctt

SEQ ID NO: 402303 - DNA, 26 bp, Artificial Sequence
  Description of Artificial Sequence: Synthetic oligonucleotide
aacaggacggagcgcgtgcgtcttgt

SEQ ID NO: 402304 - DNA, 25 bp, Artificial Sequence
  Description of Artificial Sequence: Synthetic oligonucleotide
acaggacggagcgcgtgcgtcttgt

SEQ ID NO: 402305 - DNA, 24 bp, Artificial Sequence
  Description of Artificial Sequence: Synthetic oligonucleotide
caggacggagcgcgtgcgtcttgt

SEQ ID NO: 402306 - DNA, 25 bp, Artificial Sequence
  Description of Artificial Sequence: Synthetic oligonucleotide
aggacggagcgcgtgcgtcttgtga

SEQ ID NO: 402307 - DNA, 37 bp, Artificial Sequence
  Description of Artificial Sequence: Synthetic oligonucleotide
ctcagtgacagatttctatccagcccagatcaaaatc

SEQ ID NO: 402308 - DNA, 37 bp, Artificial Sequence
  Description of Artificial Sequence: Synthetic oligonucleotide
tcagtgacagatttctatccagcccagatcaaaatcc

SEQ ID NO: 402309 - DNA, 36 bp, Artificial Sequence
  Description of Artificial Sequence: Synthetic oligonucleotide
cagtgacagatttctatccagcccagatcaaaatcc

SEQ ID NO: 402310 - DNA, 36 bp, Artificial Sequence
  Description of Artificial Sequence: Synthetic oligonucleotide
agtgacagatttctatccagcccagatcaaaatccg

SEQ ID NO: 402311 - DNA, 35 bp, Artificial Sequence
  Description of Artificial Sequence: Synthetic oligonucleotide
gtgacagatttctatccagcccagatcaaaatccg

SEQ ID NO: 402312 - DNA, 35 bp, Artificial Sequence
  Description of Artificial Sequence: Synthetic oligonucleotide
tgacagatttctatccagcccagatcaaaatccgg

SEQ ID NO: 402313 - DNA, 34 bp, Artificial Sequence
  Description of Artificial Sequence: Synthetic oligonucleotide
gacagatttctatccagcccagatcaaaatccgg

SEQ ID NO: 402314 - DNA, 35 bp, Artificial Sequence
  Description of Artificial Sequence: Synthetic oligonucleotide
acagatttctatccagcccagatcaaaatccggtg

SEQ ID NO: 402315 - DNA, 34 bp, Artificial Sequence
  Description of Artificial Sequence: Synthetic oligonucleotide
cagatttctatccagcccagatcaaaatccggtg

SEQ ID NO: 402316 - DNA, 34 bp, Artificial Sequence
  Description of Artificial Sequence: Synthetic oligonucleotide
agatttctatccagcccagatcaaaatccggtgg

SEQ ID NO: 402317 - DNA, 33 bp, Artificial Sequence
  Description of Artificial Sequence: Synthetic oligonucleotide
gatttctatccagcccagatcaaaatccggtgg

SEQ ID NO: 402318 - DNA, 36 bp, Artificial Sequence
  Description of Artificial Sequence: Synthetic oligonucleotide
atttctatccagcccagatcaaaatccggtggtttc

SEQ ID NO: 402319 - DNA, 35 bp, Artificial Sequence
  Description of Artificial Sequence: Synthetic oligonucleotide
tttctatccagcccagatcaaaatccggtggtttc

SEQ ID NO: 402320 - DNA, 34 bp, Artificial Sequence
  Description of Artificial Sequence: Synthetic oligonucleotide
ttctatccagcccagatcaaaatccggtggtttc

SEQ ID NO: 402321 - DNA, 33 bp, Artificial Sequence
  Description of Artificial Sequence: Synthetic oligonucleotide
tctatccagcccagatcaaaatccggtggtttc

SEQ ID NO: 402322 - DNA, 32 bp, Artificial Sequence
  Description of Artificial Sequence: Synthetic oligonucleotide
ctatccagcccagatcaaaatccggtggtttc

SEQ ID NO: 402323 - DNA, 32 bp, Artificial Sequence
  Description of Artificial Sequence: Synthetic oligonucleotide
tatccagcccagatcaaaatccggtggtttcg

SEQ ID NO: 402324 - DNA, 31 bp, Artificial Sequence
  Description of Artificial Sequence: Synthetic oligonucleotide
atccagcccagatcaaaatccggtggtttcg

SEQ ID NO: 402325 - DNA, 30 bp, Artificial Sequence
  Description of Artificial Sequence: Synthetic oligonucleotide
tccagcccagatcaaaatccggtggtttcg

SEQ ID NO: 402326 - DNA, 29 bp, Artificial Sequence
  Description of Artificial Sequence: Synthetic oligonucleotide
ccagcccagatcaaaatccggtggtttcg

SEQ ID NO: 402327 - DNA, 29 bp, Artificial Sequence
  Description of Artificial Sequence: Synthetic oligonucleotide
cagcccagatcaaaatccggtggtttcgg

SEQ ID NO: 402328 - DNA, 32 bp, Artificial Sequence
  Description of Artificial Sequence: Synthetic oligonucleotide
agcccagatcaaaatccggtggtttcggaatg

SEQ ID NO: 402329 - DNA, 31 bp, Artificial Sequence
  Description of Artificial Sequence: Synthetic oligonucleotide
gcccagatcaaaatccggtggtttcggaatg

SEQ ID NO: 402330 - DNA, 32 bp, Artificial Sequence
  Description of Artificial Sequence: Synthetic oligonucleotide
cccagatcaaaatccggtggtttcggaatgac

SEQ ID NO: 402331 - DNA, 32 bp, Artificial Sequence
  Description of Artificial Sequence: Synthetic oligonucleotide
ccagatcaaaatccggtggtttcggaatgacc

SEQ ID NO: 402332 - DNA, 33 bp, Artificial Sequence
  Description of Artificial Sequence: Synthetic oligonucleotide
cagatcaaaatccggtggtttcggaatgaccag

SEQ ID NO: 402333 - DNA, 33 bp, Artificial Sequence
  Description of Artificial Sequence: Synthetic oligonucleotide
agatcaaaatccggtggtttcggaatgaccagg

SEQ ID NO: 402334 - DNA, 32 bp, Artificial Sequence
  Description of Artificial Sequence: Synthetic oligonucleotide
gatcaaaatccggtggtttcggaatgaccagg

SEQ ID NO: 402335 - DNA, 33 bp, Artificial Sequence
  Description of Artificial Sequence: Synthetic oligonucleotide
atcaaaatccggtggtttcggaatgaccaggag

SEQ ID NO: 402336 - DNA, 32 bp, Artificial Sequence
  Description of Artificial Sequence: Synthetic oligonucleotide
tcaaaatccggtggtttcggaatgaccaggag

SEQ ID NO: 402337 - DNA, 31 bp, Artificial Sequence
  Description of Artificial Sequence: Synthetic oligonucleotide
caaaatccggtggtttcggaatgaccaggag

SEQ ID NO: 402338 - DNA, 31 bp, Artificial Sequence
  Description of Artificial Sequence: Synthetic oligonucleotide
aaaatccggtggtttcggaatgaccaggagg

SEQ ID NO: 402339 - DNA, 30 bp, Artificial Sequence
  Description of Artificial Sequence: Synthetic oligonucleotide
aaatccggtggtttcggaatgaccaggagg

SEQ ID NO: 402340 - DNA, 29 bp, Artificial Sequence
  Description of Artificial Sequence: Synthetic oligonucleotide
aatccggtggtttcggaatgaccaggagg

SEQ ID NO: 402341 - DNA, 28 bp, Artificial Sequence
  Description of Artificial Sequence: Synthetic oligonucleotide
atccggtggtttcggaatgaccaggagg

SEQ ID NO: 402342 - DNA, 27 bp, Artificial Sequence
  Description of Artificial Sequence: Synthetic oligonucleotide
ctacttcaccaacgggacggagcgcat

SEQ ID NO: 402343 - DNA, 27 bp, Artificial Sequence
  Description of Artificial Sequence: Synthetic oligonucleotide
tacttcaccaacgggacggagcgcatg

SEQ ID NO: 402344 - DNA, 26 bp, Artificial Sequence
  Description of Artificial Sequence: Synthetic oligonucleotide
acttcaccaacgggacggagcgcatg

SEQ ID NO: 402345 - DNA, 25 bp, Artificial Sequence
  Description of Artificial Sequence: Synthetic oligonucleotide
cttcaccaacgggacggagcgcatg

SEQ ID NO: 402346 - DNA, 25 bp, Artificial Sequence
  Description of Artificial Sequence: Synthetic oligonucleotide
ttcaccaacgggacggagcgcatgc

SEQ ID NO: 402347 - DNA, 24 bp, Artificial Sequence
  Description of Artificial Sequence: Synthetic oligonucleotide
tcaccaacgggacggagcgcatgc

SEQ ID NO: 402348 - DNA, 23 bp, Artificial Sequence
  Description of Artificial Sequence: Synthetic oligonucleotide
caccaacgggacggagcgcatgc

SEQ ID NO: 402349 - DNA, 27 bp, Artificial Sequence
  Description of Artificial Sequence: Synthetic oligonucleotide
accaacgggacggagcgcatgcgttat

SEQ ID NO: 402350 - DNA, 26 bp, Artificial Sequence
  Description of Artificial Sequence: Synthetic oligonucleotide
ccaacgggacggagcgcatgcgttat

SEQ ID NO: 402351 - DNA, 27 bp, Artificial Sequence
  Description of Artificial Sequence: Synthetic oligonucleotide
caacgggacggagcgcatgcgttatgt

SEQ ID NO: 402352 - DNA, 27 bp, Artificial Sequence
  Description of Artificial Sequence: Synthetic oligonucleotide
aacgggacggagcgcatgcgttatgtg

SEQ ID NO: 402353 - DNA, 27 bp, Artificial Sequence
  Description of Artificial Sequence: Synthetic oligonucleotide
acgggacggagcgcatgcgttatgtga

SEQ ID NO: 402354 - DNA, 26 bp, Artificial Sequence
  Description of Artificial Sequence: Synthetic oligonucleotide
cgggacggagcgcatgcgttatgtga

SEQ ID NO: 402355 - DNA, 26 bp, Artificial Sequence
  Description of Artificial Sequence: Synthetic oligonucleotide
gggacggagcgcatgcgttatgtgac

SEQ ID NO: 402356 - DNA, 27 bp, Artificial Sequence
  Description of Artificial Sequence: Synthetic oligonucleotide
ggacggagcgcatgcgttatgtgacca

SEQ ID NO: 402357 - DNA, 27 bp, Artificial Sequence
  Description of Artificial Sequence: Synthetic oligonucleotide
gacggagcgcatgcgttatgtgaccag

SEQ ID NO: 402358 - DNA, 30 bp, Artificial Sequence
  Description of Artificial Sequence: Synthetic oligonucleotide
acggagcgcatgcgttatgtgaccagatac

SEQ ID NO: 402359 - DNA, 29 bp, Artificial Sequence
  Description of Artificial Sequence: Synthetic oligonucleotide
cggagcgcatgcgttatgtgaccagatac

SEQ ID NO: 402360 - DNA, 31 bp, Artificial Sequence
  Description of Artificial Sequence: Synthetic oligonucleotide
ggagcgcatgcgttatgtgaccagatacatc

SEQ ID NO: 402361 - DNA, 36 bp, Artificial Sequence
  Description of Artificial Sequence: Synthetic oligonucleotide
gagcgcatgcgttatgtgaccagatacatctataac

SEQ ID NO: 402362 - DNA, 36 bp, Artificial Sequence
  Description of Artificial Sequence: Synthetic oligonucleotide
agcgcatgcgttatgtgaccagatacatctataacc

SEQ ID NO: 402363 - DNA, 35 bp, Artificial Sequence
  Description of Artificial Sequence: Synthetic oligonucleotide
gcgcatgcgttatgtgaccagatacatctataacc

SEQ ID NO: 402364 - DNA, 35 bp, Artificial Sequence
  Description of Artificial Sequence: Synthetic oligonucleotide
cgcatgcgttatgtgaccagatacatctataaccg

SEQ ID NO: 402365 - DNA, 36 bp, Artificial Sequence
  Description of Artificial Sequence: Synthetic oligonucleotide
gcatgcgttatgtgaccagatacatctataaccgag

SEQ ID NO: 402366 - DNA, 37 bp, Artificial Sequence
  Description of Artificial Sequence: Synthetic oligonucleotide
catgcgttatgtgaccagatacatctataaccgagag

SEQ ID NO: 402367 - DNA, 37 bp, Artificial Sequence
  Description of Artificial Sequence: Synthetic oligonucleotide
atgcgttatgtgaccagatacatctataaccgagagg

SEQ ID NO: 402368 - DNA, 35 bp, Artificial Sequence
  Description of Artificial Sequence: Synthetic oligonucleotide
gtcttgtgaccagatacatctataaccgagaggac

SEQ ID NO: 402369 - DNA, 37 bp, Artificial Sequence
  Description of Artificial Sequence: Synthetic oligonucleotide
tcttgtgaccagatacatctataaccgagaggactac

SEQ ID NO: 402370 - DNA, 36 bp, Artificial Sequence
  Description of Artificial Sequence: Synthetic oligonucleotide
cttgtgaccagatacatctataaccgagaggactac

SEQ ID NO: 402371 - DNA, 36 bp, Artificial Sequence
  Description of Artificial Sequence: Synthetic oligonucleotide
ttgtgaccagatacatctataaccgagaggactacg

SEQ ID NO: 402372 - DNA, 35 bp, Artificial Sequence
  Description of Artificial Sequence: Synthetic oligonucleotide
tgtgaccagatacatctataaccgagaggactacg

SEQ ID NO: 402373 - DNA, 34 bp, Artificial Sequence
  Description of Artificial Sequence: Synthetic oligonucleotide
gtgaccagatacatctataaccgagaggactacg

SEQ ID NO: 402374 - DNA, 34 bp, Artificial Sequence
  Description of Artificial Sequence: Synthetic oligonucleotide
tgaccagatacatctataaccgagaggactacgc

SEQ ID NO: 402375 - DNA, 33 bp, Artificial Sequence
  Description of Artificial Sequence: Synthetic oligonucleotide
gaccagatacatctataaccgagaggactacgc

SEQ ID NO: 402376 - DNA, 34 bp, Artificial Sequence
  Description of Artificial Sequence: Synthetic oligonucleotide
accagatacatctataaccgagaggactacgcac

SEQ ID NO: 402377 - DNA, 33 bp, Artificial Sequence
  Description of Artificial Sequence: Synthetic oligonucleotide
ccagatacatctataaccgagaggactacgcac

SEQ ID NO: 402378 - DNA, 33 bp, Artificial Sequence
  Description of Artificial Sequence: Synthetic oligonucleotide
cagatacatctataaccgagaggactacgcacg

SEQ ID NO: 402379 - DNA, 33 bp, Artificial Sequence
  Description of Artificial Sequence: Synthetic oligonucleotide
agatacatctataaccgagaggactacgcacgc

SEQ ID NO: 402380 - DNA, 32 bp, Artificial Sequence
  Description of Artificial Sequence: Synthetic oligonucleotide
gatacatctataaccgagaggactacgcacgc

SEQ ID NO: 402381 - DNA, 34 bp, Artificial Sequence
  Description of Artificial Sequence: Synthetic oligonucleotide
atacatctataaccgagaggactacgcacgcttc

SEQ ID NO: 402382 - DNA, 33 bp, Artificial Sequence
  Description of Artificial Sequence: Synthetic oligonucleotide
tacatctataaccgagaggactacgcacgcttc

SEQ ID NO: 402383 - DNA, 32 bp, Artificial Sequence
  Description of Artificial Sequence: Synthetic oligonucleotide
acatctataaccgagaggactacgcacgcttc

SEQ ID NO: 402384 - DNA, 31 bp, Artificial Sequence
  Description of Artificial Sequence: Synthetic oligonucleotide
catctataaccgagaggactacgcacgcttc

SEQ ID NO: 402385 - DNA, 31 bp, Artificial Sequence
  Description of Artificial Sequence: Synthetic oligonucleotide
atctataaccgagaggactacgcacgcttcg

SEQ ID NO: 402386 - DNA, 30 bp, Artificial Sequence
  Description of Artificial Sequence: Synthetic oligonucleotide
tctataaccgagaggactacgcacgcttcg

SEQ ID NO: 402387 - DNA, 29 bp, Artificial Sequence
  Description of Artificial Sequence: Synthetic oligonucleotide
ctataaccgagaggactacgcacgcttcg

SEQ ID NO: 402388 - DNA, 30 bp, Artificial Sequence
  Description of Artificial Sequence: Synthetic oligonucleotide
tataaccgagaggactacgcacgcttcgac

SEQ ID NO: 402389 - DNA, 29 bp, Artificial Sequence
  Description of Artificial Sequence: Synthetic oligonucleotide
ataaccgagaggactacgcacgcttcgac

SEQ ID NO: 402390 - DNA, 28 bp, Artificial Sequence
  Description of Artificial Sequence: Synthetic oligonucleotide
taaccgagaggactacgcacgcttcgac

SEQ ID NO: 402391 - DNA, 27 bp, Artificial Sequence
  Description of Artificial Sequence: Synthetic oligonucleotide
aaccgagaggactacgcacgcttcgac

SEQ ID NO: 402392 - DNA, 27 bp, Artificial Sequence
  Description of Artificial Sequence: Synthetic oligonucleotide
accgagaggactacgcacgcttcgaca

SEQ ID NO: 402393 - DNA, 26 bp, Artificial Sequence
  Description of Artificial Sequence: Synthetic oligonucleotide
ccgagaggactacgcacgcttcgaca

SEQ ID NO: 402394 - DNA, 26 bp, Artificial Sequence
  Description of Artificial Sequence: Synthetic oligonucleotide
cgagaggactacgcacgcttcgacag

SEQ ID NO: 402395 - DNA, 26 bp, Artificial Sequence
  Description of Artificial Sequence: Synthetic oligonucleotide
gagaggactacgcacgcttcgacagc

SEQ ID NO: 402396 - DNA, 27 bp, Artificial Sequence
  Description of Artificial Sequence: Synthetic oligonucleotide
agaggactacgcacgcttcgacagcga

SEQ ID NO: 402397 - DNA, 26 bp, Artificial Sequence
  Description of Artificial Sequence: Synthetic oligonucleotide
gaggactacgcacgcttcgacagcga

SEQ ID NO: 402398 - DNA, 26 bp, Artificial Sequence
  Description of Artificial Sequence: Synthetic oligonucleotide
aggactacgcacgcttcgacagcgac

SEQ ID NO: 402399 - DNA, 25 bp, Artificial Sequence
  Description of Artificial Sequence: Synthetic oligonucleotide
ggactacgcacgcttcgacagcgac

SEQ ID NO: 402400 - DNA, 26 bp, Artificial Sequence
  Description of Artificial Sequence: Synthetic oligonucleotide
gactacgcacgcttcgacagcgacgt

SEQ ID NO: 402401 - DNA, 26 bp, Artificial Sequence
  Description of Artificial Sequence: Synthetic oligonucleotide
actacgcacgcttcgacagcgacgtg

SEQ ID NO: 402402 - DNA, 25 bp, Artificial Sequence
  Description of Artificial Sequence: Synthetic oligonucleotide
ctacgcacgcttcgacagcgacgtg

SEQ ID NO: 402403 - DNA, 25 bp, Artificial Sequence
  Description of Artificial Sequence: Synthetic oligonucleotide
ggagcgcgtgcgtcttgtgaccaga

SEQ ID NO: 402404 - DNA, 26 bp, Artificial Sequence
  Description of Artificial Sequence: Synthetic oligonucleotide
gagcgcgtgcgtcttgtgaccagaca

SEQ ID NO: 402405 - DNA, 27 bp, Artificial Sequence
  Description of Artificial Sequence: Synthetic oligonucleotide
agcgcgtgcgtcttgtgaccagacaca

SEQ ID NO: 402406 - DNA, 27 bp, Artificial Sequence
  Description of Artificial Sequence: Synthetic oligonucleotide
gcgcgtgcgtcttgtgaccagacacat

SEQ ID NO: 402407 - DNA, 27 bp, Artificial Sequence
  Description of Artificial Sequence: Synthetic oligonucleotide
cgcgtgcgtcttgtgaccagacacatc

SEQ ID NO: 402408 - DNA, 32 bp, Artificial Sequence; identical to SEQ ID NO: 61737
  Description of Artificial Sequence: Synthetic oligonucleotide

SEQ ID NO: 402409 - DNA, 32 bp, Artificial Sequence; identical to SEQ ID NO: 61738
  Description of Artificial Sequence: Synthetic oligonucleotide

SEQ ID NO: 402410 - DNA, 32 bp, Artificial Sequence; identical to SEQ ID NO: 61739
  Description of Artificial Sequence: Synthetic oligonucleotide

SEQ ID NO: 402411 - DNA, 33 bp, Artificial Sequence; identical to SEQ ID NO: 61740
  Description of Artificial Sequence: Synthetic oligonucleotide

SEQ ID NO: 402412 - DNA, 32 bp, Artificial Sequence; identical to SEQ ID NO: 61741
  Description of Artificial Sequence: Synthetic oligonucleotide

SEQ ID NO: 402413 - DNA, 33 bp, Artificial Sequence; identical to SEQ ID NO: 61742
  Description of Artificial Sequence: Synthetic oligonucleotide

SEQ ID NO: 402414 - DNA, 33 bp, Artificial Sequence; identical to SEQ ID NO: 61743
  Description of Artificial Sequence: Synthetic oligonucleotide

SEQ ID NO: 402415 - DNA, 34 bp, Artificial Sequence; identical to SEQ ID NO: 61744
  Description of Artificial Sequence: Synthetic oligonucleotide

SEQ ID NO: 402416 - DNA, 33 bp, Artificial Sequence; identical to SEQ ID NO: 61745
  Description of Artificial Sequence: Synthetic oligonucleotide

SEQ ID NO: 402417 - DNA, 35 bp, Artificial Sequence; identical to SEQ ID NO: 61746
  Description of Artificial Sequence: Synthetic oligonucleotide

SEQ ID NO: 402418 - DNA, 34 bp, Artificial Sequence; identical to SEQ ID NO: 60475
  Description of Artificial Sequence: Synthetic oligonucleotide

SEQ ID NO: 402419 - DNA, 33 bp, Artificial Sequence; identical to SEQ ID NO: 60476
  Description of Artificial Sequence: Synthetic oligonucleotide

SEQ ID NO: 402420 - DNA, 33 bp, Artificial Sequence; identical to SEQ ID NO: 60477
  Description of Artificial Sequence: Synthetic oligonucleotide

SEQ ID NO: 402421 - DNA, 32 bp, Artificial Sequence; identical to SEQ ID NO: 60478
  Description of Artificial Sequence: Synthetic oligonucleotide

SEQ ID NO: 402422 - DNA, 32 bp, Artificial Sequence; identical to SEQ ID NO: 61044
  Description of Artificial Sequence: Synthetic oligonucleotide

SEQ ID NO: 402423 - DNA, 31 bp, Artificial Sequence; identical to SEQ ID NO: 61045
  Description of Artificial Sequence: Synthetic oligonucleotide

SEQ ID NO: 402424 - DNA, 32 bp, Artificial Sequence; identical to SEQ ID NO: 61587
  Description of Artificial Sequence: Synthetic oligonucleotide

SEQ ID NO: 402425 - DNA, 32 bp, Artificial Sequence; identical to SEQ ID NO: 61588
  Description of Artificial Sequence: Synthetic oligonucleotide

SEQ ID NO: 402426 - DNA, 31 bp, Artificial Sequence; identical to SEQ ID NO: 61589
  Description of Artificial Sequence: Synthetic oligonucleotide

SEQ ID NO: 402427 - DNA, 31 bp, Artificial Sequence; identical to SEQ ID NO: 61590
  Description of Artificial Sequence: Synthetic oligonucleotide

SEQ ID NO: 402428 - DNA, 30 bp, Artificial Sequence; identical to SEQ ID NO: 61591
  Description of Artificial Sequence: Synthetic oligonucleotide

SEQ ID NO: 402429 - DNA, 27 bp, Artificial Sequence
  Description of Artificial Sequence: Synthetic oligonucleotide
tgaccttgatgctggcgatgctgagcg

SEQ ID NO: 402430 - DNA, 26 bp, Artificial Sequence
  Description of Artificial Sequence: Synthetic oligonucleotide
gaccttgatgctggcgatgctgagcg

SEQ ID NO: 402431 - DNA, 26 bp, Artificial Sequence
  Description of Artificial Sequence: Synthetic oligonucleotide
accttgatgctggcgatgctgagcgc

SEQ ID NO: 402432 - DNA, 25 bp, Artificial Sequence
  Description of Artificial Sequence: Synthetic oligonucleotide
ccttgatgctggcgatgctgagcgc

SEQ ID NO: 402433 - DNA, 25 bp, Artificial Sequence
  Description of Artificial Sequence: Synthetic oligonucleotide
cttgatgctggcgatgctgagcgcc

SEQ ID NO: 402434 - DNA, 25 bp, Artificial Sequence
  Description of Artificial Sequence: Synthetic oligonucleotide
ttgatgctggcgatgctgagcgccc

SEQ ID NO: 402435 - DNA, 24 bp, Artificial Sequence
  Description of Artificial Sequence: Synthetic oligonucleotide
tgatgctggcgatgctgagcgccc

SEQ ID NO: 402436 - DNA, 23 bp, Artificial Sequence
  Description of Artificial Sequence: Synthetic oligonucleotide
gatgctggcgatgctgagcgccc

SEQ ID NO: 402437 - DNA, 23 bp, Artificial Sequence
  Description of Artificial Sequence: Synthetic oligonucleotide
atgctggcgatgctgagcgcccc

SEQ ID NO: 402438 - DNA, 22 bp, Artificial Sequence
  Description of Artificial Sequence: Synthetic oligonucleotide
tgctggcgatgctgagcgcccc

SEQ ID NO: 402439 - DNA, 21 bp, Artificial Sequence
  Description of Artificial Sequence: Synthetic oligonucleotide
gctggcgatgctgagcgcccc

SEQ ID NO: 402440 - DNA, 21 bp, Artificial Sequence
  Description of Artificial Sequence: Synthetic oligonucleotide
ctggcgatgctgagcgccccg

SEQ ID NO: 402441 - DNA, 22 bp, Artificial Sequence
  Description of Artificial Sequence: Synthetic oligonucleotide
tggcgatgctgagcgccccggt

SEQ ID NO: 402442 - DNA, 21 bp, Artificial Sequence
  Description of Artificial Sequence: Synthetic oligonucleotide
ggcgatgctgagcgccccggt

SEQ ID NO: 402443 - DNA, 21 bp, Artificial Sequence
  Description of Artificial Sequence: Synthetic oligonucleotide
gcgatgctgagcgccccggtg

SEQ ID NO: 402444 - DNA, 21 bp, Artificial Sequence
  Description of Artificial Sequence: Synthetic oligonucleotide
cgatgctgagcgccccggtgg

SEQ ID NO: 402445 - DNA, 22 bp, Artificial Sequence
  Description of Artificial Sequence: Synthetic oligonucleotide
gatgctgagcgccccggtggct

SEQ ID NO: 402446 - DNA, 23 bp, Artificial Sequence
  Description of Artificial Sequence: Synthetic oligonucleotide
atgctgagcgccccggtggctga

SEQ ID NO: 402447 - DNA, 22 bp, Artificial Sequence
  Description of Artificial Sequence: Synthetic oligonucleotide
tgctgagcgccccggtggctga

SEQ ID NO: 402448 - DNA, 21 bp, Artificial Sequence
  Description of Artificial Sequence: Synthetic oligonucleotide
gctgagcgccccggtggctga

SEQ ID NO: 402449 - DNA, 21 bp, Artificial Sequence
  Description of Artificial Sequence: Synthetic oligonucleotide
ctgagcgccccggtggctgag

SEQ ID NO: 402450 - DNA, 21 bp, Artificial Sequence
  Description of Artificial Sequence: Synthetic oligonucleotide
tgagcgccccggtggctgagg

SEQ ID NO: 402451 - DNA, 20 bp, Artificial Sequence
  Description of Artificial Sequence: Synthetic oligonucleotide
gagcgccccggtggctgagg

SEQ ID NO: 402452 - DNA, 20 bp, Artificial Sequence
  Description of Artificial Sequence: Synthetic oligonucleotide
agcgccccggtggctgaggg

SEQ ID NO: 402453 - DNA, 20 bp, Artificial Sequence
  Description of Artificial Sequence: Synthetic oligonucleotide
gcgccccggtggctgagggt

SEQ ID NO: 402454 - DNA, 20 bp, Artificial Sequence
  Description of Artificial Sequence: Synthetic oligonucleotide
cgccccggtggctgagggca

SEQ ID NO: 402455 - DNA, 21 bp, Artificial Sequence
  Description of Artificial Sequence: Synthetic oligonucleotide
gccccggtggctgagggcaga

SEQ ID NO: 402456 - DNA, 29 bp, Artificial Sequence
  Description of Artificial Sequence: Synthetic oligonucleotide
gcagagactctcccgaggatttcgtgttc

SEQ ID NO: 402457 - DNA, 29 bp, Artificial Sequence
  Description of Artificial Sequence: Synthetic oligonucleotide
cagagactctcccgaggatttcgtgttcc

SEQ ID NO: 402458 - DNA, 30 bp, Artificial Sequence; identical to SEQ ID NO: 60288
  Description of Artificial Sequence: Synthetic oligonucleotide

SEQ ID NO: 402459 - DNA, 29 bp, Artificial Sequence
  Description of Artificial Sequence: Synthetic oligonucleotide
gagactctcccgaggatttcgtgttccag

SEQ ID NO: 402460 - DNA, 34 bp, Artificial Sequence; identical to SEQ ID NO: 60290
  Description of Artificial Sequence: Synthetic oligonucleotide

SEQ ID NO: 402461 - DNA, 33 bp, Artificial Sequence; identical to SEQ ID NO: 60291
  Description of Artificial Sequence: Synthetic oligonucleotide

SEQ ID NO: 402462 - DNA, 33 bp, Artificial Sequence; identical to SEQ ID NO: 60292
  Description of Artificial Sequence: Synthetic oligonucleotide

SEQ ID NO: 402463 - DNA, 32 bp, Artificial Sequence; identical to SEQ ID NO: 60293
  Description of Artificial Sequence: Synthetic oligonucleotide

SEQ ID NO: 402464 - DNA, 32 bp, Artificial Sequence; identical to SEQ ID NO: 60294
  Description of Artificial Sequence: Synthetic oligonucleotide

SEQ ID NO: 402465 - DNA, 31 bp, Artificial Sequence; identical to SEQ ID NO: 60295
  Description of Artificial Sequence: Synthetic oligonucleotide

SEQ ID NO: 402466 - DNA, 31 bp, Artificial Sequence; identical to SEQ ID NO: 60296
  Description of Artificial Sequence: Synthetic oligonucleotide

SEQ ID NO: 402467 - DNA, 30 bp, Artificial Sequence; identical to SEQ ID NO: 60297
  Description of Artificial Sequence: Synthetic oligonucleotide

SEQ ID NO: 402468 - DNA, 32 bp, Artificial Sequence; identical to SEQ ID NO: 60298
  Description of Artificial Sequence: Synthetic oligonucleotide

SEQ ID NO: 402469 - DNA, 33 bp, Artificial Sequence; identical to SEQ ID NO: 60299
  Description of Artificial Sequence: Synthetic oligonucleotide

SEQ ID NO: 402470 - DNA, 33 bp, Artificial Sequence; identical to SEQ ID NO: 60300
  Description of Artificial Sequence: Synthetic oligonucleotide

SEQ ID NO: 402471 - DNA, 27 bp, Artificial Sequence
  Description of Artificial Sequence: Synthetic oligonucleotide
gtgctacttcaccaacgggaccgagct

SEQ ID NO: 402472 - DNA, 27 bp, Artificial Sequence
  Description of Artificial Sequence: Synthetic oligonucleotide
tgctacttcaccaacgggaccgagctc

SEQ ID NO: 402473 - DNA, 26 bp, Artificial Sequence
  Description of Artificial Sequence: Synthetic oligonucleotide
gctacttcaccaacgggaccgagctc

SEQ ID NO: 402474 - DNA, 27 bp, Artificial Sequence
  Description of Artificial Sequence: Synthetic oligonucleotide
ctacttcaccaacgggaccgagctcgt

SEQ ID NO: 402475 - DNA, 27 bp, Artificial Sequence
  Description of Artificial Sequence: Synthetic oligonucleotide
tacttcaccaacgggaccgagctcgtg

SEQ ID NO: 402476 - DNA, 26 bp, Artificial Sequence
  Description of Artificial Sequence: Synthetic oligonucleotide
acttcaccaacgggaccgagctcgtg

SEQ ID NO: 402477 - DNA, 25 bp, Artificial Sequence
  Description of Artificial Sequence: Synthetic oligonucleotide
cttcaccaacgggaccgagctcgtg

SEQ ID NO: 402478 - DNA, 25 bp, Artificial Sequence
  Description of Artificial Sequence: Synthetic oligonucleotide
ttcaccaacgggaccgagctcgtgc

SEQ ID NO: 402479 - DNA, 24 bp, Artificial Sequence
  Description of Artificial Sequence: Synthetic oligonucleotide
tcaccaacgggaccgagctcgtgc

SEQ ID NO: 402480 - DNA, 23 bp, Artificial Sequence
  Description of Artificial Sequence: Synthetic oligonucleotide
caccaacgggaccgagctcgtgc

SEQ ID NO: 402481 - DNA, 23 bp, Artificial Sequence
  Description of Artificial Sequence: Synthetic oligonucleotide
accaacgggaccgagctcgtgcg

SEQ ID NO: 402482 - DNA, 22 bp, Artificial Sequence
  Description of Artificial Sequence: Synthetic oligonucleotide
ccaacgggaccgagctcgtgcg

SEQ ID NO: 402483 - DNA, 22 bp, Artificial Sequence
  Description of Artificial Sequence: Synthetic oligonucleotide
caacgggaccgagctcgtgcgg

SEQ ID NO: 402484 - DNA, 22 bp, Artificial Sequence
  Description of Artificial Sequence: Synthetic oligonucleotide
aacgggaccgagctcgtgcggg

SEQ ID NO: 402485 - DNA, 21 bp, Artificial Sequence
  Description of Artificial Sequence: Synthetic oligonucleotide
acgggaccgagctcgtgcggg

SEQ ID NO: 402486 - DNA, 20 bp, Artificial Sequence
  Description of Artificial Sequence: Synthetic oligonucleotide
cgggaccgagctcgtgcggg

SEQ ID NO: 402487 - DNA, 21 bp, Artificial Sequence
  Description of Artificial Sequence: Synthetic oligonucleotide
gggaccgagctcgtgcggggt

SEQ ID NO: 402488 - DNA, 22 bp, Artificial Sequence
  Description of Artificial Sequence: Synthetic oligonucleotide
ggaccgagctcgtgcggggtgt

SEQ ID NO: 402489 - DNA, 23 bp, Artificial Sequence
  Description of Artificial Sequence: Synthetic oligonucleotide
gaccgagctcgtgcggggtgtga

SEQ ID NO: 402490 - DNA, 23 bp, Artificial Sequence
  Description of Artificial Sequence: Synthetic oligonucleotide
accgagctcgtgcggggtgtgac

SEQ ID NO: 402491 - DNA, 22 bp, Artificial Sequence
  Description of Artificial Sequence: Synthetic oligonucleotide
ccgagctcgtgcggggtgtgac

SEQ ID NO: 402492 - DNA, 23 bp, Artificial Sequence
  Description of Artificial Sequence: Synthetic oligonucleotide
cgagctcgtgcggggtgtgacca

SEQ ID NO: 402493 - DNA, 26 bp, Artificial Sequence
  Description of Artificial Sequence: Synthetic oligonucleotide
gagctcgtgcggggtgtgaccagata

SEQ ID NO: 402494 - DNA, 27 bp, Artificial Sequence
  Description of Artificial Sequence: Synthetic oligonucleotide
agctcgtgcggggtgtgaccagataca

SEQ ID NO: 402495 - DNA, 27 bp, Artificial Sequence
  Description of Artificial Sequence: Synthetic oligonucleotide
gctcgtgcggggtgtgaccagatacat

SEQ ID NO: 402496 - DNA, 27 bp, Artificial Sequence
  Description of Artificial Sequence: Synthetic oligonucleotide
ctcgtgcggggtgtgaccagatacatc

SEQ ID NO: 402497 - DNA, 32 bp, Artificial Sequence; identical to SEQ ID NO: 60340
  Description of Artificial Sequence: Synthetic oligonucleotide

SEQ ID NO: 402498 - DNA, 23 bp, Artificial Sequence
  Description of Artificial Sequence: Synthetic oligonucleotide
tggaggaggaccgggcgtcggtt

SEQ ID NO: 402499 - DNA, 22 bp, Artificial Sequence
  Description of Artificial Sequence: Synthetic oligonucleotide
ggaggaggaccgggcgtcggtt

SEQ ID NO: 402500 - DNA, 23 bp, Artificial Sequence
  Description of Artificial Sequence: Synthetic oligonucleotide
gaggaggaccgggcgtcggttga

SEQ ID NO: 402501 - DNA, 24 bp, Artificial Sequence
  Description of Artificial Sequence: Synthetic oligonucleotide
aggaggaccgggcgtcggttgaca

SEQ ID NO: 402502 - DNA, 23 bp, Artificial Sequence
  Description of Artificial Sequence: Synthetic oligonucleotide
ggaggaccgggcgtcggttgaca

SEQ ID NO: 402503 - DNA, 23 bp, Artificial Sequence
  Description of Artificial Sequence: Synthetic oligonucleotide
gaggaccgggcgtcggttgacac

SEQ ID NO: 402504 - DNA, 23 bp, Artificial Sequence
  Description of Artificial Sequence: Synthetic oligonucleotide
aggaccgggcgtcggttgacacc

SEQ ID NO: 402505 - DNA, 22 bp, Artificial Sequence
  Description of Artificial Sequence: Synthetic oligonucleotide
ggaccgggcgtcggttgacacc

SEQ ID NO: 402506 - DNA, 25 bp, Artificial Sequence
  Description of Artificial Sequence: Synthetic oligonucleotide
gaccgggcgtcggttgacaccgtat

SEQ ID NO: 402507 - DNA, 25 bp, Artificial Sequence
  Description of Artificial Sequence: Synthetic oligonucleotide
accgggcgtcggttgacaccgtatg

SEQ ID NO: 402508 - DNA, 24 bp, Artificial Sequence
  Description of Artificial Sequence: Synthetic oligonucleotide
ccgggcgtcggttgacaccgtatg

SEQ ID NO: 402509 - DNA, 25 bp, Artificial Sequence
  Description of Artificial Sequence: Synthetic oligonucleotide
cgggcgtcggttgacaccgtatgca

SEQ ID NO: 402510 - DNA, 26 bp, Artificial Sequence
  Description of Artificial Sequence: Synthetic oligonucleotide
gggcgtcggttgacaccgtatgcaga

SEQ ID NO: 402511 - DNA, 27 bp, Artificial Sequence
  Description of Artificial Sequence: Synthetic oligonucleotide
ggcgtcggttgacaccgtatgcagaca

SEQ ID NO: 402512 - DNA, 27 bp, Artificial Sequence
  Description of Artificial Sequence: Synthetic oligonucleotide
gcgtcggttgacaccgtatgcagacac

SEQ ID NO: 402513 - DNA, 29 bp, Artificial Sequence
  Description of Artificial Sequence: Synthetic oligonucleotide
cgtcggttgacaccgtatgcagacacaac

SEQ ID NO: 402514 - DNA, 31 bp, Artificial Sequence; identical to SEQ ID NO: 60357
  Description of Artificial Sequence: Synthetic oligonucleotide

SEQ ID NO: 402515 - DNA, 31 bp, Artificial Sequence; identical to SEQ ID NO: 60358
  Description of Artificial Sequence: Synthetic oligonucleotide

SEQ ID NO: 402516 - DNA, 30 bp, Artificial Sequence; identical to SEQ ID NO: 60359
  Description of Artificial Sequence: Synthetic oligonucleotide

SEQ ID NO: 402517 - DNA, 31 bp, Artificial Sequence; identical to SEQ ID NO: 60360
  Description of Artificial Sequence: Synthetic oligonucleotide

SEQ ID NO: 402518 - DNA, 33 bp, Artificial Sequence; identical to SEQ ID NO: 60361
  Description of Artificial Sequence: Synthetic oligonucleotide

SEQ ID NO: 402519 - DNA, 33 bp, Artificial Sequence; identical to SEQ ID NO: 60362
  Description of Artificial Sequence: Synthetic oligonucleotide

SEQ ID NO: 402520 - DNA, 32 bp, Artificial Sequence; identical to SEQ ID NO: 60363
  Description of Artificial Sequence: Synthetic oligonucleotide

SEQ ID NO: 402521 - DNA, 23 bp, Artificial Sequence
  Description of Artificial Sequence: Synthetic oligonucleotide
accaacgggacagagcgcgtgcg

SEQ ID NO: 402522 - DNA, 22 bp, Artificial Sequence
  Description of Artificial Sequence: Synthetic oligonucleotide
ccaacgggacagagcgcgtgcg

SEQ ID NO: 402523 - DNA, 22 bp, Artificial Sequence
  Description of Artificial Sequence: Synthetic oligonucleotide
caacgggacagagcgcgtgcgg

SEQ ID NO: 402524 - DNA, 22 bp, Artificial Sequence
  Description of Artificial Sequence: Synthetic oligonucleotide
aacgggacagagcgcgtgcggg

SEQ ID NO: 402525 - DNA, 21 bp, Artificial Sequence
  Description of Artificial Sequence: Synthetic oligonucleotide
acgggacagagcgcgtgcggg

SEQ ID NO: 402526 - DNA, 20 bp, Artificial Sequence
  Description of Artificial Sequence: Synthetic oligonucleotide
cgggacagagcgcgtgcggg

SEQ ID NO: 402527 - DNA, 21 bp, Artificial Sequence
  Description of Artificial Sequence: Synthetic oligonucleotide
gggacagagcgcgtgcggggt

SEQ ID NO: 402528 - DNA, 22 bp, Artificial Sequence
  Description of Artificial Sequence: Synthetic oligonucleotide
ggacagagcgcgtgcggggtgt

SEQ ID NO: 402529 - DNA, 23 bp, Artificial Sequence
  Description of Artificial Sequence: Synthetic oligonucleotide
gacagagcgcgtgcggggtgtga

SEQ ID NO: 402530 - DNA, 23 bp, Artificial Sequence
  Description of Artificial Sequence: Synthetic oligonucleotide
acagagcgcgtgcggggtgtgac

SEQ ID NO: 402531 - DNA, 22 bp, Artificial Sequence
  Description of Artificial Sequence: Synthetic oligonucleotide
cagagcgcgtgcggggtgtgac

SEQ ID NO: 402532 - DNA, 23 bp, Artificial Sequence
  Description of Artificial Sequence: Synthetic oligonucleotide
agagcgcgtgcggggtgtgacca

SEQ ID NO: 402533 - DNA, 22 bp, Artificial Sequence
  Description of Artificial Sequence: Synthetic oligonucleotide
caacgggaccgagcgcgtgcgt

SEQ ID NO: 402534 - DNA, 24 bp, Artificial Sequence
  Description of Artificial Sequence: Synthetic oligonucleotide
aacgggaccgagcgcgtgcgtctt

SEQ ID NO: 402535 - DNA, 23 bp, Artificial Sequence
  Description of Artificial Sequence: Synthetic oligonucleotide
acgggaccgagcgcgtgcgtctt

SEQ ID NO: 402536 - DNA, 22 bp, Artificial Sequence
  Description of Artificial Sequence: Synthetic oligonucleotide
cgggaccgagcgcgtgcgtctt

SEQ ID NO: 402537 - DNA, 23 bp, Artificial Sequence
  Description of Artificial Sequence: Synthetic oligonucleotide
gggaccgagcgcgtgcgtcttgt

SEQ ID NO: 402538 - DNA, 24 bp, Artificial Sequence
  Description of Artificial Sequence: Synthetic oligonucleotide
ggaccgagcgcgtgcgtcttgtga

SEQ ID NO: 402539 - DNA, 24 bp, Artificial Sequence
  Description of Artificial Sequence: Synthetic oligonucleotide
gaccgagcgcgtgcgtcttgtgac

SEQ ID NO: 402540 - DNA, 25 bp, Artificial Sequence
  Description of Artificial Sequence: Synthetic oligonucleotide
accgagcgcgtgcgtcttgtgacca

SEQ ID NO: 402541 - DNA, 24 bp, Artificial Sequence
  Description of Artificial Sequence: Synthetic oligonucleotide
ccgagcgcgtgcgtcttgtgacca

SEQ ID NO: 402542 - DNA, 27 bp, Artificial Sequence
  Description of Artificial Sequence: Synthetic oligonucleotide
cgagcgcgtgcgtcttgtgaccagata

SEQ ID NO: 402543 - DNA, 20 bp, Artificial Sequence
  Description of Artificial Sequence: Synthetic oligonucleotide
gcggtgacgccgctggggtg

SEQ ID NO: 402544 - DNA, 20 bp, Artificial Sequence
  Description of Artificial Sequence: Synthetic oligonucleotide
cggtgacgccgctggggtgg

SEQ ID NO: 402545 - DNA, 22 bp, Artificial Sequence
  Description of Artificial Sequence: Synthetic oligonucleotide
ggtgacgccgctggggtggctt

SEQ ID NO: 402546 - DNA, 23 bp, Artificial Sequence
  Description of Artificial Sequence: Synthetic oligonucleotide
gtgacgccgctggggtggcttga

SEQ ID NO: 402547 - DNA, 23 bp, Artificial Sequence
  Description of Artificial Sequence: Synthetic oligonucleotide
tgacgccgctggggtggcttgac

SEQ ID NO: 402548 - DNA, 22 bp, Artificial Sequence
  Description of Artificial Sequence: Synthetic oligonucleotide
gacgccgctggggtggcttgac

SEQ ID NO: 402549 - DNA, 22 bp, Artificial Sequence
  Description of Artificial Sequence: Synthetic oligonucleotide
acgccgctggggtggcttgacg

SEQ ID NO: 402550 - DNA, 21 bp, Artificial Sequence
  Description of Artificial Sequence: Synthetic oligonucleotide
cgccgctggggtggcttgacg

SEQ ID NO: 402551 - DNA, 21 bp, Artificial Sequence
  Description of Artificial Sequence: Synthetic oligonucleotide
gccgctggggtggcttgacgc

SEQ ID NO: 402552 - DNA, 21 bp, Artificial Sequence
  Description of Artificial Sequence: Synthetic oligonucleotide
ccgctggggtggcttgacgcc

SEQ ID NO: 402553 - DNA, 22 bp, Artificial Sequence
  Description of Artificial Sequence: Synthetic oligonucleotide
cgctggggtggcttgacgccga

SEQ ID NO: 402554 - DNA, 24 bp, Artificial Sequence
  Description of Artificial Sequence: Synthetic oligonucleotide
gctggggtggcttgacgccgagta

SEQ ID NO: 402555 - DNA, 25 bp, Artificial Sequence
  Description of Artificial Sequence: Synthetic oligonucleotide
ctggggtggcttgacgccgagtact

SEQ ID NO: 402556 - DNA, 25 bp, Artificial Sequence
  Description of Artificial Sequence: Synthetic oligonucleotide
tggggtggcttgacgccgagtactg

SEQ ID NO: 402557 - DNA, 24 bp, Artificial Sequence
  Description of Artificial Sequence: Synthetic oligonucleotide
ggggtggcttgacgccgagtactg

SEQ ID NO: 402558 - DNA, 27 bp, Artificial Sequence
  Description of Artificial Sequence: Synthetic oligonucleotide
gggtggcttgacgccgagtactggaat

SEQ ID NO: 402559 - DNA, 28 bp, Artificial Sequence
  Description of Artificial Sequence: Synthetic oligonucleotide
ggtggcttgacgccgagtactggaatag

SEQ ID NO: 402560 - DNA, 28 bp, Artificial Sequence
  Description of Artificial Sequence: Synthetic oligonucleotide
gtggcttgacgccgagtactggaatagc

SEQ ID NO: 402561 - DNA, 28 bp, Artificial Sequence
  Description of Artificial Sequence: Synthetic oligonucleotide
tggcttgacgccgagtactggaatagcc

SEQ ID NO: 402562 - DNA, 27 bp, Artificial Sequence
  Description of Artificial Sequence: Synthetic oligonucleotide
aggaggagacaactggcgttgtgtccg

SEQ ID NO: 402563 - DNA, 26 bp, Artificial Sequence
  Description of Artificial Sequence: Synthetic oligonucleotide
ggaggagacaactggcgttgtgtccg

SEQ ID NO: 402564 - DNA, 26 bp, Artificial Sequence
  Description of Artificial Sequence: Synthetic oligonucleotide
gaggagacaactggcgttgtgtccgc

SEQ ID NO: 402565 - DNA, 26 bp, Artificial Sequence
  Description of Artificial Sequence: Synthetic oligonucleotide
aggagacaactggcgttgtgtccgcc

SEQ ID NO: 402566 - DNA, 25 bp, Artificial Sequence
  Description of Artificial Sequence: Synthetic oligonucleotide
ggagacaactggcgttgtgtccgcc

SEQ ID NO: 402567 - DNA, 25 bp, Artificial Sequence
  Description of Artificial Sequence: Synthetic oligonucleotide
gagacaactggcgttgtgtccgccc

SEQ ID NO: 402568 - DNA, 25 bp, Artificial Sequence
  Description of Artificial Sequence: Synthetic oligonucleotide
agacaactggcgttgtgtccgcccc

SEQ ID NO: 402569 - DNA, 24 bp, Artificial Sequence
  Description of Artificial Sequence: Synthetic oligonucleotide
gacaactggcgttgtgtccgcccc

SEQ ID NO: 402570 - DNA, 24 bp, Artificial Sequence
  Description of Artificial Sequence: Synthetic oligonucleotide
acaactggcgttgtgtccgccccc

SEQ ID NO: 402571 - DNA, 23 bp, Artificial Sequence
  Description of Artificial Sequence: Synthetic oligonucleotide
caactggcgttgtgtccgccccc

SEQ ID NO: 402572 - DNA, 27 bp, Artificial Sequence
  Description of Artificial Sequence: Synthetic oligonucleotide
aactggcgttgtgtccgccccccttat

SEQ ID NO: 402573 - DNA, 27 bp, Artificial Sequence
  Description of Artificial Sequence: Synthetic oligonucleotide
actggcgttgtgtccgccccccttatt

SEQ ID NO: 402574 - DNA, 27 bp, Artificial Sequence
  Description of Artificial Sequence: Synthetic oligonucleotide
ctggcgttgtgtccgccccccttatta

SEQ ID NO: 402575 - DNA, 27 bp, Artificial Sequence
  Description of Artificial Sequence: Synthetic oligonucleotide
tggcgttgtgtccgccccccttattag

SEQ ID NO: 402576 - DNA, 26 bp, Artificial Sequence
  Description of Artificial Sequence: Synthetic oligonucleotide
ggcgttgtgtccgccccccttattag

SEQ ID NO: 402577 - DNA, 27 bp, Artificial Sequence
  Description of Artificial Sequence: Synthetic oligonucleotide
gcgttgtgtccgccccccttattagga

SEQ ID NO: 402578 - DNA, 28 bp, Artificial Sequence
  Description of Artificial Sequence: Synthetic oligonucleotide
cgttgtgtccgccccccttattaggaac

SEQ ID NO: 402579 - DNA, 28 bp, Artificial Sequence
  Description of Artificial Sequence: Synthetic oligonucleotide
gttgtgtccgccccccttattaggaacg

SEQ ID NO: 402580 - DNA, 28 bp, Artificial Sequence
  Description of Artificial Sequence: Synthetic oligonucleotide
ttgtgtccgccccccttattaggaacgg

SEQ ID NO: 402581 - DNA, 27 bp, Artificial Sequence
  Description of Artificial Sequence: Synthetic oligonucleotide
tgtgtccgccccccttattaggaacgg

SEQ ID NO: 402582 - DNA, 27 bp, Artificial Sequence
  Description of Artificial Sequence: Synthetic oligonucleotide
gtgtccgccccccttattaggaacggt

SEQ ID NO: 402583 - DNA, 27 bp, Artificial Sequence
  Description of Artificial Sequence: Synthetic oligonucleotide
tgtccgccccccttattaggaacggtg

SEQ ID NO: 402584 - DNA, 27 bp, Artificial Sequence
  Description of Artificial Sequence: Synthetic oligonucleotide
gtccgccccccttattaggaacggtga

SEQ ID NO: 402585 - DNA, 27 bp, Artificial Sequence
  Description of Artificial Sequence: Synthetic oligonucleotide
tccgccccccttattaggaacggtgac

SEQ ID NO: 402586 - DNA, 27 bp, Artificial Sequence
  Description of Artificial Sequence: Synthetic oligonucleotide
ccgccccccttattaggaacggtgact

SEQ ID NO: 402587 - DNA, 27 bp, Artificial Sequence
  Description of Artificial Sequence: Synthetic oligonucleotide
cgccccccttattaggaacggtgactg

SEQ ID NO: 402588 - DNA, 27 bp, Artificial Sequence
  Description of Artificial Sequence: Synthetic oligonucleotide
gccccccttattaggaacggtgactgg

SEQ ID NO: 402589 - DNA, 35 bp, Artificial Sequence
  Description of Artificial Sequence: Synthetic oligonucleotide
ttctaagacctttgctcttctccccaggacttaag

SEQ ID NO: 402590 - DNA, 34 bp, Artificial Sequence
  Description of Artificial Sequence: Synthetic oligonucleotide
tctaagacctttgctcttctccccaggacttaag

SEQ ID NO: 402591 - DNA, 33 bp, Artificial Sequence
  Description of Artificial Sequence: Synthetic oligonucleotide
ctaagacctttgctcttctccccaggacttaag

SEQ ID NO: 402592 - DNA, 33 bp, Artificial Sequence
  Description of Artificial Sequence: Synthetic oligonucleotide
taagacctttgctcttctccccaggacttaagg

SEQ ID NO: 402593 - DNA, 32 bp, Artificial Sequence
  Description of Artificial Sequence: Synthetic oligonucleotide
aagacctttgctcttctccccaggacttaagg

SEQ ID NO: 402594 - DNA, 31 bp, Artificial Sequence
  Description of Artificial Sequence: Synthetic oligonucleotide
agacctttgctcttctccccaggacttaagg

SEQ ID NO: 402595 - DNA, 30 bp, Artificial Sequence
  Description of Artificial Sequence: Synthetic oligonucleotide
gacctttgctcttctccccaggacttaagg

SEQ ID NO: 402596 - DNA, 30 bp, Artificial Sequence
  Description of Artificial Sequence: Synthetic oligonucleotide
acctttgctcttctccccaggacttaaggc

SEQ ID NO: 402597 - DNA, 29 bp, Artificial Sequence
  Description of Artificial Sequence: Synthetic oligonucleotide
cctttgctcttctccccaggacttaaggc

SEQ ID NO: 402598 - DNA, 30 bp, Artificial Sequence
  Description of Artificial Sequence: Synthetic oligonucleotide
ctttgctcttctccccaggacttaaggctc

SEQ ID NO: 402599 - DNA, 32 bp, Artificial Sequence
  Description of Artificial Sequence: Synthetic oligonucleotide
tttgctcttctccccaggacttaaggctcttc

SEQ ID NO: 402600 - DNA, 31 bp, Artificial Sequence
  Description of Artificial Sequence: Synthetic oligonucleotide
ttgctcttctccccaggacttaaggctcttc

SEQ ID NO: 402601 - DNA, 30 bp, Artificial Sequence
  Description of Artificial Sequence: Synthetic oligonucleotide
tgctcttctccccaggacttaaggctcttc

SEQ ID NO: 402602 - DNA, 29 bp, Artificial Sequence
  Description of Artificial Sequence: Synthetic oligonucleotide
gctcttctccccaggacttaaggctcttc

SEQ ID NO: 402603 - DNA, 30 bp, Artificial Sequence
  Description of Artificial Sequence: Synthetic oligonucleotide
ctcttctccccaggacttaaggctcttcag

SEQ ID NO: 402604 - DNA, 30 bp, Artificial Sequence
  Description of Artificial Sequence: Synthetic oligonucleotide
tcttctccccaggacttaaggctcttcagc

SEQ ID NO: 402605 - DNA, 29 bp, Artificial Sequence
  Description of Artificial Sequence: Synthetic oligonucleotide
cttctccccaggacttaaggctcttcagc

SEQ ID NO: 402606 - DNA, 29 bp, Artificial Sequence
  Description of Artificial Sequence: Synthetic oligonucleotide
ttctccccaggacttaaggctcttcagcg

SEQ ID NO: 402607 - DNA, 28 bp, Artificial Sequence
  Description of Artificial Sequence: Synthetic oligonucleotide
tctccccaggacttaaggctcttcagcg

SEQ ID NO: 402608 - DNA, 27 bp, Artificial Sequence
  Description of Artificial Sequence: Synthetic oligonucleotide
ctccccaggacttaaggctcttcagcg

SEQ ID NO: 402609 - DNA, 28 bp, Artificial Sequence
  Description of Artificial Sequence: Synthetic oligonucleotide
tccccaggacttaaggctcttcagcgtg

SEQ ID NO: 402610 - DNA, 27 bp, Artificial Sequence
  Description of Artificial Sequence: Synthetic oligonucleotide
ccccaggacttaaggctcttcagcgtg

SEQ ID NO: 402611 - DNA, 28 bp, Artificial Sequence
  Description of Artificial Sequence: Synthetic oligonucleotide
cccaggacttaaggctcttcagcgtgtc

SEQ ID NO: 402612 - DNA, 31 bp, Artificial Sequence
  Description of Artificial Sequence: Synthetic oligonucleotide
ccaggacttaaggctcttcagcgtgtctaag

SEQ ID NO: 402613 - DNA, 32 bp, Artificial Sequence
  Description of Artificial Sequence: Synthetic oligonucleotide
caggacttaaggctcttcagcgtgtctaagac

SEQ ID NO: 402614 - DNA, 34 bp, Artificial Sequence
  Description of Artificial Sequence: Synthetic oligonucleotide
aggacttaaggctcttcagcgtgtctaagacaac

SEQ ID NO: 402615 - DNA, 33 bp, Artificial Sequence
  Description of Artificial Sequence: Synthetic oligonucleotide
ggacttaaggctcttcagcgtgtctaagacaac

SEQ ID NO: 402616 - DNA, 34 bp, Artificial Sequence
  Description of Artificial Sequence: Synthetic oligonucleotide
gacttaaggctcttcagcgtgtctaagacaacag

SEQ ID NO: 402617 - DNA, 34 bp, Artificial Sequence
  Description of Artificial Sequence: Synthetic oligonucleotide
acttaaggctcttcagcgtgtctaagacaacagc

SEQ ID NO: 402618 - DNA, 33 bp, Artificial Sequence
  Description of Artificial Sequence: Synthetic oligonucleotide
cttaaggctcttcagcgtgtctaagacaacagc

SEQ ID NO: 402619 - DNA, 34 bp, Artificial Sequence
  Description of Artificial Sequence: Synthetic oligonucleotide
ttaaggctcttcagcgtgtctaagacaacagcag

SEQ ID NO: 402620 - DNA, 33 bp, Artificial Sequence
  Description of Artificial Sequence: Synthetic oligonucleotide
taaggctcttcagcgtgtctaagacaacagcag

SEQ ID NO: 402621 - DNA, 32 bp, Artificial Sequence
  Description of Artificial Sequence: Synthetic oligonucleotide
aaggctcttcagcgtgtctaagacaacagcag

SEQ ID NO: 402622 - DNA, 31 bp, Artificial Sequence
  Description of Artificial Sequence: Synthetic oligonucleotide
aggctcttcagcgtgtctaagacaacagcag

SEQ ID NO: 402623 - DNA, 30 bp, Artificial Sequence
  Description of Artificial Sequence: Synthetic oligonucleotide
ggctcttcagcgtgtctaagacaacagcag

SEQ ID NO: 402624 - DNA, 39 bp, Artificial Sequence
  Description of Artificial Sequence: Synthetic oligonucleotide
gctcttcagcgtgtctaagacaacagcagtaaaaatttc

SEQ ID NO: 402625 - DNA, 40 bp, Artificial Sequence
  Description of Artificial Sequence: Synthetic oligonucleotide
ctcttcagcgtgtctaagacaacagcagtaaaaatttctg

SEQ ID NO: 402626 - DNA, 41 bp, Artificial Sequence
  Description of Artificial Sequence: Synthetic oligonucleotide
tcttcagcgtgtctaagacaacagcagtaaaaatttctgtg

SEQ ID NO: 402627 - DNA, 40 bp, Artificial Sequence
  Description of Artificial Sequence: Synthetic oligonucleotide
cttcagcgtgtctaagacaacagcagtaaaaatttctgtg

SEQ ID NO: 402628 - DNA, 41 bp, Artificial Sequence
  Description of Artificial Sequence: Synthetic oligonucleotide
ttcagcgtgtctaagacaacagcagtaaaaatttctgtgac

SEQ ID NO: 402629 - DNA, 40 bp, Artificial Sequence
  Description of Artificial Sequence: Synthetic oligonucleotide
tcagcgtgtctaagacaacagcagtaaaaatttctgtgac

SEQ ID NO: 402630 - DNA, 39 bp, Artificial Sequence
  Description of Artificial Sequence: Synthetic oligonucleotide
cagcgtgtctaagacaacagcagtaaaaatttctgtgac

SEQ ID NO: 402631 - DNA, 40 bp, Artificial Sequence
  Description of Artificial Sequence: Synthetic oligonucleotide
agcgtgtctaagacaacagcagtaaaaatttctgtgacag

SEQ ID NO: 402632 - DNA, 39 bp, Artificial Sequence
  Description of Artificial Sequence: Synthetic oligonucleotide
gcgtgtctaagacaacagcagtaaaaatttctgtgacag

SEQ ID NO: 402633 - DNA, 39 bp, Artificial Sequence
  Description of Artificial Sequence: Synthetic oligonucleotide
cgtgtctaagacaacagcagtaaaaatttctgtgacagc

SEQ ID NO: 402634 - DNA, 45 bp, Artificial Sequence
  Description of Artificial Sequence: Synthetic oligonucleotide
gtgtctaagacaacagcagtaaaaatttctgtgacagcaattttc

SEQ ID NO: 402635 - DNA, 46 bp, Artificial Sequence
  Description of Artificial Sequence: Synthetic oligonucleotide
tgtctaagacaacagcagtaaaaatttctgtgacagcaattttctc

SEQ ID NO: 402636 - DNA, 45 bp, Artificial Sequence
  Description of Artificial Sequence: Synthetic oligonucleotide
gtctaagacaacagcagtaaaaatttctgtgacagcaattttctc

SEQ ID NO: 402637 - DNA, 46 bp, Artificial Sequence
  Description of Artificial Sequence: Synthetic oligonucleotide
tctaagacaacagcagtaaaaatttctgtgacagcaattttctctc

SEQ ID NO: 402638 - DNA, 45 bp, Artificial Sequence
  Description of Artificial Sequence: Synthetic oligonucleotide
ctaagacaacagcagtaaaaatttctgtgacagcaattttctctc

SEQ ID NO: 402639 - DNA, 45 bp, Artificial Sequence
  Description of Artificial Sequence: Synthetic oligonucleotide
taagacaacagcagtaaaaatttctgtgacagcaattttctctcc

SEQ ID NO: 402640 - DNA, 44 bp, Artificial Sequence
  Description of Artificial Sequence: Synthetic oligonucleotide
aagacaacagcagtaaaaatttctgtgacagcaattttctctcc

SEQ ID NO: 402641 - DNA, 43 bp, Artificial Sequence
  Description of Artificial Sequence: Synthetic oligonucleotide
agacaacagcagtaaaaatttctgtgacagcaattttctctcc

SEQ ID NO: 402642 - DNA, 42 bp, Artificial Sequence
  Description of Artificial Sequence: Synthetic oligonucleotide
gacaacagcagtaaaaatttctgtgacagcaattttctctcc

SEQ ID NO: 402643 - DNA, 42 bp, Artificial Sequence
  Description of Artificial Sequence: Synthetic oligonucleotide
acaacagcagtaaaaatttctgtgacagcaattttctctccc

SEQ ID NO: 402644 - DNA, 41 bp, Artificial Sequence
  Description of Artificial Sequence: Synthetic oligonucleotide
caacagcagtaaaaatttctgtgacagcaattttctctccc

SEQ ID NO: 402645 - DNA, 41 bp, Artificial Sequence
  Description of Artificial Sequence: Synthetic oligonucleotide
aacagcagtaaaaatttctgtgacagcaattttctctcccc

SEQ ID NO: 402646 - DNA, 40 bp, Artificial Sequence
  Description of Artificial Sequence: Synthetic oligonucleotide
acagcagtaaaaatttctgtgacagcaattttctctcccc

SEQ ID NO: 402647 - DNA, 39 bp, Artificial Sequence
  Description of Artificial Sequence: Synthetic oligonucleotide
cagcagtaaaaatttctgtgacagcaattttctctcccc

SEQ ID NO: 402648 - DNA, 40 bp, Artificial Sequence
  Description of Artificial Sequence: Synthetic oligonucleotide
agcagtaaaaatttctgtgacagcaattttctctcccctg

SEQ ID NO: 402649 - DNA, 39 bp, Artificial Sequence
  Description of Artificial Sequence: Synthetic oligonucleotide
gcagtaaaaatttctgtgacagcaattttctctcccctg

SEQ ID NO: 402650 - DNA, 45 bp, Artificial Sequence
  Description of Artificial Sequence: Synthetic oligonucleotide
cagtaaaaatttctgtgacagcaattttctctcccctgaaatatg

SEQ ID NO: 402651 - DNA, 47 bp, Artificial Sequence
  Description of Artificial Sequence: Synthetic oligonucleotide
agtaaaaatttctgtgacagcaattttctctcccctgaaatatgatc

SEQ ID NO: 402652 - DNA, 46 bp, Artificial Sequence
  Description of Artificial Sequence: Synthetic oligonucleotide
gtaaaaatttctgtgacagcaattttctctcccctgaaatatgatc

SEQ ID NO: 402653 - DNA, 46 bp, Artificial Sequence
  Description of Artificial Sequence: Synthetic oligonucleotide
taaaaatttctgtgacagcaattttctctcccctgaaatatgatcc

SEQ ID NO: 402654 - DNA, 45 bp, Artificial Sequence
  Description of Artificial Sequence: Synthetic oligonucleotide
aaaaatttctgtgacagcaattttctctcccctgaaatatgatcc

SEQ ID NO: 402655 - DNA, 44 bp, Artificial Sequence
  Description of Artificial Sequence: Synthetic oligonucleotide
aaaatttctgtgacagcaattttctctcccctgaaatatgatcc

SEQ ID NO: 402656 - DNA, 43 bp, Artificial Sequence
  Description of Artificial Sequence: Synthetic oligonucleotide
aaatttctgtgacagcaattttctctcccctgaaatatgatcc

SEQ ID NO: 402657 - DNA, 42 bp, Artificial Sequence
  Description of Artificial Sequence: Synthetic oligonucleotide
aatttctgtgacagcaattttctctcccctgaaatatgatcc

SEQ ID NO: 402658 - DNA, 41 bp, Artificial Sequence
  Description of Artificial Sequence: Synthetic oligonucleotide
atttctgtgacagcaattttctctcccctgaaatatgatcc

SEQ ID NO: 402659 - DNA, 40 bp, Artificial Sequence
  Description of Artificial Sequence: Synthetic oligonucleotide
tttctgtgacagcaattttctctcccctgaaatatgatcc

SEQ ID NO: 402660 - DNA, 39 bp, Artificial Sequence
  Description of Artificial Sequence: Synthetic oligonucleotide
ttctgtgacagcaattttctctcccctgaaatatgatcc

SEQ ID NO: 402661 - DNA, 38 bp, Artificial Sequence
  Description of Artificial Sequence: Synthetic oligonucleotide
tctgtgacagcaattttctctcccctgaaatatgatcc

SEQ ID NO: 402662 - DNA, 37 bp, Artificial Sequence
  Description of Artificial Sequence: Synthetic oligonucleotide
ctgtgacagcaattttctctcccctgaaatatgatcc

SEQ ID NO: 402663 - DNA, 37 bp, Artificial Sequence
  Description of Artificial Sequence: Synthetic oligonucleotide
tgtgacagcaattttctctcccctgaaatatgatccc

SEQ ID NO: 402664 - DNA, 36 bp, Artificial Sequence
  Description of Artificial Sequence: Synthetic oligonucleotide
gtgacagcaattttctctcccctgaaatatgatccc

SEQ ID NO: 402665 - DNA, 35 bp, Artificial Sequence
  Description of Artificial Sequence: Synthetic oligonucleotide
agcaattttctctcccctgaaatatgatccccacc

SEQ ID NO: 402666 - DNA, 34 bp, Artificial Sequence
  Description of Artificial Sequence: Synthetic oligonucleotide
gcaattttctctcccctgaaatatgatccccacc

SEQ ID NO: 402667 - DNA, 40 bp, Artificial Sequence
  Description of Artificial Sequence: Synthetic oligonucleotide
caattttctctcccctgaaatatgatccccacctaatttg

SEQ ID NO: 402668 - DNA, 40 bp, Artificial Sequence
  Description of Artificial Sequence: Synthetic oligonucleotide
aattttctctcccctgaaatatgatccccacctaatttgc

SEQ ID NO: 402669 - DNA, 39 bp, Artificial Sequence
  Description of Artificial Sequence: Synthetic oligonucleotide
attttctctcccctgaaatatgatccccacctaatttgc

SEQ ID NO: 402670 - DNA, 38 bp, Artificial Sequence
  Description of Artificial Sequence: Synthetic oligonucleotide
ttttctctcccctgaaatatgatccccacctaatttgc

SEQ ID NO: 402671 - DNA, 37 bp, Artificial Sequence
  Description of Artificial Sequence: Synthetic oligonucleotide
tttctctcccctgaaatatgatccccacctaatttgc

SEQ ID NO: 402672 - DNA, 36 bp, Artificial Sequence
  Description of Artificial Sequence: Synthetic oligonucleotide
ttctctcccctgaaatatgatccccacctaatttgc

SEQ ID NO: 402673 - DNA, 35 bp, Artificial Sequence
  Description of Artificial Sequence: Synthetic oligonucleotide
tctctcccctgaaatatgatccccacctaatttgc

SEQ ID NO: 402674 - DNA, 34 bp, Artificial Sequence
  Description of Artificial Sequence: Synthetic oligonucleotide
ctctcccctgaaatatgatccccacctaatttgc

SEQ ID NO: 402675 - DNA, 46 bp, Artificial Sequence
  Description of Artificial Sequence: Synthetic oligonucleotide
tctcccctgaaatatgatccccacctaatttgctttattaaaaatc

SEQ ID NO: 402676 - DNA, 45 bp, Artificial Sequence
  Description of Artificial Sequence: Synthetic oligonucleotide
ctcccctgaaatatgatccccacctaatttgctttattaaaaatc

SEQ ID NO: 402677 - DNA, 45 bp, Artificial Sequence
  Description of Artificial Sequence: Synthetic oligonucleotide
tcccctgaaatatgatccccacctaatttgctttattaaaaatcc

SEQ ID NO: 402678 - DNA, 44 bp, Artificial Sequence
  Description of Artificial Sequence: Synthetic oligonucleotide
cccctgaaatatgatccccacctaatttgctttattaaaaatcc

SEQ ID NO: 402679 - DNA, 44 bp, Artificial Sequence
  Description of Artificial Sequence: Synthetic oligonucleotide
ccctgaaatatgatccccacctaatttgctttattaaaaatccc

SEQ ID NO: 402680 - DNA, 46 bp, Artificial Sequence
  Description of Artificial Sequence: Synthetic oligonucleotide
cctgaaatatgatccccacctaatttgctttattaaaaatcccaag

SEQ ID NO: 402681 - DNA, 54 bp, Artificial Sequence
  Description of Artificial Sequence: Synthetic oligonucleotide
ctgaaatatgatccccacctaatttgctttattaaaaatcccaagtataataac

SEQ ID NO: 402682 - DNA, 56 bp, Artificial Sequence
  Description of Artificial Sequence: Synthetic oligonucleotide
tgaaatatgatccccacctaatttgctttattaaaaatcccaagtataataacaac

SEQ ID NO: 402683 - DNA, 55 bp, Artificial Sequence
  Description of Artificial Sequence: Synthetic oligonucleotide
gaaatatgatccccacctaatttgctttattaaaaatcccaagtataataacaac

SEQ ID NO: 402684 - DNA, 56 bp, Artificial Sequence
  Description of Artificial Sequence: Synthetic oligonucleotide
aaatatgatccccacctaatttgctttattaaaaatcccaagtataataacaactg

SEQ ID NO: 402685 - DNA, 55 bp, Artificial Sequence
  Description of Artificial Sequence: Synthetic oligonucleotide
aatatgatccccacctaatttgctttattaaaaatcccaagtataataacaactg

SEQ ID NO: 402686 - DNA, 54 bp, Artificial Sequence
  Description of Artificial Sequence: Synthetic oligonucleotide
atatgatccccacctaatttgctttattaaaaatcccaagtataataacaactg

SEQ ID NO: 402687 - DNA, 53 bp, Artificial Sequence
  Description of Artificial Sequence: Synthetic oligonucleotide
tatgatccccacctaatttgctttattaaaaatcccaagtataataacaactg

SEQ ID NO: 402688 - DNA, 52 bp, Artificial Sequence
  Description of Artificial Sequence: Synthetic oligonucleotide
atgatccccacctaatttgctttattaaaaatcccaagtataataacaactg

SEQ ID NO: 402689 - DNA, 51 bp, Artificial Sequence
  Description of Artificial Sequence: Synthetic oligonucleotide
tgatccccacctaatttgctttattaaaaatcccaagtataataacaactg

SEQ ID NO: 402690 - DNA, 50 bp, Artificial Sequence
  Description of Artificial Sequence: Synthetic oligonucleotide
gatccccacctaatttgctttattaaaaatcccaagtataataacaactg

SEQ ID NO: 402691 - DNA, 50 bp, Artificial Sequence
  Description of Artificial Sequence: Synthetic oligonucleotide
atccccacctaatttgctttattaaaaatcccaagtataataacaactgg

SEQ ID NO: 402692 - DNA, 49 bp, Artificial Sequence
  Description of Artificial Sequence: Synthetic oligonucleotide
tccccacctaatttgctttattaaaaatcccaagtataataacaactgg

SEQ ID NO: 402693 - DNA, 48 bp, Artificial Sequence
  Description of Artificial Sequence: Synthetic oligonucleotide
ccccacctaatttgctttattaaaaatcccaagtataataacaactgg

SEQ ID NO: 402694 - DNA, 55 bp, Artificial Sequence
  Description of Artificial Sequence: Synthetic oligonucleotide
cccacctaatttgctttattaaaaatcccaagtataataacaactggtttttaac

SEQ ID NO: 402695 - DNA, 60 bp, Artificial Sequence
  Description of Artificial Sequence: Synthetic oligonucleotide
ccacctaatttgctttattaaaaatcccaagtataataacaactggtttttaacaatatt

SEQ ID NO: 402696 - DNA, 60 bp, Artificial Sequence
  Description of Artificial Sequence: Synthetic oligonucleotide
cacctaatttgctttattaaaaatcccaagtataataacaactggtttttaacaatatta

SEQ ID NO: 402697 - DNA, 60 bp, Artificial Sequence
  Description of Artificial Sequence: Synthetic oligonucleotide
acctaatttgctttattaaaaatcccaagtataataacaactggtttttaacaatattac

SEQ ID NO: 402698 - DNA, 60 bp, Artificial Sequence
  Description of Artificial Sequence: Synthetic oligonucleotide
cctaatttgctttattaaaaatcccaagtataataacaactggtttttaacaatattaca

SEQ ID NO: 402699 - DNA, 60 bp, Artificial Sequence
  Description of Artificial Sequence: Synthetic oligonucleotide
ctaatttgctttattaaaaatcccaagtataataacaactggtttttaacaatattacag

SEQ ID NO: 402700 - DNA, 60 bp, Artificial Sequence
  Description of Artificial Sequence: Synthetic oligonucleotide
taatttgctttattaaaaatcccaagtataataacaactggtttttaacaatattacaga

SEQ ID NO: 402701 - DNA, 60 bp, Artificial Sequence
  Description of Artificial Sequence: Synthetic oligonucleotide
aatttgctttattaaaaatcccaagtataataacaactggtttttaacaatattacagag

SEQ ID NO: 402702 - DNA, 60 bp, Artificial Sequence
  Description of Artificial Sequence: Synthetic oligonucleotide
atttgctttattaaaaatcccaagtataataacaactggtttttaacaatattacagaga

SEQ ID NO: 402703 - DNA, 60 bp, Artificial Sequence
  Description of Artificial Sequence: Synthetic oligonucleotide
tttgctttattaaaaatcccaagtataataacaactggtttttaacaatattacagagat

SEQ ID NO: 402704 - DNA, 60 bp, Artificial Sequence
  Description of Artificial Sequence: Synthetic oligonucleotide
ttgctttattaaaaatcccaagtataataacaactggtttttaacaatattacagagatg

SEQ ID NO: 402705 - DNA, 60 bp, Artificial Sequence
  Description of Artificial Sequence: Synthetic oligonucleotide
tgctttattaaaaatcccaagtataataacaactggtttttaacaatattacagagatgt

SEQ ID NO: 402706 - DNA, 60 bp, Artificial Sequence
  Description of Artificial Sequence: Synthetic oligonucleotide
gctttattaaaaatcccaagtataataacaactggtttttaacaatattacagagatgtt

SEQ ID NO: 402707 - DNA, 60 bp, Artificial Sequence
  Description of Artificial Sequence: Synthetic oligonucleotide
ctttattaaaaatcccaagtataataacaactggtttttaacaatattacagagatgttt

SEQ ID NO: 402708 - DNA, 60 bp, Artificial Sequence
  Description of Artificial Sequence: Synthetic oligonucleotide
tttattaaaaatcccaagtataataacaactggtttttaacaatattacagagatgttta

SEQ ID NO: 402709 - DNA, 60 bp, Artificial Sequence
  Description of Artificial Sequence: Synthetic oligonucleotide
ttattaaaaatcccaagtataataacaactggtttttaacaatattacagagatgtttac

SEQ ID NO: 402710 - DNA, 60 bp, Artificial Sequence
  Description of Artificial Sequence: Synthetic oligonucleotide
tattaaaaatcccaagtataataacaactggtttttaacaatattacagagatgtttact

SEQ ID NO: 402711 - DNA, 60 bp, Artificial Sequence
  Description of Artificial Sequence: Synthetic oligonucleotide
attaaaaatcccaagtataataacaactggtttttaacaatattacagagatgtttactg

SEQ ID NO: 402712 - DNA, 60 bp, Artificial Sequence
  Description of Artificial Sequence: Synthetic oligonucleotide
ttaaaaatcccaagtataataacaactggtttttaacaatattacagagatgtttactgt

SEQ ID NO: 402713 - DNA, 60 bp, Artificial Sequence
  Description of Artificial Sequence: Synthetic oligonucleotide
taaaaatcccaagtataataacaactggtttttaacaatattacagagatgtttactgtt

SEQ ID NO: 402714 - DNA, 60 bp, Artificial Sequence
  Description of Artificial Sequence: Synthetic oligonucleotide
aaaaatcccaagtataataacaactggtttttaacaatattacagagatgtttactgttg

SEQ ID NO: 402715 - DNA, 59 bp, Artificial Sequence
  Description of Artificial Sequence: Synthetic oligonucleotide
aaaatcccaagtataataacaactggtttttaacaatattacagagatgtttactgttg

SEQ ID NO: 402716 - DNA, 58 bp, Artificial Sequence
  Description of Artificial Sequence: Synthetic oligonucleotide
aaatcccaagtataataacaactggtttttaacaatattacagagatgtttactgttg

SEQ ID NO: 402717 - DNA, 57 bp, Artificial Sequence
  Description of Artificial Sequence: Synthetic oligonucleotide
aatcccaagtataataacaactggtttttaacaatattacagagatgtttactgttg

SEQ ID NO: 402718 - DNA, 56 bp, Artificial Sequence
  Description of Artificial Sequence: Synthetic oligonucleotide
atcccaagtataataacaactggtttttaacaatattacagagatgtttactgttg

SEQ ID NO: 402719 - DNA, 55 bp, Artificial Sequence
  Description of Artificial Sequence: Synthetic oligonucleotide
tcccaagtataataacaactggtttttaacaatattacagagatgtttactgttg

SEQ ID NO: 402720 - DNA, 54 bp, Artificial Sequence
  Description of Artificial Sequence: Synthetic oligonucleotide
cccaagtataataacaactggtttttaacaatattacagagatgtttactgttg

SEQ ID NO: 402721 - DNA, 58 bp, Artificial Sequence
  Description of Artificial Sequence: Synthetic oligonucleotide
ccaagtataataacaactggtttttaacaatattacagagatgtttactgttgaattg

SEQ ID NO: 402722 - DNA, 58 bp, Artificial Sequence
  Description of Artificial Sequence: Synthetic oligonucleotide
caagtataataacaactggtttttaacaatattacagagatgtttactgttgaattgc

SEQ ID NO: 402723 - DNA, 60 bp, Artificial Sequence
  Description of Artificial Sequence: Synthetic oligonucleotide
aagtataataacaactggtttttaacaatattacagagatgtttactgttgaattgcatt

SEQ ID NO: 402724 - DNA, 60 bp, Artificial Sequence
  Description of Artificial Sequence: Synthetic oligonucleotide
agtataataacaactggtttttaacaatattacagagatgtttactgttgaattgcattt

SEQ ID NO: 402725 - DNA, 60 bp, Artificial Sequence
  Description of Artificial Sequence: Synthetic oligonucleotide
gtataataacaactggtttttaacaatattacagagatgtttactgttgaattgcatttt

SEQ ID NO: 402726 - DNA, 60 bp, Artificial Sequence
  Description of Artificial Sequence: Synthetic oligonucleotide
tataataacaactggtttttaacaatattacagagatgtttactgttgaattgcattttt

SEQ ID NO: 402727 - DNA, 60 bp, Artificial Sequence
  Description of Artificial Sequence: Synthetic oligonucleotide
ataataacaactggtttttaacaatattacagagatgtttactgttgaattgcatttttc

SEQ ID NO: 402728 - DNA, 60 bp, Artificial Sequence
  Description of Artificial Sequence: Synthetic oligonucleotide
taataacaactggtttttaacaatattacagagatgtttactgttgaattgcatttttct

SEQ ID NO: 402729 - DNA, 60 bp, Artificial Sequence
  Description of Artificial Sequence: Synthetic oligonucleotide
aataacaactggtttttaacaatattacagagatgtttactgttgaattgcatttttctt

SEQ ID NO: 402730 - DNA, 60 bp, Artificial Sequence
  Description of Artificial Sequence: Synthetic oligonucleotide
ataacaactggtttttaacaatattacagagatgtttactgttgaattgcatttttcttt

SEQ ID NO: 402731 - DNA, 60 bp, Artificial Sequence
  Description of Artificial Sequence: Synthetic oligonucleotide
taacaactggtttttaacaatattacagagatgtttactgttgaattgcatttttctttt

SEQ ID NO: 402732 - DNA, 60 bp, Artificial Sequence
  Description of Artificial Sequence: Synthetic oligonucleotide
aacaactggtttttaacaatattacagagatgtttactgttgaattgcatttttcttttg

SEQ ID NO: 402733 - DNA, 59 bp, Artificial Sequence
  Description of Artificial Sequence: Synthetic oligonucleotide
acaactggtttttaacaatattacagagatgtttactgttgaattgcatttttcttttg

SEQ ID NO: 402734 - DNA, 58 bp, Artificial Sequence
  Description of Artificial Sequence: Synthetic oligonucleotide
caactggtttttaacaatattacagagatgtttactgttgaattgcatttttcttttg

SEQ ID NO: 402735 - DNA, 58 bp, Artificial Sequence
  Description of Artificial Sequence: Synthetic oligonucleotide
aactggtttttaacaatattacagagatgtttactgttgaattgcatttttcttttgc

SEQ ID NO: 402736 - DNA, 57 bp, Artificial Sequence
  Description of Artificial Sequence: Synthetic oligonucleotide
actggtttttaacaatattacagagatgtttactgttgaattgcatttttcttttgc

SEQ ID NO: 402737 - DNA, 56 bp, Artificial Sequence
  Description of Artificial Sequence: Synthetic oligonucleotide
ctggtttttaacaatattacagagatgtttactgttgaattgcatttttcttttgc

SEQ ID NO: 402738 - DNA, 56 bp, Artificial Sequence
  Description of Artificial Sequence: Synthetic oligonucleotide
tggtttttaacaatattacagagatgtttactgttgaattgcatttttcttttgcc

SEQ ID NO: 402739 - DNA, 55 bp, Artificial Sequence
  Description of Artificial Sequence: Synthetic oligonucleotide
ggtttttaacaatattacagagatgtttactgttgaattgcatttttcttttgcc

SEQ ID NO: 402740 - DNA, 56 bp, Artificial Sequence
  Description of Artificial Sequence: Synthetic oligonucleotide
gtttttaacaatattacagagatgtttactgttgaattgcatttttcttttgcctc

SEQ ID NO: 402741 - DNA, 57 bp, Artificial Sequence
  Description of Artificial Sequence: Synthetic oligonucleotide
tttttaacaatattacagagatgtttactgttgaattgcatttttcttttgcctctc

SEQ ID NO: 402742 - DNA, 56 bp, Artificial Sequence
  Description of Artificial Sequence: Synthetic oligonucleotide
ttttaacaatattacagagatgtttactgttgaattgcatttttcttttgcctctc

SEQ ID NO: 402743 - DNA, 55 bp, Artificial Sequence
  Description of Artificial Sequence: Synthetic oligonucleotide
tttaacaatattacagagatgtttactgttgaattgcatttttcttttgcctctc

SEQ ID NO: 402744 - DNA, 54 bp, Artificial Sequence
  Description of Artificial Sequence: Synthetic oligonucleotide
ttaacaatattacagagatgtttactgttgaattgcatttttcttttgcctctc

SEQ ID NO: 402745 - DNA, 53 bp, Artificial Sequence
  Description of Artificial Sequence: Synthetic oligonucleotide
taacaatattacagagatgtttactgttgaattgcatttttcttttgcctctc

SEQ ID NO: 402746 - DNA, 52 bp, Artificial Sequence
  Description of Artificial Sequence: Synthetic oligonucleotide
aacaatattacagagatgtttactgttgaattgcatttttcttttgcctctc

SEQ ID NO: 402747 - DNA, 51 bp, Artificial Sequence
  Description of Artificial Sequence: Synthetic oligonucleotide
acaatattacagagatgtttactgttgaattgcatttttcttttgcctctc

SEQ ID NO: 402748 - DNA, 50 bp, Artificial Sequence
  Description of Artificial Sequence: Synthetic oligonucleotide
caatattacagagatgtttactgttgaattgcatttttcttttgcctctc

SEQ ID NO: 402749 - DNA, 55 bp, Artificial Sequence
  Description of Artificial Sequence: Synthetic oligonucleotide
aatattacagagatgtttactgttgaattgcatttttcttttgcctctcaaaatc

SEQ ID NO: 402750 - DNA, 54 bp, Artificial Sequence
  Description of Artificial Sequence: Synthetic oligonucleotide
atattacagagatgtttactgttgaattgcatttttcttttgcctctcaaaatc

SEQ ID NO: 402751 - DNA, 53 bp, Artificial Sequence
  Description of Artificial Sequence: Synthetic oligonucleotide
tattacagagatgtttactgttgaattgcatttttcttttgcctctcaaaatc

SEQ ID NO: 402752 - DNA, 52 bp, Artificial Sequence
  Description of Artificial Sequence: Synthetic oligonucleotide
attacagagatgtttactgttgaattgcatttttcttttgcctctcaaaatc

SEQ ID NO: 402753 - DNA, 51 bp, Artificial Sequence
  Description of Artificial Sequence: Synthetic oligonucleotide
ttacagagatgtttactgttgaattgcatttttcttttgcctctcaaaatc

SEQ ID NO: 402754 - DNA, 50 bp, Artificial Sequence
  Description of Artificial Sequence: Synthetic oligonucleotide
tacagagatgtttactgttgaattgcatttttcttttgcctctcaaaatc

SEQ ID NO: 402755 - DNA, 49 bp, Artificial Sequence
  Description of Artificial Sequence: Synthetic oligonucleotide
acagagatgtttactgttgaattgcatttttcttttgcctctcaaaatc

SEQ ID NO: 402756 - DNA, 48 bp, Artificial Sequence
  Description of Artificial Sequence: Synthetic oligonucleotide
cagagatgtttactgttgaattgcatttttcttttgcctctcaaaatc

SEQ ID NO: 402757 - DNA, 48 bp, Artificial Sequence
  Description of Artificial Sequence: Synthetic oligonucleotide
agagatgtttactgttgaattgcatttttcttttgcctctcaaaatcc

SEQ ID NO: 402758 - DNA, 47 bp, Artificial Sequence
  Description of Artificial Sequence: Synthetic oligonucleotide
gagatgtttactgttgaattgcatttttcttttgcctctcaaaatcc

SEQ ID NO: 402759 - DNA, 47 bp, Artificial Sequence
  Description of Artificial Sequence: Synthetic oligonucleotide
agatgtttactgttgaattgcatttttcttttgcctctcaaaatccc

SEQ ID NO: 402760 - DNA, 46 bp, Artificial Sequence
  Description of Artificial Sequence: Synthetic oligonucleotide
gatgtttactgttgaattgcatttttcttttgcctctcaaaatccc

SEQ ID NO: 402761 - DNA, 47 bp, Artificial Sequence
  Description of Artificial Sequence: Synthetic oligonucleotide
atgtttactgttgaattgcatttttcttttgcctctcaaaatccctg

SEQ ID NO: 402762 - DNA, 46 bp, Artificial Sequence
  Description of Artificial Sequence: Synthetic oligonucleotide
tgtttactgttgaattgcatttttcttttgcctctcaaaatccctg

SEQ ID NO: 402763 - DNA, 45 bp, Artificial Sequence
  Description of Artificial Sequence: Synthetic oligonucleotide
gtttactgttgaattgcatttttcttttgcctctcaaaatccctg

SEQ ID NO: 402764 - DNA, 46 bp, Artificial Sequence
  Description of Artificial Sequence: Synthetic oligonucleotide
tttactgttgaattgcatttttcttttgcctctcaaaatccctgag

SEQ ID NO: 402765 - DNA, 45 bp, Artificial Sequence
  Description of Artificial Sequence: Synthetic oligonucleotide
ttactgttgaattgcatttttcttttgcctctcaaaatccctgag

SEQ ID NO: 402766 - DNA, 44 bp, Artificial Sequence
  Description of Artificial Sequence: Synthetic oligonucleotide
tactgttgaattgcatttttcttttgcctctcaaaatccctgag

SEQ ID NO: 402767 - DNA, 43 bp, Artificial Sequence
  Description of Artificial Sequence: Synthetic oligonucleotide
actgttgaattgcatttttcttttgcctctcaaaatccctgag

SEQ ID NO: 402768 - DNA, 42 bp, Artificial Sequence
  Description of Artificial Sequence: Synthetic oligonucleotide
ctgttgaattgcatttttcttttgcctctcaaaatccctgag

SEQ ID NO: 402769 - DNA, 42 bp, Artificial Sequence
  Description of Artificial Sequence: Synthetic oligonucleotide
tgttgaattgcatttttcttttgcctctcaaaatccctgagg

SEQ ID NO: 402770 - DNA, 41 bp, Artificial Sequence
  Description of Artificial Sequence: Synthetic oligonucleotide
gttgaattgcatttttcttttgcctctcaaaatccctgagg

SEQ ID NO: 402771 - DNA, 46 bp, Artificial Sequence
  Description of Artificial Sequence: Synthetic oligonucleotide
ttgaattgcatttttcttttgcctctcaaaatccctgaggaatttg

SEQ ID NO: 402772 - DNA, 45 bp, Artificial Sequence
  Description of Artificial Sequence: Synthetic oligonucleotide
tgaattgcatttttcttttgcctctcaaaatccctgaggaatttg

SEQ ID NO: 402773 - DNA, 44 bp, Artificial Sequence
  Description of Artificial Sequence: Synthetic oligonucleotide
gaattgcatttttcttttgcctctcaaaatccctgaggaatttg

SEQ ID NO: 402774 - DNA, 46 bp, Artificial Sequence
  Description of Artificial Sequence: Synthetic oligonucleotide
aattgcatttttcttttgcctctcaaaatccctgaggaatttgttc

SEQ ID NO: 402775 - DNA, 45 bp, Artificial Sequence
  Description of Artificial Sequence: Synthetic oligonucleotide
attgcatttttcttttgcctctcaaaatccctgaggaatttgttc

SEQ ID NO: 402776 - DNA, 44 bp, Artificial Sequence
  Description of Artificial Sequence: Synthetic oligonucleotide
ttgcatttttcttttgcctctcaaaatccctgaggaatttgttc

SEQ ID NO: 402777 - DNA, 43 bp, Artificial Sequence
  Description of Artificial Sequence: Synthetic oligonucleotide
tgcatttttcttttgcctctcaaaatccctgaggaatttgttc

SEQ ID NO: 402778 - DNA, 42 bp, Artificial Sequence
  Description of Artificial Sequence: Synthetic oligonucleotide
gcatttttcttttgcctctcaaaatccctgaggaatttgttc

SEQ ID NO: 402779 - DNA, 44 bp, Artificial Sequence
  Description of Artificial Sequence: Synthetic oligonucleotide
catttttcttttgcctctcaaaatccctgaggaatttgttcttc

SEQ ID NO: 402780 - DNA, 45 bp, Artificial Sequence
  Description of Artificial Sequence: Synthetic oligonucleotide
atttttcttttgcctctcaaaatccctgaggaatttgttcttcag

SEQ ID NO: 402781 - DNA, 44 bp, Artificial Sequence
  Description of Artificial Sequence: Synthetic oligonucleotide
tttttcttttgcctctcaaaatccctgaggaatttgttcttcag

SEQ ID NO: 402782 - DNA, 43 bp, Artificial Sequence
  Description of Artificial Sequence: Synthetic oligonucleotide
ttttcttttgcctctcaaaatccctgaggaatttgttcttcag

SEQ ID NO: 402783 - DNA, 42 bp, Artificial Sequence
  Description of Artificial Sequence: Synthetic oligonucleotide
tttcttttgcctctcaaaatccctgaggaatttgttcttcag

SEQ ID NO: 402784 - DNA, 41 bp, Artificial Sequence
  Description of Artificial Sequence: Synthetic oligonucleotide
ttcttttgcctctcaaaatccctgaggaatttgttcttcag

SEQ ID NO: 402785 - DNA, 40 bp, Artificial Sequence
  Description of Artificial Sequence: Synthetic oligonucleotide
tcttttgcctctcaaaatccctgaggaatttgttcttcag

SEQ ID NO: 402786 - DNA, 39 bp, Artificial Sequence
  Description of Artificial Sequence: Synthetic oligonucleotide
cttttgcctctcaaaatccctgaggaatttgttcttcag

SEQ ID NO: 402787 - DNA, 39 bp, Artificial Sequence
  Description of Artificial Sequence: Synthetic oligonucleotide
ttttgcctctcaaaatccctgaggaatttgttcttcagc

SEQ ID NO: 402788 - DNA, 38 bp, Artificial Sequence
  Description of Artificial Sequence: Synthetic oligonucleotide
tttgcctctcaaaatccctgaggaatttgttcttcagc

SEQ ID NO: 402789 - DNA, 37 bp, Artificial Sequence
  Description of Artificial Sequence: Synthetic oligonucleotide
ttgcctctcaaaatccctgaggaatttgttcttcagc

SEQ ID NO: 402790 - DNA, 36 bp, Artificial Sequence
  Description of Artificial Sequence: Synthetic oligonucleotide
tgcctctcaaaatccctgaggaatttgttcttcagc

SEQ ID NO: 402791 - DNA, 35 bp, Artificial Sequence
  Description of Artificial Sequence: Synthetic oligonucleotide
gcctctcaaaatccctgaggaatttgttcttcagc

SEQ ID NO: 402792 - DNA, 36 bp, Artificial Sequence
  Description of Artificial Sequence: Synthetic oligonucleotide
cctctcaaaatccctgaggaatttgttcttcagctc

SEQ ID NO: 402793 - DNA, 38 bp, Artificial Sequence
  Description of Artificial Sequence: Synthetic oligonucleotide
ctctcaaaatccctgaggaatttgttcttcagctcttc

SEQ ID NO: 402794 - DNA, 44 bp, Artificial Sequence
  Description of Artificial Sequence: Synthetic oligonucleotide
tctcaaaatccctgaggaatttgttcttcagctcttctataatc

SEQ ID NO: 402795 - DNA, 43 bp, Artificial Sequence
  Description of Artificial Sequence: Synthetic oligonucleotide
ctcaaaatccctgaggaatttgttcttcagctcttctataatc

SEQ ID NO: 402796 - DNA, 43 bp, Artificial Sequence
  Description of Artificial Sequence: Synthetic oligonucleotide
tcaaaatccctgaggaatttgttcttcagctcttctataatcg

SEQ ID NO: 402797 - DNA, 42 bp, Artificial Sequence
  Description of Artificial Sequence: Synthetic oligonucleotide
caaaatccctgaggaatttgttcttcagctcttctataatcg

SEQ ID NO: 402798 - DNA, 43 bp, Artificial Sequence
  Description of Artificial Sequence: Synthetic oligonucleotide
aaaatccctgaggaatttgttcttcagctcttctataatcgag

SEQ ID NO: 402799 - DNA, 42 bp, Artificial Sequence
  Description of Artificial Sequence: Synthetic oligonucleotide
aaatccctgaggaatttgttcttcagctcttctataatcgag

SEQ ID NO: 402800 - DNA, 41 bp, Artificial Sequence
  Description of Artificial Sequence: Synthetic oligonucleotide
aatccctgaggaatttgttcttcagctcttctataatcgag

SEQ ID NO: 402801 - DNA, 40 bp, Artificial Sequence
  Description of Artificial Sequence: Synthetic oligonucleotide
atccctgaggaatttgttcttcagctcttctataatcgag

SEQ ID NO: 402802 - DNA, 39 bp, Artificial Sequence
  Description of Artificial Sequence: Synthetic oligonucleotide
tccctgaggaatttgttcttcagctcttctataatcgag

SEQ ID NO: 402803 - DNA, 38 bp, Artificial Sequence
  Description of Artificial Sequence: Synthetic oligonucleotide
ccctgaggaatttgttcttcagctcttctataatcgag

SEQ ID NO: 402804 - DNA, 39 bp, Artificial Sequence
  Description of Artificial Sequence: Synthetic oligonucleotide
cctgaggaatttgttcttcagctcttctataatcgagag

SEQ ID NO: 402805 - DNA, 39 bp, Artificial Sequence
  Description of Artificial Sequence: Synthetic oligonucleotide
ctgaggaatttgttcttcagctcttctataatcgagagg

SEQ ID NO: 402806 - DNA, 46 bp, Artificial Sequence
  Description of Artificial Sequence: Synthetic oligonucleotide
tgaggaatttgttcttcagctcttctataatcgagaggaaattttc

SEQ ID NO: 402807 - DNA, 45 bp, Artificial Sequence
  Description of Artificial Sequence: Synthetic oligonucleotide
gaggaatttgttcttcagctcttctataatcgagaggaaattttc

SEQ ID NO: 402808 - DNA, 46 bp, Artificial Sequence
  Description of Artificial Sequence: Synthetic oligonucleotide
aggaatttgttcttcagctcttctataatcgagaggaaattttcac

SEQ ID NO: 402809 - DNA, 45 bp, Artificial Sequence
  Description of Artificial Sequence: Synthetic oligonucleotide
ggaatttgttcttcagctcttctataatcgagaggaaattttcac

SEQ ID NO: 402810 - DNA, 45 bp, Artificial Sequence
  Description of Artificial Sequence: Synthetic oligonucleotide
gaatttgttcttcagctcttctataatcgagaggaaattttcacc

SEQ ID NO: 402811 - DNA, 46 bp, Artificial Sequence
  Description of Artificial Sequence: Synthetic oligonucleotide
aatttgttcttcagctcttctataatcgagaggaaattttcacctc

SEQ ID NO: 402812 - DNA, 45 bp, Artificial Sequence
  Description of Artificial Sequence: Synthetic oligonucleotide
atttgttcttcagctcttctataatcgagaggaaattttcacctc

SEQ ID NO: 402813 - DNA, 44 bp, Artificial Sequence
  Description of Artificial Sequence: Synthetic oligonucleotide
tttgttcttcagctcttctataatcgagaggaaattttcacctc

SEQ ID NO: 402814 - DNA, 43 bp, Artificial Sequence
  Description of Artificial Sequence: Synthetic oligonucleotide
ttgttcttcagctcttctataatcgagaggaaattttcacctc

SEQ ID NO: 402815 - DNA, 42 bp, Artificial Sequence
  Description of Artificial Sequence: Synthetic oligonucleotide
tgttcttcagctcttctataatcgagaggaaattttcacctc

SEQ ID NO: 402816 - DNA, 41 bp, Artificial Sequence
  Description of Artificial Sequence: Synthetic oligonucleotide
gttcttcagctcttctataatcgagaggaaattttcacctc

SEQ ID NO: 402817 - DNA, 42 bp, Artificial Sequence
  Description of Artificial Sequence: Synthetic oligonucleotide
ttcttcagctcttctataatcgagaggaaattttcacctcag

SEQ ID NO: 402818 - DNA, 41 bp, Artificial Sequence
  Description of Artificial Sequence: Synthetic oligonucleotide
tcttcagctcttctataatcgagaggaaattttcacctcag

SEQ ID NO: 402819 - DNA, 40 bp, Artificial Sequence
  Description of Artificial Sequence: Synthetic oligonucleotide
cttcagctcttctataatcgagaggaaattttcacctcag

SEQ ID NO: 402820 - DNA, 42 bp, Artificial Sequence
  Description of Artificial Sequence: Synthetic oligonucleotide
ttcagctcttctataatcgagaggaaattttcacctcagatg

SEQ ID NO: 402821 - DNA, 41 bp, Artificial Sequence
  Description of Artificial Sequence: Synthetic oligonucleotide
tcagctcttctataatcgagaggaaattttcacctcagatg

SEQ ID NO: 402822 - DNA, 40 bp, Artificial Sequence
  Description of Artificial Sequence: Synthetic oligonucleotide
cagctcttctataatcgagaggaaattttcacctcagatg

SEQ ID NO: 402823 - DNA, 42 bp, Artificial Sequence
  Description of Artificial Sequence: Synthetic oligonucleotide
agctcttctataatcgagaggaaattttcacctcagatgttc

SEQ ID NO: 402824 - DNA, 41 bp, Artificial Sequence
  Description of Artificial Sequence: Synthetic oligonucleotide
gctcttctataatcgagaggaaattttcacctcagatgttc

SEQ ID NO: 402825 - DNA, 43 bp, Artificial Sequence
  Description of Artificial Sequence: Synthetic oligonucleotide
ctcttctataatcgagaggaaattttcacctcagatgttcatc

SEQ ID NO: 402826 - DNA, 43 bp, Artificial Sequence
  Description of Artificial Sequence: Synthetic oligonucleotide
tcttctataatcgagaggaaattttcacctcagatgttcatcc

SEQ ID NO: 402827 - DNA, 42 bp, Artificial Sequence
  Description of Artificial Sequence: Synthetic oligonucleotide
cttctataatcgagaggaaattttcacctcagatgttcatcc

SEQ ID NO: 402828 - DNA, 43 bp, Artificial Sequence
  Description of Artificial Sequence: Synthetic oligonucleotide
ttctataatcgagaggaaattttcacctcagatgttcatccag

SEQ ID NO: 402829 - DNA, 42 bp, Artificial Sequence
  Description of Artificial Sequence: Synthetic oligonucleotide
tctataatcgagaggaaattttcacctcagatgttcatccag

SEQ ID NO: 402830 - DNA, 41 bp, Artificial Sequence
  Description of Artificial Sequence: Synthetic oligonucleotide
ctataatcgagaggaaattttcacctcagatgttcatccag

SEQ ID NO: 402831 - DNA, 42 bp, Artificial Sequence
  Description of Artificial Sequence: Synthetic oligonucleotide
tataatcgagaggaaattttcacctcagatgttcatccagtg

SEQ ID NO: 402832 - DNA, 41 bp, Artificial Sequence
  Description of Artificial Sequence: Synthetic oligonucleotide
ataatcgagaggaaattttcacctcagatgttcatccagtg

SEQ ID NO: 402833 - DNA, 40 bp, Artificial Sequence
  Description of Artificial Sequence: Synthetic oligonucleotide
taatcgagaggaaattttcacctcagatgttcatccagtg

SEQ ID NO: 402834 - DNA, 39 bp, Artificial Sequence
  Description of Artificial Sequence: Synthetic oligonucleotide
aatcgagaggaaattttcacctcagatgttcatccagtg

SEQ ID NO: 402835 - DNA, 38 bp, Artificial Sequence
  Description of Artificial Sequence: Synthetic oligonucleotide
atcgagaggaaattttcacctcagatgttcatccagtg

SEQ ID NO: 402836 - DNA, 37 bp, Artificial Sequence
  Description of Artificial Sequence: Synthetic oligonucleotide
tcgagaggaaattttcacctcagatgttcatccagtg

SEQ ID NO: 402837 - DNA, 36 bp, Artificial Sequence
  Description of Artificial Sequence: Synthetic oligonucleotide
cgagaggaaattttcacctcagatgttcatccagtg

SEQ ID NO: 402838 - DNA, 36 bp, Artificial Sequence
  Description of Artificial Sequence: Synthetic oligonucleotide
gagaggaaattttcacctcagatgttcatccagtgc

SEQ ID NO: 402839 - DNA, 40 bp, Artificial Sequence
  Description of Artificial Sequence: Synthetic oligonucleotide
agaggaaattttcacctcagatgttcatccagtgcaattg

SEQ ID NO: 402840 - DNA, 39 bp, Artificial Sequence
  Description of Artificial Sequence: Synthetic oligonucleotide
gaggaaattttcacctcagatgttcatccagtgcaattg

SEQ ID NO: 402841 - DNA, 39 bp, Artificial Sequence
  Description of Artificial Sequence: Synthetic oligonucleotide
aggaaattttcacctcagatgttcatccagtgcaattgg

SEQ ID NO: 402842 - DNA, 38 bp, Artificial Sequence
  Description of Artificial Sequence: Synthetic oligonucleotide
ggaaattttcacctcagatgttcatccagtgcaattgg

SEQ ID NO: 402843 - DNA, 40 bp, Artificial Sequence
  Description of Artificial Sequence: Synthetic oligonucleotide
gaaattttcacctcagatgttcatccagtgcaattggaag

SEQ ID NO: 402844 - DNA, 41 bp, Artificial Sequence
  Description of Artificial Sequence: Synthetic oligonucleotide
aaattttcacctcagatgttcatccagtgcaattggaagac

SEQ ID NO: 402845 - DNA, 40 bp, Artificial Sequence
  Description of Artificial Sequence: Synthetic oligonucleotide
aattttcacctcagatgttcatccagtgcaattggaagac

SEQ ID NO: 402846 - DNA, 39 bp, Artificial Sequence
  Description of Artificial Sequence: Synthetic oligonucleotide
attttcacctcagatgttcatccagtgcaattggaagac

SEQ ID NO: 402847 - DNA, 38 bp, Artificial Sequence
  Description of Artificial Sequence: Synthetic oligonucleotide
ttttcacctcagatgttcatccagtgcaattggaagac

SEQ ID NO: 402848 - DNA, 37 bp, Artificial Sequence
  Description of Artificial Sequence: Synthetic oligonucleotide
tttcacctcagatgttcatccagtgcaattggaagac

SEQ ID NO: 402849 - DNA, 36 bp, Artificial Sequence
  Description of Artificial Sequence: Synthetic oligonucleotide
ttcacctcagatgttcatccagtgcaattggaagac

SEQ ID NO: 402850 - DNA, 35 bp, Artificial Sequence
  Description of Artificial Sequence: Synthetic oligonucleotide
tcacctcagatgttcatccagtgcaattggaagac

SEQ ID NO: 402851 - DNA, 34 bp, Artificial Sequence
  Description of Artificial Sequence: Synthetic oligonucleotide
cacctcagatgttcatccagtgcaattggaagac

SEQ ID NO: 402852 - DNA, 34 bp, Artificial Sequence
  Description of Artificial Sequence: Synthetic oligonucleotide
acctcagatgttcatccagtgcaattggaagacg

SEQ ID NO: 402853 - DNA, 33 bp, Artificial Sequence
  Description of Artificial Sequence: Synthetic oligonucleotide
cctcagatgttcatccagtgcaattggaagacg

SEQ ID NO: 402854 - DNA, 34 bp, Artificial Sequence
  Description of Artificial Sequence: Synthetic oligonucleotide
ctcagatgttcatccagtgcaattggaagacgtc

SEQ ID NO: 402855 - DNA, 35 bp, Artificial Sequence
  Description of Artificial Sequence: Synthetic oligonucleotide
tcagatgttcatccagtgcaattggaagacgtcac

SEQ ID NO: 402856 - DNA, 34 bp, Artificial Sequence
  Description of Artificial Sequence: Synthetic oligonucleotide
cagatgttcatccagtgcaattggaagacgtcac

SEQ ID NO: 402857 - DNA, 35 bp, Artificial Sequence
  Description of Artificial Sequence: Synthetic oligonucleotide
agatgttcatccagtgcaattggaagacgtcacag

SEQ ID NO: 402858 - DNA, 34 bp, Artificial Sequence
  Description of Artificial Sequence: Synthetic oligonucleotide
gatgttcatccagtgcaattggaagacgtcacag

SEQ ID NO: 402859 - DNA, 39 bp, Artificial Sequence
  Description of Artificial Sequence: Synthetic oligonucleotide
tgccaggcactggattgagaaccttcacaaaaaaaaatg

SEQ ID NO: 402860 - DNA, 38 bp, Artificial Sequence
  Description of Artificial Sequence: Synthetic oligonucleotide
gccaggcactggattgagaaccttcacaaaaaaaaatg

SEQ ID NO: 402861 - DNA, 39 bp, Artificial Sequence
  Description of Artificial Sequence: Synthetic oligonucleotide
ccaggcactggattgagaaccttcacaaaaaaaaatgtc

SEQ ID NO: 402862 - DNA, 40 bp, Artificial Sequence
  Description of Artificial Sequence: Synthetic oligonucleotide
caggcactggattgagaaccttcacaaaaaaaaatgtctg

SEQ ID NO: 402863 - DNA, 40 bp, Artificial Sequence
  Description of Artificial Sequence: Synthetic oligonucleotide
aggcactggattgagaaccttcacaaaaaaaaatgtctgc

SEQ ID NO: 402864 - DNA, 39 bp, Artificial Sequence
  Description of Artificial Sequence: Synthetic oligonucleotide
ggcactggattgagaaccttcacaaaaaaaaatgtctgc

SEQ ID NO: 402865 - DNA, 39 bp, Artificial Sequence
  Description of Artificial Sequence: Synthetic oligonucleotide
gcactggattgagaaccttcacaaaaaaaaatgtctgcc

SEQ ID NO: 402866 - DNA, 39 bp, Artificial Sequence
  Description of Artificial Sequence: Synthetic oligonucleotide
cactggattgagaaccttcacaaaaaaaaatgtctgccc

SEQ ID NO: 402867 - DNA, 40 bp, Artificial Sequence
  Description of Artificial Sequence: Synthetic oligonucleotide
actggattgagaaccttcacaaaaaaaaatgtctgcccag

SEQ ID NO: 402868 - DNA, 39 bp, Artificial Sequence
  Description of Artificial Sequence: Synthetic oligonucleotide
ctggattgagaaccttcacaaaaaaaaatgtctgcccag

SEQ ID NO: 402869 - DNA, 40 bp, Artificial Sequence
  Description of Artificial Sequence: Synthetic oligonucleotide
tggattgagaaccttcacaaaaaaaaatgtctgcccagag

SEQ ID NO: 402870 - DNA, 39 bp, Artificial Sequence
  Description of Artificial Sequence: Synthetic oligonucleotide
ggattgagaaccttcacaaaaaaaaatgtctgcccagag

SEQ ID NO: 402871 - DNA, 40 bp, Artificial Sequence
  Description of Artificial Sequence: Synthetic oligonucleotide
gattgagaaccttcacaaaaaaaaatgtctgcccagagac

SEQ ID NO: 402872 - DNA, 41 bp, Artificial Sequence
  Description of Artificial Sequence: Synthetic oligonucleotide
attgagaaccttcacaaaaaaaaatgtctgcccagagacag

SEQ ID NO: 402873 - DNA, 40 bp, Artificial Sequence
  Description of Artificial Sequence: Synthetic oligonucleotide
ttgagaaccttcacaaaaaaaaatgtctgcccagagacag

SEQ ID NO: 402874 - DNA, 39 bp, Artificial Sequence
  Description of Artificial Sequence: Synthetic oligonucleotide
tgagaaccttcacaaaaaaaaatgtctgcccagagacag

SEQ ID NO: 402875 - DNA, 38 bp, Artificial Sequence
  Description of Artificial Sequence: Synthetic oligonucleotide
gagaaccttcacaaaaaaaaatgtctgcccagagacag

SEQ ID NO: 402876 - DNA, 40 bp, Artificial Sequence
  Description of Artificial Sequence: Synthetic oligonucleotide
agaaccttcacaaaaaaaaatgtctgcccagagacagatg

SEQ ID NO: 402877 - DNA, 39 bp, Artificial Sequence
  Description of Artificial Sequence: Synthetic oligonucleotide
gaaccttcacaaaaaaaaatgtctgcccagagacagatg

SEQ ID NO: 402878 - DNA, 40 bp, Artificial Sequence
  Description of Artificial Sequence: Synthetic oligonucleotide
aaccttcacaaaaaaaaatgtctgcccagagacagatgag

SEQ ID NO: 402879 - DNA, 39 bp, Artificial Sequence
  Description of Artificial Sequence: Synthetic oligonucleotide
accttcacaaaaaaaaatgtctgcccagagacagatgag

SEQ ID NO: 402880 - DNA, 38 bp, Artificial Sequence
  Description of Artificial Sequence: Synthetic oligonucleotide
ccttcacaaaaaaaaatgtctgcccagagacagatgag

SEQ ID NO: 402881 - DNA, 38 bp, Artificial Sequence
  Description of Artificial Sequence: Synthetic oligonucleotide
cttcacaaaaaaaaatgtctgcccagagacagatgagg

SEQ ID NO: 402882 - DNA, 39 bp, Artificial Sequence
  Description of Artificial Sequence: Synthetic oligonucleotide
ttcacaaaaaaaaatgtctgcccagagacagatgaggtc

SEQ ID NO: 402883 - DNA, 38 bp, Artificial Sequence
  Description of Artificial Sequence: Synthetic oligonucleotide
tcacaaaaaaaaatgtctgcccagagacagatgaggtc

SEQ ID NO: 402884 - DNA, 37 bp, Artificial Sequence
  Description of Artificial Sequence: Synthetic oligonucleotide
cacaaaaaaaaatgtctgcccagagacagatgaggtc

SEQ ID NO: 402885 - DNA, 37 bp, Artificial Sequence
  Description of Artificial Sequence: Synthetic oligonucleotide
acaaaaaaaaatgtctgcccagagacagatgaggtcc

SEQ ID NO: 402886 - DNA, 36 bp, Artificial Sequence
  Description of Artificial Sequence: Synthetic oligonucleotide
caaaaaaaaatgtctgcccagagacagatgaggtcc

SEQ ID NO: 402887 - DNA, 38 bp, Artificial Sequence
  Description of Artificial Sequence: Synthetic oligonucleotide
aaaaaaaaatgtctgcccagagacagatgaggtccttc

SEQ ID NO: 402888 - DNA, 37 bp, Artificial Sequence
  Description of Artificial Sequence: Synthetic oligonucleotide
aaaaaaaatgtctgcccagagacagatgaggtccttc

SEQ ID NO: 402889 - DNA, 36 bp, Artificial Sequence
  Description of Artificial Sequence: Synthetic oligonucleotide
aaaaaaatgtctgcccagagacagatgaggtccttc

SEQ ID NO: 402890 - DNA, 35 bp, Artificial Sequence
  Description of Artificial Sequence: Synthetic oligonucleotide
aaaaaatgtctgcccagagacagatgaggtccttc

SEQ ID NO: 402891 - DNA, 34 bp, Artificial Sequence
  Description of Artificial Sequence: Synthetic oligonucleotide
aaaaatgtctgcccagagacagatgaggtccttc

SEQ ID NO: 402892 - DNA, 33 bp, Artificial Sequence
  Description of Artificial Sequence: Synthetic oligonucleotide
aaaatgtctgcccagagacagatgaggtccttc

SEQ ID NO: 402893 - DNA, 32 bp, Artificial Sequence
  Description of Artificial Sequence: Synthetic oligonucleotide
aaatgtctgcccagagacagatgaggtccttc

SEQ ID NO: 402894 - DNA, 31 bp, Artificial Sequence
  Description of Artificial Sequence: Synthetic oligonucleotide
aatgtctgcccagagacagatgaggtccttc

SEQ ID NO: 402895 - DNA, 30 bp, Artificial Sequence
  Description of Artificial Sequence: Synthetic oligonucleotide
atgtctgcccagagacagatgaggtccttc

SEQ ID NO: 402896 - DNA, 29 bp, Artificial Sequence
  Description of Artificial Sequence: Synthetic oligonucleotide
tgtctgcccagagacagatgaggtccttc

SEQ ID NO: 402897 - DNA, 28 bp, Artificial Sequence
  Description of Artificial Sequence: Synthetic oligonucleotide
gtctgcccagagacagatgaggtccttc

SEQ ID NO: 402898 - DNA, 33 bp, Artificial Sequence
  Description of Artificial Sequence: Synthetic oligonucleotide
gtccttcagctccagtgctgattggttcttttc

SEQ ID NO: 402899 - DNA, 33 bp, Artificial Sequence
  Description of Artificial Sequence: Synthetic oligonucleotide
tccttcagctccagtgctgattggttcttttcc

SEQ ID NO: 402900 - DNA, 32 bp, Artificial Sequence
  Description of Artificial Sequence: Synthetic oligonucleotide
ccttcagctccagtgctgattggttcttttcc

SEQ ID NO: 402901 - DNA, 34 bp, Artificial Sequence
  Description of Artificial Sequence: Synthetic oligonucleotide
cttcagctccagtgctgattggttcttttccaag

SEQ ID NO: 402902 - DNA, 34 bp, Artificial Sequence
  Description of Artificial Sequence: Synthetic oligonucleotide
ttcagctccagtgctgattggttcttttccaagc

SEQ ID NO: 402903 - DNA, 33 bp, Artificial Sequence
  Description of Artificial Sequence: Synthetic oligonucleotide
tcagctccagtgctgattggttcttttccaagc

SEQ ID NO: 402904 - DNA, 32 bp, Artificial Sequence
  Description of Artificial Sequence: Synthetic oligonucleotide
cagctccagtgctgattggttcttttccaagc

SEQ ID NO: 402905 - DNA, 32 bp, Artificial Sequence
  Description of Artificial Sequence: Synthetic oligonucleotide
agctccagtgctgattggttcttttccaagcg

SEQ ID NO: 402906 - DNA, 31 bp, Artificial Sequence
  Description of Artificial Sequence: Synthetic oligonucleotide
gctccagtgctgattggttcttttccaagcg

SEQ ID NO: 402907 - DNA, 32 bp, Artificial Sequence
  Description of Artificial Sequence: Synthetic oligonucleotide
ctccagtgctgattggttcttttccaagcgac

SEQ ID NO: 402908 - DNA, 32 bp, Artificial Sequence
  Description of Artificial Sequence: Synthetic oligonucleotide
tccagtgctgattggttcttttccaagcgacc

SEQ ID NO: 402909 - DNA, 31 bp, Artificial Sequence
  Description of Artificial Sequence: Synthetic oligonucleotide
ccagtgctgattggttcttttccaagcgacc

SEQ ID NO: 402910 - DNA, 33 bp, Artificial Sequence
  Description of Artificial Sequence: Synthetic oligonucleotide
cagtgctgattggttcttttccaagcgaccatc

SEQ ID NO: 402911 - DNA, 33 bp, Artificial Sequence
  Description of Artificial Sequence: Synthetic oligonucleotide
agtgctgattggttcttttccaagcgaccatcc

SEQ ID NO: 402912 - DNA, 32 bp, Artificial Sequence
  Description of Artificial Sequence: Synthetic oligonucleotide
gtgctgattggttcttttccaagcgaccatcc

SEQ ID NO: 402913 - DNA, 35 bp, Artificial Sequence
  Description of Artificial Sequence: Synthetic oligonucleotide
tgctgattggttcttttccaagcgaccatccaatc

SEQ ID NO: 402914 - DNA, 34 bp, Artificial Sequence
  Description of Artificial Sequence: Synthetic oligonucleotide
gctgattggttcttttccaagcgaccatccaatc

SEQ ID NO: 402915 - DNA, 34 bp, Artificial Sequence
  Description of Artificial Sequence: Synthetic oligonucleotide
ctgattggttcttttccaagcgaccatccaatcc

SEQ ID NO: 402916 - DNA, 35 bp, Artificial Sequence
  Description of Artificial Sequence: Synthetic oligonucleotide
tgattggttcttttccaagcgaccatccaatcctg

SEQ ID NO: 402917 - DNA, 34 bp, Artificial Sequence
  Description of Artificial Sequence: Synthetic oligonucleotide
gattggttcttttccaagcgaccatccaatcctg

SEQ ID NO: 402918 - DNA, 34 bp, Artificial Sequence
  Description of Artificial Sequence: Synthetic oligonucleotide
attggttcttttccaagcgaccatccaatcctgc

SEQ ID NO: 402919 - DNA, 33 bp, Artificial Sequence
  Description of Artificial Sequence: Synthetic oligonucleotide
ttggttcttttccaagcgaccatccaatcctgc

SEQ ID NO: 402920 - DNA, 32 bp, Artificial Sequence
  Description of Artificial Sequence: Synthetic oligonucleotide
tggttcttttccaagcgaccatccaatcctgc

SEQ ID NO: 402921 - DNA, 31 bp, Artificial Sequence
  Description of Artificial Sequence: Synthetic oligonucleotide
ggttcttttccaagcgaccatccaatcctgc

SEQ ID NO: 402922 - DNA, 31 bp, Artificial Sequence
  Description of Artificial Sequence: Synthetic oligonucleotide
gttcttttccaagcgaccatccaatcctgcc

SEQ ID NO: 402923 - DNA, 32 bp, Artificial Sequence
  Description of Artificial Sequence: Synthetic oligonucleotide
ttcttttccaagcgaccatccaatcctgccac

SEQ ID NO: 402924 - DNA, 31 bp, Artificial Sequence
  Description of Artificial Sequence: Synthetic oligonucleotide
tcttttccaagcgaccatccaatcctgccac

SEQ ID NO: 402925 - DNA, 30 bp, Artificial Sequence
  Description of Artificial Sequence: Synthetic oligonucleotide
cttttccaagcgaccatccaatcctgccac

SEQ ID NO: 402926 - DNA, 30 bp, Artificial Sequence
  Description of Artificial Sequence: Synthetic oligonucleotide
ttttccaagcgaccatccaatcctgccacg

SEQ ID NO: 402927 - DNA, 29 bp, Artificial Sequence
  Description of Artificial Sequence: Synthetic oligonucleotide
tttccaagcgaccatccaatcctgccacg

SEQ ID NO: 402928 - DNA, 28 bp, Artificial Sequence
  Description of Artificial Sequence: Synthetic oligonucleotide
ttccaagcgaccatccaatcctgccacg

SEQ ID NO: 402929 - DNA, 27 bp, Artificial Sequence
  Description of Artificial Sequence: Synthetic oligonucleotide
tccaagcgaccatccaatcctgccacg

SEQ ID NO: 402930 - DNA, 26 bp, Artificial Sequence
  Description of Artificial Sequence: Synthetic oligonucleotide
ccaagcgaccatccaatcctgccacg

SEQ ID NO: 402931 - DNA, 27 bp, Artificial Sequence
  Description of Artificial Sequence: Synthetic oligonucleotide
caagcgaccatccaatcctgccacgca

SEQ ID NO: 402932 - DNA, 27 bp, Artificial Sequence
  Description of Artificial Sequence: Synthetic oligonucleotide
aagcgaccatccaatcctgccacgcac

SEQ ID NO: 402933 - DNA, 26 bp, Artificial Sequence
  Description of Artificial Sequence: Synthetic oligonucleotide
agcgaccatccaatcctgccacgcac

SEQ ID NO: 402934 - DNA, 25 bp, Artificial Sequence
  Description of Artificial Sequence: Synthetic oligonucleotide
gcgaccatccaatcctgccacgcac

SEQ ID NO: 402935 - DNA, 25 bp, Artificial Sequence
  Description of Artificial Sequence: Synthetic oligonucleotide
cgaccatccaatcctgccacgcacg

SEQ ID NO: 402936 - DNA, 27 bp, Artificial Sequence
  Description of Artificial Sequence: Synthetic oligonucleotide
gaccatccaatcctgccacgcacggaa

SEQ ID NO: 402937 - DNA, 28 bp, Artificial Sequence
  Description of Artificial Sequence: Synthetic oligonucleotide
accatccaatcctgccacgcacggaaac

SEQ ID NO: 402938 - DNA, 27 bp, Artificial Sequence
  Description of Artificial Sequence: Synthetic oligonucleotide
ccatccaatcctgccacgcacggaaac

SEQ ID NO: 402939 - DNA, 29 bp, Artificial Sequence
  Description of Artificial Sequence: Synthetic oligonucleotide
catccaatcctgccacgcacggaaacatc

SEQ ID NO: 402940 - DNA, 29 bp, Artificial Sequence
  Description of Artificial Sequence: Synthetic oligonucleotide
atccaatcctgccacgcacggaaacatcc

SEQ ID NO: 402941 - DNA, 28 bp, Artificial Sequence
  Description of Artificial Sequence: Synthetic oligonucleotide
tccaatcctgccacgcacggaaacatcc

SEQ ID NO: 402942 - DNA, 27 bp, Artificial Sequence
  Description of Artificial Sequence: Synthetic oligonucleotide
ccaatcctgccacgcacggaaacatcc

SEQ ID NO: 402943 - DNA, 28 bp, Artificial Sequence
  Description of Artificial Sequence: Synthetic oligonucleotide
caatcctgccacgcacggaaacatccac

SEQ ID NO: 402944 - DNA, 29 bp, Artificial Sequence
  Description of Artificial Sequence: Synthetic oligonucleotide
aatcctgccacgcacggaaacatccacag

SEQ ID NO: 402945 - DNA, 28 bp, Artificial Sequence
  Description of Artificial Sequence: Synthetic oligonucleotide
atcctgccacgcacggaaacatccacag

SEQ ID NO: 402946 - DNA, 27 bp, Artificial Sequence
  Description of Artificial Sequence: Synthetic oligonucleotide
tcctgccacgcacggaaacatccacag

SEQ ID NO: 402947 - DNA, 26 bp, Artificial Sequence
  Description of Artificial Sequence: Synthetic oligonucleotide
cctgccacgcacggaaacatccacag

SEQ ID NO: 402948 - DNA, 27 bp, Artificial Sequence
  Description of Artificial Sequence: Synthetic oligonucleotide
ctgccacgcacggaaacatccacaggt

SEQ ID NO: 402949 - DNA, 34 bp, Artificial Sequence
  Description of Artificial Sequence: Synthetic oligonucleotide
tgccacgcacggaaacatccacaggtttttattc

SEQ ID NO: 402950 - DNA, 33 bp, Artificial Sequence
  Description of Artificial Sequence: Synthetic oligonucleotide
gccacgcacggaaacatccacaggtttttattc

SEQ ID NO: 402951 - DNA, 36 bp, Artificial Sequence
  Description of Artificial Sequence: Synthetic oligonucleotide
ccacgcacggaaacatccacaggtttttattctttc

SEQ ID NO: 402952 - DNA, 37 bp, Artificial Sequence
  Description of Artificial Sequence: Synthetic oligonucleotide
cacgcacggaaacatccacaggtttttattctttctg

SEQ ID NO: 402953 - DNA, 37 bp, Artificial Sequence
  Description of Artificial Sequence: Synthetic oligonucleotide
acgcacggaaacatccacaggtttttattctttctgc

SEQ ID NO: 402954 - DNA, 36 bp, Artificial Sequence
  Description of Artificial Sequence: Synthetic oligonucleotide
cgcacggaaacatccacaggtttttattctttctgc

SEQ ID NO: 402955 - DNA, 36 bp, Artificial Sequence
  Description of Artificial Sequence: Synthetic oligonucleotide
gcacggaaacatccacaggtttttattctttctgcc

SEQ ID NO: 402956 - DNA, 37 bp, Artificial Sequence
  Description of Artificial Sequence: Synthetic oligonucleotide
cacggaaacatccacaggtttttattctttctgccag

SEQ ID NO: 402957 - DNA, 37 bp, Artificial Sequence
  Description of Artificial Sequence: Synthetic oligonucleotide
acggaaacatccacaggtttttattctttctgccagg

SEQ ID NO: 402958 - DNA, 36 bp, Artificial Sequence
  Description of Artificial Sequence: Synthetic oligonucleotide
cggaaacatccacaggtttttattctttctgccagg

SEQ ID NO: 402959 - DNA, 33 bp, Artificial Sequence
  Description of Artificial Sequence: Synthetic oligonucleotide
tttctgccaggtacatcagatccatcaggtctg

SEQ ID NO: 402960 - DNA, 32 bp, Artificial Sequence
  Description of Artificial Sequence: Synthetic oligonucleotide
ttctgccaggtacatcagatccatcaggtctg

SEQ ID NO: 402961 - DNA, 31 bp, Artificial Sequence
  Description of Artificial Sequence: Synthetic oligonucleotide
tctgccaggtacatcagatccatcaggtctg

SEQ ID NO: 402962 - DNA, 30 bp, Artificial Sequence
  Description of Artificial Sequence: Synthetic oligonucleotide
ctgccaggtacatcagatccatcaggtctg

SEQ ID NO: 402963 - DNA, 31 bp, Artificial Sequence
  Description of Artificial Sequence: Synthetic oligonucleotide
tgccaggtacatcagatccatcaggtctgag

SEQ ID NO: 402964 - DNA, 30 bp, Artificial Sequence
  Description of Artificial Sequence: Synthetic oligonucleotide
gccaggtacatcagatccatcaggtctgag

SEQ ID NO: 402965 - DNA, 30 bp, Artificial Sequence
  Description of Artificial Sequence: Synthetic oligonucleotide
ccaggtacatcagatccatcaggtctgagc

SEQ ID NO: 402966 - DNA, 31 bp, Artificial Sequence
  Description of Artificial Sequence: Synthetic oligonucleotide
caggtacatcagatccatcaggtctgagctg

SEQ ID NO: 402967 - DNA, 32 bp, Artificial Sequence
  Description of Artificial Sequence: Synthetic oligonucleotide
aggtacatcagatccatcaggtctgagctgtg

SEQ ID NO: 402968 - DNA, 31 bp, Artificial Sequence
  Description of Artificial Sequence: Synthetic oligonucleotide
ggtacatcagatccatcaggtctgagctgtg

SEQ ID NO: 402969 - DNA, 33 bp, Artificial Sequence
  Description of Artificial Sequence: Synthetic oligonucleotide
gtacatcagatccatcaggtctgagctgtgttg

SEQ ID NO: 402970 - DNA, 34 bp, Artificial Sequence
  Description of Artificial Sequence: Synthetic oligonucleotide
tacatcagatccatcaggtctgagctgtgttgac

SEQ ID NO: 402971 - DNA, 33 bp, Artificial Sequence
  Description of Artificial Sequence: Synthetic oligonucleotide
acatcagatccatcaggtctgagctgtgttgac

SEQ ID NO: 402972 - DNA, 32 bp, Artificial Sequence
  Description of Artificial Sequence: Synthetic oligonucleotide
catcagatccatcaggtctgagctgtgttgac

SEQ ID NO: 402973 - DNA, 34 bp, Artificial Sequence
  Description of Artificial Sequence: Synthetic oligonucleotide
atcagatccatcaggtctgagctgtgttgactac

SEQ ID NO: 402974 - DNA, 33 bp, Artificial Sequence
  Description of Artificial Sequence: Synthetic oligonucleotide
tcagatccatcaggtctgagctgtgttgactac

SEQ ID NO: 402975 - DNA, 32 bp, Artificial Sequence
  Description of Artificial Sequence: Synthetic oligonucleotide
cagatccatcaggtctgagctgtgttgactac

SEQ ID NO: 402976 - DNA, 32 bp, Artificial Sequence
  Description of Artificial Sequence: Synthetic oligonucleotide
agatccatcaggtctgagctgtgttgactacc

SEQ ID NO: 402977 - DNA, 31 bp, Artificial Sequence
  Description of Artificial Sequence: Synthetic oligonucleotide
gatccatcaggtctgagctgtgttgactacc

SEQ ID NO: 402978 - DNA, 32 bp, Artificial Sequence
  Description of Artificial Sequence: Synthetic oligonucleotide
atccatcaggtctgagctgtgttgactaccac

SEQ ID NO: 402979 - DNA, 31 bp, Artificial Sequence
  Description of Artificial Sequence: Synthetic oligonucleotide
tccatcaggtctgagctgtgttgactaccac

SEQ ID NO: 402980 - DNA, 30 bp, Artificial Sequence
  Description of Artificial Sequence: Synthetic oligonucleotide
ccatcaggtctgagctgtgttgactaccac

SEQ ID NO: 402981 - DNA, 32 bp, Artificial Sequence
  Description of Artificial Sequence: Synthetic oligonucleotide
catcaggtctgagctgtgttgactaccactac

SEQ ID NO: 402982 - DNA, 36 bp, Artificial Sequence
  Description of Artificial Sequence: Synthetic oligonucleotide
atcaggtctgagctgtgttgactaccactacttttc

SEQ ID NO: 402983 - DNA, 35 bp, Artificial Sequence
  Description of Artificial Sequence: Synthetic oligonucleotide
tcaggtctgagctgtgttgactaccactacttttc

SEQ ID NO: 402984 - DNA, 34 bp, Artificial Sequence
  Description of Artificial Sequence: Synthetic oligonucleotide
caggtctgagctgtgttgactaccactacttttc

SEQ ID NO: 402985 - DNA, 34 bp, Artificial Sequence
  Description of Artificial Sequence: Synthetic oligonucleotide
aggtctgagctgtgttgactaccactacttttcc

SEQ ID NO: 402986 - DNA, 33 bp, Artificial Sequence
  Description of Artificial Sequence: Synthetic oligonucleotide
ggtctgagctgtgttgactaccactacttttcc

SEQ ID NO: 402987 - DNA, 33 bp, Artificial Sequence
  Description of Artificial Sequence: Synthetic oligonucleotide
gtctgagctgtgttgactaccactacttttccc

SEQ ID NO: 402988 - DNA, 35 bp, Artificial Sequence
  Description of Artificial Sequence: Synthetic oligonucleotide
tctgagctgtgttgactaccactacttttcccttc

SEQ ID NO: 402989 - DNA, 34 bp, Artificial Sequence
  Description of Artificial Sequence: Synthetic oligonucleotide
ctgagctgtgttgactaccactacttttcccttc

SEQ ID NO: 402990 - DNA, 34 bp, Artificial Sequence
  Description of Artificial Sequence: Synthetic oligonucleotide
tgagctgtgttgactaccactacttttcccttcg

SEQ ID NO: 402991 - DNA, 41 bp, Artificial Sequence
  Description of Artificial Sequence: Synthetic oligonucleotide
actacttttcccttcgtctcaattatgtcttggaagaagtc

SEQ ID NO: 402992 - DNA, 40 bp, Artificial Sequence
  Description of Artificial Sequence: Synthetic oligonucleotide
ctacttttcccttcgtctcaattatgtcttggaagaagtc

SEQ ID NO: 402993 - DNA, 43 bp, Artificial Sequence
  Description of Artificial Sequence: Synthetic oligonucleotide
tacttttcccttcgtctcaattatgtcttggaagaagtctttg

SEQ ID NO: 402994 - DNA, 42 bp, Artificial Sequence
  Description of Artificial Sequence: Synthetic oligonucleotide
acttttcccttcgtctcaattatgtcttggaagaagtctttg

SEQ ID NO: 402995 - DNA, 41 bp, Artificial Sequence
  Description of Artificial Sequence: Synthetic oligonucleotide
cttttcccttcgtctcaattatgtcttggaagaagtctttg

SEQ ID NO: 402996 - DNA, 41 bp, Artificial Sequence
  Description of Artificial Sequence: Synthetic oligonucleotide
ttttcccttcgtctcaattatgtcttggaagaagtctttgc

SEQ ID NO: 402997 - DNA, 40 bp, Artificial Sequence
  Description of Artificial Sequence: Synthetic oligonucleotide
tttcccttcgtctcaattatgtcttggaagaagtctttgc

SEQ ID NO: 402998 - DNA, 39 bp, Artificial Sequence
  Description of Artificial Sequence: Synthetic oligonucleotide
ttcccttcgtctcaattatgtcttggaagaagtctttgc

SEQ ID NO: 402999 - DNA, 38 bp, Artificial Sequence
  Description of Artificial Sequence: Synthetic oligonucleotide
tcccttcgtctcaattatgtcttggaagaagtctttgc

SEQ ID NO: 403000 - DNA, 37 bp, Artificial Sequence
  Description of Artificial Sequence: Synthetic oligonucleotide
cccttcgtctcaattatgtcttggaagaagtctttgc

SEQ ID NO: 403001 - DNA, 37 bp, Artificial Sequence
  Description of Artificial Sequence: Synthetic oligonucleotide
ccttcgtctcaattatgtcttggaagaagtctttgcg

SEQ ID NO: 403002 - DNA, 37 bp, Artificial Sequence
  Description of Artificial Sequence: Synthetic oligonucleotide
cttcgtctcaattatgtcttggaagaagtctttgcgg

SEQ ID NO: 403003 - DNA, 39 bp, Artificial Sequence
  Description of Artificial Sequence: Synthetic oligonucleotide
ttcgtctcaattatgtcttggaagaagtctttgcggatc

SEQ ID NO: 403004 - DNA, 38 bp, Artificial Sequence
  Description of Artificial Sequence: Synthetic oligonucleotide
tcgtctcaattatgtcttggaagaagtctttgcggatc

SEQ ID NO: 403005 - DNA, 37 bp, Artificial Sequence
  Description of Artificial Sequence: Synthetic oligonucleotide
cgtctcaattatgtcttggaagaagtctttgcggatc

SEQ ID NO: 403006 - DNA, 37 bp, Artificial Sequence
  Description of Artificial Sequence: Synthetic oligonucleotide
gtctcaattatgtcttggaagaagtctttgcggatcc

SEQ ID NO: 403007 - DNA, 37 bp, Artificial Sequence
  Description of Artificial Sequence: Synthetic oligonucleotide
tctcaattatgtcttggaagaagtctttgcggatccc

SEQ ID NO: 403008 - DNA, 36 bp, Artificial Sequence
  Description of Artificial Sequence: Synthetic oligonucleotide
ctcaattatgtcttggaagaagtctttgcggatccc

SEQ ID NO: 403009 - DNA, 36 bp, Artificial Sequence
  Description of Artificial Sequence: Synthetic oligonucleotide
tcaattatgtcttggaagaagtctttgcggatcccc

SEQ ID NO: 403010 - DNA, 35 bp, Artificial Sequence
  Description of Artificial Sequence: Synthetic oligonucleotide
caattatgtcttggaagaagtctttgcggatcccc

SEQ ID NO: 403011 - DNA, 35 bp, Artificial Sequence
  Description of Artificial Sequence: Synthetic oligonucleotide
aattatgtcttggaagaagtctttgcggatccccg

SEQ ID NO: 403012 - DNA, 34 bp, Artificial Sequence
  Description of Artificial Sequence: Synthetic oligonucleotide
attatgtcttggaagaagtctttgcggatccccg

SEQ ID NO: 403013 - DNA, 33 bp, Artificial Sequence
  Description of Artificial Sequence: Synthetic oligonucleotide
ttatgtcttggaagaagtctttgcggatccccg

SEQ ID NO: 403014 - DNA, 32 bp, Artificial Sequence
  Description of Artificial Sequence: Synthetic oligonucleotide
tatgtcttggaagaagtctttgcggatccccg

SEQ ID NO: 403015 - DNA, 31 bp, Artificial Sequence; identical to SEQ ID NO: 60374
  Description of Artificial Sequence: Synthetic oligonucleotide

SEQ ID NO: 403016 - DNA, 30 bp, Artificial Sequence; identical to SEQ ID NO: 60375
  Description of Artificial Sequence: Synthetic oligonucleotide

SEQ ID NO: 403017 - DNA, 29 bp, Artificial Sequence
  Description of Artificial Sequence: Synthetic oligonucleotide
gtcttggaagaagtctttgcggatccccg

SEQ ID NO: 403018 - DNA, 29 bp, Artificial Sequence
  Description of Artificial Sequence: Synthetic oligonucleotide
tcttggaagaagtctttgcggatccccgg

SEQ ID NO: 403019 - DNA, 28 bp, Artificial Sequence
  Description of Artificial Sequence: Synthetic oligonucleotide
cttggaagaagtctttgcggatccccgg

SEQ ID NO: 403020 - DNA, 29 bp, Artificial Sequence
  Description of Artificial Sequence: Synthetic oligonucleotide
ttggaagaagtctttgcggatccccggag

SEQ ID NO: 403021 - DNA, 28 bp, Artificial Sequence
  Description of Artificial Sequence: Synthetic oligonucleotide
tggaagaagtctttgcggatccccggag

SEQ ID NO: 403022 - DNA, 27 bp, Artificial Sequence
  Description of Artificial Sequence: Synthetic oligonucleotide
ggaagaagtctttgcggatccccggag

SEQ ID NO: 403023 - DNA, 28 bp, Artificial Sequence
  Description of Artificial Sequence: Synthetic oligonucleotide
gaagaagtctttgcggatccccggagac

SEQ ID NO: 403024 - DNA, 28 bp, Artificial Sequence
  Description of Artificial Sequence: Synthetic oligonucleotide
aagaagtctttgcggatccccggagacc

SEQ ID NO: 403025 - DNA, 27 bp, Artificial Sequence
  Description of Artificial Sequence: Synthetic oligonucleotide
agaagtctttgcggatccccggagacc

SEQ ID NO: 403026 - DNA, 27 bp, Artificial Sequence
  Description of Artificial Sequence: Synthetic oligonucleotide
gaagtctttgcggatccccggagacct

SEQ ID NO: 403027 - DNA, 28 bp, Artificial Sequence
  Description of Artificial Sequence: Synthetic oligonucleotide
aagtctttgcggatccccggagaccttc

SEQ ID NO: 403028 - DNA, 27 bp, Artificial Sequence
  Description of Artificial Sequence: Synthetic oligonucleotide
agtctttgcggatccccggagaccttc

SEQ ID NO: 403029 - DNA, 26 bp, Artificial Sequence
  Description of Artificial Sequence: Synthetic oligonucleotide
gtctttgcggatccccggagaccttc

SEQ ID NO: 403030 - DNA, 26 bp, Artificial Sequence
  Description of Artificial Sequence: Synthetic oligonucleotide
tctttgcggatccccggagaccttcg

SEQ ID NO: 403031 - DNA, 25 bp, Artificial Sequence
  Description of Artificial Sequence: Synthetic oligonucleotide
ctttgcggatccccggagaccttcg

SEQ ID NO: 403032 - DNA, 25 bp, Artificial Sequence
  Description of Artificial Sequence: Synthetic oligonucleotide
tttgcggatccccggagaccttcgg

SEQ ID NO: 403033 - DNA, 24 bp, Artificial Sequence
  Description of Artificial Sequence: Synthetic oligonucleotide
ttgcggatccccggagaccttcgg

SEQ ID NO: 403034 - DNA, 23 bp, Artificial Sequence
  Description of Artificial Sequence: Synthetic oligonucleotide
tgcggatccccggagaccttcgg

SEQ ID NO: 403035 - DNA, 22 bp, Artificial Sequence
  Description of Artificial Sequence: Synthetic oligonucleotide
gcggatccccggagaccttcgg

SEQ ID NO: 403036 - DNA, 24 bp, Artificial Sequence
  Description of Artificial Sequence: Synthetic oligonucleotide
cggatccccggagaccttcgggta

SEQ ID NO: 403037 - DNA, 24 bp, Artificial Sequence
  Description of Artificial Sequence: Synthetic oligonucleotide
ggatccccggagaccttcgggtag

SEQ ID NO: 403038 - DNA, 26 bp, Artificial Sequence
  Description of Artificial Sequence: Synthetic oligonucleotide
gatccccggagaccttcgggtagcaa

SEQ ID NO: 403039 - DNA, 27 bp, Artificial Sequence
  Description of Artificial Sequence: Synthetic oligonucleotide
atccccggagaccttcgggtagcaact

SEQ ID NO: 403040 - DNA, 26 bp, Artificial Sequence
  Description of Artificial Sequence: Synthetic oligonucleotide
tccccggagaccttcgggtagcaact

SEQ ID NO: 403041 - DNA, 25 bp, Artificial Sequence
  Description of Artificial Sequence: Synthetic oligonucleotide
ccccggagaccttcgggtagcaact

SEQ ID NO: 403042 - DNA, 26 bp, Artificial Sequence
  Description of Artificial Sequence: Synthetic oligonucleotide
cccggagaccttcgggtagcaactgt

SEQ ID NO: 403043 - DNA, 27 bp, Artificial Sequence
  Description of Artificial Sequence: Synthetic oligonucleotide
ccggagaccttcgggtagcaactgtca

SEQ ID NO: 403044 - DNA, 27 bp, Artificial Sequence
  Description of Artificial Sequence: Synthetic oligonucleotide
cggagaccttcgggtagcaactgtcac

SEQ ID NO: 403045 - DNA, 27 bp, Artificial Sequence
  Description of Artificial Sequence: Synthetic oligonucleotide
ggagaccttcgggtagcaactgtcacc

SEQ ID NO: 403046 - DNA, 29 bp, Artificial Sequence
  Description of Artificial Sequence: Synthetic oligonucleotide
gagaccttcgggtagcaactgtcaccttg

SEQ ID NO: 403047 - DNA, 31 bp, Artificial Sequence; identical to SEQ ID NO: 60406
  Description of Artificial Sequence: Synthetic oligonucleotide

SEQ ID NO: 403048 - DNA, 30 bp, Artificial Sequence; identical to SEQ ID NO: 60407
  Description of Artificial Sequence: Synthetic oligonucleotide

SEQ ID NO: 403049 - DNA, 30 bp, Artificial Sequence; identical to SEQ ID NO: 60408
  Description of Artificial Sequence: Synthetic oligonucleotide

SEQ ID NO: 403050 - DNA, 29 bp, Artificial Sequence
  Description of Artificial Sequence: Synthetic oligonucleotide
ccttcgggtagcaactgtcaccttgatgc

SEQ ID NO: 403051 - DNA, 30 bp, Artificial Sequence; identical to SEQ ID NO: 60410
  Description of Artificial Sequence: Synthetic oligonucleotide

SEQ ID NO: 403052 - DNA, 30 bp, Artificial Sequence; identical to SEQ ID NO: 60411
  Description of Artificial Sequence: Synthetic oligonucleotide

SEQ ID NO: 403053 - DNA, 29 bp, Artificial Sequence
  Description of Artificial Sequence: Synthetic oligonucleotide
tcgggtagcaactgtcaccttgatgctgg

SEQ ID NO: 403054 - DNA, 28 bp, Artificial Sequence
  Description of Artificial Sequence: Synthetic oligonucleotide
cgggtagcaactgtcaccttgatgctgg

SEQ ID NO: 403055 - DNA, 28 bp, Artificial Sequence
  Description of Artificial Sequence: Synthetic oligonucleotide
gggtagcaactgtcaccttgatgctggc

SEQ ID NO: 403056 - DNA, 28 bp, Artificial Sequence
  Description of Artificial Sequence: Synthetic oligonucleotide
ggtagcaactgtcaccttgatgctggcg

SEQ ID NO: 403057 - DNA, 30 bp, Artificial Sequence; identical to SEQ ID NO: 60416
  Description of Artificial Sequence: Synthetic oligonucleotide

SEQ ID NO: 403058 - DNA, 30 bp, Artificial Sequence; identical to SEQ ID NO: 60417
  Description of Artificial Sequence: Synthetic oligonucleotide

SEQ ID NO: 403059 - DNA, 29 bp, Artificial Sequence
  Description of Artificial Sequence: Synthetic oligonucleotide
agcaactgtcaccttgatgctggcgatcc

SEQ ID NO: 403060 - DNA, 28 bp, Artificial Sequence
  Description of Artificial Sequence: Synthetic oligonucleotide
gcaactgtcaccttgatgctggcgatcc

SEQ ID NO: 403061 - DNA, 29 bp, Artificial Sequence
  Description of Artificial Sequence: Synthetic oligonucleotide
caactgtcaccttgatgctggcgatcctg

SEQ ID NO: 403062 - DNA, 30 bp, Artificial Sequence; identical to SEQ ID NO: 60421
  Description of Artificial Sequence: Synthetic oligonucleotide

SEQ ID NO: 403063 - DNA, 29 bp, Artificial Sequence
  Description of Artificial Sequence: Synthetic oligonucleotide
actgtcaccttgatgctggcgatcctgag

SEQ ID NO: 403064 - DNA, 28 bp, Artificial Sequence
  Description of Artificial Sequence: Synthetic oligonucleotide
ctgtcaccttgatgctggcgatcctgag

SEQ ID NO: 403065 - DNA, 28 bp, Artificial Sequence
  Description of Artificial Sequence: Synthetic oligonucleotide
tgtcaccttgatgctggcgatcctgagc

SEQ ID NO: 403066 - DNA, 27 bp, Artificial Sequence
  Description of Artificial Sequence: Synthetic oligonucleotide
gtcaccttgatgctggcgatcctgagc

SEQ ID NO: 403067 - DNA, 28 bp, Artificial Sequence
  Description of Artificial Sequence: Synthetic oligonucleotide
tcaccttgatgctggcgatcctgagctc

SEQ ID NO: 403068 - DNA, 27 bp, Artificial Sequence
  Description of Artificial Sequence: Synthetic oligonucleotide
caccttgatgctggcgatcctgagctc

SEQ ID NO: 403069 - DNA, 27 bp, Artificial Sequence
  Description of Artificial Sequence: Synthetic oligonucleotide
accttgatgctggcgatcctgagctcc

SEQ ID NO: 403070 - DNA, 27 bp, Artificial Sequence
  Description of Artificial Sequence: Synthetic oligonucleotide
ccttgatgctggcgatcctgagctcct

SEQ ID NO: 403071 - DNA, 27 bp, Artificial Sequence
  Description of Artificial Sequence: Synthetic oligonucleotide
cttgatgctggcgatcctgagctcctc

SEQ ID NO: 403072 - DNA, 28 bp, Artificial Sequence
  Description of Artificial Sequence: Synthetic oligonucleotide
ttgatgctggcgatcctgagctcctcac

SEQ ID NO: 403073 - DNA, 27 bp, Artificial Sequence
  Description of Artificial Sequence: Synthetic oligonucleotide
tgatgctggcgatcctgagctcctcac

SEQ ID NO: 403074 - DNA, 27 bp, Artificial Sequence
  Description of Artificial Sequence: Synthetic oligonucleotide
gatgctggcgatcctgagctcctcact

SEQ ID NO: 403075 - DNA, 27 bp, Artificial Sequence
  Description of Artificial Sequence: Synthetic oligonucleotide
atgctggcgatcctgagctcctcactg

SEQ ID NO: 403076 - DNA, 26 bp, Artificial Sequence
  Description of Artificial Sequence: Synthetic oligonucleotide
tgctggcgatcctgagctcctcactg

SEQ ID NO: 403077 - DNA, 25 bp, Artificial Sequence
  Description of Artificial Sequence: Synthetic oligonucleotide
gctggcgatcctgagctcctcactg

SEQ ID NO: 403078 - DNA, 25 bp, Artificial Sequence
  Description of Artificial Sequence: Synthetic oligonucleotide
ctggcgatcctgagctcctcactgg

SEQ ID NO: 403079 - DNA, 26 bp, Artificial Sequence
  Description of Artificial Sequence: Synthetic oligonucleotide
tggcgatcctgagctcctcactggct

SEQ ID NO: 403080 - DNA, 25 bp, Artificial Sequence
  Description of Artificial Sequence: Synthetic oligonucleotide
ggcgatcctgagctcctcactggct

SEQ ID NO: 403081 - DNA, 26 bp, Artificial Sequence
  Description of Artificial Sequence: Synthetic oligonucleotide
gcgatcctgagctcctcactggctga

SEQ ID NO: 403082 - DNA, 26 bp, Artificial Sequence
  Description of Artificial Sequence: Synthetic oligonucleotide
cgatcctgagctcctcactggctgag

SEQ ID NO: 403083 - DNA, 26 bp, Artificial Sequence
  Description of Artificial Sequence: Synthetic oligonucleotide
gatcctgagctcctcactggctgagg

SEQ ID NO: 403084 - DNA, 26 bp, Artificial Sequence
  Description of Artificial Sequence: Synthetic oligonucleotide
atcctgagctcctcactggctgaggg

SEQ ID NO: 403085 - DNA, 25 bp, Artificial Sequence
  Description of Artificial Sequence: Synthetic oligonucleotide
tcctgagctcctcactggctgaggg

SEQ ID NO: 403086 - DNA, 24 bp, Artificial Sequence
  Description of Artificial Sequence: Synthetic oligonucleotide
cctgagctcctcactggctgaggg

SEQ ID NO: 403087 - DNA, 25 bp, Artificial Sequence
  Description of Artificial Sequence: Synthetic oligonucleotide
ctgagctcctcactggctgagggca

SEQ ID NO: 403088 - DNA, 26 bp, Artificial Sequence
  Description of Artificial Sequence: Synthetic oligonucleotide
tgagctcctcactggctgagggcaga

SEQ ID NO: 403089 - DNA, 25 bp, Artificial Sequence
  Description of Artificial Sequence: Synthetic oligonucleotide
gagctcctcactggctgagggcaga

SEQ ID NO: 403090 - DNA, 26 bp, Artificial Sequence
  Description of Artificial Sequence: Synthetic oligonucleotide
agctcctcactggctgagggcagaga

SEQ ID NO: 403091 - DNA, 25 bp, Artificial Sequence
  Description of Artificial Sequence: Synthetic oligonucleotide
gctcctcactggctgagggcagaga

SEQ ID NO: 403092 - DNA, 26 bp, Artificial Sequence
  Description of Artificial Sequence: Synthetic oligonucleotide
ctcctcactggctgagggcagagact

SEQ ID NO: 403093 - DNA, 27 bp, Artificial Sequence
  Description of Artificial Sequence: Synthetic oligonucleotide
tcctcactggctgagggcagagactct

SEQ ID NO: 403094 - DNA, 26 bp, Artificial Sequence
  Description of Artificial Sequence: Synthetic oligonucleotide
cctcactggctgagggcagagactct

SEQ ID NO: 403095 - DNA, 26 bp, Artificial Sequence
  Description of Artificial Sequence: Synthetic oligonucleotide
ctcactggctgagggcagagactctc

SEQ ID NO: 403096 - DNA, 26 bp, Artificial Sequence
  Description of Artificial Sequence: Synthetic oligonucleotide
tcactggctgagggcagagactctcc

SEQ ID NO: 403097 - DNA, 25 bp, Artificial Sequence
  Description of Artificial Sequence: Synthetic oligonucleotide
cactggctgagggcagagactctcc

SEQ ID NO: 403098 - DNA, 25 bp, Artificial Sequence
  Description of Artificial Sequence: Synthetic oligonucleotide
actggctgagggcagagactctccc

SEQ ID NO: 403099 - DNA, 24 bp, Artificial Sequence
  Description of Artificial Sequence: Synthetic oligonucleotide
ctggctgagggcagagactctccc

SEQ ID NO: 403100 - DNA, 30 bp, Artificial Sequence; identical to SEQ ID NO: 60459
  Description of Artificial Sequence: Synthetic oligonucleotide

SEQ ID NO: 403101 - DNA, 31 bp, Artificial Sequence; identical to SEQ ID NO: 60460
  Description of Artificial Sequence: Synthetic oligonucleotide

SEQ ID NO: 403102 - DNA, 32 bp, Artificial Sequence; identical to SEQ ID NO: 60461
  Description of Artificial Sequence: Synthetic oligonucleotide

SEQ ID NO: 403103 - DNA, 23 bp, Artificial Sequence
  Description of Artificial Sequence: Synthetic oligonucleotide
agcgcgtgcggggtgtgaccaga

SEQ ID NO: 403104 - DNA, 22 bp, Artificial Sequence
  Description of Artificial Sequence: Synthetic oligonucleotide
gcgcgtgcggggtgtgaccaga

SEQ ID NO: 403105 - DNA, 23 bp, Artificial Sequence
  Description of Artificial Sequence: Synthetic oligonucleotide
cgcgtgcggggtgtgaccagaca

SEQ ID NO: 403106 - DNA, 25 bp, Artificial Sequence
  Description of Artificial Sequence: Synthetic oligonucleotide
gcgtgcggggtgtgaccagacacat

SEQ ID NO: 403107 - DNA, 27 bp, Artificial Sequence
  Description of Artificial Sequence: Synthetic oligonucleotide
cgtgcggggtgtgaccagacacatcta

SEQ ID NO: 403108 - DNA, 30 bp, Artificial Sequence; identical to SEQ ID NO: 60467
  Description of Artificial Sequence: Synthetic oligonucleotide

SEQ ID NO: 403109 - DNA, 30 bp, Artificial Sequence; identical to SEQ ID NO: 60468
  Description of Artificial Sequence: Synthetic oligonucleotide

SEQ ID NO: 403110 - DNA, 29 bp, Artificial Sequence
  Description of Artificial Sequence: Synthetic oligonucleotide
gcggggtgtgaccagacacatctataacc

SEQ ID NO: 403111 - DNA, 29 bp, Artificial Sequence
  Description of Artificial Sequence: Synthetic oligonucleotide
cggggtgtgaccagacacatctataaccg

SEQ ID NO: 403112 - DNA, 30 bp, Artificial Sequence; identical to SEQ ID NO: 60471
  Description of Artificial Sequence: Synthetic oligonucleotide

SEQ ID NO: 403113 - DNA, 31 bp, Artificial Sequence; identical to SEQ ID NO: 60472
  Description of Artificial Sequence: Synthetic oligonucleotide

SEQ ID NO: 403114 - DNA, 31 bp, Artificial Sequence; identical to SEQ ID NO: 60473
  Description of Artificial Sequence: Synthetic oligonucleotide

SEQ ID NO: 403115 - DNA, 32 bp, Artificial Sequence; identical to SEQ ID NO: 60474
  Description of Artificial Sequence: Synthetic oligonucleotide

SEQ ID NO: 403116 - DNA, 33 bp, Artificial Sequence; identical to SEQ ID NO: 60479
  Description of Artificial Sequence: Synthetic oligonucleotide

SEQ ID NO: 403117 - DNA, 32 bp, Artificial Sequence; identical to SEQ ID NO: 60480
  Description of Artificial Sequence: Synthetic oligonucleotide

SEQ ID NO: 403118 - DNA, 32 bp, Artificial Sequence; identical to SEQ ID NO: 60481
  Description of Artificial Sequence: Synthetic oligonucleotide

SEQ ID NO: 403119 - DNA, 32 bp, Artificial Sequence; identical to SEQ ID NO: 60482
  Description of Artificial Sequence: Synthetic oligonucleotide

SEQ ID NO: 403120 - DNA, 31 bp, Artificial Sequence; identical to SEQ ID NO: 60483
  Description of Artificial Sequence: Synthetic oligonucleotide

SEQ ID NO: 403121 - DNA, 31 bp, Artificial Sequence; identical to SEQ ID NO: 60484
  Description of Artificial Sequence: Synthetic oligonucleotide

SEQ ID NO: 403122 - DNA, 30 bp, Artificial Sequence; identical to SEQ ID NO: 60485
  Description of Artificial Sequence: Synthetic oligonucleotide

SEQ ID NO: 403123 - DNA, 32 bp, Artificial Sequence; identical to SEQ ID NO: 60486
  Description of Artificial Sequence: Synthetic oligonucleotide

SEQ ID NO: 403124 - DNA, 31 bp, Artificial Sequence; identical to SEQ ID NO: 60487
  Description of Artificial Sequence: Synthetic oligonucleotide

SEQ ID NO: 403125 - DNA, 31 bp, Artificial Sequence; identical to SEQ ID NO: 60488
  Description of Artificial Sequence: Synthetic oligonucleotide

SEQ ID NO: 403126 - DNA, 30 bp, Artificial Sequence; identical to SEQ ID NO: 60489
  Description of Artificial Sequence: Synthetic oligonucleotide

SEQ ID NO: 403127 - DNA, 29 bp, Artificial Sequence
  Description of Artificial Sequence: Synthetic oligonucleotide
ctataaccgagaggagtacgtgcgcttcg

SEQ ID NO: 403128 - DNA, 30 bp, Artificial Sequence; identical to SEQ ID NO: 60491
  Description of Artificial Sequence: Synthetic oligonucleotide

SEQ ID NO: 403129 - DNA, 29 bp, Artificial Sequence
  Description of Artificial Sequence: Synthetic oligonucleotide
ataaccgagaggagtacgtgcgcttcgac

SEQ ID NO: 403130 - DNA, 28 bp, Artificial Sequence
  Description of Artificial Sequence: Synthetic oligonucleotide
taaccgagaggagtacgtgcgcttcgac

SEQ ID NO: 403131 - DNA, 27 bp, Artificial Sequence
  Description of Artificial Sequence: Synthetic oligonucleotide
aaccgagaggagtacgtgcgcttcgac

SEQ ID NO: 403132 - DNA, 27 bp, Artificial Sequence
  Description of Artificial Sequence: Synthetic oligonucleotide
accgagaggagtacgtgcgcttcgaca

SEQ ID NO: 403133 - DNA, 26 bp, Artificial Sequence
  Description of Artificial Sequence: Synthetic oligonucleotide
ccgagaggagtacgtgcgcttcgaca

SEQ ID NO: 403134 - DNA, 26 bp, Artificial Sequence
  Description of Artificial Sequence: Synthetic oligonucleotide
cgagaggagtacgtgcgcttcgacag

SEQ ID NO: 403135 - DNA, 26 bp, Artificial Sequence
  Description of Artificial Sequence: Synthetic oligonucleotide
gagaggagtacgtgcgcttcgacagc

SEQ ID NO: 403136 - DNA, 27 bp, Artificial Sequence
  Description of Artificial Sequence: Synthetic oligonucleotide
agaggagtacgtgcgcttcgacagcga

SEQ ID NO: 403137 - DNA, 26 bp, Artificial Sequence
  Description of Artificial Sequence: Synthetic oligonucleotide
gaggagtacgtgcgcttcgacagcga

SEQ ID NO: 403138 - DNA, 26 bp, Artificial Sequence
  Description of Artificial Sequence: Synthetic oligonucleotide
aggagtacgtgcgcttcgacagcgac

SEQ ID NO: 403139 - DNA, 25 bp, Artificial Sequence
  Description of Artificial Sequence: Synthetic oligonucleotide
ggagtacgtgcgcttcgacagcgac

SEQ ID NO: 403140 - DNA, 26 bp, Artificial Sequence
  Description of Artificial Sequence: Synthetic oligonucleotide
gagtacgtgcgcttcgacagcgacgt

SEQ ID NO: 403141 - DNA, 26 bp, Artificial Sequence
  Description of Artificial Sequence: Synthetic oligonucleotide
agtacgtgcgcttcgacagcgacgtg

SEQ ID NO: 403142 - DNA, 25 bp, Artificial Sequence
  Description of Artificial Sequence: Synthetic oligonucleotide
gtacgtgcgcttcgacagcgacgtg

SEQ ID NO: 403143 - DNA, 25 bp, Artificial Sequence
  Description of Artificial Sequence: Synthetic oligonucleotide
tacgtgcgcttcgacagcgacgtgg

SEQ ID NO: 403144 - DNA, 24 bp, Artificial Sequence
  Description of Artificial Sequence: Synthetic oligonucleotide
acgtgcgcttcgacagcgacgtgg

SEQ ID NO: 403145 - DNA, 22 bp, Artificial Sequence
  Description of Artificial Sequence: Synthetic oligonucleotide
cgacgtgggggtgtaccgggca

SEQ ID NO: 403146 - DNA, 23 bp, Artificial Sequence
  Description of Artificial Sequence: Synthetic oligonucleotide
gacgtgggggtgtaccgggcagt

SEQ ID NO: 403147 - DNA, 24 bp, Artificial Sequence
  Description of Artificial Sequence: Synthetic oligonucleotide
acgtgggggtgtaccgggcagtga

SEQ ID NO: 403148 - DNA, 23 bp, Artificial Sequence
  Description of Artificial Sequence: Synthetic oligonucleotide
cgtgggggtgtaccgggcagtga

SEQ ID NO: 403149 - DNA, 23 bp, Artificial Sequence
  Description of Artificial Sequence: Synthetic oligonucleotide
gtgggggtgtaccgggcagtgac

SEQ ID NO: 403150 - DNA, 23 bp, Artificial Sequence
  Description of Artificial Sequence: Synthetic oligonucleotide
tgggggtgtaccgggcagtgacg

SEQ ID NO: 403151 - DNA, 22 bp, Artificial Sequence
  Description of Artificial Sequence: Synthetic oligonucleotide
gggggtgtaccgggcagtgacg

SEQ ID NO: 403152 - DNA, 22 bp, Artificial Sequence
  Description of Artificial Sequence: Synthetic oligonucleotide
ggggtgtaccgggcagtgacgc

SEQ ID NO: 403153 - DNA, 22 bp, Artificial Sequence
  Description of Artificial Sequence: Synthetic oligonucleotide
gggtgtaccgggcagtgacgcc

SEQ ID NO: 403154 - DNA, 22 bp, Artificial Sequence
  Description of Artificial Sequence: Synthetic oligonucleotide
ggtgtaccgggcagtgacgccg

SEQ ID NO: 403155 - DNA, 23 bp, Artificial Sequence
  Description of Artificial Sequence: Synthetic oligonucleotide
gtgtaccgggcagtgacgccgca

SEQ ID NO: 403156 - DNA, 23 bp, Artificial Sequence
  Description of Artificial Sequence: Synthetic oligonucleotide
tgtaccgggcagtgacgccgcag

SEQ ID NO: 403157 - DNA, 22 bp, Artificial Sequence
  Description of Artificial Sequence: Synthetic oligonucleotide
gtaccgggcagtgacgccgcag

SEQ ID NO: 403158 - DNA, 22 bp, Artificial Sequence
  Description of Artificial Sequence: Synthetic oligonucleotide
taccgggcagtgacgccgcagg

SEQ ID NO: 403159 - DNA, 21 bp, Artificial Sequence
  Description of Artificial Sequence: Synthetic oligonucleotide
accgggcagtgacgccgcagg

SEQ ID NO: 403160 - DNA, 20 bp, Artificial Sequence
  Description of Artificial Sequence: Synthetic oligonucleotide
ccgggcagtgacgccgcagg

SEQ ID NO: 403161 - DNA, 20 bp, Artificial Sequence
  Description of Artificial Sequence: Synthetic oligonucleotide
cgggcagtgacgccgcaggg

SEQ ID NO: 403162 - DNA, 20 bp, Artificial Sequence
  Description of Artificial Sequence: Synthetic oligonucleotide
gggcagtgacgccgcagggg

SEQ ID NO: 403163 - DNA, 20 bp, Artificial Sequence
  Description of Artificial Sequence: Synthetic oligonucleotide
ggcagtgacgccgcaggggc

SEQ ID NO: 403164 - DNA, 20 bp, Artificial Sequence
  Description of Artificial Sequence: Synthetic oligonucleotide
gcagtgacgccgcaggggcg

SEQ ID NO: 403165 - DNA, 20 bp, Artificial Sequence
  Description of Artificial Sequence: Synthetic oligonucleotide
cagtgacgccgcaggggcgg

SEQ ID NO: 403166 - DNA, 20 bp, Artificial Sequence
  Description of Artificial Sequence: Synthetic oligonucleotide
agtgacgccgcaggggcggc

SEQ ID NO: 403167 - DNA, 21 bp, Artificial Sequence
  Description of Artificial Sequence: Synthetic oligonucleotide
acgccgcaggggcggcctgtt

SEQ ID NO: 403168 - DNA, 20 bp, Artificial Sequence
  Description of Artificial Sequence: Synthetic oligonucleotide
cgccgcaggggcggcctgtt

SEQ ID NO: 403169 - DNA, 20 bp, Artificial Sequence
  Description of Artificial Sequence: Synthetic oligonucleotide
gccgcaggggcggcctgttg

SEQ ID NO: 403170 - DNA, 20 bp, Artificial Sequence
  Description of Artificial Sequence: Synthetic oligonucleotide
ccgcaggggcggcctgttgc

SEQ ID NO: 403171 - DNA, 20 bp, Artificial Sequence
  Description of Artificial Sequence: Synthetic oligonucleotide
cgcaggggcggcctgttgcc

SEQ ID NO: 403172 - DNA, 21 bp, Artificial Sequence
  Description of Artificial Sequence: Synthetic oligonucleotide
gcaggggcggcctgttgccga

SEQ ID NO: 403173 - DNA, 23 bp, Artificial Sequence
  Description of Artificial Sequence: Synthetic oligonucleotide
caggggcggcctgttgccgagta

SEQ ID NO: 403174 - DNA, 24 bp, Artificial Sequence
  Description of Artificial Sequence: Synthetic oligonucleotide
aggggcggcctgttgccgagtact

SEQ ID NO: 403175 - DNA, 23 bp, Artificial Sequence
  Description of Artificial Sequence: Synthetic oligonucleotide
ggggcggcctgttgccgagtact

SEQ ID NO: 403176 - DNA, 23 bp, Artificial Sequence
  Description of Artificial Sequence: Synthetic oligonucleotide
gggcggcctgttgccgagtactg

SEQ ID NO: 403177 - DNA, 25 bp, Artificial Sequence
  Description of Artificial Sequence: Synthetic oligonucleotide
ggcggcctgttgccgagtactggaa

SEQ ID NO: 403178 - DNA, 26 bp, Artificial Sequence
  Description of Artificial Sequence: Synthetic oligonucleotide
gcggcctgttgccgagtactggaaca

SEQ ID NO: 403179 - DNA, 26 bp, Artificial Sequence
  Description of Artificial Sequence: Synthetic oligonucleotide
cggcctgttgccgagtactggaacag

SEQ ID NO: 403180 - DNA, 26 bp, Artificial Sequence
  Description of Artificial Sequence: Synthetic oligonucleotide
ggcctgttgccgagtactggaacagc

SEQ ID NO: 403181 - DNA, 27 bp, Artificial Sequence
  Description of Artificial Sequence: Synthetic oligonucleotide
gcctgttgccgagtactggaacagcca

SEQ ID NO: 403182 - DNA, 27 bp, Artificial Sequence
  Description of Artificial Sequence: Synthetic oligonucleotide
cctgttgccgagtactggaacagccag

SEQ ID NO: 403183 - DNA, 29 bp, Artificial Sequence
  Description of Artificial Sequence: Synthetic oligonucleotide
ctgttgccgagtactggaacagccagaag

SEQ ID NO: 403184 - DNA, 29 bp, Artificial Sequence
  Description of Artificial Sequence: Synthetic oligonucleotide
tgttgccgagtactggaacagccagaagg

SEQ ID NO: 403185 - DNA, 28 bp, Artificial Sequence
  Description of Artificial Sequence: Synthetic oligonucleotide
gttgccgagtactggaacagccagaagg

SEQ ID NO: 403186 - DNA, 30 bp, Artificial Sequence; identical to SEQ ID NO: 60549
  Description of Artificial Sequence: Synthetic oligonucleotide

SEQ ID NO: 403187 - DNA, 26 bp, Artificial Sequence
  Description of Artificial Sequence: Synthetic oligonucleotide
acagccagaaggaagtcctggagggg

SEQ ID NO: 403188 - DNA, 25 bp, Artificial Sequence
  Description of Artificial Sequence: Synthetic oligonucleotide
cagccagaaggaagtcctggagggg

SEQ ID NO: 403189 - DNA, 25 bp, Artificial Sequence
  Description of Artificial Sequence: Synthetic oligonucleotide
agccagaaggaagtcctggaggggg

SEQ ID NO: 403190 - DNA, 24 bp, Artificial Sequence
  Description of Artificial Sequence: Synthetic oligonucleotide
gccagaaggaagtcctggaggggg

SEQ ID NO: 403191 - DNA, 24 bp, Artificial Sequence
  Description of Artificial Sequence: Synthetic oligonucleotide
ccagaaggaagtcctggagggggc

SEQ ID NO: 403192 - DNA, 24 bp, Artificial Sequence
  Description of Artificial Sequence: Synthetic oligonucleotide
cagaaggaagtcctggagggggcc

SEQ ID NO: 403193 - DNA, 24 bp, Artificial Sequence
  Description of Artificial Sequence: Synthetic oligonucleotide
agaaggaagtcctggagggggccc

SEQ ID NO: 403194 - DNA, 23 bp, Artificial Sequence
  Description of Artificial Sequence: Synthetic oligonucleotide
gaaggaagtcctggagggggccc

SEQ ID NO: 403195 - DNA, 23 bp, Artificial Sequence
  Description of Artificial Sequence: Synthetic oligonucleotide
aaggaagtcctggagggggcccg

SEQ ID NO: 403196 - DNA, 22 bp, Artificial Sequence
  Description of Artificial Sequence: Synthetic oligonucleotide
aggaagtcctggagggggcccg

SEQ ID NO: 403197 - DNA, 21 bp, Artificial Sequence
  Description of Artificial Sequence: Synthetic oligonucleotide
ggaagtcctggagggggcccg

SEQ ID NO: 403198 - DNA, 21 bp, Artificial Sequence
  Description of Artificial Sequence: Synthetic oligonucleotide
gaagtcctggagggggcccgg

SEQ ID NO: 403199 - DNA, 21 bp, Artificial Sequence
  Description of Artificial Sequence: Synthetic oligonucleotide
aagtcctggagggggcccggg

SEQ ID NO: 403200 - DNA, 20 bp, Artificial Sequence
  Description of Artificial Sequence: Synthetic oligonucleotide
agtcctggagggggcccggg

SEQ ID NO: 403201 - DNA, 20 bp, Artificial Sequence
  Description of Artificial Sequence: Synthetic oligonucleotide
gtcctggagggggcccgggt

SEQ ID NO: 403202 - DNA, 20 bp, Artificial Sequence
  Description of Artificial Sequence: Synthetic oligonucleotide
tcctggagggggcccgggct

SEQ ID NO: 403203 - DNA, 20 bp, Artificial Sequence
  Description of Artificial Sequence: Synthetic oligonucleotide
cctggagggggcccgggctt

SEQ ID NO: 403204 - DNA, 20 bp, Artificial Sequence
  Description of Artificial Sequence: Synthetic oligonucleotide
ctggagggggcccgggcgtt

SEQ ID NO: 403205 - DNA, 20 bp, Artificial Sequence
  Description of Artificial Sequence: Synthetic oligonucleotide
tggagggggcccgggcgtct

SEQ ID NO: 403206 - DNA, 20 bp, Artificial Sequence
  Description of Artificial Sequence: Synthetic oligonucleotide
ggagggggcccgggcgtctt

SEQ ID NO: 403207 - DNA, 20 bp, Artificial Sequence
  Description of Artificial Sequence: Synthetic oligonucleotide
gagggggcccgggcgtcgtt

SEQ ID NO: 403208 - DNA, 20 bp, Artificial Sequence
  Description of Artificial Sequence: Synthetic oligonucleotide
agggggcccgggcgtcggtt

SEQ ID NO: 403209 - DNA, 20 bp, Artificial Sequence
  Description of Artificial Sequence: Synthetic oligonucleotide
gggggcccgggcgtcggttt

SEQ ID NO: 403210 - DNA, 20 bp, Artificial Sequence
  Description of Artificial Sequence: Synthetic oligonucleotide
ggggcccgggcgtcggtgtt

SEQ ID NO: 403211 - DNA, 20 bp, Artificial Sequence
  Description of Artificial Sequence: Synthetic oligonucleotide
gggcccgggcgtcggtggat

SEQ ID NO: 403212 - DNA, 20 bp, Artificial Sequence
  Description of Artificial Sequence: Synthetic oligonucleotide
ggcccgggcgtcggtggaca

SEQ ID NO: 403213 - DNA, 20 bp, Artificial Sequence
  Description of Artificial Sequence: Synthetic oligonucleotide
gcccgggcgtcggtggacag

SEQ ID NO: 403214 - DNA, 20 bp, Artificial Sequence
  Description of Artificial Sequence: Synthetic oligonucleotide
cccgggcgtcggtggacagg

SEQ ID NO: 403215 - DNA, 21 bp, Artificial Sequence
  Description of Artificial Sequence: Synthetic oligonucleotide
ccgggcgtcggtggacagggt

SEQ ID NO: 403216 - DNA, 22 bp, Artificial Sequence
  Description of Artificial Sequence: Synthetic oligonucleotide
cgggcgtcggtggacagggtgt

SEQ ID NO: 403217 - DNA, 22 bp, Artificial Sequence
  Description of Artificial Sequence: Synthetic oligonucleotide
gggcgtcggtggacagggtgtg

SEQ ID NO: 403218 - DNA, 23 bp, Artificial Sequence
  Description of Artificial Sequence: Synthetic oligonucleotide
ggcgtcggtggacagggtgtgca

SEQ ID NO: 403219 - DNA, 24 bp, Artificial Sequence
  Description of Artificial Sequence: Synthetic oligonucleotide
gcgtcggtggacagggtgtgcaga

SEQ ID NO: 403220 - DNA, 25 bp, Artificial Sequence
  Description of Artificial Sequence: Synthetic oligonucleotide
cgtcggtggacagggtgtgcagaca

SEQ ID NO: 403221 - DNA, 27 bp, Artificial Sequence
  Description of Artificial Sequence: Synthetic oligonucleotide
gtcggtggacagggtgtgcagacacaa

SEQ ID NO: 403222 - DNA, 27 bp, Artificial Sequence
  Description of Artificial Sequence: Synthetic oligonucleotide
tcggtggacagggtgtgcagacacaac

SEQ ID NO: 403223 - DNA, 28 bp, Artificial Sequence
  Description of Artificial Sequence: Synthetic oligonucleotide
gtggacagggtgtgcagacacaactacg

SEQ ID NO: 403224 - DNA, 29 bp, Artificial Sequence
  Description of Artificial Sequence: Synthetic oligonucleotide
tggacagggtgtgcagacacaactacgag

SEQ ID NO: 403225 - DNA, 28 bp, Artificial Sequence
  Description of Artificial Sequence: Synthetic oligonucleotide
ggacagggtgtgcagacacaactacgag

SEQ ID NO: 403226 - DNA, 28 bp, Artificial Sequence
  Description of Artificial Sequence: Synthetic oligonucleotide
gacagggtgtgcagacacaactacgagg

SEQ ID NO: 403227 - DNA, 29 bp, Artificial Sequence
  Description of Artificial Sequence: Synthetic oligonucleotide
acagggtgtgcagacacaactacgaggtg

SEQ ID NO: 403228 - DNA, 28 bp, Artificial Sequence
  Description of Artificial Sequence: Synthetic oligonucleotide
cagggtgtgcagacacaactacgaggtg

SEQ ID NO: 403229 - DNA, 28 bp, Artificial Sequence
  Description of Artificial Sequence: Synthetic oligonucleotide
agggtgtgcagacacaactacgaggtgg

SEQ ID NO: 403230 - DNA, 27 bp, Artificial Sequence
  Description of Artificial Sequence: Synthetic oligonucleotide
gggtgtgcagacacaactacgaggtgg

SEQ ID NO: 403231 - DNA, 27 bp, Artificial Sequence
  Description of Artificial Sequence: Synthetic oligonucleotide
ggtgtgcagacacaactacgaggtggc

SEQ ID NO: 403232 - DNA, 27 bp, Artificial Sequence
  Description of Artificial Sequence: Synthetic oligonucleotide
gtgtgcagacacaactacgaggtggcg

SEQ ID NO: 403233 - DNA, 29 bp, Artificial Sequence
  Description of Artificial Sequence: Synthetic oligonucleotide
tgtgcagacacaactacgaggtggcgtac

SEQ ID NO: 403234 - DNA, 28 bp, Artificial Sequence
  Description of Artificial Sequence: Synthetic oligonucleotide
gtgcagacacaactacgaggtggcgtac

SEQ ID NO: 403235 - DNA, 28 bp, Artificial Sequence
  Description of Artificial Sequence: Synthetic oligonucleotide
tgcagacacaactacgaggtggcgtacc

SEQ ID NO: 403236 - DNA, 27 bp, Artificial Sequence
  Description of Artificial Sequence: Synthetic oligonucleotide
gcagacacaactacgaggtggcgtacc

SEQ ID NO: 403237 - DNA, 27 bp, Artificial Sequence
  Description of Artificial Sequence: Synthetic oligonucleotide
cagacacaactacgaggtggcgtaccg

SEQ ID NO: 403238 - DNA, 27 bp, Artificial Sequence
  Description of Artificial Sequence: Synthetic oligonucleotide
agacacaactacgaggtggcgtaccgc

SEQ ID NO: 403239 - DNA, 26 bp, Artificial Sequence
  Description of Artificial Sequence: Synthetic oligonucleotide
gacacaactacgaggtggcgtaccgc

SEQ ID NO: 403240 - DNA, 26 bp, Artificial Sequence
  Description of Artificial Sequence: Synthetic oligonucleotide
acacaactacgaggtggcgtaccgcg

SEQ ID NO: 403241 - DNA, 25 bp, Artificial Sequence
  Description of Artificial Sequence: Synthetic oligonucleotide
cacaactacgaggtggcgtaccgcg

SEQ ID NO: 403242 - DNA, 25 bp, Artificial Sequence
  Description of Artificial Sequence: Synthetic oligonucleotide
acaactacgaggtggcgtaccgcgg

SEQ ID NO: 403243 - DNA, 24 bp, Artificial Sequence
  Description of Artificial Sequence: Synthetic oligonucleotide
caactacgaggtggcgtaccgcgg

SEQ ID NO: 403244 - DNA, 26 bp, Artificial Sequence
  Description of Artificial Sequence: Synthetic oligonucleotide
aactacgaggtggcgtaccgcgggat

SEQ ID NO: 403245 - DNA, 25 bp, Artificial Sequence
  Description of Artificial Sequence: Synthetic oligonucleotide
actacgaggtggcgtaccgcgggat

SEQ ID NO: 403246 - DNA, 24 bp, Artificial Sequence
  Description of Artificial Sequence: Synthetic oligonucleotide
ctacgaggtggcgtaccgcgggat

SEQ ID NO: 403247 - DNA, 24 bp, Artificial Sequence
  Description of Artificial Sequence: Synthetic oligonucleotide
tacgaggtggcgtaccgcgggatc

SEQ ID NO: 403248 - DNA, 23 bp, Artificial Sequence
  Description of Artificial Sequence: Synthetic oligonucleotide
acgaggtggcgtaccgcgggatc

SEQ ID NO: 403249 - DNA, 22 bp, Artificial Sequence
  Description of Artificial Sequence: Synthetic oligonucleotide
cgaggtggcgtaccgcgggatc

SEQ ID NO: 403250 - DNA, 23 bp, Artificial Sequence
  Description of Artificial Sequence: Synthetic oligonucleotide
gaggtggcgtaccgcgggatcct

SEQ ID NO: 403251 - DNA, 23 bp, Artificial Sequence
  Description of Artificial Sequence: Synthetic oligonucleotide
aggtggcgtaccgcgggatcctg

SEQ ID NO: 403252 - DNA, 22 bp, Artificial Sequence
  Description of Artificial Sequence: Synthetic oligonucleotide
ggtggcgtaccgcgggatcctg

SEQ ID NO: 403253 - DNA, 23 bp, Artificial Sequence
  Description of Artificial Sequence: Synthetic oligonucleotide
gtggcgtaccgcgggatcctgca

SEQ ID NO: 403254 - DNA, 24 bp, Artificial Sequence
  Description of Artificial Sequence: Synthetic oligonucleotide
tggcgtaccgcgggatcctgcaga

SEQ ID NO: 403255 - DNA, 23 bp, Artificial Sequence
  Description of Artificial Sequence: Synthetic oligonucleotide
ggcgtaccgcgggatcctgcaga

SEQ ID NO: 403256 - DNA, 23 bp, Artificial Sequence
  Description of Artificial Sequence: Synthetic oligonucleotide
gcgtaccgcgggatcctgcagag

SEQ ID NO: 403257 - DNA, 24 bp, Artificial Sequence
  Description of Artificial Sequence: Synthetic oligonucleotide
cgtaccgcgggatcctgcagagga

SEQ ID NO: 403258 - DNA, 25 bp, Artificial Sequence
  Description of Artificial Sequence: Synthetic oligonucleotide
gtaccgcgggatcctgcagaggaga

SEQ ID NO: 403259 - DNA, 26 bp, Artificial Sequence
  Description of Artificial Sequence: Synthetic oligonucleotide
taccgcgggatcctgcagaggagagt

SEQ ID NO: 403260 - DNA, 25 bp, Artificial Sequence
  Description of Artificial Sequence: Synthetic oligonucleotide
accgcgggatcctgcagaggagagt

SEQ ID NO: 403261 - DNA, 24 bp, Artificial Sequence
  Description of Artificial Sequence: Synthetic oligonucleotide
ccgcgggatcctgcagaggagagt

SEQ ID NO: 403262 - DNA, 24 bp, Artificial Sequence
  Description of Artificial Sequence: Synthetic oligonucleotide
cgcgggatcctgcagaggagagtg

SEQ ID NO: 403263 - DNA, 25 bp, Artificial Sequence
  Description of Artificial Sequence: Synthetic oligonucleotide
gcgggatcctgcagaggagagtgga

SEQ ID NO: 403264 - DNA, 25 bp, Artificial Sequence
  Description of Artificial Sequence: Synthetic oligonucleotide
cgggatcctgcagaggagagtggag

SEQ ID NO: 403265 - DNA, 25 bp, Artificial Sequence
  Description of Artificial Sequence: Synthetic oligonucleotide
gggatcctgcagaggagagtggagc

SEQ ID NO: 403266 - DNA, 25 bp, Artificial Sequence
  Description of Artificial Sequence: Synthetic oligonucleotide
ggatcctgcagaggagagtggagcc

SEQ ID NO: 403267 - DNA, 26 bp, Artificial Sequence
  Description of Artificial Sequence: Synthetic oligonucleotide
gatcctgcagaggagagtggagccca

SEQ ID NO: 403268 - DNA, 27 bp, Artificial Sequence
  Description of Artificial Sequence: Synthetic oligonucleotide
atcctgcagaggagagtggagcccaca

SEQ ID NO: 403269 - DNA, 26 bp, Artificial Sequence
  Description of Artificial Sequence: Synthetic oligonucleotide
tcctgcagaggagagtggagcccaca

SEQ ID NO: 403270 - DNA, 25 bp, Artificial Sequence
  Description of Artificial Sequence: Synthetic oligonucleotide
cctgcagaggagagtggagcccaca

SEQ ID NO: 403271 - DNA, 26 bp, Artificial Sequence
  Description of Artificial Sequence: Synthetic oligonucleotide
ctgcagaggagagtggagcccacagt

SEQ ID NO: 403272 - DNA, 27 bp, Artificial Sequence
  Description of Artificial Sequence: Synthetic oligonucleotide
tgcagaggagagtggagcccacagtga

SEQ ID NO: 403273 - DNA, 26 bp, Artificial Sequence
  Description of Artificial Sequence: Synthetic oligonucleotide
gcagaggagagtggagcccacagtga

SEQ ID NO: 403274 - DNA, 26 bp, Artificial Sequence
  Description of Artificial Sequence: Synthetic oligonucleotide
cagaggagagtggagcccacagtgac

SEQ ID NO: 403275 - DNA, 27 bp, Artificial Sequence
  Description of Artificial Sequence: Synthetic oligonucleotide
agaggagagtggagcccacagtgacca

SEQ ID NO: 403276 - DNA, 27 bp, Artificial Sequence
  Description of Artificial Sequence: Synthetic oligonucleotide
gaggagagtggagcccacagtgaccat

SEQ ID NO: 403277 - DNA, 27 bp, Artificial Sequence
  Description of Artificial Sequence: Synthetic oligonucleotide
aggagagtggagcccacagtgaccatc

SEQ ID NO: 403278 - DNA, 27 bp, Artificial Sequence
  Description of Artificial Sequence: Synthetic oligonucleotide
ggagagtggagcccacagtgaccatct

SEQ ID NO: 403279 - DNA, 27 bp, Artificial Sequence
  Description of Artificial Sequence: Synthetic oligonucleotide
gagagtggagcccacagtgaccatctc

SEQ ID NO: 403280 - DNA, 27 bp, Artificial Sequence
  Description of Artificial Sequence: Synthetic oligonucleotide
agagtggagcccacagtgaccatctcc

SEQ ID NO: 403281 - DNA, 29 bp, Artificial Sequence
  Description of Artificial Sequence: Synthetic oligonucleotide
tcaaccaccacaacctgctgatctgctcg

SEQ ID NO: 403282 - DNA, 28 bp, Artificial Sequence
  Description of Artificial Sequence: Synthetic oligonucleotide
caaccaccacaacctgctgatctgctcg

SEQ ID NO: 403283 - DNA, 28 bp, Artificial Sequence
  Description of Artificial Sequence: Synthetic oligonucleotide
aaccaccacaacctgctgatctgctcgg

SEQ ID NO: 403284 - DNA, 27 bp, Artificial Sequence
  Description of Artificial Sequence: Synthetic oligonucleotide
accaccacaacctgctgatctgctcgg

SEQ ID NO: 403285 - DNA, 27 bp, Artificial Sequence
  Description of Artificial Sequence: Synthetic oligonucleotide
ccaccacaacctgctgatctgctcggt

SEQ ID NO: 403286 - DNA, 27 bp, Artificial Sequence
  Description of Artificial Sequence: Synthetic oligonucleotide
caccacaacctgctgatctgctcggtg

SEQ ID NO: 403287 - DNA, 28 bp, Artificial Sequence
  Description of Artificial Sequence: Synthetic oligonucleotide
accacaacctgctgatctgctcggtgac

SEQ ID NO: 403288 - DNA, 27 bp, Artificial Sequence
  Description of Artificial Sequence: Synthetic oligonucleotide
ccacaacctgctgatctgctcggtgac

SEQ ID NO: 403289 - DNA, 28 bp, Artificial Sequence
  Description of Artificial Sequence: Synthetic oligonucleotide
cacaacctgctgatctgctcggtgacag

SEQ ID NO: 403290 - DNA, 32 bp, Artificial Sequence; identical to SEQ ID NO: 60659
  Description of Artificial Sequence: Synthetic oligonucleotide

SEQ ID NO: 403291 - DNA, 31 bp, Artificial Sequence; identical to SEQ ID NO: 60660
  Description of Artificial Sequence: Synthetic oligonucleotide

SEQ ID NO: 403292 - DNA, 34 bp, Artificial Sequence; identical to SEQ ID NO: 60661
  Description of Artificial Sequence: Synthetic oligonucleotide

SEQ ID NO: 403293 - DNA, 33 bp, Artificial Sequence; identical to SEQ ID NO: 60662
  Description of Artificial Sequence: Synthetic oligonucleotide

SEQ ID NO: 403294 - DNA, 32 bp, Artificial Sequence; identical to SEQ ID NO: 60663
  Description of Artificial Sequence: Synthetic oligonucleotide

SEQ ID NO: 403295 - DNA, 32 bp, Artificial Sequence; identical to SEQ ID NO: 60664
  Description of Artificial Sequence: Synthetic oligonucleotide

SEQ ID NO: 403296 - DNA, 34 bp, Artificial Sequence; identical to SEQ ID NO: 60665
  Description of Artificial Sequence: Synthetic oligonucleotide

SEQ ID NO: 403297 - DNA, 33 bp, Artificial Sequence; identical to SEQ ID NO: 60666
  Description of Artificial Sequence: Synthetic oligonucleotide

SEQ ID NO: 403298 - DNA, 33 bp, Artificial Sequence; identical to SEQ ID NO: 60667
  Description of Artificial Sequence: Synthetic oligonucleotide

SEQ ID NO: 403299 - DNA, 33 bp, Artificial Sequence; identical to SEQ ID NO: 60668
  Description of Artificial Sequence: Synthetic oligonucleotide

SEQ ID NO: 403300 - DNA, 32 bp, Artificial Sequence; identical to SEQ ID NO: 60669
  Description of Artificial Sequence: Synthetic oligonucleotide

SEQ ID NO: 403301 - DNA, 33 bp, Artificial Sequence; identical to SEQ ID NO: 60670
  Description of Artificial Sequence: Synthetic oligonucleotide

SEQ ID NO: 403302 - DNA, 32 bp, Artificial Sequence; identical to SEQ ID NO: 60671
  Description of Artificial Sequence: Synthetic oligonucleotide

SEQ ID NO: 403303 - DNA, 31 bp, Artificial Sequence; identical to SEQ ID NO: 60672
  Description of Artificial Sequence: Synthetic oligonucleotide

SEQ ID NO: 403304 - DNA, 33 bp, Artificial Sequence; identical to SEQ ID NO: 60673
  Description of Artificial Sequence: Synthetic oligonucleotide

SEQ ID NO: 403305 - DNA, 32 bp, Artificial Sequence; identical to SEQ ID NO: 60674
  Description of Artificial Sequence: Synthetic oligonucleotide

SEQ ID NO: 403306 - DNA, 35 bp, Artificial Sequence; identical to SEQ ID NO: 60675
  Description of Artificial Sequence: Synthetic oligonucleotide

SEQ ID NO: 403307 - DNA, 36 bp, Artificial Sequence; identical to SEQ ID NO: 60676
  Description of Artificial Sequence: Synthetic oligonucleotide

SEQ ID NO: 403308 - DNA, 35 bp, Artificial Sequence; identical to SEQ ID NO: 60677
  Description of Artificial Sequence: Synthetic oligonucleotide

SEQ ID NO: 403309 - DNA, 35 bp, Artificial Sequence; identical to SEQ ID NO: 60678
  Description of Artificial Sequence: Synthetic oligonucleotide

SEQ ID NO: 403310 - DNA, 35 bp, Artificial Sequence; identical to SEQ ID NO: 60679
  Description of Artificial Sequence: Synthetic oligonucleotide

SEQ ID NO: 403311 - DNA, 35 bp, Artificial Sequence; identical to SEQ ID NO: 60680
  Description of Artificial Sequence: Synthetic oligonucleotide

SEQ ID NO: 403312 - DNA, 34 bp, Artificial Sequence; identical to SEQ ID NO: 60681
  Description of Artificial Sequence: Synthetic oligonucleotide

SEQ ID NO: 403313 - DNA, 35 bp, Artificial Sequence; identical to SEQ ID NO: 60682
  Description of Artificial Sequence: Synthetic oligonucleotide

SEQ ID NO: 403314 - DNA, 34 bp, Artificial Sequence; identical to SEQ ID NO: 60683
  Description of Artificial Sequence: Synthetic oligonucleotide

SEQ ID NO: 403315 - DNA, 34 bp, Artificial Sequence; identical to SEQ ID NO: 60684
  Description of Artificial Sequence: Synthetic oligonucleotide

SEQ ID NO: 403316 - DNA, 33 bp, Artificial Sequence; identical to SEQ ID NO: 60685
  Description of Artificial Sequence: Synthetic oligonucleotide

SEQ ID NO: 403317 - DNA, 36 bp, Artificial Sequence; identical to SEQ ID NO: 60686
  Description of Artificial Sequence: Synthetic oligonucleotide

SEQ ID NO: 403318 - DNA, 35 bp, Artificial Sequence; identical to SEQ ID NO: 60687
  Description of Artificial Sequence: Synthetic oligonucleotide

SEQ ID NO: 403319 - DNA, 34 bp, Artificial Sequence; identical to SEQ ID NO: 60688
  Description of Artificial Sequence: Synthetic oligonucleotide

SEQ ID NO: 403320 - DNA, 33 bp, Artificial Sequence; identical to SEQ ID NO: 60689
  Description of Artificial Sequence: Synthetic oligonucleotide

SEQ ID NO: 403321 - DNA, 32 bp, Artificial Sequence; identical to SEQ ID NO: 60690
  Description of Artificial Sequence: Synthetic oligonucleotide

SEQ ID NO: 403322 - DNA, 32 bp, Artificial Sequence; identical to SEQ ID NO: 60691
  Description of Artificial Sequence: Synthetic oligonucleotide

SEQ ID NO: 403323 - DNA, 31 bp, Artificial Sequence; identical to SEQ ID NO: 60692
  Description of Artificial Sequence: Synthetic oligonucleotide

SEQ ID NO: 403324 - DNA, 30 bp, Artificial Sequence; identical to SEQ ID NO: 60693
  Description of Artificial Sequence: Synthetic oligonucleotide

SEQ ID NO: 403325 - DNA, 29 bp, Artificial Sequence
  Description of Artificial Sequence: Synthetic oligonucleotide
ccaagccagatcaaagtccggtggtttcg

SEQ ID NO: 403326 - DNA, 29 bp, Artificial Sequence
  Description of Artificial Sequence: Synthetic oligonucleotide
caagccagatcaaagtccggtggtttcgg

SEQ ID NO: 403327 - DNA, 32 bp, Artificial Sequence; identical to SEQ ID NO: 60696
  Description of Artificial Sequence: Synthetic oligonucleotide

SEQ ID NO: 403328 - DNA, 31 bp, Artificial Sequence; identical to SEQ ID NO: 60697
  Description of Artificial Sequence: Synthetic oligonucleotide

SEQ ID NO: 403329 - DNA, 30 bp, Artificial Sequence; identical to SEQ ID NO: 60698
  Description of Artificial Sequence: Synthetic oligonucleotide

SEQ ID NO: 403330 - DNA, 32 bp, Artificial Sequence; identical to SEQ ID NO: 60699
  Description of Artificial Sequence: Synthetic oligonucleotide

SEQ ID NO: 403331 - DNA, 33 bp, Artificial Sequence; identical to SEQ ID NO: 60700
  Description of Artificial Sequence: Synthetic oligonucleotide

SEQ ID NO: 403332 - DNA, 33 bp, Artificial Sequence; identical to SEQ ID NO: 60701
  Description of Artificial Sequence: Synthetic oligonucleotide

SEQ ID NO: 403333 - DNA, 32 bp, Artificial Sequence; identical to SEQ ID NO: 60702
  Description of Artificial Sequence: Synthetic oligonucleotide

SEQ ID NO: 403334 - DNA, 33 bp, Artificial Sequence; identical to SEQ ID NO: 60703
  Description of Artificial Sequence: Synthetic oligonucleotide

SEQ ID NO: 403335 - DNA, 32 bp, Artificial Sequence; identical to SEQ ID NO: 60704
  Description of Artificial Sequence: Synthetic oligonucleotide

SEQ ID NO: 403336 - DNA, 31 bp, Artificial Sequence; identical to SEQ ID NO: 60705
  Description of Artificial Sequence: Synthetic oligonucleotide

SEQ ID NO: 403337 - DNA, 31 bp, Artificial Sequence; identical to SEQ ID NO: 60706
  Description of Artificial Sequence: Synthetic oligonucleotide

SEQ ID NO: 403338 - DNA, 30 bp, Artificial Sequence; identical to SEQ ID NO: 60707
  Description of Artificial Sequence: Synthetic oligonucleotide

SEQ ID NO: 403339 - DNA, 29 bp, Artificial Sequence
  Description of Artificial Sequence: Synthetic oligonucleotide
agtccggtggtttcggaatgatcaggagg

SEQ ID NO: 403340 - DNA, 28 bp, Artificial Sequence
  Description of Artificial Sequence: Synthetic oligonucleotide
gtccggtggtttcggaatgatcaggagg

SEQ ID NO: 403341 - DNA, 29 bp, Artificial Sequence
  Description of Artificial Sequence: Synthetic oligonucleotide
tccggtggtttcggaatgatcaggaggag

SEQ ID NO: 403342 - DNA, 28 bp, Artificial Sequence
  Description of Artificial Sequence: Synthetic oligonucleotide
ccggtggtttcggaatgatcaggaggag

SEQ ID NO: 403343 - DNA, 29 bp, Artificial Sequence
  Description of Artificial Sequence: Synthetic oligonucleotide
cggtggtttcggaatgatcaggaggagac

SEQ ID NO: 403344 - DNA, 30 bp, Artificial Sequence; identical to SEQ ID NO: 60713
  Description of Artificial Sequence: Synthetic oligonucleotide

SEQ ID NO: 403345 - DNA, 30 bp, Artificial Sequence; identical to SEQ ID NO: 60714
  Description of Artificial Sequence: Synthetic oligonucleotide

SEQ ID NO: 403346 - DNA, 30 bp, Artificial Sequence; identical to SEQ ID NO: 60715
  Description of Artificial Sequence: Synthetic oligonucleotide

SEQ ID NO: 403347 - DNA, 29 bp, Artificial Sequence
  Description of Artificial Sequence: Synthetic oligonucleotide
ggtttcggaatgatcaggaggagacagcc

SEQ ID NO: 403348 - DNA, 29 bp, Artificial Sequence
  Description of Artificial Sequence: Synthetic oligonucleotide
gtttcggaatgatcaggaggagacagccg

SEQ ID NO: 403349 - DNA, 29 bp, Artificial Sequence
  Description of Artificial Sequence: Synthetic oligonucleotide
tttcggaatgatcaggaggagacagccgg

SEQ ID NO: 403350 - DNA, 28 bp, Artificial Sequence
  Description of Artificial Sequence: Synthetic oligonucleotide
ttcggaatgatcaggaggagacagccgg

SEQ ID NO: 403351 - DNA, 27 bp, Artificial Sequence
  Description of Artificial Sequence: Synthetic oligonucleotide
tcggaatgatcaggaggagacagccgg

SEQ ID NO: 403352 - DNA, 26 bp, Artificial Sequence
  Description of Artificial Sequence: Synthetic oligonucleotide
cggaatgatcaggaggagacagccgg

SEQ ID NO: 403353 - DNA, 26 bp, Artificial Sequence
  Description of Artificial Sequence: Synthetic oligonucleotide
ggaatgatcaggaggagacagccggc

SEQ ID NO: 403354 - DNA, 27 bp, Artificial Sequence
  Description of Artificial Sequence: Synthetic oligonucleotide
gaatgatcaggaggagacagccggcgt

SEQ ID NO: 403355 - DNA, 28 bp, Artificial Sequence
  Description of Artificial Sequence: Synthetic oligonucleotide
aatgatcaggaggagacagccggcgttg

SEQ ID NO: 403356 - DNA, 27 bp, Artificial Sequence
  Description of Artificial Sequence: Synthetic oligonucleotide
atgatcaggaggagacagccggcgttg

SEQ ID NO: 403357 - DNA, 27 bp, Artificial Sequence
  Description of Artificial Sequence: Synthetic oligonucleotide
tgatcaggaggagacagccggcgttgt

SEQ ID NO: 403358 - DNA, 26 bp, Artificial Sequence
  Description of Artificial Sequence: Synthetic oligonucleotide
gatcaggaggagacagccggcgttgt

SEQ ID NO: 403359 - DNA, 27 bp, Artificial Sequence
  Description of Artificial Sequence: Synthetic oligonucleotide
atcaggaggagacagccggcgttgtgt

SEQ ID NO: 403360 - DNA, 26 bp, Artificial Sequence
  Description of Artificial Sequence: Synthetic oligonucleotide
tcaggaggagacagccggcgttgtgt

SEQ ID NO: 403361 - DNA, 25 bp, Artificial Sequence
  Description of Artificial Sequence: Synthetic oligonucleotide
caggaggagacagccggcgttgtgt

SEQ ID NO: 403362 - DNA, 25 bp, Artificial Sequence
  Description of Artificial Sequence: Synthetic oligonucleotide
aggaggagacagccggcgttgtgtc

SEQ ID NO: 403363 - DNA, 24 bp, Artificial Sequence
  Description of Artificial Sequence: Synthetic oligonucleotide
ggaggagacagccggcgttgtgtc

SEQ ID NO: 403364 - DNA, 25 bp, Artificial Sequence
  Description of Artificial Sequence: Synthetic oligonucleotide
gaggagacagccggcgttgtgtcca

SEQ ID NO: 403365 - DNA, 25 bp, Artificial Sequence
  Description of Artificial Sequence: Synthetic oligonucleotide
aggagacagccggcgttgtgtccac

SEQ ID NO: 403366 - DNA, 24 bp, Artificial Sequence
  Description of Artificial Sequence: Synthetic oligonucleotide
ggagacagccggcgttgtgtccac

SEQ ID NO: 403367 - DNA, 24 bp, Artificial Sequence
  Description of Artificial Sequence: Synthetic oligonucleotide
gagacagccggcgttgtgtccacc

SEQ ID NO: 403368 - DNA, 24 bp, Artificial Sequence
  Description of Artificial Sequence: Synthetic oligonucleotide
agacagccggcgttgtgtccaccc

SEQ ID NO: 403369 - DNA, 23 bp, Artificial Sequence
  Description of Artificial Sequence: Synthetic oligonucleotide
gacagccggcgttgtgtccaccc

SEQ ID NO: 403370 - DNA, 23 bp, Artificial Sequence
  Description of Artificial Sequence: Synthetic oligonucleotide
acagccggcgttgtgtccacccc

SEQ ID NO: 403371 - DNA, 22 bp, Artificial Sequence
  Description of Artificial Sequence: Synthetic oligonucleotide
cagccggcgttgtgtccacccc

SEQ ID NO: 403372 - DNA, 22 bp, Artificial Sequence
  Description of Artificial Sequence: Synthetic oligonucleotide
agccggcgttgtgtccaccccc

SEQ ID NO: 403373 - DNA, 21 bp, Artificial Sequence
  Description of Artificial Sequence: Synthetic oligonucleotide
gccggcgttgtgtccaccccc

SEQ ID NO: 403374 - DNA, 22 bp, Artificial Sequence
  Description of Artificial Sequence: Synthetic oligonucleotide
ccggcgttgtgtccacccccct

SEQ ID NO: 403375 - DNA, 26 bp, Artificial Sequence
  Description of Artificial Sequence: Synthetic oligonucleotide
cggcgttgtgtccacccccctcatta

SEQ ID NO: 403376 - DNA, 26 bp, Artificial Sequence
  Description of Artificial Sequence: Synthetic oligonucleotide
ggcgttgtgtccacccccctcattag

SEQ ID NO: 403377 - DNA, 27 bp, Artificial Sequence
  Description of Artificial Sequence: Synthetic oligonucleotide
gcgttgtgtccacccccctcattagga

SEQ ID NO: 403378 - DNA, 28 bp, Artificial Sequence
  Description of Artificial Sequence: Synthetic oligonucleotide
cgttgtgtccacccccctcattaggaac

SEQ ID NO: 403379 - DNA, 28 bp, Artificial Sequence
  Description of Artificial Sequence: Synthetic oligonucleotide
gttgtgtccacccccctcattaggaacg

SEQ ID NO: 403380 - DNA, 28 bp, Artificial Sequence
  Description of Artificial Sequence: Synthetic oligonucleotide
ttgtgtccacccccctcattaggaacgg

SEQ ID NO: 403381 - DNA, 27 bp, Artificial Sequence
  Description of Artificial Sequence: Synthetic oligonucleotide
tgtgtccacccccctcattaggaacgg

SEQ ID NO: 403382 - DNA, 27 bp, Artificial Sequence
  Description of Artificial Sequence: Synthetic oligonucleotide
gtgtccacccccctcattaggaacggt

SEQ ID NO: 403383 - DNA, 27 bp, Artificial Sequence
  Description of Artificial Sequence: Synthetic oligonucleotide
tgtccacccccctcattaggaacggtg

SEQ ID NO: 403384 - DNA, 27 bp, Artificial Sequence
  Description of Artificial Sequence: Synthetic oligonucleotide
gtccacccccctcattaggaacggtga

SEQ ID NO: 403385 - DNA, 27 bp, Artificial Sequence
  Description of Artificial Sequence: Synthetic oligonucleotide
tccacccccctcattaggaacggtgac

SEQ ID NO: 403386 - DNA, 27 bp, Artificial Sequence
  Description of Artificial Sequence: Synthetic oligonucleotide
ccacccccctcattaggaacggtgact

SEQ ID NO: 403387 - DNA, 27 bp, Artificial Sequence
  Description of Artificial Sequence: Synthetic oligonucleotide
cacccccctcattaggaacggtgactg

SEQ ID NO: 403388 - DNA, 27 bp, Artificial Sequence
  Description of Artificial Sequence: Synthetic oligonucleotide
acccccctcattaggaacggtgactgg

SEQ ID NO: 403389 - DNA, 27 bp, Artificial Sequence
  Description of Artificial Sequence: Synthetic oligonucleotide
cccccctcattaggaacggtgactgga

SEQ ID NO: 403390 - DNA, 27 bp, Artificial Sequence
  Description of Artificial Sequence: Synthetic oligonucleotide
ccccctcattaggaacggtgactggac

SEQ ID NO: 403391 - DNA, 27 bp, Artificial Sequence
  Description of Artificial Sequence: Synthetic oligonucleotide
cccctcattaggaacggtgactggacc

SEQ ID NO: 403392 - DNA, 29 bp, Artificial Sequence
  Description of Artificial Sequence: Synthetic oligonucleotide
ccctcattaggaacggtgactggaccttc

SEQ ID NO: 403393 - DNA, 29 bp, Artificial Sequence
  Description of Artificial Sequence: Synthetic oligonucleotide
cctcattaggaacggtgactggaccttcc

SEQ ID NO: 403394 - DNA, 30 bp, Artificial Sequence; identical to SEQ ID NO: 60763
  Description of Artificial Sequence: Synthetic oligonucleotide

SEQ ID NO: 403395 - DNA, 32 bp, Artificial Sequence; identical to SEQ ID NO: 60764
  Description of Artificial Sequence: Synthetic oligonucleotide

SEQ ID NO: 403396 - DNA, 31 bp, Artificial Sequence; identical to SEQ ID NO: 60765
  Description of Artificial Sequence: Synthetic oligonucleotide

SEQ ID NO: 403397 - DNA, 26 bp, Artificial Sequence
  Description of Artificial Sequence: Synthetic oligonucleotide
ctgcccagagcaagatgctgagtggc

SEQ ID NO: 403398 - DNA, 27 bp, Artificial Sequence
  Description of Artificial Sequence: Synthetic oligonucleotide
tgcccagagcaagatgctgagtggcgt

SEQ ID NO: 403399 - DNA, 27 bp, Artificial Sequence
  Description of Artificial Sequence: Synthetic oligonucleotide
gcccagagcaagatgctgagtggcgtt

SEQ ID NO: 403400 - DNA, 27 bp, Artificial Sequence
  Description of Artificial Sequence: Synthetic oligonucleotide
cccagagcaagatgctgagtggcgttg

SEQ ID NO: 403401 - DNA, 27 bp, Artificial Sequence
  Description of Artificial Sequence: Synthetic oligonucleotide
ccagagcaagatgctgagtggcgttgg

SEQ ID NO: 403402 - DNA, 28 bp, Artificial Sequence
  Description of Artificial Sequence: Synthetic oligonucleotide
cagagcaagatgctgagtggcgttggag

SEQ ID NO: 403403 - DNA, 28 bp, Artificial Sequence
  Description of Artificial Sequence: Synthetic oligonucleotide
agagcaagatgctgagtggcgttggagg

SEQ ID NO: 403404 - DNA, 27 bp, Artificial Sequence
  Description of Artificial Sequence: Synthetic oligonucleotide
gagcaagatgctgagtggcgttggagg

SEQ ID NO: 403405 - DNA, 27 bp, Artificial Sequence
  Description of Artificial Sequence: Synthetic oligonucleotide
agcaagatgctgagtggcgttggaggc

SEQ ID NO: 403406 - DNA, 27 bp, Artificial Sequence
  Description of Artificial Sequence: Synthetic oligonucleotide
gcaagatgctgagtggcgttggaggct

SEQ ID NO: 403407 - DNA, 28 bp, Artificial Sequence
  Description of Artificial Sequence: Synthetic oligonucleotide
caagatgctgagtggcgttggaggcttc

SEQ ID NO: 403408 - DNA, 28 bp, Artificial Sequence
  Description of Artificial Sequence: Synthetic oligonucleotide
aagatgctgagtggcgttggaggcttcg

SEQ ID NO: 403409 - DNA, 27 bp, Artificial Sequence
  Description of Artificial Sequence: Synthetic oligonucleotide
agatgctgagtggcgttggaggcttcg

SEQ ID NO: 403410 - DNA, 27 bp, Artificial Sequence
  Description of Artificial Sequence: Synthetic oligonucleotide
gatgctgagtggcgttggaggcttcgt

SEQ ID NO: 403411 - DNA, 27 bp, Artificial Sequence
  Description of Artificial Sequence: Synthetic oligonucleotide
atgctgagtggcgttggaggcttcgtg

SEQ ID NO: 403412 - DNA, 26 bp, Artificial Sequence
  Description of Artificial Sequence: Synthetic oligonucleotide
tgctgagtggcgttggaggcttcgtg

SEQ ID NO: 403413 - DNA, 25 bp, Artificial Sequence
  Description of Artificial Sequence: Synthetic oligonucleotide
gctgagtggcgttggaggcttcgtg

SEQ ID NO: 403414 - DNA, 26 bp, Artificial Sequence
  Description of Artificial Sequence: Synthetic oligonucleotide
ctgagtggcgttggaggcttcgtgct

SEQ ID NO: 403415 - DNA, 26 bp, Artificial Sequence
  Description of Artificial Sequence: Synthetic oligonucleotide
tgagtggcgttggaggcttcgtgctg

SEQ ID NO: 403416 - DNA, 25 bp, Artificial Sequence
  Description of Artificial Sequence: Synthetic oligonucleotide
gagtggcgttggaggcttcgtgctg

SEQ ID NO: 403417 - DNA, 25 bp, Artificial Sequence
  Description of Artificial Sequence: Synthetic oligonucleotide
agtggcgttggaggcttcgtgctgg

SEQ ID NO: 403418 - DNA, 24 bp, Artificial Sequence
  Description of Artificial Sequence: Synthetic oligonucleotide
gtggcgttggaggcttcgtgctgg

SEQ ID NO: 403419 - DNA, 24 bp, Artificial Sequence
  Description of Artificial Sequence: Synthetic oligonucleotide
tggcgttggaggcttcgtgctggg

SEQ ID NO: 403420 - DNA, 23 bp, Artificial Sequence
  Description of Artificial Sequence: Synthetic oligonucleotide
ggcgttggaggcttcgtgctggg

SEQ ID NO: 403421 - DNA, 23 bp, Artificial Sequence
  Description of Artificial Sequence: Synthetic oligonucleotide
gcgttggaggcttcgtgctgggg

SEQ ID NO: 403422 - DNA, 24 bp, Artificial Sequence
  Description of Artificial Sequence: Synthetic oligonucleotide
cgttggaggcttcgtgctggggct

SEQ ID NO: 403423 - DNA, 26 bp, Artificial Sequence
  Description of Artificial Sequence: Synthetic oligonucleotide
gttggaggcttcgtgctggggctgat

SEQ ID NO: 403424 - DNA, 27 bp, Artificial Sequence
  Description of Artificial Sequence: Synthetic oligonucleotide
ggcttcgtgctggggctgatcttcctt

SEQ ID NO: 403425 - DNA, 27 bp, Artificial Sequence
  Description of Artificial Sequence: Synthetic oligonucleotide
gcttcgtgctggggctgatcttccttg

SEQ ID NO: 403426 - DNA, 27 bp, Artificial Sequence
  Description of Artificial Sequence: Synthetic oligonucleotide
cttcgtgctggggctgatcttccttgg

SEQ ID NO: 403427 - DNA, 27 bp, Artificial Sequence
  Description of Artificial Sequence: Synthetic oligonucleotide
ttcgtgctggggctgatcttccttggg

SEQ ID NO: 403428 - DNA, 26 bp, Artificial Sequence
  Description of Artificial Sequence: Synthetic oligonucleotide
tcgtgctggggctgatcttccttggg

SEQ ID NO: 403429 - DNA, 25 bp, Artificial Sequence
  Description of Artificial Sequence: Synthetic oligonucleotide
cgtgctggggctgatcttccttggg

SEQ ID NO: 403430 - DNA, 27 bp, Artificial Sequence
  Description of Artificial Sequence: Synthetic oligonucleotide
gtgctggggctgatcttccttgggctt

SEQ ID NO: 403431 - DNA, 27 bp, Artificial Sequence
  Description of Artificial Sequence: Synthetic oligonucleotide
tgctggggctgatcttccttgggcttg

SEQ ID NO: 403432 - DNA, 26 bp, Artificial Sequence
  Description of Artificial Sequence: Synthetic oligonucleotide
gctggggctgatcttccttgggcttg

SEQ ID NO: 403433 - DNA, 26 bp, Artificial Sequence
  Description of Artificial Sequence: Synthetic oligonucleotide
ctggggctgatcttccttgggcttgg

SEQ ID NO: 403434 - DNA, 26 bp, Artificial Sequence
  Description of Artificial Sequence: Synthetic oligonucleotide
tggggctgatcttccttgggcttggc

SEQ ID NO: 403435 - DNA, 25 bp, Artificial Sequence
  Description of Artificial Sequence: Synthetic oligonucleotide
ggggctgatcttccttgggcttggc

SEQ ID NO: 403436 - DNA, 27 bp, Artificial Sequence
  Description of Artificial Sequence: Synthetic oligonucleotide
gggctgatcttccttgggcttggcctt

SEQ ID NO: 403437 - DNA, 29 bp, Artificial Sequence
  Description of Artificial Sequence: Synthetic oligonucleotide
ggctgatcttccttgggcttggccttatc

SEQ ID NO: 403438 - DNA, 31 bp, Artificial Sequence; identical to SEQ ID NO: 60827
  Description of Artificial Sequence: Synthetic oligonucleotide

SEQ ID NO: 403439 - DNA, 31 bp, Artificial Sequence; identical to SEQ ID NO: 60828
  Description of Artificial Sequence: Synthetic oligonucleotide

SEQ ID NO: 403440 - DNA, 31 bp, Artificial Sequence; identical to SEQ ID NO: 60829
  Description of Artificial Sequence: Synthetic oligonucleotide

SEQ ID NO: 403441 - DNA, 30 bp, Artificial Sequence; identical to SEQ ID NO: 60830
  Description of Artificial Sequence: Synthetic oligonucleotide

SEQ ID NO: 403442 - DNA, 31 bp, Artificial Sequence; identical to SEQ ID NO: 60831
  Description of Artificial Sequence: Synthetic oligonucleotide

SEQ ID NO: 403443 - DNA, 30 bp, Artificial Sequence; identical to SEQ ID NO: 60832
  Description of Artificial Sequence: Synthetic oligonucleotide

SEQ ID NO: 403444 - DNA, 29 bp, Artificial Sequence
  Description of Artificial Sequence: Synthetic oligonucleotide
cttccttgggcttggccttatcatccgtc

SEQ ID NO: 403445 - DNA, 32 bp, Artificial Sequence; identical to SEQ ID NO: 60834
  Description of Artificial Sequence: Synthetic oligonucleotide

SEQ ID NO: 403446 - DNA, 31 bp, Artificial Sequence; identical to SEQ ID NO: 60835
  Description of Artificial Sequence: Synthetic oligonucleotide

SEQ ID NO: 403447 - DNA, 30 bp, Artificial Sequence; identical to SEQ ID NO: 60836
  Description of Artificial Sequence: Synthetic oligonucleotide

SEQ ID NO: 403448 - DNA, 30 bp, Artificial Sequence; identical to SEQ ID NO: 60837
  Description of Artificial Sequence: Synthetic oligonucleotide

SEQ ID NO: 403449 - DNA, 31 bp, Artificial Sequence; identical to SEQ ID NO: 60838
  Description of Artificial Sequence: Synthetic oligonucleotide

SEQ ID NO: 403450 - DNA, 30 bp, Artificial Sequence; identical to SEQ ID NO: 60839
  Description of Artificial Sequence: Synthetic oligonucleotide

SEQ ID NO: 403451 - DNA, 29 bp, Artificial Sequence
  Description of Artificial Sequence: Synthetic oligonucleotide
gggcttggccttatcatccgtcaaaggag

SEQ ID NO: 403452 - DNA, 30 bp, Artificial Sequence; identical to SEQ ID NO: 60841
  Description of Artificial Sequence: Synthetic oligonucleotide

SEQ ID NO: 403453 - DNA, 30 bp, Artificial Sequence; identical to SEQ ID NO: 60842
  Description of Artificial Sequence: Synthetic oligonucleotide

SEQ ID NO: 403454 - DNA, 30 bp, Artificial Sequence; identical to SEQ ID NO: 60843
  Description of Artificial Sequence: Synthetic oligonucleotide

SEQ ID NO: 403455 - DNA, 33 bp, Artificial Sequence; identical to SEQ ID NO: 60844
  Description of Artificial Sequence: Synthetic oligonucleotide

SEQ ID NO: 403456 - DNA, 32 bp, Artificial Sequence; identical to SEQ ID NO: 60845
  Description of Artificial Sequence: Synthetic oligonucleotide

SEQ ID NO: 403457 - DNA, 31 bp, Artificial Sequence; identical to SEQ ID NO: 60846
  Description of Artificial Sequence: Synthetic oligonucleotide

SEQ ID NO: 403458 - DNA, 31 bp, Artificial Sequence; identical to SEQ ID NO: 60847
  Description of Artificial Sequence: Synthetic oligonucleotide

SEQ ID NO: 403459 - DNA, 31 bp, Artificial Sequence; identical to SEQ ID NO: 60848
  Description of Artificial Sequence: Synthetic oligonucleotide

SEQ ID NO: 403460 - DNA, 31 bp, Artificial Sequence; identical to SEQ ID NO: 60849
  Description of Artificial Sequence: Synthetic oligonucleotide

SEQ ID NO: 403461 - DNA, 33 bp, Artificial Sequence; identical to SEQ ID NO: 60850
  Description of Artificial Sequence: Synthetic oligonucleotide

SEQ ID NO: 403462 - DNA, 32 bp, Artificial Sequence; identical to SEQ ID NO: 60851
  Description of Artificial Sequence: Synthetic oligonucleotide

SEQ ID NO: 403463 - DNA, 31 bp, Artificial Sequence; identical to SEQ ID NO: 60852
  Description of Artificial Sequence: Synthetic oligonucleotide

SEQ ID NO: 403464 - DNA, 30 bp, Artificial Sequence; identical to SEQ ID NO: 60853
  Description of Artificial Sequence: Synthetic oligonucleotide

SEQ ID NO: 403465 - DNA, 29 bp, Artificial Sequence
  Description of Artificial Sequence: Synthetic oligonucleotide
catccgtcaaaggagtcggaaagggcttc

SEQ ID NO: 403466 - DNA, 30 bp, Artificial Sequence; identical to SEQ ID NO: 60855
  Description of Artificial Sequence: Synthetic oligonucleotide

SEQ ID NO: 403467 - DNA, 29 bp, Artificial Sequence
  Description of Artificial Sequence: Synthetic oligonucleotide
tccgtcaaaggagtcggaaagggcttctg

SEQ ID NO: 403468 - DNA, 28 bp, Artificial Sequence
  Description of Artificial Sequence: Synthetic oligonucleotide
ccgtcaaaggagtcggaaagggcttctg

SEQ ID NO: 403469 - DNA, 28 bp, Artificial Sequence
  Description of Artificial Sequence: Synthetic oligonucleotide
cgtcaaaggagtcggaaagggcttctgc

SEQ ID NO: 403470 - DNA, 29 bp, Artificial Sequence
  Description of Artificial Sequence: Synthetic oligonucleotide
gtcaaaggagtcggaaagggcttctgcac

SEQ ID NO: 403471 - DNA, 30 bp, Artificial Sequence; identical to SEQ ID NO: 60860
  Description of Artificial Sequence: Synthetic oligonucleotide

SEQ ID NO: 403472 - DNA, 29 bp, Artificial Sequence
  Description of Artificial Sequence: Synthetic oligonucleotide
caaaggagtcggaaagggcttctgcactg

SEQ ID NO: 403473 - DNA, 22 bp, Artificial Sequence
  Description of Artificial Sequence: Synthetic oligonucleotide
tgtaccgggcggtgacgccgca

SEQ ID NO: 403474 - DNA, 21 bp, Artificial Sequence
  Description of Artificial Sequence: Synthetic oligonucleotide
gtaccgggcggtgacgccgca

SEQ ID NO: 403475 - DNA, 21 bp, Artificial Sequence
  Description of Artificial Sequence: Synthetic oligonucleotide
taccgggcggtgacgccgcag

SEQ ID NO: 403476 - DNA, 20 bp, Artificial Sequence
  Description of Artificial Sequence: Synthetic oligonucleotide
accgggcggtgacgccgcag

SEQ ID NO: 403477 - DNA, 20 bp, Artificial Sequence
  Description of Artificial Sequence: Synthetic oligonucleotide
ccgggcggtgacgccgcagt

SEQ ID NO: 403478 - DNA, 20 bp, Artificial Sequence
  Description of Artificial Sequence: Synthetic oligonucleotide
cgggcggtgacgccgcaggt

SEQ ID NO: 403479 - DNA, 20 bp, Artificial Sequence
  Description of Artificial Sequence: Synthetic oligonucleotide
gggcggtgacgccgcagggt

SEQ ID NO: 403480 - DNA, 20 bp, Artificial Sequence
  Description of Artificial Sequence: Synthetic oligonucleotide
ggcggtgacgccgcaggggt

SEQ ID NO: 403481 - DNA, 21 bp, Artificial Sequence
  Description of Artificial Sequence: Synthetic oligonucleotide
gcccgggcgtcggtggacaga

SEQ ID NO: 403482 - DNA, 22 bp, Artificial Sequence
  Description of Artificial Sequence: Synthetic oligonucleotide
cccgggcgtcggtggacagagt

SEQ ID NO: 403483 - DNA, 23 bp, Artificial Sequence
  Description of Artificial Sequence: Synthetic oligonucleotide
ccgggcgtcggtggacagagtgt

SEQ ID NO: 403484 - DNA, 23 bp, Artificial Sequence
  Description of Artificial Sequence: Synthetic oligonucleotide
cgggcgtcggtggacagagtgtg

SEQ ID NO: 403485 - DNA, 24 bp, Artificial Sequence
  Description of Artificial Sequence: Synthetic oligonucleotide
gggcgtcggtggacagagtgtgca

SEQ ID NO: 403486 - DNA, 25 bp, Artificial Sequence
  Description of Artificial Sequence: Synthetic oligonucleotide
ggcgtcggtggacagagtgtgcaga

SEQ ID NO: 403487 - DNA, 26 bp, Artificial Sequence
  Description of Artificial Sequence: Synthetic oligonucleotide
gcgtcggtggacagagtgtgcagaca

SEQ ID NO: 403488 - DNA, 27 bp, Artificial Sequence
  Description of Artificial Sequence: Synthetic oligonucleotide
cgtcggtggacagagtgtgcagacaca

SEQ ID NO: 403489 - DNA, 28 bp, Artificial Sequence
  Description of Artificial Sequence: Synthetic oligonucleotide
gtcggtggacagagtgtgcagacacaac

SEQ ID NO: 403490 - DNA, 30 bp, Artificial Sequence; identical to SEQ ID NO: 60879
  Description of Artificial Sequence: Synthetic oligonucleotide

SEQ ID NO: 403491 - DNA, 29 bp, Artificial Sequence
  Description of Artificial Sequence: Synthetic oligonucleotide
cggtggacagagtgtgcagacacaactac

SEQ ID NO: 403492 - DNA, 29 bp, Artificial Sequence
  Description of Artificial Sequence: Synthetic oligonucleotide
ggtggacagagtgtgcagacacaactacg

SEQ ID NO: 403493 - DNA, 30 bp, Artificial Sequence; identical to SEQ ID NO: 60882
  Description of Artificial Sequence: Synthetic oligonucleotide

SEQ ID NO: 403494 - DNA, 30 bp, Artificial Sequence; identical to SEQ ID NO: 60883
  Description of Artificial Sequence: Synthetic oligonucleotide

SEQ ID NO: 403495 - DNA, 29 bp, Artificial Sequence
  Description of Artificial Sequence: Synthetic oligonucleotide
ggacagagtgtgcagacacaactacgagg

SEQ ID NO: 403496 - DNA, 30 bp, Artificial Sequence; identical to SEQ ID NO: 60885
  Description of Artificial Sequence: Synthetic oligonucleotide

SEQ ID NO: 403497 - DNA, 30 bp, Artificial Sequence; identical to SEQ ID NO: 60886
  Description of Artificial Sequence: Synthetic oligonucleotide

SEQ ID NO: 403498 - DNA, 29 bp, Artificial Sequence
  Description of Artificial Sequence: Synthetic oligonucleotide
cagagtgtgcagacacaactacgaggtgg

SEQ ID NO: 403499 - DNA, 29 bp, Artificial Sequence
  Description of Artificial Sequence: Synthetic oligonucleotide
agagtgtgcagacacaactacgaggtggc

SEQ ID NO: 403500 - DNA, 28 bp, Artificial Sequence
  Description of Artificial Sequence: Synthetic oligonucleotide
gagtgtgcagacacaactacgaggtggc

SEQ ID NO: 403501 - DNA, 28 bp, Artificial Sequence
  Description of Artificial Sequence: Synthetic oligonucleotide
agtgtgcagacacaactacgaggtggcg

SEQ ID NO: 403502 - DNA, 23 bp, Artificial Sequence
  Description of Artificial Sequence: Synthetic oligonucleotide
cgtaccgcgggatcctgcagagg

SEQ ID NO: 403503 - DNA, 21 bp, Artificial Sequence
  Description of Artificial Sequence: Synthetic oligonucleotide
tgacgccgcaggggcggccta

SEQ ID NO: 403504 - DNA, 20 bp, Artificial Sequence
  Description of Artificial Sequence: Synthetic oligonucleotide
gacgccgcaggggcggccta

SEQ ID NO: 403505 - DNA, 20 bp, Artificial Sequence
  Description of Artificial Sequence: Synthetic oligonucleotide
acgccgcaggggcggcctag

SEQ ID NO: 403506 - DNA, 20 bp, Artificial Sequence
  Description of Artificial Sequence: Synthetic oligonucleotide
cgccgcaggggcggcctagt

SEQ ID NO: 403507 - DNA, 20 bp, Artificial Sequence
  Description of Artificial Sequence: Synthetic oligonucleotide
gccgcaggggcggcctagct

SEQ ID NO: 403508 - DNA, 20 bp, Artificial Sequence
  Description of Artificial Sequence: Synthetic oligonucleotide
ccgcaggggcggcctagcgt

SEQ ID NO: 403509 - DNA, 20 bp, Artificial Sequence
  Description of Artificial Sequence: Synthetic oligonucleotide
cgcaggggcggcctagcgct

SEQ ID NO: 403510 - DNA, 20 bp, Artificial Sequence
  Description of Artificial Sequence: Synthetic oligonucleotide
gcaggggcggcctagcgcct

SEQ ID NO: 403511 - DNA, 20 bp, Artificial Sequence
  Description of Artificial Sequence: Synthetic oligonucleotide
caggggcggcctagcgccga

SEQ ID NO: 403512 - DNA, 22 bp, Artificial Sequence
  Description of Artificial Sequence: Synthetic oligonucleotide
aggggcggcctagcgccgagta

SEQ ID NO: 403513 - DNA, 21 bp, Artificial Sequence
  Description of Artificial Sequence: Synthetic oligonucleotide
ggggcggcctagcgccgagta

SEQ ID NO: 403514 - DNA, 22 bp, Artificial Sequence
  Description of Artificial Sequence: Synthetic oligonucleotide
gggcggcctagcgccgagtact

SEQ ID NO: 403515 - DNA, 22 bp, Artificial Sequence
  Description of Artificial Sequence: Synthetic oligonucleotide
ggcggcctagcgccgagtactg

SEQ ID NO: 403516 - DNA, 24 bp, Artificial Sequence
  Description of Artificial Sequence: Synthetic oligonucleotide
gcggcctagcgccgagtactggaa

SEQ ID NO: 403517 - DNA, 25 bp, Artificial Sequence
  Description of Artificial Sequence: Synthetic oligonucleotide
cggcctagcgccgagtactggaaca

SEQ ID NO: 403518 - DNA, 25 bp, Artificial Sequence
  Description of Artificial Sequence: Synthetic oligonucleotide
ggcctagcgccgagtactggaacag

SEQ ID NO: 403519 - DNA, 25 bp, Artificial Sequence
  Description of Artificial Sequence: Synthetic oligonucleotide
gcctagcgccgagtactggaacagc

SEQ ID NO: 403520 - DNA, 26 bp, Artificial Sequence
  Description of Artificial Sequence: Synthetic oligonucleotide
cctagcgccgagtactggaacagcca

SEQ ID NO: 403521 - DNA, 27 bp, Artificial Sequence
  Description of Artificial Sequence: Synthetic oligonucleotide
ctagcgccgagtactggaacagccaga

SEQ ID NO: 403522 - DNA, 28 bp, Artificial Sequence
  Description of Artificial Sequence: Synthetic oligonucleotide
tagcgccgagtactggaacagccagaag

SEQ ID NO: 403523 - DNA, 27 bp, Artificial Sequence
  Description of Artificial Sequence: Synthetic oligonucleotide
agcgccgagtactggaacagccagaag

SEQ ID NO: 403524 - DNA, 26 bp, Artificial Sequence
  Description of Artificial Sequence: Synthetic oligonucleotide
gcgccgagtactggaacagccagaag

SEQ ID NO: 403525 - DNA, 33 bp, Artificial Sequence; identical to SEQ ID NO: 60914
  Description of Artificial Sequence: Synthetic oligonucleotide

SEQ ID NO: 403526 - DNA, 32 bp, Artificial Sequence; identical to SEQ ID NO: 60915
  Description of Artificial Sequence: Synthetic oligonucleotide

SEQ ID NO: 403527 - DNA, 31 bp, Artificial Sequence; identical to SEQ ID NO: 60916
  Description of Artificial Sequence: Synthetic oligonucleotide

SEQ ID NO: 403528 - DNA, 33 bp, Artificial Sequence; identical to SEQ ID NO: 60917
  Description of Artificial Sequence: Synthetic oligonucleotide

SEQ ID NO: 403529 - DNA, 32 bp, Artificial Sequence; identical to SEQ ID NO: 60918
  Description of Artificial Sequence: Synthetic oligonucleotide

SEQ ID NO: 403530 - DNA, 35 bp, Artificial Sequence; identical to SEQ ID NO: 60919
  Description of Artificial Sequence: Synthetic oligonucleotide

SEQ ID NO: 403531 - DNA, 36 bp, Artificial Sequence; identical to SEQ ID NO: 60920
  Description of Artificial Sequence: Synthetic oligonucleotide

SEQ ID NO: 403532 - DNA, 35 bp, Artificial Sequence; identical to SEQ ID NO: 60921
  Description of Artificial Sequence: Synthetic oligonucleotide

SEQ ID NO: 403533 - DNA, 35 bp, Artificial Sequence; identical to SEQ ID NO: 60922
  Description of Artificial Sequence: Synthetic oligonucleotide

SEQ ID NO: 403534 - DNA, 35 bp, Artificial Sequence; identical to SEQ ID NO: 60923
  Description of Artificial Sequence: Synthetic oligonucleotide

SEQ ID NO: 403535 - DNA, 35 bp, Artificial Sequence; identical to SEQ ID NO: 60924
  Description of Artificial Sequence: Synthetic oligonucleotide

SEQ ID NO: 403536 - DNA, 34 bp, Artificial Sequence; identical to SEQ ID NO: 60925
  Description of Artificial Sequence: Synthetic oligonucleotide

SEQ ID NO: 403537 - DNA, 35 bp, Artificial Sequence; identical to SEQ ID NO: 60926
  Description of Artificial Sequence: Synthetic oligonucleotide

SEQ ID NO: 403538 - DNA, 34 bp, Artificial Sequence; identical to SEQ ID NO: 60927
  Description of Artificial Sequence: Synthetic oligonucleotide

SEQ ID NO: 403539 - DNA, 34 bp, Artificial Sequence; identical to SEQ ID NO: 60928
  Description of Artificial Sequence: Synthetic oligonucleotide

SEQ ID NO: 403540 - DNA, 33 bp, Artificial Sequence; identical to SEQ ID NO: 60929
  Description of Artificial Sequence: Synthetic oligonucleotide

SEQ ID NO: 403541 - DNA, 36 bp, Artificial Sequence; identical to SEQ ID NO: 60930
  Description of Artificial Sequence: Synthetic oligonucleotide

SEQ ID NO: 403542 - DNA, 35 bp, Artificial Sequence; identical to SEQ ID NO: 60931
  Description of Artificial Sequence: Synthetic oligonucleotide

SEQ ID NO: 403543 - DNA, 34 bp, Artificial Sequence; identical to SEQ ID NO: 60932
  Description of Artificial Sequence: Synthetic oligonucleotide

SEQ ID NO: 403544 - DNA, 33 bp, Artificial Sequence; identical to SEQ ID NO: 60933
  Description of Artificial Sequence: Synthetic oligonucleotide

SEQ ID NO: 403545 - DNA, 32 bp, Artificial Sequence; identical to SEQ ID NO: 60934
  Description of Artificial Sequence: Synthetic oligonucleotide

SEQ ID NO: 403546 - DNA, 32 bp, Artificial Sequence; identical to SEQ ID NO: 60935
  Description of Artificial Sequence: Synthetic oligonucleotide

SEQ ID NO: 403547 - DNA, 31 bp, Artificial Sequence; identical to SEQ ID NO: 60936
  Description of Artificial Sequence: Synthetic oligonucleotide

SEQ ID NO: 403548 - DNA, 30 bp, Artificial Sequence; identical to SEQ ID NO: 60937
  Description of Artificial Sequence: Synthetic oligonucleotide

SEQ ID NO: 403549 - DNA, 29 bp, Artificial Sequence
  Description of Artificial Sequence: Synthetic oligonucleotide
ccaagccacatcaaagtccggtggtttcg

SEQ ID NO: 403550 - DNA, 29 bp, Artificial Sequence
  Description of Artificial Sequence: Synthetic oligonucleotide
caagccacatcaaagtccggtggtttcgg

SEQ ID NO: 403551 - DNA, 32 bp, Artificial Sequence; identical to SEQ ID NO: 60940
  Description of Artificial Sequence: Synthetic oligonucleotide

SEQ ID NO: 403552 - DNA, 31 bp, Artificial Sequence; identical to SEQ ID NO: 60941
  Description of Artificial Sequence: Synthetic oligonucleotide

SEQ ID NO: 403553 - DNA, 30 bp, Artificial Sequence; identical to SEQ ID NO: 60942
  Description of Artificial Sequence: Synthetic oligonucleotide

SEQ ID NO: 403554 - DNA, 32 bp, Artificial Sequence; identical to SEQ ID NO: 60943
  Description of Artificial Sequence: Synthetic oligonucleotide

SEQ ID NO: 403555 - DNA, 33 bp, Artificial Sequence; identical to SEQ ID NO: 60944
  Description of Artificial Sequence: Synthetic oligonucleotide

SEQ ID NO: 403556 - DNA, 33 bp, Artificial Sequence; identical to SEQ ID NO: 60945
  Description of Artificial Sequence: Synthetic oligonucleotide

SEQ ID NO: 403557 - DNA, 32 bp, Artificial Sequence; identical to SEQ ID NO: 60946
  Description of Artificial Sequence: Synthetic oligonucleotide

SEQ ID NO: 403558 - DNA, 23 bp, Artificial Sequence
  Description of Artificial Sequence: Synthetic oligonucleotide
gtgtatcgggcggtgacgccgca

SEQ ID NO: 403559 - DNA, 23 bp, Artificial Sequence
  Description of Artificial Sequence: Synthetic oligonucleotide
tgtatcgggcggtgacgccgcag

SEQ ID NO: 403560 - DNA, 22 bp, Artificial Sequence
  Description of Artificial Sequence: Synthetic oligonucleotide
gtatcgggcggtgacgccgcag

SEQ ID NO: 403561 - DNA, 22 bp, Artificial Sequence
  Description of Artificial Sequence: Synthetic oligonucleotide
tatcgggcggtgacgccgcagg

SEQ ID NO: 403562 - DNA, 21 bp, Artificial Sequence
  Description of Artificial Sequence: Synthetic oligonucleotide
atcgggcggtgacgccgcagg

SEQ ID NO: 403563 - DNA, 20 bp, Artificial Sequence
  Description of Artificial Sequence: Synthetic oligonucleotide
tcgggcggtgacgccgcagg

SEQ ID NO: 403564 - DNA, 38 bp, Artificial Sequence
  Description of Artificial Sequence: Synthetic oligonucleotide
tgccaggcactggattgagaaccttcacaaaaaaaatg

SEQ ID NO: 403565 - DNA, 37 bp, Artificial Sequence
  Description of Artificial Sequence: Synthetic oligonucleotide
gccaggcactggattgagaaccttcacaaaaaaaatg

SEQ ID NO: 403566 - DNA, 38 bp, Artificial Sequence
  Description of Artificial Sequence: Synthetic oligonucleotide
ccaggcactggattgagaaccttcacaaaaaaaatgtc

SEQ ID NO: 403567 - DNA, 39 bp, Artificial Sequence
  Description of Artificial Sequence: Synthetic oligonucleotide
caggcactggattgagaaccttcacaaaaaaaatgtctg

SEQ ID NO: 403568 - DNA, 39 bp, Artificial Sequence
  Description of Artificial Sequence: Synthetic oligonucleotide
aggcactggattgagaaccttcacaaaaaaaatgtctgc

SEQ ID NO: 403569 - DNA, 38 bp, Artificial Sequence
  Description of Artificial Sequence: Synthetic oligonucleotide
ggcactggattgagaaccttcacaaaaaaaatgtctgc

SEQ ID NO: 403570 - DNA, 38 bp, Artificial Sequence
  Description of Artificial Sequence: Synthetic oligonucleotide
gcactggattgagaaccttcacaaaaaaaatgtctgcc

SEQ ID NO: 403571 - DNA, 38 bp, Artificial Sequence
  Description of Artificial Sequence: Synthetic oligonucleotide
cactggattgagaaccttcacaaaaaaaatgtctgccc

SEQ ID NO: 403572 - DNA, 39 bp, Artificial Sequence
  Description of Artificial Sequence: Synthetic oligonucleotide
actggattgagaaccttcacaaaaaaaatgtctgcccag

SEQ ID NO: 403573 - DNA, 38 bp, Artificial Sequence
  Description of Artificial Sequence: Synthetic oligonucleotide
ctggattgagaaccttcacaaaaaaaatgtctgcccag

SEQ ID NO: 403574 - DNA, 39 bp, Artificial Sequence
  Description of Artificial Sequence: Synthetic oligonucleotide
tggattgagaaccttcacaaaaaaaatgtctgcccagag

SEQ ID NO: 403575 - DNA, 38 bp, Artificial Sequence
  Description of Artificial Sequence: Synthetic oligonucleotide
ggattgagaaccttcacaaaaaaaatgtctgcccagag

SEQ ID NO: 403576 - DNA, 39 bp, Artificial Sequence
  Description of Artificial Sequence: Synthetic oligonucleotide
gattgagaaccttcacaaaaaaaatgtctgcccagagac

SEQ ID NO: 403577 - DNA, 40 bp, Artificial Sequence
  Description of Artificial Sequence: Synthetic oligonucleotide
attgagaaccttcacaaaaaaaatgtctgcccagagacag

SEQ ID NO: 403578 - DNA, 39 bp, Artificial Sequence
  Description of Artificial Sequence: Synthetic oligonucleotide
ttgagaaccttcacaaaaaaaatgtctgcccagagacag

SEQ ID NO: 403579 - DNA, 38 bp, Artificial Sequence
  Description of Artificial Sequence: Synthetic oligonucleotide
tgagaaccttcacaaaaaaaatgtctgcccagagacag

SEQ ID NO: 403580 - DNA, 37 bp, Artificial Sequence
  Description of Artificial Sequence: Synthetic oligonucleotide
gagaaccttcacaaaaaaaatgtctgcccagagacag

SEQ ID NO: 403581 - DNA, 39 bp, Artificial Sequence
  Description of Artificial Sequence: Synthetic oligonucleotide
agaaccttcacaaaaaaaatgtctgcccagagacagatg

SEQ ID NO: 403582 - DNA, 38 bp, Artificial Sequence
  Description of Artificial Sequence: Synthetic oligonucleotide
gaaccttcacaaaaaaaatgtctgcccagagacagatg

SEQ ID NO: 403583 - DNA, 39 bp, Artificial Sequence
  Description of Artificial Sequence: Synthetic oligonucleotide
aaccttcacaaaaaaaatgtctgcccagagacagatgag

SEQ ID NO: 403584 - DNA, 38 bp, Artificial Sequence
  Description of Artificial Sequence: Synthetic oligonucleotide
accttcacaaaaaaaatgtctgcccagagacagatgag

SEQ ID NO: 403585 - DNA, 37 bp, Artificial Sequence
  Description of Artificial Sequence: Synthetic oligonucleotide
ccttcacaaaaaaaatgtctgcccagagacagatgag

SEQ ID NO: 403586 - DNA, 37 bp, Artificial Sequence
  Description of Artificial Sequence: Synthetic oligonucleotide
cttcacaaaaaaaatgtctgcccagagacagatgagg

SEQ ID NO: 403587 - DNA, 38 bp, Artificial Sequence
  Description of Artificial Sequence: Synthetic oligonucleotide
ttcacaaaaaaaatgtctgcccagagacagatgaggtc

SEQ ID NO: 403588 - DNA, 37 bp, Artificial Sequence
  Description of Artificial Sequence: Synthetic oligonucleotide
tcacaaaaaaaatgtctgcccagagacagatgaggtc

SEQ ID NO: 403589 - DNA, 36 bp, Artificial Sequence
  Description of Artificial Sequence: Synthetic oligonucleotide
cacaaaaaaaatgtctgcccagagacagatgaggtc

SEQ ID NO: 403590 - DNA, 36 bp, Artificial Sequence
  Description of Artificial Sequence: Synthetic oligonucleotide
acaaaaaaaatgtctgcccagagacagatgaggtcc

SEQ ID NO: 403591 - DNA, 35 bp, Artificial Sequence
  Description of Artificial Sequence: Synthetic oligonucleotide
caaaaaaaatgtctgcccagagacagatgaggtcc

SEQ ID NO: 403592 - DNA, 20 bp, Artificial Sequence
  Description of Artificial Sequence: Synthetic oligonucleotide
acgccgcaggggcggcctga

SEQ ID NO: 403593 - DNA, 20 bp, Artificial Sequence
  Description of Artificial Sequence: Synthetic oligonucleotide
gccgcaggggcggcctgact

SEQ ID NO: 403594 - DNA, 20 bp, Artificial Sequence
  Description of Artificial Sequence: Synthetic oligonucleotide
ccgcaggggcggcctgacgt

SEQ ID NO: 403595 - DNA, 20 bp, Artificial Sequence
  Description of Artificial Sequence: Synthetic oligonucleotide
cgcaggggcggcctgacgct

SEQ ID NO: 403596 - DNA, 20 bp, Artificial Sequence
  Description of Artificial Sequence: Synthetic oligonucleotide
gcaggggcggcctgacgcct

SEQ ID NO: 403597 - DNA, 20 bp, Artificial Sequence
  Description of Artificial Sequence: Synthetic oligonucleotide
caggggcggcctgacgccga

SEQ ID NO: 403598 - DNA, 22 bp, Artificial Sequence
  Description of Artificial Sequence: Synthetic oligonucleotide
aggggcggcctgacgccgagta

SEQ ID NO: 403599 - DNA, 21 bp, Artificial Sequence
  Description of Artificial Sequence: Synthetic oligonucleotide
ggggcggcctgacgccgagta

SEQ ID NO: 403600 - DNA, 22 bp, Artificial Sequence
  Description of Artificial Sequence: Synthetic oligonucleotide
gggcggcctgacgccgagtact

SEQ ID NO: 403601 - DNA, 22 bp, Artificial Sequence
  Description of Artificial Sequence: Synthetic oligonucleotide
ggcggcctgacgccgagtactg

SEQ ID NO: 403602 - DNA, 24 bp, Artificial Sequence
  Description of Artificial Sequence: Synthetic oligonucleotide
gcggcctgacgccgagtactggaa

SEQ ID NO: 403603 - DNA, 25 bp, Artificial Sequence
  Description of Artificial Sequence: Synthetic oligonucleotide
cggcctgacgccgagtactggaaca

SEQ ID NO: 403604 - DNA, 25 bp, Artificial Sequence
  Description of Artificial Sequence: Synthetic oligonucleotide
ggcctgacgccgagtactggaacag

SEQ ID NO: 403605 - DNA, 32 bp, Artificial Sequence; identical to SEQ ID NO: 60966
  Description of Artificial Sequence: Synthetic oligonucleotide

SEQ ID NO: 403606 - DNA, 32 bp, Artificial Sequence; identical to SEQ ID NO: 60967
  Description of Artificial Sequence: Synthetic oligonucleotide

SEQ ID NO: 403607 - DNA, 33 bp, Artificial Sequence; identical to SEQ ID NO: 60968
  Description of Artificial Sequence: Synthetic oligonucleotide

SEQ ID NO: 403608 - DNA, 32 bp, Artificial Sequence; identical to SEQ ID NO: 60969
  Description of Artificial Sequence: Synthetic oligonucleotide

SEQ ID NO: 403609 - DNA, 31 bp, Artificial Sequence; identical to SEQ ID NO: 60970
  Description of Artificial Sequence: Synthetic oligonucleotide

SEQ ID NO: 403610 - DNA, 30 bp, Artificial Sequence; identical to SEQ ID NO: 60971
  Description of Artificial Sequence: Synthetic oligonucleotide

SEQ ID NO: 403611 - DNA, 29 bp, Artificial Sequence
  Description of Artificial Sequence: Synthetic oligonucleotide
catccgtcaaaggagtcggaaaggacctc

SEQ ID NO: 403612 - DNA, 31 bp, Artificial Sequence; identical to SEQ ID NO: 60973
  Description of Artificial Sequence: Synthetic oligonucleotide

SEQ ID NO: 403613 - DNA, 30 bp, Artificial Sequence; identical to SEQ ID NO: 60974
  Description of Artificial Sequence: Synthetic oligonucleotide

SEQ ID NO: 403614 - DNA, 29 bp, Artificial Sequence
  Description of Artificial Sequence: Synthetic oligonucleotide
ccgtcaaaggagtcggaaaggacctcaag

SEQ ID NO: 403615 - DNA, 29 bp, Artificial Sequence
  Description of Artificial Sequence: Synthetic oligonucleotide
cgtcaaaggagtcggaaaggacctcaagg

SEQ ID NO: 403616 - DNA, 29 bp, Artificial Sequence
  Description of Artificial Sequence: Synthetic oligonucleotide
gtcaaaggagtcggaaaggacctcaaggg

SEQ ID NO: 403617 - DNA, 29 bp, Artificial Sequence
  Description of Artificial Sequence: Synthetic oligonucleotide
tcaaaggagtcggaaaggacctcaagggc

SEQ ID NO: 403618 - DNA, 28 bp, Artificial Sequence
  Description of Artificial Sequence: Synthetic oligonucleotide
caaaggagtcggaaaggacctcaagggc

SEQ ID NO: 403619 - DNA, 28 bp, Artificial Sequence
  Description of Artificial Sequence: Synthetic oligonucleotide
aaaggagtcggaaaggacctcaagggcc

SEQ ID NO: 403620 - DNA, 27 bp, Artificial Sequence
  Description of Artificial Sequence: Synthetic oligonucleotide
aaggagtcggaaaggacctcaagggcc

SEQ ID NO: 403621 - DNA, 27 bp, Artificial Sequence
  Description of Artificial Sequence: Synthetic oligonucleotide
aggagtcggaaaggacctcaagggcct

SEQ ID NO: 403622 - DNA, 26 bp, Artificial Sequence
  Description of Artificial Sequence: Synthetic oligonucleotide
ggagtcggaaaggacctcaagggcct

SEQ ID NO: 403623 - DNA, 26 bp, Artificial Sequence
  Description of Artificial Sequence: Synthetic oligonucleotide
gagtcggaaaggacctcaagggcctc

SEQ ID NO: 403624 - DNA, 27 bp, Artificial Sequence
  Description of Artificial Sequence: Synthetic oligonucleotide
agtcggaaaggacctcaagggcctcca

SEQ ID NO: 403625 - DNA, 26 bp, Artificial Sequence
  Description of Artificial Sequence: Synthetic oligonucleotide
gtcggaaaggacctcaagggcctcca

SEQ ID NO: 403626 - DNA, 26 bp, Artificial Sequence
  Description of Artificial Sequence: Synthetic oligonucleotide
tcggaaaggacctcaagggcctccac

SEQ ID NO: 403627 - DNA, 25 bp, Artificial Sequence
  Description of Artificial Sequence: Synthetic oligonucleotide
cggaaaggacctcaagggcctccac

SEQ ID NO: 403628 - DNA, 26 bp, Artificial Sequence
  Description of Artificial Sequence: Synthetic oligonucleotide
ggaaaggacctcaagggcctccacca

SEQ ID NO: 403629 - DNA, 26 bp, Artificial Sequence
  Description of Artificial Sequence: Synthetic oligonucleotide
gaaaggacctcaagggcctccaccag

SEQ ID NO: 403630 - DNA, 27 bp, Artificial Sequence
  Description of Artificial Sequence: Synthetic oligonucleotide
aaaggacctcaagggcctccaccagca

SEQ ID NO: 403631 - DNA, 26 bp, Artificial Sequence
  Description of Artificial Sequence: Synthetic oligonucleotide
aaggacctcaagggcctccaccagca

SEQ ID NO: 403632 - DNA, 25 bp, Artificial Sequence
  Description of Artificial Sequence: Synthetic oligonucleotide
aggacctcaagggcctccaccagca

SEQ ID NO: 403633 - DNA, 24 bp, Artificial Sequence
  Description of Artificial Sequence: Synthetic oligonucleotide
ggacctcaagggcctccaccagca

SEQ ID NO: 403634 - DNA, 24 bp, Artificial Sequence
  Description of Artificial Sequence: Synthetic oligonucleotide
gacctcaagggcctccaccagcag

SEQ ID NO: 403635 - DNA, 24 bp, Artificial Sequence
  Description of Artificial Sequence: Synthetic oligonucleotide
acctcaagggcctccaccagcagg

SEQ ID NO: 403636 - DNA, 23 bp, Artificial Sequence
  Description of Artificial Sequence: Synthetic oligonucleotide
cctcaagggcctccaccagcagg

SEQ ID NO: 403637 - DNA, 23 bp, Artificial Sequence
  Description of Artificial Sequence: Synthetic oligonucleotide
ctcaagggcctccaccagcaggg

SEQ ID NO: 403638 - DNA, 25 bp, Artificial Sequence
  Description of Artificial Sequence: Synthetic oligonucleotide
tcaagggcctccaccagcagggctt

SEQ ID NO: 403639 - DNA, 24 bp, Artificial Sequence
  Description of Artificial Sequence: Synthetic oligonucleotide
caagggcctccaccagcagggctt

SEQ ID NO: 403640 - DNA, 25 bp, Artificial Sequence
  Description of Artificial Sequence: Synthetic oligonucleotide
aagggcctccaccagcagggcttct

SEQ ID NO: 403641 - DNA, 24 bp, Artificial Sequence
  Description of Artificial Sequence: Synthetic oligonucleotide
agggcctccaccagcagggcttct

SEQ ID NO: 403642 - DNA, 23 bp, Artificial Sequence
  Description of Artificial Sequence: Synthetic oligonucleotide
gggcctccaccagcagggcttct

SEQ ID NO: 403643 - DNA, 23 bp, Artificial Sequence
  Description of Artificial Sequence: Synthetic oligonucleotide
ggcctccaccagcagggcttctg

SEQ ID NO: 403644 - DNA, 24 bp, Artificial Sequence
  Description of Artificial Sequence: Synthetic oligonucleotide
gcctccaccagcagggcttctgca

SEQ ID NO: 403645 - DNA, 25 bp, Artificial Sequence
  Description of Artificial Sequence: Synthetic oligonucleotide
cctccaccagcagggcttctgcact

SEQ ID NO: 403646 - DNA, 26 bp, Artificial Sequence
  Description of Artificial Sequence: Synthetic oligonucleotide
ctccaccagcagggcttctgcactga

SEQ ID NO: 403647 - DNA, 39 bp, Artificial Sequence
  Description of Artificial Sequence: Synthetic oligonucleotide
ttcacaaaaaaaatgtctgcccagagacagatgaggttc

SEQ ID NO: 403648 - DNA, 38 bp, Artificial Sequence
  Description of Artificial Sequence: Synthetic oligonucleotide
tcacaaaaaaaatgtctgcccagagacagatgaggttc

SEQ ID NO: 403649 - DNA, 37 bp, Artificial Sequence
  Description of Artificial Sequence: Synthetic oligonucleotide
cacaaaaaaaatgtctgcccagagacagatgaggttc

SEQ ID NO: 403650 - DNA, 39 bp, Artificial Sequence
  Description of Artificial Sequence: Synthetic oligonucleotide
acaaaaaaaatgtctgcccagagacagatgaggttcttc

SEQ ID NO: 403651 - DNA, 38 bp, Artificial Sequence
  Description of Artificial Sequence: Synthetic oligonucleotide
caaaaaaaatgtctgcccagagacagatgaggttcttc

SEQ ID NO: 403652 - DNA, 39 bp, Artificial Sequence
  Description of Artificial Sequence: Synthetic oligonucleotide
aaaaaaaatgtctgcccagagacagatgaggttcttcag

SEQ ID NO: 403653 - DNA, 38 bp, Artificial Sequence
  Description of Artificial Sequence: Synthetic oligonucleotide
aaaaaaatgtctgcccagagacagatgaggttcttcag

SEQ ID NO: 403654 - DNA, 37 bp, Artificial Sequence
  Description of Artificial Sequence: Synthetic oligonucleotide
aaaaaatgtctgcccagagacagatgaggttcttcag

SEQ ID NO: 403655 - DNA, 36 bp, Artificial Sequence
  Description of Artificial Sequence: Synthetic oligonucleotide
aaaaatgtctgcccagagacagatgaggttcttcag

SEQ ID NO: 403656 - DNA, 35 bp, Artificial Sequence
  Description of Artificial Sequence: Synthetic oligonucleotide
aaaatgtctgcccagagacagatgaggttcttcag

SEQ ID NO: 403657 - DNA, 34 bp, Artificial Sequence
  Description of Artificial Sequence: Synthetic oligonucleotide
aaatgtctgcccagagacagatgaggttcttcag

SEQ ID NO: 403658 - DNA, 33 bp, Artificial Sequence
  Description of Artificial Sequence: Synthetic oligonucleotide
aatgtctgcccagagacagatgaggttcttcag

SEQ ID NO: 403659 - DNA, 32 bp, Artificial Sequence
  Description of Artificial Sequence: Synthetic oligonucleotide
atgtctgcccagagacagatgaggttcttcag

SEQ ID NO: 403660 - DNA, 31 bp, Artificial Sequence
  Description of Artificial Sequence: Synthetic oligonucleotide
tgtctgcccagagacagatgaggttcttcag

SEQ ID NO: 403661 - DNA, 30 bp, Artificial Sequence
  Description of Artificial Sequence: Synthetic oligonucleotide
gtctgcccagagacagatgaggttcttcag

SEQ ID NO: 403662 - DNA, 30 bp, Artificial Sequence
  Description of Artificial Sequence: Synthetic oligonucleotide
tctgcccagagacagatgaggttcttcagc

SEQ ID NO: 403663 - DNA, 29 bp, Artificial Sequence
  Description of Artificial Sequence: Synthetic oligonucleotide
ctgcccagagacagatgaggttcttcagc

SEQ ID NO: 403664 - DNA, 30 bp, Artificial Sequence
  Description of Artificial Sequence: Synthetic oligonucleotide
tgcccagagacagatgaggttcttcagctc

SEQ ID NO: 403665 - DNA, 29 bp, Artificial Sequence
  Description of Artificial Sequence: Synthetic oligonucleotide
gcccagagacagatgaggttcttcagctc

SEQ ID NO: 403666 - DNA, 29 bp, Artificial Sequence
  Description of Artificial Sequence: Synthetic oligonucleotide
cccagagacagatgaggttcttcagctcc

SEQ ID NO: 403667 - DNA, 30 bp, Artificial Sequence
  Description of Artificial Sequence: Synthetic oligonucleotide
ccagagacagatgaggttcttcagctccag

SEQ ID NO: 403668 - DNA, 31 bp, Artificial Sequence
  Description of Artificial Sequence: Synthetic oligonucleotide
cagagacagatgaggttcttcagctccagtg

SEQ ID NO: 403669 - DNA, 31 bp, Artificial Sequence
  Description of Artificial Sequence: Synthetic oligonucleotide
agagacagatgaggttcttcagctccagtgc

SEQ ID NO: 403670 - DNA, 30 bp, Artificial Sequence
  Description of Artificial Sequence: Synthetic oligonucleotide
gagacagatgaggttcttcagctccagtgc

SEQ ID NO: 403671 - DNA, 31 bp, Artificial Sequence
  Description of Artificial Sequence: Synthetic oligonucleotide
agacagatgaggttcttcagctccagtgctg

SEQ ID NO: 403672 - DNA, 30 bp, Artificial Sequence
  Description of Artificial Sequence: Synthetic oligonucleotide
gacagatgaggttcttcagctccagtgctg

SEQ ID NO: 403673 - DNA, 33 bp, Artificial Sequence
  Description of Artificial Sequence: Synthetic oligonucleotide
acagatgaggttcttcagctccagtgctgattg

SEQ ID NO: 403674 - DNA, 32 bp, Artificial Sequence
  Description of Artificial Sequence: Synthetic oligonucleotide
cagatgaggttcttcagctccagtgctgattg

SEQ ID NO: 403675 - DNA, 32 bp, Artificial Sequence
  Description of Artificial Sequence: Synthetic oligonucleotide
agatgaggttcttcagctccagtgctgattgg

SEQ ID NO: 403676 - DNA, 31 bp, Artificial Sequence
  Description of Artificial Sequence: Synthetic oligonucleotide
gatgaggttcttcagctccagtgctgattgg

SEQ ID NO: 403677 - DNA, 33 bp, Artificial Sequence
  Description of Artificial Sequence: Synthetic oligonucleotide
atgaggttcttcagctccagtgctgattggttc

SEQ ID NO: 403678 - DNA, 32 bp, Artificial Sequence
  Description of Artificial Sequence: Synthetic oligonucleotide
tgaggttcttcagctccagtgctgattggttc

SEQ ID NO: 403679 - DNA, 31 bp, Artificial Sequence
  Description of Artificial Sequence: Synthetic oligonucleotide
gaggttcttcagctccagtgctgattggttc

SEQ ID NO: 403680 - DNA, 35 bp, Artificial Sequence
  Description of Artificial Sequence: Synthetic oligonucleotide
aggttcttcagctccagtgctgattggttcttttc

SEQ ID NO: 403681 - DNA, 34 bp, Artificial Sequence
  Description of Artificial Sequence: Synthetic oligonucleotide
ggttcttcagctccagtgctgattggttcttttc

SEQ ID NO: 403682 - DNA, 34 bp, Artificial Sequence
  Description of Artificial Sequence: Synthetic oligonucleotide
gttcttcagctccagtgctgattggttcttttcc

SEQ ID NO: 403683 - DNA, 36 bp, Artificial Sequence
  Description of Artificial Sequence: Synthetic oligonucleotide
ttcttcagctccagtgctgattggttcttttccaag

SEQ ID NO: 403684 - DNA, 35 bp, Artificial Sequence
  Description of Artificial Sequence: Synthetic oligonucleotide
tcttcagctccagtgctgattggttcttttccaag

SEQ ID NO: 403685 - DNA, 31 bp, Artificial Sequence
  Description of Artificial Sequence: Synthetic oligonucleotide
tggtttcggaatgatcaggaggagacagctg

SEQ ID NO: 403686 - DNA, 30 bp, Artificial Sequence
  Description of Artificial Sequence: Synthetic oligonucleotide
ggtttcggaatgatcaggaggagacagctg

SEQ ID NO: 403687 - DNA, 30 bp, Artificial Sequence
  Description of Artificial Sequence: Synthetic oligonucleotide
gtttcggaatgatcaggaggagacagctgg

SEQ ID NO: 403688 - DNA, 30 bp, Artificial Sequence
  Description of Artificial Sequence: Synthetic oligonucleotide
tttcggaatgatcaggaggagacagctggc

SEQ ID NO: 403689 - DNA, 29 bp, Artificial Sequence
  Description of Artificial Sequence: Synthetic oligonucleotide
ttcggaatgatcaggaggagacagctggc

SEQ ID NO: 403690 - DNA, 28 bp, Artificial Sequence
  Description of Artificial Sequence: Synthetic oligonucleotide
tcggaatgatcaggaggagacagctggc

SEQ ID NO: 403691 - DNA, 27 bp, Artificial Sequence
  Description of Artificial Sequence: Synthetic oligonucleotide
cggaatgatcaggaggagacagctggc

SEQ ID NO: 403692 - DNA, 27 bp, Artificial Sequence
  Description of Artificial Sequence: Synthetic oligonucleotide
ggaatgatcaggaggagacagctggcg

SEQ ID NO: 403693 - DNA, 29 bp, Artificial Sequence
  Description of Artificial Sequence: Synthetic oligonucleotide
gaatgatcaggaggagacagctggcgttg

SEQ ID NO: 403694 - DNA, 30 bp, Artificial Sequence
  Description of Artificial Sequence: Synthetic oligonucleotide
aatgatcaggaggagacagctggcgttgtg

SEQ ID NO: 403695 - DNA, 29 bp, Artificial Sequence
  Description of Artificial Sequence: Synthetic oligonucleotide
atgatcaggaggagacagctggcgttgtg

SEQ ID NO: 403696 - DNA, 28 bp, Artificial Sequence
  Description of Artificial Sequence: Synthetic oligonucleotide
tgatcaggaggagacagctggcgttgtg

SEQ ID NO: 403697 - DNA, 27 bp, Artificial Sequence
  Description of Artificial Sequence: Synthetic oligonucleotide
gatcaggaggagacagctggcgttgtg

SEQ ID NO: 403698 - DNA, 28 bp, Artificial Sequence
  Description of Artificial Sequence: Synthetic oligonucleotide
atcaggaggagacagctggcgttgtgtc

SEQ ID NO: 403699 - DNA, 27 bp, Artificial Sequence
  Description of Artificial Sequence: Synthetic oligonucleotide
tcaggaggagacagctggcgttgtgtc

SEQ ID NO: 403700 - DNA, 24 bp, Artificial Sequence
  Description of Artificial Sequence: Synthetic oligonucleotide
agctggcgttgtgtccacccccct

SEQ ID NO: 403701 - DNA, 23 bp, Artificial Sequence
  Description of Artificial Sequence: Synthetic oligonucleotide
gctggcgttgtgtccacccccct

SEQ ID NO: 403702 - DNA, 27 bp, Artificial Sequence
  Description of Artificial Sequence: Synthetic oligonucleotide
ctggcgttgtgtccacccccctcatta

SEQ ID NO: 403703 - DNA, 27 bp, Artificial Sequence
  Description of Artificial Sequence: Synthetic oligonucleotide
tggcgttgtgtccacccccctcattag

SEQ ID NO: 403704 - DNA, 29 bp, Artificial Sequence
  Description of Artificial Sequence: Synthetic oligonucleotide
acaacctgctgatctgctcggtgacagac

SEQ ID NO: 403705 - DNA, 28 bp, Artificial Sequence
  Description of Artificial Sequence: Synthetic oligonucleotide
caacctgctgatctgctcggtgacagac

SEQ ID NO: 403706 - DNA, 30 bp, Artificial Sequence
  Description of Artificial Sequence: Synthetic oligonucleotide
aacctgctgatctgctcggtgacagacttc

SEQ ID NO: 403707 - DNA, 29 bp, Artificial Sequence
  Description of Artificial Sequence: Synthetic oligonucleotide
acctgctgatctgctcggtgacagacttc

SEQ ID NO: 403708 - DNA, 28 bp, Artificial Sequence
  Description of Artificial Sequence: Synthetic oligonucleotide
cctgctgatctgctcggtgacagacttc

SEQ ID NO: 403709 - DNA, 31 bp, Artificial Sequence
  Description of Artificial Sequence: Synthetic oligonucleotide
ctgctgatctgctcggtgacagacttctatc

SEQ ID NO: 403710 - DNA, 31 bp, Artificial Sequence
  Description of Artificial Sequence: Synthetic oligonucleotide
tgctgatctgctcggtgacagacttctatcc

SEQ ID NO: 403711 - DNA, 30 bp, Artificial Sequence
  Description of Artificial Sequence: Synthetic oligonucleotide
gctgatctgctcggtgacagacttctatcc

SEQ ID NO: 403712 - DNA, 32 bp, Artificial Sequence
  Description of Artificial Sequence: Synthetic oligonucleotide
ctgatctgctcggtgacagacttctatccaag

SEQ ID NO: 403713 - DNA, 32 bp, Artificial Sequence
  Description of Artificial Sequence: Synthetic oligonucleotide
tgatctgctcggtgacagacttctatccaagc

SEQ ID NO: 403714 - DNA, 31 bp, Artificial Sequence
  Description of Artificial Sequence: Synthetic oligonucleotide
gatctgctcggtgacagacttctatccaagc

SEQ ID NO: 403715 - DNA, 31 bp, Artificial Sequence
  Description of Artificial Sequence: Synthetic oligonucleotide
atctgctcggtgacagacttctatccaagcc

SEQ ID NO: 403716 - DNA, 30 bp, Artificial Sequence
  Description of Artificial Sequence: Synthetic oligonucleotide
tctgctcggtgacagacttctatccaagcc

SEQ ID NO: 403717 - DNA, 29 bp, Artificial Sequence
  Description of Artificial Sequence: Synthetic oligonucleotide
ctgctcggtgacagacttctatccaagcc

SEQ ID NO: 403718 - DNA, 30 bp, Artificial Sequence
  Description of Artificial Sequence: Synthetic oligonucleotide
tgctcggtgacagacttctatccaagccag

SEQ ID NO: 403719 - DNA, 29 bp, Artificial Sequence
  Description of Artificial Sequence: Synthetic oligonucleotide
gctcggtgacagacttctatccaagccag

SEQ ID NO: 403720 - DNA, 31 bp, Artificial Sequence
  Description of Artificial Sequence: Synthetic oligonucleotide
ctcggtgacagacttctatccaagccagatc

SEQ ID NO: 403721 - DNA, 34 bp, Artificial Sequence
  Description of Artificial Sequence: Synthetic oligonucleotide
tcggtgacagacttctatccaagccagatcaaag

SEQ ID NO: 403722 - DNA, 33 bp, Artificial Sequence
  Description of Artificial Sequence: Synthetic oligonucleotide
cggtgacagacttctatccaagccagatcaaag

SEQ ID NO: 403723 - DNA, 34 bp, Artificial Sequence
  Description of Artificial Sequence: Synthetic oligonucleotide
ggtgacagacttctatccaagccagatcaaagtc

SEQ ID NO: 403724 - DNA, 34 bp, Artificial Sequence
  Description of Artificial Sequence: Synthetic oligonucleotide
gtgacagacttctatccaagccagatcaaagtcc

SEQ ID NO: 403725 - DNA, 34 bp, Artificial Sequence
  Description of Artificial Sequence: Synthetic oligonucleotide
tgacagacttctatccaagccagatcaaagtccg

SEQ ID NO: 403726 - DNA, 33 bp, Artificial Sequence
  Description of Artificial Sequence: Synthetic oligonucleotide
gacagacttctatccaagccagatcaaagtccg

SEQ ID NO: 403727 - DNA, 33 bp, Artificial Sequence
  Description of Artificial Sequence: Synthetic oligonucleotide
acagacttctatccaagccagatcaaagtccgg

SEQ ID NO: 403728 - DNA, 32 bp, Artificial Sequence
  Description of Artificial Sequence: Synthetic oligonucleotide
cagacttctatccaagccagatcaaagtccgg

SEQ ID NO: 403729 - DNA, 33 bp, Artificial Sequence
  Description of Artificial Sequence: Synthetic oligonucleotide
agacttctatccaagccagatcaaagtccggtg

SEQ ID NO: 403730 - DNA, 32 bp, Artificial Sequence
  Description of Artificial Sequence: Synthetic oligonucleotide
gacttctatccaagccagatcaaagtccggtg

SEQ ID NO: 403731 - DNA, 32 bp, Artificial Sequence
  Description of Artificial Sequence: Synthetic oligonucleotide
acttctatccaagccagatcaaagtccggtgg

SEQ ID NO: 403732 - DNA, 31 bp, Artificial Sequence
  Description of Artificial Sequence: Synthetic oligonucleotide
cttctatccaagccagatcaaagtccggtgg

SEQ ID NO: 403733 - DNA, 24 bp, Artificial Sequence
  Description of Artificial Sequence: Synthetic oligonucleotide
ggcgtcggtggacagagtgtgcag

SEQ ID NO: 403734 - DNA, 24 bp, Artificial Sequence
  Description of Artificial Sequence: Synthetic oligonucleotide
gcgtcggtggacagagtgtgcagg

SEQ ID NO: 403735 - DNA, 25 bp, Artificial Sequence
  Description of Artificial Sequence: Synthetic oligonucleotide
cgtcggtggacagagtgtgcaggca

SEQ ID NO: 403736 - DNA, 27 bp, Artificial Sequence
  Description of Artificial Sequence: Synthetic oligonucleotide
gtcggtggacagagtgtgcaggcacaa

SEQ ID NO: 403737 - DNA, 27 bp, Artificial Sequence
  Description of Artificial Sequence: Synthetic oligonucleotide
tcggtggacagagtgtgcaggcacaac

SEQ ID NO: 403738 - DNA, 27 bp, Artificial Sequence
  Description of Artificial Sequence: Synthetic oligonucleotide
cggtggacagagtgtgcaggcacaact

SEQ ID NO: 403739 - DNA, 28 bp, Artificial Sequence
  Description of Artificial Sequence: Synthetic oligonucleotide
ggtggacagagtgtgcaggcacaactac

SEQ ID NO: 403740 - DNA, 28 bp, Artificial Sequence
  Description of Artificial Sequence: Synthetic oligonucleotide
gtggacagagtgtgcaggcacaactacg

SEQ ID NO: 403741 - DNA, 29 bp, Artificial Sequence
  Description of Artificial Sequence: Synthetic oligonucleotide
tggacagagtgtgcaggcacaactacgag

SEQ ID NO: 403742 - DNA, 28 bp, Artificial Sequence
  Description of Artificial Sequence: Synthetic oligonucleotide
ggacagagtgtgcaggcacaactacgag

SEQ ID NO: 403743 - DNA, 28 bp, Artificial Sequence
  Description of Artificial Sequence: Synthetic oligonucleotide
gacagagtgtgcaggcacaactacgagg

SEQ ID NO: 403744 - DNA, 29 bp, Artificial Sequence
  Description of Artificial Sequence: Synthetic oligonucleotide
acagagtgtgcaggcacaactacgaggtg

SEQ ID NO: 403745 - DNA, 28 bp, Artificial Sequence
  Description of Artificial Sequence: Synthetic oligonucleotide
cagagtgtgcaggcacaactacgaggtg

SEQ ID NO: 403746 - DNA, 28 bp, Artificial Sequence
  Description of Artificial Sequence: Synthetic oligonucleotide
agagtgtgcaggcacaactacgaggtgg

SEQ ID NO: 403747 - DNA, 27 bp, Artificial Sequence
  Description of Artificial Sequence: Synthetic oligonucleotide
gagtgtgcaggcacaactacgaggtgg

SEQ ID NO: 403748 - DNA, 27 bp, Artificial Sequence
  Description of Artificial Sequence: Synthetic oligonucleotide
agtgtgcaggcacaactacgaggtggc

SEQ ID NO: 403749 - DNA, 26 bp, Artificial Sequence
  Description of Artificial Sequence: Synthetic oligonucleotide
gtgtgcaggcacaactacgaggtggc

SEQ ID NO: 403750 - DNA, 27 bp, Artificial Sequence
  Description of Artificial Sequence: Synthetic oligonucleotide
tgtgcaggcacaactacgaggtggcgt

SEQ ID NO: 403751 - DNA, 27 bp, Artificial Sequence
  Description of Artificial Sequence: Synthetic oligonucleotide
gtgcaggcacaactacgaggtggcgta

SEQ ID NO: 403752 - DNA, 27 bp, Artificial Sequence
  Description of Artificial Sequence: Synthetic oligonucleotide
tgcaggcacaactacgaggtggcgtac

SEQ ID NO: 403753 - DNA, 26 bp, Artificial Sequence
  Description of Artificial Sequence: Synthetic oligonucleotide
gcaggcacaactacgaggtggcgtac

SEQ ID NO: 403754 - DNA, 26 bp, Artificial Sequence
  Description of Artificial Sequence: Synthetic oligonucleotide
caggcacaactacgaggtggcgtacc

SEQ ID NO: 403755 - DNA, 26 bp, Artificial Sequence
  Description of Artificial Sequence: Synthetic oligonucleotide
aggcacaactacgaggtggcgtaccg

SEQ ID NO: 403756 - DNA, 25 bp, Artificial Sequence
  Description of Artificial Sequence: Synthetic oligonucleotide
ggcacaactacgaggtggcgtaccg

SEQ ID NO: 403757 - DNA, 25 bp, Artificial Sequence
  Description of Artificial Sequence: Synthetic oligonucleotide
gcacaactacgaggtggcgtaccgc

SEQ ID NO: 403758 - DNA, 33 bp, Artificial Sequence; identical to SEQ ID NO: 61008
  Description of Artificial Sequence: Synthetic oligonucleotide

SEQ ID NO: 403759 - DNA, 34 bp, Artificial Sequence; identical to SEQ ID NO: 61009
  Description of Artificial Sequence: Synthetic oligonucleotide

SEQ ID NO: 403760 - DNA, 36 bp, Artificial Sequence; identical to SEQ ID NO: 61010
  Description of Artificial Sequence: Synthetic oligonucleotide

SEQ ID NO: 403761 - DNA, 36 bp, Artificial Sequence; identical to SEQ ID NO: 61011
  Description of Artificial Sequence: Synthetic oligonucleotide

SEQ ID NO: 403762 - DNA, 37 bp, Artificial Sequence; identical to SEQ ID NO: 61012
  Description of Artificial Sequence: Synthetic oligonucleotide

SEQ ID NO: 403763 - DNA, 36 bp, Artificial Sequence; identical to SEQ ID NO: 61013
  Description of Artificial Sequence: Synthetic oligonucleotide

SEQ ID NO: 403764 - DNA, 36 bp, Artificial Sequence; identical to SEQ ID NO: 61014
  Description of Artificial Sequence: Synthetic oligonucleotide

SEQ ID NO: 403765 - DNA, 35 bp, Artificial Sequence; identical to SEQ ID NO: 61015
  Description of Artificial Sequence: Synthetic oligonucleotide

SEQ ID NO: 403766 - DNA, 35 bp, Artificial Sequence; identical to SEQ ID NO: 61016
  Description of Artificial Sequence: Synthetic oligonucleotide

SEQ ID NO: 403767 - DNA, 34 bp, Artificial Sequence; identical to SEQ ID NO: 61017
  Description of Artificial Sequence: Synthetic oligonucleotide

SEQ ID NO: 403768 - DNA, 34 bp, Artificial Sequence; identical to SEQ ID NO: 61018
  Description of Artificial Sequence: Synthetic oligonucleotide

SEQ ID NO: 403769 - DNA, 36 bp, Artificial Sequence; identical to SEQ ID NO: 61019
  Description of Artificial Sequence: Synthetic oligonucleotide

SEQ ID NO: 403770 - DNA, 35 bp, Artificial Sequence; identical to SEQ ID NO: 61020
  Description of Artificial Sequence: Synthetic oligonucleotide

SEQ ID NO: 403771 - DNA, 35 bp, Artificial Sequence; identical to SEQ ID NO: 61021
  Description of Artificial Sequence: Synthetic oligonucleotide

SEQ ID NO: 403772 - DNA, 34 bp, Artificial Sequence; identical to SEQ ID NO: 61022
  Description of Artificial Sequence: Synthetic oligonucleotide

SEQ ID NO: 403773 - DNA, 33 bp, Artificial Sequence; identical to SEQ ID NO: 61023
  Description of Artificial Sequence: Synthetic oligonucleotide

SEQ ID NO: 403774 - DNA, 32 bp, Artificial Sequence; identical to SEQ ID NO: 61024
  Description of Artificial Sequence: Synthetic oligonucleotide

SEQ ID NO: 403775 - DNA, 33 bp, Artificial Sequence; identical to SEQ ID NO: 61025
  Description of Artificial Sequence: Synthetic oligonucleotide

SEQ ID NO: 403776 - DNA, 32 bp, Artificial Sequence; identical to SEQ ID NO: 61026
  Description of Artificial Sequence: Synthetic oligonucleotide

SEQ ID NO: 403777 - DNA, 31 bp, Artificial Sequence; identical to SEQ ID NO: 61027
  Description of Artificial Sequence: Synthetic oligonucleotide

SEQ ID NO: 403778 - DNA, 32 bp, Artificial Sequence; identical to SEQ ID NO: 61028
  Description of Artificial Sequence: Synthetic oligonucleotide

SEQ ID NO: 403779 - DNA, 31 bp, Artificial Sequence; identical to SEQ ID NO: 61029
  Description of Artificial Sequence: Synthetic oligonucleotide

SEQ ID NO: 403780 - DNA, 30 bp, Artificial Sequence; identical to SEQ ID NO: 61030
  Description of Artificial Sequence: Synthetic oligonucleotide

SEQ ID NO: 403781 - DNA, 29 bp, Artificial Sequence
  Description of Artificial Sequence: Synthetic oligonucleotide
aaccgagaagagtacgtgcgcttcgacag

SEQ ID NO: 403782 - DNA, 28 bp, Artificial Sequence
  Description of Artificial Sequence: Synthetic oligonucleotide
accgagaagagtacgtgcgcttcgacag

SEQ ID NO: 403783 - DNA, 27 bp, Artificial Sequence
  Description of Artificial Sequence: Synthetic oligonucleotide
ccgagaagagtacgtgcgcttcgacag

SEQ ID NO: 403784 - DNA, 27 bp, Artificial Sequence
  Description of Artificial Sequence: Synthetic oligonucleotide
cgagaagagtacgtgcgcttcgacagc

SEQ ID NO: 403785 - DNA, 27 bp, Artificial Sequence
  Description of Artificial Sequence: Synthetic oligonucleotide
gagaagagtacgtgcgcttcgacagcg

SEQ ID NO: 403786 - DNA, 28 bp, Artificial Sequence
  Description of Artificial Sequence: Synthetic oligonucleotide
agaagagtacgtgcgcttcgacagcgac

SEQ ID NO: 403787 - DNA, 27 bp, Artificial Sequence
  Description of Artificial Sequence: Synthetic oligonucleotide
gaagagtacgtgcgcttcgacagcgac

SEQ ID NO: 403788 - DNA, 27 bp, Artificial Sequence
  Description of Artificial Sequence: Synthetic oligonucleotide
aagagtacgtgcgcttcgacagcgacg

SEQ ID NO: 403789 - DNA, 27 bp, Artificial Sequence
  Description of Artificial Sequence: Synthetic oligonucleotide
agagtacgtgcgcttcgacagcgacgt

SEQ ID NO: 403790 - DNA, 22 bp, Artificial Sequence
  Description of Artificial Sequence: Synthetic oligonucleotide
aggaccgggcgtcggtggacag

SEQ ID NO: 403791 - DNA, 21 bp, Artificial Sequence
  Description of Artificial Sequence: Synthetic oligonucleotide
ggaccgggcgtcggtggacag

SEQ ID NO: 403792 - DNA, 21 bp, Artificial Sequence
  Description of Artificial Sequence: Synthetic oligonucleotide
gaccgggcgtcggtggacagg

SEQ ID NO: 403793 - DNA, 22 bp, Artificial Sequence
  Description of Artificial Sequence: Synthetic oligonucleotide
accgggcgtcggtggacagggt

SEQ ID NO: 403794 - DNA, 31 bp, Artificial Sequence; identical to SEQ ID NO: 61046
  Description of Artificial Sequence: Synthetic oligonucleotide

SEQ ID NO: 403795 - DNA, 31 bp, Artificial Sequence; identical to SEQ ID NO: 61047
  Description of Artificial Sequence: Synthetic oligonucleotide

SEQ ID NO: 403796 - DNA, 30 bp, Artificial Sequence; identical to SEQ ID NO: 61048
  Description of Artificial Sequence: Synthetic oligonucleotide

SEQ ID NO: 403797 - DNA, 30 bp, Artificial Sequence; identical to SEQ ID NO: 61049
  Description of Artificial Sequence: Synthetic oligonucleotide

SEQ ID NO: 403798 - DNA, 29 bp, Artificial Sequence
  Description of Artificial Sequence: Synthetic oligonucleotide
cacatctataaccgagaggagtacgcgcg

SEQ ID NO: 403799 - DNA, 25 bp, Artificial Sequence
  Description of Artificial Sequence: Synthetic oligonucleotide
taccgcgggatcctgcagaggagag

SEQ ID NO: 403800 - DNA, 32 bp, Artificial Sequence; identical to SEQ ID NO: 61052
  Description of Artificial Sequence: Synthetic oligonucleotide

SEQ ID NO: 403801 - DNA, 31 bp, Artificial Sequence; identical to SEQ ID NO: 61053
  Description of Artificial Sequence: Synthetic oligonucleotide

SEQ ID NO: 403802 - DNA, 31 bp, Artificial Sequence; identical to SEQ ID NO: 61054
  Description of Artificial Sequence: Synthetic oligonucleotide

SEQ ID NO: 403803 - DNA, 30 bp, Artificial Sequence; identical to SEQ ID NO: 61055
  Description of Artificial Sequence: Synthetic oligonucleotide

SEQ ID NO: 403804 - DNA, 29 bp, Artificial Sequence
  Description of Artificial Sequence: Synthetic oligonucleotide
ctataaccgagaggagtacgtgcgcttgg

SEQ ID NO: 403805 - DNA, 30 bp, Artificial Sequence; identical to SEQ ID NO: 61057
  Description of Artificial Sequence: Synthetic oligonucleotide

SEQ ID NO: 403806 - DNA, 29 bp, Artificial Sequence
  Description of Artificial Sequence: Synthetic oligonucleotide
ataaccgagaggagtacgtgcgcttggac

SEQ ID NO: 403807 - DNA, 28 bp, Artificial Sequence
  Description of Artificial Sequence: Synthetic oligonucleotide
taaccgagaggagtacgtgcgcttggac

SEQ ID NO: 403808 - DNA, 27 bp, Artificial Sequence
  Description of Artificial Sequence: Synthetic oligonucleotide
aaccgagaggagtacgtgcgcttggac

SEQ ID NO: 403809 - DNA, 27 bp, Artificial Sequence
  Description of Artificial Sequence: Synthetic oligonucleotide
accgagaggagtacgtgcgcttggaca

SEQ ID NO: 403810 - DNA, 26 bp, Artificial Sequence
  Description of Artificial Sequence: Synthetic oligonucleotide
ccgagaggagtacgtgcgcttggaca

SEQ ID NO: 403811 - DNA, 26 bp, Artificial Sequence
  Description of Artificial Sequence: Synthetic oligonucleotide
cgagaggagtacgtgcgcttggacag

SEQ ID NO: 403812 - DNA, 26 bp, Artificial Sequence
  Description of Artificial Sequence: Synthetic oligonucleotide
gagaggagtacgtgcgcttggacagc

SEQ ID NO: 403813 - DNA, 27 bp, Artificial Sequence
  Description of Artificial Sequence: Synthetic oligonucleotide
agaggagtacgtgcgcttggacagcga

SEQ ID NO: 403814 - DNA, 26 bp, Artificial Sequence
  Description of Artificial Sequence: Synthetic oligonucleotide
gaggagtacgtgcgcttggacagcga

SEQ ID NO: 403815 - DNA, 26 bp, Artificial Sequence
  Description of Artificial Sequence: Synthetic oligonucleotide
aggagtacgtgcgcttggacagcgac

SEQ ID NO: 403816 - DNA, 25 bp, Artificial Sequence
  Description of Artificial Sequence: Synthetic oligonucleotide
ggagtacgtgcgcttggacagcgac

SEQ ID NO: 403817 - DNA, 26 bp, Artificial Sequence
  Description of Artificial Sequence: Synthetic oligonucleotide
gagtacgtgcgcttggacagcgacgt

SEQ ID NO: 403818 - DNA, 26 bp, Artificial Sequence
  Description of Artificial Sequence: Synthetic oligonucleotide
agtacgtgcgcttggacagcgacgtg

SEQ ID NO: 403819 - DNA, 25 bp, Artificial Sequence
  Description of Artificial Sequence: Synthetic oligonucleotide
gtacgtgcgcttggacagcgacgtg

SEQ ID NO: 403820 - DNA, 25 bp, Artificial Sequence
  Description of Artificial Sequence: Synthetic oligonucleotide
tacgtgcgcttggacagcgacgtgg

SEQ ID NO: 403821 - DNA, 24 bp, Artificial Sequence
  Description of Artificial Sequence: Synthetic oligonucleotide
acgtgcgcttggacagcgacgtgg

SEQ ID NO: 403822 - DNA, 23 bp, Artificial Sequence
  Description of Artificial Sequence: Synthetic oligonucleotide
cgtgcgcttggacagcgacgtgg

SEQ ID NO: 403823 - DNA, 23 bp, Artificial Sequence
  Description of Artificial Sequence: Synthetic oligonucleotide
gtgcgcttggacagcgacgtggg

SEQ ID NO: 403824 - DNA, 23 bp, Artificial Sequence
  Description of Artificial Sequence: Synthetic oligonucleotide
tgcgcttggacagcgacgtgggg

SEQ ID NO: 403825 - DNA, 22 bp, Artificial Sequence
  Description of Artificial Sequence: Synthetic oligonucleotide
gcgcttggacagcgacgtgggg

SEQ ID NO: 403826 - DNA, 23 bp, Artificial Sequence
  Description of Artificial Sequence: Synthetic oligonucleotide
cgcttggacagcgacgtgggggt

SEQ ID NO: 403827 - DNA, 26 bp, Artificial Sequence
  Description of Artificial Sequence: Synthetic oligonucleotide
gcttggacagcgacgtgggggtgtat

SEQ ID NO: 403828 - DNA, 26 bp, Artificial Sequence
  Description of Artificial Sequence: Synthetic oligonucleotide
cttggacagcgacgtgggggtgtatc

SEQ ID NO: 403829 - DNA, 26 bp, Artificial Sequence
  Description of Artificial Sequence: Synthetic oligonucleotide
ttggacagcgacgtgggggtgtatcg

SEQ ID NO: 403830 - DNA, 25 bp, Artificial Sequence
  Description of Artificial Sequence: Synthetic oligonucleotide
tggacagcgacgtgggggtgtatcg

SEQ ID NO: 403831 - DNA, 24 bp, Artificial Sequence
  Description of Artificial Sequence: Synthetic oligonucleotide
ggacagcgacgtgggggtgtatcg

SEQ ID NO: 403832 - DNA, 33 bp, Artificial Sequence
  Description of Artificial Sequence: Synthetic oligonucleotide
agacacatctataaccgagaggagtacgtgcac

SEQ ID NO: 403833 - DNA, 32 bp, Artificial Sequence
  Description of Artificial Sequence: Synthetic oligonucleotide
gacacatctataaccgagaggagtacgtgcac

SEQ ID NO: 403834 - DNA, 34 bp, Artificial Sequence
  Description of Artificial Sequence: Synthetic oligonucleotide
acacatctataaccgagaggagtacgtgcacttc

SEQ ID NO: 403835 - DNA, 33 bp, Artificial Sequence
  Description of Artificial Sequence: Synthetic oligonucleotide
cacatctataaccgagaggagtacgtgcacttc

SEQ ID NO: 403836 - DNA, 33 bp, Artificial Sequence
  Description of Artificial Sequence: Synthetic oligonucleotide
acatctataaccgagaggagtacgtgcacttcg

SEQ ID NO: 403837 - DNA, 32 bp, Artificial Sequence
  Description of Artificial Sequence: Synthetic oligonucleotide
catctataaccgagaggagtacgtgcacttcg

SEQ ID NO: 403838 - DNA, 33 bp, Artificial Sequence
  Description of Artificial Sequence: Synthetic oligonucleotide
atctataaccgagaggagtacgtgcacttcgac

SEQ ID NO: 403839 - DNA, 32 bp, Artificial Sequence
  Description of Artificial Sequence: Synthetic oligonucleotide
tctataaccgagaggagtacgtgcacttcgac

SEQ ID NO: 403840 - DNA, 31 bp, Artificial Sequence
  Description of Artificial Sequence: Synthetic oligonucleotide
ctataaccgagaggagtacgtgcacttcgac

SEQ ID NO: 403841 - DNA, 32 bp, Artificial Sequence
  Description of Artificial Sequence: Synthetic oligonucleotide
tataaccgagaggagtacgtgcacttcgacag

SEQ ID NO: 403842 - DNA, 31 bp, Artificial Sequence
  Description of Artificial Sequence: Synthetic oligonucleotide
ataaccgagaggagtacgtgcacttcgacag

SEQ ID NO: 403843 - DNA, 30 bp, Artificial Sequence
  Description of Artificial Sequence: Synthetic oligonucleotide
taaccgagaggagtacgtgcacttcgacag

SEQ ID NO: 403844 - DNA, 29 bp, Artificial Sequence
  Description of Artificial Sequence: Synthetic oligonucleotide
aaccgagaggagtacgtgcacttcgacag

SEQ ID NO: 403845 - DNA, 28 bp, Artificial Sequence
  Description of Artificial Sequence: Synthetic oligonucleotide
accgagaggagtacgtgcacttcgacag

SEQ ID NO: 403846 - DNA, 27 bp, Artificial Sequence
  Description of Artificial Sequence: Synthetic oligonucleotide
ccgagaggagtacgtgcacttcgacag

SEQ ID NO: 403847 - DNA, 27 bp, Artificial Sequence
  Description of Artificial Sequence: Synthetic oligonucleotide
cgagaggagtacgtgcacttcgacagc

SEQ ID NO: 403848 - DNA, 27 bp, Artificial Sequence
  Description of Artificial Sequence: Synthetic oligonucleotide
gagaggagtacgtgcacttcgacagcg

SEQ ID NO: 403849 - DNA, 28 bp, Artificial Sequence
  Description of Artificial Sequence: Synthetic oligonucleotide
agaggagtacgtgcacttcgacagcgac

SEQ ID NO: 403850 - DNA, 27 bp, Artificial Sequence
  Description of Artificial Sequence: Synthetic oligonucleotide
gaggagtacgtgcacttcgacagcgac

SEQ ID NO: 403851 - DNA, 27 bp, Artificial Sequence
  Description of Artificial Sequence: Synthetic oligonucleotide
aggagtacgtgcacttcgacagcgacg

SEQ ID NO: 403852 - DNA, 27 bp, Artificial Sequence
  Description of Artificial Sequence: Synthetic oligonucleotide
ggagtacgtgcacttcgacagcgacgt

SEQ ID NO: 403853 - DNA, 27 bp, Artificial Sequence
  Description of Artificial Sequence: Synthetic oligonucleotide
gagtacgtgcacttcgacagcgacgtg

SEQ ID NO: 403854 - DNA, 27 bp, Artificial Sequence
  Description of Artificial Sequence: Synthetic oligonucleotide
agtacgtgcacttcgacagcgacgtgg

SEQ ID NO: 403855 - DNA, 26 bp, Artificial Sequence
  Description of Artificial Sequence: Synthetic oligonucleotide
gtacgtgcacttcgacagcgacgtgg

SEQ ID NO: 403856 - DNA, 26 bp, Artificial Sequence
  Description of Artificial Sequence: Synthetic oligonucleotide
tacgtgcacttcgacagcgacgtggg

SEQ ID NO: 403857 - DNA, 25 bp, Artificial Sequence
  Description of Artificial Sequence: Synthetic oligonucleotide
acgtgcacttcgacagcgacgtggg

SEQ ID NO: 403858 - DNA, 24 bp, Artificial Sequence
  Description of Artificial Sequence: Synthetic oligonucleotide
cgtgcacttcgacagcgacgtggg

SEQ ID NO: 403859 - DNA, 24 bp, Artificial Sequence
  Description of Artificial Sequence: Synthetic oligonucleotide
gtgcacttcgacagcgacgtgggg

SEQ ID NO: 403860 - DNA, 25 bp, Artificial Sequence
  Description of Artificial Sequence: Synthetic oligonucleotide
tgcacttcgacagcgacgtgggggt

SEQ ID NO: 403861 - DNA, 24 bp, Artificial Sequence
  Description of Artificial Sequence: Synthetic oligonucleotide
gcacttcgacagcgacgtgggggt

SEQ ID NO: 403862 - DNA, 26 bp, Artificial Sequence
  Description of Artificial Sequence: Synthetic oligonucleotide
cacttcgacagcgacgtgggggtgta

SEQ ID NO: 403863 - DNA, 26 bp, Artificial Sequence
  Description of Artificial Sequence: Synthetic oligonucleotide
acttcgacagcgacgtgggggtgtac

SEQ ID NO: 403864 - DNA, 32 bp, Artificial Sequence
  Description of Artificial Sequence: Synthetic oligonucleotide
tgtgaccagacacatctataaccgagaggagg

SEQ ID NO: 403865 - DNA, 31 bp, Artificial Sequence
  Description of Artificial Sequence: Synthetic oligonucleotide
gtgaccagacacatctataaccgagaggagg

SEQ ID NO: 403866 - DNA, 32 bp, Artificial Sequence
  Description of Artificial Sequence: Synthetic oligonucleotide
tgaccagacacatctataaccgagaggaggac

SEQ ID NO: 403867 - DNA, 31 bp, Artificial Sequence
  Description of Artificial Sequence: Synthetic oligonucleotide
gaccagacacatctataaccgagaggaggac

SEQ ID NO: 403868 - DNA, 31 bp, Artificial Sequence
  Description of Artificial Sequence: Synthetic oligonucleotide
accagacacatctataaccgagaggaggacg

SEQ ID NO: 403869 - DNA, 30 bp, Artificial Sequence
  Description of Artificial Sequence: Synthetic oligonucleotide
ccagacacatctataaccgagaggaggacg

SEQ ID NO: 403870 - DNA, 31 bp, Artificial Sequence
  Description of Artificial Sequence: Synthetic oligonucleotide
cagacacatctataaccgagaggaggacgtg

SEQ ID NO: 403871 - DNA, 31 bp, Artificial Sequence
  Description of Artificial Sequence: Synthetic oligonucleotide
agacacatctataaccgagaggaggacgtgc

SEQ ID NO: 403872 - DNA, 30 bp, Artificial Sequence
  Description of Artificial Sequence: Synthetic oligonucleotide
gacacatctataaccgagaggaggacgtgc

SEQ ID NO: 403873 - DNA, 30 bp, Artificial Sequence
  Description of Artificial Sequence: Synthetic oligonucleotide
acacatctataaccgagaggaggacgtgcg

SEQ ID NO: 403874 - DNA, 29 bp, Artificial Sequence
  Description of Artificial Sequence: Synthetic oligonucleotide
cacatctataaccgagaggaggacgtgcg

SEQ ID NO: 403875 - DNA, 29 bp, Artificial Sequence
  Description of Artificial Sequence: Synthetic oligonucleotide
acatctataaccgagaggaggacgtgcgc

SEQ ID NO: 403876 - DNA, 28 bp, Artificial Sequence
  Description of Artificial Sequence: Synthetic oligonucleotide
catctataaccgagaggaggacgtgcgc

SEQ ID NO: 403877 - DNA, 30 bp, Artificial Sequence; identical to SEQ ID NO: 61158
  Description of Artificial Sequence: Synthetic oligonucleotide

SEQ ID NO: 403878 - DNA, 29 bp, Artificial Sequence
  Description of Artificial Sequence: Synthetic oligonucleotide
tctataaccgagaggaggacgtgcgcttc

SEQ ID NO: 403879 - DNA, 28 bp, Artificial Sequence
  Description of Artificial Sequence: Synthetic oligonucleotide
ctataaccgagaggaggacgtgcgcttc

SEQ ID NO: 403880 - DNA, 28 bp, Artificial Sequence
  Description of Artificial Sequence: Synthetic oligonucleotide
tataaccgagaggaggacgtgcgcttcg

SEQ ID NO: 403881 - DNA, 27 bp, Artificial Sequence
  Description of Artificial Sequence: Synthetic oligonucleotide
ataaccgagaggaggacgtgcgcttcg

SEQ ID NO: 403882 - DNA, 27 bp, Artificial Sequence
  Description of Artificial Sequence: Synthetic oligonucleotide
taaccgagaggaggacgtgcgcttcga

SEQ ID NO: 403883 - DNA, 26 bp, Artificial Sequence
  Description of Artificial Sequence: Synthetic oligonucleotide
aaccgagaggaggacgtgcgcttcga

SEQ ID NO: 403884 - DNA, 25 bp, Artificial Sequence
  Description of Artificial Sequence: Synthetic oligonucleotide
accgagaggaggacgtgcgcttcga

SEQ ID NO: 403885 - DNA, 24 bp, Artificial Sequence
  Description of Artificial Sequence: Synthetic oligonucleotide
ccgagaggaggacgtgcgcttcga

SEQ ID NO: 403886 - DNA, 25 bp, Artificial Sequence
  Description of Artificial Sequence: Synthetic oligonucleotide
cgagaggaggacgtgcgcttcgaca

SEQ ID NO: 403887 - DNA, 25 bp, Artificial Sequence
  Description of Artificial Sequence: Synthetic oligonucleotide
gagaggaggacgtgcgcttcgacag

SEQ ID NO: 403888 - DNA, 25 bp, Artificial Sequence
  Description of Artificial Sequence: Synthetic oligonucleotide
agaggaggacgtgcgcttcgacagc

SEQ ID NO: 403889 - DNA, 24 bp, Artificial Sequence
  Description of Artificial Sequence: Synthetic oligonucleotide
gaggaggacgtgcgcttcgacagc

SEQ ID NO: 403890 - DNA, 25 bp, Artificial Sequence
  Description of Artificial Sequence: Synthetic oligonucleotide
aggaggacgtgcgcttcgacagcga

SEQ ID NO: 403891 - DNA, 24 bp, Artificial Sequence
  Description of Artificial Sequence: Synthetic oligonucleotide
ggaggacgtgcgcttcgacagcga

SEQ ID NO: 403892 - DNA, 24 bp, Artificial Sequence
  Description of Artificial Sequence: Synthetic oligonucleotide
gaggacgtgcgcttcgacagcgac

SEQ ID NO: 403893 - DNA, 25 bp, Artificial Sequence
  Description of Artificial Sequence: Synthetic oligonucleotide
aggacgtgcgcttcgacagcgacgt

SEQ ID NO: 403894 - DNA, 24 bp, Artificial Sequence
  Description of Artificial Sequence: Synthetic oligonucleotide
ggacgtgcgcttcgacagcgacgt

SEQ ID NO: 403895 - DNA, 24 bp, Artificial Sequence
  Description of Artificial Sequence: Synthetic oligonucleotide
gacgtgcgcttcgacagcgacgtg

SEQ ID NO: 403896 - DNA, 24 bp, Artificial Sequence
  Description of Artificial Sequence: Synthetic oligonucleotide
gtggagcaccccagcctccagaga

SEQ ID NO: 403897 - DNA, 24 bp, Artificial Sequence
  Description of Artificial Sequence: Synthetic oligonucleotide
tggagcaccccagcctccagagac

SEQ ID NO: 403898 - DNA, 23 bp, Artificial Sequence
  Description of Artificial Sequence: Synthetic oligonucleotide
ggagcaccccagcctccagagac

SEQ ID NO: 403899 - DNA, 23 bp, Artificial Sequence
  Description of Artificial Sequence: Synthetic oligonucleotide
gagcaccccagcctccagagacc

SEQ ID NO: 403900 - DNA, 25 bp, Artificial Sequence
  Description of Artificial Sequence: Synthetic oligonucleotide
agcaccccagcctccagagacccat

SEQ ID NO: 403901 - DNA, 24 bp, Artificial Sequence
  Description of Artificial Sequence: Synthetic oligonucleotide
gcaccccagcctccagagacccat

SEQ ID NO: 403902 - DNA, 25 bp, Artificial Sequence
  Description of Artificial Sequence: Synthetic oligonucleotide
caccccagcctccagagacccatca

SEQ ID NO: 403903 - DNA, 25 bp, Artificial Sequence
  Description of Artificial Sequence: Synthetic oligonucleotide
accccagcctccagagacccatcac

SEQ ID NO: 403904 - DNA, 24 bp, Artificial Sequence
  Description of Artificial Sequence: Synthetic oligonucleotide
ccccagcctccagagacccatcac

SEQ ID NO: 403905 - DNA, 24 bp, Artificial Sequence
  Description of Artificial Sequence: Synthetic oligonucleotide
cccagcctccagagacccatcacc

SEQ ID NO: 403906 - DNA, 25 bp, Artificial Sequence
  Description of Artificial Sequence: Synthetic oligonucleotide
ccagcctccagagacccatcaccgt

SEQ ID NO: 403907 - DNA, 25 bp, Artificial Sequence
  Description of Artificial Sequence: Synthetic oligonucleotide
cagcctccagagacccatcaccgtg

SEQ ID NO: 403908 - DNA, 26 bp, Artificial Sequence
  Description of Artificial Sequence: Synthetic oligonucleotide
agcctccagagacccatcaccgtgga

SEQ ID NO: 403909 - DNA, 25 bp, Artificial Sequence
  Description of Artificial Sequence: Synthetic oligonucleotide
gcctccagagacccatcaccgtgga

SEQ ID NO: 403910 - DNA, 26 bp, Artificial Sequence
  Description of Artificial Sequence: Synthetic oligonucleotide
cctccagagacccatcaccgtggagt

SEQ ID NO: 403911 - DNA, 26 bp, Artificial Sequence
  Description of Artificial Sequence: Synthetic oligonucleotide
ctccagagacccatcaccgtggagtg

SEQ ID NO: 403912 - DNA, 26 bp, Artificial Sequence
  Description of Artificial Sequence: Synthetic oligonucleotide
tccagagacccatcaccgtggagtgg

SEQ ID NO: 403913 - DNA, 25 bp, Artificial Sequence
  Description of Artificial Sequence: Synthetic oligonucleotide
ccagagacccatcaccgtggagtgg

SEQ ID NO: 403914 - DNA, 25 bp, Artificial Sequence
  Description of Artificial Sequence: Synthetic oligonucleotide
cagagacccatcaccgtggagtggc

SEQ ID NO: 403915 - DNA, 22 bp, Artificial Sequence
  Description of Artificial Sequence: Synthetic oligonucleotide
cccgggcgtcggtggacaggtt

SEQ ID NO: 403916 - DNA, 23 bp, Artificial Sequence
  Description of Artificial Sequence: Synthetic oligonucleotide
ccgggcgtcggtggacaggttgt

SEQ ID NO: 403917 - DNA, 23 bp, Artificial Sequence
  Description of Artificial Sequence: Synthetic oligonucleotide
cgggcgtcggtggacaggttgtg

SEQ ID NO: 403918 - DNA, 24 bp, Artificial Sequence
  Description of Artificial Sequence: Synthetic oligonucleotide
gggcgtcggtggacaggttgtgca

SEQ ID NO: 403919 - DNA, 25 bp, Artificial Sequence
  Description of Artificial Sequence: Synthetic oligonucleotide
ggcgtcggtggacaggttgtgcaga

SEQ ID NO: 403920 - DNA, 26 bp, Artificial Sequence
  Description of Artificial Sequence: Synthetic oligonucleotide
gcgtcggtggacaggttgtgcagaca

SEQ ID NO: 403921 - DNA, 27 bp, Artificial Sequence
  Description of Artificial Sequence: Synthetic oligonucleotide
cgtcggtggacaggttgtgcagacaca

SEQ ID NO: 403922 - DNA, 28 bp, Artificial Sequence
  Description of Artificial Sequence: Synthetic oligonucleotide
gtcggtggacaggttgtgcagacacaac

SEQ ID NO: 403923 - DNA, 30 bp, Artificial Sequence
  Description of Artificial Sequence: Synthetic oligonucleotide
tcggtggacaggttgtgcagacacaactac

SEQ ID NO: 403924 - DNA, 29 bp, Artificial Sequence
  Description of Artificial Sequence: Synthetic oligonucleotide
cggtggacaggttgtgcagacacaactac

SEQ ID NO: 403925 - DNA, 29 bp, Artificial Sequence
  Description of Artificial Sequence: Synthetic oligonucleotide
ggtggacaggttgtgcagacacaactacg

SEQ ID NO: 403926 - DNA, 30 bp, Artificial Sequence
  Description of Artificial Sequence: Synthetic oligonucleotide
gtggacaggttgtgcagacacaactacgag

SEQ ID NO: 403927 - DNA, 30 bp, Artificial Sequence
  Description of Artificial Sequence: Synthetic oligonucleotide
tggacaggttgtgcagacacaactacgagg

SEQ ID NO: 403928 - DNA, 29 bp, Artificial Sequence
  Description of Artificial Sequence: Synthetic oligonucleotide
ggacaggttgtgcagacacaactacgagg

SEQ ID NO: 403929 - DNA, 30 bp, Artificial Sequence
  Description of Artificial Sequence: Synthetic oligonucleotide
gacaggttgtgcagacacaactacgaggtg

SEQ ID NO: 403930 - DNA, 30 bp, Artificial Sequence
  Description of Artificial Sequence: Synthetic oligonucleotide
acaggttgtgcagacacaactacgaggtgg

SEQ ID NO: 403931 - DNA, 29 bp, Artificial Sequence
  Description of Artificial Sequence: Synthetic oligonucleotide
caggttgtgcagacacaactacgaggtgg

SEQ ID NO: 403932 - DNA, 29 bp, Artificial Sequence
  Description of Artificial Sequence: Synthetic oligonucleotide
aggttgtgcagacacaactacgaggtggc

SEQ ID NO: 403933 - DNA, 28 bp, Artificial Sequence
  Description of Artificial Sequence: Synthetic oligonucleotide
ggttgtgcagacacaactacgaggtggc

SEQ ID NO: 403934 - DNA, 28 bp, Artificial Sequence
  Description of Artificial Sequence: Synthetic oligonucleotide
gttgtgcagacacaactacgaggtggcg

SEQ ID NO: 403935 - DNA, 30 bp, Artificial Sequence
  Description of Artificial Sequence: Synthetic oligonucleotide
ttgtgcagacacaactacgaggtggcgtac

SEQ ID NO: 403936 - DNA, 42 bp, Artificial Sequence
  Description of Artificial Sequence: Synthetic oligonucleotide
ttctaagaactttgctcttctcaccaaaacttaaggctcttc

SEQ ID NO: 403937 - DNA, 41 bp, Artificial Sequence
  Description of Artificial Sequence: Synthetic oligonucleotide
tctaagaactttgctcttctcaccaaaacttaaggctcttc

SEQ ID NO: 403938 - DNA, 40 bp, Artificial Sequence
  Description of Artificial Sequence: Synthetic oligonucleotide
ctaagaactttgctcttctcaccaaaacttaaggctcttc

SEQ ID NO: 403939 - DNA, 41 bp, Artificial Sequence
  Description of Artificial Sequence: Synthetic oligonucleotide
taagaactttgctcttctcaccaaaacttaaggctcttcag

SEQ ID NO: 403940 - DNA, 40 bp, Artificial Sequence
  Description of Artificial Sequence: Synthetic oligonucleotide
aagaactttgctcttctcaccaaaacttaaggctcttcag

SEQ ID NO: 403941 - DNA, 39 bp, Artificial Sequence
  Description of Artificial Sequence: Synthetic oligonucleotide
agaactttgctcttctcaccaaaacttaaggctcttcag

SEQ ID NO: 403942 - DNA, 38 bp, Artificial Sequence
  Description of Artificial Sequence: Synthetic oligonucleotide
gaactttgctcttctcaccaaaacttaaggctcttcag

SEQ ID NO: 403943 - DNA, 38 bp, Artificial Sequence
  Description of Artificial Sequence: Synthetic oligonucleotide
aactttgctcttctcaccaaaacttaaggctcttcagc

SEQ ID NO: 403944 - DNA, 37 bp, Artificial Sequence
  Description of Artificial Sequence: Synthetic oligonucleotide
actttgctcttctcaccaaaacttaaggctcttcagc

SEQ ID NO: 403945 - DNA, 36 bp, Artificial Sequence
  Description of Artificial Sequence: Synthetic oligonucleotide
ctttgctcttctcaccaaaacttaaggctcttcagc

SEQ ID NO: 403946 - DNA, 36 bp, Artificial Sequence
  Description of Artificial Sequence: Synthetic oligonucleotide
tttgctcttctcaccaaaacttaaggctcttcagcg

SEQ ID NO: 403947 - DNA, 35 bp, Artificial Sequence
  Description of Artificial Sequence: Synthetic oligonucleotide
ttgctcttctcaccaaaacttaaggctcttcagcg

SEQ ID NO: 403948 - DNA, 34 bp, Artificial Sequence
  Description of Artificial Sequence: Synthetic oligonucleotide
tgctcttctcaccaaaacttaaggctcttcagcg

SEQ ID NO: 403949 - DNA, 33 bp, Artificial Sequence
  Description of Artificial Sequence: Synthetic oligonucleotide
gctcttctcaccaaaacttaaggctcttcagcg

SEQ ID NO: 403950 - DNA, 34 bp, Artificial Sequence
  Description of Artificial Sequence: Synthetic oligonucleotide
ctcttctcaccaaaacttaaggctcttcagcgtg

SEQ ID NO: 403951 - DNA, 35 bp, Artificial Sequence
  Description of Artificial Sequence: Synthetic oligonucleotide
tcttctcaccaaaacttaaggctcttcagcgtgtc

SEQ ID NO: 403952 - DNA, 34 bp, Artificial Sequence
  Description of Artificial Sequence: Synthetic oligonucleotide
cttctcaccaaaacttaaggctcttcagcgtgtc

SEQ ID NO: 403953 - DNA, 37 bp, Artificial Sequence
  Description of Artificial Sequence: Synthetic oligonucleotide
ttctcaccaaaacttaaggctcttcagcgtgtctaag

SEQ ID NO: 403954 - DNA, 36 bp, Artificial Sequence
  Description of Artificial Sequence: Synthetic oligonucleotide
tctcaccaaaacttaaggctcttcagcgtgtctaag

SEQ ID NO: 403955 - DNA, 35 bp, Artificial Sequence
  Description of Artificial Sequence: Synthetic oligonucleotide
ctcaccaaaacttaaggctcttcagcgtgtctaag

SEQ ID NO: 403956 - DNA, 36 bp, Artificial Sequence
  Description of Artificial Sequence: Synthetic oligonucleotide
tcaccaaaacttaaggctcttcagcgtgtctaagac

SEQ ID NO: 403957 - DNA, 35 bp, Artificial Sequence
  Description of Artificial Sequence: Synthetic oligonucleotide
caccaaaacttaaggctcttcagcgtgtctaagac

SEQ ID NO: 403958 - DNA, 37 bp, Artificial Sequence
  Description of Artificial Sequence: Synthetic oligonucleotide
accaaaacttaaggctcttcagcgtgtctaagacaac

SEQ ID NO: 403959 - DNA, 36 bp, Artificial Sequence
  Description of Artificial Sequence: Synthetic oligonucleotide
ccaaaacttaaggctcttcagcgtgtctaagacaac

SEQ ID NO: 403960 - DNA, 37 bp, Artificial Sequence
  Description of Artificial Sequence: Synthetic oligonucleotide
caaaacttaaggctcttcagcgtgtctaagacaacag

SEQ ID NO: 403961 - DNA, 37 bp, Artificial Sequence
  Description of Artificial Sequence: Synthetic oligonucleotide
aaaacttaaggctcttcagcgtgtctaagacaacagc

SEQ ID NO: 403962 - DNA, 36 bp, Artificial Sequence
  Description of Artificial Sequence: Synthetic oligonucleotide
aaacttaaggctcttcagcgtgtctaagacaacagc

SEQ ID NO: 403963 - DNA, 35 bp, Artificial Sequence
  Description of Artificial Sequence: Synthetic oligonucleotide
aacttaaggctcttcagcgtgtctaagacaacagc

SEQ ID NO: 403964 - DNA, 42 bp, Artificial Sequence
  Description of Artificial Sequence: Synthetic oligonucleotide
ctcttcagcgtgtctaagacaacagcagtaaaaatttctatg

SEQ ID NO: 403965 - DNA, 43 bp, Artificial Sequence
  Description of Artificial Sequence: Synthetic oligonucleotide
tcttcagcgtgtctaagacaacagcagtaaaaatttctatgac

SEQ ID NO: 403966 - DNA, 42 bp, Artificial Sequence
  Description of Artificial Sequence: Synthetic oligonucleotide
cttcagcgtgtctaagacaacagcagtaaaaatttctatgac

SEQ ID NO: 403967 - DNA, 43 bp, Artificial Sequence
  Description of Artificial Sequence: Synthetic oligonucleotide
ttcagcgtgtctaagacaacagcagtaaaaatttctatgacag

SEQ ID NO: 403968 - DNA, 42 bp, Artificial Sequence
  Description of Artificial Sequence: Synthetic oligonucleotide
tcagcgtgtctaagacaacagcagtaaaaatttctatgacag

SEQ ID NO: 403969 - DNA, 41 bp, Artificial Sequence
  Description of Artificial Sequence: Synthetic oligonucleotide
cagcgtgtctaagacaacagcagtaaaaatttctatgacag

SEQ ID NO: 403970 - DNA, 41 bp, Artificial Sequence
  Description of Artificial Sequence: Synthetic oligonucleotide
agcgtgtctaagacaacagcagtaaaaatttctatgacagc

SEQ ID NO: 403971 - DNA, 40 bp, Artificial Sequence
  Description of Artificial Sequence: Synthetic oligonucleotide
gcgtgtctaagacaacagcagtaaaaatttctatgacagc

SEQ ID NO: 403972 - DNA, 46 bp, Artificial Sequence
  Description of Artificial Sequence: Synthetic oligonucleotide
cgtgtctaagacaacagcagtaaaaatttctatgacagcaattttc

SEQ ID NO: 403973 - DNA, 47 bp, Artificial Sequence
  Description of Artificial Sequence: Synthetic oligonucleotide
gtgtctaagacaacagcagtaaaaatttctatgacagcaattttctc

SEQ ID NO: 403974 - DNA, 48 bp, Artificial Sequence
  Description of Artificial Sequence: Synthetic oligonucleotide
tgtctaagacaacagcagtaaaaatttctatgacagcaattttctctc

SEQ ID NO: 403975 - DNA, 47 bp, Artificial Sequence
  Description of Artificial Sequence: Synthetic oligonucleotide
gtctaagacaacagcagtaaaaatttctatgacagcaattttctctc

SEQ ID NO: 403976 - DNA, 47 bp, Artificial Sequence
  Description of Artificial Sequence: Synthetic oligonucleotide
tctaagacaacagcagtaaaaatttctatgacagcaattttctctcc

SEQ ID NO: 403977 - DNA, 46 bp, Artificial Sequence
  Description of Artificial Sequence: Synthetic oligonucleotide
ctaagacaacagcagtaaaaatttctatgacagcaattttctctcc

SEQ ID NO: 403978 - DNA, 46 bp, Artificial Sequence
  Description of Artificial Sequence: Synthetic oligonucleotide
taagacaacagcagtaaaaatttctatgacagcaattttctctccc

SEQ ID NO: 403979 - DNA, 45 bp, Artificial Sequence
  Description of Artificial Sequence: Synthetic oligonucleotide
aagacaacagcagtaaaaatttctatgacagcaattttctctccc

SEQ ID NO: 403980 - DNA, 44 bp, Artificial Sequence
  Description of Artificial Sequence: Synthetic oligonucleotide
agacaacagcagtaaaaatttctatgacagcaattttctctccc

SEQ ID NO: 403981 - DNA, 43 bp, Artificial Sequence
  Description of Artificial Sequence: Synthetic oligonucleotide
gacaacagcagtaaaaatttctatgacagcaattttctctccc

SEQ ID NO: 403982 - DNA, 43 bp, Artificial Sequence
  Description of Artificial Sequence: Synthetic oligonucleotide
acaacagcagtaaaaatttctatgacagcaattttctctcccc

SEQ ID NO: 403983 - DNA, 42 bp, Artificial Sequence
  Description of Artificial Sequence: Synthetic oligonucleotide
caacagcagtaaaaatttctatgacagcaattttctctcccc

SEQ ID NO: 403984 - DNA, 43 bp, Artificial Sequence
  Description of Artificial Sequence: Synthetic oligonucleotide
aacagcagtaaaaatttctatgacagcaattttctctcccctg

SEQ ID NO: 403985 - DNA, 42 bp, Artificial Sequence
  Description of Artificial Sequence: Synthetic oligonucleotide
acagcagtaaaaatttctatgacagcaattttctctcccctg

SEQ ID NO: 403986 - DNA, 41 bp, Artificial Sequence
  Description of Artificial Sequence: Synthetic oligonucleotide
cagcagtaaaaatttctatgacagcaattttctctcccctg

SEQ ID NO: 403987 - DNA, 47 bp, Artificial Sequence
  Description of Artificial Sequence: Synthetic oligonucleotide
agcagtaaaaatttctatgacagcaattttctctcccctgaaatatg

SEQ ID NO: 403988 - DNA, 46 bp, Artificial Sequence
  Description of Artificial Sequence: Synthetic oligonucleotide
gcagtaaaaatttctatgacagcaattttctctcccctgaaatatg

SEQ ID NO: 403989 - DNA, 48 bp, Artificial Sequence
  Description of Artificial Sequence: Synthetic oligonucleotide
cagtaaaaatttctatgacagcaattttctctcccctgaaatatgatc

SEQ ID NO: 403990 - DNA, 48 bp, Artificial Sequence
  Description of Artificial Sequence: Synthetic oligonucleotide
agtaaaaatttctatgacagcaattttctctcccctgaaatatgatcc

SEQ ID NO: 403991 - DNA, 47 bp, Artificial Sequence
  Description of Artificial Sequence: Synthetic oligonucleotide
gtaaaaatttctatgacagcaattttctctcccctgaaatatgatcc

SEQ ID NO: 403992 - DNA, 47 bp, Artificial Sequence
  Description of Artificial Sequence: Synthetic oligonucleotide
taaaaatttctatgacagcaattttctctcccctgaaatatgatccc

SEQ ID NO: 403993 - DNA, 46 bp, Artificial Sequence
  Description of Artificial Sequence: Synthetic oligonucleotide
aaaaatttctatgacagcaattttctctcccctgaaatatgatccc

SEQ ID NO: 403994 - DNA, 45 bp, Artificial Sequence
  Description of Artificial Sequence: Synthetic oligonucleotide
aaaatttctatgacagcaattttctctcccctgaaatatgatccc

SEQ ID NO: 403995 - DNA, 44 bp, Artificial Sequence
  Description of Artificial Sequence: Synthetic oligonucleotide
aaatttctatgacagcaattttctctcccctgaaatatgatccc

SEQ ID NO: 403996 - DNA, 43 bp, Artificial Sequence
  Description of Artificial Sequence: Synthetic oligonucleotide
aatttctatgacagcaattttctctcccctgaaatatgatccc

SEQ ID NO: 403997 - DNA, 42 bp, Artificial Sequence
  Description of Artificial Sequence: Synthetic oligonucleotide
atttctatgacagcaattttctctcccctgaaatatgatccc

SEQ ID NO: 403998 - DNA, 41 bp, Artificial Sequence
  Description of Artificial Sequence: Synthetic oligonucleotide
tttctatgacagcaattttctctcccctgaaatatgatccc

SEQ ID NO: 403999 - DNA, 40 bp, Artificial Sequence
  Description of Artificial Sequence: Synthetic oligonucleotide
ttctatgacagcaattttctctcccctgaaatatgatccc

SEQ ID NO: 404000 - DNA, 53 bp, Artificial Sequence
  Description of Artificial Sequence: Synthetic oligonucleotide
aattttctctcccctgaaatatgatccccacttaatttgctttattaaaaatc

SEQ ID NO: 404001 - DNA, 52 bp, Artificial Sequence
  Description of Artificial Sequence: Synthetic oligonucleotide
attttctctcccctgaaatatgatccccacttaatttgctttattaaaaatc

SEQ ID NO: 404002 - DNA, 51 bp, Artificial Sequence
  Description of Artificial Sequence: Synthetic oligonucleotide
ttttctctcccctgaaatatgatccccacttaatttgctttattaaaaatc

SEQ ID NO: 404003 - DNA, 50 bp, Artificial Sequence
  Description of Artificial Sequence: Synthetic oligonucleotide
tttctctcccctgaaatatgatccccacttaatttgctttattaaaaatc

SEQ ID NO: 404004 - DNA, 49 bp, Artificial Sequence
  Description of Artificial Sequence: Synthetic oligonucleotide
ttctctcccctgaaatatgatccccacttaatttgctttattaaaaatc

SEQ ID NO: 404005 - DNA, 48 bp, Artificial Sequence
  Description of Artificial Sequence: Synthetic oligonucleotide
tctctcccctgaaatatgatccccacttaatttgctttattaaaaatc

SEQ ID NO: 404006 - DNA, 47 bp, Artificial Sequence
  Description of Artificial Sequence: Synthetic oligonucleotide
ctctcccctgaaatatgatccccacttaatttgctttattaaaaatc

SEQ ID NO: 404007 - DNA, 47 bp, Artificial Sequence
  Description of Artificial Sequence: Synthetic oligonucleotide
tctcccctgaaatatgatccccacttaatttgctttattaaaaatcc

SEQ ID NO: 404008 - DNA, 46 bp, Artificial Sequence
  Description of Artificial Sequence: Synthetic oligonucleotide
ctcccctgaaatatgatccccacttaatttgctttattaaaaatcc

SEQ ID NO: 404009 - DNA, 46 bp, Artificial Sequence
  Description of Artificial Sequence: Synthetic oligonucleotide
tcccctgaaatatgatccccacttaatttgctttattaaaaatccc

SEQ ID NO: 404010 - DNA, 45 bp, Artificial Sequence
  Description of Artificial Sequence: Synthetic oligonucleotide
cccctgaaatatgatccccacttaatttgctttattaaaaatccc

SEQ ID NO: 404011 - DNA, 47 bp, Artificial Sequence
  Description of Artificial Sequence: Synthetic oligonucleotide
ccctgaaatatgatccccacttaatttgctttattaaaaatcccaag

SEQ ID NO: 404012 - DNA, 55 bp, Artificial Sequence
  Description of Artificial Sequence: Synthetic oligonucleotide
cctgaaatatgatccccacttaatttgctttattaaaaatcccaagtataataac

SEQ ID NO: 404013 - DNA, 57 bp, Artificial Sequence
  Description of Artificial Sequence: Synthetic oligonucleotide
ctgaaatatgatccccacttaatttgctttattaaaaatcccaagtataataacaac

SEQ ID NO: 404014 - DNA, 58 bp, Artificial Sequence
  Description of Artificial Sequence: Synthetic oligonucleotide
tgaaatatgatccccacttaatttgctttattaaaaatcccaagtataataacaactg

SEQ ID NO: 404015 - DNA, 57 bp, Artificial Sequence
  Description of Artificial Sequence: Synthetic oligonucleotide
gaaatatgatccccacttaatttgctttattaaaaatcccaagtataataacaactg

SEQ ID NO: 404016 - DNA, 57 bp, Artificial Sequence
  Description of Artificial Sequence: Synthetic oligonucleotide
aaatatgatccccacttaatttgctttattaaaaatcccaagtataataacaactgg

SEQ ID NO: 404017 - DNA, 56 bp, Artificial Sequence
  Description of Artificial Sequence: Synthetic oligonucleotide
aatatgatccccacttaatttgctttattaaaaatcccaagtataataacaactgg

SEQ ID NO: 404018 - DNA, 55 bp, Artificial Sequence
  Description of Artificial Sequence: Synthetic oligonucleotide
atatgatccccacttaatttgctttattaaaaatcccaagtataataacaactgg

SEQ ID NO: 404019 - DNA, 54 bp, Artificial Sequence
  Description of Artificial Sequence: Synthetic oligonucleotide
tatgatccccacttaatttgctttattaaaaatcccaagtataataacaactgg

SEQ ID NO: 404020 - DNA, 53 bp, Artificial Sequence
  Description of Artificial Sequence: Synthetic oligonucleotide
atgatccccacttaatttgctttattaaaaatcccaagtataataacaactgg

SEQ ID NO: 404021 - DNA, 52 bp, Artificial Sequence
  Description of Artificial Sequence: Synthetic oligonucleotide
tgatccccacttaatttgctttattaaaaatcccaagtataataacaactgg

SEQ ID NO: 404022 - DNA, 51 bp, Artificial Sequence
  Description of Artificial Sequence: Synthetic oligonucleotide
gatccccacttaatttgctttattaaaaatcccaagtataataacaactgg

SEQ ID NO: 404023 - DNA, 59 bp, Artificial Sequence
  Description of Artificial Sequence: Synthetic oligonucleotide
atccccacttaatttgctttattaaaaatcccaagtataataacaactggtttttaatc

SEQ ID NO: 404024 - DNA, 58 bp, Artificial Sequence
  Description of Artificial Sequence: Synthetic oligonucleotide
tccccacttaatttgctttattaaaaatcccaagtataataacaactggtttttaatc

SEQ ID NO: 404025 - DNA, 57 bp, Artificial Sequence
  Description of Artificial Sequence: Synthetic oligonucleotide
ccccacttaatttgctttattaaaaatcccaagtataataacaactggtttttaatc

SEQ ID NO: 404026 - DNA, 60 bp, Artificial Sequence
  Description of Artificial Sequence: Synthetic oligonucleotide
cccacttaatttgctttattaaaaatcccaagtataataacaactggtttttaatcaata

SEQ ID NO: 404027 - DNA, 60 bp, Artificial Sequence
  Description of Artificial Sequence: Synthetic oligonucleotide
ccacttaatttgctttattaaaaatcccaagtataataacaactggtttttaatcaatat

SEQ ID NO: 404028 - DNA, 60 bp, Artificial Sequence
  Description of Artificial Sequence: Synthetic oligonucleotide
cacttaatttgctttattaaaaatcccaagtataataacaactggtttttaatcaatatt

SEQ ID NO: 404029 - DNA, 60 bp, Artificial Sequence
  Description of Artificial Sequence: Synthetic oligonucleotide
acttaatttgctttattaaaaatcccaagtataataacaactggtttttaatcaatatta

SEQ ID NO: 404030 - DNA, 60 bp, Artificial Sequence
  Description of Artificial Sequence: Synthetic oligonucleotide
cttaatttgctttattaaaaatcccaagtataataacaactggtttttaatcaatattac

SEQ ID NO: 404031 - DNA, 60 bp, Artificial Sequence
  Description of Artificial Sequence: Synthetic oligonucleotide
ttaatttgctttattaaaaatcccaagtataataacaactggtttttaatcaatattaca

SEQ ID NO: 404032 - DNA, 60 bp, Artificial Sequence
  Description of Artificial Sequence: Synthetic oligonucleotide
taatttgctttattaaaaatcccaagtataataacaactggtttttaatcaatattacag

SEQ ID NO: 404033 - DNA, 60 bp, Artificial Sequence
  Description of Artificial Sequence: Synthetic oligonucleotide
aatttgctttattaaaaatcccaagtataataacaactggtttttaatcaatattacaga

SEQ ID NO: 404034 - DNA, 60 bp, Artificial Sequence
  Description of Artificial Sequence: Synthetic oligonucleotide
atttgctttattaaaaatcccaagtataataacaactggtttttaatcaatattacagag

SEQ ID NO: 404035 - DNA, 60 bp, Artificial Sequence
  Description of Artificial Sequence: Synthetic oligonucleotide
tttgctttattaaaaatcccaagtataataacaactggtttttaatcaatattacagaga

SEQ ID NO: 404036 - DNA, 60 bp, Artificial Sequence
  Description of Artificial Sequence: Synthetic oligonucleotide
ttgctttattaaaaatcccaagtataataacaactggtttttaatcaatattacagagat

SEQ ID NO: 404037 - DNA, 60 bp, Artificial Sequence
  Description of Artificial Sequence: Synthetic oligonucleotide
tgctttattaaaaatcccaagtataataacaactggtttttaatcaatattacagagatg

SEQ ID NO: 404038 - DNA, 60 bp, Artificial Sequence
  Description of Artificial Sequence: Synthetic oligonucleotide
gctttattaaaaatcccaagtataataacaactggtttttaatcaatattacagagatgt

SEQ ID NO: 404039 - DNA, 60 bp, Artificial Sequence
  Description of Artificial Sequence: Synthetic oligonucleotide
ctttattaaaaatcccaagtataataacaactggtttttaatcaatattacagagatgtt

SEQ ID NO: 404040 - DNA, 60 bp, Artificial Sequence
  Description of Artificial Sequence: Synthetic oligonucleotide
tttattaaaaatcccaagtataataacaactggtttttaatcaatattacagagatgttt

SEQ ID NO: 404041 - DNA, 60 bp, Artificial Sequence
  Description of Artificial Sequence: Synthetic oligonucleotide
ttattaaaaatcccaagtataataacaactggtttttaatcaatattacagagatgttta

SEQ ID NO: 404042 - DNA, 60 bp, Artificial Sequence
  Description of Artificial Sequence: Synthetic oligonucleotide
tattaaaaatcccaagtataataacaactggtttttaatcaatattacagagatgtttac

SEQ ID NO: 404043 - DNA, 60 bp, Artificial Sequence
  Description of Artificial Sequence: Synthetic oligonucleotide
attaaaaatcccaagtataataacaactggtttttaatcaatattacagagatgtttact

SEQ ID NO: 404044 - DNA, 60 bp, Artificial Sequence
  Description of Artificial Sequence: Synthetic oligonucleotide
ttaaaaatcccaagtataataacaactggtttttaatcaatattacagagatgtttactg

SEQ ID NO: 404045 - DNA, 60 bp, Artificial Sequence
  Description of Artificial Sequence: Synthetic oligonucleotide
taaaaatcccaagtataataacaactggtttttaatcaatattacagagatgtttactgt

SEQ ID NO: 404046 - DNA, 60 bp, Artificial Sequence
  Description of Artificial Sequence: Synthetic oligonucleotide
aaaaatcccaagtataataacaactggtttttaatcaatattacagagatgtttactgtt

SEQ ID NO: 404047 - DNA, 60 bp, Artificial Sequence
  Description of Artificial Sequence: Synthetic oligonucleotide
aaaatcccaagtataataacaactggtttttaatcaatattacagagatgtttactgttg

SEQ ID NO: 404048 - DNA, 59 bp, Artificial Sequence
  Description of Artificial Sequence: Synthetic oligonucleotide
aaatcccaagtataataacaactggtttttaatcaatattacagagatgtttactgttg

SEQ ID NO: 404049 - DNA, 58 bp, Artificial Sequence
  Description of Artificial Sequence: Synthetic oligonucleotide
aatcccaagtataataacaactggtttttaatcaatattacagagatgtttactgttg

SEQ ID NO: 404050 - DNA, 57 bp, Artificial Sequence
  Description of Artificial Sequence: Synthetic oligonucleotide
atcccaagtataataacaactggtttttaatcaatattacagagatgtttactgttg

SEQ ID NO: 404051 - DNA, 56 bp, Artificial Sequence
  Description of Artificial Sequence: Synthetic oligonucleotide
tcccaagtataataacaactggtttttaatcaatattacagagatgtttactgttg

SEQ ID NO: 404052 - DNA, 55 bp, Artificial Sequence
  Description of Artificial Sequence: Synthetic oligonucleotide
cccaagtataataacaactggtttttaatcaatattacagagatgtttactgttg

SEQ ID NO: 404053 - DNA, 58 bp, Artificial Sequence
  Description of Artificial Sequence: Synthetic oligonucleotide
ccaagtataataacaactggtttttaatcaatattacagagatgtttactgttgaatc

SEQ ID NO: 404054 - DNA, 58 bp, Artificial Sequence
  Description of Artificial Sequence: Synthetic oligonucleotide
caagtataataacaactggtttttaatcaatattacagagatgtttactgttgaatcg

SEQ ID NO: 404055 - DNA, 58 bp, Artificial Sequence
  Description of Artificial Sequence: Synthetic oligonucleotide
aagtataataacaactggtttttaatcaatattacagagatgtttactgttgaatcgc

SEQ ID NO: 404056 - DNA, 57 bp, Artificial Sequence
  Description of Artificial Sequence: Synthetic oligonucleotide
agtataataacaactggtttttaatcaatattacagagatgtttactgttgaatcgc

SEQ ID NO: 404057 - DNA, 56 bp, Artificial Sequence
  Description of Artificial Sequence: Synthetic oligonucleotide
gtataataacaactggtttttaatcaatattacagagatgtttactgttgaatcgc

SEQ ID NO: 404058 - DNA, 60 bp, Artificial Sequence
  Description of Artificial Sequence: Synthetic oligonucleotide
tataataacaactggtttttaatcaatattacagagatgtttactgttgaatcgcatttt

SEQ ID NO: 404059 - DNA, 60 bp, Artificial Sequence
  Description of Artificial Sequence: Synthetic oligonucleotide
ataataacaactggtttttaatcaatattacagagatgtttactgttgaatcgcattttt

SEQ ID NO: 404060 - DNA, 60 bp, Artificial Sequence
  Description of Artificial Sequence: Synthetic oligonucleotide
taataacaactggtttttaatcaatattacagagatgtttactgttgaatcgcatttttc

SEQ ID NO: 404061 - DNA, 59 bp, Artificial Sequence
  Description of Artificial Sequence: Synthetic oligonucleotide
aataacaactggtttttaatcaatattacagagatgtttactgttgaatcgcatttttc

SEQ ID NO: 404062 - DNA, 58 bp, Artificial Sequence
  Description of Artificial Sequence: Synthetic oligonucleotide
ataacaactggtttttaatcaatattacagagatgtttactgttgaatcgcatttttc

SEQ ID NO: 404063 - DNA, 57 bp, Artificial Sequence
  Description of Artificial Sequence: Synthetic oligonucleotide
taacaactggtttttaatcaatattacagagatgtttactgttgaatcgcatttttc

SEQ ID NO: 404064 - DNA, 56 bp, Artificial Sequence
  Description of Artificial Sequence: Synthetic oligonucleotide
aacaactggtttttaatcaatattacagagatgtttactgttgaatcgcatttttc

SEQ ID NO: 404065 - DNA, 55 bp, Artificial Sequence
  Description of Artificial Sequence: Synthetic oligonucleotide
acaactggtttttaatcaatattacagagatgtttactgttgaatcgcatttttc

SEQ ID NO: 404066 - DNA, 54 bp, Artificial Sequence
  Description of Artificial Sequence: Synthetic oligonucleotide
caactggtttttaatcaatattacagagatgtttactgttgaatcgcatttttc

SEQ ID NO: 404067 - DNA, 58 bp, Artificial Sequence
  Description of Artificial Sequence: Synthetic oligonucleotide
aactggtttttaatcaatattacagagatgtttactgttgaatcgcatttttcttttg

SEQ ID NO: 404068 - DNA, 57 bp, Artificial Sequence
  Description of Artificial Sequence: Synthetic oligonucleotide
actggtttttaatcaatattacagagatgtttactgttgaatcgcatttttcttttg

SEQ ID NO: 404069 - DNA, 56 bp, Artificial Sequence
  Description of Artificial Sequence: Synthetic oligonucleotide
ctggtttttaatcaatattacagagatgtttactgttgaatcgcatttttcttttg

SEQ ID NO: 404070 - DNA, 56 bp, Artificial Sequence
  Description of Artificial Sequence: Synthetic oligonucleotide
tggtttttaatcaatattacagagatgtttactgttgaatcgcatttttcttttgc

SEQ ID NO: 404071 - DNA, 55 bp, Artificial Sequence
  Description of Artificial Sequence: Synthetic oligonucleotide
ggtttttaatcaatattacagagatgtttactgttgaatcgcatttttcttttgc

SEQ ID NO: 404072 - DNA, 55 bp, Artificial Sequence
  Description of Artificial Sequence: Synthetic oligonucleotide
gtttttaatcaatattacagagatgtttactgttgaatcgcatttttcttttgcc

SEQ ID NO: 404073 - DNA, 56 bp, Artificial Sequence
  Description of Artificial Sequence: Synthetic oligonucleotide
tttttaatcaatattacagagatgtttactgttgaatcgcatttttcttttgcctc

SEQ ID NO: 404074 - DNA, 55 bp, Artificial Sequence
  Description of Artificial Sequence: Synthetic oligonucleotide
ttttaatcaatattacagagatgtttactgttgaatcgcatttttcttttgcctc

SEQ ID NO: 404075 - DNA, 54 bp, Artificial Sequence
  Description of Artificial Sequence: Synthetic oligonucleotide
tttaatcaatattacagagatgtttactgttgaatcgcatttttcttttgcctc

SEQ ID NO: 404076 - DNA, 53 bp, Artificial Sequence
  Description of Artificial Sequence: Synthetic oligonucleotide
ttaatcaatattacagagatgtttactgttgaatcgcatttttcttttgcctc

SEQ ID NO: 404077 - DNA, 52 bp, Artificial Sequence
  Description of Artificial Sequence: Synthetic oligonucleotide
taatcaatattacagagatgtttactgttgaatcgcatttttcttttgcctc

SEQ ID NO: 404078 - DNA, 51 bp, Artificial Sequence
  Description of Artificial Sequence: Synthetic oligonucleotide
aatcaatattacagagatgtttactgttgaatcgcatttttcttttgcctc

SEQ ID NO: 404079 - DNA, 50 bp, Artificial Sequence
  Description of Artificial Sequence: Synthetic oligonucleotide
atcaatattacagagatgtttactgttgaatcgcatttttcttttgcctc

SEQ ID NO: 404080 - DNA, 49 bp, Artificial Sequence
  Description of Artificial Sequence: Synthetic oligonucleotide
tcaatattacagagatgtttactgttgaatcgcatttttcttttgcctc

SEQ ID NO: 404081 - DNA, 48 bp, Artificial Sequence
  Description of Artificial Sequence: Synthetic oligonucleotide
caatattacagagatgtttactgttgaatcgcatttttcttttgcctc

SEQ ID NO: 404082 - DNA, 49 bp, Artificial Sequence
  Description of Artificial Sequence: Synthetic oligonucleotide
aatattacagagatgtttactgttgaatcgcatttttcttttgcctctc

SEQ ID NO: 404083 - DNA, 48 bp, Artificial Sequence
  Description of Artificial Sequence: Synthetic oligonucleotide
atattacagagatgtttactgttgaatcgcatttttcttttgcctctc

SEQ ID NO: 404084 - DNA, 47 bp, Artificial Sequence
  Description of Artificial Sequence: Synthetic oligonucleotide
tattacagagatgtttactgttgaatcgcatttttcttttgcctctc

SEQ ID NO: 404085 - DNA, 46 bp, Artificial Sequence
  Description of Artificial Sequence: Synthetic oligonucleotide
attacagagatgtttactgttgaatcgcatttttcttttgcctctc

SEQ ID NO: 404086 - DNA, 45 bp, Artificial Sequence
  Description of Artificial Sequence: Synthetic oligonucleotide
ttacagagatgtttactgttgaatcgcatttttcttttgcctctc

SEQ ID NO: 404087 - DNA, 44 bp, Artificial Sequence
  Description of Artificial Sequence: Synthetic oligonucleotide
tacagagatgtttactgttgaatcgcatttttcttttgcctctc

SEQ ID NO: 404088 - DNA, 43 bp, Artificial Sequence
  Description of Artificial Sequence: Synthetic oligonucleotide
acagagatgtttactgttgaatcgcatttttcttttgcctctc

SEQ ID NO: 404089 - DNA, 42 bp, Artificial Sequence
  Description of Artificial Sequence: Synthetic oligonucleotide
cagagatgtttactgttgaatcgcatttttcttttgcctctc

SEQ ID NO: 404090 - DNA, 47 bp, Artificial Sequence
  Description of Artificial Sequence: Synthetic oligonucleotide
agagatgtttactgttgaatcgcatttttcttttgcctctcaaaatc

SEQ ID NO: 404091 - DNA, 46 bp, Artificial Sequence
  Description of Artificial Sequence: Synthetic oligonucleotide
gagatgtttactgttgaatcgcatttttcttttgcctctcaaaatc

SEQ ID NO: 404092 - DNA, 46 bp, Artificial Sequence
  Description of Artificial Sequence: Synthetic oligonucleotide
agatgtttactgttgaatcgcatttttcttttgcctctcaaaatcc

SEQ ID NO: 404093 - DNA, 45 bp, Artificial Sequence
  Description of Artificial Sequence: Synthetic oligonucleotide
gatgtttactgttgaatcgcatttttcttttgcctctcaaaatcc

SEQ ID NO: 404094 - DNA, 45 bp, Artificial Sequence
  Description of Artificial Sequence: Synthetic oligonucleotide
atgtttactgttgaatcgcatttttcttttgcctctcaaaatccc

SEQ ID NO: 404095 - DNA, 44 bp, Artificial Sequence
  Description of Artificial Sequence: Synthetic oligonucleotide
tgtttactgttgaatcgcatttttcttttgcctctcaaaatccc

SEQ ID NO: 404096 - DNA, 43 bp, Artificial Sequence
  Description of Artificial Sequence: Synthetic oligonucleotide
gtttactgttgaatcgcatttttcttttgcctctcaaaatccc

SEQ ID NO: 404097 - DNA, 44 bp, Artificial Sequence
  Description of Artificial Sequence: Synthetic oligonucleotide
tttactgttgaatcgcatttttcttttgcctctcaaaatccctg

SEQ ID NO: 404098 - DNA, 43 bp, Artificial Sequence
  Description of Artificial Sequence: Synthetic oligonucleotide
ttactgttgaatcgcatttttcttttgcctctcaaaatccctg

SEQ ID NO: 404099 - DNA, 42 bp, Artificial Sequence
  Description of Artificial Sequence: Synthetic oligonucleotide
tactgttgaatcgcatttttcttttgcctctcaaaatccctg

SEQ ID NO: 404100 - DNA, 41 bp, Artificial Sequence
  Description of Artificial Sequence: Synthetic oligonucleotide
actgttgaatcgcatttttcttttgcctctcaaaatccctg

SEQ ID NO: 404101 - DNA, 40 bp, Artificial Sequence
  Description of Artificial Sequence: Synthetic oligonucleotide
ctgttgaatcgcatttttcttttgcctctcaaaatccctg

SEQ ID NO: 404102 - DNA, 41 bp, Artificial Sequence
  Description of Artificial Sequence: Synthetic oligonucleotide
tgttgaatcgcatttttcttttgcctctcaaaatccctgag

SEQ ID NO: 404103 - DNA, 40 bp, Artificial Sequence
  Description of Artificial Sequence: Synthetic oligonucleotide
gttgaatcgcatttttcttttgcctctcaaaatccctgag

SEQ ID NO: 404104 - DNA, 40 bp, Artificial Sequence
  Description of Artificial Sequence: Synthetic oligonucleotide
ttgaatcgcatttttcttttgcctctcaaaatccctgagg

SEQ ID NO: 404105 - DNA, 39 bp, Artificial Sequence
  Description of Artificial Sequence: Synthetic oligonucleotide
tgaatcgcatttttcttttgcctctcaaaatccctgagg

SEQ ID NO: 404106 - DNA, 38 bp, Artificial Sequence
  Description of Artificial Sequence: Synthetic oligonucleotide
gaatcgcatttttcttttgcctctcaaaatccctgagg

SEQ ID NO: 404107 - DNA, 38 bp, Artificial Sequence
  Description of Artificial Sequence: Synthetic oligonucleotide
aatcgcatttttcttttgcctctcaaaatccctgaggc

SEQ ID NO: 404108 - DNA, 37 bp, Artificial Sequence
  Description of Artificial Sequence: Synthetic oligonucleotide
atcgcatttttcttttgcctctcaaaatccctgaggc

SEQ ID NO: 404109 - DNA, 36 bp, Artificial Sequence
  Description of Artificial Sequence: Synthetic oligonucleotide
tcgcatttttcttttgcctctcaaaatccctgaggc

SEQ ID NO: 404110 - DNA, 35 bp, Artificial Sequence
  Description of Artificial Sequence: Synthetic oligonucleotide
cgcatttttcttttgcctctcaaaatccctgaggc

SEQ ID NO: 404111 - DNA, 36 bp, Artificial Sequence
  Description of Artificial Sequence: Synthetic oligonucleotide
gcatttttcttttgcctctcaaaatccctgaggcac

SEQ ID NO: 404112 - DNA, 37 bp, Artificial Sequence
  Description of Artificial Sequence: Synthetic oligonucleotide
catttttcttttgcctctcaaaatccctgaggcactc

SEQ ID NO: 404113 - DNA, 40 bp, Artificial Sequence
  Description of Artificial Sequence: Synthetic oligonucleotide
atttttcttttgcctctcaaaatccctgaggcactcattc

SEQ ID NO: 404114 - DNA, 39 bp, Artificial Sequence
  Description of Artificial Sequence: Synthetic oligonucleotide
tttttcttttgcctctcaaaatccctgaggcactcattc

SEQ ID NO: 404115 - DNA, 38 bp, Artificial Sequence
  Description of Artificial Sequence: Synthetic oligonucleotide
ttttcttttgcctctcaaaatccctgaggcactcattc

SEQ ID NO: 404116 - DNA, 37 bp, Artificial Sequence
  Description of Artificial Sequence: Synthetic oligonucleotide
tttcttttgcctctcaaaatccctgaggcactcattc

SEQ ID NO: 404117 - DNA, 36 bp, Artificial Sequence
  Description of Artificial Sequence: Synthetic oligonucleotide
ttcttttgcctctcaaaatccctgaggcactcattc

SEQ ID NO: 404118 - DNA, 35 bp, Artificial Sequence
  Description of Artificial Sequence: Synthetic oligonucleotide
tcttttgcctctcaaaatccctgaggcactcattc

SEQ ID NO: 404119 - DNA, 34 bp, Artificial Sequence
  Description of Artificial Sequence: Synthetic oligonucleotide
cttttgcctctcaaaatccctgaggcactcattc

SEQ ID NO: 404120 - DNA, 36 bp, Artificial Sequence
  Description of Artificial Sequence: Synthetic oligonucleotide
ttttgcctctcaaaatccctgaggcactcattcttc

SEQ ID NO: 404121 - DNA, 35 bp, Artificial Sequence
  Description of Artificial Sequence: Synthetic oligonucleotide
tttgcctctcaaaatccctgaggcactcattcttc

SEQ ID NO: 404122 - DNA, 34 bp, Artificial Sequence
  Description of Artificial Sequence: Synthetic oligonucleotide
ttgcctctcaaaatccctgaggcactcattcttc

SEQ ID NO: 404123 - DNA, 33 bp, Artificial Sequence
  Description of Artificial Sequence: Synthetic oligonucleotide
tgcctctcaaaatccctgaggcactcattcttc

SEQ ID NO: 404124 - DNA, 32 bp, Artificial Sequence
  Description of Artificial Sequence: Synthetic oligonucleotide
gcctctcaaaatccctgaggcactcattcttc

SEQ ID NO: 404125 - DNA, 33 bp, Artificial Sequence
  Description of Artificial Sequence: Synthetic oligonucleotide
cctctcaaaatccctgaggcactcattcttcag

SEQ ID NO: 404126 - DNA, 33 bp, Artificial Sequence
  Description of Artificial Sequence: Synthetic oligonucleotide
ctctcaaaatccctgaggcactcattcttcagc

SEQ ID NO: 404127 - DNA, 37 bp, Artificial Sequence
  Description of Artificial Sequence: Synthetic oligonucleotide
tctcaaaatccctgaggcactcattcttcagcttttc

SEQ ID NO: 404128 - DNA, 36 bp, Artificial Sequence
  Description of Artificial Sequence: Synthetic oligonucleotide
ctcaaaatccctgaggcactcattcttcagcttttc

SEQ ID NO: 404129 - DNA, 43 bp, Artificial Sequence
  Description of Artificial Sequence: Synthetic oligonucleotide
tcaaaatccctgaggcactcattcttcagcttttctataattg

SEQ ID NO: 404130 - DNA, 42 bp, Artificial Sequence
  Description of Artificial Sequence: Synthetic oligonucleotide
caaaatccctgaggcactcattcttcagcttttctataattg

SEQ ID NO: 404131 - DNA, 43 bp, Artificial Sequence
  Description of Artificial Sequence: Synthetic oligonucleotide
aaaatccctgaggcactcattcttcagcttttctataattgag

SEQ ID NO: 404132 - DNA, 42 bp, Artificial Sequence
  Description of Artificial Sequence: Synthetic oligonucleotide
aaatccctgaggcactcattcttcagcttttctataattgag

SEQ ID NO: 404133 - DNA, 41 bp, Artificial Sequence
  Description of Artificial Sequence: Synthetic oligonucleotide
aatccctgaggcactcattcttcagcttttctataattgag

SEQ ID NO: 404134 - DNA, 40 bp, Artificial Sequence
  Description of Artificial Sequence: Synthetic oligonucleotide
atccctgaggcactcattcttcagcttttctataattgag

SEQ ID NO: 404135 - DNA, 39 bp, Artificial Sequence
  Description of Artificial Sequence: Synthetic oligonucleotide
tccctgaggcactcattcttcagcttttctataattgag

SEQ ID NO: 404136 - DNA, 38 bp, Artificial Sequence
  Description of Artificial Sequence: Synthetic oligonucleotide
ccctgaggcactcattcttcagcttttctataattgag

SEQ ID NO: 404137 - DNA, 39 bp, Artificial Sequence
  Description of Artificial Sequence: Synthetic oligonucleotide
cctgaggcactcattcttcagcttttctataattgagag

SEQ ID NO: 404138 - DNA, 47 bp, Artificial Sequence
  Description of Artificial Sequence: Synthetic oligonucleotide
ctgaggcactcattcttcagcttttctataattgagagaaaattttc

SEQ ID NO: 404139 - DNA, 48 bp, Artificial Sequence
  Description of Artificial Sequence: Synthetic oligonucleotide
tgaggcactcattcttcagcttttctataattgagagaaaattttcac

SEQ ID NO: 404140 - DNA, 47 bp, Artificial Sequence
  Description of Artificial Sequence: Synthetic oligonucleotide
gaggcactcattcttcagcttttctataattgagagaaaattttcac

SEQ ID NO: 404141 - DNA, 47 bp, Artificial Sequence
  Description of Artificial Sequence: Synthetic oligonucleotide
aggcactcattcttcagcttttctataattgagagaaaattttcacc

SEQ ID NO: 404142 - DNA, 46 bp, Artificial Sequence
  Description of Artificial Sequence: Synthetic oligonucleotide
ggcactcattcttcagcttttctataattgagagaaaattttcacc

SEQ ID NO: 404143 - DNA, 47 bp, Artificial Sequence
  Description of Artificial Sequence: Synthetic oligonucleotide
gcactcattcttcagcttttctataattgagagaaaattttcacctc

SEQ ID NO: 404144 - DNA, 51 bp, Artificial Sequence
  Description of Artificial Sequence: Synthetic oligonucleotide
cactcattcttcagcttttctataattgagagaaaattttcacctcaaatg

SEQ ID NO: 404145 - DNA, 53 bp, Artificial Sequence
  Description of Artificial Sequence: Synthetic oligonucleotide
actcattcttcagcttttctataattgagagaaaattttcacctcaaatgttc

SEQ ID NO: 404146 - DNA, 52 bp, Artificial Sequence
  Description of Artificial Sequence: Synthetic oligonucleotide
ctcattcttcagcttttctataattgagagaaaattttcacctcaaatgttc

SEQ ID NO: 404147 - DNA, 54 bp, Artificial Sequence
  Description of Artificial Sequence: Synthetic oligonucleotide
tcattcttcagcttttctataattgagagaaaattttcacctcaaatgttcatc

SEQ ID NO: 404148 - DNA, 53 bp, Artificial Sequence
  Description of Artificial Sequence: Synthetic oligonucleotide
cattcttcagcttttctataattgagagaaaattttcacctcaaatgttcatc

SEQ ID NO: 404149 - DNA, 53 bp, Artificial Sequence
  Description of Artificial Sequence: Synthetic oligonucleotide
attcttcagcttttctataattgagagaaaattttcacctcaaatgttcatcc

SEQ ID NO: 404150 - DNA, 52 bp, Artificial Sequence
  Description of Artificial Sequence: Synthetic oligonucleotide
ttcttcagcttttctataattgagagaaaattttcacctcaaatgttcatcc

SEQ ID NO: 404151 - DNA, 51 bp, Artificial Sequence
  Description of Artificial Sequence: Synthetic oligonucleotide
tcttcagcttttctataattgagagaaaattttcacctcaaatgttcatcc

SEQ ID NO: 404152 - DNA, 50 bp, Artificial Sequence
  Description of Artificial Sequence: Synthetic oligonucleotide
cttcagcttttctataattgagagaaaattttcacctcaaatgttcatcc

SEQ ID NO: 404153 - DNA, 51 bp, Artificial Sequence
  Description of Artificial Sequence: Synthetic oligonucleotide
ttcagcttttctataattgagagaaaattttcacctcaaatgttcatccag

SEQ ID NO: 404154 - DNA, 50 bp, Artificial Sequence
  Description of Artificial Sequence: Synthetic oligonucleotide
tcagcttttctataattgagagaaaattttcacctcaaatgttcatccag

SEQ ID NO: 404155 - DNA, 49 bp, Artificial Sequence
  Description of Artificial Sequence: Synthetic oligonucleotide
cagcttttctataattgagagaaaattttcacctcaaatgttcatccag

SEQ ID NO: 404156 - DNA, 50 bp, Artificial Sequence
  Description of Artificial Sequence: Synthetic oligonucleotide
agcttttctataattgagagaaaattttcacctcaaatgttcatccagtg

SEQ ID NO: 404157 - DNA, 49 bp, Artificial Sequence
  Description of Artificial Sequence: Synthetic oligonucleotide
gcttttctataattgagagaaaattttcacctcaaatgttcatccagtg

SEQ ID NO: 404158 - DNA, 49 bp, Artificial Sequence
  Description of Artificial Sequence: Synthetic oligonucleotide
cttttctataattgagagaaaattttcacctcaaatgttcatccagtgc

SEQ ID NO: 404159 - DNA, 54 bp, Artificial Sequence
  Description of Artificial Sequence: Synthetic oligonucleotide
ttttctataattgagagaaaattttcacctcaaatgttcatccagtgcaatttg

SEQ ID NO: 404160 - DNA, 53 bp, Artificial Sequence
  Description of Artificial Sequence: Synthetic oligonucleotide
tttctataattgagagaaaattttcacctcaaatgttcatccagtgcaatttg

SEQ ID NO: 404161 - DNA, 52 bp, Artificial Sequence
  Description of Artificial Sequence: Synthetic oligonucleotide
ttctataattgagagaaaattttcacctcaaatgttcatccagtgcaatttg

SEQ ID NO: 404162 - DNA, 51 bp, Artificial Sequence
  Description of Artificial Sequence: Synthetic oligonucleotide
tctataattgagagaaaattttcacctcaaatgttcatccagtgcaatttg

SEQ ID NO: 404163 - DNA, 50 bp, Artificial Sequence
  Description of Artificial Sequence: Synthetic oligonucleotide
ctataattgagagaaaattttcacctcaaatgttcatccagtgcaatttg

SEQ ID NO: 404164 - DNA, 52 bp, Artificial Sequence
  Description of Artificial Sequence: Synthetic oligonucleotide
tataattgagagaaaattttcacctcaaatgttcatccagtgcaatttgaag

SEQ ID NO: 404165 - DNA, 51 bp, Artificial Sequence
  Description of Artificial Sequence: Synthetic oligonucleotide
ataattgagagaaaattttcacctcaaatgttcatccagtgcaatttgaag

SEQ ID NO: 404166 - DNA, 50 bp, Artificial Sequence
  Description of Artificial Sequence: Synthetic oligonucleotide
taattgagagaaaattttcacctcaaatgttcatccagtgcaatttgaag

SEQ ID NO: 404167 - DNA, 49 bp, Artificial Sequence
  Description of Artificial Sequence: Synthetic oligonucleotide
aattgagagaaaattttcacctcaaatgttcatccagtgcaatttgaag

SEQ ID NO: 404168 - DNA, 48 bp, Artificial Sequence
  Description of Artificial Sequence: Synthetic oligonucleotide
attgagagaaaattttcacctcaaatgttcatccagtgcaatttgaag

SEQ ID NO: 404169 - DNA, 47 bp, Artificial Sequence
  Description of Artificial Sequence: Synthetic oligonucleotide
ttgagagaaaattttcacctcaaatgttcatccagtgcaatttgaag

SEQ ID NO: 404170 - DNA, 46 bp, Artificial Sequence
  Description of Artificial Sequence: Synthetic oligonucleotide
tgagagaaaattttcacctcaaatgttcatccagtgcaatttgaag

SEQ ID NO: 404171 - DNA, 45 bp, Artificial Sequence
  Description of Artificial Sequence: Synthetic oligonucleotide
gagagaaaattttcacctcaaatgttcatccagtgcaatttgaag

SEQ ID NO: 404172 - DNA, 46 bp, Artificial Sequence
  Description of Artificial Sequence: Synthetic oligonucleotide
agagaaaattttcacctcaaatgttcatccagtgcaatttgaagac

SEQ ID NO: 404173 - DNA, 45 bp, Artificial Sequence
  Description of Artificial Sequence: Synthetic oligonucleotide
gagaaaattttcacctcaaatgttcatccagtgcaatttgaagac

SEQ ID NO: 404174 - DNA, 47 bp, Artificial Sequence
  Description of Artificial Sequence: Synthetic oligonucleotide
agaaaattttcacctcaaatgttcatccagtgcaatttgaagacatc

SEQ ID NO: 404175 - DNA, 46 bp, Artificial Sequence
  Description of Artificial Sequence: Synthetic oligonucleotide
gaaaattttcacctcaaatgttcatccagtgcaatttgaagacatc

SEQ ID NO: 404176 - DNA, 47 bp, Artificial Sequence
  Description of Artificial Sequence: Synthetic oligonucleotide
aaaattttcacctcaaatgttcatccagtgcaatttgaagacatcac

SEQ ID NO: 404177 - DNA, 46 bp, Artificial Sequence
  Description of Artificial Sequence: Synthetic oligonucleotide
aaattttcacctcaaatgttcatccagtgcaatttgaagacatcac

SEQ ID NO: 404178 - DNA, 45 bp, Artificial Sequence
  Description of Artificial Sequence: Synthetic oligonucleotide
aattttcacctcaaatgttcatccagtgcaatttgaagacatcac

SEQ ID NO: 404179 - DNA, 44 bp, Artificial Sequence
  Description of Artificial Sequence: Synthetic oligonucleotide
attttcacctcaaatgttcatccagtgcaatttgaagacatcac

SEQ ID NO: 404180 - DNA, 43 bp, Artificial Sequence
  Description of Artificial Sequence: Synthetic oligonucleotide
ttttcacctcaaatgttcatccagtgcaatttgaagacatcac

SEQ ID NO: 404181 - DNA, 42 bp, Artificial Sequence
  Description of Artificial Sequence: Synthetic oligonucleotide
tttcacctcaaatgttcatccagtgcaatttgaagacatcac

SEQ ID NO: 404182 - DNA, 41 bp, Artificial Sequence
  Description of Artificial Sequence: Synthetic oligonucleotide
ttcacctcaaatgttcatccagtgcaatttgaagacatcac

SEQ ID NO: 404183 - DNA, 40 bp, Artificial Sequence
  Description of Artificial Sequence: Synthetic oligonucleotide
tcacctcaaatgttcatccagtgcaatttgaagacatcac

SEQ ID NO: 404184 - DNA, 39 bp, Artificial Sequence
  Description of Artificial Sequence: Synthetic oligonucleotide
cacctcaaatgttcatccagtgcaatttgaagacatcac

SEQ ID NO: 404185 - DNA, 40 bp, Artificial Sequence
  Description of Artificial Sequence: Synthetic oligonucleotide
acctcaaatgttcatccagtgcaatttgaagacatcacag

SEQ ID NO: 404186 - DNA, 39 bp, Artificial Sequence
  Description of Artificial Sequence: Synthetic oligonucleotide
cctcaaatgttcatccagtgcaatttgaagacatcacag

SEQ ID NO: 404187 - DNA, 40 bp, Artificial Sequence
  Description of Artificial Sequence: Synthetic oligonucleotide
ctcaaatgttcatccagtgcaatttgaagacatcacagtg

SEQ ID NO: 404188 - DNA, 40 bp, Artificial Sequence
  Description of Artificial Sequence: Synthetic oligonucleotide
tcaaatgttcatccagtgcaatttgaagacatcacagtgc

SEQ ID NO: 404189 - DNA, 39 bp, Artificial Sequence
  Description of Artificial Sequence: Synthetic oligonucleotide
caaatgttcatccagtgcaatttgaagacatcacagtgc

SEQ ID NO: 404190 - DNA, 39 bp, Artificial Sequence
  Description of Artificial Sequence: Synthetic oligonucleotide
aaatgttcatccagtgcaatttgaagacatcacagtgcc

SEQ ID NO: 404191 - DNA, 38 bp, Artificial Sequence
  Description of Artificial Sequence: Synthetic oligonucleotide
aatgttcatccagtgcaatttgaagacatcacagtgcc

SEQ ID NO: 404192 - DNA, 37 bp, Artificial Sequence
  Description of Artificial Sequence: Synthetic oligonucleotide
atgttcatccagtgcaatttgaagacatcacagtgcc

SEQ ID NO: 404193 - DNA, 36 bp, Artificial Sequence
  Description of Artificial Sequence: Synthetic oligonucleotide
tgttcatccagtgcaatttgaagacatcacagtgcc

SEQ ID NO: 404194 - DNA, 35 bp, Artificial Sequence
  Description of Artificial Sequence: Synthetic oligonucleotide
gttcatccagtgcaatttgaagacatcacagtgcc

SEQ ID NO: 404195 - DNA, 36 bp, Artificial Sequence
  Description of Artificial Sequence: Synthetic oligonucleotide
ttcatccagtgcaatttgaagacatcacagtgccag

SEQ ID NO: 404196 - DNA, 35 bp, Artificial Sequence
  Description of Artificial Sequence: Synthetic oligonucleotide
tcatccagtgcaatttgaagacatcacagtgccag

SEQ ID NO: 404197 - DNA, 34 bp, Artificial Sequence
  Description of Artificial Sequence: Synthetic oligonucleotide
catccagtgcaatttgaagacatcacagtgccag

SEQ ID NO: 404198 - DNA, 34 bp, Artificial Sequence
  Description of Artificial Sequence: Synthetic oligonucleotide
atccagtgcaatttgaagacatcacagtgccagg

SEQ ID NO: 404199 - DNA, 33 bp, Artificial Sequence
  Description of Artificial Sequence: Synthetic oligonucleotide
tccagtgcaatttgaagacatcacagtgccagg

SEQ ID NO: 404200 - DNA, 32 bp, Artificial Sequence
  Description of Artificial Sequence: Synthetic oligonucleotide
ccagtgcaatttgaagacatcacagtgccagg

SEQ ID NO: 404201 - DNA, 32 bp, Artificial Sequence
  Description of Artificial Sequence: Synthetic oligonucleotide
cagtgcaatttgaagacatcacagtgccaggc

SEQ ID NO: 404202 - DNA, 33 bp, Artificial Sequence
  Description of Artificial Sequence: Synthetic oligonucleotide
agtgcaatttgaagacatcacagtgccaggcac

SEQ ID NO: 404203 - DNA, 32 bp, Artificial Sequence
  Description of Artificial Sequence: Synthetic oligonucleotide
gtgcaatttgaagacatcacagtgccaggcac

SEQ ID NO: 404204 - DNA, 33 bp, Artificial Sequence
  Description of Artificial Sequence: Synthetic oligonucleotide
tgcaatttgaagacatcacagtgccaggcactg

SEQ ID NO: 404205 - DNA, 32 bp, Artificial Sequence
  Description of Artificial Sequence: Synthetic oligonucleotide
gcaatttgaagacatcacagtgccaggcactg

SEQ ID NO: 404206 - DNA, 32 bp, Artificial Sequence
  Description of Artificial Sequence: Synthetic oligonucleotide
caatttgaagacatcacagtgccaggcactgg

SEQ ID NO: 404207 - DNA, 33 bp, Artificial Sequence
  Description of Artificial Sequence: Synthetic oligonucleotide
aatttgaagacatcacagtgccaggcactggac

SEQ ID NO: 404208 - DNA, 32 bp, Artificial Sequence
  Description of Artificial Sequence: Synthetic oligonucleotide
atttgaagacatcacagtgccaggcactggac

SEQ ID NO: 404209 - DNA, 31 bp, Artificial Sequence
  Description of Artificial Sequence: Synthetic oligonucleotide
tttgaagacatcacagtgccaggcactggac

SEQ ID NO: 404210 - DNA, 30 bp, Artificial Sequence
  Description of Artificial Sequence: Synthetic oligonucleotide
ttgaagacatcacagtgccaggcactggac

SEQ ID NO: 404211 - DNA, 29 bp, Artificial Sequence
  Description of Artificial Sequence: Synthetic oligonucleotide
tgaagacatcacagtgccaggcactggac

SEQ ID NO: 404212 - DNA, 28 bp, Artificial Sequence
  Description of Artificial Sequence: Synthetic oligonucleotide
gaagacatcacagtgccaggcactggac

SEQ ID NO: 404213 - DNA, 29 bp, Artificial Sequence
  Description of Artificial Sequence: Synthetic oligonucleotide
aagacatcacagtgccaggcactggactg

SEQ ID NO: 404214 - DNA, 28 bp, Artificial Sequence
  Description of Artificial Sequence: Synthetic oligonucleotide
agacatcacagtgccaggcactggactg

SEQ ID NO: 404215 - DNA, 27 bp, Artificial Sequence
  Description of Artificial Sequence: Synthetic oligonucleotide
gacatcacagtgccaggcactggactg

SEQ ID NO: 404216 - DNA, 28 bp, Artificial Sequence
  Description of Artificial Sequence: Synthetic oligonucleotide
acatcacagtgccaggcactggactgag

SEQ ID NO: 404217 - DNA, 27 bp, Artificial Sequence
  Description of Artificial Sequence: Synthetic oligonucleotide
catcacagtgccaggcactggactgag

SEQ ID NO: 404218 - DNA, 29 bp, Artificial Sequence
  Description of Artificial Sequence: Synthetic oligonucleotide
atcacagtgccaggcactggactgagaac

SEQ ID NO: 404219 - DNA, 28 bp, Artificial Sequence
  Description of Artificial Sequence: Synthetic oligonucleotide
tcacagtgccaggcactggactgagaac

SEQ ID NO: 404220 - DNA, 27 bp, Artificial Sequence
  Description of Artificial Sequence: Synthetic oligonucleotide
cacagtgccaggcactggactgagaac

SEQ ID NO: 404221 - DNA, 27 bp, Artificial Sequence
  Description of Artificial Sequence: Synthetic oligonucleotide
acagtgccaggcactggactgagaacc

SEQ ID NO: 404222 - DNA, 27 bp, Artificial Sequence
  Description of Artificial Sequence: Synthetic oligonucleotide
cagtgccaggcactggactgagaacct

SEQ ID NO: 404223 - DNA, 28 bp, Artificial Sequence
  Description of Artificial Sequence: Synthetic oligonucleotide
agtgccaggcactggactgagaaccttc

SEQ ID NO: 404224 - DNA, 27 bp, Artificial Sequence
  Description of Artificial Sequence: Synthetic oligonucleotide
gtgccaggcactggactgagaaccttc

SEQ ID NO: 404225 - DNA, 28 bp, Artificial Sequence
  Description of Artificial Sequence: Synthetic oligonucleotide
tgccaggcactggactgagaaccttcac

SEQ ID NO: 404226 - DNA, 27 bp, Artificial Sequence
  Description of Artificial Sequence: Synthetic oligonucleotide
gccaggcactggactgagaaccttcac

SEQ ID NO: 404227 - DNA, 27 bp, Artificial Sequence
  Description of Artificial Sequence: Synthetic oligonucleotide
ccaggcactggactgagaaccttcacc

SEQ ID NO: 404228 - DNA, 35 bp, Artificial Sequence
  Description of Artificial Sequence: Synthetic oligonucleotide
caggcactggactgagaaccttcaccaaaaaaatg

SEQ ID NO: 404229 - DNA, 36 bp, Artificial Sequence
  Description of Artificial Sequence: Synthetic oligonucleotide
aggcactggactgagaaccttcaccaaaaaaatgtc

SEQ ID NO: 404230 - DNA, 35 bp, Artificial Sequence
  Description of Artificial Sequence: Synthetic oligonucleotide
ggcactggactgagaaccttcaccaaaaaaatgtc

SEQ ID NO: 404231 - DNA, 36 bp, Artificial Sequence
  Description of Artificial Sequence: Synthetic oligonucleotide
gcactggactgagaaccttcaccaaaaaaatgtctg

SEQ ID NO: 404232 - DNA, 36 bp, Artificial Sequence
  Description of Artificial Sequence: Synthetic oligonucleotide
cactggactgagaaccttcaccaaaaaaatgtctgc

SEQ ID NO: 404233 - DNA, 36 bp, Artificial Sequence
  Description of Artificial Sequence: Synthetic oligonucleotide
actggactgagaaccttcaccaaaaaaatgtctgcc

SEQ ID NO: 404234 - DNA, 35 bp, Artificial Sequence
  Description of Artificial Sequence: Synthetic oligonucleotide
ctggactgagaaccttcaccaaaaaaatgtctgcc

SEQ ID NO: 404235 - DNA, 35 bp, Artificial Sequence
  Description of Artificial Sequence: Synthetic oligonucleotide
tggactgagaaccttcaccaaaaaaatgtctgccc

SEQ ID NO: 404236 - DNA, 34 bp, Artificial Sequence
  Description of Artificial Sequence: Synthetic oligonucleotide
ggactgagaaccttcaccaaaaaaatgtctgccc

SEQ ID NO: 404237 - DNA, 35 bp, Artificial Sequence
  Description of Artificial Sequence: Synthetic oligonucleotide
gactgagaaccttcaccaaaaaaatgtctgcccag

SEQ ID NO: 404238 - DNA, 36 bp, Artificial Sequence
  Description of Artificial Sequence: Synthetic oligonucleotide
actgagaaccttcaccaaaaaaatgtctgcccagag

SEQ ID NO: 404239 - DNA, 35 bp, Artificial Sequence
  Description of Artificial Sequence: Synthetic oligonucleotide
ctgagaaccttcaccaaaaaaatgtctgcccagag

SEQ ID NO: 404240 - DNA, 36 bp, Artificial Sequence
  Description of Artificial Sequence: Synthetic oligonucleotide
tgagaaccttcaccaaaaaaatgtctgcccagagac

SEQ ID NO: 404241 - DNA, 35 bp, Artificial Sequence
  Description of Artificial Sequence: Synthetic oligonucleotide
gagaaccttcaccaaaaaaatgtctgcccagagac

SEQ ID NO: 404242 - DNA, 36 bp, Artificial Sequence
  Description of Artificial Sequence: Synthetic oligonucleotide
agaaccttcaccaaaaaaatgtctgcccagagacag

SEQ ID NO: 404243 - DNA, 35 bp, Artificial Sequence
  Description of Artificial Sequence: Synthetic oligonucleotide
gaaccttcaccaaaaaaatgtctgcccagagacag

SEQ ID NO: 404244 - DNA, 37 bp, Artificial Sequence
  Description of Artificial Sequence: Synthetic oligonucleotide
aaccttcaccaaaaaaatgtctgcccagagacagatg

SEQ ID NO: 404245 - DNA, 36 bp, Artificial Sequence
  Description of Artificial Sequence: Synthetic oligonucleotide
accttcaccaaaaaaatgtctgcccagagacagatg

SEQ ID NO: 404246 - DNA, 35 bp, Artificial Sequence
  Description of Artificial Sequence: Synthetic oligonucleotide
ccttcaccaaaaaaatgtctgcccagagacagatg

SEQ ID NO: 404247 - DNA, 36 bp, Artificial Sequence
  Description of Artificial Sequence: Synthetic oligonucleotide
cttcaccaaaaaaatgtctgcccagagacagatgag

SEQ ID NO: 404248 - DNA, 36 bp, Artificial Sequence
  Description of Artificial Sequence: Synthetic oligonucleotide
ttcaccaaaaaaatgtctgcccagagacagatgagg

SEQ ID NO: 404249 - DNA, 35 bp, Artificial Sequence
  Description of Artificial Sequence: Synthetic oligonucleotide
tcaccaaaaaaatgtctgcccagagacagatgagg

SEQ ID NO: 404250 - DNA, 34 bp, Artificial Sequence
  Description of Artificial Sequence: Synthetic oligonucleotide
caccaaaaaaatgtctgcccagagacagatgagg

SEQ ID NO: 404251 - DNA, 35 bp, Artificial Sequence
  Description of Artificial Sequence: Synthetic oligonucleotide
accaaaaaaatgtctgcccagagacagatgaggtc

SEQ ID NO: 404252 - DNA, 34 bp, Artificial Sequence
  Description of Artificial Sequence: Synthetic oligonucleotide
ccaaaaaaatgtctgcccagagacagatgaggtc

SEQ ID NO: 404253 - DNA, 34 bp, Artificial Sequence
  Description of Artificial Sequence: Synthetic oligonucleotide
caaaaaaatgtctgcccagagacagatgaggtcc

SEQ ID NO: 404254 - DNA, 35 bp, Artificial Sequence
  Description of Artificial Sequence: Synthetic oligonucleotide
cttcagctccagtgctgattggttcttttccaaag

SEQ ID NO: 404255 - DNA, 35 bp, Artificial Sequence
  Description of Artificial Sequence: Synthetic oligonucleotide
ttcagctccagtgctgattggttcttttccaaagg

SEQ ID NO: 404256 - DNA, 34 bp, Artificial Sequence
  Description of Artificial Sequence: Synthetic oligonucleotide
tcagctccagtgctgattggttcttttccaaagg

SEQ ID NO: 404257 - DNA, 33 bp, Artificial Sequence
  Description of Artificial Sequence: Synthetic oligonucleotide
cagctccagtgctgattggttcttttccaaagg

SEQ ID NO: 404258 - DNA, 33 bp, Artificial Sequence
  Description of Artificial Sequence: Synthetic oligonucleotide
agctccagtgctgattggttcttttccaaaggc

SEQ ID NO: 404259 - DNA, 32 bp, Artificial Sequence
  Description of Artificial Sequence: Synthetic oligonucleotide
gctccagtgctgattggttcttttccaaaggc

SEQ ID NO: 404260 - DNA, 32 bp, Artificial Sequence
  Description of Artificial Sequence: Synthetic oligonucleotide
ctccagtgctgattggttcttttccaaaggcc

SEQ ID NO: 404261 - DNA, 32 bp, Artificial Sequence
  Description of Artificial Sequence: Synthetic oligonucleotide
tccagtgctgattggttcttttccaaaggccc

SEQ ID NO: 404262 - DNA, 31 bp, Artificial Sequence
  Description of Artificial Sequence: Synthetic oligonucleotide
ccagtgctgattggttcttttccaaaggccc

SEQ ID NO: 404263 - DNA, 33 bp, Artificial Sequence
  Description of Artificial Sequence: Synthetic oligonucleotide
cagtgctgattggttcttttccaaaggcccatc

SEQ ID NO: 404264 - DNA, 37 bp, Artificial Sequence
  Description of Artificial Sequence: Synthetic oligonucleotide
agtgctgattggttcttttccaaaggcccatctaatc

SEQ ID NO: 404265 - DNA, 36 bp, Artificial Sequence
  Description of Artificial Sequence: Synthetic oligonucleotide
gtgctgattggttcttttccaaaggcccatctaatc

SEQ ID NO: 404266 - DNA, 36 bp, Artificial Sequence
  Description of Artificial Sequence: Synthetic oligonucleotide
tgctgattggttcttttccaaaggcccatctaatcc

SEQ ID NO: 404267 - DNA, 35 bp, Artificial Sequence
  Description of Artificial Sequence: Synthetic oligonucleotide
gctgattggttcttttccaaaggcccatctaatcc

SEQ ID NO: 404268 - DNA, 37 bp, Artificial Sequence
  Description of Artificial Sequence: Synthetic oligonucleotide
ctgattggttcttttccaaaggcccatctaatcctac

SEQ ID NO: 404269 - DNA, 37 bp, Artificial Sequence
  Description of Artificial Sequence: Synthetic oligonucleotide
tgattggttcttttccaaaggcccatctaatcctacc

SEQ ID NO: 404270 - DNA, 36 bp, Artificial Sequence
  Description of Artificial Sequence: Synthetic oligonucleotide
gattggttcttttccaaaggcccatctaatcctacc

SEQ ID NO: 404271 - DNA, 37 bp, Artificial Sequence
  Description of Artificial Sequence: Synthetic oligonucleotide
attggttcttttccaaaggcccatctaatcctaccac

SEQ ID NO: 404272 - DNA, 36 bp, Artificial Sequence
  Description of Artificial Sequence: Synthetic oligonucleotide
ttggttcttttccaaaggcccatctaatcctaccac

SEQ ID NO: 404273 - DNA, 35 bp, Artificial Sequence
  Description of Artificial Sequence: Synthetic oligonucleotide
tggttcttttccaaaggcccatctaatcctaccac

SEQ ID NO: 404274 - DNA, 34 bp, Artificial Sequence
  Description of Artificial Sequence: Synthetic oligonucleotide
ggttcttttccaaaggcccatctaatcctaccac

SEQ ID NO: 404275 - DNA, 34 bp, Artificial Sequence
  Description of Artificial Sequence: Synthetic oligonucleotide
gttcttttccaaaggcccatctaatcctaccacg

SEQ ID NO: 404276 - DNA, 34 bp, Artificial Sequence
  Description of Artificial Sequence: Synthetic oligonucleotide
ttcttttccaaaggcccatctaatcctaccacgc

SEQ ID NO: 404277 - DNA, 33 bp, Artificial Sequence
  Description of Artificial Sequence: Synthetic oligonucleotide
tcttttccaaaggcccatctaatcctaccacgc

SEQ ID NO: 404278 - DNA, 32 bp, Artificial Sequence
  Description of Artificial Sequence: Synthetic oligonucleotide
cttttccaaaggcccatctaatcctaccacgc

SEQ ID NO: 404279 - DNA, 33 bp, Artificial Sequence
  Description of Artificial Sequence: Synthetic oligonucleotide
ttttccaaaggcccatctaatcctaccacgcac

SEQ ID NO: 404280 - DNA, 32 bp, Artificial Sequence
  Description of Artificial Sequence: Synthetic oligonucleotide
tttccaaaggcccatctaatcctaccacgcac

SEQ ID NO: 404281 - DNA, 31 bp, Artificial Sequence
  Description of Artificial Sequence: Synthetic oligonucleotide
ttccaaaggcccatctaatcctaccacgcac

SEQ ID NO: 404282 - DNA, 30 bp, Artificial Sequence
  Description of Artificial Sequence: Synthetic oligonucleotide
tccaaaggcccatctaatcctaccacgcac

SEQ ID NO: 404283 - DNA, 29 bp, Artificial Sequence
  Description of Artificial Sequence: Synthetic oligonucleotide
ccaaaggcccatctaatcctaccacgcac

SEQ ID NO: 404284 - DNA, 29 bp, Artificial Sequence
  Description of Artificial Sequence: Synthetic oligonucleotide
caaaggcccatctaatcctaccacgcacg

SEQ ID NO: 404285 - DNA, 29 bp, Artificial Sequence
  Description of Artificial Sequence: Synthetic oligonucleotide
aaaggcccatctaatcctaccacgcacgg

SEQ ID NO: 404286 - DNA, 28 bp, Artificial Sequence
  Description of Artificial Sequence: Synthetic oligonucleotide
aaggcccatctaatcctaccacgcacgg

SEQ ID NO: 404287 - DNA, 27 bp, Artificial Sequence
  Description of Artificial Sequence: Synthetic oligonucleotide
aggcccatctaatcctaccacgcacgg

SEQ ID NO: 404288 - DNA, 27 bp, Artificial Sequence
  Description of Artificial Sequence: Synthetic oligonucleotide
ggcccatctaatcctaccacgcacgga

SEQ ID NO: 404289 - DNA, 32 bp, Artificial Sequence
  Description of Artificial Sequence: Synthetic oligonucleotide
gcccatctaatcctaccacgcacggaaatatc

SEQ ID NO: 404290 - DNA, 32 bp, Artificial Sequence
  Description of Artificial Sequence: Synthetic oligonucleotide
cccatctaatcctaccacgcacggaaatatcc

SEQ ID NO: 404291 - DNA, 33 bp, Artificial Sequence
  Description of Artificial Sequence: Synthetic oligonucleotide
ccatctaatcctaccacgcacggaaatatccac

SEQ ID NO: 404292 - DNA, 34 bp, Artificial Sequence
  Description of Artificial Sequence: Synthetic oligonucleotide
catctaatcctaccacgcacggaaatatccacag

SEQ ID NO: 404293 - DNA, 34 bp, Artificial Sequence
  Description of Artificial Sequence: Synthetic oligonucleotide
atctaatcctaccacgcacggaaatatccacagg

SEQ ID NO: 404294 - DNA, 33 bp, Artificial Sequence
  Description of Artificial Sequence: Synthetic oligonucleotide
tctaatcctaccacgcacggaaatatccacagg

SEQ ID NO: 404295 - DNA, 32 bp, Artificial Sequence
  Description of Artificial Sequence: Synthetic oligonucleotide
ctaatcctaccacgcacggaaatatccacagg

SEQ ID NO: 404296 - DNA, 40 bp, Artificial Sequence
  Description of Artificial Sequence: Synthetic oligonucleotide
taatcctaccacgcacggaaatatccacaggtttttattc

SEQ ID NO: 404297 - DNA, 39 bp, Artificial Sequence
  Description of Artificial Sequence: Synthetic oligonucleotide
aatcctaccacgcacggaaatatccacaggtttttattc

SEQ ID NO: 404298 - DNA, 38 bp, Artificial Sequence
  Description of Artificial Sequence: Synthetic oligonucleotide
atcctaccacgcacggaaatatccacaggtttttattc

SEQ ID NO: 404299 - DNA, 37 bp, Artificial Sequence
  Description of Artificial Sequence: Synthetic oligonucleotide
tcctaccacgcacggaaatatccacaggtttttattc

SEQ ID NO: 404300 - DNA, 36 bp, Artificial Sequence
  Description of Artificial Sequence: Synthetic oligonucleotide
cctaccacgcacggaaatatccacaggtttttattc

SEQ ID NO: 404301 - DNA, 39 bp, Artificial Sequence
  Description of Artificial Sequence: Synthetic oligonucleotide
ctaccacgcacggaaatatccacaggtttttattctttc

SEQ ID NO: 404302 - DNA, 40 bp, Artificial Sequence
  Description of Artificial Sequence: Synthetic oligonucleotide
taccacgcacggaaatatccacaggtttttattctttctg

SEQ ID NO: 404303 - DNA, 39 bp, Artificial Sequence
  Description of Artificial Sequence: Synthetic oligonucleotide
accacgcacggaaatatccacaggtttttattctttctg

SEQ ID NO: 404304 - DNA, 38 bp, Artificial Sequence
  Description of Artificial Sequence: Synthetic oligonucleotide
ccacgcacggaaatatccacaggtttttattctttctg

SEQ ID NO: 404305 - DNA, 38 bp, Artificial Sequence
  Description of Artificial Sequence: Synthetic oligonucleotide
cacgcacggaaatatccacaggtttttattctttctgc

SEQ ID NO: 404306 - DNA, 38 bp, Artificial Sequence
  Description of Artificial Sequence: Synthetic oligonucleotide
acgcacggaaatatccacaggtttttattctttctgcc

SEQ ID NO: 404307 - DNA, 37 bp, Artificial Sequence
  Description of Artificial Sequence: Synthetic oligonucleotide
cgcacggaaatatccacaggtttttattctttctgcc

SEQ ID NO: 404308 - DNA, 38 bp, Artificial Sequence
  Description of Artificial Sequence: Synthetic oligonucleotide
gcacggaaatatccacaggtttttattctttctgccag

SEQ ID NO: 404309 - DNA, 38 bp, Artificial Sequence
  Description of Artificial Sequence: Synthetic oligonucleotide
cacggaaatatccacaggtttttattctttctgccagc

SEQ ID NO: 404310 - DNA, 40 bp, Artificial Sequence
  Description of Artificial Sequence: Synthetic oligonucleotide
acggaaatatccacaggtttttattctttctgccagctac

SEQ ID NO: 404311 - DNA, 39 bp, Artificial Sequence
  Description of Artificial Sequence: Synthetic oligonucleotide
cggaaatatccacaggtttttattctttctgccagctac

SEQ ID NO: 404312 - DNA, 41 bp, Artificial Sequence
  Description of Artificial Sequence: Synthetic oligonucleotide
ggaaatatccacaggtttttattctttctgccagctacatc

SEQ ID NO: 404313 - DNA, 42 bp, Artificial Sequence
  Description of Artificial Sequence: Synthetic oligonucleotide
gaaatatccacaggtttttattctttctgccagctacatcag

SEQ ID NO: 404314 - DNA, 44 bp, Artificial Sequence
  Description of Artificial Sequence: Synthetic oligonucleotide
aaatatccacaggtttttattctttctgccagctacatcagatc

SEQ ID NO: 404315 - DNA, 43 bp, Artificial Sequence
  Description of Artificial Sequence: Synthetic oligonucleotide
aatatccacaggtttttattctttctgccagctacatcagatc

SEQ ID NO: 404316 - DNA, 42 bp, Artificial Sequence
  Description of Artificial Sequence: Synthetic oligonucleotide
atatccacaggtttttattctttctgccagctacatcagatc

SEQ ID NO: 404317 - DNA, 41 bp, Artificial Sequence
  Description of Artificial Sequence: Synthetic oligonucleotide
tatccacaggtttttattctttctgccagctacatcagatc

SEQ ID NO: 404318 - DNA, 40 bp, Artificial Sequence
  Description of Artificial Sequence: Synthetic oligonucleotide
atccacaggtttttattctttctgccagctacatcagatc

SEQ ID NO: 404319 - DNA, 39 bp, Artificial Sequence
  Description of Artificial Sequence: Synthetic oligonucleotide
tccacaggtttttattctttctgccagctacatcagatc

SEQ ID NO: 404320 - DNA, 38 bp, Artificial Sequence
  Description of Artificial Sequence: Synthetic oligonucleotide
ccacaggtttttattctttctgccagctacatcagatc

SEQ ID NO: 404321 - DNA, 38 bp, Artificial Sequence
  Description of Artificial Sequence: Synthetic oligonucleotide
cacaggtttttattctttctgccagctacatcagatcc

SEQ ID NO: 404322 - DNA, 40 bp, Artificial Sequence
  Description of Artificial Sequence: Synthetic oligonucleotide
acaggtttttattctttctgccagctacatcagatccatc

SEQ ID NO: 404323 - DNA, 39 bp, Artificial Sequence
  Description of Artificial Sequence: Synthetic oligonucleotide
caggtttttattctttctgccagctacatcagatccatc

SEQ ID NO: 404324 - DNA, 40 bp, Artificial Sequence
  Description of Artificial Sequence: Synthetic oligonucleotide
aggtttttattctttctgccagctacatcagatccatcag

SEQ ID NO: 404325 - DNA, 39 bp, Artificial Sequence
  Description of Artificial Sequence: Synthetic oligonucleotide
ggtttttattctttctgccagctacatcagatccatcag

SEQ ID NO: 404326 - DNA, 39 bp, Artificial Sequence
  Description of Artificial Sequence: Synthetic oligonucleotide
gtttttattctttctgccagctacatcagatccatcagg

SEQ ID NO: 404327 - DNA, 40 bp, Artificial Sequence
  Description of Artificial Sequence: Synthetic oligonucleotide
tttttattctttctgccagctacatcagatccatcaggtc

SEQ ID NO: 404328 - DNA, 39 bp, Artificial Sequence
  Description of Artificial Sequence: Synthetic oligonucleotide
ttttattctttctgccagctacatcagatccatcaggtc

SEQ ID NO: 404329 - DNA, 38 bp, Artificial Sequence
  Description of Artificial Sequence: Synthetic oligonucleotide
tttattctttctgccagctacatcagatccatcaggtc

SEQ ID NO: 404330 - DNA, 37 bp, Artificial Sequence
  Description of Artificial Sequence: Synthetic oligonucleotide
ttattctttctgccagctacatcagatccatcaggtc

SEQ ID NO: 404331 - DNA, 36 bp, Artificial Sequence
  Description of Artificial Sequence: Synthetic oligonucleotide
tattctttctgccagctacatcagatccatcaggtc

SEQ ID NO: 404332 - DNA, 35 bp, Artificial Sequence
  Description of Artificial Sequence: Synthetic oligonucleotide
attctttctgccagctacatcagatccatcaggtc

SEQ ID NO: 404333 - DNA, 34 bp, Artificial Sequence
  Description of Artificial Sequence: Synthetic oligonucleotide
ttctttctgccagctacatcagatccatcaggtc

SEQ ID NO: 404334 - DNA, 33 bp, Artificial Sequence
  Description of Artificial Sequence: Synthetic oligonucleotide
tctttctgccagctacatcagatccatcaggtc

SEQ ID NO: 404335 - DNA, 32 bp, Artificial Sequence
  Description of Artificial Sequence: Synthetic oligonucleotide
ctttctgccagctacatcagatccatcaggtc

SEQ ID NO: 404336 - DNA, 32 bp, Artificial Sequence
  Description of Artificial Sequence: Synthetic oligonucleotide
tttctgccagctacatcagatccatcaggtcc

SEQ ID NO: 404337 - DNA, 31 bp, Artificial Sequence
  Description of Artificial Sequence: Synthetic oligonucleotide
ttctgccagctacatcagatccatcaggtcc

SEQ ID NO: 404338 - DNA, 30 bp, Artificial Sequence
  Description of Artificial Sequence: Synthetic oligonucleotide
tctgccagctacatcagatccatcaggtcc

SEQ ID NO: 404339 - DNA, 29 bp, Artificial Sequence
  Description of Artificial Sequence: Synthetic oligonucleotide
ctgccagctacatcagatccatcaggtcc

SEQ ID NO: 404340 - DNA, 29 bp, Artificial Sequence
  Description of Artificial Sequence: Synthetic oligonucleotide
tgccagctacatcagatccatcaggtccg

SEQ ID NO: 404341 - DNA, 28 bp, Artificial Sequence
  Description of Artificial Sequence: Synthetic oligonucleotide
gccagctacatcagatccatcaggtccg

SEQ ID NO: 404342 - DNA, 29 bp, Artificial Sequence
  Description of Artificial Sequence: Synthetic oligonucleotide
ccagctacatcagatccatcaggtccgag

SEQ ID NO: 404343 - DNA, 29 bp, Artificial Sequence
  Description of Artificial Sequence: Synthetic oligonucleotide
cagctacatcagatccatcaggtccgagc

SEQ ID NO: 404344 - DNA, 30 bp, Artificial Sequence
  Description of Artificial Sequence: Synthetic oligonucleotide
agctacatcagatccatcaggtccgagctg

SEQ ID NO: 404345 - DNA, 29 bp, Artificial Sequence
  Description of Artificial Sequence: Synthetic oligonucleotide
gctacatcagatccatcaggtccgagctg

SEQ ID NO: 404346 - DNA, 30 bp, Artificial Sequence
  Description of Artificial Sequence: Synthetic oligonucleotide
ctacatcagatccatcaggtccgagctgtg

SEQ ID NO: 404347 - DNA, 34 bp, Artificial Sequence
  Description of Artificial Sequence: Synthetic oligonucleotide
cgagctgtgttgactaccactacttttccctttg

SEQ ID NO: 404348 - DNA, 35 bp, Artificial Sequence
  Description of Artificial Sequence: Synthetic oligonucleotide
gagctgtgttgactaccactacttttccctttgtc

SEQ ID NO: 404349 - DNA, 36 bp, Artificial Sequence
  Description of Artificial Sequence: Synthetic oligonucleotide
agctgtgttgactaccactacttttccctttgtctc

SEQ ID NO: 404350 - DNA, 35 bp, Artificial Sequence
  Description of Artificial Sequence: Synthetic oligonucleotide
gctgtgttgactaccactacttttccctttgtctc

SEQ ID NO: 404351 - DNA, 41 bp, Artificial Sequence
  Description of Artificial Sequence: Synthetic oligonucleotide
ctgtgttgactaccactacttttccctttgtctcaattatg

SEQ ID NO: 404352 - DNA, 42 bp, Artificial Sequence
  Description of Artificial Sequence: Synthetic oligonucleotide
tgtgttgactaccactacttttccctttgtctcaattatgtc

SEQ ID NO: 404353 - DNA, 41 bp, Artificial Sequence
  Description of Artificial Sequence: Synthetic oligonucleotide
gtgttgactaccactacttttccctttgtctcaattatgtc

SEQ ID NO: 404354 - DNA, 43 bp, Artificial Sequence
  Description of Artificial Sequence: Synthetic oligonucleotide
tgttgactaccactacttttccctttgtctcaattatgtcttg

SEQ ID NO: 404355 - DNA, 42 bp, Artificial Sequence
  Description of Artificial Sequence: Synthetic oligonucleotide
gttgactaccactacttttccctttgtctcaattatgtcttg

SEQ ID NO: 404356 - DNA, 42 bp, Artificial Sequence
  Description of Artificial Sequence: Synthetic oligonucleotide
ttgactaccactacttttccctttgtctcaattatgtcttgg

SEQ ID NO: 404357 - DNA, 41 bp, Artificial Sequence
  Description of Artificial Sequence: Synthetic oligonucleotide
tgactaccactacttttccctttgtctcaattatgtcttgg

SEQ ID NO: 404358 - DNA, 40 bp, Artificial Sequence
  Description of Artificial Sequence: Synthetic oligonucleotide
gactaccactacttttccctttgtctcaattatgtcttgg

SEQ ID NO: 404359 - DNA, 42 bp, Artificial Sequence
  Description of Artificial Sequence: Synthetic oligonucleotide
actaccactacttttccctttgtctcaattatgtcttggaag

SEQ ID NO: 404360 - DNA, 41 bp, Artificial Sequence
  Description of Artificial Sequence: Synthetic oligonucleotide
ctaccactacttttccctttgtctcaattatgtcttggaag

SEQ ID NO: 404361 - DNA, 43 bp, Artificial Sequence
  Description of Artificial Sequence: Synthetic oligonucleotide
taccactacttttccctttgtctcaattatgtcttggaagaag

SEQ ID NO: 404362 - DNA, 42 bp, Artificial Sequence
  Description of Artificial Sequence: Synthetic oligonucleotide
accactacttttccctttgtctcaattatgtcttggaagaag

SEQ ID NO: 404363 - DNA, 41 bp, Artificial Sequence
  Description of Artificial Sequence: Synthetic oligonucleotide
ccactacttttccctttgtctcaattatgtcttggaagaag

SEQ ID NO: 404364 - DNA, 41 bp, Artificial Sequence
  Description of Artificial Sequence: Synthetic oligonucleotide
cactacttttccctttgtctcaattatgtcttggaagaagg

SEQ ID NO: 404365 - DNA, 41 bp, Artificial Sequence
  Description of Artificial Sequence: Synthetic oligonucleotide
actacttttccctttgtctcaattatgtcttggaagaaggc

SEQ ID NO: 404366 - DNA, 40 bp, Artificial Sequence
  Description of Artificial Sequence: Synthetic oligonucleotide
ctacttttccctttgtctcaattatgtcttggaagaaggc

SEQ ID NO: 404367 - DNA, 43 bp, Artificial Sequence
  Description of Artificial Sequence: Synthetic oligonucleotide
tacttttccctttgtctcaattatgtcttggaagaaggctttg

SEQ ID NO: 404368 - DNA, 42 bp, Artificial Sequence
  Description of Artificial Sequence: Synthetic oligonucleotide
acttttccctttgtctcaattatgtcttggaagaaggctttg

SEQ ID NO: 404369 - DNA, 41 bp, Artificial Sequence
  Description of Artificial Sequence: Synthetic oligonucleotide
cttttccctttgtctcaattatgtcttggaagaaggctttg

SEQ ID NO: 404370 - DNA, 41 bp, Artificial Sequence
  Description of Artificial Sequence: Synthetic oligonucleotide
ttttccctttgtctcaattatgtcttggaagaaggctttgc

SEQ ID NO: 404371 - DNA, 40 bp, Artificial Sequence
  Description of Artificial Sequence: Synthetic oligonucleotide
tttccctttgtctcaattatgtcttggaagaaggctttgc

SEQ ID NO: 404372 - DNA, 39 bp, Artificial Sequence
  Description of Artificial Sequence: Synthetic oligonucleotide
ttccctttgtctcaattatgtcttggaagaaggctttgc

SEQ ID NO: 404373 - DNA, 38 bp, Artificial Sequence
  Description of Artificial Sequence: Synthetic oligonucleotide
tccctttgtctcaattatgtcttggaagaaggctttgc

SEQ ID NO: 404374 - DNA, 37 bp, Artificial Sequence
  Description of Artificial Sequence: Synthetic oligonucleotide
ccctttgtctcaattatgtcttggaagaaggctttgc

SEQ ID NO: 404375 - DNA, 37 bp, Artificial Sequence
  Description of Artificial Sequence: Synthetic oligonucleotide
cctttgtctcaattatgtcttggaagaaggctttgcg

SEQ ID NO: 404376 - DNA, 37 bp, Artificial Sequence
  Description of Artificial Sequence: Synthetic oligonucleotide
ctttgtctcaattatgtcttggaagaaggctttgcgg

SEQ ID NO: 404377 - DNA, 39 bp, Artificial Sequence
  Description of Artificial Sequence: Synthetic oligonucleotide
tttgtctcaattatgtcttggaagaaggctttgcggatc

SEQ ID NO: 404378 - DNA, 38 bp, Artificial Sequence
  Description of Artificial Sequence: Synthetic oligonucleotide
ttgtctcaattatgtcttggaagaaggctttgcggatc

SEQ ID NO: 404379 - DNA, 37 bp, Artificial Sequence
  Description of Artificial Sequence: Synthetic oligonucleotide
tgtctcaattatgtcttggaagaaggctttgcggatc

SEQ ID NO: 404380 - DNA, 34 bp, Artificial Sequence
  Description of Artificial Sequence: Synthetic oligonucleotide
aattatgtcttggaagaaggctttgcggatcccc

SEQ ID NO: 404381 - DNA, 33 bp, Artificial Sequence
  Description of Artificial Sequence: Synthetic oligonucleotide
attatgtcttggaagaaggctttgcggatcccc

SEQ ID NO: 404382 - DNA, 32 bp, Artificial Sequence
  Description of Artificial Sequence: Synthetic oligonucleotide
ttatgtcttggaagaaggctttgcggatcccc

SEQ ID NO: 404383 - DNA, 31 bp, Artificial Sequence
  Description of Artificial Sequence: Synthetic oligonucleotide
tatgtcttggaagaaggctttgcggatcccc

SEQ ID NO: 404384 - DNA, 30 bp, Artificial Sequence; identical to SEQ ID NO: 61442
  Description of Artificial Sequence: Synthetic oligonucleotide

SEQ ID NO: 404385 - DNA, 29 bp, Artificial Sequence
  Description of Artificial Sequence: Synthetic oligonucleotide
tgtcttggaagaaggctttgcggatcccc

SEQ ID NO: 404386 - DNA, 28 bp, Artificial Sequence
  Description of Artificial Sequence: Synthetic oligonucleotide
gtcttggaagaaggctttgcggatcccc

SEQ ID NO: 404387 - DNA, 28 bp, Artificial Sequence
  Description of Artificial Sequence: Synthetic oligonucleotide
tcttggaagaaggctttgcggatccccg

SEQ ID NO: 404388 - DNA, 27 bp, Artificial Sequence
  Description of Artificial Sequence: Synthetic oligonucleotide
cttggaagaaggctttgcggatccccg

SEQ ID NO: 404389 - DNA, 27 bp, Artificial Sequence
  Description of Artificial Sequence: Synthetic oligonucleotide
ttggaagaaggctttgcggatccccgg

SEQ ID NO: 404390 - DNA, 27 bp, Artificial Sequence
  Description of Artificial Sequence: Synthetic oligonucleotide
tggaagaaggctttgcggatccccgga

SEQ ID NO: 404391 - DNA, 26 bp, Artificial Sequence
  Description of Artificial Sequence: Synthetic oligonucleotide
ggaagaaggctttgcggatccccgga

SEQ ID NO: 404392 - DNA, 26 bp, Artificial Sequence
  Description of Artificial Sequence: Synthetic oligonucleotide
gaagaaggctttgcggatccccggag

SEQ ID NO: 404393 - DNA, 26 bp, Artificial Sequence
  Description of Artificial Sequence: Synthetic oligonucleotide
aagaaggctttgcggatccccggagg

SEQ ID NO: 404394 - DNA, 25 bp, Artificial Sequence
  Description of Artificial Sequence: Synthetic oligonucleotide
agaaggctttgcggatccccggagg

SEQ ID NO: 404395 - DNA, 24 bp, Artificial Sequence
  Description of Artificial Sequence: Synthetic oligonucleotide
gaaggctttgcggatccccggagg

SEQ ID NO: 404396 - DNA, 22 bp, Artificial Sequence
  Description of Artificial Sequence: Synthetic oligonucleotide
atccccggaggccttcgggcac

SEQ ID NO: 404397 - DNA, 21 bp, Artificial Sequence
  Description of Artificial Sequence: Synthetic oligonucleotide
tccccggaggccttcgggcac

SEQ ID NO: 404398 - DNA, 20 bp, Artificial Sequence
  Description of Artificial Sequence: Synthetic oligonucleotide
ccccggaggccttcgggcac

SEQ ID NO: 404399 - DNA, 22 bp, Artificial Sequence
  Description of Artificial Sequence: Synthetic oligonucleotide
cccggaggccttcgggcaccaa

SEQ ID NO: 404400 - DNA, 23 bp, Artificial Sequence
  Description of Artificial Sequence: Synthetic oligonucleotide
ccggaggccttcgggcaccaact

SEQ ID NO: 404401 - DNA, 24 bp, Artificial Sequence
  Description of Artificial Sequence: Synthetic oligonucleotide
cggaggccttcgggcaccaactgt

SEQ ID NO: 404402 - DNA, 25 bp, Artificial Sequence
  Description of Artificial Sequence: Synthetic oligonucleotide
ggaggccttcgggcaccaactgtga

SEQ ID NO: 404403 - DNA, 25 bp, Artificial Sequence
  Description of Artificial Sequence: Synthetic oligonucleotide
gaggccttcgggcaccaactgtgac

SEQ ID NO: 404404 - DNA, 27 bp, Artificial Sequence
  Description of Artificial Sequence: Synthetic oligonucleotide
aggccttcgggcaccaactgtgacctt

SEQ ID NO: 404405 - DNA, 26 bp, Artificial Sequence
  Description of Artificial Sequence: Synthetic oligonucleotide
ggccttcgggcaccaactgtgacctt

SEQ ID NO: 404406 - DNA, 27 bp, Artificial Sequence
  Description of Artificial Sequence: Synthetic oligonucleotide
gccttcgggcaccaactgtgaccttga

SEQ ID NO: 404407 - DNA, 28 bp, Artificial Sequence
  Description of Artificial Sequence: Synthetic oligonucleotide
ccttcgggcaccaactgtgaccttgatg

SEQ ID NO: 404408 - DNA, 28 bp, Artificial Sequence
  Description of Artificial Sequence: Synthetic oligonucleotide
cttcgggcaccaactgtgaccttgatgc

SEQ ID NO: 404409 - DNA, 29 bp, Artificial Sequence
  Description of Artificial Sequence: Synthetic oligonucleotide
ttcgggcaccaactgtgaccttgatgctg

SEQ ID NO: 404410 - DNA, 28 bp, Artificial Sequence
  Description of Artificial Sequence: Synthetic oligonucleotide
tcgggcaccaactgtgaccttgatgctg

SEQ ID NO: 404411 - DNA, 27 bp, Artificial Sequence
  Description of Artificial Sequence: Synthetic oligonucleotide
cgggcaccaactgtgaccttgatgctg

SEQ ID NO: 404412 - DNA, 27 bp, Artificial Sequence
  Description of Artificial Sequence: Synthetic oligonucleotide
gggcaccaactgtgaccttgatgctgg

SEQ ID NO: 404413 - DNA, 27 bp, Artificial Sequence
  Description of Artificial Sequence: Synthetic oligonucleotide
ggcaccaactgtgaccttgatgctggc

SEQ ID NO: 404414 - DNA, 27 bp, Artificial Sequence
  Description of Artificial Sequence: Synthetic oligonucleotide
gcaccaactgtgaccttgatgctggcg

SEQ ID NO: 404415 - DNA, 29 bp, Artificial Sequence
  Description of Artificial Sequence: Synthetic oligonucleotide
caccaactgtgaccttgatgctggcgatg

SEQ ID NO: 404416 - DNA, 29 bp, Artificial Sequence
  Description of Artificial Sequence: Synthetic oligonucleotide
accaactgtgaccttgatgctggcgatgc

SEQ ID NO: 404417 - DNA, 28 bp, Artificial Sequence
  Description of Artificial Sequence: Synthetic oligonucleotide
ccaactgtgaccttgatgctggcgatgc

SEQ ID NO: 404418 - DNA, 24 bp, Artificial Sequence
  Description of Artificial Sequence: Synthetic oligonucleotide
accccagtggctgagggcagagac

SEQ ID NO: 404419 - DNA, 23 bp, Artificial Sequence
  Description of Artificial Sequence: Synthetic oligonucleotide
ccccagtggctgagggcagagac

SEQ ID NO: 404420 - DNA, 23 bp, Artificial Sequence
  Description of Artificial Sequence: Synthetic oligonucleotide
cccagtggctgagggcagagacc

SEQ ID NO: 404421 - DNA, 24 bp, Artificial Sequence
  Description of Artificial Sequence: Synthetic oligonucleotide
ccagtggctgagggcagagaccct

SEQ ID NO: 404422 - DNA, 24 bp, Artificial Sequence
  Description of Artificial Sequence: Synthetic oligonucleotide
cagtggctgagggcagagaccctc

SEQ ID NO: 404423 - DNA, 24 bp, Artificial Sequence
  Description of Artificial Sequence: Synthetic oligonucleotide
agtggctgagggcagagaccctcc

SEQ ID NO: 404424 - DNA, 23 bp, Artificial Sequence
  Description of Artificial Sequence: Synthetic oligonucleotide
gtggctgagggcagagaccctcc

SEQ ID NO: 404425 - DNA, 23 bp, Artificial Sequence
  Description of Artificial Sequence: Synthetic oligonucleotide
tggctgagggcagagaccctccc

SEQ ID NO: 404426 - DNA, 22 bp, Artificial Sequence
  Description of Artificial Sequence: Synthetic oligonucleotide
ggctgagggcagagaccctccc

SEQ ID NO: 404427 - DNA, 23 bp, Artificial Sequence
  Description of Artificial Sequence: Synthetic oligonucleotide
gctgagggcagagaccctcccga

SEQ ID NO: 404428 - DNA, 23 bp, Artificial Sequence
  Description of Artificial Sequence: Synthetic oligonucleotide
ctgagggcagagaccctcccgag

SEQ ID NO: 404429 - DNA, 27 bp, Artificial Sequence
  Description of Artificial Sequence: Synthetic oligonucleotide
tgagggcagagaccctcccgaggattt

SEQ ID NO: 404430 - DNA, 26 bp, Artificial Sequence
  Description of Artificial Sequence: Synthetic oligonucleotide
gagggcagagaccctcccgaggattt

SEQ ID NO: 404431 - DNA, 26 bp, Artificial Sequence
  Description of Artificial Sequence: Synthetic oligonucleotide
agggcagagaccctcccgaggatttc

SEQ ID NO: 404432 - DNA, 25 bp, Artificial Sequence
  Description of Artificial Sequence: Synthetic oligonucleotide
gggcagagaccctcccgaggatttc

SEQ ID NO: 404433 - DNA, 26 bp, Artificial Sequence
  Description of Artificial Sequence: Synthetic oligonucleotide
ggcagagaccctcccgaggatttcgt

SEQ ID NO: 404434 - DNA, 26 bp, Artificial Sequence
  Description of Artificial Sequence: Synthetic oligonucleotide
gcagagaccctcccgaggatttcgtg

SEQ ID NO: 404435 - DNA, 27 bp, Artificial Sequence
  Description of Artificial Sequence: Synthetic oligonucleotide
cagagaccctcccgaggatttcgtgct

SEQ ID NO: 404436 - DNA, 27 bp, Artificial Sequence
  Description of Artificial Sequence: Synthetic oligonucleotide
agagaccctcccgaggatttcgtgctc

SEQ ID NO: 404437 - DNA, 26 bp, Artificial Sequence
  Description of Artificial Sequence: Synthetic oligonucleotide
gagaccctcccgaggatttcgtgctc

SEQ ID NO: 404438 - DNA, 27 bp, Artificial Sequence
  Description of Artificial Sequence: Synthetic oligonucleotide
agaccctcccgaggatttcgtgctcca

SEQ ID NO: 404439 - DNA, 26 bp, Artificial Sequence
  Description of Artificial Sequence: Synthetic oligonucleotide
gaccctcccgaggatttcgtgctcca

SEQ ID NO: 404440 - DNA, 27 bp, Artificial Sequence
  Description of Artificial Sequence: Synthetic oligonucleotide
accctcccgaggatttcgtgctccagt

SEQ ID NO: 404441 - DNA, 27 bp, Artificial Sequence
  Description of Artificial Sequence: Synthetic oligonucleotide
ccctcccgaggatttcgtgctccagtt

SEQ ID NO: 404442 - DNA, 30 bp, Artificial Sequence; identical to SEQ ID NO: 61090
  Description of Artificial Sequence: Synthetic oligonucleotide

SEQ ID NO: 404443 - DNA, 30 bp, Artificial Sequence; identical to SEQ ID NO: 61091
  Description of Artificial Sequence: Synthetic oligonucleotide

SEQ ID NO: 404444 - DNA, 30 bp, Artificial Sequence; identical to SEQ ID NO: 61092
  Description of Artificial Sequence: Synthetic oligonucleotide

SEQ ID NO: 404445 - DNA, 29 bp, Artificial Sequence
  Description of Artificial Sequence: Synthetic oligonucleotide
cccgaggatttcgtgctccagtttaaggc

SEQ ID NO: 404446 - DNA, 29 bp, Artificial Sequence
  Description of Artificial Sequence: Synthetic oligonucleotide
ccgaggatttcgtgctccagtttaaggcc

SEQ ID NO: 404447 - DNA, 31 bp, Artificial Sequence; identical to SEQ ID NO: 61095
  Description of Artificial Sequence: Synthetic oligonucleotide

SEQ ID NO: 404448 - DNA, 32 bp, Artificial Sequence; identical to SEQ ID NO: 61096
  Description of Artificial Sequence: Synthetic oligonucleotide

SEQ ID NO: 404449 - DNA, 32 bp, Artificial Sequence; identical to SEQ ID NO: 61097
  Description of Artificial Sequence: Synthetic oligonucleotide

SEQ ID NO: 404450 - DNA, 31 bp, Artificial Sequence; identical to SEQ ID NO: 61098
  Description of Artificial Sequence: Synthetic oligonucleotide

SEQ ID NO: 404451 - DNA, 33 bp, Artificial Sequence; identical to SEQ ID NO: 61099
  Description of Artificial Sequence: Synthetic oligonucleotide

SEQ ID NO: 404452 - DNA, 35 bp, Artificial Sequence; identical to SEQ ID NO: 61100
  Description of Artificial Sequence: Synthetic oligonucleotide

SEQ ID NO: 404453 - DNA, 34 bp, Artificial Sequence; identical to SEQ ID NO: 61101
  Description of Artificial Sequence: Synthetic oligonucleotide

SEQ ID NO: 404454 - DNA, 33 bp, Artificial Sequence; identical to SEQ ID NO: 61102
  Description of Artificial Sequence: Synthetic oligonucleotide

SEQ ID NO: 404455 - DNA, 32 bp, Artificial Sequence; identical to SEQ ID NO: 61103
  Description of Artificial Sequence: Synthetic oligonucleotide

SEQ ID NO: 404456 - DNA, 31 bp, Artificial Sequence; identical to SEQ ID NO: 61104
  Description of Artificial Sequence: Synthetic oligonucleotide

SEQ ID NO: 404457 - DNA, 32 bp, Artificial Sequence; identical to SEQ ID NO: 61105
  Description of Artificial Sequence: Synthetic oligonucleotide

SEQ ID NO: 404458 - DNA, 32 bp, Artificial Sequence; identical to SEQ ID NO: 61106
  Description of Artificial Sequence: Synthetic oligonucleotide

SEQ ID NO: 404459 - DNA, 31 bp, Artificial Sequence; identical to SEQ ID NO: 61107
  Description of Artificial Sequence: Synthetic oligonucleotide

SEQ ID NO: 404460 - DNA, 34 bp, Artificial Sequence; identical to SEQ ID NO: 61108
  Description of Artificial Sequence: Synthetic oligonucleotide

SEQ ID NO: 404461 - DNA, 34 bp, Artificial Sequence; identical to SEQ ID NO: 61109
  Description of Artificial Sequence: Synthetic oligonucleotide

SEQ ID NO: 404462 - DNA, 33 bp, Artificial Sequence; identical to SEQ ID NO: 61110
  Description of Artificial Sequence: Synthetic oligonucleotide

SEQ ID NO: 404463 - DNA, 33 bp, Artificial Sequence; identical to SEQ ID NO: 61111
  Description of Artificial Sequence: Synthetic oligonucleotide

SEQ ID NO: 404464 - DNA, 34 bp, Artificial Sequence; identical to SEQ ID NO: 61112
  Description of Artificial Sequence: Synthetic oligonucleotide

SEQ ID NO: 404465 - DNA, 33 bp, Artificial Sequence; identical to SEQ ID NO: 61113
  Description of Artificial Sequence: Synthetic oligonucleotide

SEQ ID NO: 404466 - DNA, 33 bp, Artificial Sequence; identical to SEQ ID NO: 61114
  Description of Artificial Sequence: Synthetic oligonucleotide

SEQ ID NO: 404467 - DNA, 32 bp, Artificial Sequence; identical to SEQ ID NO: 61115
  Description of Artificial Sequence: Synthetic oligonucleotide

SEQ ID NO: 404468 - DNA, 31 bp, Artificial Sequence; identical to SEQ ID NO: 61116
  Description of Artificial Sequence: Synthetic oligonucleotide

SEQ ID NO: 404469 - DNA, 30 bp, Artificial Sequence; identical to SEQ ID NO: 61117
  Description of Artificial Sequence: Synthetic oligonucleotide

SEQ ID NO: 404470 - DNA, 29 bp, Artificial Sequence
  Description of Artificial Sequence: Synthetic oligonucleotide
aggccatgtgctacttcaccaatgggacg

SEQ ID NO: 404471 - DNA, 28 bp, Artificial Sequence
  Description of Artificial Sequence: Synthetic oligonucleotide
ggccatgtgctacttcaccaatgggacg

SEQ ID NO: 404472 - DNA, 28 bp, Artificial Sequence
  Description of Artificial Sequence: Synthetic oligonucleotide
gccatgtgctacttcaccaatgggacgg

SEQ ID NO: 404473 - DNA, 29 bp, Artificial Sequence
  Description of Artificial Sequence: Synthetic oligonucleotide
ccatgtgctacttcaccaatgggacggag

SEQ ID NO: 404474 - DNA, 29 bp, Artificial Sequence
  Description of Artificial Sequence: Synthetic oligonucleotide
catgtgctacttcaccaatgggacggagc

SEQ ID NO: 404475 - DNA, 29 bp, Artificial Sequence
  Description of Artificial Sequence: Synthetic oligonucleotide
atgtgctacttcaccaatgggacggagcg

SEQ ID NO: 404476 - DNA, 28 bp, Artificial Sequence
  Description of Artificial Sequence: Synthetic oligonucleotide
tgtgctacttcaccaatgggacggagcg

SEQ ID NO: 404477 - DNA, 27 bp, Artificial Sequence
  Description of Artificial Sequence: Synthetic oligonucleotide
gtgctacttcaccaatgggacggagcg

SEQ ID NO: 404478 - DNA, 27 bp, Artificial Sequence
  Description of Artificial Sequence: Synthetic oligonucleotide
tgctacttcaccaatgggacggagcgc

SEQ ID NO: 404479 - DNA, 26 bp, Artificial Sequence
  Description of Artificial Sequence: Synthetic oligonucleotide
gctacttcaccaatgggacggagcgc

SEQ ID NO: 404480 - DNA, 27 bp, Artificial Sequence
  Description of Artificial Sequence: Synthetic oligonucleotide
ctacttcaccaatgggacggagcgcgt

SEQ ID NO: 404481 - DNA, 27 bp, Artificial Sequence
  Description of Artificial Sequence: Synthetic oligonucleotide
tacttcaccaatgggacggagcgcgtg

SEQ ID NO: 404482 - DNA, 26 bp, Artificial Sequence
  Description of Artificial Sequence: Synthetic oligonucleotide
acttcaccaatgggacggagcgcgtg

SEQ ID NO: 404483 - DNA, 25 bp, Artificial Sequence
  Description of Artificial Sequence: Synthetic oligonucleotide
cttcaccaatgggacggagcgcgtg

SEQ ID NO: 404484 - DNA, 25 bp, Artificial Sequence
  Description of Artificial Sequence: Synthetic oligonucleotide
ttcaccaatgggacggagcgcgtgc

SEQ ID NO: 404485 - DNA, 24 bp, Artificial Sequence
  Description of Artificial Sequence: Synthetic oligonucleotide
tcaccaatgggacggagcgcgtgc

SEQ ID NO: 404486 - DNA, 23 bp, Artificial Sequence
  Description of Artificial Sequence: Synthetic oligonucleotide
caccaatgggacggagcgcgtgc

SEQ ID NO: 404487 - DNA, 27 bp, Artificial Sequence
  Description of Artificial Sequence: Synthetic oligonucleotide
accaatgggacggagcgcgtgcgttat

SEQ ID NO: 404488 - DNA, 26 bp, Artificial Sequence
  Description of Artificial Sequence: Synthetic oligonucleotide
ccaatgggacggagcgcgtgcgttat

SEQ ID NO: 404489 - DNA, 27 bp, Artificial Sequence
  Description of Artificial Sequence: Synthetic oligonucleotide
caatgggacggagcgcgtgcgttatgt

SEQ ID NO: 404490 - DNA, 27 bp, Artificial Sequence
  Description of Artificial Sequence: Synthetic oligonucleotide
aatgggacggagcgcgtgcgttatgtg

SEQ ID NO: 404491 - DNA, 27 bp, Artificial Sequence
  Description of Artificial Sequence: Synthetic oligonucleotide
atgggacggagcgcgtgcgttatgtga

SEQ ID NO: 404492 - DNA, 26 bp, Artificial Sequence
  Description of Artificial Sequence: Synthetic oligonucleotide
tgggacggagcgcgtgcgttatgtga

SEQ ID NO: 404493 - DNA, 36 bp, Artificial Sequence; identical to SEQ ID NO: 61141
  Description of Artificial Sequence: Synthetic oligonucleotide

SEQ ID NO: 404494 - DNA, 37 bp, Artificial Sequence; identical to SEQ ID NO: 61142
  Description of Artificial Sequence: Synthetic oligonucleotide

SEQ ID NO: 404495 - DNA, 36 bp, Artificial Sequence; identical to SEQ ID NO: 61143
  Description of Artificial Sequence: Synthetic oligonucleotide

SEQ ID NO: 404496 - DNA, 35 bp, Artificial Sequence; identical to SEQ ID NO: 61144
  Description of Artificial Sequence: Synthetic oligonucleotide

SEQ ID NO: 404497 - DNA, 34 bp, Artificial Sequence; identical to SEQ ID NO: 61145
  Description of Artificial Sequence: Synthetic oligonucleotide

SEQ ID NO: 404498 - DNA, 33 bp, Artificial Sequence; identical to SEQ ID NO: 61146
  Description of Artificial Sequence: Synthetic oligonucleotide

SEQ ID NO: 404499 - DNA, 33 bp, Artificial Sequence; identical to SEQ ID NO: 61147
  Description of Artificial Sequence: Synthetic oligonucleotide

SEQ ID NO: 404500 - DNA, 32 bp, Artificial Sequence; identical to SEQ ID NO: 61148
  Description of Artificial Sequence: Synthetic oligonucleotide

SEQ ID NO: 404501 - DNA, 33 bp, Artificial Sequence; identical to SEQ ID NO: 61149
  Description of Artificial Sequence: Synthetic oligonucleotide

SEQ ID NO: 404502 - DNA, 32 bp, Artificial Sequence; identical to SEQ ID NO: 61150
  Description of Artificial Sequence: Synthetic oligonucleotide

SEQ ID NO: 404503 - DNA, 32 bp, Artificial Sequence; identical to SEQ ID NO: 61151
  Description of Artificial Sequence: Synthetic oligonucleotide

SEQ ID NO: 404504 - DNA, 32 bp, Artificial Sequence; identical to SEQ ID NO: 61152
  Description of Artificial Sequence: Synthetic oligonucleotide

SEQ ID NO: 404505 - DNA, 31 bp, Artificial Sequence; identical to SEQ ID NO: 61153
  Description of Artificial Sequence: Synthetic oligonucleotide

SEQ ID NO: 404506 - DNA, 31 bp, Artificial Sequence; identical to SEQ ID NO: 61154
  Description of Artificial Sequence: Synthetic oligonucleotide

SEQ ID NO: 404507 - DNA, 30 bp, Artificial Sequence; identical to SEQ ID NO: 61155
  Description of Artificial Sequence: Synthetic oligonucleotide

SEQ ID NO: 404508 - DNA, 29 bp, Artificial Sequence
  Description of Artificial Sequence: Synthetic oligonucleotide
aacagccagaaggacatcctggagaggac

SEQ ID NO: 404509 - DNA, 28 bp, Artificial Sequence
  Description of Artificial Sequence: Synthetic oligonucleotide
acagccagaaggacatcctggagaggac

SEQ ID NO: 404510 - DNA, 27 bp, Artificial Sequence
  Description of Artificial Sequence: Synthetic oligonucleotide
cagccagaaggacatcctggagaggac

SEQ ID NO: 404511 - DNA, 27 bp, Artificial Sequence
  Description of Artificial Sequence: Synthetic oligonucleotide
agccagaaggacatcctggagaggacc

SEQ ID NO: 404512 - DNA, 26 bp, Artificial Sequence
  Description of Artificial Sequence: Synthetic oligonucleotide
gccagaaggacatcctggagaggacc

SEQ ID NO: 404513 - DNA, 26 bp, Artificial Sequence
  Description of Artificial Sequence: Synthetic oligonucleotide
ccagaaggacatcctggagaggaccc

SEQ ID NO: 404514 - DNA, 27 bp, Artificial Sequence
  Description of Artificial Sequence: Synthetic oligonucleotide
cagaaggacatcctggagaggacccga

SEQ ID NO: 404515 - DNA, 27 bp, Artificial Sequence
  Description of Artificial Sequence: Synthetic oligonucleotide
agaaggacatcctggagaggacccgag

SEQ ID NO: 404516 - DNA, 26 bp, Artificial Sequence
  Description of Artificial Sequence: Synthetic oligonucleotide
gaaggacatcctggagaggacccgag

SEQ ID NO: 404517 - DNA, 26 bp, Artificial Sequence
  Description of Artificial Sequence: Synthetic oligonucleotide
aaggacatcctggagaggacccgagc

SEQ ID NO: 404518 - DNA, 25 bp, Artificial Sequence
  Description of Artificial Sequence: Synthetic oligonucleotide
aggacatcctggagaggacccgagc

SEQ ID NO: 404519 - DNA, 24 bp, Artificial Sequence
  Description of Artificial Sequence: Synthetic oligonucleotide
ggacatcctggagaggacccgagc

SEQ ID NO: 404520 - DNA, 24 bp, Artificial Sequence
  Description of Artificial Sequence: Synthetic oligonucleotide
gacatcctggagaggacccgagcg

SEQ ID NO: 404521 - DNA, 25 bp, Artificial Sequence
  Description of Artificial Sequence: Synthetic oligonucleotide
acatcctggagaggacccgagcgga

SEQ ID NO: 404522 - DNA, 24 bp, Artificial Sequence
  Description of Artificial Sequence: Synthetic oligonucleotide
catcctggagaggacccgagcgga

SEQ ID NO: 404523 - DNA, 26 bp, Artificial Sequence
  Description of Artificial Sequence: Synthetic oligonucleotide
atcctggagaggacccgagcggagtt

SEQ ID NO: 404524 - DNA, 25 bp, Artificial Sequence
  Description of Artificial Sequence: Synthetic oligonucleotide
tcctggagaggacccgagcggagtt

SEQ ID NO: 404525 - DNA, 24 bp, Artificial Sequence
  Description of Artificial Sequence: Synthetic oligonucleotide
cctggagaggacccgagcggagtt

SEQ ID NO: 404526 - DNA, 24 bp, Artificial Sequence
  Description of Artificial Sequence: Synthetic oligonucleotide
ctggagaggacccgagcggagttg

SEQ ID NO: 404527 - DNA, 25 bp, Artificial Sequence
  Description of Artificial Sequence: Synthetic oligonucleotide
tggagaggacccgagcggagttgga

SEQ ID NO: 404528 - DNA, 24 bp, Artificial Sequence
  Description of Artificial Sequence: Synthetic oligonucleotide
ggagaggacccgagcggagttgga

SEQ ID NO: 404529 - DNA, 25 bp, Artificial Sequence
  Description of Artificial Sequence: Synthetic oligonucleotide
gagaggacccgagcggagttggaca

SEQ ID NO: 404530 - DNA, 25 bp, Artificial Sequence
  Description of Artificial Sequence: Synthetic oligonucleotide
agaggacccgagcggagttggacac

SEQ ID NO: 404531 - DNA, 24 bp, Artificial Sequence
  Description of Artificial Sequence: Synthetic oligonucleotide
gaggacccgagcggagttggacac

SEQ ID NO: 404532 - DNA, 24 bp, Artificial Sequence
  Description of Artificial Sequence: Synthetic oligonucleotide
aggacccgagcggagttggacacg

SEQ ID NO: 404533 - DNA, 23 bp, Artificial Sequence
  Description of Artificial Sequence: Synthetic oligonucleotide
ggacccgagcggagttggacacg

SEQ ID NO: 404534 - DNA, 24 bp, Artificial Sequence
  Description of Artificial Sequence: Synthetic oligonucleotide
gacccgagcggagttggacacggt

SEQ ID NO: 404535 - DNA, 25 bp, Artificial Sequence
  Description of Artificial Sequence: Synthetic oligonucleotide
acccgagcggagttggacacggtgt

SEQ ID NO: 404536 - DNA, 24 bp, Artificial Sequence
  Description of Artificial Sequence: Synthetic oligonucleotide
cccgagcggagttggacacggtgt

SEQ ID NO: 404537 - DNA, 24 bp, Artificial Sequence
  Description of Artificial Sequence: Synthetic oligonucleotide
ccgagcggagttggacacggtgtg

SEQ ID NO: 404538 - DNA, 25 bp, Artificial Sequence
  Description of Artificial Sequence: Synthetic oligonucleotide
cgagcggagttggacacggtgtgca

SEQ ID NO: 404539 - DNA, 26 bp, Artificial Sequence
  Description of Artificial Sequence: Synthetic oligonucleotide
gagcggagttggacacggtgtgcaga

SEQ ID NO: 404540 - DNA, 27 bp, Artificial Sequence
  Description of Artificial Sequence: Synthetic oligonucleotide
agcggagttggacacggtgtgcagaca

SEQ ID NO: 404541 - DNA, 30 bp, Artificial Sequence; identical to SEQ ID NO: 61210
  Description of Artificial Sequence: Synthetic oligonucleotide

SEQ ID NO: 404542 - DNA, 29 bp, Artificial Sequence
  Description of Artificial Sequence: Synthetic oligonucleotide
gttggacacggtgtgcagacacaactacg

SEQ ID NO: 404543 - DNA, 30 bp, Artificial Sequence; identical to SEQ ID NO: 61212
  Description of Artificial Sequence: Synthetic oligonucleotide

SEQ ID NO: 404544 - DNA, 29 bp, Artificial Sequence
  Description of Artificial Sequence: Synthetic oligonucleotide
tggacacggtgtgcagacacaactacgag

SEQ ID NO: 404545 - DNA, 28 bp, Artificial Sequence
  Description of Artificial Sequence: Synthetic oligonucleotide
ggacacggtgtgcagacacaactacgag

SEQ ID NO: 404546 - DNA, 28 bp, Artificial Sequence
  Description of Artificial Sequence: Synthetic oligonucleotide
gacacggtgtgcagacacaactacgagg

SEQ ID NO: 404547 - DNA, 29 bp, Artificial Sequence
  Description of Artificial Sequence: Synthetic oligonucleotide
acacggtgtgcagacacaactacgaggtg

SEQ ID NO: 404548 - DNA, 28 bp, Artificial Sequence
  Description of Artificial Sequence: Synthetic oligonucleotide
cacggtgtgcagacacaactacgaggtg

SEQ ID NO: 404549 - DNA, 28 bp, Artificial Sequence
  Description of Artificial Sequence: Synthetic oligonucleotide
acggtgtgcagacacaactacgaggtgg

SEQ ID NO: 404550 - DNA, 27 bp, Artificial Sequence
  Description of Artificial Sequence: Synthetic oligonucleotide
cggtgtgcagacacaactacgaggtgg

SEQ ID NO: 404551 - DNA, 29 bp, Artificial Sequence
  Description of Artificial Sequence: Synthetic oligonucleotide
tgtgcagacacaactacgaggtggcgttc

SEQ ID NO: 404552 - DNA, 28 bp, Artificial Sequence
  Description of Artificial Sequence: Synthetic oligonucleotide
gtgcagacacaactacgaggtggcgttc

SEQ ID NO: 404553 - DNA, 28 bp, Artificial Sequence
  Description of Artificial Sequence: Synthetic oligonucleotide
tgcagacacaactacgaggtggcgttcc

SEQ ID NO: 404554 - DNA, 27 bp, Artificial Sequence
  Description of Artificial Sequence: Synthetic oligonucleotide
gcagacacaactacgaggtggcgttcc

SEQ ID NO: 404555 - DNA, 27 bp, Artificial Sequence
  Description of Artificial Sequence: Synthetic oligonucleotide
cagacacaactacgaggtggcgttccg

SEQ ID NO: 404556 - DNA, 27 bp, Artificial Sequence
  Description of Artificial Sequence: Synthetic oligonucleotide
agacacaactacgaggtggcgttccgc

SEQ ID NO: 404557 - DNA, 26 bp, Artificial Sequence
  Description of Artificial Sequence: Synthetic oligonucleotide
gacacaactacgaggtggcgttccgc

SEQ ID NO: 404558 - DNA, 26 bp, Artificial Sequence
  Description of Artificial Sequence: Synthetic oligonucleotide
acacaactacgaggtggcgttccgcg

SEQ ID NO: 404559 - DNA, 25 bp, Artificial Sequence
  Description of Artificial Sequence: Synthetic oligonucleotide
cacaactacgaggtggcgttccgcg

SEQ ID NO: 404560 - DNA, 25 bp, Artificial Sequence
  Description of Artificial Sequence: Synthetic oligonucleotide
acaactacgaggtggcgttccgcgg

SEQ ID NO: 404561 - DNA, 24 bp, Artificial Sequence
  Description of Artificial Sequence: Synthetic oligonucleotide
caactacgaggtggcgttccgcgg

SEQ ID NO: 404562 - DNA, 26 bp, Artificial Sequence
  Description of Artificial Sequence: Synthetic oligonucleotide
aactacgaggtggcgttccgcgggat

SEQ ID NO: 404563 - DNA, 25 bp, Artificial Sequence
  Description of Artificial Sequence: Synthetic oligonucleotide
actacgaggtggcgttccgcgggat

SEQ ID NO: 404564 - DNA, 24 bp, Artificial Sequence
  Description of Artificial Sequence: Synthetic oligonucleotide
ctacgaggtggcgttccgcgggat

SEQ ID NO: 404565 - DNA, 26 bp, Artificial Sequence
  Description of Artificial Sequence: Synthetic oligonucleotide
tacgaggtggcgttccgcgggatctt

SEQ ID NO: 404566 - DNA, 25 bp, Artificial Sequence
  Description of Artificial Sequence: Synthetic oligonucleotide
acgaggtggcgttccgcgggatctt

SEQ ID NO: 404567 - DNA, 24 bp, Artificial Sequence
  Description of Artificial Sequence: Synthetic oligonucleotide
cgaggtggcgttccgcgggatctt

SEQ ID NO: 404568 - DNA, 24 bp, Artificial Sequence
  Description of Artificial Sequence: Synthetic oligonucleotide
gaggtggcgttccgcgggatcttg

SEQ ID NO: 404569 - DNA, 25 bp, Artificial Sequence
  Description of Artificial Sequence: Synthetic oligonucleotide
aggtggcgttccgcgggatcttgca

SEQ ID NO: 404570 - DNA, 24 bp, Artificial Sequence
  Description of Artificial Sequence: Synthetic oligonucleotide
ggtggcgttccgcgggatcttgca

SEQ ID NO: 404571 - DNA, 25 bp, Artificial Sequence
  Description of Artificial Sequence: Synthetic oligonucleotide
gtggcgttccgcgggatcttgcaga

SEQ ID NO: 404572 - DNA, 25 bp, Artificial Sequence
  Description of Artificial Sequence: Synthetic oligonucleotide
tggcgttccgcgggatcttgcagag

SEQ ID NO: 404573 - DNA, 24 bp, Artificial Sequence
  Description of Artificial Sequence: Synthetic oligonucleotide
ggcgttccgcgggatcttgcagag

SEQ ID NO: 404574 - DNA, 25 bp, Artificial Sequence
  Description of Artificial Sequence: Synthetic oligonucleotide
gcgttccgcgggatcttgcagagga

SEQ ID NO: 404575 - DNA, 26 bp, Artificial Sequence
  Description of Artificial Sequence: Synthetic oligonucleotide
cgttccgcgggatcttgcagaggaga

SEQ ID NO: 404576 - DNA, 27 bp, Artificial Sequence
  Description of Artificial Sequence: Synthetic oligonucleotide
gttccgcgggatcttgcagaggagagt

SEQ ID NO: 404577 - DNA, 27 bp, Artificial Sequence
  Description of Artificial Sequence: Synthetic oligonucleotide
ttccgcgggatcttgcagaggagagtg

SEQ ID NO: 404578 - DNA, 26 bp, Artificial Sequence
  Description of Artificial Sequence: Synthetic oligonucleotide
tccgcgggatcttgcagaggagagtg

SEQ ID NO: 404579 - DNA, 25 bp, Artificial Sequence
  Description of Artificial Sequence: Synthetic oligonucleotide
ccgcgggatcttgcagaggagagtg

SEQ ID NO: 404580 - DNA, 26 bp, Artificial Sequence
  Description of Artificial Sequence: Synthetic oligonucleotide
cgcgggatcttgcagaggagagtgga

SEQ ID NO: 404581 - DNA, 26 bp, Artificial Sequence
  Description of Artificial Sequence: Synthetic oligonucleotide
gcgggatcttgcagaggagagtggag

SEQ ID NO: 404582 - DNA, 26 bp, Artificial Sequence
  Description of Artificial Sequence: Synthetic oligonucleotide
cgggatcttgcagaggagagtggagc

SEQ ID NO: 404583 - DNA, 26 bp, Artificial Sequence
  Description of Artificial Sequence: Synthetic oligonucleotide
gggatcttgcagaggagagtggagcc

SEQ ID NO: 404584 - DNA, 27 bp, Artificial Sequence
  Description of Artificial Sequence: Synthetic oligonucleotide
ggatcttgcagaggagagtggagccca

SEQ ID NO: 404585 - DNA, 27 bp, Artificial Sequence
  Description of Artificial Sequence: Synthetic oligonucleotide
gatcttgcagaggagagtggagcccac

SEQ ID NO: 404586 - DNA, 28 bp, Artificial Sequence
  Description of Artificial Sequence: Synthetic oligonucleotide
atcttgcagaggagagtggagcccacag

SEQ ID NO: 404587 - DNA, 27 bp, Artificial Sequence
  Description of Artificial Sequence: Synthetic oligonucleotide
tcttgcagaggagagtggagcccacag

SEQ ID NO: 404588 - DNA, 27 bp, Artificial Sequence
  Description of Artificial Sequence: Synthetic oligonucleotide
cttgcagaggagagtggagcccacagt

SEQ ID NO: 404589 - DNA, 27 bp, Artificial Sequence
  Description of Artificial Sequence: Synthetic oligonucleotide
ttgcagaggagagtggagcccacagtg

SEQ ID NO: 404590 - DNA, 31 bp, Artificial Sequence; identical to SEQ ID NO: 61259
  Description of Artificial Sequence: Synthetic oligonucleotide

SEQ ID NO: 404591 - DNA, 30 bp, Artificial Sequence; identical to SEQ ID NO: 61260
  Description of Artificial Sequence: Synthetic oligonucleotide

SEQ ID NO: 404592 - DNA, 30 bp, Artificial Sequence; identical to SEQ ID NO: 61261
  Description of Artificial Sequence: Synthetic oligonucleotide

SEQ ID NO: 404593 - DNA, 30 bp, Artificial Sequence; identical to SEQ ID NO: 61262
  Description of Artificial Sequence: Synthetic oligonucleotide

SEQ ID NO: 404594 - DNA, 29 bp, Artificial Sequence
  Description of Artificial Sequence: Synthetic oligonucleotide
ctgctcggtgacagatttctatccaggcc

SEQ ID NO: 404595 - DNA, 30 bp, Artificial Sequence; identical to SEQ ID NO: 61264
  Description of Artificial Sequence: Synthetic oligonucleotide

SEQ ID NO: 404596 - DNA, 29 bp, Artificial Sequence
  Description of Artificial Sequence: Synthetic oligonucleotide
gctcggtgacagatttctatccaggccag

SEQ ID NO: 404597 - DNA, 31 bp, Artificial Sequence; identical to SEQ ID NO: 61266
  Description of Artificial Sequence: Synthetic oligonucleotide

SEQ ID NO: 404598 - DNA, 34 bp, Artificial Sequence; identical to SEQ ID NO: 61267
  Description of Artificial Sequence: Synthetic oligonucleotide

SEQ ID NO: 404599 - DNA, 33 bp, Artificial Sequence; identical to SEQ ID NO: 61268
  Description of Artificial Sequence: Synthetic oligonucleotide

SEQ ID NO: 404600 - DNA, 34 bp, Artificial Sequence; identical to SEQ ID NO: 61269
  Description of Artificial Sequence: Synthetic oligonucleotide

SEQ ID NO: 404601 - DNA, 34 bp, Artificial Sequence; identical to SEQ ID NO: 61270
  Description of Artificial Sequence: Synthetic oligonucleotide

SEQ ID NO: 404602 - DNA, 34 bp, Artificial Sequence; identical to SEQ ID NO: 61271
  Description of Artificial Sequence: Synthetic oligonucleotide

SEQ ID NO: 404603 - DNA, 33 bp, Artificial Sequence; identical to SEQ ID NO: 61272
  Description of Artificial Sequence: Synthetic oligonucleotide

SEQ ID NO: 404604 - DNA, 33 bp, Artificial Sequence; identical to SEQ ID NO: 61273
  Description of Artificial Sequence: Synthetic oligonucleotide

SEQ ID NO: 404605 - DNA, 32 bp, Artificial Sequence; identical to SEQ ID NO: 61274
  Description of Artificial Sequence: Synthetic oligonucleotide

SEQ ID NO: 404606 - DNA, 33 bp, Artificial Sequence; identical to SEQ ID NO: 61275
  Description of Artificial Sequence: Synthetic oligonucleotide

SEQ ID NO: 404607 - DNA, 32 bp, Artificial Sequence; identical to SEQ ID NO: 61276
  Description of Artificial Sequence: Synthetic oligonucleotide

SEQ ID NO: 404608 - DNA, 32 bp, Artificial Sequence; identical to SEQ ID NO: 61277
  Description of Artificial Sequence: Synthetic oligonucleotide

SEQ ID NO: 404609 - DNA, 31 bp, Artificial Sequence; identical to SEQ ID NO: 61278
  Description of Artificial Sequence: Synthetic oligonucleotide

SEQ ID NO: 404610 - DNA, 30 bp, Artificial Sequence; identical to SEQ ID NO: 61279
  Description of Artificial Sequence: Synthetic oligonucleotide

SEQ ID NO: 404611 - DNA, 29 bp, Artificial Sequence
  Description of Artificial Sequence: Synthetic oligonucleotide
tctatccaggccagatcaaagtccggtgg

SEQ ID NO: 404612 - DNA, 28 bp, Artificial Sequence
  Description of Artificial Sequence: Synthetic oligonucleotide
ctatccaggccagatcaaagtccggtgg

SEQ ID NO: 404613 - DNA, 31 bp, Artificial Sequence; identical to SEQ ID NO: 61282
  Description of Artificial Sequence: Synthetic oligonucleotide

SEQ ID NO: 404614 - DNA, 30 bp, Artificial Sequence; identical to SEQ ID NO: 61283
  Description of Artificial Sequence: Synthetic oligonucleotide

SEQ ID NO: 404615 - DNA, 29 bp, Artificial Sequence
  Description of Artificial Sequence: Synthetic oligonucleotide
tccaggccagatcaaagtccggtggtttc

SEQ ID NO: 404616 - DNA, 28 bp, Artificial Sequence
  Description of Artificial Sequence: Synthetic oligonucleotide
ccaggccagatcaaagtccggtggtttc

SEQ ID NO: 404617 - DNA, 28 bp, Artificial Sequence
  Description of Artificial Sequence: Synthetic oligonucleotide
caggccagatcaaagtccggtggtttcg

SEQ ID NO: 404618 - DNA, 28 bp, Artificial Sequence
  Description of Artificial Sequence: Synthetic oligonucleotide
aggccagatcaaagtccggtggtttcgg

SEQ ID NO: 404619 - DNA, 27 bp, Artificial Sequence
  Description of Artificial Sequence: Synthetic oligonucleotide
ggccagatcaaagtccggtggtttcgg

SEQ ID NO: 404620 - DNA, 27 bp, Artificial Sequence
  Description of Artificial Sequence: Synthetic oligonucleotide
gcgggctcagtctgaatctgcccagaa

SEQ ID NO: 404621 - DNA, 27 bp, Artificial Sequence
  Description of Artificial Sequence: Synthetic oligonucleotide
cgggctcagtctgaatctgcccagaac

SEQ ID NO: 404622 - DNA, 29 bp, Artificial Sequence
  Description of Artificial Sequence: Synthetic oligonucleotide
gggctcagtctgaatctgcccagaacaag

SEQ ID NO: 404623 - DNA, 31 bp, Artificial Sequence; identical to SEQ ID NO: 61292
  Description of Artificial Sequence: Synthetic oligonucleotide

SEQ ID NO: 404624 - DNA, 31 bp, Artificial Sequence; identical to SEQ ID NO: 61293
  Description of Artificial Sequence: Synthetic oligonucleotide

SEQ ID NO: 404625 - DNA, 32 bp, Artificial Sequence; identical to SEQ ID NO: 61294
  Description of Artificial Sequence: Synthetic oligonucleotide

SEQ ID NO: 404626 - DNA, 33 bp, Artificial Sequence; identical to SEQ ID NO: 61295
  Description of Artificial Sequence: Synthetic oligonucleotide

SEQ ID NO: 404627 - DNA, 32 bp, Artificial Sequence; identical to SEQ ID NO: 61296
  Description of Artificial Sequence: Synthetic oligonucleotide

SEQ ID NO: 404628 - DNA, 33 bp, Artificial Sequence; identical to SEQ ID NO: 61297
  Description of Artificial Sequence: Synthetic oligonucleotide

SEQ ID NO: 404629 - DNA, 32 bp, Artificial Sequence; identical to SEQ ID NO: 61298
  Description of Artificial Sequence: Synthetic oligonucleotide

SEQ ID NO: 404630 - DNA, 32 bp, Artificial Sequence; identical to SEQ ID NO: 61299
  Description of Artificial Sequence: Synthetic oligonucleotide

SEQ ID NO: 404631 - DNA, 31 bp, Artificial Sequence; identical to SEQ ID NO: 61300
  Description of Artificial Sequence: Synthetic oligonucleotide

SEQ ID NO: 404632 - DNA, 31 bp, Artificial Sequence; identical to SEQ ID NO: 61301
  Description of Artificial Sequence: Synthetic oligonucleotide

SEQ ID NO: 404633 - DNA, 30 bp, Artificial Sequence; identical to SEQ ID NO: 61302
  Description of Artificial Sequence: Synthetic oligonucleotide

SEQ ID NO: 404634 - DNA, 33 bp, Artificial Sequence; identical to SEQ ID NO: 61303
  Description of Artificial Sequence: Synthetic oligonucleotide

SEQ ID NO: 404635 - DNA, 32 bp, Artificial Sequence; identical to SEQ ID NO: 61304
  Description of Artificial Sequence: Synthetic oligonucleotide

SEQ ID NO: 404636 - DNA, 31 bp, Artificial Sequence; identical to SEQ ID NO: 61305
  Description of Artificial Sequence: Synthetic oligonucleotide

SEQ ID NO: 404637 - DNA, 30 bp, Artificial Sequence; identical to SEQ ID NO: 61306
  Description of Artificial Sequence: Synthetic oligonucleotide

SEQ ID NO: 404638 - DNA, 30 bp, Artificial Sequence; identical to SEQ ID NO: 61307
  Description of Artificial Sequence: Synthetic oligonucleotide

SEQ ID NO: 404639 - DNA, 29 bp, Artificial Sequence
  Description of Artificial Sequence: Synthetic oligonucleotide
gcccagaacaagatgctgagtggcattgg

SEQ ID NO: 404640 - DNA, 30 bp, Artificial Sequence; identical to SEQ ID NO: 61309
  Description of Artificial Sequence: Synthetic oligonucleotide

SEQ ID NO: 404641 - DNA, 30 bp, Artificial Sequence; identical to SEQ ID NO: 61310
  Description of Artificial Sequence: Synthetic oligonucleotide

SEQ ID NO: 404642 - DNA, 30 bp, Artificial Sequence; identical to SEQ ID NO: 61311
  Description of Artificial Sequence: Synthetic oligonucleotide

SEQ ID NO: 404643 - DNA, 32 bp, Artificial Sequence; identical to SEQ ID NO: 61312
  Description of Artificial Sequence: Synthetic oligonucleotide

SEQ ID NO: 404644 - DNA, 31 bp, Artificial Sequence; identical to SEQ ID NO: 61313
  Description of Artificial Sequence: Synthetic oligonucleotide

SEQ ID NO: 404645 - DNA, 31 bp, Artificial Sequence; identical to SEQ ID NO: 61314
  Description of Artificial Sequence: Synthetic oligonucleotide

SEQ ID NO: 404646 - DNA, 30 bp, Artificial Sequence; identical to SEQ ID NO: 61315
  Description of Artificial Sequence: Synthetic oligonucleotide

SEQ ID NO: 404647 - DNA, 26 bp, Artificial Sequence
  Description of Artificial Sequence: Synthetic oligonucleotide
cttcctcgggctgggccttatcatcc

SEQ ID NO: 404648 - DNA, 27 bp, Artificial Sequence
  Description of Artificial Sequence: Synthetic oligonucleotide
ttcctcgggctgggccttatcatccgt

SEQ ID NO: 404649 - DNA, 26 bp, Artificial Sequence
  Description of Artificial Sequence: Synthetic oligonucleotide
tcctcgggctgggccttatcatccgt

SEQ ID NO: 404650 - DNA, 25 bp, Artificial Sequence
  Description of Artificial Sequence: Synthetic oligonucleotide
cctcgggctgggccttatcatccgt

SEQ ID NO: 404651 - DNA, 27 bp, Artificial Sequence
  Description of Artificial Sequence: Synthetic oligonucleotide
ctcgggctgggccttatcatccgtcaa

SEQ ID NO: 404652 - DNA, 28 bp, Artificial Sequence
  Description of Artificial Sequence: Synthetic oligonucleotide
tcgggctgggccttatcatccgtcaaag

SEQ ID NO: 404653 - DNA, 27 bp, Artificial Sequence
  Description of Artificial Sequence: Synthetic oligonucleotide
cgggctgggccttatcatccgtcaaag

SEQ ID NO: 404654 - DNA, 27 bp, Artificial Sequence
  Description of Artificial Sequence: Synthetic oligonucleotide
gggctgggccttatcatccgtcaaagg

SEQ ID NO: 404655 - DNA, 28 bp, Artificial Sequence
  Description of Artificial Sequence: Synthetic oligonucleotide
ggctgggccttatcatccgtcaaaggag

SEQ ID NO: 404656 - DNA, 29 bp, Artificial Sequence
  Description of Artificial Sequence: Synthetic oligonucleotide
gctgggccttatcatccgtcaaaggagtc

SEQ ID NO: 404657 - DNA, 30 bp, Artificial Sequence; identical to SEQ ID NO: 61326
  Description of Artificial Sequence: Synthetic oligonucleotide

SEQ ID NO: 404658 - DNA, 33 bp, Artificial Sequence; identical to SEQ ID NO: 61327
  Description of Artificial Sequence: Synthetic oligonucleotide

SEQ ID NO: 404659 - DNA, 32 bp, Artificial Sequence; identical to SEQ ID NO: 61328
  Description of Artificial Sequence: Synthetic oligonucleotide

SEQ ID NO: 404660 - DNA, 32 bp, Artificial Sequence; identical to SEQ ID NO: 61329
  Description of Artificial Sequence: Synthetic oligonucleotide

SEQ ID NO: 404661 - DNA, 33 bp, Artificial Sequence; identical to SEQ ID NO: 61330
  Description of Artificial Sequence: Synthetic oligonucleotide

SEQ ID NO: 404662 - DNA, 33 bp, Artificial Sequence; identical to SEQ ID NO: 61331
  Description of Artificial Sequence: Synthetic oligonucleotide

SEQ ID NO: 404663 - DNA, 34 bp, Artificial Sequence; identical to SEQ ID NO: 61332
  Description of Artificial Sequence: Synthetic oligonucleotide

SEQ ID NO: 404664 - DNA, 36 bp, Artificial Sequence; identical to SEQ ID NO: 61333
  Description of Artificial Sequence: Synthetic oligonucleotide

SEQ ID NO: 404665 - DNA, 35 bp, Artificial Sequence; identical to SEQ ID NO: 61334
  Description of Artificial Sequence: Synthetic oligonucleotide

SEQ ID NO: 404666 - DNA, 34 bp, Artificial Sequence; identical to SEQ ID NO: 61335
  Description of Artificial Sequence: Synthetic oligonucleotide

SEQ ID NO: 404667 - DNA, 33 bp, Artificial Sequence; identical to SEQ ID NO: 61336
  Description of Artificial Sequence: Synthetic oligonucleotide

SEQ ID NO: 404668 - DNA, 32 bp, Artificial Sequence; identical to SEQ ID NO: 61337
  Description of Artificial Sequence: Synthetic oligonucleotide

SEQ ID NO: 404669 - DNA, 32 bp, Artificial Sequence; identical to SEQ ID NO: 61338
  Description of Artificial Sequence: Synthetic oligonucleotide

SEQ ID NO: 404670 - DNA, 31 bp, Artificial Sequence; identical to SEQ ID NO: 61339
  Description of Artificial Sequence: Synthetic oligonucleotide

SEQ ID NO: 404671 - DNA, 30 bp, Artificial Sequence; identical to SEQ ID NO: 61340
  Description of Artificial Sequence: Synthetic oligonucleotide

SEQ ID NO: 404672 - DNA, 30 bp, Artificial Sequence; identical to SEQ ID NO: 61341
  Description of Artificial Sequence: Synthetic oligonucleotide

SEQ ID NO: 404673 - DNA, 30 bp, Artificial Sequence; identical to SEQ ID NO: 61342
  Description of Artificial Sequence: Synthetic oligonucleotide

SEQ ID NO: 404674 - DNA, 30 bp, Artificial Sequence; identical to SEQ ID NO: 61343
  Description of Artificial Sequence: Synthetic oligonucleotide

SEQ ID NO: 404675 - DNA, 29 bp, Artificial Sequence
  Description of Artificial Sequence: Synthetic oligonucleotide
caaaggagtcagaaaggacctcaagggcc

SEQ ID NO: 404676 - DNA, 30 bp, Artificial Sequence; identical to SEQ ID NO: 61345
  Description of Artificial Sequence: Synthetic oligonucleotide

SEQ ID NO: 404677 - DNA, 29 bp, Artificial Sequence
  Description of Artificial Sequence: Synthetic oligonucleotide
aaggagtcagaaaggacctcaagggcctc

SEQ ID NO: 404678 - DNA, 28 bp, Artificial Sequence
  Description of Artificial Sequence: Synthetic oligonucleotide
aggagtcagaaaggacctcaagggcctc

SEQ ID NO: 404679 - DNA, 27 bp, Artificial Sequence
  Description of Artificial Sequence: Synthetic oligonucleotide
ggagtcagaaaggacctcaagggcctc

SEQ ID NO: 404680 - DNA, 27 bp, Artificial Sequence
  Description of Artificial Sequence: Synthetic oligonucleotide
gagtcagaaaggacctcaagggcctcc

SEQ ID NO: 404681 - DNA, 28 bp, Artificial Sequence
  Description of Artificial Sequence: Synthetic oligonucleotide
agtcagaaaggacctcaagggcctccac

SEQ ID NO: 404682 - DNA, 27 bp, Artificial Sequence
  Description of Artificial Sequence: Synthetic oligonucleotide
gtcagaaaggacctcaagggcctccac

SEQ ID NO: 404683 - DNA, 27 bp, Artificial Sequence
  Description of Artificial Sequence: Synthetic oligonucleotide
tcagaaaggacctcaagggcctccacc

SEQ ID NO: 404684 - DNA, 27 bp, Artificial Sequence
  Description of Artificial Sequence: Synthetic oligonucleotide
cagaaaggacctcaagggcctccacca

SEQ ID NO: 404685 - DNA, 27 bp, Artificial Sequence
  Description of Artificial Sequence: Synthetic oligonucleotide
agaaaggacctcaagggcctccaccag

SEQ ID NO: 404686 - DNA, 23 bp, Artificial Sequence
  Description of Artificial Sequence: Synthetic oligonucleotide
tgggggtgtatcgggcggtgacc

SEQ ID NO: 404687 - DNA, 22 bp, Artificial Sequence
  Description of Artificial Sequence: Synthetic oligonucleotide
gggggtgtatcgggcggtgacc

SEQ ID NO: 404688 - DNA, 22 bp, Artificial Sequence
  Description of Artificial Sequence: Synthetic oligonucleotide
ggggtgtatcgggcggtgaccc

SEQ ID NO: 404689 - DNA, 22 bp, Artificial Sequence
  Description of Artificial Sequence: Synthetic oligonucleotide
gggtgtatcgggcggtgacccc

SEQ ID NO: 404690 - DNA, 22 bp, Artificial Sequence
  Description of Artificial Sequence: Synthetic oligonucleotide
ggtgtatcgggcggtgaccccg

SEQ ID NO: 404691 - DNA, 23 bp, Artificial Sequence
  Description of Artificial Sequence: Synthetic oligonucleotide
gtgtatcgggcggtgaccccgca

SEQ ID NO: 404692 - DNA, 23 bp, Artificial Sequence
  Description of Artificial Sequence: Synthetic oligonucleotide
tgtatcgggcggtgaccccgcag

SEQ ID NO: 404693 - DNA, 22 bp, Artificial Sequence
  Description of Artificial Sequence: Synthetic oligonucleotide
gtatcgggcggtgaccccgcag

SEQ ID NO: 404694 - DNA, 22 bp, Artificial Sequence
  Description of Artificial Sequence: Synthetic oligonucleotide
tatcgggcggtgaccccgcagg

SEQ ID NO: 404695 - DNA, 21 bp, Artificial Sequence
  Description of Artificial Sequence: Synthetic oligonucleotide
atcgggcggtgaccccgcagg

SEQ ID NO: 404696 - DNA, 20 bp, Artificial Sequence
  Description of Artificial Sequence: Synthetic oligonucleotide
tcgggcggtgaccccgcagg

SEQ ID NO: 404697 - DNA, 20 bp, Artificial Sequence
  Description of Artificial Sequence: Synthetic oligonucleotide
cgggcggtgaccccgcaggt

SEQ ID NO: 404698 - DNA, 20 bp, Artificial Sequence
  Description of Artificial Sequence: Synthetic oligonucleotide
gggcggtgaccccgcagggt

SEQ ID NO: 404699 - DNA, 20 bp, Artificial Sequence
  Description of Artificial Sequence: Synthetic oligonucleotide
ggcggtgaccccgcaggggt

SEQ ID NO: 404700 - DNA, 20 bp, Artificial Sequence
  Description of Artificial Sequence: Synthetic oligonucleotide
gcggtgaccccgcaggggct

SEQ ID NO: 404701 - DNA, 20 bp, Artificial Sequence
  Description of Artificial Sequence: Synthetic oligonucleotide
cggtgaccccgcaggggcgt

SEQ ID NO: 404702 - DNA, 20 bp, Artificial Sequence
  Description of Artificial Sequence: Synthetic oligonucleotide
ggtgaccccgcaggggcggt

SEQ ID NO: 404703 - DNA, 20 bp, Artificial Sequence
  Description of Artificial Sequence: Synthetic oligonucleotide
gtgaccccgcaggggcggct

SEQ ID NO: 404704 - DNA, 20 bp, Artificial Sequence
  Description of Artificial Sequence: Synthetic oligonucleotide
tgaccccgcaggggcggcct

SEQ ID NO: 404705 - DNA, 20 bp, Artificial Sequence
  Description of Artificial Sequence: Synthetic oligonucleotide
gaccccgcaggggcggcctt

SEQ ID NO: 404706 - DNA, 20 bp, Artificial Sequence
  Description of Artificial Sequence: Synthetic oligonucleotide
accccgcaggggcggcctga

SEQ ID NO: 404707 - DNA, 20 bp, Artificial Sequence
  Description of Artificial Sequence: Synthetic oligonucleotide
ccccgcaggggcggcctgat

SEQ ID NO: 404708 - DNA, 20 bp, Artificial Sequence
  Description of Artificial Sequence: Synthetic oligonucleotide
cccgcaggggcggcctgact

SEQ ID NO: 404709 - DNA, 31 bp, Artificial Sequence; identical to SEQ ID NO: 61378
  Description of Artificial Sequence: Synthetic oligonucleotide

SEQ ID NO: 404710 - DNA, 30 bp, Artificial Sequence; identical to SEQ ID NO: 61379
  Description of Artificial Sequence: Synthetic oligonucleotide

SEQ ID NO: 404711 - DNA, 29 bp, Artificial Sequence
  Description of Artificial Sequence: Synthetic oligonucleotide
agtccggtggtttcggaatgaccaggaag

SEQ ID NO: 404712 - DNA, 28 bp, Artificial Sequence
  Description of Artificial Sequence: Synthetic oligonucleotide
gtccggtggtttcggaatgaccaggaag

SEQ ID NO: 404713 - DNA, 29 bp, Artificial Sequence
  Description of Artificial Sequence: Synthetic oligonucleotide
tccggtggtttcggaatgaccaggaagag

SEQ ID NO: 404714 - DNA, 28 bp, Artificial Sequence
  Description of Artificial Sequence: Synthetic oligonucleotide
ccggtggtttcggaatgaccaggaagag

SEQ ID NO: 404715 - DNA, 29 bp, Artificial Sequence
  Description of Artificial Sequence: Synthetic oligonucleotide
cggtggtttcggaatgaccaggaagagac

SEQ ID NO: 404716 - DNA, 30 bp, Artificial Sequence; identical to SEQ ID NO: 61385
  Description of Artificial Sequence: Synthetic oligonucleotide

SEQ ID NO: 404717 - DNA, 30 bp, Artificial Sequence; identical to SEQ ID NO: 61386
  Description of Artificial Sequence: Synthetic oligonucleotide

SEQ ID NO: 404718 - DNA, 31 bp, Artificial Sequence; identical to SEQ ID NO: 61387
  Description of Artificial Sequence: Synthetic oligonucleotide

SEQ ID NO: 404719 - DNA, 30 bp, Artificial Sequence; identical to SEQ ID NO: 61388
  Description of Artificial Sequence: Synthetic oligonucleotide

SEQ ID NO: 404720 - DNA, 30 bp, Artificial Sequence; identical to SEQ ID NO: 61389
  Description of Artificial Sequence: Synthetic oligonucleotide

SEQ ID NO: 404721 - DNA, 30 bp, Artificial Sequence; identical to SEQ ID NO: 61390
  Description of Artificial Sequence: Synthetic oligonucleotide

SEQ ID NO: 404722 - DNA, 29 bp, Artificial Sequence
  Description of Artificial Sequence: Synthetic oligonucleotide
ttcggaatgaccaggaagagacagctggc

SEQ ID NO: 404723 - DNA, 28 bp, Artificial Sequence
  Description of Artificial Sequence: Synthetic oligonucleotide
tcggaatgaccaggaagagacagctggc

SEQ ID NO: 404724 - DNA, 27 bp, Artificial Sequence
  Description of Artificial Sequence: Synthetic oligonucleotide
cggaatgaccaggaagagacagctggc

SEQ ID NO: 404725 - DNA, 27 bp, Artificial Sequence
  Description of Artificial Sequence: Synthetic oligonucleotide
ggaatgaccaggaagagacagctggcg

SEQ ID NO: 404726 - DNA, 29 bp, Artificial Sequence
  Description of Artificial Sequence: Synthetic oligonucleotide
gaatgaccaggaagagacagctggcgttg

SEQ ID NO: 404727 - DNA, 30 bp, Artificial Sequence; identical to SEQ ID NO: 61396
  Description of Artificial Sequence: Synthetic oligonucleotide

SEQ ID NO: 404728 - DNA, 29 bp, Artificial Sequence
  Description of Artificial Sequence: Synthetic oligonucleotide
atgaccaggaagagacagctggcgttgtg

SEQ ID NO: 404729 - DNA, 28 bp, Artificial Sequence
  Description of Artificial Sequence: Synthetic oligonucleotide
tgaccaggaagagacagctggcgttgtg

SEQ ID NO: 404730 - DNA, 27 bp, Artificial Sequence
  Description of Artificial Sequence: Synthetic oligonucleotide
gaccaggaagagacagctggcgttgtg

SEQ ID NO: 404731 - DNA, 28 bp, Artificial Sequence
  Description of Artificial Sequence: Synthetic oligonucleotide
accaggaagagacagctggcgttgtgtc

SEQ ID NO: 404732 - DNA, 27 bp, Artificial Sequence
  Description of Artificial Sequence: Synthetic oligonucleotide
ccaggaagagacagctggcgttgtgtc

SEQ ID NO: 404733 - DNA, 27 bp, Artificial Sequence
  Description of Artificial Sequence: Synthetic oligonucleotide
caggaagagacagctggcgttgtgtcc

SEQ ID NO: 404734 - DNA, 28 bp, Artificial Sequence
  Description of Artificial Sequence: Synthetic oligonucleotide
aggaagagacagctggcgttgtgtccac

SEQ ID NO: 404735 - DNA, 27 bp, Artificial Sequence
  Description of Artificial Sequence: Synthetic oligonucleotide
ggaagagacagctggcgttgtgtccac

SEQ ID NO: 404736 - DNA, 27 bp, Artificial Sequence
  Description of Artificial Sequence: Synthetic oligonucleotide
gaagagacagctggcgttgtgtccacc

SEQ ID NO: 404737 - DNA, 27 bp, Artificial Sequence
  Description of Artificial Sequence: Synthetic oligonucleotide
aagagacagctggcgttgtgtccaccc

SEQ ID NO: 404738 - DNA, 26 bp, Artificial Sequence
  Description of Artificial Sequence: Synthetic oligonucleotide
agagacagctggcgttgtgtccaccc

SEQ ID NO: 404739 - DNA, 33 bp, Artificial Sequence; identical to SEQ ID NO: 61408
  Description of Artificial Sequence: Synthetic oligonucleotide

SEQ ID NO: 404740 - DNA, 34 bp, Artificial Sequence; identical to SEQ ID NO: 61409
  Description of Artificial Sequence: Synthetic oligonucleotide

SEQ ID NO: 404741 - DNA, 33 bp, Artificial Sequence; identical to SEQ ID NO: 61410
  Description of Artificial Sequence: Synthetic oligonucleotide

SEQ ID NO: 404742 - DNA, 33 bp, Artificial Sequence; identical to SEQ ID NO: 61411
  Description of Artificial Sequence: Synthetic oligonucleotide

SEQ ID NO: 404743 - DNA, 32 bp, Artificial Sequence; identical to SEQ ID NO: 61412
  Description of Artificial Sequence: Synthetic oligonucleotide

SEQ ID NO: 404744 - DNA, 31 bp, Artificial Sequence; identical to SEQ ID NO: 61413
  Description of Artificial Sequence: Synthetic oligonucleotide

SEQ ID NO: 404745 - DNA, 30 bp, Artificial Sequence; identical to SEQ ID NO: 61414
  Description of Artificial Sequence: Synthetic oligonucleotide

SEQ ID NO: 404746 - DNA, 29 bp, Artificial Sequence
  Description of Artificial Sequence: Synthetic oligonucleotide
aggccatgtgctacttcaccaatggcacg

SEQ ID NO: 404747 - DNA, 28 bp, Artificial Sequence
  Description of Artificial Sequence: Synthetic oligonucleotide
ggccatgtgctacttcaccaatggcacg

SEQ ID NO: 404748 - DNA, 28 bp, Artificial Sequence
  Description of Artificial Sequence: Synthetic oligonucleotide
gccatgtgctacttcaccaatggcacgg

SEQ ID NO: 404749 - DNA, 29 bp, Artificial Sequence
  Description of Artificial Sequence: Synthetic oligonucleotide
ccatgtgctacttcaccaatggcacggag

SEQ ID NO: 404750 - DNA, 29 bp, Artificial Sequence
  Description of Artificial Sequence: Synthetic oligonucleotide
catgtgctacttcaccaatggcacggagc

SEQ ID NO: 404751 - DNA, 29 bp, Artificial Sequence
  Description of Artificial Sequence: Synthetic oligonucleotide
atgtgctacttcaccaatggcacggagcg

SEQ ID NO: 404752 - DNA, 28 bp, Artificial Sequence
  Description of Artificial Sequence: Synthetic oligonucleotide
tgtgctacttcaccaatggcacggagcg

SEQ ID NO: 404753 - DNA, 27 bp, Artificial Sequence
  Description of Artificial Sequence: Synthetic oligonucleotide
gtgctacttcaccaatggcacggagcg

SEQ ID NO: 404754 - DNA, 27 bp, Artificial Sequence
  Description of Artificial Sequence: Synthetic oligonucleotide
tgctacttcaccaatggcacggagcgc

SEQ ID NO: 404755 - DNA, 26 bp, Artificial Sequence
  Description of Artificial Sequence: Synthetic oligonucleotide
gctacttcaccaatggcacggagcgc

SEQ ID NO: 404756 - DNA, 27 bp, Artificial Sequence
  Description of Artificial Sequence: Synthetic oligonucleotide
ctacttcaccaatggcacggagcgcgt

SEQ ID NO: 404757 - DNA, 27 bp, Artificial Sequence
  Description of Artificial Sequence: Synthetic oligonucleotide
tacttcaccaatggcacggagcgcgtg

SEQ ID NO: 404758 - DNA, 26 bp, Artificial Sequence
  Description of Artificial Sequence: Synthetic oligonucleotide
acttcaccaatggcacggagcgcgtg

SEQ ID NO: 404759 - DNA, 25 bp, Artificial Sequence
  Description of Artificial Sequence: Synthetic oligonucleotide
cttcaccaatggcacggagcgcgtg

SEQ ID NO: 404760 - DNA, 25 bp, Artificial Sequence
  Description of Artificial Sequence: Synthetic oligonucleotide
ttcaccaatggcacggagcgcgtgc

SEQ ID NO: 404761 - DNA, 24 bp, Artificial Sequence
  Description of Artificial Sequence: Synthetic oligonucleotide
tcaccaatggcacggagcgcgtgc

SEQ ID NO: 404762 - DNA, 23 bp, Artificial Sequence
  Description of Artificial Sequence: Synthetic oligonucleotide
caccaatggcacggagcgcgtgc

SEQ ID NO: 404763 - DNA, 27 bp, Artificial Sequence
  Description of Artificial Sequence: Synthetic oligonucleotide
accaatggcacggagcgcgtgcgttat

SEQ ID NO: 404764 - DNA, 26 bp, Artificial Sequence
  Description of Artificial Sequence: Synthetic oligonucleotide
ccaatggcacggagcgcgtgcgttat

SEQ ID NO: 404765 - DNA, 27 bp, Artificial Sequence
  Description of Artificial Sequence: Synthetic oligonucleotide
caatggcacggagcgcgtgcgttatgt

SEQ ID NO: 404766 - DNA, 27 bp, Artificial Sequence
  Description of Artificial Sequence: Synthetic oligonucleotide
aatggcacggagcgcgtgcgttatgtg

SEQ ID NO: 404767 - DNA, 27 bp, Artificial Sequence
  Description of Artificial Sequence: Synthetic oligonucleotide
atggcacggagcgcgtgcgttatgtga

SEQ ID NO: 404768 - DNA, 26 bp, Artificial Sequence
  Description of Artificial Sequence: Synthetic oligonucleotide
tggcacggagcgcgtgcgttatgtga

SEQ ID NO: 404769 - DNA, 25 bp, Artificial Sequence
  Description of Artificial Sequence: Synthetic oligonucleotide
ggcacggagcgcgtgcgttatgtga

SEQ ID NO: 404770 - DNA, 25 bp, Artificial Sequence
  Description of Artificial Sequence: Synthetic oligonucleotide
gcacggagcgcgtgcgttatgtgac

SEQ ID NO: 404771 - DNA, 26 bp, Artificial Sequence
  Description of Artificial Sequence: Synthetic oligonucleotide
cacggagcgcgtgcgttatgtgacca

SEQ ID NO: 404772 - DNA, 26 bp, Artificial Sequence
  Description of Artificial Sequence: Synthetic oligonucleotide
gttccgcgggatcttgcagaggagag

SEQ ID NO: 404773 - DNA, 26 bp, Artificial Sequence
  Description of Artificial Sequence: Synthetic oligonucleotide
cacaacctgctggtctgctcggtgac

SEQ ID NO: 404774 - DNA, 26 bp, Artificial Sequence
  Description of Artificial Sequence: Synthetic oligonucleotide
acaacctgctggtctgctcggtgacg

SEQ ID NO: 404775 - DNA, 25 bp, Artificial Sequence
  Description of Artificial Sequence: Synthetic oligonucleotide
caacctgctggtctgctcggtgacg

SEQ ID NO: 404776 - DNA, 27 bp, Artificial Sequence
  Description of Artificial Sequence: Synthetic oligonucleotide
aacctgctggtctgctcggtgacggat

SEQ ID NO: 404777 - DNA, 27 bp, Artificial Sequence
  Description of Artificial Sequence: Synthetic oligonucleotide
acctgctggtctgctcggtgacggatt

SEQ ID NO: 404778 - DNA, 27 bp, Artificial Sequence
  Description of Artificial Sequence: Synthetic oligonucleotide
cctgctggtctgctcggtgacggattt

SEQ ID NO: 404779 - DNA, 27 bp, Artificial Sequence
  Description of Artificial Sequence: Synthetic oligonucleotide
ctgctggtctgctcggtgacggatttc

SEQ ID NO: 404780 - DNA, 30 bp, Artificial Sequence
  Description of Artificial Sequence: Synthetic oligonucleotide
tgctggtctgctcggtgacggatttctatc

SEQ ID NO: 404781 - DNA, 29 bp, Artificial Sequence
  Description of Artificial Sequence: Synthetic oligonucleotide
gctggtctgctcggtgacggatttctatc

SEQ ID NO: 404782 - DNA, 29 bp, Artificial Sequence
  Description of Artificial Sequence: Synthetic oligonucleotide
ctggtctgctcggtgacggatttctatcc

SEQ ID NO: 404783 - DNA, 30 bp, Artificial Sequence
  Description of Artificial Sequence: Synthetic oligonucleotide
tggtctgctcggtgacggatttctatccag

SEQ ID NO: 404784 - DNA, 29 bp, Artificial Sequence
  Description of Artificial Sequence: Synthetic oligonucleotide
ggtctgctcggtgacggatttctatccag

SEQ ID NO: 404785 - DNA, 29 bp, Artificial Sequence
  Description of Artificial Sequence: Synthetic oligonucleotide
gtctgctcggtgacggatttctatccagg

SEQ ID NO: 404786 - DNA, 29 bp, Artificial Sequence
  Description of Artificial Sequence: Synthetic oligonucleotide
tctgctcggtgacggatttctatccaggc

SEQ ID NO: 404787 - DNA, 28 bp, Artificial Sequence
  Description of Artificial Sequence: Synthetic oligonucleotide
ctgctcggtgacggatttctatccaggc

SEQ ID NO: 404788 - DNA, 28 bp, Artificial Sequence
  Description of Artificial Sequence: Synthetic oligonucleotide
tgctcggtgacggatttctatccaggcc

SEQ ID NO: 404789 - DNA, 27 bp, Artificial Sequence
  Description of Artificial Sequence: Synthetic oligonucleotide
gctcggtgacggatttctatccaggcc

SEQ ID NO: 404790 - DNA, 28 bp, Artificial Sequence
  Description of Artificial Sequence: Synthetic oligonucleotide
ctcggtgacggatttctatccaggccag

SEQ ID NO: 404791 - DNA, 30 bp, Artificial Sequence
  Description of Artificial Sequence: Synthetic oligonucleotide
tcggtgacggatttctatccaggccagatc

SEQ ID NO: 404792 - DNA, 29 bp, Artificial Sequence
  Description of Artificial Sequence: Synthetic oligonucleotide
cggtgacggatttctatccaggccagatc

SEQ ID NO: 404793 - DNA, 32 bp, Artificial Sequence
  Description of Artificial Sequence: Synthetic oligonucleotide
ggtgacggatttctatccaggccagatcaaag

SEQ ID NO: 404794 - DNA, 33 bp, Artificial Sequence
  Description of Artificial Sequence: Synthetic oligonucleotide
gtgacggatttctatccaggccagatcaaagtc

SEQ ID NO: 404795 - DNA, 33 bp, Artificial Sequence
  Description of Artificial Sequence: Synthetic oligonucleotide
tgacggatttctatccaggccagatcaaagtcc

SEQ ID NO: 404796 - DNA, 32 bp, Artificial Sequence
  Description of Artificial Sequence: Synthetic oligonucleotide
gacggatttctatccaggccagatcaaagtcc

SEQ ID NO: 404797 - DNA, 32 bp, Artificial Sequence
  Description of Artificial Sequence: Synthetic oligonucleotide
acggatttctatccaggccagatcaaagtccg

SEQ ID NO: 404798 - DNA, 31 bp, Artificial Sequence
  Description of Artificial Sequence: Synthetic oligonucleotide
cggatttctatccaggccagatcaaagtccg

SEQ ID NO: 404799 - DNA, 31 bp, Artificial Sequence
  Description of Artificial Sequence: Synthetic oligonucleotide
ggatttctatccaggccagatcaaagtccgg

SEQ ID NO: 404800 - DNA, 36 bp, Artificial Sequence
  Description of Artificial Sequence: Synthetic oligonucleotide
ttctaagaactttgctcttctccccaggacttaagg

SEQ ID NO: 404801 - DNA, 35 bp, Artificial Sequence
  Description of Artificial Sequence: Synthetic oligonucleotide
tctaagaactttgctcttctccccaggacttaagg

SEQ ID NO: 404802 - DNA, 34 bp, Artificial Sequence
  Description of Artificial Sequence: Synthetic oligonucleotide
ctaagaactttgctcttctccccaggacttaagg

SEQ ID NO: 404803 - DNA, 34 bp, Artificial Sequence
  Description of Artificial Sequence: Synthetic oligonucleotide
taagaactttgctcttctccccaggacttaaggc

SEQ ID NO: 404804 - DNA, 33 bp, Artificial Sequence
  Description of Artificial Sequence: Synthetic oligonucleotide
aagaactttgctcttctccccaggacttaaggc

SEQ ID NO: 404805 - DNA, 32 bp, Artificial Sequence
  Description of Artificial Sequence: Synthetic oligonucleotide
agaactttgctcttctccccaggacttaaggc

SEQ ID NO: 404806 - DNA, 31 bp, Artificial Sequence
  Description of Artificial Sequence: Synthetic oligonucleotide
gaactttgctcttctccccaggacttaaggc

SEQ ID NO: 404807 - DNA, 32 bp, Artificial Sequence
  Description of Artificial Sequence: Synthetic oligonucleotide
aactttgctcttctccccaggacttaaggctc

SEQ ID NO: 404808 - DNA, 31 bp, Artificial Sequence
  Description of Artificial Sequence: Synthetic oligonucleotide
actttgctcttctccccaggacttaaggctc

SEQ ID NO: 404809 - DNA, 57 bp, Artificial Sequence
  Description of Artificial Sequence: Synthetic oligonucleotide
ccaagtataataacaactggtttttaacaatattacagagatgtttactgttgaatc

SEQ ID NO: 404810 - DNA, 57 bp, Artificial Sequence
  Description of Artificial Sequence: Synthetic oligonucleotide
caagtataataacaactggtttttaacaatattacagagatgtttactgttgaatcg

SEQ ID NO: 404811 - DNA, 57 bp, Artificial Sequence
  Description of Artificial Sequence: Synthetic oligonucleotide
aagtataataacaactggtttttaacaatattacagagatgtttactgttgaatcgc

SEQ ID NO: 404812 - DNA, 56 bp, Artificial Sequence
  Description of Artificial Sequence: Synthetic oligonucleotide
agtataataacaactggtttttaacaatattacagagatgtttactgttgaatcgc

SEQ ID NO: 404813 - DNA, 55 bp, Artificial Sequence
  Description of Artificial Sequence: Synthetic oligonucleotide
gtataataacaactggtttttaacaatattacagagatgtttactgttgaatcgc

SEQ ID NO: 404814 - DNA, 60 bp, Artificial Sequence
  Description of Artificial Sequence: Synthetic oligonucleotide
tataataacaactggtttttaacaatattacagagatgtttactgttgaatcgcattttt

SEQ ID NO: 404815 - DNA, 60 bp, Artificial Sequence
  Description of Artificial Sequence: Synthetic oligonucleotide
ataataacaactggtttttaacaatattacagagatgtttactgttgaatcgcatttttt

SEQ ID NO: 404816 - DNA, 60 bp, Artificial Sequence
  Description of Artificial Sequence: Synthetic oligonucleotide
taataacaactggtttttaacaatattacagagatgtttactgttgaatcgcattttttt

SEQ ID NO: 404817 - DNA, 60 bp, Artificial Sequence
  Description of Artificial Sequence: Synthetic oligonucleotide
aataacaactggtttttaacaatattacagagatgtttactgttgaatcgcatttttttc

SEQ ID NO: 404818 - DNA, 59 bp, Artificial Sequence
  Description of Artificial Sequence: Synthetic oligonucleotide
ataacaactggtttttaacaatattacagagatgtttactgttgaatcgcatttttttc

SEQ ID NO: 404819 - DNA, 58 bp, Artificial Sequence
  Description of Artificial Sequence: Synthetic oligonucleotide
taacaactggtttttaacaatattacagagatgtttactgttgaatcgcatttttttc

SEQ ID NO: 404820 - DNA, 57 bp, Artificial Sequence
  Description of Artificial Sequence: Synthetic oligonucleotide
aacaactggtttttaacaatattacagagatgtttactgttgaatcgcatttttttc

SEQ ID NO: 404821 - DNA, 56 bp, Artificial Sequence
  Description of Artificial Sequence: Synthetic oligonucleotide
acaactggtttttaacaatattacagagatgtttactgttgaatcgcatttttttc

SEQ ID NO: 404822 - DNA, 55 bp, Artificial Sequence
  Description of Artificial Sequence: Synthetic oligonucleotide
caactggtttttaacaatattacagagatgtttactgttgaatcgcatttttttc

SEQ ID NO: 404823 - DNA, 59 bp, Artificial Sequence
  Description of Artificial Sequence: Synthetic oligonucleotide
aactggtttttaacaatattacagagatgtttactgttgaatcgcatttttttcttttg

SEQ ID NO: 404824 - DNA, 58 bp, Artificial Sequence
  Description of Artificial Sequence: Synthetic oligonucleotide
actggtttttaacaatattacagagatgtttactgttgaatcgcatttttttcttttg

SEQ ID NO: 404825 - DNA, 57 bp, Artificial Sequence
  Description of Artificial Sequence: Synthetic oligonucleotide
ctggtttttaacaatattacagagatgtttactgttgaatcgcatttttttcttttg

SEQ ID NO: 404826 - DNA, 57 bp, Artificial Sequence
  Description of Artificial Sequence: Synthetic oligonucleotide
tggtttttaacaatattacagagatgtttactgttgaatcgcatttttttcttttgc

SEQ ID NO: 404827 - DNA, 56 bp, Artificial Sequence
  Description of Artificial Sequence: Synthetic oligonucleotide
ggtttttaacaatattacagagatgtttactgttgaatcgcatttttttcttttgc

SEQ ID NO: 404828 - DNA, 56 bp, Artificial Sequence
  Description of Artificial Sequence: Synthetic oligonucleotide
gtttttaacaatattacagagatgtttactgttgaatcgcatttttttcttttgcc

SEQ ID NO: 404829 - DNA, 57 bp, Artificial Sequence
  Description of Artificial Sequence: Synthetic oligonucleotide
tttttaacaatattacagagatgtttactgttgaatcgcatttttttcttttgcctc

SEQ ID NO: 404830 - DNA, 56 bp, Artificial Sequence
  Description of Artificial Sequence: Synthetic oligonucleotide
ttttaacaatattacagagatgtttactgttgaatcgcatttttttcttttgcctc

SEQ ID NO: 404831 - DNA, 55 bp, Artificial Sequence
  Description of Artificial Sequence: Synthetic oligonucleotide
tttaacaatattacagagatgtttactgttgaatcgcatttttttcttttgcctc

SEQ ID NO: 404832 - DNA, 54 bp, Artificial Sequence
  Description of Artificial Sequence: Synthetic oligonucleotide
ttaacaatattacagagatgtttactgttgaatcgcatttttttcttttgcctc

SEQ ID NO: 404833 - DNA, 53 bp, Artificial Sequence
  Description of Artificial Sequence: Synthetic oligonucleotide
taacaatattacagagatgtttactgttgaatcgcatttttttcttttgcctc

SEQ ID NO: 404834 - DNA, 52 bp, Artificial Sequence
  Description of Artificial Sequence: Synthetic oligonucleotide
aacaatattacagagatgtttactgttgaatcgcatttttttcttttgcctc

SEQ ID NO: 404835 - DNA, 51 bp, Artificial Sequence
  Description of Artificial Sequence: Synthetic oligonucleotide
acaatattacagagatgtttactgttgaatcgcatttttttcttttgcctc

SEQ ID NO: 404836 - DNA, 50 bp, Artificial Sequence
  Description of Artificial Sequence: Synthetic oligonucleotide
caatattacagagatgtttactgttgaatcgcatttttttcttttgcctc

SEQ ID NO: 404837 - DNA, 51 bp, Artificial Sequence
  Description of Artificial Sequence: Synthetic oligonucleotide
aatattacagagatgtttactgttgaatcgcatttttttcttttgcctctc

SEQ ID NO: 404838 - DNA, 50 bp, Artificial Sequence
  Description of Artificial Sequence: Synthetic oligonucleotide
atattacagagatgtttactgttgaatcgcatttttttcttttgcctctc

SEQ ID NO: 404839 - DNA, 49 bp, Artificial Sequence
  Description of Artificial Sequence: Synthetic oligonucleotide
tattacagagatgtttactgttgaatcgcatttttttcttttgcctctc

SEQ ID NO: 404840 - DNA, 48 bp, Artificial Sequence
  Description of Artificial Sequence: Synthetic oligonucleotide
attacagagatgtttactgttgaatcgcatttttttcttttgcctctc

SEQ ID NO: 404841 - DNA, 47 bp, Artificial Sequence
  Description of Artificial Sequence: Synthetic oligonucleotide
ttacagagatgtttactgttgaatcgcatttttttcttttgcctctc

SEQ ID NO: 404842 - DNA, 46 bp, Artificial Sequence
  Description of Artificial Sequence: Synthetic oligonucleotide
tacagagatgtttactgttgaatcgcatttttttcttttgcctctc

SEQ ID NO: 404843 - DNA, 45 bp, Artificial Sequence
  Description of Artificial Sequence: Synthetic oligonucleotide
acagagatgtttactgttgaatcgcatttttttcttttgcctctc

SEQ ID NO: 404844 - DNA, 44 bp, Artificial Sequence
  Description of Artificial Sequence: Synthetic oligonucleotide
cagagatgtttactgttgaatcgcatttttttcttttgcctctc

SEQ ID NO: 404845 - DNA, 49 bp, Artificial Sequence
  Description of Artificial Sequence: Synthetic oligonucleotide
agagatgtttactgttgaatcgcatttttttcttttgcctctcaaaatc

SEQ ID NO: 404846 - DNA, 48 bp, Artificial Sequence
  Description of Artificial Sequence: Synthetic oligonucleotide
gagatgtttactgttgaatcgcatttttttcttttgcctctcaaaatc

SEQ ID NO: 404847 - DNA, 48 bp, Artificial Sequence
  Description of Artificial Sequence: Synthetic oligonucleotide
agatgtttactgttgaatcgcatttttttcttttgcctctcaaaatcc

SEQ ID NO: 404848 - DNA, 47 bp, Artificial Sequence
  Description of Artificial Sequence: Synthetic oligonucleotide
gatgtttactgttgaatcgcatttttttcttttgcctctcaaaatcc

SEQ ID NO: 404849 - DNA, 47 bp, Artificial Sequence
  Description of Artificial Sequence: Synthetic oligonucleotide
atgtttactgttgaatcgcatttttttcttttgcctctcaaaatccc

SEQ ID NO: 404850 - DNA, 46 bp, Artificial Sequence
  Description of Artificial Sequence: Synthetic oligonucleotide
tgtttactgttgaatcgcatttttttcttttgcctctcaaaatccc

SEQ ID NO: 404851 - DNA, 45 bp, Artificial Sequence
  Description of Artificial Sequence: Synthetic oligonucleotide
gtttactgttgaatcgcatttttttcttttgcctctcaaaatccc

SEQ ID NO: 404852 - DNA, 45 bp, Artificial Sequence
  Description of Artificial Sequence: Synthetic oligonucleotide
tttactgttgaatcgcatttttttcttttgcctctcaaaatcccc

SEQ ID NO: 404853 - DNA, 44 bp, Artificial Sequence
  Description of Artificial Sequence: Synthetic oligonucleotide
ttactgttgaatcgcatttttttcttttgcctctcaaaatcccc

SEQ ID NO: 404854 - DNA, 43 bp, Artificial Sequence
  Description of Artificial Sequence: Synthetic oligonucleotide
tactgttgaatcgcatttttttcttttgcctctcaaaatcccc

SEQ ID NO: 404855 - DNA, 42 bp, Artificial Sequence
  Description of Artificial Sequence: Synthetic oligonucleotide
actgttgaatcgcatttttttcttttgcctctcaaaatcccc

SEQ ID NO: 404856 - DNA, 41 bp, Artificial Sequence
  Description of Artificial Sequence: Synthetic oligonucleotide
ctgttgaatcgcatttttttcttttgcctctcaaaatcccc

SEQ ID NO: 404857 - DNA, 41 bp, Artificial Sequence
  Description of Artificial Sequence: Synthetic oligonucleotide
tgttgaatcgcatttttttcttttgcctctcaaaatccccg

SEQ ID NO: 404858 - DNA, 40 bp, Artificial Sequence
  Description of Artificial Sequence: Synthetic oligonucleotide
gttgaatcgcatttttttcttttgcctctcaaaatccccg

SEQ ID NO: 404859 - DNA, 41 bp, Artificial Sequence
  Description of Artificial Sequence: Synthetic oligonucleotide
ttgaatcgcatttttttcttttgcctctcaaaatccccgag

SEQ ID NO: 404860 - DNA, 40 bp, Artificial Sequence
  Description of Artificial Sequence: Synthetic oligonucleotide
tgaatcgcatttttttcttttgcctctcaaaatccccgag

SEQ ID NO: 404861 - DNA, 39 bp, Artificial Sequence
  Description of Artificial Sequence: Synthetic oligonucleotide
gaatcgcatttttttcttttgcctctcaaaatccccgag

SEQ ID NO: 404862 - DNA, 39 bp, Artificial Sequence
  Description of Artificial Sequence: Synthetic oligonucleotide
aatcgcatttttttcttttgcctctcaaaatccccgagg

SEQ ID NO: 404863 - DNA, 38 bp, Artificial Sequence
  Description of Artificial Sequence: Synthetic oligonucleotide
atcgcatttttttcttttgcctctcaaaatccccgagg

SEQ ID NO: 404864 - DNA, 37 bp, Artificial Sequence
  Description of Artificial Sequence: Synthetic oligonucleotide
tcgcatttttttcttttgcctctcaaaatccccgagg

SEQ ID NO: 404865 - DNA, 36 bp, Artificial Sequence
  Description of Artificial Sequence: Synthetic oligonucleotide
cgcatttttttcttttgcctctcaaaatccccgagg

SEQ ID NO: 404866 - DNA, 36 bp, Artificial Sequence
  Description of Artificial Sequence: Synthetic oligonucleotide
gcatttttttcttttgcctctcaaaatccccgaggc

SEQ ID NO: 404867 - DNA, 39 bp, Artificial Sequence
  Description of Artificial Sequence: Synthetic oligonucleotide
catttttttcttttgcctctcaaaatccccgaggcattc

SEQ ID NO: 404868 - DNA, 39 bp, Artificial Sequence
  Description of Artificial Sequence: Synthetic oligonucleotide
atttttttcttttgcctctcaaaatccccgaggcattcg

SEQ ID NO: 404869 - DNA, 38 bp, Artificial Sequence
  Description of Artificial Sequence: Synthetic oligonucleotide
tttttttcttttgcctctcaaaatccccgaggcattcg

SEQ ID NO: 404870 - DNA, 37 bp, Artificial Sequence
  Description of Artificial Sequence: Synthetic oligonucleotide
ttttttcttttgcctctcaaaatccccgaggcattcg

SEQ ID NO: 404871 - DNA, 36 bp, Artificial Sequence
  Description of Artificial Sequence: Synthetic oligonucleotide
tttttcttttgcctctcaaaatccccgaggcattcg

SEQ ID NO: 404872 - DNA, 35 bp, Artificial Sequence
  Description of Artificial Sequence: Synthetic oligonucleotide
ttttcttttgcctctcaaaatccccgaggcattcg

SEQ ID NO: 404873 - DNA, 34 bp, Artificial Sequence
  Description of Artificial Sequence: Synthetic oligonucleotide
tttcttttgcctctcaaaatccccgaggcattcg

SEQ ID NO: 404874 - DNA, 33 bp, Artificial Sequence
  Description of Artificial Sequence: Synthetic oligonucleotide
ttcttttgcctctcaaaatccccgaggcattcg

SEQ ID NO: 404875 - DNA, 32 bp, Artificial Sequence
  Description of Artificial Sequence: Synthetic oligonucleotide
tcttttgcctctcaaaatccccgaggcattcg

SEQ ID NO: 404876 - DNA, 31 bp, Artificial Sequence
  Description of Artificial Sequence: Synthetic oligonucleotide
cttttgcctctcaaaatccccgaggcattcg

SEQ ID NO: 404877 - DNA, 33 bp, Artificial Sequence
  Description of Artificial Sequence: Synthetic oligonucleotide
ttttgcctctcaaaatccccgaggcattcgttc

SEQ ID NO: 404878 - DNA, 32 bp, Artificial Sequence
  Description of Artificial Sequence: Synthetic oligonucleotide
tttgcctctcaaaatccccgaggcattcgttc

SEQ ID NO: 404879 - DNA, 31 bp, Artificial Sequence
  Description of Artificial Sequence: Synthetic oligonucleotide
ttgcctctcaaaatccccgaggcattcgttc

SEQ ID NO: 404880 - DNA, 30 bp, Artificial Sequence
  Description of Artificial Sequence: Synthetic oligonucleotide
tgcctctcaaaatccccgaggcattcgttc

SEQ ID NO: 404881 - DNA, 29 bp, Artificial Sequence
  Description of Artificial Sequence: Synthetic oligonucleotide
gcctctcaaaatccccgaggcattcgttc

SEQ ID NO: 404882 - DNA, 31 bp, Artificial Sequence
  Description of Artificial Sequence: Synthetic oligonucleotide
cctctcaaaatccccgaggcattcgttcttc

SEQ ID NO: 404883 - DNA, 32 bp, Artificial Sequence
  Description of Artificial Sequence: Synthetic oligonucleotide
ctctcaaaatccccgaggcattcgttcttcag

SEQ ID NO: 404884 - DNA, 32 bp, Artificial Sequence
  Description of Artificial Sequence: Synthetic oligonucleotide
tctcaaaatccccgaggcattcgttcttcagc

SEQ ID NO: 404885 - DNA, 31 bp, Artificial Sequence
  Description of Artificial Sequence: Synthetic oligonucleotide
ctcaaaatccccgaggcattcgttcttcagc

SEQ ID NO: 404886 - DNA, 32 bp, Artificial Sequence
  Description of Artificial Sequence: Synthetic oligonucleotide
tcaaaatccccgaggcattcgttcttcagctc

SEQ ID NO: 404887 - DNA, 31 bp, Artificial Sequence
  Description of Artificial Sequence: Synthetic oligonucleotide
caaaatccccgaggcattcgttcttcagctc

SEQ ID NO: 404888 - DNA, 33 bp, Artificial Sequence
  Description of Artificial Sequence: Synthetic oligonucleotide
aaaatccccgaggcattcgttcttcagctcttc

SEQ ID NO: 404889 - DNA, 32 bp, Artificial Sequence
  Description of Artificial Sequence: Synthetic oligonucleotide
aaatccccgaggcattcgttcttcagctcttc

SEQ ID NO: 404890 - DNA, 31 bp, Artificial Sequence
  Description of Artificial Sequence: Synthetic oligonucleotide
aatccccgaggcattcgttcttcagctcttc

SEQ ID NO: 404891 - DNA, 30 bp, Artificial Sequence
  Description of Artificial Sequence: Synthetic oligonucleotide
atccccgaggcattcgttcttcagctcttc

SEQ ID NO: 404892 - DNA, 29 bp, Artificial Sequence
  Description of Artificial Sequence: Synthetic oligonucleotide
tccccgaggcattcgttcttcagctcttc

SEQ ID NO: 404893 - DNA, 28 bp, Artificial Sequence
  Description of Artificial Sequence: Synthetic oligonucleotide
ccccgaggcattcgttcttcagctcttc

SEQ ID NO: 404894 - DNA, 34 bp, Artificial Sequence
  Description of Artificial Sequence: Synthetic oligonucleotide
cccgaggcattcgttcttcagctcttctataatc

SEQ ID NO: 404895 - DNA, 34 bp, Artificial Sequence
  Description of Artificial Sequence: Synthetic oligonucleotide
ccgaggcattcgttcttcagctcttctataatcg

SEQ ID NO: 404896 - DNA, 35 bp, Artificial Sequence
  Description of Artificial Sequence: Synthetic oligonucleotide
cgaggcattcgttcttcagctcttctataatcgag

SEQ ID NO: 404897 - DNA, 36 bp, Artificial Sequence
  Description of Artificial Sequence: Synthetic oligonucleotide
gaggcattcgttcttcagctcttctataatcgagag

SEQ ID NO: 404898 - DNA, 36 bp, Artificial Sequence
  Description of Artificial Sequence: Synthetic oligonucleotide
aggcattcgttcttcagctcttctataatcgagagg

SEQ ID NO: 404899 - DNA, 35 bp, Artificial Sequence
  Description of Artificial Sequence: Synthetic oligonucleotide
ggcattcgttcttcagctcttctataatcgagagg

SEQ ID NO: 404900 - DNA, 42 bp, Artificial Sequence
  Description of Artificial Sequence: Synthetic oligonucleotide
gcattcgttcttcagctcttctataatcgagaggaaattttc

SEQ ID NO: 404901 - DNA, 43 bp, Artificial Sequence
  Description of Artificial Sequence: Synthetic oligonucleotide
cattcgttcttcagctcttctataatcgagaggaaattttcac

SEQ ID NO: 404902 - DNA, 43 bp, Artificial Sequence
  Description of Artificial Sequence: Synthetic oligonucleotide
attcgttcttcagctcttctataatcgagaggaaattttcacc

SEQ ID NO: 404903 - DNA, 42 bp, Artificial Sequence
  Description of Artificial Sequence: Synthetic oligonucleotide
ttcgttcttcagctcttctataatcgagaggaaattttcacc

SEQ ID NO: 404904 - DNA, 41 bp, Artificial Sequence
  Description of Artificial Sequence: Synthetic oligonucleotide
tcgttcttcagctcttctataatcgagaggaaattttcacc

SEQ ID NO: 404905 - DNA, 40 bp, Artificial Sequence
  Description of Artificial Sequence: Synthetic oligonucleotide
cgttcttcagctcttctataatcgagaggaaattttcacc

SEQ ID NO: 404906 - DNA, 43 bp, Artificial Sequence
  Description of Artificial Sequence: Synthetic oligonucleotide
tataatcgagaggaaattttcacctcagatgttcatccagtac

SEQ ID NO: 404907 - DNA, 42 bp, Artificial Sequence
  Description of Artificial Sequence: Synthetic oligonucleotide
ataatcgagaggaaattttcacctcagatgttcatccagtac

SEQ ID NO: 404908 - DNA, 41 bp, Artificial Sequence
  Description of Artificial Sequence: Synthetic oligonucleotide
taatcgagaggaaattttcacctcagatgttcatccagtac

SEQ ID NO: 404909 - DNA, 40 bp, Artificial Sequence
  Description of Artificial Sequence: Synthetic oligonucleotide
aatcgagaggaaattttcacctcagatgttcatccagtac

SEQ ID NO: 404910 - DNA, 39 bp, Artificial Sequence
  Description of Artificial Sequence: Synthetic oligonucleotide
atcgagaggaaattttcacctcagatgttcatccagtac

SEQ ID NO: 404911 - DNA, 38 bp, Artificial Sequence
  Description of Artificial Sequence: Synthetic oligonucleotide
tcgagaggaaattttcacctcagatgttcatccagtac

SEQ ID NO: 404912 - DNA, 37 bp, Artificial Sequence
  Description of Artificial Sequence: Synthetic oligonucleotide
cgagaggaaattttcacctcagatgttcatccagtac

SEQ ID NO: 404913 - DNA, 42 bp, Artificial Sequence
  Description of Artificial Sequence: Synthetic oligonucleotide
gagaggaaattttcacctcagatgttcatccagtacaatttg

SEQ ID NO: 404914 - DNA, 44 bp, Artificial Sequence
  Description of Artificial Sequence: Synthetic oligonucleotide
agaggaaattttcacctcagatgttcatccagtacaatttgaag

SEQ ID NO: 404915 - DNA, 43 bp, Artificial Sequence
  Description of Artificial Sequence: Synthetic oligonucleotide
gaggaaattttcacctcagatgttcatccagtacaatttgaag

SEQ ID NO: 404916 - DNA, 44 bp, Artificial Sequence
  Description of Artificial Sequence: Synthetic oligonucleotide
aggaaattttcacctcagatgttcatccagtacaatttgaagac

SEQ ID NO: 404917 - DNA, 43 bp, Artificial Sequence
  Description of Artificial Sequence: Synthetic oligonucleotide
ggaaattttcacctcagatgttcatccagtacaatttgaagac

SEQ ID NO: 404918 - DNA, 43 bp, Artificial Sequence
  Description of Artificial Sequence: Synthetic oligonucleotide
gaaattttcacctcagatgttcatccagtacaatttgaagacg

SEQ ID NO: 404919 - DNA, 44 bp, Artificial Sequence
  Description of Artificial Sequence: Synthetic oligonucleotide
aaattttcacctcagatgttcatccagtacaatttgaagacgtc

SEQ ID NO: 404920 - DNA, 43 bp, Artificial Sequence
  Description of Artificial Sequence: Synthetic oligonucleotide
aattttcacctcagatgttcatccagtacaatttgaagacgtc

SEQ ID NO: 404921 - DNA, 42 bp, Artificial Sequence
  Description of Artificial Sequence: Synthetic oligonucleotide
attttcacctcagatgttcatccagtacaatttgaagacgtc

SEQ ID NO: 404922 - DNA, 41 bp, Artificial Sequence
  Description of Artificial Sequence: Synthetic oligonucleotide
ttttcacctcagatgttcatccagtacaatttgaagacgtc

SEQ ID NO: 404923 - DNA, 40 bp, Artificial Sequence
  Description of Artificial Sequence: Synthetic oligonucleotide
tttcacctcagatgttcatccagtacaatttgaagacgtc

SEQ ID NO: 404924 - DNA, 39 bp, Artificial Sequence
  Description of Artificial Sequence: Synthetic oligonucleotide
ttcacctcagatgttcatccagtacaatttgaagacgtc

SEQ ID NO: 404925 - DNA, 38 bp, Artificial Sequence
  Description of Artificial Sequence: Synthetic oligonucleotide
tcacctcagatgttcatccagtacaatttgaagacgtc

SEQ ID NO: 404926 - DNA, 37 bp, Artificial Sequence
  Description of Artificial Sequence: Synthetic oligonucleotide
cacctcagatgttcatccagtacaatttgaagacgtc

SEQ ID NO: 404927 - DNA, 38 bp, Artificial Sequence
  Description of Artificial Sequence: Synthetic oligonucleotide
acctcagatgttcatccagtacaatttgaagacgtcac

SEQ ID NO: 404928 - DNA, 37 bp, Artificial Sequence
  Description of Artificial Sequence: Synthetic oligonucleotide
cctcagatgttcatccagtacaatttgaagacgtcac

SEQ ID NO: 404929 - DNA, 38 bp, Artificial Sequence
  Description of Artificial Sequence: Synthetic oligonucleotide
ctcagatgttcatccagtacaatttgaagacgtcacag

SEQ ID NO: 404930 - DNA, 39 bp, Artificial Sequence
  Description of Artificial Sequence: Synthetic oligonucleotide
tcagatgttcatccagtacaatttgaagacgtcacagtg

SEQ ID NO: 404931 - DNA, 38 bp, Artificial Sequence
  Description of Artificial Sequence: Synthetic oligonucleotide
cagatgttcatccagtacaatttgaagacgtcacagtg

SEQ ID NO: 404932 - DNA, 38 bp, Artificial Sequence
  Description of Artificial Sequence: Synthetic oligonucleotide
agatgttcatccagtacaatttgaagacgtcacagtgc

SEQ ID NO: 404933 - DNA, 37 bp, Artificial Sequence
  Description of Artificial Sequence: Synthetic oligonucleotide
gatgttcatccagtacaatttgaagacgtcacagtgc

SEQ ID NO: 404934 - DNA, 37 bp, Artificial Sequence
  Description of Artificial Sequence: Synthetic oligonucleotide
atgttcatccagtacaatttgaagacgtcacagtgcc

SEQ ID NO: 404935 - DNA, 36 bp, Artificial Sequence
  Description of Artificial Sequence: Synthetic oligonucleotide
tgttcatccagtacaatttgaagacgtcacagtgcc

SEQ ID NO: 404936 - DNA, 35 bp, Artificial Sequence
  Description of Artificial Sequence: Synthetic oligonucleotide
gttcatccagtacaatttgaagacgtcacagtgcc

SEQ ID NO: 404937 - DNA, 36 bp, Artificial Sequence
  Description of Artificial Sequence: Synthetic oligonucleotide
ttcatccagtacaatttgaagacgtcacagtgccag

SEQ ID NO: 404938 - DNA, 35 bp, Artificial Sequence
  Description of Artificial Sequence: Synthetic oligonucleotide
tcatccagtacaatttgaagacgtcacagtgccag

SEQ ID NO: 404939 - DNA, 34 bp, Artificial Sequence
  Description of Artificial Sequence: Synthetic oligonucleotide
catccagtacaatttgaagacgtcacagtgccag

SEQ ID NO: 404940 - DNA, 34 bp, Artificial Sequence
  Description of Artificial Sequence: Synthetic oligonucleotide
atccagtacaatttgaagacgtcacagtgccagg

SEQ ID NO: 404941 - DNA, 33 bp, Artificial Sequence
  Description of Artificial Sequence: Synthetic oligonucleotide
tccagtacaatttgaagacgtcacagtgccagg

SEQ ID NO: 404942 - DNA, 32 bp, Artificial Sequence
  Description of Artificial Sequence: Synthetic oligonucleotide
ccagtacaatttgaagacgtcacagtgccagg

SEQ ID NO: 404943 - DNA, 32 bp, Artificial Sequence
  Description of Artificial Sequence: Synthetic oligonucleotide
cagtacaatttgaagacgtcacagtgccaggc

SEQ ID NO: 404944 - DNA, 33 bp, Artificial Sequence
  Description of Artificial Sequence: Synthetic oligonucleotide
agtacaatttgaagacgtcacagtgccaggcac

SEQ ID NO: 404945 - DNA, 32 bp, Artificial Sequence
  Description of Artificial Sequence: Synthetic oligonucleotide
gtacaatttgaagacgtcacagtgccaggcac

SEQ ID NO: 404946 - DNA, 33 bp, Artificial Sequence
  Description of Artificial Sequence: Synthetic oligonucleotide
tacaatttgaagacgtcacagtgccaggcactg

SEQ ID NO: 404947 - DNA, 32 bp, Artificial Sequence
  Description of Artificial Sequence: Synthetic oligonucleotide
acaatttgaagacgtcacagtgccaggcactg

SEQ ID NO: 404948 - DNA, 31 bp, Artificial Sequence
  Description of Artificial Sequence: Synthetic oligonucleotide
caatttgaagacgtcacagtgccaggcactg

SEQ ID NO: 404949 - DNA, 31 bp, Artificial Sequence
  Description of Artificial Sequence: Synthetic oligonucleotide
aatttgaagacgtcacagtgccaggcactgg

SEQ ID NO: 404950 - DNA, 30 bp, Artificial Sequence
  Description of Artificial Sequence: Synthetic oligonucleotide
atttgaagacgtcacagtgccaggcactgg

SEQ ID NO: 404951 - DNA, 29 bp, Artificial Sequence
  Description of Artificial Sequence: Synthetic oligonucleotide
tttgaagacgtcacagtgccaggcactgg

SEQ ID NO: 404952 - DNA, 28 bp, Artificial Sequence
  Description of Artificial Sequence: Synthetic oligonucleotide
ttgaagacgtcacagtgccaggcactgg

SEQ ID NO: 404953 - DNA, 27 bp, Artificial Sequence
  Description of Artificial Sequence: Synthetic oligonucleotide
tgaagacgtcacagtgccaggcactgg

SEQ ID NO: 404954 - DNA, 32 bp, Artificial Sequence
  Description of Artificial Sequence: Synthetic oligonucleotide
cttcagctccagtgctgattggttcttttccg

SEQ ID NO: 404955 - DNA, 33 bp, Artificial Sequence
  Description of Artificial Sequence: Synthetic oligonucleotide
ttcagctccagtgctgattggttcttttccgag

SEQ ID NO: 404956 - DNA, 32 bp, Artificial Sequence
  Description of Artificial Sequence: Synthetic oligonucleotide
tcagctccagtgctgattggttcttttccgag

SEQ ID NO: 404957 - DNA, 31 bp, Artificial Sequence
  Description of Artificial Sequence: Synthetic oligonucleotide
cagctccagtgctgattggttcttttccgag

SEQ ID NO: 404958 - DNA, 31 bp, Artificial Sequence
  Description of Artificial Sequence: Synthetic oligonucleotide
agctccagtgctgattggttcttttccgagg

SEQ ID NO: 404959 - DNA, 30 bp, Artificial Sequence
  Description of Artificial Sequence: Synthetic oligonucleotide
gctccagtgctgattggttcttttccgagg

SEQ ID NO: 404960 - DNA, 30 bp, Artificial Sequence
  Description of Artificial Sequence: Synthetic oligonucleotide
ctccagtgctgattggttcttttccgaggg

SEQ ID NO: 404961 - DNA, 31 bp, Artificial Sequence
  Description of Artificial Sequence: Synthetic oligonucleotide
tccagtgctgattggttcttttccgagggac

SEQ ID NO: 404962 - DNA, 30 bp, Artificial Sequence
  Description of Artificial Sequence: Synthetic oligonucleotide
ccagtgctgattggttcttttccgagggac

SEQ ID NO: 404963 - DNA, 30 bp, Artificial Sequence
  Description of Artificial Sequence: Synthetic oligonucleotide
cagtgctgattggttcttttccgagggacc

SEQ ID NO: 404964 - DNA, 32 bp, Artificial Sequence
  Description of Artificial Sequence: Synthetic oligonucleotide
agtgctgattggttcttttccgagggaccatc

SEQ ID NO: 404965 - DNA, 31 bp, Artificial Sequence
  Description of Artificial Sequence: Synthetic oligonucleotide
gtgctgattggttcttttccgagggaccatc

SEQ ID NO: 404966 - DNA, 31 bp, Artificial Sequence
  Description of Artificial Sequence: Synthetic oligonucleotide
tgctgattggttcttttccgagggaccatcc

SEQ ID NO: 404967 - DNA, 30 bp, Artificial Sequence
  Description of Artificial Sequence: Synthetic oligonucleotide
gctgattggttcttttccgagggaccatcc

SEQ ID NO: 404968 - DNA, 33 bp, Artificial Sequence
  Description of Artificial Sequence: Synthetic oligonucleotide
ctgattggttcttttccgagggaccatccaatc

SEQ ID NO: 404969 - DNA, 33 bp, Artificial Sequence
  Description of Artificial Sequence: Synthetic oligonucleotide
tgattggttcttttccgagggaccatccaatcc

SEQ ID NO: 404970 - DNA, 32 bp, Artificial Sequence
  Description of Artificial Sequence: Synthetic oligonucleotide
gattggttcttttccgagggaccatccaatcc

SEQ ID NO: 404971 - DNA, 33 bp, Artificial Sequence
  Description of Artificial Sequence: Synthetic oligonucleotide
attggttcttttccgagggaccatccaatcctg

SEQ ID NO: 404972 - DNA, 32 bp, Artificial Sequence
  Description of Artificial Sequence: Synthetic oligonucleotide
ttggttcttttccgagggaccatccaatcctg

SEQ ID NO: 404973 - DNA, 31 bp, Artificial Sequence
  Description of Artificial Sequence: Synthetic oligonucleotide
tggttcttttccgagggaccatccaatcctg

SEQ ID NO: 404974 - DNA, 30 bp, Artificial Sequence
  Description of Artificial Sequence: Synthetic oligonucleotide
ggttcttttccgagggaccatccaatcctg

SEQ ID NO: 404975 - DNA, 30 bp, Artificial Sequence
  Description of Artificial Sequence: Synthetic oligonucleotide
gttcttttccgagggaccatccaatcctgc

SEQ ID NO: 404976 - DNA, 30 bp, Artificial Sequence
  Description of Artificial Sequence: Synthetic oligonucleotide
ttcttttccgagggaccatccaatcctgcc

SEQ ID NO: 404977 - DNA, 29 bp, Artificial Sequence
  Description of Artificial Sequence: Synthetic oligonucleotide
tcttttccgagggaccatccaatcctgcc

SEQ ID NO: 404978 - DNA, 28 bp, Artificial Sequence
  Description of Artificial Sequence: Synthetic oligonucleotide
cttttccgagggaccatccaatcctgcc

SEQ ID NO: 404979 - DNA, 29 bp, Artificial Sequence
  Description of Artificial Sequence: Synthetic oligonucleotide
ttttccgagggaccatccaatcctgccac

SEQ ID NO: 404980 - DNA, 28 bp, Artificial Sequence
  Description of Artificial Sequence: Synthetic oligonucleotide
tttccgagggaccatccaatcctgccac

SEQ ID NO: 404981 - DNA, 27 bp, Artificial Sequence
  Description of Artificial Sequence: Synthetic oligonucleotide
ttccgagggaccatccaatcctgccac

SEQ ID NO: 404982 - DNA, 27 bp, Artificial Sequence
  Description of Artificial Sequence: Synthetic oligonucleotide
tccgagggaccatccaatcctgccact

SEQ ID NO: 404983 - DNA, 26 bp, Artificial Sequence
  Description of Artificial Sequence: Synthetic oligonucleotide
ccgagggaccatccaatcctgccact

SEQ ID NO: 404984 - DNA, 27 bp, Artificial Sequence
  Description of Artificial Sequence: Synthetic oligonucleotide
cgagggaccatccaatcctgccactca

SEQ ID NO: 404985 - DNA, 27 bp, Artificial Sequence
  Description of Artificial Sequence: Synthetic oligonucleotide
gagggaccatccaatcctgccactcac

SEQ ID NO: 404986 - DNA, 27 bp, Artificial Sequence
  Description of Artificial Sequence: Synthetic oligonucleotide
agggaccatccaatcctgccactcacg

SEQ ID NO: 404987 - DNA, 26 bp, Artificial Sequence
  Description of Artificial Sequence: Synthetic oligonucleotide
gggaccatccaatcctgccactcacg

SEQ ID NO: 404988 - DNA, 27 bp, Artificial Sequence
  Description of Artificial Sequence: Synthetic oligonucleotide
ggaccatccaatcctgccactcacgga

SEQ ID NO: 404989 - DNA, 29 bp, Artificial Sequence
  Description of Artificial Sequence: Synthetic oligonucleotide
gaccatccaatcctgccactcacggaaac

SEQ ID NO: 404990 - DNA, 31 bp, Artificial Sequence
  Description of Artificial Sequence: Synthetic oligonucleotide
accatccaatcctgccactcacggaaacatc

SEQ ID NO: 404991 - DNA, 30 bp, Artificial Sequence
  Description of Artificial Sequence: Synthetic oligonucleotide
ccatccaatcctgccactcacggaaacatc

SEQ ID NO: 404992 - DNA, 30 bp, Artificial Sequence
  Description of Artificial Sequence: Synthetic oligonucleotide
catccaatcctgccactcacggaaacatcc

SEQ ID NO: 404993 - DNA, 31 bp, Artificial Sequence
  Description of Artificial Sequence: Synthetic oligonucleotide
atccaatcctgccactcacggaaacatccac

SEQ ID NO: 404994 - DNA, 30 bp, Artificial Sequence
  Description of Artificial Sequence: Synthetic oligonucleotide
tccaatcctgccactcacggaaacatccac

SEQ ID NO: 404995 - DNA, 29 bp, Artificial Sequence
  Description of Artificial Sequence: Synthetic oligonucleotide
ccaatcctgccactcacggaaacatccac

SEQ ID NO: 404996 - DNA, 30 bp, Artificial Sequence
  Description of Artificial Sequence: Synthetic oligonucleotide
caatcctgccactcacggaaacatccacag

SEQ ID NO: 404997 - DNA, 30 bp, Artificial Sequence
  Description of Artificial Sequence: Synthetic oligonucleotide
aatcctgccactcacggaaacatccacagg

SEQ ID NO: 404998 - DNA, 29 bp, Artificial Sequence
  Description of Artificial Sequence: Synthetic oligonucleotide
atcctgccactcacggaaacatccacagg

SEQ ID NO: 404999 - DNA, 28 bp, Artificial Sequence
  Description of Artificial Sequence: Synthetic oligonucleotide
tcctgccactcacggaaacatccacagg

SEQ ID NO: 405000 - DNA, 27 bp, Artificial Sequence
  Description of Artificial Sequence: Synthetic oligonucleotide
cctgccactcacggaaacatccacagg

SEQ ID NO: 405001 - DNA, 35 bp, Artificial Sequence
  Description of Artificial Sequence: Synthetic oligonucleotide
ctgccactcacggaaacatccacaggtttttattc

SEQ ID NO: 405002 - DNA, 38 bp, Artificial Sequence
  Description of Artificial Sequence: Synthetic oligonucleotide
tgccactcacggaaacatccacaggtttttattctttc

SEQ ID NO: 405003 - DNA, 37 bp, Artificial Sequence
  Description of Artificial Sequence: Synthetic oligonucleotide
gccactcacggaaacatccacaggtttttattctttc

SEQ ID NO: 405004 - DNA, 38 bp, Artificial Sequence
  Description of Artificial Sequence: Synthetic oligonucleotide
ccactcacggaaacatccacaggtttttattctttctg

SEQ ID NO: 405005 - DNA, 38 bp, Artificial Sequence
  Description of Artificial Sequence: Synthetic oligonucleotide
cactcacggaaacatccacaggtttttattctttctgc

SEQ ID NO: 405006 - DNA, 38 bp, Artificial Sequence
  Description of Artificial Sequence: Synthetic oligonucleotide
actcacggaaacatccacaggtttttattctttctgcc

SEQ ID NO: 405007 - DNA, 37 bp, Artificial Sequence
  Description of Artificial Sequence: Synthetic oligonucleotide
ctcacggaaacatccacaggtttttattctttctgcc

SEQ ID NO: 405008 - DNA, 38 bp, Artificial Sequence
  Description of Artificial Sequence: Synthetic oligonucleotide
tcacggaaacatccacaggtttttattctttctgccag

SEQ ID NO: 405009 - DNA, 30 bp, Artificial Sequence
  Description of Artificial Sequence: Synthetic oligonucleotide
atcaggtccgagctgtgttgactaccactg

SEQ ID NO: 405010 - DNA, 29 bp, Artificial Sequence
  Description of Artificial Sequence: Synthetic oligonucleotide
tcaggtccgagctgtgttgactaccactg

SEQ ID NO: 405011 - DNA, 28 bp, Artificial Sequence
  Description of Artificial Sequence: Synthetic oligonucleotide
caggtccgagctgtgttgactaccactg

SEQ ID NO: 405012 - DNA, 28 bp, Artificial Sequence
  Description of Artificial Sequence: Synthetic oligonucleotide
aggtccgagctgtgttgactaccactgc

SEQ ID NO: 405013 - DNA, 27 bp, Artificial Sequence
  Description of Artificial Sequence: Synthetic oligonucleotide
ggtccgagctgtgttgactaccactgc

SEQ ID NO: 405014 - DNA, 31 bp, Artificial Sequence
  Description of Artificial Sequence: Synthetic oligonucleotide
gtccgagctgtgttgactaccactgcttttc

SEQ ID NO: 405015 - DNA, 31 bp, Artificial Sequence
  Description of Artificial Sequence: Synthetic oligonucleotide
tccgagctgtgttgactaccactgcttttcc

SEQ ID NO: 405016 - DNA, 30 bp, Artificial Sequence
  Description of Artificial Sequence: Synthetic oligonucleotide
ccgagctgtgttgactaccactgcttttcc

SEQ ID NO: 405017 - DNA, 30 bp, Artificial Sequence
  Description of Artificial Sequence: Synthetic oligonucleotide
cgagctgtgttgactaccactgcttttccc

SEQ ID NO: 405018 - DNA, 32 bp, Artificial Sequence
  Description of Artificial Sequence: Synthetic oligonucleotide
gagctgtgttgactaccactgcttttcccttc

SEQ ID NO: 405019 - DNA, 32 bp, Artificial Sequence
  Description of Artificial Sequence: Synthetic oligonucleotide
agctgtgttgactaccactgcttttcccttcg

SEQ ID NO: 405020 - DNA, 31 bp, Artificial Sequence
  Description of Artificial Sequence: Synthetic oligonucleotide
gctgtgttgactaccactgcttttcccttcg

SEQ ID NO: 405021 - DNA, 32 bp, Artificial Sequence
  Description of Artificial Sequence: Synthetic oligonucleotide
ctgtgttgactaccactgcttttcccttcgtc

SEQ ID NO: 405022 - DNA, 33 bp, Artificial Sequence
  Description of Artificial Sequence: Synthetic oligonucleotide
tgtgttgactaccactgcttttcccttcgtctc

SEQ ID NO: 405023 - DNA, 32 bp, Artificial Sequence
  Description of Artificial Sequence: Synthetic oligonucleotide
gtgttgactaccactgcttttcccttcgtctc

SEQ ID NO: 405024 - DNA, 33 bp, Artificial Sequence
  Description of Artificial Sequence: Synthetic oligonucleotide
tgttgactaccactgcttttcccttcgtctcag

SEQ ID NO: 405025 - DNA, 32 bp, Artificial Sequence
  Description of Artificial Sequence: Synthetic oligonucleotide
gttgactaccactgcttttcccttcgtctcag

SEQ ID NO: 405026 - DNA, 36 bp, Artificial Sequence
  Description of Artificial Sequence: Synthetic oligonucleotide
ttgactaccactgcttttcccttcgtctcagttatg

SEQ ID NO: 405027 - DNA, 35 bp, Artificial Sequence
  Description of Artificial Sequence: Synthetic oligonucleotide
tgactaccactgcttttcccttcgtctcagttatg

SEQ ID NO: 405028 - DNA, 34 bp, Artificial Sequence
  Description of Artificial Sequence: Synthetic oligonucleotide
gactaccactgcttttcccttcgtctcagttatg

SEQ ID NO: 405029 - DNA, 35 bp, Artificial Sequence
  Description of Artificial Sequence: Synthetic oligonucleotide
actaccactgcttttcccttcgtctcagttatgtc

SEQ ID NO: 405030 - DNA, 34 bp, Artificial Sequence
  Description of Artificial Sequence: Synthetic oligonucleotide
ctaccactgcttttcccttcgtctcagttatgtc

SEQ ID NO: 405031 - DNA, 36 bp, Artificial Sequence
  Description of Artificial Sequence: Synthetic oligonucleotide
taccactgcttttcccttcgtctcagttatgtcttg

SEQ ID NO: 405032 - DNA, 35 bp, Artificial Sequence
  Description of Artificial Sequence: Synthetic oligonucleotide
accactgcttttcccttcgtctcagttatgtcttg

SEQ ID NO: 405033 - DNA, 34 bp, Artificial Sequence
  Description of Artificial Sequence: Synthetic oligonucleotide
ccactgcttttcccttcgtctcagttatgtcttg

SEQ ID NO: 405034 - DNA, 34 bp, Artificial Sequence
  Description of Artificial Sequence: Synthetic oligonucleotide
cactgcttttcccttcgtctcagttatgtcttgg

SEQ ID NO: 405035 - DNA, 36 bp, Artificial Sequence
  Description of Artificial Sequence: Synthetic oligonucleotide
actgcttttcccttcgtctcagttatgtcttggaag

SEQ ID NO: 405036 - DNA, 35 bp, Artificial Sequence
  Description of Artificial Sequence: Synthetic oligonucleotide
ctgcttttcccttcgtctcagttatgtcttggaag

SEQ ID NO: 405037 - DNA, 37 bp, Artificial Sequence
  Description of Artificial Sequence: Synthetic oligonucleotide
tgcttttcccttcgtctcagttatgtcttggaagaag

SEQ ID NO: 405038 - DNA, 36 bp, Artificial Sequence
  Description of Artificial Sequence: Synthetic oligonucleotide
gcttttcccttcgtctcagttatgtcttggaagaag

SEQ ID NO: 405039 - DNA, 36 bp, Artificial Sequence
  Description of Artificial Sequence: Synthetic oligonucleotide
cttttcccttcgtctcagttatgtcttggaagaagg

SEQ ID NO: 405040 - DNA, 36 bp, Artificial Sequence
  Description of Artificial Sequence: Synthetic oligonucleotide
ttttcccttcgtctcagttatgtcttggaagaaggc

SEQ ID NO: 405041 - DNA, 35 bp, Artificial Sequence
  Description of Artificial Sequence: Synthetic oligonucleotide
tttcccttcgtctcagttatgtcttggaagaaggc

SEQ ID NO: 405042 - DNA, 34 bp, Artificial Sequence
  Description of Artificial Sequence: Synthetic oligonucleotide
ttcccttcgtctcagttatgtcttggaagaaggc

SEQ ID NO: 405043 - DNA, 33 bp, Artificial Sequence
  Description of Artificial Sequence: Synthetic oligonucleotide
tcccttcgtctcagttatgtcttggaagaaggc

SEQ ID NO: 405044 - DNA, 32 bp, Artificial Sequence
  Description of Artificial Sequence: Synthetic oligonucleotide
cccttcgtctcagttatgtcttggaagaaggc

SEQ ID NO: 405045 - DNA, 35 bp, Artificial Sequence
  Description of Artificial Sequence: Synthetic oligonucleotide
ccttcgtctcagttatgtcttggaagaaggctttg

SEQ ID NO: 405046 - DNA, 35 bp, Artificial Sequence
  Description of Artificial Sequence: Synthetic oligonucleotide
cttcgtctcagttatgtcttggaagaaggctttgc

SEQ ID NO: 405047 - DNA, 35 bp, Artificial Sequence
  Description of Artificial Sequence: Synthetic oligonucleotide
ttcgtctcagttatgtcttggaagaaggctttgcg

SEQ ID NO: 405048 - DNA, 34 bp, Artificial Sequence
  Description of Artificial Sequence: Synthetic oligonucleotide
tcgtctcagttatgtcttggaagaaggctttgcg

SEQ ID NO: 405049 - DNA, 33 bp, Artificial Sequence
  Description of Artificial Sequence: Synthetic oligonucleotide
cgtctcagttatgtcttggaagaaggctttgcg

SEQ ID NO: 405050 - DNA, 33 bp, Artificial Sequence
  Description of Artificial Sequence: Synthetic oligonucleotide
gtctcagttatgtcttggaagaaggctttgcgg

SEQ ID NO: 405051 - DNA, 35 bp, Artificial Sequence
  Description of Artificial Sequence: Synthetic oligonucleotide
tctcagttatgtcttggaagaaggctttgcggatc

SEQ ID NO: 405052 - DNA, 34 bp, Artificial Sequence
  Description of Artificial Sequence: Synthetic oligonucleotide
ctcagttatgtcttggaagaaggctttgcggatc

SEQ ID NO: 405053 - DNA, 34 bp, Artificial Sequence
  Description of Artificial Sequence: Synthetic oligonucleotide
tcagttatgtcttggaagaaggctttgcggatcc

SEQ ID NO: 405054 - DNA, 33 bp, Artificial Sequence
  Description of Artificial Sequence: Synthetic oligonucleotide
cagttatgtcttggaagaaggctttgcggatcc

SEQ ID NO: 405055 - DNA, 33 bp, Artificial Sequence
  Description of Artificial Sequence: Synthetic oligonucleotide
agttatgtcttggaagaaggctttgcggatccc

SEQ ID NO: 405056 - DNA, 32 bp, Artificial Sequence
  Description of Artificial Sequence: Synthetic oligonucleotide
gttatgtcttggaagaaggctttgcggatccc

SEQ ID NO: 405057 - DNA, 27 bp, Artificial Sequence
  Description of Artificial Sequence: Synthetic oligonucleotide
gaagaaggctttgcggatccccggaga

SEQ ID NO: 405058 - DNA, 27 bp, Artificial Sequence
  Description of Artificial Sequence: Synthetic oligonucleotide
aagaaggctttgcggatccccggagac

SEQ ID NO: 405059 - DNA, 26 bp, Artificial Sequence
  Description of Artificial Sequence: Synthetic oligonucleotide
agaaggctttgcggatccccggagac

SEQ ID NO: 405060 - DNA, 25 bp, Artificial Sequence
  Description of Artificial Sequence: Synthetic oligonucleotide
gaaggctttgcggatccccggagac

SEQ ID NO: 405061 - DNA, 27 bp, Artificial Sequence
  Description of Artificial Sequence: Synthetic oligonucleotide
aaggctttgcggatccccggagacctt

SEQ ID NO: 405062 - DNA, 26 bp, Artificial Sequence
  Description of Artificial Sequence: Synthetic oligonucleotide
aggctttgcggatccccggagacctt

SEQ ID NO: 405063 - DNA, 25 bp, Artificial Sequence
  Description of Artificial Sequence: Synthetic oligonucleotide
ggctttgcggatccccggagacctt

SEQ ID NO: 405064 - DNA, 25 bp, Artificial Sequence
  Description of Artificial Sequence: Synthetic oligonucleotide
gctttgcggatccccggagaccttc

SEQ ID NO: 405065 - DNA, 30 bp, Artificial Sequence; identical to SEQ ID NO: 61458
  Description of Artificial Sequence: Synthetic oligonucleotide

SEQ ID NO: 405066 - DNA, 30 bp, Artificial Sequence; identical to SEQ ID NO: 61459
  Description of Artificial Sequence: Synthetic oligonucleotide

SEQ ID NO: 405067 - DNA, 29 bp, Artificial Sequence
  Description of Artificial Sequence: Synthetic oligonucleotide
agcaactgtcaccttgatgctggcgatgc

SEQ ID NO: 405068 - DNA, 28 bp, Artificial Sequence
  Description of Artificial Sequence: Synthetic oligonucleotide
gcaactgtcaccttgatgctggcgatgc

SEQ ID NO: 405069 - DNA, 29 bp, Artificial Sequence
  Description of Artificial Sequence: Synthetic oligonucleotide
caactgtcaccttgatgctggcgatgctg

SEQ ID NO: 405070 - DNA, 30 bp, Artificial Sequence; identical to SEQ ID NO: 61463
  Description of Artificial Sequence: Synthetic oligonucleotide

SEQ ID NO: 405071 - DNA, 29 bp, Artificial Sequence
  Description of Artificial Sequence: Synthetic oligonucleotide
actgtcaccttgatgctggcgatgctgag

SEQ ID NO: 405072 - DNA, 28 bp, Artificial Sequence
  Description of Artificial Sequence: Synthetic oligonucleotide
ctgtcaccttgatgctggcgatgctgag

SEQ ID NO: 405073 - DNA, 28 bp, Artificial Sequence
  Description of Artificial Sequence: Synthetic oligonucleotide
tgtcaccttgatgctggcgatgctgagc

SEQ ID NO: 405074 - DNA, 27 bp, Artificial Sequence
  Description of Artificial Sequence: Synthetic oligonucleotide
gtcaccttgatgctggcgatgctgagc

SEQ ID NO: 405075 - DNA, 28 bp, Artificial Sequence
  Description of Artificial Sequence: Synthetic oligonucleotide
tcaccttgatgctggcgatgctgagctc

SEQ ID NO: 405076 - DNA, 27 bp, Artificial Sequence
  Description of Artificial Sequence: Synthetic oligonucleotide
caccttgatgctggcgatgctgagctc

SEQ ID NO: 405077 - DNA, 27 bp, Artificial Sequence
  Description of Artificial Sequence: Synthetic oligonucleotide
accttgatgctggcgatgctgagctcc

SEQ ID NO: 405078 - DNA, 26 bp, Artificial Sequence
  Description of Artificial Sequence: Synthetic oligonucleotide
ccttgatgctggcgatgctgagctcc

SEQ ID NO: 405079 - DNA, 27 bp, Artificial Sequence
  Description of Artificial Sequence: Synthetic oligonucleotide
cttgatgctggcgatgctgagctccct

SEQ ID NO: 405080 - DNA, 28 bp, Artificial Sequence
  Description of Artificial Sequence: Synthetic oligonucleotide
ttgatgctggcgatgctgagctccctac

SEQ ID NO: 405081 - DNA, 27 bp, Artificial Sequence
  Description of Artificial Sequence: Synthetic oligonucleotide
tgatgctggcgatgctgagctccctac

SEQ ID NO: 405082 - DNA, 27 bp, Artificial Sequence
  Description of Artificial Sequence: Synthetic oligonucleotide
gatgctggcgatgctgagctccctact

SEQ ID NO: 405083 - DNA, 27 bp, Artificial Sequence
  Description of Artificial Sequence: Synthetic oligonucleotide
atgctggcgatgctgagctccctactg

SEQ ID NO: 405084 - DNA, 26 bp, Artificial Sequence
  Description of Artificial Sequence: Synthetic oligonucleotide
tgctggcgatgctgagctccctactg

SEQ ID NO: 405085 - DNA, 25 bp, Artificial Sequence
  Description of Artificial Sequence: Synthetic oligonucleotide
gctggcgatgctgagctccctactg

SEQ ID NO: 405086 - DNA, 25 bp, Artificial Sequence
  Description of Artificial Sequence: Synthetic oligonucleotide
ctggcgatgctgagctccctactgg

SEQ ID NO: 405087 - DNA, 26 bp, Artificial Sequence
  Description of Artificial Sequence: Synthetic oligonucleotide
tggcgatgctgagctccctactggct

SEQ ID NO: 405088 - DNA, 25 bp, Artificial Sequence
  Description of Artificial Sequence: Synthetic oligonucleotide
ggcgatgctgagctccctactggct

SEQ ID NO: 405089 - DNA, 26 bp, Artificial Sequence
  Description of Artificial Sequence: Synthetic oligonucleotide
gcgatgctgagctccctactggctga

SEQ ID NO: 405090 - DNA, 26 bp, Artificial Sequence
  Description of Artificial Sequence: Synthetic oligonucleotide
cgatgctgagctccctactggctgag

SEQ ID NO: 405091 - DNA, 26 bp, Artificial Sequence
  Description of Artificial Sequence: Synthetic oligonucleotide
gatgctgagctccctactggctgagg

SEQ ID NO: 405092 - DNA, 26 bp, Artificial Sequence
  Description of Artificial Sequence: Synthetic oligonucleotide
atgctgagctccctactggctgaggg

SEQ ID NO: 405093 - DNA, 25 bp, Artificial Sequence
  Description of Artificial Sequence: Synthetic oligonucleotide
tgctgagctccctactggctgaggg

SEQ ID NO: 405094 - DNA, 24 bp, Artificial Sequence
  Description of Artificial Sequence: Synthetic oligonucleotide
gctgagctccctactggctgaggg

SEQ ID NO: 405095 - DNA, 25 bp, Artificial Sequence
  Description of Artificial Sequence: Synthetic oligonucleotide
ctgagctccctactggctgagggca

SEQ ID NO: 405096 - DNA, 26 bp, Artificial Sequence
  Description of Artificial Sequence: Synthetic oligonucleotide
tgagctccctactggctgagggcaga

SEQ ID NO: 405097 - DNA, 25 bp, Artificial Sequence
  Description of Artificial Sequence: Synthetic oligonucleotide
gagctccctactggctgagggcaga

SEQ ID NO: 405098 - DNA, 26 bp, Artificial Sequence
  Description of Artificial Sequence: Synthetic oligonucleotide
agctccctactggctgagggcagaga

SEQ ID NO: 405099 - DNA, 25 bp, Artificial Sequence
  Description of Artificial Sequence: Synthetic oligonucleotide
gctccctactggctgagggcagaga

SEQ ID NO: 405100 - DNA, 26 bp, Artificial Sequence
  Description of Artificial Sequence: Synthetic oligonucleotide
ctccctactggctgagggcagagact

SEQ ID NO: 405101 - DNA, 27 bp, Artificial Sequence
  Description of Artificial Sequence: Synthetic oligonucleotide
tccctactggctgagggcagagactct

SEQ ID NO: 405102 - DNA, 26 bp, Artificial Sequence
  Description of Artificial Sequence: Synthetic oligonucleotide
ccctactggctgagggcagagactct

SEQ ID NO: 405103 - DNA, 26 bp, Artificial Sequence
  Description of Artificial Sequence: Synthetic oligonucleotide
cctactggctgagggcagagactctc

SEQ ID NO: 405104 - DNA, 26 bp, Artificial Sequence
  Description of Artificial Sequence: Synthetic oligonucleotide
ctactggctgagggcagagactctcc

SEQ ID NO: 405105 - DNA, 26 bp, Artificial Sequence
  Description of Artificial Sequence: Synthetic oligonucleotide
tactggctgagggcagagactctccc

SEQ ID NO: 405106 - DNA, 33 bp, Artificial Sequence; identical to SEQ ID NO: 61499
  Description of Artificial Sequence: Synthetic oligonucleotide

SEQ ID NO: 405107 - DNA, 32 bp, Artificial Sequence; identical to SEQ ID NO: 61500
  Description of Artificial Sequence: Synthetic oligonucleotide

SEQ ID NO: 405108 - DNA, 32 bp, Artificial Sequence; identical to SEQ ID NO: 61501
  Description of Artificial Sequence: Synthetic oligonucleotide

SEQ ID NO: 405109 - DNA, 33 bp, Artificial Sequence; identical to SEQ ID NO: 61502
  Description of Artificial Sequence: Synthetic oligonucleotide

SEQ ID NO: 405110 - DNA, 35 bp, Artificial Sequence; identical to SEQ ID NO: 61503
  Description of Artificial Sequence: Synthetic oligonucleotide

SEQ ID NO: 405111 - DNA, 35 bp, Artificial Sequence; identical to SEQ ID NO: 61504
  Description of Artificial Sequence: Synthetic oligonucleotide

SEQ ID NO: 405112 - DNA, 36 bp, Artificial Sequence; identical to SEQ ID NO: 61505
  Description of Artificial Sequence: Synthetic oligonucleotide

SEQ ID NO: 405113 - DNA, 36 bp, Artificial Sequence; identical to SEQ ID NO: 61506
  Description of Artificial Sequence: Synthetic oligonucleotide

SEQ ID NO: 405114 - DNA, 35 bp, Artificial Sequence; identical to SEQ ID NO: 61507
  Description of Artificial Sequence: Synthetic oligonucleotide

SEQ ID NO: 405115 - DNA, 34 bp, Artificial Sequence; identical to SEQ ID NO: 61508
  Description of Artificial Sequence: Synthetic oligonucleotide

SEQ ID NO: 405116 - DNA, 33 bp, Artificial Sequence; identical to SEQ ID NO: 61509
  Description of Artificial Sequence: Synthetic oligonucleotide

SEQ ID NO: 405117 - DNA, 32 bp, Artificial Sequence; identical to SEQ ID NO: 61510
  Description of Artificial Sequence: Synthetic oligonucleotide

SEQ ID NO: 405118 - DNA, 31 bp, Artificial Sequence; identical to SEQ ID NO: 61511
  Description of Artificial Sequence: Synthetic oligonucleotide

SEQ ID NO: 405119 - DNA, 30 bp, Artificial Sequence; identical to SEQ ID NO: 61512
  Description of Artificial Sequence: Synthetic oligonucleotide

SEQ ID NO: 405120 - DNA, 31 bp, Artificial Sequence; identical to SEQ ID NO: 61513
  Description of Artificial Sequence: Synthetic oligonucleotide

SEQ ID NO: 405121 - DNA, 33 bp, Artificial Sequence; identical to SEQ ID NO: 61514
  Description of Artificial Sequence: Synthetic oligonucleotide

SEQ ID NO: 405122 - DNA, 32 bp, Artificial Sequence; identical to SEQ ID NO: 61515
  Description of Artificial Sequence: Synthetic oligonucleotide

SEQ ID NO: 405123 - DNA, 31 bp, Artificial Sequence; identical to SEQ ID NO: 61516
  Description of Artificial Sequence: Synthetic oligonucleotide

SEQ ID NO: 405124 - DNA, 30 bp, Artificial Sequence; identical to SEQ ID NO: 61517
  Description of Artificial Sequence: Synthetic oligonucleotide

SEQ ID NO: 405125 - DNA, 30 bp, Artificial Sequence; identical to SEQ ID NO: 61518
  Description of Artificial Sequence: Synthetic oligonucleotide

SEQ ID NO: 405126 - DNA, 31 bp, Artificial Sequence; identical to SEQ ID NO: 61519
  Description of Artificial Sequence: Synthetic oligonucleotide

SEQ ID NO: 405127 - DNA, 30 bp, Artificial Sequence; identical to SEQ ID NO: 61520
  Description of Artificial Sequence: Synthetic oligonucleotide

SEQ ID NO: 405128 - DNA, 30 bp, Artificial Sequence; identical to SEQ ID NO: 61521
  Description of Artificial Sequence: Synthetic oligonucleotide

SEQ ID NO: 405129 - DNA, 29 bp, Artificial Sequence
  Description of Artificial Sequence: Synthetic oligonucleotide
ctggactttccagatcctggtgatgctgg

SEQ ID NO: 405130 - DNA, 33 bp, Artificial Sequence; identical to SEQ ID NO: 61523
  Description of Artificial Sequence: Synthetic oligonucleotide

SEQ ID NO: 405131 - DNA, 32 bp, Artificial Sequence; identical to SEQ ID NO: 61524
  Description of Artificial Sequence: Synthetic oligonucleotide

SEQ ID NO: 405132 - DNA, 33 bp, Artificial Sequence; identical to SEQ ID NO: 61525
  Description of Artificial Sequence: Synthetic oligonucleotide

SEQ ID NO: 405133 - DNA, 34 bp, Artificial Sequence; identical to SEQ ID NO: 61526
  Description of Artificial Sequence: Synthetic oligonucleotide

SEQ ID NO: 405134 - DNA, 33 bp, Artificial Sequence; identical to SEQ ID NO: 61527
  Description of Artificial Sequence: Synthetic oligonucleotide

SEQ ID NO: 405135 - DNA, 33 bp, Artificial Sequence; identical to SEQ ID NO: 61528
  Description of Artificial Sequence: Synthetic oligonucleotide

SEQ ID NO: 405136 - DNA, 26 bp, Artificial Sequence
  Description of Artificial Sequence: Synthetic oligonucleotide
gtgctggggctgatcttccttgggct

SEQ ID NO: 405137 - DNA, 26 bp, Artificial Sequence
  Description of Artificial Sequence: Synthetic oligonucleotide
tgctggggctgatcttccttgggctg

SEQ ID NO: 405138 - DNA, 25 bp, Artificial Sequence
  Description of Artificial Sequence: Synthetic oligonucleotide
gctggggctgatcttccttgggctg

SEQ ID NO: 405139 - DNA, 25 bp, Artificial Sequence
  Description of Artificial Sequence: Synthetic oligonucleotide
ctggggctgatcttccttgggctgg

SEQ ID NO: 405140 - DNA, 25 bp, Artificial Sequence
  Description of Artificial Sequence: Synthetic oligonucleotide
tggggctgatcttccttgggctggg

SEQ ID NO: 405141 - DNA, 24 bp, Artificial Sequence
  Description of Artificial Sequence: Synthetic oligonucleotide
ggggctgatcttccttgggctggg

SEQ ID NO: 405142 - DNA, 24 bp, Artificial Sequence
  Description of Artificial Sequence: Synthetic oligonucleotide
gggctgatcttccttgggctgggc

SEQ ID NO: 405143 - DNA, 27 bp, Artificial Sequence
  Description of Artificial Sequence: Synthetic oligonucleotide
ggctgatcttccttgggctgggcctta

SEQ ID NO: 405144 - DNA, 28 bp, Artificial Sequence
  Description of Artificial Sequence: Synthetic oligonucleotide
gctgatcttccttgggctgggccttatc

SEQ ID NO: 405145 - DNA, 30 bp, Artificial Sequence; identical to SEQ ID NO: 61538
  Description of Artificial Sequence: Synthetic oligonucleotide

SEQ ID NO: 405146 - DNA, 30 bp, Artificial Sequence; identical to SEQ ID NO: 61539
  Description of Artificial Sequence: Synthetic oligonucleotide

SEQ ID NO: 405147 - DNA, 29 bp, Artificial Sequence
  Description of Artificial Sequence: Synthetic oligonucleotide
gatcttccttgggctgggccttatcatcc

SEQ ID NO: 405148 - DNA, 29 bp, Artificial Sequence
  Description of Artificial Sequence: Synthetic oligonucleotide
atcttccttgggctgggccttatcatccg

SEQ ID NO: 405149 - DNA, 28 bp, Artificial Sequence
  Description of Artificial Sequence: Synthetic oligonucleotide
tcttccttgggctgggccttatcatccg

SEQ ID NO: 405150 - DNA, 27 bp, Artificial Sequence
  Description of Artificial Sequence: Synthetic oligonucleotide
cttccttgggctgggccttatcatccg

SEQ ID NO: 405151 - DNA, 28 bp, Artificial Sequence
  Description of Artificial Sequence: Synthetic oligonucleotide
ttccttgggctgggccttatcatccgtc

SEQ ID NO: 405152 - DNA, 27 bp, Artificial Sequence
  Description of Artificial Sequence: Synthetic oligonucleotide
tccttgggctgggccttatcatccgtc

SEQ ID NO: 405153 - DNA, 27 bp, Artificial Sequence
  Description of Artificial Sequence: Synthetic oligonucleotide
ccttgggctgggccttatcatccgtca

SEQ ID NO: 405154 - DNA, 29 bp, Artificial Sequence
  Description of Artificial Sequence: Synthetic oligonucleotide
cttgggctgggccttatcatccgtcaaag

SEQ ID NO: 405155 - DNA, 29 bp, Artificial Sequence
  Description of Artificial Sequence: Synthetic oligonucleotide
ttgggctgggccttatcatccgtcaaagg

SEQ ID NO: 405156 - DNA, 28 bp, Artificial Sequence
  Description of Artificial Sequence: Synthetic oligonucleotide
tgggctgggccttatcatccgtcaaagg

SEQ ID NO: 405157 - DNA, 32 bp, Artificial Sequence; identical to SEQ ID NO: 61550
  Description of Artificial Sequence: Synthetic oligonucleotide

SEQ ID NO: 405158 - DNA, 32 bp, Artificial Sequence; identical to SEQ ID NO: 61551
  Description of Artificial Sequence: Synthetic oligonucleotide

SEQ ID NO: 405159 - DNA, 34 bp, Artificial Sequence; identical to SEQ ID NO: 61552
  Description of Artificial Sequence: Synthetic oligonucleotide

SEQ ID NO: 405160 - DNA, 35 bp, Artificial Sequence; identical to SEQ ID NO: 61553
  Description of Artificial Sequence: Synthetic oligonucleotide

SEQ ID NO: 405161 - DNA, 34 bp, Artificial Sequence; identical to SEQ ID NO: 61554
  Description of Artificial Sequence: Synthetic oligonucleotide

SEQ ID NO: 405162 - DNA, 33 bp, Artificial Sequence; identical to SEQ ID NO: 61555
  Description of Artificial Sequence: Synthetic oligonucleotide

SEQ ID NO: 405163 - DNA, 32 bp, Artificial Sequence; identical to SEQ ID NO: 61556
  Description of Artificial Sequence: Synthetic oligonucleotide

SEQ ID NO: 405164 - DNA, 31 bp, Artificial Sequence; identical to SEQ ID NO: 61557
  Description of Artificial Sequence: Synthetic oligonucleotide

SEQ ID NO: 405165 - DNA, 31 bp, Artificial Sequence; identical to SEQ ID NO: 61558
  Description of Artificial Sequence: Synthetic oligonucleotide

SEQ ID NO: 405166 - DNA, 30 bp, Artificial Sequence; identical to SEQ ID NO: 61559
  Description of Artificial Sequence: Synthetic oligonucleotide

SEQ ID NO: 405167 - DNA, 29 bp, Artificial Sequence
  Description of Artificial Sequence: Synthetic oligonucleotide
ccgtcaaaggagtcagaaagggcttctgc

SEQ ID NO: 405168 - DNA, 30 bp, Artificial Sequence; identical to SEQ ID NO: 61561
  Description of Artificial Sequence: Synthetic oligonucleotide

SEQ ID NO: 405169 - DNA, 31 bp, Artificial Sequence; identical to SEQ ID NO: 61562
  Description of Artificial Sequence: Synthetic oligonucleotide

SEQ ID NO: 405170 - DNA, 25 bp, Artificial Sequence
  Description of Artificial Sequence: Synthetic oligonucleotide
gggacggagcgcgtgcgtcttgtaa

SEQ ID NO: 405171 - DNA, 25 bp, Artificial Sequence
  Description of Artificial Sequence: Synthetic oligonucleotide
ggacggagcgcgtgcgtcttgtaac

SEQ ID NO: 405172 - DNA, 26 bp, Artificial Sequence
  Description of Artificial Sequence: Synthetic oligonucleotide
gacggagcgcgtgcgtcttgtaacca

SEQ ID NO: 405173 - DNA, 27 bp, Artificial Sequence
  Description of Artificial Sequence: Synthetic oligonucleotide
acggagcgcgtgcgtcttgtaaccaga

SEQ ID NO: 405174 - DNA, 26 bp, Artificial Sequence
  Description of Artificial Sequence: Synthetic oligonucleotide
cggagcgcgtgcgtcttgtaaccaga

SEQ ID NO: 405175 - DNA, 27 bp, Artificial Sequence
  Description of Artificial Sequence: Synthetic oligonucleotide
ggagcgcgtgcgtcttgtaaccagaca

SEQ ID NO: 405176 - DNA, 27 bp, Artificial Sequence
  Description of Artificial Sequence: Synthetic oligonucleotide
gagcgcgtgcgtcttgtaaccagacac

SEQ ID NO: 405177 - DNA, 29 bp, Artificial Sequence
  Description of Artificial Sequence: Synthetic oligonucleotide
agcgcgtgcgtcttgtaaccagacacatc

SEQ ID NO: 405178 - DNA, 28 bp, Artificial Sequence
  Description of Artificial Sequence: Synthetic oligonucleotide
gcgcgtgcgtcttgtaaccagacacatc

SEQ ID NO: 405179 - DNA, 33 bp, Artificial Sequence; identical to SEQ ID NO: 61572
  Description of Artificial Sequence: Synthetic oligonucleotide

SEQ ID NO: 405180 - DNA, 33 bp, Artificial Sequence; identical to SEQ ID NO: 61573
  Description of Artificial Sequence: Synthetic oligonucleotide

SEQ ID NO: 405181 - DNA, 33 bp, Artificial Sequence; identical to SEQ ID NO: 61574
  Description of Artificial Sequence: Synthetic oligonucleotide

SEQ ID NO: 405182 - DNA, 34 bp, Artificial Sequence; identical to SEQ ID NO: 61575
  Description of Artificial Sequence: Synthetic oligonucleotide

SEQ ID NO: 405183 - DNA, 35 bp, Artificial Sequence; identical to SEQ ID NO: 61576
  Description of Artificial Sequence: Synthetic oligonucleotide

SEQ ID NO: 405184 - DNA, 34 bp, Artificial Sequence; identical to SEQ ID NO: 61577
  Description of Artificial Sequence: Synthetic oligonucleotide

SEQ ID NO: 405185 - DNA, 34 bp, Artificial Sequence; identical to SEQ ID NO: 61578
  Description of Artificial Sequence: Synthetic oligonucleotide

SEQ ID NO: 405186 - DNA, 35 bp, Artificial Sequence; identical to SEQ ID NO: 61579
  Description of Artificial Sequence: Synthetic oligonucleotide

SEQ ID NO: 405187 - DNA, 37 bp, Artificial Sequence; identical to SEQ ID NO: 61580
  Description of Artificial Sequence: Synthetic oligonucleotide

SEQ ID NO: 405188 - DNA, 36 bp, Artificial Sequence; identical to SEQ ID NO: 61581
  Description of Artificial Sequence: Synthetic oligonucleotide

SEQ ID NO: 405189 - DNA, 36 bp, Artificial Sequence; identical to SEQ ID NO: 61582
  Description of Artificial Sequence: Synthetic oligonucleotide

SEQ ID NO: 405190 - DNA, 35 bp, Artificial Sequence; identical to SEQ ID NO: 61583
  Description of Artificial Sequence: Synthetic oligonucleotide

SEQ ID NO: 405191 - DNA, 34 bp, Artificial Sequence; identical to SEQ ID NO: 61584
  Description of Artificial Sequence: Synthetic oligonucleotide

SEQ ID NO: 405192 - DNA, 34 bp, Artificial Sequence; identical to SEQ ID NO: 61585
  Description of Artificial Sequence: Synthetic oligonucleotide

SEQ ID NO: 405193 - DNA, 33 bp, Artificial Sequence; identical to SEQ ID NO: 61586
  Description of Artificial Sequence: Synthetic oligonucleotide

SEQ ID NO: 405194 - DNA, 27 bp, Artificial Sequence
  Description of Artificial Sequence: Synthetic oligonucleotide
ggtgtgcagacacaactacgaggtggg

SEQ ID NO: 405195 - DNA, 27 bp, Artificial Sequence
  Description of Artificial Sequence: Synthetic oligonucleotide
gtgtgcagacacaactacgaggtgggg

SEQ ID NO: 405196 - DNA, 29 bp, Artificial Sequence
  Description of Artificial Sequence: Synthetic oligonucleotide
tgtgcagacacaactacgaggtggggtac

SEQ ID NO: 405197 - DNA, 28 bp, Artificial Sequence
  Description of Artificial Sequence: Synthetic oligonucleotide
gtgcagacacaactacgaggtggggtac

SEQ ID NO: 405198 - DNA, 28 bp, Artificial Sequence
  Description of Artificial Sequence: Synthetic oligonucleotide
tgcagacacaactacgaggtggggtacc

SEQ ID NO: 405199 - DNA, 27 bp, Artificial Sequence
  Description of Artificial Sequence: Synthetic oligonucleotide
gcagacacaactacgaggtggggtacc

SEQ ID NO: 405200 - DNA, 27 bp, Artificial Sequence
  Description of Artificial Sequence: Synthetic oligonucleotide
cagacacaactacgaggtggggtaccg

SEQ ID NO: 405201 - DNA, 27 bp, Artificial Sequence
  Description of Artificial Sequence: Synthetic oligonucleotide
agacacaactacgaggtggggtaccgc

SEQ ID NO: 405202 - DNA, 26 bp, Artificial Sequence
  Description of Artificial Sequence: Synthetic oligonucleotide
gacacaactacgaggtggggtaccgc

SEQ ID NO: 405203 - DNA, 26 bp, Artificial Sequence
  Description of Artificial Sequence: Synthetic oligonucleotide
acacaactacgaggtggggtaccgcg

SEQ ID NO: 405204 - DNA, 25 bp, Artificial Sequence
  Description of Artificial Sequence: Synthetic oligonucleotide
cacaactacgaggtggggtaccgcg

SEQ ID NO: 405205 - DNA, 25 bp, Artificial Sequence
  Description of Artificial Sequence: Synthetic oligonucleotide
acaactacgaggtggggtaccgcgg

SEQ ID NO: 405206 - DNA, 24 bp, Artificial Sequence
  Description of Artificial Sequence: Synthetic oligonucleotide
caactacgaggtggggtaccgcgg

SEQ ID NO: 405207 - DNA, 26 bp, Artificial Sequence
  Description of Artificial Sequence: Synthetic oligonucleotide
aactacgaggtggggtaccgcgggat

SEQ ID NO: 405208 - DNA, 25 bp, Artificial Sequence
  Description of Artificial Sequence: Synthetic oligonucleotide
actacgaggtggggtaccgcgggat

SEQ ID NO: 405209 - DNA, 24 bp, Artificial Sequence
  Description of Artificial Sequence: Synthetic oligonucleotide
ctacgaggtggggtaccgcgggat

SEQ ID NO: 405210 - DNA, 24 bp, Artificial Sequence
  Description of Artificial Sequence: Synthetic oligonucleotide
tacgaggtggggtaccgcgggatc

SEQ ID NO: 405211 - DNA, 23 bp, Artificial Sequence
  Description of Artificial Sequence: Synthetic oligonucleotide
acgaggtggggtaccgcgggatc

SEQ ID NO: 405212 - DNA, 22 bp, Artificial Sequence
  Description of Artificial Sequence: Synthetic oligonucleotide
cgaggtggggtaccgcgggatc

SEQ ID NO: 405213 - DNA, 23 bp, Artificial Sequence
  Description of Artificial Sequence: Synthetic oligonucleotide
gaggtggggtaccgcgggatcct

SEQ ID NO: 405214 - DNA, 23 bp, Artificial Sequence
  Description of Artificial Sequence: Synthetic oligonucleotide
aggtggggtaccgcgggatcctg

SEQ ID NO: 405215 - DNA, 22 bp, Artificial Sequence
  Description of Artificial Sequence: Synthetic oligonucleotide
ggtggggtaccgcgggatcctg

SEQ ID NO: 405216 - DNA, 23 bp, Artificial Sequence
  Description of Artificial Sequence: Synthetic oligonucleotide
gtggggtaccgcgggatcctgca

SEQ ID NO: 405217 - DNA, 24 bp, Artificial Sequence
  Description of Artificial Sequence: Synthetic oligonucleotide
tggggtaccgcgggatcctgcaga

SEQ ID NO: 405218 - DNA, 23 bp, Artificial Sequence
  Description of Artificial Sequence: Synthetic oligonucleotide
ggggtaccgcgggatcctgcaga

SEQ ID NO: 405219 - DNA, 23 bp, Artificial Sequence
  Description of Artificial Sequence: Synthetic oligonucleotide
gggtaccgcgggatcctgcagag

SEQ ID NO: 405220 - DNA, 24 bp, Artificial Sequence
  Description of Artificial Sequence: Synthetic oligonucleotide
ggtaccgcgggatcctgcagagga

SEQ ID NO: 405221 - DNA, 35 bp, Artificial Sequence; identical to SEQ ID NO: 61619
  Description of Artificial Sequence: Synthetic oligonucleotide

SEQ ID NO: 405222 - DNA, 34 bp, Artificial Sequence; identical to SEQ ID NO: 61620
  Description of Artificial Sequence: Synthetic oligonucleotide

SEQ ID NO: 405223 - DNA, 35 bp, Artificial Sequence; identical to SEQ ID NO: 61621
  Description of Artificial Sequence: Synthetic oligonucleotide

SEQ ID NO: 405224 - DNA, 34 bp, Artificial Sequence; identical to SEQ ID NO: 61622
  Description of Artificial Sequence: Synthetic oligonucleotide

SEQ ID NO: 405225 - DNA, 34 bp, Artificial Sequence; identical to SEQ ID NO: 61623
  Description of Artificial Sequence: Synthetic oligonucleotide

SEQ ID NO: 405226 - DNA, 33 bp, Artificial Sequence; identical to SEQ ID NO: 61624
  Description of Artificial Sequence: Synthetic oligonucleotide

SEQ ID NO: 405227 - DNA, 36 bp, Artificial Sequence; identical to SEQ ID NO: 61625
  Description of Artificial Sequence: Synthetic oligonucleotide

SEQ ID NO: 405228 - DNA, 35 bp, Artificial Sequence; identical to SEQ ID NO: 61626
  Description of Artificial Sequence: Synthetic oligonucleotide

SEQ ID NO: 405229 - DNA, 34 bp, Artificial Sequence; identical to SEQ ID NO: 61627
  Description of Artificial Sequence: Synthetic oligonucleotide

SEQ ID NO: 405230 - DNA, 33 bp, Artificial Sequence; identical to SEQ ID NO: 61628
  Description of Artificial Sequence: Synthetic oligonucleotide

SEQ ID NO: 405231 - DNA, 32 bp, Artificial Sequence; identical to SEQ ID NO: 61629
  Description of Artificial Sequence: Synthetic oligonucleotide

SEQ ID NO: 405232 - DNA, 32 bp, Artificial Sequence; identical to SEQ ID NO: 61630
  Description of Artificial Sequence: Synthetic oligonucleotide

SEQ ID NO: 405233 - DNA, 31 bp, Artificial Sequence; identical to SEQ ID NO: 61631
  Description of Artificial Sequence: Synthetic oligonucleotide

SEQ ID NO: 405234 - DNA, 30 bp, Artificial Sequence; identical to SEQ ID NO: 61632
  Description of Artificial Sequence: Synthetic oligonucleotide

SEQ ID NO: 405235 - DNA, 29 bp, Artificial Sequence
  Description of Artificial Sequence: Synthetic oligonucleotide
ccaggccagatcaaagtccagtggtttcg

SEQ ID NO: 405236 - DNA, 29 bp, Artificial Sequence
  Description of Artificial Sequence: Synthetic oligonucleotide
caggccagatcaaagtccagtggtttcgg

SEQ ID NO: 405237 - DNA, 32 bp, Artificial Sequence; identical to SEQ ID NO: 61635
  Description of Artificial Sequence: Synthetic oligonucleotide

SEQ ID NO: 405238 - DNA, 31 bp, Artificial Sequence; identical to SEQ ID NO: 61636
  Description of Artificial Sequence: Synthetic oligonucleotide

SEQ ID NO: 405239 - DNA, 33 bp, Artificial Sequence; identical to SEQ ID NO: 61637
  Description of Artificial Sequence: Synthetic oligonucleotide

SEQ ID NO: 405240 - DNA, 34 bp, Artificial Sequence; identical to SEQ ID NO: 61638
  Description of Artificial Sequence: Synthetic oligonucleotide

SEQ ID NO: 405241 - DNA, 34 bp, Artificial Sequence; identical to SEQ ID NO: 61639
  Description of Artificial Sequence: Synthetic oligonucleotide

SEQ ID NO: 405242 - DNA, 35 bp, Artificial Sequence; identical to SEQ ID NO: 61640
  Description of Artificial Sequence: Synthetic oligonucleotide

SEQ ID NO: 405243 - DNA, 34 bp, Artificial Sequence; identical to SEQ ID NO: 61641
  Description of Artificial Sequence: Synthetic oligonucleotide

SEQ ID NO: 405244 - DNA, 34 bp, Artificial Sequence; identical to SEQ ID NO: 61642
  Description of Artificial Sequence: Synthetic oligonucleotide

SEQ ID NO: 405245 - DNA, 33 bp, Artificial Sequence; identical to SEQ ID NO: 61643
  Description of Artificial Sequence: Synthetic oligonucleotide

SEQ ID NO: 405246 - DNA, 32 bp, Artificial Sequence; identical to SEQ ID NO: 61644
  Description of Artificial Sequence: Synthetic oligonucleotide

SEQ ID NO: 405247 - DNA, 33 bp, Artificial Sequence; identical to SEQ ID NO: 61645
  Description of Artificial Sequence: Synthetic oligonucleotide

SEQ ID NO: 405248 - DNA, 32 bp, Artificial Sequence; identical to SEQ ID NO: 61646
  Description of Artificial Sequence: Synthetic oligonucleotide

SEQ ID NO: 405249 - DNA, 31 bp, Artificial Sequence; identical to SEQ ID NO: 61647
  Description of Artificial Sequence: Synthetic oligonucleotide

SEQ ID NO: 405250 - DNA, 30 bp, Artificial Sequence; identical to SEQ ID NO: 61648
  Description of Artificial Sequence: Synthetic oligonucleotide

SEQ ID NO: 405251 - DNA, 31 bp, Artificial Sequence; identical to SEQ ID NO: 61649
  Description of Artificial Sequence: Synthetic oligonucleotide

SEQ ID NO: 405252 - DNA, 30 bp, Artificial Sequence; identical to SEQ ID NO: 61650
  Description of Artificial Sequence: Synthetic oligonucleotide

SEQ ID NO: 405253 - DNA, 31 bp, Artificial Sequence; identical to SEQ ID NO: 61651
  Description of Artificial Sequence: Synthetic oligonucleotide

SEQ ID NO: 405254 - DNA, 31 bp, Artificial Sequence; identical to SEQ ID NO: 61652
  Description of Artificial Sequence: Synthetic oligonucleotide

SEQ ID NO: 405255 - DNA, 22 bp, Artificial Sequence
  Description of Artificial Sequence: Synthetic oligonucleotide
gacccgggcggagttggacacc

SEQ ID NO: 405256 - DNA, 23 bp, Artificial Sequence
  Description of Artificial Sequence: Synthetic oligonucleotide
acccgggcggagttggacaccgt

SEQ ID NO: 405257 - DNA, 22 bp, Artificial Sequence
  Description of Artificial Sequence: Synthetic oligonucleotide
cccgggcggagttggacaccgt

SEQ ID NO: 405258 - DNA, 23 bp, Artificial Sequence
  Description of Artificial Sequence: Synthetic oligonucleotide
ccgggcggagttggacaccgtgt

SEQ ID NO: 405259 - DNA, 23 bp, Artificial Sequence
  Description of Artificial Sequence: Synthetic oligonucleotide
cgggcggagttggacaccgtgtg

SEQ ID NO: 405260 - DNA, 24 bp, Artificial Sequence
  Description of Artificial Sequence: Synthetic oligonucleotide
gggcggagttggacaccgtgtgca

SEQ ID NO: 405261 - DNA, 25 bp, Artificial Sequence
  Description of Artificial Sequence: Synthetic oligonucleotide
ggcggagttggacaccgtgtgcaga

SEQ ID NO: 405262 - DNA, 26 bp, Artificial Sequence
  Description of Artificial Sequence: Synthetic oligonucleotide
gcggagttggacaccgtgtgcagaca

SEQ ID NO: 405263 - DNA, 27 bp, Artificial Sequence
  Description of Artificial Sequence: Synthetic oligonucleotide
cggagttggacaccgtgtgcagacaca

SEQ ID NO: 405264 - DNA, 28 bp, Artificial Sequence
  Description of Artificial Sequence: Synthetic oligonucleotide
ggagttggacaccgtgtgcagacacaac

SEQ ID NO: 405265 - DNA, 30 bp, Artificial Sequence; identical to SEQ ID NO: 61663
  Description of Artificial Sequence: Synthetic oligonucleotide

SEQ ID NO: 405266 - DNA, 30 bp, Artificial Sequence; identical to SEQ ID NO: 61664
  Description of Artificial Sequence: Synthetic oligonucleotide

SEQ ID NO: 405267 - DNA, 29 bp, Artificial Sequence
  Description of Artificial Sequence: Synthetic oligonucleotide
gttggacaccgtgtgcagacacaactacg

SEQ ID NO: 405268 - DNA, 30 bp, Artificial Sequence; identical to SEQ ID NO: 61666
  Description of Artificial Sequence: Synthetic oligonucleotide

SEQ ID NO: 405269 - DNA, 29 bp, Artificial Sequence
  Description of Artificial Sequence: Synthetic oligonucleotide
tggacaccgtgtgcagacacaactacgag

SEQ ID NO: 405270 - DNA, 28 bp, Artificial Sequence
  Description of Artificial Sequence: Synthetic oligonucleotide
ggacaccgtgtgcagacacaactacgag

SEQ ID NO: 405271 - DNA, 28 bp, Artificial Sequence
  Description of Artificial Sequence: Synthetic oligonucleotide
gacaccgtgtgcagacacaactacgagg

SEQ ID NO: 405272 - DNA, 29 bp, Artificial Sequence
  Description of Artificial Sequence: Synthetic oligonucleotide
acaccgtgtgcagacacaactacgaggtg

SEQ ID NO: 405273 - DNA, 28 bp, Artificial Sequence
  Description of Artificial Sequence: Synthetic oligonucleotide
caccgtgtgcagacacaactacgaggtg

SEQ ID NO: 405274 - DNA, 28 bp, Artificial Sequence
  Description of Artificial Sequence: Synthetic oligonucleotide
accgtgtgcagacacaactacgaggtgg

SEQ ID NO: 405275 - DNA, 27 bp, Artificial Sequence
  Description of Artificial Sequence: Synthetic oligonucleotide
ccgtgtgcagacacaactacgaggtgg

SEQ ID NO: 405276 - DNA, 27 bp, Artificial Sequence
  Description of Artificial Sequence: Synthetic oligonucleotide
cgtgtgcagacacaactacgaggtggg

SEQ ID NO: 405277 - DNA, 27 bp, Artificial Sequence
  Description of Artificial Sequence: Synthetic oligonucleotide
cggagcgcgtgcgtcttgtaaccagat

SEQ ID NO: 405278 - DNA, 28 bp, Artificial Sequence
  Description of Artificial Sequence: Synthetic oligonucleotide
ggagcgcgtgcgtcttgtaaccagatac

SEQ ID NO: 405279 - DNA, 30 bp, Artificial Sequence; identical to SEQ ID NO: 61677
  Description of Artificial Sequence: Synthetic oligonucleotide

SEQ ID NO: 405280 - DNA, 35 bp, Artificial Sequence; identical to SEQ ID NO: 61678
  Description of Artificial Sequence: Synthetic oligonucleotide

SEQ ID NO: 405281 - DNA, 34 bp, Artificial Sequence; identical to SEQ ID NO: 61679
  Description of Artificial Sequence: Synthetic oligonucleotide

SEQ ID NO: 405282 - DNA, 34 bp, Artificial Sequence; identical to SEQ ID NO: 61680
  Description of Artificial Sequence: Synthetic oligonucleotide

SEQ ID NO: 405283 - DNA, 34 bp, Artificial Sequence; identical to SEQ ID NO: 61681
  Description of Artificial Sequence: Synthetic oligonucleotide

SEQ ID NO: 405284 - DNA, 35 bp, Artificial Sequence; identical to SEQ ID NO: 61682
  Description of Artificial Sequence: Synthetic oligonucleotide

SEQ ID NO: 405285 - DNA, 36 bp, Artificial Sequence; identical to SEQ ID NO: 61683
  Description of Artificial Sequence: Synthetic oligonucleotide

SEQ ID NO: 405286 - DNA, 36 bp, Artificial Sequence; identical to SEQ ID NO: 61684
  Description of Artificial Sequence: Synthetic oligonucleotide

SEQ ID NO: 405287 - DNA, 35 bp, Artificial Sequence; identical to SEQ ID NO: 61685
  Description of Artificial Sequence: Synthetic oligonucleotide

SEQ ID NO: 405288 - DNA, 36 bp, Artificial Sequence; identical to SEQ ID NO: 61686
  Description of Artificial Sequence: Synthetic oligonucleotide

SEQ ID NO: 405289 - DNA, 38 bp, Artificial Sequence; identical to SEQ ID NO: 61687
  Description of Artificial Sequence: Synthetic oligonucleotide

SEQ ID NO: 405290 - DNA, 38 bp, Artificial Sequence; identical to SEQ ID NO: 61688
  Description of Artificial Sequence: Synthetic oligonucleotide

SEQ ID NO: 405291 - DNA, 37 bp, Artificial Sequence; identical to SEQ ID NO: 61689
  Description of Artificial Sequence: Synthetic oligonucleotide

SEQ ID NO: 405292 - DNA, 37 bp, Artificial Sequence; identical to SEQ ID NO: 61690
  Description of Artificial Sequence: Synthetic oligonucleotide

SEQ ID NO: 405293 - DNA, 36 bp, Artificial Sequence; identical to SEQ ID NO: 61691
  Description of Artificial Sequence: Synthetic oligonucleotide

SEQ ID NO: 405294 - DNA, 35 bp, Artificial Sequence; identical to SEQ ID NO: 61692
  Description of Artificial Sequence: Synthetic oligonucleotide

SEQ ID NO: 405295 - DNA, 35 bp, Artificial Sequence; identical to SEQ ID NO: 61693
  Description of Artificial Sequence: Synthetic oligonucleotide

SEQ ID NO: 405296 - DNA, 34 bp, Artificial Sequence; identical to SEQ ID NO: 61694
  Description of Artificial Sequence: Synthetic oligonucleotide

SEQ ID NO: 405297 - DNA, 20 bp, Artificial Sequence
  Description of Artificial Sequence: Synthetic oligonucleotide
acgccgcaggggcggcctgt

SEQ ID NO: 405298 - DNA, 20 bp, Artificial Sequence
  Description of Artificial Sequence: Synthetic oligonucleotide
gccgcaggggcggcctgtct

SEQ ID NO: 405299 - DNA, 20 bp, Artificial Sequence
  Description of Artificial Sequence: Synthetic oligonucleotide
ccgcaggggcggcctgtcgt

SEQ ID NO: 405300 - DNA, 20 bp, Artificial Sequence
  Description of Artificial Sequence: Synthetic oligonucleotide
cgcaggggcggcctgtcgct

SEQ ID NO: 405301 - DNA, 20 bp, Artificial Sequence
  Description of Artificial Sequence: Synthetic oligonucleotide
gcaggggcggcctgtcgcct

SEQ ID NO: 405302 - DNA, 20 bp, Artificial Sequence
  Description of Artificial Sequence: Synthetic oligonucleotide
caggggcggcctgtcgccga

SEQ ID NO: 405303 - DNA, 22 bp, Artificial Sequence
  Description of Artificial Sequence: Synthetic oligonucleotide
aggggcggcctgtcgccgagta

SEQ ID NO: 405304 - DNA, 21 bp, Artificial Sequence
  Description of Artificial Sequence: Synthetic oligonucleotide
ggggcggcctgtcgccgagta

SEQ ID NO: 405305 - DNA, 22 bp, Artificial Sequence
  Description of Artificial Sequence: Synthetic oligonucleotide
gggcggcctgtcgccgagtact

SEQ ID NO: 405306 - DNA, 22 bp, Artificial Sequence
  Description of Artificial Sequence: Synthetic oligonucleotide
ggcggcctgtcgccgagtactg

SEQ ID NO: 405307 - DNA, 24 bp, Artificial Sequence
  Description of Artificial Sequence: Synthetic oligonucleotide
gcggcctgtcgccgagtactggaa

SEQ ID NO: 405308 - DNA, 25 bp, Artificial Sequence
  Description of Artificial Sequence: Synthetic oligonucleotide
cggcctgtcgccgagtactggaaca

SEQ ID NO: 405309 - DNA, 25 bp, Artificial Sequence
  Description of Artificial Sequence: Synthetic oligonucleotide
ggcctgtcgccgagtactggaacag

SEQ ID NO: 405310 - DNA, 25 bp, Artificial Sequence
  Description of Artificial Sequence: Synthetic oligonucleotide
gcctgtcgccgagtactggaacagc

SEQ ID NO: 405311 - DNA, 26 bp, Artificial Sequence
  Description of Artificial Sequence: Synthetic oligonucleotide
cctgtcgccgagtactggaacagcca

SEQ ID NO: 405312 - DNA, 27 bp, Artificial Sequence
  Description of Artificial Sequence: Synthetic oligonucleotide
ctgtcgccgagtactggaacagccaga

SEQ ID NO: 405313 - DNA, 28 bp, Artificial Sequence
  Description of Artificial Sequence: Synthetic oligonucleotide
tgtcgccgagtactggaacagccagaag

SEQ ID NO: 405314 - DNA, 27 bp, Artificial Sequence
  Description of Artificial Sequence: Synthetic oligonucleotide
gtcgccgagtactggaacagccagaag

SEQ ID NO: 405315 - DNA, 27 bp, Artificial Sequence
  Description of Artificial Sequence: Synthetic oligonucleotide
tcgccgagtactggaacagccagaagg

SEQ ID NO: 405316 - DNA, 21 bp, Artificial Sequence
  Description of Artificial Sequence: Synthetic oligonucleotide
tcctggagaggacccgggcgg

SEQ ID NO: 405317 - DNA, 20 bp, Artificial Sequence
  Description of Artificial Sequence: Synthetic oligonucleotide
cctggagaggacccgggcgg

SEQ ID NO: 405318 - DNA, 20 bp, Artificial Sequence
  Description of Artificial Sequence: Synthetic oligonucleotide
ctggagaggacccgggcggc

SEQ ID NO: 405319 - DNA, 20 bp, Artificial Sequence
  Description of Artificial Sequence: Synthetic oligonucleotide
tggagaggacccgggcggcg

SEQ ID NO: 405320 - DNA, 20 bp, Artificial Sequence
  Description of Artificial Sequence: Synthetic oligonucleotide
ggagaggacccgggcggcgt

SEQ ID NO: 405321 - DNA, 20 bp, Artificial Sequence
  Description of Artificial Sequence: Synthetic oligonucleotide
gagaggacccgggcggcggt

SEQ ID NO: 405322 - DNA, 20 bp, Artificial Sequence
  Description of Artificial Sequence: Synthetic oligonucleotide
agaggacccgggcggcggtg

SEQ ID NO: 405323 - DNA, 20 bp, Artificial Sequence
  Description of Artificial Sequence: Synthetic oligonucleotide
gaggacccgggcggcggtgt

SEQ ID NO: 405324 - DNA, 20 bp, Artificial Sequence
  Description of Artificial Sequence: Synthetic oligonucleotide
aggacccgggcggcggtgga

SEQ ID NO: 405325 - DNA, 20 bp, Artificial Sequence
  Description of Artificial Sequence: Synthetic oligonucleotide
ggacccgggcggcggtggat

SEQ ID NO: 405326 - DNA, 20 bp, Artificial Sequence
  Description of Artificial Sequence: Synthetic oligonucleotide
gacccgggcggcggtggaca

SEQ ID NO: 405327 - DNA, 20 bp, Artificial Sequence
  Description of Artificial Sequence: Synthetic oligonucleotide
acccgggcggcggtggacag

SEQ ID NO: 405328 - DNA, 20 bp, Artificial Sequence
  Description of Artificial Sequence: Synthetic oligonucleotide
cccgggcggcggtggacagt

SEQ ID NO: 405329 - DNA, 20 bp, Artificial Sequence
  Description of Artificial Sequence: Synthetic oligonucleotide
ccgggcggcggtggacaggt

SEQ ID NO: 405330 - DNA, 20 bp, Artificial Sequence
  Description of Artificial Sequence: Synthetic oligonucleotide
gggcggcggtggacagggtg

SEQ ID NO: 405331 - DNA, 22 bp, Artificial Sequence
  Description of Artificial Sequence: Synthetic oligonucleotide
gaggtggggtaccgcgggatcc

SEQ ID NO: 405332 - DNA, 25 bp, Artificial Sequence
  Description of Artificial Sequence: Synthetic oligonucleotide
tacgaggtggcgttccgcgggatct

SEQ ID NO: 405333 - DNA, 24 bp, Artificial Sequence
  Description of Artificial Sequence: Synthetic oligonucleotide
gcgttccgcgggatcttgcagagg

SEQ ID NO: 405334 - DNA, 23 bp, Artificial Sequence
  Description of Artificial Sequence: Synthetic oligonucleotide
caggggcggcctgatgccgagaa

SEQ ID NO: 405335 - DNA, 24 bp, Artificial Sequence
  Description of Artificial Sequence: Synthetic oligonucleotide
aggggcggcctgatgccgagaact

SEQ ID NO: 405336 - DNA, 23 bp, Artificial Sequence
  Description of Artificial Sequence: Synthetic oligonucleotide
ggggcggcctgatgccgagaact

SEQ ID NO: 405337 - DNA, 23 bp, Artificial Sequence
  Description of Artificial Sequence: Synthetic oligonucleotide
gggcggcctgatgccgagaactg

SEQ ID NO: 405338 - DNA, 25 bp, Artificial Sequence
  Description of Artificial Sequence: Synthetic oligonucleotide
ggcggcctgatgccgagaactggaa

SEQ ID NO: 405339 - DNA, 26 bp, Artificial Sequence
  Description of Artificial Sequence: Synthetic oligonucleotide
gcggcctgatgccgagaactggaaca

SEQ ID NO: 405340 - DNA, 26 bp, Artificial Sequence
  Description of Artificial Sequence: Synthetic oligonucleotide
cggcctgatgccgagaactggaacag

SEQ ID NO: 405341 - DNA, 26 bp, Artificial Sequence
  Description of Artificial Sequence: Synthetic oligonucleotide
ggcctgatgccgagaactggaacagc

SEQ ID NO: 405342 - DNA, 27 bp, Artificial Sequence
  Description of Artificial Sequence: Synthetic oligonucleotide
gcctgatgccgagaactggaacagcca

SEQ ID NO: 405343 - DNA, 27 bp, Artificial Sequence
  Description of Artificial Sequence: Synthetic oligonucleotide
cctgatgccgagaactggaacagccag

SEQ ID NO: 405344 - DNA, 29 bp, Artificial Sequence
  Description of Artificial Sequence: Synthetic oligonucleotide
ctgatgccgagaactggaacagccagaag

SEQ ID NO: 405345 - DNA, 29 bp, Artificial Sequence
  Description of Artificial Sequence: Synthetic oligonucleotide
tgatgccgagaactggaacagccagaagg

SEQ ID NO: 405346 - DNA, 28 bp, Artificial Sequence
  Description of Artificial Sequence: Synthetic oligonucleotide
gatgccgagaactggaacagccagaagg

SEQ ID NO: 405347 - DNA, 30 bp, Artificial Sequence; identical to SEQ ID NO: 61760
  Description of Artificial Sequence: Synthetic oligonucleotide

SEQ ID NO: 405348 - DNA, 29 bp, Artificial Sequence
  Description of Artificial Sequence: Synthetic oligonucleotide
tgccgagaactggaacagccagaaggaag

SEQ ID NO: 405349 - DNA, 28 bp, Artificial Sequence
  Description of Artificial Sequence: Synthetic oligonucleotide
gccgagaactggaacagccagaaggaag

SEQ ID NO: 405350 - DNA, 29 bp, Artificial Sequence
  Description of Artificial Sequence: Synthetic oligonucleotide
ccgagaactggaacagccagaaggaagtc

SEQ ID NO: 405351 - DNA, 29 bp, Artificial Sequence
  Description of Artificial Sequence: Synthetic oligonucleotide
cgagaactggaacagccagaaggaagtcc

SEQ ID NO: 405352 - DNA, 30 bp, Artificial Sequence; identical to SEQ ID NO: 61765
  Description of Artificial Sequence: Synthetic oligonucleotide

SEQ ID NO: 405353 - DNA, 30 bp, Artificial Sequence; identical to SEQ ID NO: 61766
  Description of Artificial Sequence: Synthetic oligonucleotide

SEQ ID NO: 405354 - DNA, 29 bp, Artificial Sequence
  Description of Artificial Sequence: Synthetic oligonucleotide
gaactggaacagccagaaggaagtcctgg

SEQ ID NO: 405355 - DNA, 30 bp, Artificial Sequence; identical to SEQ ID NO: 61768
  Description of Artificial Sequence: Synthetic oligonucleotide

SEQ ID NO: 405356 - DNA, 20 bp, Artificial Sequence
  Description of Artificial Sequence: Synthetic oligonucleotide
tggagggggcccgggcggat

SEQ ID NO: 405357 - DNA, 20 bp, Artificial Sequence
  Description of Artificial Sequence: Synthetic oligonucleotide
ggagggggcccgggcggatt

SEQ ID NO: 405358 - DNA, 20 bp, Artificial Sequence
  Description of Artificial Sequence: Synthetic oligonucleotide
gagggggcccgggcggagtt

SEQ ID NO: 405359 - DNA, 20 bp, Artificial Sequence
  Description of Artificial Sequence: Synthetic oligonucleotide
agggggcccgggcggagttg

SEQ ID NO: 405360 - DNA, 20 bp, Artificial Sequence
  Description of Artificial Sequence: Synthetic oligonucleotide
gggggcccgggcggagttgt

SEQ ID NO: 405361 - DNA, 20 bp, Artificial Sequence
  Description of Artificial Sequence: Synthetic oligonucleotide
ggggcccgggcggagttgga

SEQ ID NO: 405362 - DNA, 21 bp, Artificial Sequence
  Description of Artificial Sequence: Synthetic oligonucleotide
gggcccgggcggagttggaca

SEQ ID NO: 405363 - DNA, 21 bp, Artificial Sequence
  Description of Artificial Sequence: Synthetic oligonucleotide
ggcccgggcggagttggacac

SEQ ID NO: 405364 - DNA, 21 bp, Artificial Sequence
  Description of Artificial Sequence: Synthetic oligonucleotide
gcccgggcggagttggacacg

SEQ ID NO: 405365 - DNA, 25 bp, Artificial Sequence
  Description of Artificial Sequence: Synthetic oligonucleotide
cgttccgcgggatcttgcagaggag

SEQ ID NO: 405366 - DNA, 20 bp, Artificial Sequence
  Description of Artificial Sequence: Synthetic oligonucleotide
gtgacgccgctggggcggct

SEQ ID NO: 405367 - DNA, 20 bp, Artificial Sequence
  Description of Artificial Sequence: Synthetic oligonucleotide
tgacgccgctggggcggcct

SEQ ID NO: 405368 - DNA, 20 bp, Artificial Sequence
  Description of Artificial Sequence: Synthetic oligonucleotide
gacgccgctggggcggcctt

SEQ ID NO: 405369 - DNA, 21 bp, Artificial Sequence
  Description of Artificial Sequence: Synthetic oligonucleotide
acgccgctggggcggcctgat

SEQ ID NO: 405370 - DNA, 20 bp, Artificial Sequence
  Description of Artificial Sequence: Synthetic oligonucleotide
cgccgctggggcggcctgat

SEQ ID NO: 405371 - DNA, 20 bp, Artificial Sequence
  Description of Artificial Sequence: Synthetic oligonucleotide
gccgctggggcggcctgatg

SEQ ID NO: 405372 - DNA, 20 bp, Artificial Sequence
  Description of Artificial Sequence: Synthetic oligonucleotide
ccgctggggcggcctgatgc

SEQ ID NO: 405373 - DNA, 20 bp, Artificial Sequence
  Description of Artificial Sequence: Synthetic oligonucleotide
cgctggggcggcctgatgcc

SEQ ID NO: 405374 - DNA, 21 bp, Artificial Sequence
  Description of Artificial Sequence: Synthetic oligonucleotide
gctggggcggcctgatgccga

SEQ ID NO: 405375 - DNA, 23 bp, Artificial Sequence
  Description of Artificial Sequence: Synthetic oligonucleotide
ctggggcggcctgatgccgagta

SEQ ID NO: 405376 - DNA, 24 bp, Artificial Sequence
  Description of Artificial Sequence: Synthetic oligonucleotide
tggggcggcctgatgccgagtact

SEQ ID NO: 405377 - DNA, 33 bp, Artificial Sequence; identical to SEQ ID NO: 61790
  Description of Artificial Sequence: Synthetic oligonucleotide

SEQ ID NO: 405378 - DNA, 32 bp, Artificial Sequence; identical to SEQ ID NO: 61791
  Description of Artificial Sequence: Synthetic oligonucleotide

SEQ ID NO: 405379 - DNA, 35 bp, Artificial Sequence; identical to SEQ ID NO: 61818
  Description of Artificial Sequence: Synthetic oligonucleotide

SEQ ID NO: 405380 - DNA, 34 bp, Artificial Sequence; identical to SEQ ID NO: 61819
  Description of Artificial Sequence: Synthetic oligonucleotide

SEQ ID NO: 405381 - DNA, 20 bp, Artificial Sequence
  Description of Artificial Sequence: Synthetic oligonucleotide
cggtgacgccgcaggggcct

SEQ ID NO: 405382 - DNA, 20 bp, Artificial Sequence
  Description of Artificial Sequence: Synthetic oligonucleotide
ggtgacgccgcaggggccgt

SEQ ID NO: 405383 - DNA, 20 bp, Artificial Sequence
  Description of Artificial Sequence: Synthetic oligonucleotide
gtgacgccgcaggggccgct

SEQ ID NO: 405384 - DNA, 20 bp, Artificial Sequence
  Description of Artificial Sequence: Synthetic oligonucleotide
tgacgccgcaggggccgcct

SEQ ID NO: 405385 - DNA, 20 bp, Artificial Sequence
  Description of Artificial Sequence: Synthetic oligonucleotide
gacgccgcaggggccgcctt

SEQ ID NO: 405386 - DNA, 20 bp, Artificial Sequence
  Description of Artificial Sequence: Synthetic oligonucleotide
acgccgcaggggccgcctgt

SEQ ID NO: 405387 - DNA, 20 bp, Artificial Sequence
  Description of Artificial Sequence: Synthetic oligonucleotide
cgccgcaggggccgcctgtt

SEQ ID NO: 405388 - DNA, 20 bp, Artificial Sequence
  Description of Artificial Sequence: Synthetic oligonucleotide
gccgcaggggccgcctgctt

SEQ ID NO: 405389 - DNA, 20 bp, Artificial Sequence
  Description of Artificial Sequence: Synthetic oligonucleotide
ccgcaggggccgcctgcctt

SEQ ID NO: 405390 - DNA, 20 bp, Artificial Sequence
  Description of Artificial Sequence: Synthetic oligonucleotide
cgcaggggccgcctgccgtt

SEQ ID NO: 405391 - DNA, 20 bp, Artificial Sequence
  Description of Artificial Sequence: Synthetic oligonucleotide
gcaggggccgcctgccgctt

SEQ ID NO: 405392 - DNA, 20 bp, Artificial Sequence
  Description of Artificial Sequence: Synthetic oligonucleotide
caggggccgcctgccgcctt

SEQ ID NO: 405393 - DNA, 20 bp, Artificial Sequence
  Description of Artificial Sequence: Synthetic oligonucleotide
aggggccgcctgccgccgat

SEQ ID NO: 405394 - DNA, 35 bp, Artificial Sequence; identical to SEQ ID NO: 61833
  Description of Artificial Sequence: Synthetic oligonucleotide

SEQ ID NO: 405395 - DNA, 34 bp, Artificial Sequence; identical to SEQ ID NO: 61834
  Description of Artificial Sequence: Synthetic oligonucleotide

SEQ ID NO: 405396 - DNA, 36 bp, Artificial Sequence; identical to SEQ ID NO: 61835
  Description of Artificial Sequence: Synthetic oligonucleotide

SEQ ID NO: 405397 - DNA, 37 bp, Artificial Sequence; identical to SEQ ID NO: 61836
  Description of Artificial Sequence: Synthetic oligonucleotide

SEQ ID NO: 405398 - DNA, 36 bp, Artificial Sequence; identical to SEQ ID NO: 61837
  Description of Artificial Sequence: Synthetic oligonucleotide

SEQ ID NO: 405399 - DNA, 35 bp, Artificial Sequence; identical to SEQ ID NO: 61838
  Description of Artificial Sequence: Synthetic oligonucleotide

SEQ ID NO: 405400 - DNA, 34 bp, Artificial Sequence; identical to SEQ ID NO: 61839
  Description of Artificial Sequence: Synthetic oligonucleotide

SEQ ID NO: 405401 - DNA, 33 bp, Artificial Sequence; identical to SEQ ID NO: 61840
  Description of Artificial Sequence: Synthetic oligonucleotide

SEQ ID NO: 405402 - DNA, 33 bp, Artificial Sequence; identical to SEQ ID NO: 61841
  Description of Artificial Sequence: Synthetic oligonucleotide

SEQ ID NO: 405403 - DNA, 35 bp, Artificial Sequence; identical to SEQ ID NO: 61842
  Description of Artificial Sequence: Synthetic oligonucleotide

SEQ ID NO: 405404 - DNA, 34 bp, Artificial Sequence; identical to SEQ ID NO: 61843
  Description of Artificial Sequence: Synthetic oligonucleotide

SEQ ID NO: 405405 - DNA, 34 bp, Artificial Sequence; identical to SEQ ID NO: 61844
  Description of Artificial Sequence: Synthetic oligonucleotide

SEQ ID NO: 405406 - DNA, 33 bp, Artificial Sequence; identical to SEQ ID NO: 61845
  Description of Artificial Sequence: Synthetic oligonucleotide

SEQ ID NO: 405407 - DNA, 32 bp, Artificial Sequence; identical to SEQ ID NO: 61846
  Description of Artificial Sequence: Synthetic oligonucleotide

SEQ ID NO: 405408 - DNA, 32 bp, Artificial Sequence; identical to SEQ ID NO: 61847
  Description of Artificial Sequence: Synthetic oligonucleotide

SEQ ID NO: 405409 - DNA, 32 bp, Artificial Sequence; identical to SEQ ID NO: 61848
  Description of Artificial Sequence: Synthetic oligonucleotide

SEQ ID NO: 405410 - DNA, 31 bp, Artificial Sequence; identical to SEQ ID NO: 61849
  Description of Artificial Sequence: Synthetic oligonucleotide

SEQ ID NO: 405411 - DNA, 32 bp, Artificial Sequence; identical to SEQ ID NO: 61850
  Description of Artificial Sequence: Synthetic oligonucleotide

SEQ ID NO: 405412 - DNA, 31 bp, Artificial Sequence; identical to SEQ ID NO: 61851
  Description of Artificial Sequence: Synthetic oligonucleotide

SEQ ID NO: 405413 - DNA, 30 bp, Artificial Sequence; identical to SEQ ID NO: 61852
  Description of Artificial Sequence: Synthetic oligonucleotide

SEQ ID NO: 405414 - DNA, 25 bp, Artificial Sequence
  Description of Artificial Sequence: Synthetic oligonucleotide
cagagccccatcaccgtggagtggt

SEQ ID NO: 405415 - DNA, 25 bp, Artificial Sequence
  Description of Artificial Sequence: Synthetic oligonucleotide
agagccccatcaccgtggagtggtg

SEQ ID NO: 405416 - DNA, 24 bp, Artificial Sequence
  Description of Artificial Sequence: Synthetic oligonucleotide
gagccccatcaccgtggagtggtg

SEQ ID NO: 405417 - DNA, 24 bp, Artificial Sequence
  Description of Artificial Sequence: Synthetic oligonucleotide
agccccatcaccgtggagtggtgg

SEQ ID NO: 405418 - DNA, 23 bp, Artificial Sequence
  Description of Artificial Sequence: Synthetic oligonucleotide
gccccatcaccgtggagtggtgg

SEQ ID NO: 405419 - DNA, 23 bp, Artificial Sequence
  Description of Artificial Sequence: Synthetic oligonucleotide
ccccatcaccgtggagtggtggg

SEQ ID NO: 405420 - DNA, 24 bp, Artificial Sequence
  Description of Artificial Sequence: Synthetic oligonucleotide
cccatcaccgtggagtggtgggct

SEQ ID NO: 405421 - DNA, 25 bp, Artificial Sequence
  Description of Artificial Sequence: Synthetic oligonucleotide
ccatcaccgtggagtggtgggctca

SEQ ID NO: 405422 - DNA, 25 bp, Artificial Sequence
  Description of Artificial Sequence: Synthetic oligonucleotide
acgtgcgcttcgacagcgacgtgga

SEQ ID NO: 405423 - DNA, 24 bp, Artificial Sequence
  Description of Artificial Sequence: Synthetic oligonucleotide
cgtgcgcttcgacagcgacgtgga

SEQ ID NO: 405424 - DNA, 24 bp, Artificial Sequence
  Description of Artificial Sequence: Synthetic oligonucleotide
gtgcgcttcgacagcgacgtggag

SEQ ID NO: 405425 - DNA, 25 bp, Artificial Sequence
  Description of Artificial Sequence: Synthetic oligonucleotide
tgcgcttcgacagcgacgtggaggt

SEQ ID NO: 405426 - DNA, 20 bp, Artificial Sequence
  Description of Artificial Sequence: Synthetic oligonucleotide
acgccgctggggcggcctga

SEQ ID NO: 405427 - DNA, 20 bp, Artificial Sequence
  Description of Artificial Sequence: Synthetic oligonucleotide
gccgctggggcggcctgact

SEQ ID NO: 405428 - DNA, 20 bp, Artificial Sequence
  Description of Artificial Sequence: Synthetic oligonucleotide
ccgctggggcggcctgacgt

SEQ ID NO: 405429 - DNA, 20 bp, Artificial Sequence
  Description of Artificial Sequence: Synthetic oligonucleotide
cgctggggcggcctgacgct

SEQ ID NO: 405430 - DNA, 20 bp, Artificial Sequence
  Description of Artificial Sequence: Synthetic oligonucleotide
gctggggcggcctgacgcct

SEQ ID NO: 405431 - DNA, 20 bp, Artificial Sequence
  Description of Artificial Sequence: Synthetic oligonucleotide
ctggggcggcctgacgccga

SEQ ID NO: 405432 - DNA, 22 bp, Artificial Sequence
  Description of Artificial Sequence: Synthetic oligonucleotide
tggggcggcctgacgccgagta

SEQ ID NO: 405433 - DNA, 23 bp, Artificial Sequence
  Description of Artificial Sequence: Synthetic oligonucleotide
cagcctccagagccccatcaccg

SEQ ID NO: 405434 - DNA, 23 bp, Artificial Sequence
  Description of Artificial Sequence: Synthetic oligonucleotide
agcctccagagccccatcaccgc

SEQ ID NO: 405435 - DNA, 22 bp, Artificial Sequence
  Description of Artificial Sequence: Synthetic oligonucleotide
gcctccagagccccatcaccgc

SEQ ID NO: 405436 - DNA, 22 bp, Artificial Sequence
  Description of Artificial Sequence: Synthetic oligonucleotide
cctccagagccccatcaccgcg

SEQ ID NO: 405437 - DNA, 23 bp, Artificial Sequence
  Description of Artificial Sequence: Synthetic oligonucleotide
ctccagagccccatcaccgcgga

SEQ ID NO: 405438 - DNA, 24 bp, Artificial Sequence
  Description of Artificial Sequence: Synthetic oligonucleotide
tccagagccccatcaccgcggagt

SEQ ID NO: 405439 - DNA, 23 bp, Artificial Sequence
  Description of Artificial Sequence: Synthetic oligonucleotide
ccagagccccatcaccgcggagt

SEQ ID NO: 405440 - DNA, 23 bp, Artificial Sequence
  Description of Artificial Sequence: Synthetic oligonucleotide
cagagccccatcaccgcggagtg

SEQ ID NO: 405441 - DNA, 23 bp, Artificial Sequence
  Description of Artificial Sequence: Synthetic oligonucleotide
agagccccatcaccgcggagtgg

SEQ ID NO: 405442 - DNA, 22 bp, Artificial Sequence
  Description of Artificial Sequence: Synthetic oligonucleotide
gagccccatcaccgcggagtgg

SEQ ID NO: 405443 - DNA, 22 bp, Artificial Sequence
  Description of Artificial Sequence: Synthetic oligonucleotide
agccccatcaccgcggagtggc

SEQ ID NO: 405444 - DNA, 21 bp, Artificial Sequence
  Description of Artificial Sequence: Synthetic oligonucleotide
gccccatcaccgcggagtggc

SEQ ID NO: 405445 - DNA, 21 bp, Artificial Sequence
  Description of Artificial Sequence: Synthetic oligonucleotide
ccccatcaccgcggagtggcg

SEQ ID NO: 405446 - DNA, 21 bp, Artificial Sequence
  Description of Artificial Sequence: Synthetic oligonucleotide
cccatcaccgcggagtggcgg

SEQ ID NO: 405447 - DNA, 21 bp, Artificial Sequence
  Description of Artificial Sequence: Synthetic oligonucleotide
ccatcaccgcggagtggcggg

SEQ ID NO: 405448 - DNA, 22 bp, Artificial Sequence
  Description of Artificial Sequence: Synthetic oligonucleotide
catcaccgcggagtggcgggct

SEQ ID NO: 405449 - DNA, 23 bp, Artificial Sequence
  Description of Artificial Sequence: Synthetic oligonucleotide
atcaccgcggagtggcgggctca

SEQ ID NO: 405450 - DNA, 22 bp, Artificial Sequence
  Description of Artificial Sequence: Synthetic oligonucleotide
tcaccgcggagtggcgggctca

SEQ ID NO: 405451 - DNA, 21 bp, Artificial Sequence
  Description of Artificial Sequence: Synthetic oligonucleotide
caccgcggagtggcgggctca

SEQ ID NO: 405452 - DNA, 22 bp, Artificial Sequence
  Description of Artificial Sequence: Synthetic oligonucleotide
accgcggagtggcgggctcagt

SEQ ID NO: 405453 - DNA, 21 bp, Artificial Sequence
  Description of Artificial Sequence: Synthetic oligonucleotide
ccgcggagtggcgggctcagt

SEQ ID NO: 405454 - DNA, 22 bp, Artificial Sequence
  Description of Artificial Sequence: Synthetic oligonucleotide
cgcggagtggcgggctcagtct

SEQ ID NO: 405455 - DNA, 25 bp, Artificial Sequence
  Description of Artificial Sequence: Synthetic oligonucleotide
gcggagtggcgggctcagtctgaat

SEQ ID NO: 405456 - DNA, 26 bp, Artificial Sequence
  Description of Artificial Sequence: Synthetic oligonucleotide
cggagtggcgggctcagtctgaatct

SEQ ID NO: 405457 - DNA, 26 bp, Artificial Sequence
  Description of Artificial Sequence: Synthetic oligonucleotide
gcggcctgatgccgagtactggaaga

SEQ ID NO: 405458 - DNA, 26 bp, Artificial Sequence
  Description of Artificial Sequence: Synthetic oligonucleotide
cggcctgatgccgagtactggaagag

SEQ ID NO: 405459 - DNA, 26 bp, Artificial Sequence
  Description of Artificial Sequence: Synthetic oligonucleotide
ggcctgatgccgagtactggaagagc

SEQ ID NO: 405460 - DNA, 27 bp, Artificial Sequence
  Description of Artificial Sequence: Synthetic oligonucleotide
gcctgatgccgagtactggaagagcca

SEQ ID NO: 405461 - DNA, 27 bp, Artificial Sequence
  Description of Artificial Sequence: Synthetic oligonucleotide
cctgatgccgagtactggaagagccag

SEQ ID NO: 405462 - DNA, 29 bp, Artificial Sequence
  Description of Artificial Sequence: Synthetic oligonucleotide
ctgatgccgagtactggaagagccagaag

SEQ ID NO: 405463 - DNA, 29 bp, Artificial Sequence
  Description of Artificial Sequence: Synthetic oligonucleotide
tgatgccgagtactggaagagccagaagg

SEQ ID NO: 405464 - DNA, 28 bp, Artificial Sequence
  Description of Artificial Sequence: Synthetic oligonucleotide
gatgccgagtactggaagagccagaagg

SEQ ID NO: 405465 - DNA, 30 bp, Artificial Sequence; identical to SEQ ID NO: 61904
  Description of Artificial Sequence: Synthetic oligonucleotide

SEQ ID NO: 405466 - DNA, 29 bp, Artificial Sequence
  Description of Artificial Sequence: Synthetic oligonucleotide
tgccgagtactggaagagccagaaggaag

SEQ ID NO: 405467 - DNA, 28 bp, Artificial Sequence
  Description of Artificial Sequence: Synthetic oligonucleotide
gccgagtactggaagagccagaaggaag

SEQ ID NO: 405468 - DNA, 29 bp, Artificial Sequence
  Description of Artificial Sequence: Synthetic oligonucleotide
ccgagtactggaagagccagaaggaagtc

SEQ ID NO: 405469 - DNA, 29 bp, Artificial Sequence
  Description of Artificial Sequence: Synthetic oligonucleotide
cgagtactggaagagccagaaggaagtcc

SEQ ID NO: 405470 - DNA, 30 bp, Artificial Sequence; identical to SEQ ID NO: 61909
  Description of Artificial Sequence: Synthetic oligonucleotide

SEQ ID NO: 405471 - DNA, 30 bp, Artificial Sequence; identical to SEQ ID NO: 61910
  Description of Artificial Sequence: Synthetic oligonucleotide

SEQ ID NO: 405472 - DNA, 29 bp, Artificial Sequence
  Description of Artificial Sequence: Synthetic oligonucleotide
gtactggaagagccagaaggaagtcctgg

SEQ ID NO: 405473 - DNA, 30 bp, Artificial Sequence; identical to SEQ ID NO: 61912
  Description of Artificial Sequence: Synthetic oligonucleotide

SEQ ID NO: 405474 - DNA, 29 bp, Artificial Sequence
  Description of Artificial Sequence: Synthetic oligonucleotide
actggaagagccagaaggaagtcctggag

SEQ ID NO: 405475 - DNA, 28 bp, Artificial Sequence
  Description of Artificial Sequence: Synthetic oligonucleotide
ctggaagagccagaaggaagtcctggag

SEQ ID NO: 405476 - DNA, 29 bp, Artificial Sequence
  Description of Artificial Sequence: Synthetic oligonucleotide
tggaagagccagaaggaagtcctggagag

SEQ ID NO: 405477 - DNA, 28 bp, Artificial Sequence
  Description of Artificial Sequence: Synthetic oligonucleotide
ggaagagccagaaggaagtcctggagag

SEQ ID NO: 405478 - DNA, 28 bp, Artificial Sequence
  Description of Artificial Sequence: Synthetic oligonucleotide
gaagagccagaaggaagtcctggagagg

SEQ ID NO: 405479 - DNA, 29 bp, Artificial Sequence
  Description of Artificial Sequence: Synthetic oligonucleotide
aagagccagaaggaagtcctggagaggac

SEQ ID NO: 405480 - DNA, 28 bp, Artificial Sequence
  Description of Artificial Sequence: Synthetic oligonucleotide
agagccagaaggaagtcctggagaggac

SEQ ID NO: 405481 - DNA, 27 bp, Artificial Sequence
  Description of Artificial Sequence: Synthetic oligonucleotide
gagccagaaggaagtcctggagaggac

SEQ ID NO: 405482 - DNA, 33 bp, Artificial Sequence; identical to SEQ ID NO: 61921
  Description of Artificial Sequence: Synthetic oligonucleotide

SEQ ID NO: 405483 - DNA, 32 bp, Artificial Sequence; identical to SEQ ID NO: 61922
  Description of Artificial Sequence: Synthetic oligonucleotide

SEQ ID NO: 405484 - DNA, 31 bp, Artificial Sequence; identical to SEQ ID NO: 61923
  Description of Artificial Sequence: Synthetic oligonucleotide

SEQ ID NO: 405485 - DNA, 30 bp, Artificial Sequence; identical to SEQ ID NO: 61924
  Description of Artificial Sequence: Synthetic oligonucleotide

SEQ ID NO: 405486 - DNA, 33 bp, Artificial Sequence; identical to SEQ ID NO: 61925
  Description of Artificial Sequence: Synthetic oligonucleotide

SEQ ID NO: 405487 - DNA, 35 bp, Artificial Sequence; identical to SEQ ID NO: 61926
  Description of Artificial Sequence: Synthetic oligonucleotide

SEQ ID NO: 405488 - DNA, 34 bp, Artificial Sequence; identical to SEQ ID NO: 61927
  Description of Artificial Sequence: Synthetic oligonucleotide

SEQ ID NO: 405489 - DNA, 35 bp, Artificial Sequence; identical to SEQ ID NO: 61928
  Description of Artificial Sequence: Synthetic oligonucleotide

SEQ ID NO: 405490 - DNA, 35 bp, Artificial Sequence; identical to SEQ ID NO: 61929
  Description of Artificial Sequence: Synthetic oligonucleotide

SEQ ID NO: 405491 - DNA, 36 bp, Artificial Sequence; identical to SEQ ID NO: 61930
  Description of Artificial Sequence: Synthetic oligonucleotide

SEQ ID NO: 405492 - DNA, 36 bp, Artificial Sequence; identical to SEQ ID NO: 61931
  Description of Artificial Sequence: Synthetic oligonucleotide

SEQ ID NO: 405493 - DNA, 35 bp, Artificial Sequence; identical to SEQ ID NO: 61932
  Description of Artificial Sequence: Synthetic oligonucleotide

SEQ ID NO: 405494 - DNA, 36 bp, Artificial Sequence; identical to SEQ ID NO: 61933
  Description of Artificial Sequence: Synthetic oligonucleotide

SEQ ID NO: 405495 - DNA, 35 bp, Artificial Sequence; identical to SEQ ID NO: 61934
  Description of Artificial Sequence: Synthetic oligonucleotide

SEQ ID NO: 405496 - DNA, 34 bp, Artificial Sequence; identical to SEQ ID NO: 61935
  Description of Artificial Sequence: Synthetic oligonucleotide

SEQ ID NO: 405497 - DNA, 35 bp, Artificial Sequence; identical to SEQ ID NO: 61936
  Description of Artificial Sequence: Synthetic oligonucleotide

SEQ ID NO: 405498 - DNA, 34 bp, Artificial Sequence; identical to SEQ ID NO: 61937
  Description of Artificial Sequence: Synthetic oligonucleotide

SEQ ID NO: 405499 - DNA, 33 bp, Artificial Sequence; identical to SEQ ID NO: 61938
  Description of Artificial Sequence: Synthetic oligonucleotide

SEQ ID NO: 405500 - DNA, 32 bp, Artificial Sequence; identical to SEQ ID NO: 61939
  Description of Artificial Sequence: Synthetic oligonucleotide

SEQ ID NO: 405501 - DNA, 33 bp, Artificial Sequence; identical to SEQ ID NO: 61940
  Description of Artificial Sequence: Synthetic oligonucleotide

SEQ ID NO: 405502 - DNA, 32 bp, Artificial Sequence; identical to SEQ ID NO: 61941
  Description of Artificial Sequence: Synthetic oligonucleotide

SEQ ID NO: 405503 - DNA, 32 bp, Artificial Sequence; identical to SEQ ID NO: 61942
  Description of Artificial Sequence: Synthetic oligonucleotide

SEQ ID NO: 405504 - DNA, 32 bp, Artificial Sequence; identical to SEQ ID NO: 61943
  Description of Artificial Sequence: Synthetic oligonucleotide

SEQ ID NO: 405505 - DNA, 31 bp, Artificial Sequence; identical to SEQ ID NO: 61944
  Description of Artificial Sequence: Synthetic oligonucleotide

SEQ ID NO: 405506 - DNA, 31 bp, Artificial Sequence; identical to SEQ ID NO: 61945
  Description of Artificial Sequence: Synthetic oligonucleotide

SEQ ID NO: 405507 - DNA, 30 bp, Artificial Sequence; identical to SEQ ID NO: 61946
  Description of Artificial Sequence: Synthetic oligonucleotide

SEQ ID NO: 405508 - DNA, 30 bp, Artificial Sequence; identical to SEQ ID NO: 61947
  Description of Artificial Sequence: Synthetic oligonucleotide

SEQ ID NO: 405509 - DNA, 30 bp, Artificial Sequence; identical to SEQ ID NO: 61948
  Description of Artificial Sequence: Synthetic oligonucleotide

SEQ ID NO: 405510 - DNA, 29 bp, Artificial Sequence
  Description of Artificial Sequence: Synthetic oligonucleotide
ttcagaatgatcaggaggagacagccggc

SEQ ID NO: 405511 - DNA, 28 bp, Artificial Sequence
  Description of Artificial Sequence: Synthetic oligonucleotide
tcagaatgatcaggaggagacagccggc

SEQ ID NO: 405512 - DNA, 27 bp, Artificial Sequence
  Description of Artificial Sequence: Synthetic oligonucleotide
cagaatgatcaggaggagacagccggc

SEQ ID NO: 405513 - DNA, 27 bp, Artificial Sequence
  Description of Artificial Sequence: Synthetic oligonucleotide
agaatgatcaggaggagacagccggcg

SEQ ID NO: 405514 - DNA, 27 bp, Artificial Sequence
  Description of Artificial Sequence: Synthetic oligonucleotide
agcgcgtgcgtcttgtaaccagacacg

SEQ ID NO: 405515 - DNA, 27 bp, Artificial Sequence
  Description of Artificial Sequence: Synthetic oligonucleotide
gcgcgtgcgtcttgtaaccagacacgt

SEQ ID NO: 405516 - DNA, 27 bp, Artificial Sequence
  Description of Artificial Sequence: Synthetic oligonucleotide
cgcgtgcgtcttgtaaccagacacgtc

SEQ ID NO: 405517 - DNA, 32 bp, Artificial Sequence; identical to SEQ ID NO: 61956
  Description of Artificial Sequence: Synthetic oligonucleotide

SEQ ID NO: 405518 - DNA, 32 bp, Artificial Sequence; identical to SEQ ID NO: 61957
  Description of Artificial Sequence: Synthetic oligonucleotide

SEQ ID NO: 405519 - DNA, 32 bp, Artificial Sequence; identical to SEQ ID NO: 61958
  Description of Artificial Sequence: Synthetic oligonucleotide

SEQ ID NO: 405520 - DNA, 33 bp, Artificial Sequence; identical to SEQ ID NO: 61959
  Description of Artificial Sequence: Synthetic oligonucleotide

SEQ ID NO: 405521 - DNA, 32 bp, Artificial Sequence; identical to SEQ ID NO: 61960
  Description of Artificial Sequence: Synthetic oligonucleotide

SEQ ID NO: 405522 - DNA, 33 bp, Artificial Sequence; identical to SEQ ID NO: 61961
  Description of Artificial Sequence: Synthetic oligonucleotide

SEQ ID NO: 405523 - DNA, 33 bp, Artificial Sequence; identical to SEQ ID NO: 61962
  Description of Artificial Sequence: Synthetic oligonucleotide

SEQ ID NO: 405524 - DNA, 34 bp, Artificial Sequence; identical to SEQ ID NO: 61963
  Description of Artificial Sequence: Synthetic oligonucleotide

SEQ ID NO: 405525 - DNA, 33 bp, Artificial Sequence; identical to SEQ ID NO: 61964
  Description of Artificial Sequence: Synthetic oligonucleotide

SEQ ID NO: 405526 - DNA, 35 bp, Artificial Sequence; identical to SEQ ID NO: 61965
  Description of Artificial Sequence: Synthetic oligonucleotide

SEQ ID NO: 405527 - DNA, 34 bp, Artificial Sequence; identical to SEQ ID NO: 61966
  Description of Artificial Sequence: Synthetic oligonucleotide

SEQ ID NO: 405528 - DNA, 33 bp, Artificial Sequence; identical to SEQ ID NO: 61967
  Description of Artificial Sequence: Synthetic oligonucleotide

SEQ ID NO: 405529 - DNA, 33 bp, Artificial Sequence; identical to SEQ ID NO: 61968
  Description of Artificial Sequence: Synthetic oligonucleotide

SEQ ID NO: 405530 - DNA, 32 bp, Artificial Sequence; identical to SEQ ID NO: 61969
  Description of Artificial Sequence: Synthetic oligonucleotide

SEQ ID NO: 405531 - DNA, 31 bp, Artificial Sequence; identical to SEQ ID NO: 61970
  Description of Artificial Sequence: Synthetic oligonucleotide

SEQ ID NO: 405532 - DNA, 30 bp, Artificial Sequence; identical to SEQ ID NO: 61971
  Description of Artificial Sequence: Synthetic oligonucleotide

SEQ ID NO: 405533 - DNA, 30 bp, Artificial Sequence; identical to SEQ ID NO: 61972
  Description of Artificial Sequence: Synthetic oligonucleotide

SEQ ID NO: 405534 - DNA, 30 bp, Artificial Sequence; identical to SEQ ID NO: 61973
  Description of Artificial Sequence: Synthetic oligonucleotide

SEQ ID NO: 405535 - DNA, 29 bp, Artificial Sequence
  Description of Artificial Sequence: Synthetic oligonucleotide
gacacgtctataaccgagaggagtacgcg

SEQ ID NO: 405536 - DNA, 29 bp, Artificial Sequence
  Description of Artificial Sequence: Synthetic oligonucleotide
acacgtctataaccgagaggagtacgcgc

SEQ ID NO: 405537 - DNA, 28 bp, Artificial Sequence
  Description of Artificial Sequence: Synthetic oligonucleotide
cacgtctataaccgagaggagtacgcgc

SEQ ID NO: 405538 - DNA, 28 bp, Artificial Sequence
  Description of Artificial Sequence: Synthetic oligonucleotide
acgtctataaccgagaggagtacgcgcg

SEQ ID NO: 405539 - DNA, 27 bp, Artificial Sequence
  Description of Artificial Sequence: Synthetic oligonucleotide
cgtctataaccgagaggagtacgcgcg

SEQ ID NO: 405540 - DNA, 27 bp, Artificial Sequence
  Description of Artificial Sequence: Synthetic oligonucleotide
gtctataaccgagaggagtacgcgcgc

SEQ ID NO: 405541 - DNA, 27 bp, Artificial Sequence
  Description of Artificial Sequence: Synthetic oligonucleotide
gaaggacatcctggagaggacccgagt

SEQ ID NO: 405542 - DNA, 27 bp, Artificial Sequence
  Description of Artificial Sequence: Synthetic oligonucleotide
aaggacatcctggagaggacccgagtg

SEQ ID NO: 405543 - DNA, 26 bp, Artificial Sequence
  Description of Artificial Sequence: Synthetic oligonucleotide
aggacatcctggagaggacccgagtg

SEQ ID NO: 405544 - DNA, 25 bp, Artificial Sequence
  Description of Artificial Sequence: Synthetic oligonucleotide
ggacatcctggagaggacccgagtg

SEQ ID NO: 405545 - DNA, 26 bp, Artificial Sequence
  Description of Artificial Sequence: Synthetic oligonucleotide
gacatcctggagaggacccgagtgga

SEQ ID NO: 405546 - DNA, 27 bp, Artificial Sequence
  Description of Artificial Sequence: Synthetic oligonucleotide
acatcctggagaggacccgagtggagt

SEQ ID NO: 405547 - DNA, 27 bp, Artificial Sequence
  Description of Artificial Sequence: Synthetic oligonucleotide
catcctggagaggacccgagtggagtt

SEQ ID NO: 405548 - DNA, 27 bp, Artificial Sequence
  Description of Artificial Sequence: Synthetic oligonucleotide
atcctggagaggacccgagtggagttg

SEQ ID NO: 405549 - DNA, 26 bp, Artificial Sequence
  Description of Artificial Sequence: Synthetic oligonucleotide
tcctggagaggacccgagtggagttg

SEQ ID NO: 405550 - DNA, 25 bp, Artificial Sequence
  Description of Artificial Sequence: Synthetic oligonucleotide
cctggagaggacccgagtggagttg

SEQ ID NO: 405551 - DNA, 26 bp, Artificial Sequence
  Description of Artificial Sequence: Synthetic oligonucleotide
ctggagaggacccgagtggagttgga

SEQ ID NO: 405552 - DNA, 27 bp, Artificial Sequence
  Description of Artificial Sequence: Synthetic oligonucleotide
tggagaggacccgagtggagttggaca

SEQ ID NO: 405553 - DNA, 26 bp, Artificial Sequence
  Description of Artificial Sequence: Synthetic oligonucleotide
ggagaggacccgagtggagttggaca

SEQ ID NO: 405554 - DNA, 26 bp, Artificial Sequence
  Description of Artificial Sequence: Synthetic oligonucleotide
gagaggacccgagtggagttggacac

SEQ ID NO: 405555 - DNA, 26 bp, Artificial Sequence
  Description of Artificial Sequence: Synthetic oligonucleotide
agaggacccgagtggagttggacacg

SEQ ID NO: 405556 - DNA, 25 bp, Artificial Sequence
  Description of Artificial Sequence: Synthetic oligonucleotide
gaggacccgagtggagttggacacg

SEQ ID NO: 405557 - DNA, 26 bp, Artificial Sequence
  Description of Artificial Sequence: Synthetic oligonucleotide
aggacccgagtggagttggacacggt

SEQ ID NO: 405558 - DNA, 25 bp, Artificial Sequence
  Description of Artificial Sequence: Synthetic oligonucleotide
ggacccgagtggagttggacacggt

SEQ ID NO: 405559 - DNA, 26 bp, Artificial Sequence
  Description of Artificial Sequence: Synthetic oligonucleotide
gacccgagtggagttggacacggtgt

SEQ ID NO: 405560 - DNA, 26 bp, Artificial Sequence
  Description of Artificial Sequence: Synthetic oligonucleotide
acccgagtggagttggacacggtgtg

SEQ ID NO: 405561 - DNA, 25 bp, Artificial Sequence
  Description of Artificial Sequence: Synthetic oligonucleotide
cccgagtggagttggacacggtgtg

SEQ ID NO: 405562 - DNA, 26 bp, Artificial Sequence
  Description of Artificial Sequence: Synthetic oligonucleotide
ccgagtggagttggacacggtgtgca

SEQ ID NO: 405563 - DNA, 27 bp, Artificial Sequence
  Description of Artificial Sequence: Synthetic oligonucleotide
cgagtggagttggacacggtgtgcaga

SEQ ID NO: 405564 - DNA, 27 bp, Artificial Sequence
  Description of Artificial Sequence: Synthetic oligonucleotide
gagtggagttggacacggtgtgcagac

SEQ ID NO: 405565 - DNA, 28 bp, Artificial Sequence
  Description of Artificial Sequence: Synthetic oligonucleotide
agtggagttggacacggtgtgcagacac

SEQ ID NO: 405566 - DNA, 27 bp, Artificial Sequence
  Description of Artificial Sequence: Synthetic oligonucleotide
gtggagttggacacggtgtgcagacac

SEQ ID NO: 405567 - DNA, 29 bp, Artificial Sequence
  Description of Artificial Sequence: Synthetic oligonucleotide
tggagttggacacggtgtgcagacacaac

SEQ ID NO: 405568 - DNA, 28 bp, Artificial Sequence
  Description of Artificial Sequence: Synthetic oligonucleotide
cagcgtggagatgtctacacctgccaag

SEQ ID NO: 405569 - DNA, 29 bp, Artificial Sequence
  Description of Artificial Sequence: Synthetic oligonucleotide
agcgtggagatgtctacacctgccaagtg

SEQ ID NO: 405570 - DNA, 28 bp, Artificial Sequence
  Description of Artificial Sequence: Synthetic oligonucleotide
gcgtggagatgtctacacctgccaagtg

SEQ ID NO: 405571 - DNA, 28 bp, Artificial Sequence
  Description of Artificial Sequence: Synthetic oligonucleotide
cgtggagatgtctacacctgccaagtgg

SEQ ID NO: 405572 - DNA, 29 bp, Artificial Sequence
  Description of Artificial Sequence: Synthetic oligonucleotide
gtggagatgtctacacctgccaagtggag

SEQ ID NO: 405573 - DNA, 29 bp, Artificial Sequence
  Description of Artificial Sequence: Synthetic oligonucleotide
tggagatgtctacacctgccaagtggagc

SEQ ID NO: 405574 - DNA, 29 bp, Artificial Sequence
  Description of Artificial Sequence: Synthetic oligonucleotide
agatgtctacacctgccaagtggagcacc

SEQ ID NO: 405575 - DNA, 28 bp, Artificial Sequence
  Description of Artificial Sequence: Synthetic oligonucleotide
gatgtctacacctgccaagtggagcacc

SEQ ID NO: 405576 - DNA, 28 bp, Artificial Sequence
  Description of Artificial Sequence: Synthetic oligonucleotide
atgtctacacctgccaagtggagcaccc

SEQ ID NO: 405577 - DNA, 27 bp, Artificial Sequence
  Description of Artificial Sequence: Synthetic oligonucleotide
tgtctacacctgccaagtggagcaccc

SEQ ID NO: 405578 - DNA, 26 bp, Artificial Sequence
  Description of Artificial Sequence: Synthetic oligonucleotide
gtctacacctgccaagtggagcaccc

SEQ ID NO: 405579 - DNA, 27 bp, Artificial Sequence
  Description of Artificial Sequence: Synthetic oligonucleotide
tctacacctgccaagtggagcacccca

SEQ ID NO: 405580 - DNA, 26 bp, Artificial Sequence
  Description of Artificial Sequence: Synthetic oligonucleotide
ctacacctgccaagtggagcacccca

SEQ ID NO: 405581 - DNA, 26 bp, Artificial Sequence
  Description of Artificial Sequence: Synthetic oligonucleotide
tacacctgccaagtggagcaccccag

SEQ ID NO: 405582 - DNA, 25 bp, Artificial Sequence
  Description of Artificial Sequence: Synthetic oligonucleotide
acacctgccaagtggagcaccccag

SEQ ID NO: 405583 - DNA, 24 bp, Artificial Sequence
  Description of Artificial Sequence: Synthetic oligonucleotide
cacctgccaagtggagcaccccag

SEQ ID NO: 405584 - DNA, 24 bp, Artificial Sequence
  Description of Artificial Sequence: Synthetic oligonucleotide
acctgccaagtggagcaccccagc

SEQ ID NO: 405585 - DNA, 23 bp, Artificial Sequence
  Description of Artificial Sequence: Synthetic oligonucleotide
cctgccaagtggagcaccccagc

SEQ ID NO: 405586 - DNA, 24 bp, Artificial Sequence
  Description of Artificial Sequence: Synthetic oligonucleotide
ctgccaagtggagcaccccagcct

SEQ ID NO: 405587 - DNA, 24 bp, Artificial Sequence
  Description of Artificial Sequence: Synthetic oligonucleotide
tgccaagtggagcaccccagcctc

SEQ ID NO: 405588 - DNA, 23 bp, Artificial Sequence
  Description of Artificial Sequence: Synthetic oligonucleotide
gccaagtggagcaccccagcctc

SEQ ID NO: 405589 - DNA, 24 bp, Artificial Sequence
  Description of Artificial Sequence: Synthetic oligonucleotide
ccaagtggagcaccccagcctcca

SEQ ID NO: 405590 - DNA, 25 bp, Artificial Sequence
  Description of Artificial Sequence: Synthetic oligonucleotide
caagtggagcaccccagcctccaga

SEQ ID NO: 405591 - DNA, 25 bp, Artificial Sequence
  Description of Artificial Sequence: Synthetic oligonucleotide
aagtggagcaccccagcctccagag

SEQ ID NO: 405592 - DNA, 24 bp, Artificial Sequence
  Description of Artificial Sequence: Synthetic oligonucleotide
agtggagcaccccagcctccagag

SEQ ID NO: 405593 - DNA, 38 bp, Artificial Sequence
  Description of Artificial Sequence: Synthetic oligonucleotide
tcactaatgtgcttcaggtatatccctgtctagaagtc

SEQ ID NO: 405594 - DNA, 37 bp, Artificial Sequence
  Description of Artificial Sequence: Synthetic oligonucleotide
cactaatgtgcttcaggtatatccctgtctagaagtc

SEQ ID NO: 405595 - DNA, 38 bp, Artificial Sequence
  Description of Artificial Sequence: Synthetic oligonucleotide
actaatgtgcttcaggtatatccctgtctagaagtcag

SEQ ID NO: 405596 - DNA, 37 bp, Artificial Sequence
  Description of Artificial Sequence: Synthetic oligonucleotide
ctaatgtgcttcaggtatatccctgtctagaagtcag

SEQ ID NO: 405597 - DNA, 40 bp, Artificial Sequence
  Description of Artificial Sequence: Synthetic oligonucleotide
taatgtgcttcaggtatatccctgtctagaagtcagattg

SEQ ID NO: 405598 - DNA, 39 bp, Artificial Sequence
  Description of Artificial Sequence: Synthetic oligonucleotide
aatgtgcttcaggtatatccctgtctagaagtcagattg

SEQ ID NO: 405599 - DNA, 38 bp, Artificial Sequence
  Description of Artificial Sequence: Synthetic oligonucleotide
atgtgcttcaggtatatccctgtctagaagtcagattg

SEQ ID NO: 405600 - DNA, 37 bp, Artificial Sequence
  Description of Artificial Sequence: Synthetic oligonucleotide
tgtgcttcaggtatatccctgtctagaagtcagattg

SEQ ID NO: 405601 - DNA, 36 bp, Artificial Sequence
  Description of Artificial Sequence: Synthetic oligonucleotide
gtgcttcaggtatatccctgtctagaagtcagattg

SEQ ID NO: 405602 - DNA, 36 bp, Artificial Sequence
  Description of Artificial Sequence: Synthetic oligonucleotide
tgcttcaggtatatccctgtctagaagtcagattgg

SEQ ID NO: 405603 - DNA, 35 bp, Artificial Sequence
  Description of Artificial Sequence: Synthetic oligonucleotide
gcttcaggtatatccctgtctagaagtcagattgg

SEQ ID NO: 405604 - DNA, 35 bp, Artificial Sequence
  Description of Artificial Sequence: Synthetic oligonucleotide
cttcaggtatatccctgtctagaagtcagattggg

SEQ ID NO: 405605 - DNA, 35 bp, Artificial Sequence
  Description of Artificial Sequence: Synthetic oligonucleotide
ttcaggtatatccctgtctagaagtcagattgggg

SEQ ID NO: 405606 - DNA, 34 bp, Artificial Sequence
  Description of Artificial Sequence: Synthetic oligonucleotide
tcaggtatatccctgtctagaagtcagattgggg

SEQ ID NO: 405607 - DNA, 33 bp, Artificial Sequence
  Description of Artificial Sequence: Synthetic oligonucleotide
caggtatatccctgtctagaagtcagattgggg

SEQ ID NO: 405608 - DNA, 38 bp, Artificial Sequence
  Description of Artificial Sequence: Synthetic oligonucleotide
aggtatatccctgtctagaagtcagattggggttaaag

SEQ ID NO: 405609 - DNA, 37 bp, Artificial Sequence
  Description of Artificial Sequence: Synthetic oligonucleotide
ggtatatccctgtctagaagtcagattggggttaaag

SEQ ID NO: 405610 - DNA, 38 bp, Artificial Sequence
  Description of Artificial Sequence: Synthetic oligonucleotide
gtatatccctgtctagaagtcagattggggttaaagag

SEQ ID NO: 405611 - DNA, 39 bp, Artificial Sequence
  Description of Artificial Sequence: Synthetic oligonucleotide
tatatccctgtctagaagtcagattggggttaaagagtc

SEQ ID NO: 405612 - DNA, 38 bp, Artificial Sequence
  Description of Artificial Sequence: Synthetic oligonucleotide
atatccctgtctagaagtcagattggggttaaagagtc

SEQ ID NO: 405613 - DNA, 37 bp, Artificial Sequence
  Description of Artificial Sequence: Synthetic oligonucleotide
tatccctgtctagaagtcagattggggttaaagagtc

SEQ ID NO: 405614 - DNA, 36 bp, Artificial Sequence
  Description of Artificial Sequence: Synthetic oligonucleotide
atccctgtctagaagtcagattggggttaaagagtc

SEQ ID NO: 405615 - DNA, 35 bp, Artificial Sequence
  Description of Artificial Sequence: Synthetic oligonucleotide
tccctgtctagaagtcagattggggttaaagagtc

SEQ ID NO: 405616 - DNA, 34 bp, Artificial Sequence
  Description of Artificial Sequence: Synthetic oligonucleotide
ccctgtctagaagtcagattggggttaaagagtc

SEQ ID NO: 405617 - DNA, 35 bp, Artificial Sequence
  Description of Artificial Sequence: Synthetic oligonucleotide
cctgtctagaagtcagattggggttaaagagtctg

SEQ ID NO: 405618 - DNA, 36 bp, Artificial Sequence
  Description of Artificial Sequence: Synthetic oligonucleotide
ctgtctagaagtcagattggggttaaagagtctgtc

SEQ ID NO: 405619 - DNA, 36 bp, Artificial Sequence
  Description of Artificial Sequence: Synthetic oligonucleotide
tgtctagaagtcagattggggttaaagagtctgtcc

SEQ ID NO: 405620 - DNA, 35 bp, Artificial Sequence
  Description of Artificial Sequence: Synthetic oligonucleotide
gtctagaagtcagattggggttaaagagtctgtcc

SEQ ID NO: 405621 - DNA, 35 bp, Artificial Sequence
  Description of Artificial Sequence: Synthetic oligonucleotide
tctagaagtcagattggggttaaagagtctgtccg

SEQ ID NO: 405622 - DNA, 34 bp, Artificial Sequence
  Description of Artificial Sequence: Synthetic oligonucleotide
ctagaagtcagattggggttaaagagtctgtccg

SEQ ID NO: 405623 - DNA, 35 bp, Artificial Sequence
  Description of Artificial Sequence: Synthetic oligonucleotide
tagaagtcagattggggttaaagagtctgtccgtg

SEQ ID NO: 405624 - DNA, 34 bp, Artificial Sequence
  Description of Artificial Sequence: Synthetic oligonucleotide
agaagtcagattggggttaaagagtctgtccgtg

SEQ ID NO: 405625 - DNA, 33 bp, Artificial Sequence
  Description of Artificial Sequence: Synthetic oligonucleotide
gaagtcagattggggttaaagagtctgtccgtg

SEQ ID NO: 405626 - DNA, 36 bp, Artificial Sequence
  Description of Artificial Sequence: Synthetic oligonucleotide
aagtcagattggggttaaagagtctgtccgtgattg

SEQ ID NO: 405627 - DNA, 35 bp, Artificial Sequence
  Description of Artificial Sequence: Synthetic oligonucleotide
agtcagattggggttaaagagtctgtccgtgattg

SEQ ID NO: 405628 - DNA, 34 bp, Artificial Sequence
  Description of Artificial Sequence: Synthetic oligonucleotide
gtcagattggggttaaagagtctgtccgtgattg

SEQ ID NO: 405629 - DNA, 35 bp, Artificial Sequence
  Description of Artificial Sequence: Synthetic oligonucleotide
tcagattggggttaaagagtctgtccgtgattgac

SEQ ID NO: 405630 - DNA, 34 bp, Artificial Sequence
  Description of Artificial Sequence: Synthetic oligonucleotide
cagattggggttaaagagtctgtccgtgattgac

SEQ ID NO: 405631 - DNA, 37 bp, Artificial Sequence
  Description of Artificial Sequence: Synthetic oligonucleotide
agattggggttaaagagtctgtccgtgattgactaac

SEQ ID NO: 405632 - DNA, 36 bp, Artificial Sequence
  Description of Artificial Sequence: Synthetic oligonucleotide
gattggggttaaagagtctgtccgtgattgactaac

SEQ ID NO: 405633 - DNA, 37 bp, Artificial Sequence
  Description of Artificial Sequence: Synthetic oligonucleotide
attggggttaaagagtctgtccgtgattgactaacag

SEQ ID NO: 405634 - DNA, 36 bp, Artificial Sequence
  Description of Artificial Sequence: Synthetic oligonucleotide
ttggggttaaagagtctgtccgtgattgactaacag

SEQ ID NO: 405635 - DNA, 35 bp, Artificial Sequence
  Description of Artificial Sequence: Synthetic oligonucleotide
tggggttaaagagtctgtccgtgattgactaacag

SEQ ID NO: 405636 - DNA, 34 bp, Artificial Sequence
  Description of Artificial Sequence: Synthetic oligonucleotide
ggggttaaagagtctgtccgtgattgactaacag

SEQ ID NO: 405637 - DNA, 35 bp, Artificial Sequence
  Description of Artificial Sequence: Synthetic oligonucleotide
gggttaaagagtctgtccgtgattgactaacagtc

SEQ ID NO: 405638 - DNA, 42 bp, Artificial Sequence
  Description of Artificial Sequence: Synthetic oligonucleotide
ggttaaagagtctgtccgtgattgactaacagtcttaaatac

SEQ ID NO: 405639 - DNA, 44 bp, Artificial Sequence
  Description of Artificial Sequence: Synthetic oligonucleotide
gttaaagagtctgtccgtgattgactaacagtcttaaatacttg

SEQ ID NO: 405640 - DNA, 48 bp, Artificial Sequence
  Description of Artificial Sequence: Synthetic oligonucleotide
ttaaagagtctgtccgtgattgactaacagtcttaaatacttgatttg

SEQ ID NO: 405641 - DNA, 47 bp, Artificial Sequence
  Description of Artificial Sequence: Synthetic oligonucleotide
taaagagtctgtccgtgattgactaacagtcttaaatacttgatttg

SEQ ID NO: 405642 - DNA, 46 bp, Artificial Sequence
  Description of Artificial Sequence: Synthetic oligonucleotide
aaagagtctgtccgtgattgactaacagtcttaaatacttgatttg

SEQ ID NO: 405643 - DNA, 45 bp, Artificial Sequence
  Description of Artificial Sequence: Synthetic oligonucleotide
aagagtctgtccgtgattgactaacagtcttaaatacttgatttg

SEQ ID NO: 405644 - DNA, 44 bp, Artificial Sequence
  Description of Artificial Sequence: Synthetic oligonucleotide
agagtctgtccgtgattgactaacagtcttaaatacttgatttg

SEQ ID NO: 405645 - DNA, 43 bp, Artificial Sequence
  Description of Artificial Sequence: Synthetic oligonucleotide
gagtctgtccgtgattgactaacagtcttaaatacttgatttg

SEQ ID NO: 405646 - DNA, 45 bp, Artificial Sequence
  Description of Artificial Sequence: Synthetic oligonucleotide
agtctgtccgtgattgactaacagtcttaaatacttgatttgttg

SEQ ID NO: 405647 - DNA, 44 bp, Artificial Sequence
  Description of Artificial Sequence: Synthetic oligonucleotide
gtctgtccgtgattgactaacagtcttaaatacttgatttgttg

SEQ ID NO: 405648 - DNA, 46 bp, Artificial Sequence
  Description of Artificial Sequence: Synthetic oligonucleotide
tctgtccgtgattgactaacagtcttaaatacttgatttgttgttg

SEQ ID NO: 405649 - DNA, 45 bp, Artificial Sequence
  Description of Artificial Sequence: Synthetic oligonucleotide
ctgtccgtgattgactaacagtcttaaatacttgatttgttgttg

SEQ ID NO: 405650 - DNA, 47 bp, Artificial Sequence
  Description of Artificial Sequence: Synthetic oligonucleotide
tgtccgtgattgactaacagtcttaaatacttgatttgttgttgttg

SEQ ID NO: 405651 - DNA, 46 bp, Artificial Sequence
  Description of Artificial Sequence: Synthetic oligonucleotide
gtccgtgattgactaacagtcttaaatacttgatttgttgttgttg

SEQ ID NO: 405652 - DNA, 48 bp, Artificial Sequence
  Description of Artificial Sequence: Synthetic oligonucleotide
tccgtgattgactaacagtcttaaatacttgatttgttgttgttgttg

SEQ ID NO: 405653 - DNA, 47 bp, Artificial Sequence
  Description of Artificial Sequence: Synthetic oligonucleotide
ccgtgattgactaacagtcttaaatacttgatttgttgttgttgttg

SEQ ID NO: 405654 - DNA, 48 bp, Artificial Sequence
  Description of Artificial Sequence: Synthetic oligonucleotide
cgtgattgactaacagtcttaaatacttgatttgttgttgttgttgtc

SEQ ID NO: 405655 - DNA, 48 bp, Artificial Sequence
  Description of Artificial Sequence: Synthetic oligonucleotide
gtgattgactaacagtcttaaatacttgatttgttgttgttgttgtcc

SEQ ID NO: 405656 - DNA, 49 bp, Artificial Sequence
  Description of Artificial Sequence: Synthetic oligonucleotide
tgattgactaacagtcttaaatacttgatttgttgttgttgttgtcctg

SEQ ID NO: 405657 - DNA, 48 bp, Artificial Sequence
  Description of Artificial Sequence: Synthetic oligonucleotide
gattgactaacagtcttaaatacttgatttgttgttgttgttgtcctg

SEQ ID NO: 405658 - DNA, 51 bp, Artificial Sequence
  Description of Artificial Sequence: Synthetic oligonucleotide
attgactaacagtcttaaatacttgatttgttgttgttgttgtcctgtttg

SEQ ID NO: 405659 - DNA, 50 bp, Artificial Sequence
  Description of Artificial Sequence: Synthetic oligonucleotide
ttgactaacagtcttaaatacttgatttgttgttgttgttgtcctgtttg

SEQ ID NO: 405660 - DNA, 49 bp, Artificial Sequence
  Description of Artificial Sequence: Synthetic oligonucleotide
tgactaacagtcttaaatacttgatttgttgttgttgttgtcctgtttg

SEQ ID NO: 405661 - DNA, 48 bp, Artificial Sequence
  Description of Artificial Sequence: Synthetic oligonucleotide
gactaacagtcttaaatacttgatttgttgttgttgttgtcctgtttg

SEQ ID NO: 405662 - DNA, 53 bp, Artificial Sequence
  Description of Artificial Sequence: Synthetic oligonucleotide
actaacagtcttaaatacttgatttgttgttgttgttgtcctgtttgtttaag

SEQ ID NO: 405663 - DNA, 52 bp, Artificial Sequence
  Description of Artificial Sequence: Synthetic oligonucleotide
ctaacagtcttaaatacttgatttgttgttgttgttgtcctgtttgtttaag

SEQ ID NO: 405664 - DNA, 54 bp, Artificial Sequence
  Description of Artificial Sequence: Synthetic oligonucleotide
taacagtcttaaatacttgatttgttgttgttgttgtcctgtttgtttaagaac

SEQ ID NO: 405665 - DNA, 53 bp, Artificial Sequence
  Description of Artificial Sequence: Synthetic oligonucleotide
aacagtcttaaatacttgatttgttgttgttgttgtcctgtttgtttaagaac

SEQ ID NO: 405666 - DNA, 52 bp, Artificial Sequence
  Description of Artificial Sequence: Synthetic oligonucleotide
acagtcttaaatacttgatttgttgttgttgttgtcctgtttgtttaagaac

SEQ ID NO: 405667 - DNA, 51 bp, Artificial Sequence
  Description of Artificial Sequence: Synthetic oligonucleotide
cagtcttaaatacttgatttgttgttgttgttgtcctgtttgtttaagaac

SEQ ID NO: 405668 - DNA, 55 bp, Artificial Sequence
  Description of Artificial Sequence: Synthetic oligonucleotide
agtcttaaatacttgatttgttgttgttgttgtcctgtttgtttaagaactttac

SEQ ID NO: 405669 - DNA, 54 bp, Artificial Sequence
  Description of Artificial Sequence: Synthetic oligonucleotide
gtcttaaatacttgatttgttgttgttgttgtcctgtttgtttaagaactttac

SEQ ID NO: 405670 - DNA, 56 bp, Artificial Sequence
  Description of Artificial Sequence: Synthetic oligonucleotide
tcttaaatacttgatttgttgttgttgttgtcctgtttgtttaagaactttacttc

SEQ ID NO: 405671 - DNA, 55 bp, Artificial Sequence
  Description of Artificial Sequence: Synthetic oligonucleotide
cttaaatacttgatttgttgttgttgttgtcctgtttgtttaagaactttacttc

SEQ ID NO: 405672 - DNA, 60 bp, Artificial Sequence
  Description of Artificial Sequence: Synthetic oligonucleotide
ttaaatacttgatttgttgttgttgttgtcctgtttgtttaagaactttacttctttatc

SEQ ID NO: 405673 - DNA, 59 bp, Artificial Sequence
  Description of Artificial Sequence: Synthetic oligonucleotide
taaatacttgatttgttgttgttgttgtcctgtttgtttaagaactttacttctttatc

SEQ ID NO: 405674 - DNA, 58 bp, Artificial Sequence
  Description of Artificial Sequence: Synthetic oligonucleotide
aaatacttgatttgttgttgttgttgtcctgtttgtttaagaactttacttctttatc

SEQ ID NO: 405675 - DNA, 57 bp, Artificial Sequence
  Description of Artificial Sequence: Synthetic oligonucleotide
aatacttgatttgttgttgttgttgtcctgtttgtttaagaactttacttctttatc

SEQ ID NO: 405676 - DNA, 56 bp, Artificial Sequence
  Description of Artificial Sequence: Synthetic oligonucleotide
atacttgatttgttgttgttgttgtcctgtttgtttaagaactttacttctttatc

SEQ ID NO: 405677 - DNA, 55 bp, Artificial Sequence
  Description of Artificial Sequence: Synthetic oligonucleotide
tacttgatttgttgttgttgttgtcctgtttgtttaagaactttacttctttatc

SEQ ID NO: 405678 - DNA, 54 bp, Artificial Sequence
  Description of Artificial Sequence: Synthetic oligonucleotide
acttgatttgttgttgttgttgtcctgtttgtttaagaactttacttctttatc

SEQ ID NO: 405679 - DNA, 53 bp, Artificial Sequence
  Description of Artificial Sequence: Synthetic oligonucleotide
cttgatttgttgttgttgttgtcctgtttgtttaagaactttacttctttatc

SEQ ID NO: 405680 - DNA, 53 bp, Artificial Sequence
  Description of Artificial Sequence: Synthetic oligonucleotide
ttgatttgttgttgttgttgtcctgtttgtttaagaactttacttctttatcc

SEQ ID NO: 405681 - DNA, 52 bp, Artificial Sequence
  Description of Artificial Sequence: Synthetic oligonucleotide
tgatttgttgttgttgttgtcctgtttgtttaagaactttacttctttatcc

SEQ ID NO: 405682 - DNA, 51 bp, Artificial Sequence
  Description of Artificial Sequence: Synthetic oligonucleotide
gatttgttgttgttgttgtcctgtttgtttaagaactttacttctttatcc

SEQ ID NO: 405683 - DNA, 54 bp, Artificial Sequence
  Description of Artificial Sequence: Synthetic oligonucleotide
atttgttgttgttgttgtcctgtttgtttaagaactttacttctttatccaatg

SEQ ID NO: 405684 - DNA, 53 bp, Artificial Sequence
  Description of Artificial Sequence: Synthetic oligonucleotide
tttgttgttgttgttgtcctgtttgtttaagaactttacttctttatccaatg

SEQ ID NO: 405685 - DNA, 52 bp, Artificial Sequence
  Description of Artificial Sequence: Synthetic oligonucleotide
ttgttgttgttgttgtcctgtttgtttaagaactttacttctttatccaatg

SEQ ID NO: 405686 - DNA, 51 bp, Artificial Sequence
  Description of Artificial Sequence: Synthetic oligonucleotide
tgttgttgttgttgtcctgtttgtttaagaactttacttctttatccaatg

SEQ ID NO: 405687 - DNA, 50 bp, Artificial Sequence
  Description of Artificial Sequence: Synthetic oligonucleotide
gttgttgttgttgtcctgtttgtttaagaactttacttctttatccaatg

SEQ ID NO: 405688 - DNA, 52 bp, Artificial Sequence
  Description of Artificial Sequence: Synthetic oligonucleotide
ttgttgttgttgtcctgtttgtttaagaactttacttctttatccaatgaac

SEQ ID NO: 405689 - DNA, 51 bp, Artificial Sequence
  Description of Artificial Sequence: Synthetic oligonucleotide
tgttgttgttgtcctgtttgtttaagaactttacttctttatccaatgaac

SEQ ID NO: 405690 - DNA, 50 bp, Artificial Sequence
  Description of Artificial Sequence: Synthetic oligonucleotide
gttgttgttgtcctgtttgtttaagaactttacttctttatccaatgaac

SEQ ID NO: 405691 - DNA, 50 bp, Artificial Sequence
  Description of Artificial Sequence: Synthetic oligonucleotide
ttgttgttgtcctgtttgtttaagaactttacttctttatccaatgaacg

SEQ ID NO: 405692 - DNA, 49 bp, Artificial Sequence
  Description of Artificial Sequence: Synthetic oligonucleotide
tgttgttgtcctgtttgtttaagaactttacttctttatccaatgaacg

SEQ ID NO: 405693 - DNA, 48 bp, Artificial Sequence
  Description of Artificial Sequence: Synthetic oligonucleotide
gttgttgtcctgtttgtttaagaactttacttctttatccaatgaacg

SEQ ID NO: 405694 - DNA, 48 bp, Artificial Sequence
  Description of Artificial Sequence: Synthetic oligonucleotide
ttgttgtcctgtttgtttaagaactttacttctttatccaatgaacgg

SEQ ID NO: 405695 - DNA, 47 bp, Artificial Sequence
  Description of Artificial Sequence: Synthetic oligonucleotide
tgttgtcctgtttgtttaagaactttacttctttatccaatgaacgg

SEQ ID NO: 405696 - DNA, 46 bp, Artificial Sequence
  Description of Artificial Sequence: Synthetic oligonucleotide
gttgtcctgtttgtttaagaactttacttctttatccaatgaacgg

SEQ ID NO: 405697 - DNA, 47 bp, Artificial Sequence
  Description of Artificial Sequence: Synthetic oligonucleotide
ttgtcctgtttgtttaagaactttacttctttatccaatgaacggag

SEQ ID NO: 405698 - DNA, 46 bp, Artificial Sequence
  Description of Artificial Sequence: Synthetic oligonucleotide
tgtcctgtttgtttaagaactttacttctttatccaatgaacggag

SEQ ID NO: 405699 - DNA, 45 bp, Artificial Sequence
  Description of Artificial Sequence: Synthetic oligonucleotide
gtcctgtttgtttaagaactttacttctttatccaatgaacggag

SEQ ID NO: 405700 - DNA, 48 bp, Artificial Sequence
  Description of Artificial Sequence: Synthetic oligonucleotide
tcctgtttgtttaagaactttacttctttatccaatgaacggagtatc

SEQ ID NO: 405701 - DNA, 47 bp, Artificial Sequence
  Description of Artificial Sequence: Synthetic oligonucleotide
cctgtttgtttaagaactttacttctttatccaatgaacggagtatc

SEQ ID NO: 405702 - DNA, 49 bp, Artificial Sequence
  Description of Artificial Sequence: Synthetic oligonucleotide
ctgtttgtttaagaactttacttctttatccaatgaacggagtatcttg

SEQ ID NO: 405703 - DNA, 50 bp, Artificial Sequence
  Description of Artificial Sequence: Synthetic oligonucleotide
tgtttgtttaagaactttacttctttatccaatgaacggagtatcttgtg

SEQ ID NO: 405704 - DNA, 49 bp, Artificial Sequence
  Description of Artificial Sequence: Synthetic oligonucleotide
gtttgtttaagaactttacttctttatccaatgaacggagtatcttgtg

SEQ ID NO: 405705 - DNA, 50 bp, Artificial Sequence
  Description of Artificial Sequence: Synthetic oligonucleotide
tttgtttaagaactttacttctttatccaatgaacggagtatcttgtgtc

SEQ ID NO: 405706 - DNA, 49 bp, Artificial Sequence
  Description of Artificial Sequence: Synthetic oligonucleotide
ttgtttaagaactttacttctttatccaatgaacggagtatcttgtgtc

SEQ ID NO: 405707 - DNA, 48 bp, Artificial Sequence
  Description of Artificial Sequence: Synthetic oligonucleotide
tgtttaagaactttacttctttatccaatgaacggagtatcttgtgtc

SEQ ID NO: 405708 - DNA, 47 bp, Artificial Sequence
  Description of Artificial Sequence: Synthetic oligonucleotide
gtttaagaactttacttctttatccaatgaacggagtatcttgtgtc

SEQ ID NO: 405709 - DNA, 47 bp, Artificial Sequence
  Description of Artificial Sequence: Synthetic oligonucleotide
tttaagaactttacttctttatccaatgaacggagtatcttgtgtcc

SEQ ID NO: 405710 - DNA, 46 bp, Artificial Sequence
  Description of Artificial Sequence: Synthetic oligonucleotide
ttaagaactttacttctttatccaatgaacggagtatcttgtgtcc

SEQ ID NO: 405711 - DNA, 45 bp, Artificial Sequence
  Description of Artificial Sequence: Synthetic oligonucleotide
taagaactttacttctttatccaatgaacggagtatcttgtgtcc

SEQ ID NO: 405712 - DNA, 44 bp, Artificial Sequence
  Description of Artificial Sequence: Synthetic oligonucleotide
aagaactttacttctttatccaatgaacggagtatcttgtgtcc

SEQ ID NO: 405713 - DNA, 43 bp, Artificial Sequence
  Description of Artificial Sequence: Synthetic oligonucleotide
agaactttacttctttatccaatgaacggagtatcttgtgtcc

SEQ ID NO: 405714 - DNA, 42 bp, Artificial Sequence
  Description of Artificial Sequence: Synthetic oligonucleotide
gaactttacttctttatccaatgaacggagtatcttgtgtcc

SEQ ID NO: 405715 - DNA, 43 bp, Artificial Sequence
  Description of Artificial Sequence: Synthetic oligonucleotide
aactttacttctttatccaatgaacggagtatcttgtgtcctg

SEQ ID NO: 405716 - DNA, 42 bp, Artificial Sequence
  Description of Artificial Sequence: Synthetic oligonucleotide
actttacttctttatccaatgaacggagtatcttgtgtcctg

SEQ ID NO: 405717 - DNA, 41 bp, Artificial Sequence
  Description of Artificial Sequence: Synthetic oligonucleotide
ctttacttctttatccaatgaacggagtatcttgtgtcctg

SEQ ID NO: 405718 - DNA, 41 bp, Artificial Sequence
  Description of Artificial Sequence: Synthetic oligonucleotide
tttacttctttatccaatgaacggagtatcttgtgtcctgg

SEQ ID NO: 405719 - DNA, 40 bp, Artificial Sequence
  Description of Artificial Sequence: Synthetic oligonucleotide
ttacttctttatccaatgaacggagtatcttgtgtcctgg

SEQ ID NO: 405720 - DNA, 39 bp, Artificial Sequence
  Description of Artificial Sequence: Synthetic oligonucleotide
tacttctttatccaatgaacggagtatcttgtgtcctgg

SEQ ID NO: 405721 - DNA, 38 bp, Artificial Sequence
  Description of Artificial Sequence: Synthetic oligonucleotide
acttctttatccaatgaacggagtatcttgtgtcctgg

SEQ ID NO: 405722 - DNA, 37 bp, Artificial Sequence
  Description of Artificial Sequence: Synthetic oligonucleotide
cttctttatccaatgaacggagtatcttgtgtcctgg

SEQ ID NO: 405723 - DNA, 38 bp, Artificial Sequence
  Description of Artificial Sequence: Synthetic oligonucleotide
ttctttatccaatgaacggagtatcttgtgtcctggac

SEQ ID NO: 405724 - DNA, 37 bp, Artificial Sequence
  Description of Artificial Sequence: Synthetic oligonucleotide
tctttatccaatgaacggagtatcttgtgtcctggac

SEQ ID NO: 405725 - DNA, 36 bp, Artificial Sequence
  Description of Artificial Sequence: Synthetic oligonucleotide
ctttatccaatgaacggagtatcttgtgtcctggac

SEQ ID NO: 405726 - DNA, 36 bp, Artificial Sequence
  Description of Artificial Sequence: Synthetic oligonucleotide
tttatccaatgaacggagtatcttgtgtcctggacc

SEQ ID NO: 405727 - DNA, 35 bp, Artificial Sequence
  Description of Artificial Sequence: Synthetic oligonucleotide
ttatccaatgaacggagtatcttgtgtcctggacc

SEQ ID NO: 405728 - DNA, 34 bp, Artificial Sequence
  Description of Artificial Sequence: Synthetic oligonucleotide
tatccaatgaacggagtatcttgtgtcctggacc

SEQ ID NO: 405729 - DNA, 33 bp, Artificial Sequence
  Description of Artificial Sequence: Synthetic oligonucleotide
atccaatgaacggagtatcttgtgtcctggacc

SEQ ID NO: 405730 - DNA, 32 bp, Artificial Sequence
  Description of Artificial Sequence: Synthetic oligonucleotide
tccaatgaacggagtatcttgtgtcctggacc

SEQ ID NO: 405731 - DNA, 31 bp, Artificial Sequence
  Description of Artificial Sequence: Synthetic oligonucleotide
ccaatgaacggagtatcttgtgtcctggacc

SEQ ID NO: 405732 - DNA, 31 bp, Artificial Sequence
  Description of Artificial Sequence: Synthetic oligonucleotide
caatgaacggagtatcttgtgtcctggaccc

SEQ ID NO: 405733 - DNA, 34 bp, Artificial Sequence
  Description of Artificial Sequence: Synthetic oligonucleotide
aatgaacggagtatcttgtgtcctggaccctttg

SEQ ID NO: 405734 - DNA, 33 bp, Artificial Sequence
  Description of Artificial Sequence: Synthetic oligonucleotide
atgaacggagtatcttgtgtcctggaccctttg

SEQ ID NO: 405735 - DNA, 32 bp, Artificial Sequence
  Description of Artificial Sequence: Synthetic oligonucleotide
tgaacggagtatcttgtgtcctggaccctttg

SEQ ID NO: 405736 - DNA, 31 bp, Artificial Sequence
  Description of Artificial Sequence: Synthetic oligonucleotide
gaacggagtatcttgtgtcctggaccctttg

SEQ ID NO: 405737 - DNA, 31 bp, Artificial Sequence
  Description of Artificial Sequence: Synthetic oligonucleotide
aacggagtatcttgtgtcctggaccctttgc

SEQ ID NO: 405738 - DNA, 30 bp, Artificial Sequence
  Description of Artificial Sequence: Synthetic oligonucleotide
acggagtatcttgtgtcctggaccctttgc

SEQ ID NO: 405739 - DNA, 29 bp, Artificial Sequence
  Description of Artificial Sequence: Synthetic oligonucleotide
cggagtatcttgtgtcctggaccctttgc

SEQ ID NO: 405740 - DNA, 31 bp, Artificial Sequence
  Description of Artificial Sequence: Synthetic oligonucleotide
ggagtatcttgtgtcctggaccctttgcaag

SEQ ID NO: 405741 - DNA, 33 bp, Artificial Sequence
  Description of Artificial Sequence: Synthetic oligonucleotide
gagtatcttgtgtcctggaccctttgcaagaac

SEQ ID NO: 405742 - DNA, 33 bp, Artificial Sequence
  Description of Artificial Sequence: Synthetic oligonucleotide
agtatcttgtgtcctggaccctttgcaagaacc

SEQ ID NO: 405743 - DNA, 32 bp, Artificial Sequence
  Description of Artificial Sequence: Synthetic oligonucleotide
gtatcttgtgtcctggaccctttgcaagaacc

SEQ ID NO: 405744 - DNA, 32 bp, Artificial Sequence
  Description of Artificial Sequence: Synthetic oligonucleotide
tatcttgtgtcctggaccctttgcaagaaccc

SEQ ID NO: 405745 - DNA, 31 bp, Artificial Sequence
  Description of Artificial Sequence: Synthetic oligonucleotide
atcttgtgtcctggaccctttgcaagaaccc

SEQ ID NO: 405746 - DNA, 30 bp, Artificial Sequence
  Description of Artificial Sequence: Synthetic oligonucleotide
tcttgtgtcctggaccctttgcaagaaccc

SEQ ID NO: 405747 - DNA, 29 bp, Artificial Sequence
  Description of Artificial Sequence: Synthetic oligonucleotide
cttgtgtcctggaccctttgcaagaaccc

SEQ ID NO: 405748 - DNA, 31 bp, Artificial Sequence
  Description of Artificial Sequence: Synthetic oligonucleotide
ttgtgtcctggaccctttgcaagaacccttc

SEQ ID NO: 405749 - DNA, 30 bp, Artificial Sequence
  Description of Artificial Sequence: Synthetic oligonucleotide
tgtgtcctggaccctttgcaagaacccttc

SEQ ID NO: 405750 - DNA, 29 bp, Artificial Sequence
  Description of Artificial Sequence: Synthetic oligonucleotide
gtgtcctggaccctttgcaagaacccttc

SEQ ID NO: 405751 - DNA, 29 bp, Artificial Sequence
  Description of Artificial Sequence: Synthetic oligonucleotide
tgtcctggaccctttgcaagaacccttcc

SEQ ID NO: 405752 - DNA, 28 bp, Artificial Sequence
  Description of Artificial Sequence: Synthetic oligonucleotide
gtcctggaccctttgcaagaacccttcc

SEQ ID NO: 405753 - DNA, 28 bp, Artificial Sequence
  Description of Artificial Sequence: Synthetic oligonucleotide
tcctggaccctttgcaagaacccttccc

SEQ ID NO: 405754 - DNA, 27 bp, Artificial Sequence
  Description of Artificial Sequence: Synthetic oligonucleotide
cctggaccctttgcaagaacccttccc

SEQ ID NO: 405755 - DNA, 27 bp, Artificial Sequence
  Description of Artificial Sequence: Synthetic oligonucleotide
ctggaccctttgcaagaacccttcccc

SEQ ID NO: 405756 - DNA, 29 bp, Artificial Sequence
  Description of Artificial Sequence: Synthetic oligonucleotide
tggaccctttgcaagaacccttcccctag

SEQ ID NO: 405757 - DNA, 28 bp, Artificial Sequence
  Description of Artificial Sequence: Synthetic oligonucleotide
ggaccctttgcaagaacccttcccctag

SEQ ID NO: 405758 - DNA, 28 bp, Artificial Sequence
  Description of Artificial Sequence: Synthetic oligonucleotide
gaccctttgcaagaacccttcccctagc

SEQ ID NO: 405759 - DNA, 30 bp, Artificial Sequence
  Description of Artificial Sequence: Synthetic oligonucleotide
accctttgcaagaacccttcccctagcaac

SEQ ID NO: 405760 - DNA, 29 bp, Artificial Sequence
  Description of Artificial Sequence: Synthetic oligonucleotide
ccctttgcaagaacccttcccctagcaac

SEQ ID NO: 405761 - DNA, 30 bp, Artificial Sequence
  Description of Artificial Sequence: Synthetic oligonucleotide
cctttgcaagaacccttcccctagcaacag

SEQ ID NO: 405762 - DNA, 32 bp, Artificial Sequence
  Description of Artificial Sequence: Synthetic oligonucleotide
ctttgcaagaacccttcccctagcaacagatg

SEQ ID NO: 405763 - DNA, 32 bp, Artificial Sequence
  Description of Artificial Sequence: Synthetic oligonucleotide
tttgcaagaacccttcccctagcaacagatgc

SEQ ID NO: 405764 - DNA, 31 bp, Artificial Sequence
  Description of Artificial Sequence: Synthetic oligonucleotide
ttgcaagaacccttcccctagcaacagatgc

SEQ ID NO: 405765 - DNA, 30 bp, Artificial Sequence
  Description of Artificial Sequence: Synthetic oligonucleotide
tgcaagaacccttcccctagcaacagatgc

SEQ ID NO: 405766 - DNA, 29 bp, Artificial Sequence
  Description of Artificial Sequence: Synthetic oligonucleotide
gcaagaacccttcccctagcaacagatgc

SEQ ID NO: 405767 - DNA, 29 bp, Artificial Sequence
  Description of Artificial Sequence: Synthetic oligonucleotide
caagaacccttcccctagcaacagatgcg

SEQ ID NO: 405768 - DNA, 30 bp, Artificial Sequence
  Description of Artificial Sequence: Synthetic oligonucleotide
aagaacccttcccctagcaacagatgcgtc

SEQ ID NO: 405769 - DNA, 29 bp, Artificial Sequence
  Description of Artificial Sequence: Synthetic oligonucleotide
agaacccttcccctagcaacagatgcgtc

SEQ ID NO: 405770 - DNA, 28 bp, Artificial Sequence
  Description of Artificial Sequence: Synthetic oligonucleotide
gaacccttcccctagcaacagatgcgtc

SEQ ID NO: 405771 - DNA, 30 bp, Artificial Sequence
  Description of Artificial Sequence: Synthetic oligonucleotide
aacccttcccctagcaacagatgcgtcatc

SEQ ID NO: 405772 - DNA, 29 bp, Artificial Sequence
  Description of Artificial Sequence: Synthetic oligonucleotide
acccttcccctagcaacagatgcgtcatc

SEQ ID NO: 405773 - DNA, 28 bp, Artificial Sequence
  Description of Artificial Sequence: Synthetic oligonucleotide
cccttcccctagcaacagatgcgtcatc

SEQ ID NO: 405774 - DNA, 29 bp, Artificial Sequence
  Description of Artificial Sequence: Synthetic oligonucleotide
ccttcccctagcaacagatgcgtcatctc

SEQ ID NO: 405775 - DNA, 40 bp, Artificial Sequence
  Description of Artificial Sequence: Synthetic oligonucleotide
cttcccctagcaacagatgcgtcatctcaaaatatttttc

SEQ ID NO: 405776 - DNA, 41 bp, Artificial Sequence
  Description of Artificial Sequence: Synthetic oligonucleotide
ttcccctagcaacagatgcgtcatctcaaaatatttttctg

SEQ ID NO: 405777 - DNA, 40 bp, Artificial Sequence
  Description of Artificial Sequence: Synthetic oligonucleotide
tcccctagcaacagatgcgtcatctcaaaatatttttctg

SEQ ID NO: 405778 - DNA, 39 bp, Artificial Sequence
  Description of Artificial Sequence: Synthetic oligonucleotide
cccctagcaacagatgcgtcatctcaaaatatttttctg

SEQ ID NO: 405779 - DNA, 42 bp, Artificial Sequence
  Description of Artificial Sequence: Synthetic oligonucleotide
ccctagcaacagatgcgtcatctcaaaatatttttctgattg

SEQ ID NO: 405780 - DNA, 42 bp, Artificial Sequence
  Description of Artificial Sequence: Synthetic oligonucleotide
cctagcaacagatgcgtcatctcaaaatatttttctgattgg

SEQ ID NO: 405781 - DNA, 42 bp, Artificial Sequence
  Description of Artificial Sequence: Synthetic oligonucleotide
ctagcaacagatgcgtcatctcaaaatatttttctgattggc

SEQ ID NO: 405782 - DNA, 42 bp, Artificial Sequence
  Description of Artificial Sequence: Synthetic oligonucleotide
tagcaacagatgcgtcatctcaaaatatttttctgattggcc

SEQ ID NO: 405783 - DNA, 41 bp, Artificial Sequence
  Description of Artificial Sequence: Synthetic oligonucleotide
agcaacagatgcgtcatctcaaaatatttttctgattggcc

SEQ ID NO: 405784 - DNA, 40 bp, Artificial Sequence
  Description of Artificial Sequence: Synthetic oligonucleotide
gcaacagatgcgtcatctcaaaatatttttctgattggcc

SEQ ID NO: 405785 - DNA, 43 bp, Artificial Sequence
  Description of Artificial Sequence: Synthetic oligonucleotide
caacagatgcgtcatctcaaaatatttttctgattggccaaag

SEQ ID NO: 405786 - DNA, 44 bp, Artificial Sequence
  Description of Artificial Sequence: Synthetic oligonucleotide
aacagatgcgtcatctcaaaatatttttctgattggccaaagag

SEQ ID NO: 405787 - DNA, 43 bp, Artificial Sequence
  Description of Artificial Sequence: Synthetic oligonucleotide
acagatgcgtcatctcaaaatatttttctgattggccaaagag

SEQ ID NO: 405788 - DNA, 42 bp, Artificial Sequence
  Description of Artificial Sequence: Synthetic oligonucleotide
cagatgcgtcatctcaaaatatttttctgattggccaaagag

SEQ ID NO: 405789 - DNA, 47 bp, Artificial Sequence
  Description of Artificial Sequence: Synthetic oligonucleotide
agatgcgtcatctcaaaatatttttctgattggccaaagagtaattg

SEQ ID NO: 405790 - DNA, 46 bp, Artificial Sequence
  Description of Artificial Sequence: Synthetic oligonucleotide
gatgcgtcatctcaaaatatttttctgattggccaaagagtaattg

SEQ ID NO: 405791 - DNA, 50 bp, Artificial Sequence
  Description of Artificial Sequence: Synthetic oligonucleotide
atgcgtcatctcaaaatatttttctgattggccaaagagtaattgatttg

SEQ ID NO: 405792 - DNA, 49 bp, Artificial Sequence
  Description of Artificial Sequence: Synthetic oligonucleotide
tgcgtcatctcaaaatatttttctgattggccaaagagtaattgatttg

SEQ ID NO: 405793 - DNA, 48 bp, Artificial Sequence
  Description of Artificial Sequence: Synthetic oligonucleotide
gcgtcatctcaaaatatttttctgattggccaaagagtaattgatttg

SEQ ID NO: 405794 - DNA, 48 bp, Artificial Sequence
  Description of Artificial Sequence: Synthetic oligonucleotide
cgtcatctcaaaatatttttctgattggccaaagagtaattgatttgc

SEQ ID NO: 405795 - DNA, 56 bp, Artificial Sequence
  Description of Artificial Sequence: Synthetic oligonucleotide
gtcatctcaaaatatttttctgattggccaaagagtaattgatttgcattttaatg

SEQ ID NO: 405796 - DNA, 56 bp, Artificial Sequence
  Description of Artificial Sequence: Synthetic oligonucleotide
tcatctcaaaatatttttctgattggccaaagagtaattgatttgcattttaatgg

SEQ ID NO: 405797 - DNA, 55 bp, Artificial Sequence
  Description of Artificial Sequence: Synthetic oligonucleotide
catctcaaaatatttttctgattggccaaagagtaattgatttgcattttaatgg

SEQ ID NO: 405798 - DNA, 56 bp, Artificial Sequence
  Description of Artificial Sequence: Synthetic oligonucleotide
atctcaaaatatttttctgattggccaaagagtaattgatttgcattttaatggtc

SEQ ID NO: 405799 - DNA, 55 bp, Artificial Sequence
  Description of Artificial Sequence: Synthetic oligonucleotide
tctcaaaatatttttctgattggccaaagagtaattgatttgcattttaatggtc

SEQ ID NO: 405800 - DNA, 54 bp, Artificial Sequence
  Description of Artificial Sequence: Synthetic oligonucleotide
ctcaaaatatttttctgattggccaaagagtaattgatttgcattttaatggtc

SEQ ID NO: 405801 - DNA, 55 bp, Artificial Sequence
  Description of Artificial Sequence: Synthetic oligonucleotide
tcaaaatatttttctgattggccaaagagtaattgatttgcattttaatggtcag

SEQ ID NO: 405802 - DNA, 54 bp, Artificial Sequence
  Description of Artificial Sequence: Synthetic oligonucleotide
caaaatatttttctgattggccaaagagtaattgatttgcattttaatggtcag

SEQ ID NO: 405803 - DNA, 55 bp, Artificial Sequence
  Description of Artificial Sequence: Synthetic oligonucleotide
aaaatatttttctgattggccaaagagtaattgatttgcattttaatggtcagac

SEQ ID NO: 405804 - DNA, 54 bp, Artificial Sequence
  Description of Artificial Sequence: Synthetic oligonucleotide
aaatatttttctgattggccaaagagtaattgatttgcattttaatggtcagac

SEQ ID NO: 405805 - DNA, 53 bp, Artificial Sequence
  Description of Artificial Sequence: Synthetic oligonucleotide
aatatttttctgattggccaaagagtaattgatttgcattttaatggtcagac

SEQ ID NO: 405806 - DNA, 52 bp, Artificial Sequence
  Description of Artificial Sequence: Synthetic oligonucleotide
atatttttctgattggccaaagagtaattgatttgcattttaatggtcagac

SEQ ID NO: 405807 - DNA, 51 bp, Artificial Sequence
  Description of Artificial Sequence: Synthetic oligonucleotide
tatttttctgattggccaaagagtaattgatttgcattttaatggtcagac

SEQ ID NO: 405808 - DNA, 50 bp, Artificial Sequence
  Description of Artificial Sequence: Synthetic oligonucleotide
atttttctgattggccaaagagtaattgatttgcattttaatggtcagac

SEQ ID NO: 405809 - DNA, 49 bp, Artificial Sequence
  Description of Artificial Sequence: Synthetic oligonucleotide
tttttctgattggccaaagagtaattgatttgcattttaatggtcagac

SEQ ID NO: 405810 - DNA, 48 bp, Artificial Sequence
  Description of Artificial Sequence: Synthetic oligonucleotide
ttttctgattggccaaagagtaattgatttgcattttaatggtcagac

SEQ ID NO: 405811 - DNA, 47 bp, Artificial Sequence
  Description of Artificial Sequence: Synthetic oligonucleotide
tttctgattggccaaagagtaattgatttgcattttaatggtcagac

SEQ ID NO: 405812 - DNA, 46 bp, Artificial Sequence
  Description of Artificial Sequence: Synthetic oligonucleotide
ttctgattggccaaagagtaattgatttgcattttaatggtcagac

SEQ ID NO: 405813 - DNA, 45 bp, Artificial Sequence
  Description of Artificial Sequence: Synthetic oligonucleotide
tctgattggccaaagagtaattgatttgcattttaatggtcagac

SEQ ID NO: 405814 - DNA, 44 bp, Artificial Sequence
  Description of Artificial Sequence: Synthetic oligonucleotide
ctgattggccaaagagtaattgatttgcattttaatggtcagac

SEQ ID NO: 405815 - DNA, 45 bp, Artificial Sequence
  Description of Artificial Sequence: Synthetic oligonucleotide
tgattggccaaagagtaattgatttgcattttaatggtcagactc

SEQ ID NO: 405816 - DNA, 44 bp, Artificial Sequence
  Description of Artificial Sequence: Synthetic oligonucleotide
gattggccaaagagtaattgatttgcattttaatggtcagactc

SEQ ID NO: 405817 - DNA, 49 bp, Artificial Sequence
  Description of Artificial Sequence: Synthetic oligonucleotide
attggccaaagagtaattgatttgcattttaatggtcagactctattac

SEQ ID NO: 405818 - DNA, 48 bp, Artificial Sequence
  Description of Artificial Sequence: Synthetic oligonucleotide
ttggccaaagagtaattgatttgcattttaatggtcagactctattac

SEQ ID NO: 405819 - DNA, 47 bp, Artificial Sequence
  Description of Artificial Sequence: Synthetic oligonucleotide
tggccaaagagtaattgatttgcattttaatggtcagactctattac

SEQ ID NO: 405820 - DNA, 46 bp, Artificial Sequence
  Description of Artificial Sequence: Synthetic oligonucleotide
ggccaaagagtaattgatttgcattttaatggtcagactctattac

SEQ ID NO: 405821 - DNA, 47 bp, Artificial Sequence
  Description of Artificial Sequence: Synthetic oligonucleotide
gccaaagagtaattgatttgcattttaatggtcagactctattacac

SEQ ID NO: 405822 - DNA, 47 bp, Artificial Sequence
  Description of Artificial Sequence: Synthetic oligonucleotide
ccaaagagtaattgatttgcattttaatggtcagactctattacacc

SEQ ID NO: 405823 - DNA, 47 bp, Artificial Sequence
  Description of Artificial Sequence: Synthetic oligonucleotide
caaagagtaattgatttgcattttaatggtcagactctattacaccc

SEQ ID NO: 405824 - DNA, 47 bp, Artificial Sequence
  Description of Artificial Sequence: Synthetic oligonucleotide
aaagagtaattgatttgcattttaatggtcagactctattacacccc

SEQ ID NO: 405825 - DNA, 46 bp, Artificial Sequence
  Description of Artificial Sequence: Synthetic oligonucleotide
aagagtaattgatttgcattttaatggtcagactctattacacccc

SEQ ID NO: 405826 - DNA, 45 bp, Artificial Sequence
  Description of Artificial Sequence: Synthetic oligonucleotide
agagtaattgatttgcattttaatggtcagactctattacacccc

SEQ ID NO: 405827 - DNA, 44 bp, Artificial Sequence
  Description of Artificial Sequence: Synthetic oligonucleotide
gagtaattgatttgcattttaatggtcagactctattacacccc

SEQ ID NO: 405828 - DNA, 45 bp, Artificial Sequence
  Description of Artificial Sequence: Synthetic oligonucleotide
agtaattgatttgcattttaatggtcagactctattacaccccac

SEQ ID NO: 405829 - DNA, 44 bp, Artificial Sequence
  Description of Artificial Sequence: Synthetic oligonucleotide
gtaattgatttgcattttaatggtcagactctattacaccccac

SEQ ID NO: 405830 - DNA, 47 bp, Artificial Sequence
  Description of Artificial Sequence: Synthetic oligonucleotide
taattgatttgcattttaatggtcagactctattacaccccacattc

SEQ ID NO: 405831 - DNA, 46 bp, Artificial Sequence
  Description of Artificial Sequence: Synthetic oligonucleotide
aattgatttgcattttaatggtcagactctattacaccccacattc

SEQ ID NO: 405832 - DNA, 45 bp, Artificial Sequence
  Description of Artificial Sequence: Synthetic oligonucleotide
attgatttgcattttaatggtcagactctattacaccccacattc

SEQ ID NO: 405833 - DNA, 44 bp, Artificial Sequence
  Description of Artificial Sequence: Synthetic oligonucleotide
ttgatttgcattttaatggtcagactctattacaccccacattc

SEQ ID NO: 405834 - DNA, 43 bp, Artificial Sequence
  Description of Artificial Sequence: Synthetic oligonucleotide
tgatttgcattttaatggtcagactctattacaccccacattc

SEQ ID NO: 405835 - DNA, 42 bp, Artificial Sequence
  Description of Artificial Sequence: Synthetic oligonucleotide
gatttgcattttaatggtcagactctattacaccccacattc

SEQ ID NO: 405836 - DNA, 43 bp, Artificial Sequence
  Description of Artificial Sequence: Synthetic oligonucleotide
atttgcattttaatggtcagactctattacaccccacattctc

SEQ ID NO: 405837 - DNA, 42 bp, Artificial Sequence
  Description of Artificial Sequence: Synthetic oligonucleotide
tttgcattttaatggtcagactctattacaccccacattctc

SEQ ID NO: 405838 - DNA, 41 bp, Artificial Sequence
  Description of Artificial Sequence: Synthetic oligonucleotide
ttgcattttaatggtcagactctattacaccccacattctc

SEQ ID NO: 405839 - DNA, 40 bp, Artificial Sequence
  Description of Artificial Sequence: Synthetic oligonucleotide
tgcattttaatggtcagactctattacaccccacattctc

SEQ ID NO: 405840 - DNA, 39 bp, Artificial Sequence
  Description of Artificial Sequence: Synthetic oligonucleotide
gcattttaatggtcagactctattacaccccacattctc

SEQ ID NO: 405841 - DNA, 43 bp, Artificial Sequence
  Description of Artificial Sequence: Synthetic oligonucleotide
cattttaatggtcagactctattacaccccacattctcttttc

SEQ ID NO: 405842 - DNA, 50 bp, Artificial Sequence
  Description of Artificial Sequence: Synthetic oligonucleotide
attttaatggtcagactctattacaccccacattctcttttcttttattc

SEQ ID NO: 405843 - DNA, 49 bp, Artificial Sequence
  Description of Artificial Sequence: Synthetic oligonucleotide
ttttaatggtcagactctattacaccccacattctcttttcttttattc

SEQ ID NO: 405844 - DNA, 48 bp, Artificial Sequence
  Description of Artificial Sequence: Synthetic oligonucleotide
tttaatggtcagactctattacaccccacattctcttttcttttattc

SEQ ID NO: 405845 - DNA, 47 bp, Artificial Sequence
  Description of Artificial Sequence: Synthetic oligonucleotide
ttaatggtcagactctattacaccccacattctcttttcttttattc

SEQ ID NO: 405846 - DNA, 46 bp, Artificial Sequence
  Description of Artificial Sequence: Synthetic oligonucleotide
taatggtcagactctattacaccccacattctcttttcttttattc

SEQ ID NO: 405847 - DNA, 45 bp, Artificial Sequence
  Description of Artificial Sequence: Synthetic oligonucleotide
aatggtcagactctattacaccccacattctcttttcttttattc

SEQ ID NO: 405848 - DNA, 44 bp, Artificial Sequence
  Description of Artificial Sequence: Synthetic oligonucleotide
atggtcagactctattacaccccacattctcttttcttttattc

SEQ ID NO: 405849 - DNA, 43 bp, Artificial Sequence
  Description of Artificial Sequence: Synthetic oligonucleotide
tggtcagactctattacaccccacattctcttttcttttattc

SEQ ID NO: 405850 - DNA, 42 bp, Artificial Sequence
  Description of Artificial Sequence: Synthetic oligonucleotide
ggtcagactctattacaccccacattctcttttcttttattc

SEQ ID NO: 405851 - DNA, 44 bp, Artificial Sequence
  Description of Artificial Sequence: Synthetic oligonucleotide
gtcagactctattacaccccacattctcttttcttttattcttg

SEQ ID NO: 405852 - DNA, 45 bp, Artificial Sequence
  Description of Artificial Sequence: Synthetic oligonucleotide
tcagactctattacaccccacattctcttttcttttattcttgtc

SEQ ID NO: 405853 - DNA, 44 bp, Artificial Sequence
  Description of Artificial Sequence: Synthetic oligonucleotide
cagactctattacaccccacattctcttttcttttattcttgtc

SEQ ID NO: 405854 - DNA, 45 bp, Artificial Sequence
  Description of Artificial Sequence: Synthetic oligonucleotide
agactctattacaccccacattctcttttcttttattcttgtctg

SEQ ID NO: 405855 - DNA, 44 bp, Artificial Sequence
  Description of Artificial Sequence: Synthetic oligonucleotide
gactctattacaccccacattctcttttcttttattcttgtctg

SEQ ID NO: 405856 - DNA, 46 bp, Artificial Sequence
  Description of Artificial Sequence: Synthetic oligonucleotide
actctattacaccccacattctcttttcttttattcttgtctgttc

SEQ ID NO: 405857 - DNA, 45 bp, Artificial Sequence
  Description of Artificial Sequence: Synthetic oligonucleotide
ctctattacaccccacattctcttttcttttattcttgtctgttc

SEQ ID NO: 405858 - DNA, 46 bp, Artificial Sequence
  Description of Artificial Sequence: Synthetic oligonucleotide
tctattacaccccacattctcttttcttttattcttgtctgttctg

SEQ ID NO: 405859 - DNA, 45 bp, Artificial Sequence
  Description of Artificial Sequence: Synthetic oligonucleotide
ctattacaccccacattctcttttcttttattcttgtctgttctg

SEQ ID NO: 405860 - DNA, 45 bp, Artificial Sequence
  Description of Artificial Sequence: Synthetic oligonucleotide
tattacaccccacattctcttttcttttattcttgtctgttctgc

SEQ ID NO: 405861 - DNA, 44 bp, Artificial Sequence
  Description of Artificial Sequence: Synthetic oligonucleotide
attacaccccacattctcttttcttttattcttgtctgttctgc

SEQ ID NO: 405862 - DNA, 43 bp, Artificial Sequence
  Description of Artificial Sequence: Synthetic oligonucleotide
ttacaccccacattctcttttcttttattcttgtctgttctgc

SEQ ID NO: 405863 - DNA, 42 bp, Artificial Sequence
  Description of Artificial Sequence: Synthetic oligonucleotide
tacaccccacattctcttttcttttattcttgtctgttctgc

SEQ ID NO: 405864 - DNA, 41 bp, Artificial Sequence
  Description of Artificial Sequence: Synthetic oligonucleotide
acaccccacattctcttttcttttattcttgtctgttctgc

SEQ ID NO: 405865 - DNA, 40 bp, Artificial Sequence
  Description of Artificial Sequence: Synthetic oligonucleotide
caccccacattctcttttcttttattcttgtctgttctgc

SEQ ID NO: 405866 - DNA, 40 bp, Artificial Sequence
  Description of Artificial Sequence: Synthetic oligonucleotide
accccacattctcttttcttttattcttgtctgttctgcc

SEQ ID NO: 405867 - DNA, 39 bp, Artificial Sequence
  Description of Artificial Sequence: Synthetic oligonucleotide
ccccacattctcttttcttttattcttgtctgttctgcc

SEQ ID NO: 405868 - DNA, 40 bp, Artificial Sequence
  Description of Artificial Sequence: Synthetic oligonucleotide
cccacattctcttttcttttattcttgtctgttctgcctc

SEQ ID NO: 405869 - DNA, 41 bp, Artificial Sequence
  Description of Artificial Sequence: Synthetic oligonucleotide
ccacattctcttttcttttattcttgtctgttctgcctcac

SEQ ID NO: 405870 - DNA, 42 bp, Artificial Sequence
  Description of Artificial Sequence: Synthetic oligonucleotide
cacattctcttttcttttattcttgtctgttctgcctcactc

SEQ ID NO: 405871 - DNA, 42 bp, Artificial Sequence
  Description of Artificial Sequence: Synthetic oligonucleotide
acattctcttttcttttattcttgtctgttctgcctcactcc

SEQ ID NO: 405872 - DNA, 41 bp, Artificial Sequence
  Description of Artificial Sequence: Synthetic oligonucleotide
cattctcttttcttttattcttgtctgttctgcctcactcc

SEQ ID NO: 405873 - DNA, 41 bp, Artificial Sequence
  Description of Artificial Sequence: Synthetic oligonucleotide
attctcttttcttttattcttgtctgttctgcctcactccc

SEQ ID NO: 405874 - DNA, 40 bp, Artificial Sequence
  Description of Artificial Sequence: Synthetic oligonucleotide
ttctcttttcttttattcttgtctgttctgcctcactccc

SEQ ID NO: 405875 - DNA, 39 bp, Artificial Sequence
  Description of Artificial Sequence: Synthetic oligonucleotide
tctcttttcttttattcttgtctgttctgcctcactccc

SEQ ID NO: 405876 - DNA, 38 bp, Artificial Sequence
  Description of Artificial Sequence: Synthetic oligonucleotide
ctcttttcttttattcttgtctgttctgcctcactccc

SEQ ID NO: 405877 - DNA, 38 bp, Artificial Sequence
  Description of Artificial Sequence: Synthetic oligonucleotide
tcttttcttttattcttgtctgttctgcctcactcccg

SEQ ID NO: 405878 - DNA, 37 bp, Artificial Sequence
  Description of Artificial Sequence: Synthetic oligonucleotide
cttttcttttattcttgtctgttctgcctcactcccg

SEQ ID NO: 405879 - DNA, 38 bp, Artificial Sequence
  Description of Artificial Sequence: Synthetic oligonucleotide
ttttcttttattcttgtctgttctgcctcactcccgag

SEQ ID NO: 405880 - DNA, 37 bp, Artificial Sequence
  Description of Artificial Sequence: Synthetic oligonucleotide
tttcttttattcttgtctgttctgcctcactcccgag

SEQ ID NO: 405881 - DNA, 36 bp, Artificial Sequence
  Description of Artificial Sequence: Synthetic oligonucleotide
ttcttttattcttgtctgttctgcctcactcccgag

SEQ ID NO: 405882 - DNA, 35 bp, Artificial Sequence
  Description of Artificial Sequence: Synthetic oligonucleotide
tcttttattcttgtctgttctgcctcactcccgag

SEQ ID NO: 405883 - DNA, 34 bp, Artificial Sequence
  Description of Artificial Sequence: Synthetic oligonucleotide
cttttattcttgtctgttctgcctcactcccgag

SEQ ID NO: 405884 - DNA, 34 bp, Artificial Sequence
  Description of Artificial Sequence: Synthetic oligonucleotide
ttttattcttgtctgttctgcctcactcccgagc

SEQ ID NO: 405885 - DNA, 33 bp, Artificial Sequence
  Description of Artificial Sequence: Synthetic oligonucleotide
tttattcttgtctgttctgcctcactcccgagc

SEQ ID NO: 405886 - DNA, 32 bp, Artificial Sequence
  Description of Artificial Sequence: Synthetic oligonucleotide
ttattcttgtctgttctgcctcactcccgagc

SEQ ID NO: 405887 - DNA, 31 bp, Artificial Sequence
  Description of Artificial Sequence: Synthetic oligonucleotide
tattcttgtctgttctgcctcactcccgagc

SEQ ID NO: 405888 - DNA, 30 bp, Artificial Sequence
  Description of Artificial Sequence: Synthetic oligonucleotide
attcttgtctgttctgcctcactcccgagc

SEQ ID NO: 405889 - DNA, 29 bp, Artificial Sequence
  Description of Artificial Sequence: Synthetic oligonucleotide
ttcttgtctgttctgcctcactcccgagc

SEQ ID NO: 405890 - DNA, 28 bp, Artificial Sequence
  Description of Artificial Sequence: Synthetic oligonucleotide
tcttgtctgttctgcctcactcccgagc

SEQ ID NO: 405891 - DNA, 27 bp, Artificial Sequence
  Description of Artificial Sequence: Synthetic oligonucleotide
cttgtctgttctgcctcactcccgagc

SEQ ID NO: 405892 - DNA, 28 bp, Artificial Sequence
  Description of Artificial Sequence: Synthetic oligonucleotide
ttgtctgttctgcctcactcccgagctc

SEQ ID NO: 405893 - DNA, 27 bp, Artificial Sequence
  Description of Artificial Sequence: Synthetic oligonucleotide
tgtctgttctgcctcactcccgagctc

SEQ ID NO: 405894 - DNA, 27 bp, Artificial Sequence
  Description of Artificial Sequence: Synthetic oligonucleotide
gtctgttctgcctcactcccgagctct

SEQ ID NO: 405895 - DNA, 28 bp, Artificial Sequence
  Description of Artificial Sequence: Synthetic oligonucleotide
tctgttctgcctcactcccgagctctac

SEQ ID NO: 405896 - DNA, 27 bp, Artificial Sequence
  Description of Artificial Sequence: Synthetic oligonucleotide
ctgttctgcctcactcccgagctctac

SEQ ID NO: 405897 - DNA, 28 bp, Artificial Sequence
  Description of Artificial Sequence: Synthetic oligonucleotide
tgttctgcctcactcccgagctctactg

SEQ ID NO: 405898 - DNA, 27 bp, Artificial Sequence
  Description of Artificial Sequence: Synthetic oligonucleotide
gttctgcctcactcccgagctctactg

SEQ ID NO: 405899 - DNA, 28 bp, Artificial Sequence
  Description of Artificial Sequence: Synthetic oligonucleotide
ttctgcctcactcccgagctctactgac

SEQ ID NO: 405900 - DNA, 27 bp, Artificial Sequence
  Description of Artificial Sequence: Synthetic oligonucleotide
tctgcctcactcccgagctctactgac

SEQ ID NO: 405901 - DNA, 27 bp, Artificial Sequence
  Description of Artificial Sequence: Synthetic oligonucleotide
ctgcctcactcccgagctctactgact

SEQ ID NO: 405902 - DNA, 27 bp, Artificial Sequence
  Description of Artificial Sequence: Synthetic oligonucleotide
tgcctcactcccgagctctactgactc

SEQ ID NO: 405903 - DNA, 26 bp, Artificial Sequence
  Description of Artificial Sequence: Synthetic oligonucleotide
gcctcactcccgagctctactgactc

SEQ ID NO: 405904 - DNA, 26 bp, Artificial Sequence
  Description of Artificial Sequence: Synthetic oligonucleotide
cctcactcccgagctctactgactcc

SEQ ID NO: 405905 - DNA, 27 bp, Artificial Sequence
  Description of Artificial Sequence: Synthetic oligonucleotide
ctcactcccgagctctactgactccca

SEQ ID NO: 405906 - DNA, 30 bp, Artificial Sequence
  Description of Artificial Sequence: Synthetic oligonucleotide
tcactcccgagctctactgactcccaaaag

SEQ ID NO: 405907 - DNA, 29 bp, Artificial Sequence
  Description of Artificial Sequence: Synthetic oligonucleotide
cactcccgagctctactgactcccaaaag

SEQ ID NO: 405908 - DNA, 30 bp, Artificial Sequence
  Description of Artificial Sequence: Synthetic oligonucleotide
actcccgagctctactgactcccaaaagag

SEQ ID NO: 405909 - DNA, 29 bp, Artificial Sequence
  Description of Artificial Sequence: Synthetic oligonucleotide
ctcccgagctctactgactcccaaaagag

SEQ ID NO: 405910 - DNA, 29 bp, Artificial Sequence
  Description of Artificial Sequence: Synthetic oligonucleotide
tcccgagctctactgactcccaaaagagc

SEQ ID NO: 405911 - DNA, 28 bp, Artificial Sequence
  Description of Artificial Sequence: Synthetic oligonucleotide
cccgagctctactgactcccaaaagagc

SEQ ID NO: 405912 - DNA, 28 bp, Artificial Sequence
  Description of Artificial Sequence: Synthetic oligonucleotide
ccgagctctactgactcccaaaagagcg

SEQ ID NO: 405913 - DNA, 28 bp, Artificial Sequence
  Description of Artificial Sequence: Synthetic oligonucleotide
cgagctctactgactcccaaaagagcgc

SEQ ID NO: 405914 - DNA, 28 bp, Artificial Sequence
  Description of Artificial Sequence: Synthetic oligonucleotide
gagctctactgactcccaaaagagcgcc

SEQ ID NO: 405915 - DNA, 28 bp, Artificial Sequence
  Description of Artificial Sequence: Synthetic oligonucleotide
agctctactgactcccaaaagagcgccc

SEQ ID NO: 405916 - DNA, 27 bp, Artificial Sequence
  Description of Artificial Sequence: Synthetic oligonucleotide
gctctactgactcccaaaagagcgccc

SEQ ID NO: 405917 - DNA, 29 bp, Artificial Sequence
  Description of Artificial Sequence: Synthetic oligonucleotide
ctctactgactcccaaaagagcgcccaag

SEQ ID NO: 405918 - DNA, 31 bp, Artificial Sequence
  Description of Artificial Sequence: Synthetic oligonucleotide
tctactgactcccaaaagagcgcccaagaag

SEQ ID NO: 405919 - DNA, 30 bp, Artificial Sequence
  Description of Artificial Sequence: Synthetic oligonucleotide
ctactgactcccaaaagagcgcccaagaag

SEQ ID NO: 405920 - DNA, 35 bp, Artificial Sequence
  Description of Artificial Sequence: Synthetic oligonucleotide
tactgactcccaaaagagcgcccaagaagaaaatg

SEQ ID NO: 405921 - DNA, 34 bp, Artificial Sequence
  Description of Artificial Sequence: Synthetic oligonucleotide
actgactcccaaaagagcgcccaagaagaaaatg

SEQ ID NO: 405922 - DNA, 33 bp, Artificial Sequence
  Description of Artificial Sequence: Synthetic oligonucleotide
ctgactcccaaaagagcgcccaagaagaaaatg

SEQ ID NO: 405923 - DNA, 33 bp, Artificial Sequence
  Description of Artificial Sequence: Synthetic oligonucleotide
tgactcccaaaagagcgcccaagaagaaaatgg

SEQ ID NO: 405924 - DNA, 32 bp, Artificial Sequence
  Description of Artificial Sequence: Synthetic oligonucleotide
gactcccaaaagagcgcccaagaagaaaatgg

SEQ ID NO: 405925 - DNA, 32 bp, Artificial Sequence
  Description of Artificial Sequence: Synthetic oligonucleotide
actcccaaaagagcgcccaagaagaaaatggc

SEQ ID NO: 405926 - DNA, 31 bp, Artificial Sequence
  Description of Artificial Sequence: Synthetic oligonucleotide
ctcccaaaagagcgcccaagaagaaaatggc

SEQ ID NO: 405927 - DNA, 31 bp, Artificial Sequence
  Description of Artificial Sequence: Synthetic oligonucleotide
tcccaaaagagcgcccaagaagaaaatggcc

SEQ ID NO: 405928 - DNA, 30 bp, Artificial Sequence
  Description of Artificial Sequence: Synthetic oligonucleotide
cccaaaagagcgcccaagaagaaaatggcc

SEQ ID NO: 405929 - DNA, 34 bp, Artificial Sequence
  Description of Artificial Sequence: Synthetic oligonucleotide
ccaaaagagcgcccaagaagaaaatggccataag

SEQ ID NO: 405930 - DNA, 35 bp, Artificial Sequence
  Description of Artificial Sequence: Synthetic oligonucleotide
caaaagagcgcccaagaagaaaatggccataagtg

SEQ ID NO: 405931 - DNA, 35 bp, Artificial Sequence
  Description of Artificial Sequence: Synthetic oligonucleotide
aaaagagcgcccaagaagaaaatggccataagtgg

SEQ ID NO: 405932 - DNA, 34 bp, Artificial Sequence
  Description of Artificial Sequence: Synthetic oligonucleotide
aaagagcgcccaagaagaaaatggccataagtgg

SEQ ID NO: 405933 - DNA, 33 bp, Artificial Sequence
  Description of Artificial Sequence: Synthetic oligonucleotide
aagagcgcccaagaagaaaatggccataagtgg

SEQ ID NO: 405934 - DNA, 32 bp, Artificial Sequence
  Description of Artificial Sequence: Synthetic oligonucleotide
agagcgcccaagaagaaaatggccataagtgg

SEQ ID NO: 405935 - DNA, 31 bp, Artificial Sequence
  Description of Artificial Sequence: Synthetic oligonucleotide
gagcgcccaagaagaaaatggccataagtgg

SEQ ID NO: 405936 - DNA, 32 bp, Artificial Sequence
  Description of Artificial Sequence: Synthetic oligonucleotide
agcgcccaagaagaaaatggccataagtggag

SEQ ID NO: 405937 - DNA, 31 bp, Artificial Sequence
  Description of Artificial Sequence: Synthetic oligonucleotide
gcgcccaagaagaaaatggccataagtggag

SEQ ID NO: 405938 - DNA, 32 bp, Artificial Sequence
  Description of Artificial Sequence: Synthetic oligonucleotide
cgcccaagaagaaaatggccataagtggagtc

SEQ ID NO: 405939 - DNA, 32 bp, Artificial Sequence
  Description of Artificial Sequence: Synthetic oligonucleotide
gcccaagaagaaaatggccataagtggagtcc

SEQ ID NO: 405940 - DNA, 32 bp, Artificial Sequence
  Description of Artificial Sequence: Synthetic oligonucleotide
cccaagaagaaaatggccataagtggagtccc

SEQ ID NO: 405941 - DNA, 33 bp, Artificial Sequence
  Description of Artificial Sequence: Synthetic oligonucleotide
ccaagaagaaaatggccataagtggagtccctg

SEQ ID NO: 405942 - DNA, 34 bp, Artificial Sequence
  Description of Artificial Sequence: Synthetic oligonucleotide
caagaagaaaatggccataagtggagtccctgtg

SEQ ID NO: 405943 - DNA, 34 bp, Artificial Sequence
  Description of Artificial Sequence: Synthetic oligonucleotide
aagaagaaaatggccataagtggagtccctgtgc

SEQ ID NO: 405944 - DNA, 33 bp, Artificial Sequence
  Description of Artificial Sequence: Synthetic oligonucleotide
agaagaaaatggccataagtggagtccctgtgc

SEQ ID NO: 405945 - DNA, 32 bp, Artificial Sequence
  Description of Artificial Sequence: Synthetic oligonucleotide
gaagaaaatggccataagtggagtccctgtgc

SEQ ID NO: 405946 - DNA, 34 bp, Artificial Sequence
  Description of Artificial Sequence: Synthetic oligonucleotide
aagaaaatggccataagtggagtccctgtgctag

SEQ ID NO: 405947 - DNA, 33 bp, Artificial Sequence
  Description of Artificial Sequence: Synthetic oligonucleotide
agaaaatggccataagtggagtccctgtgctag

SEQ ID NO: 405948 - DNA, 32 bp, Artificial Sequence
  Description of Artificial Sequence: Synthetic oligonucleotide
gaaaatggccataagtggagtccctgtgctag

SEQ ID NO: 405949 - DNA, 32 bp, Artificial Sequence
  Description of Artificial Sequence: Synthetic oligonucleotide
aaaatggccataagtggagtccctgtgctagg

SEQ ID NO: 405950 - DNA, 31 bp, Artificial Sequence
  Description of Artificial Sequence: Synthetic oligonucleotide
aaatggccataagtggagtccctgtgctagg

SEQ ID NO: 405951 - DNA, 30 bp, Artificial Sequence
  Description of Artificial Sequence: Synthetic oligonucleotide
aatggccataagtggagtccctgtgctagg

SEQ ID NO: 405952 - DNA, 29 bp, Artificial Sequence
  Description of Artificial Sequence: Synthetic oligonucleotide
atggccataagtggagtccctgtgctagg

SEQ ID NO: 405953 - DNA, 28 bp, Artificial Sequence
  Description of Artificial Sequence: Synthetic oligonucleotide
tggccataagtggagtccctgtgctagg

SEQ ID NO: 405954 - DNA, 27 bp, Artificial Sequence
  Description of Artificial Sequence: Synthetic oligonucleotide
ggccataagtggagtccctgtgctagg

SEQ ID NO: 405955 - DNA, 33 bp, Artificial Sequence; identical to SEQ ID NO: 61983
  Description of Artificial Sequence: Synthetic oligonucleotide

SEQ ID NO: 405956 - DNA, 35 bp, Artificial Sequence; identical to SEQ ID NO: 61984
  Description of Artificial Sequence: Synthetic oligonucleotide

SEQ ID NO: 405957 - DNA, 38 bp, Artificial Sequence; identical to SEQ ID NO: 61985
  Description of Artificial Sequence: Synthetic oligonucleotide

SEQ ID NO: 405958 - DNA, 38 bp, Artificial Sequence; identical to SEQ ID NO: 61986
  Description of Artificial Sequence: Synthetic oligonucleotide

SEQ ID NO: 405959 - DNA, 37 bp, Artificial Sequence; identical to SEQ ID NO: 61987
  Description of Artificial Sequence: Synthetic oligonucleotide

SEQ ID NO: 405960 - DNA, 36 bp, Artificial Sequence; identical to SEQ ID NO: 61988
  Description of Artificial Sequence: Synthetic oligonucleotide

SEQ ID NO: 405961 - DNA, 35 bp, Artificial Sequence; identical to SEQ ID NO: 61989
  Description of Artificial Sequence: Synthetic oligonucleotide

SEQ ID NO: 405962 - DNA, 34 bp, Artificial Sequence; identical to SEQ ID NO: 61990
  Description of Artificial Sequence: Synthetic oligonucleotide

SEQ ID NO: 405963 - DNA, 35 bp, Artificial Sequence; identical to SEQ ID NO: 61991
  Description of Artificial Sequence: Synthetic oligonucleotide

SEQ ID NO: 405964 - DNA, 34 bp, Artificial Sequence; identical to SEQ ID NO: 61992
  Description of Artificial Sequence: Synthetic oligonucleotide

SEQ ID NO: 405965 - DNA, 35 bp, Artificial Sequence; identical to SEQ ID NO: 61993
  Description of Artificial Sequence: Synthetic oligonucleotide

SEQ ID NO: 405966 - DNA, 35 bp, Artificial Sequence; identical to SEQ ID NO: 61994
  Description of Artificial Sequence: Synthetic oligonucleotide

SEQ ID NO: 405967 - DNA, 34 bp, Artificial Sequence; identical to SEQ ID NO: 61995
  Description of Artificial Sequence: Synthetic oligonucleotide

SEQ ID NO: 405968 - DNA, 35 bp, Artificial Sequence; identical to SEQ ID NO: 61996
  Description of Artificial Sequence: Synthetic oligonucleotide

SEQ ID NO: 405969 - DNA, 34 bp, Artificial Sequence; identical to SEQ ID NO: 61997
  Description of Artificial Sequence: Synthetic oligonucleotide

SEQ ID NO: 405970 - DNA, 36 bp, Artificial Sequence; identical to SEQ ID NO: 61998
  Description of Artificial Sequence: Synthetic oligonucleotide

SEQ ID NO: 405971 - DNA, 37 bp, Artificial Sequence; identical to SEQ ID NO: 61999
  Description of Artificial Sequence: Synthetic oligonucleotide

SEQ ID NO: 405972 - DNA, 37 bp, Artificial Sequence; identical to SEQ ID NO: 62000
  Description of Artificial Sequence: Synthetic oligonucleotide

SEQ ID NO: 405973 - DNA, 36 bp, Artificial Sequence; identical to SEQ ID NO: 62001
  Description of Artificial Sequence: Synthetic oligonucleotide

SEQ ID NO: 405974 - DNA, 36 bp, Artificial Sequence; identical to SEQ ID NO: 62002
  Description of Artificial Sequence: Synthetic oligonucleotide

SEQ ID NO: 405975 - DNA, 35 bp, Artificial Sequence; identical to SEQ ID NO: 62003
  Description of Artificial Sequence: Synthetic oligonucleotide

SEQ ID NO: 405976 - DNA, 35 bp, Artificial Sequence; identical to SEQ ID NO: 62004
  Description of Artificial Sequence: Synthetic oligonucleotide

SEQ ID NO: 405977 - DNA, 36 bp, Artificial Sequence; identical to SEQ ID NO: 62005
  Description of Artificial Sequence: Synthetic oligonucleotide

SEQ ID NO: 405978 - DNA, 35 bp, Artificial Sequence; identical to SEQ ID NO: 62006
  Description of Artificial Sequence: Synthetic oligonucleotide

SEQ ID NO: 405979 - DNA, 34 bp, Artificial Sequence; identical to SEQ ID NO: 62007
  Description of Artificial Sequence: Synthetic oligonucleotide

SEQ ID NO: 405980 - DNA, 35 bp, Artificial Sequence; identical to SEQ ID NO: 62008
  Description of Artificial Sequence: Synthetic oligonucleotide

SEQ ID NO: 405981 - DNA, 35 bp, Artificial Sequence; identical to SEQ ID NO: 62009
  Description of Artificial Sequence: Synthetic oligonucleotide

SEQ ID NO: 405982 - DNA, 34 bp, Artificial Sequence; identical to SEQ ID NO: 62010
  Description of Artificial Sequence: Synthetic oligonucleotide

SEQ ID NO: 405983 - DNA, 33 bp, Artificial Sequence; identical to SEQ ID NO: 62011
  Description of Artificial Sequence: Synthetic oligonucleotide

SEQ ID NO: 405984 - DNA, 32 bp, Artificial Sequence; identical to SEQ ID NO: 62012
  Description of Artificial Sequence: Synthetic oligonucleotide

SEQ ID NO: 405985 - DNA, 31 bp, Artificial Sequence; identical to SEQ ID NO: 62013
  Description of Artificial Sequence: Synthetic oligonucleotide

SEQ ID NO: 405986 - DNA, 30 bp, Artificial Sequence; identical to SEQ ID NO: 62014
  Description of Artificial Sequence: Synthetic oligonucleotide

SEQ ID NO: 405987 - DNA, 29 bp, Artificial Sequence
  Description of Artificial Sequence: Synthetic oligonucleotide
catcatagctgtgctgatgagcgctcagg

SEQ ID NO: 405988 - DNA, 32 bp, Artificial Sequence; identical to SEQ ID NO: 62016
  Description of Artificial Sequence: Synthetic oligonucleotide

SEQ ID NO: 405989 - DNA, 31 bp, Artificial Sequence; identical to SEQ ID NO: 62017
  Description of Artificial Sequence: Synthetic oligonucleotide

SEQ ID NO: 405990 - DNA, 30 bp, Artificial Sequence; identical to SEQ ID NO: 62018
  Description of Artificial Sequence: Synthetic oligonucleotide

SEQ ID NO: 405991 - DNA, 32 bp, Artificial Sequence; identical to SEQ ID NO: 62019
  Description of Artificial Sequence: Synthetic oligonucleotide

SEQ ID NO: 405992 - DNA, 31 bp, Artificial Sequence; identical to SEQ ID NO: 62020
  Description of Artificial Sequence: Synthetic oligonucleotide

SEQ ID NO: 405993 - DNA, 30 bp, Artificial Sequence; identical to SEQ ID NO: 62021
  Description of Artificial Sequence: Synthetic oligonucleotide

SEQ ID NO: 405994 - DNA, 29 bp, Artificial Sequence
  Description of Artificial Sequence: Synthetic oligonucleotide
gctgtgctgatgagcgctcaggaatcatg

SEQ ID NO: 405995 - DNA, 29 bp, Artificial Sequence
  Description of Artificial Sequence: Synthetic oligonucleotide
ctgtgctgatgagcgctcaggaatcatgg

SEQ ID NO: 405996 - DNA, 29 bp, Artificial Sequence
  Description of Artificial Sequence: Synthetic oligonucleotide
tgtgctgatgagcgctcaggaatcatggg

SEQ ID NO: 405997 - DNA, 28 bp, Artificial Sequence
  Description of Artificial Sequence: Synthetic oligonucleotide
gtgctgatgagcgctcaggaatcatggg

SEQ ID NO: 405998 - DNA, 28 bp, Artificial Sequence
  Description of Artificial Sequence: Synthetic oligonucleotide
tgctgatgagcgctcaggaatcatgggc

SEQ ID NO: 405999 - DNA, 27 bp, Artificial Sequence
  Description of Artificial Sequence: Synthetic oligonucleotide
gctgatgagcgctcaggaatcatgggc

SEQ ID NO: 406000 - DNA, 30 bp, Artificial Sequence; identical to SEQ ID NO: 62028
  Description of Artificial Sequence: Synthetic oligonucleotide

SEQ ID NO: 406001 - DNA, 33 bp, Artificial Sequence; identical to SEQ ID NO: 62029
  Description of Artificial Sequence: Synthetic oligonucleotide

SEQ ID NO: 406002 - DNA, 32 bp, Artificial Sequence; identical to SEQ ID NO: 62030
  Description of Artificial Sequence: Synthetic oligonucleotide

SEQ ID NO: 406003 - DNA, 34 bp, Artificial Sequence; identical to SEQ ID NO: 62031
  Description of Artificial Sequence: Synthetic oligonucleotide

SEQ ID NO: 406004 - DNA, 33 bp, Artificial Sequence; identical to SEQ ID NO: 62032
  Description of Artificial Sequence: Synthetic oligonucleotide

SEQ ID NO: 406005 - DNA, 32 bp, Artificial Sequence; identical to SEQ ID NO: 62033
  Description of Artificial Sequence: Synthetic oligonucleotide

SEQ ID NO: 406006 - DNA, 34 bp, Artificial Sequence; identical to SEQ ID NO: 62034
  Description of Artificial Sequence: Synthetic oligonucleotide

SEQ ID NO: 406007 - DNA, 33 bp, Artificial Sequence; identical to SEQ ID NO: 62035
  Description of Artificial Sequence: Synthetic oligonucleotide

SEQ ID NO: 406008 - DNA, 35 bp, Artificial Sequence; identical to SEQ ID NO: 62036
  Description of Artificial Sequence: Synthetic oligonucleotide

SEQ ID NO: 406009 - DNA, 36 bp, Artificial Sequence; identical to SEQ ID NO: 62037
  Description of Artificial Sequence: Synthetic oligonucleotide

SEQ ID NO: 406010 - DNA, 38 bp, Artificial Sequence; identical to SEQ ID NO: 62038
  Description of Artificial Sequence: Synthetic oligonucleotide

SEQ ID NO: 406011 - DNA, 40 bp, Artificial Sequence; identical to SEQ ID NO: 62039
  Description of Artificial Sequence: Synthetic oligonucleotide

SEQ ID NO: 406012 - DNA, 39 bp, Artificial Sequence; identical to SEQ ID NO: 62040
  Description of Artificial Sequence: Synthetic oligonucleotide

SEQ ID NO: 406013 - DNA, 39 bp, Artificial Sequence; identical to SEQ ID NO: 62041
  Description of Artificial Sequence: Synthetic oligonucleotide

SEQ ID NO: 406014 - DNA, 38 bp, Artificial Sequence; identical to SEQ ID NO: 62042
  Description of Artificial Sequence: Synthetic oligonucleotide

SEQ ID NO: 406015 - DNA, 39 bp, Artificial Sequence; identical to SEQ ID NO: 62043
  Description of Artificial Sequence: Synthetic oligonucleotide

SEQ ID NO: 406016 - DNA, 39 bp, Artificial Sequence; identical to SEQ ID NO: 62044
  Description of Artificial Sequence: Synthetic oligonucleotide

SEQ ID NO: 406017 - DNA, 38 bp, Artificial Sequence; identical to SEQ ID NO: 62045
  Description of Artificial Sequence: Synthetic oligonucleotide

SEQ ID NO: 406018 - DNA, 37 bp, Artificial Sequence; identical to SEQ ID NO: 62046
  Description of Artificial Sequence: Synthetic oligonucleotide

SEQ ID NO: 406019 - DNA, 36 bp, Artificial Sequence; identical to SEQ ID NO: 62047
  Description of Artificial Sequence: Synthetic oligonucleotide

SEQ ID NO: 406020 - DNA, 36 bp, Artificial Sequence; identical to SEQ ID NO: 62048
  Description of Artificial Sequence: Synthetic oligonucleotide

SEQ ID NO: 406021 - DNA, 35 bp, Artificial Sequence; identical to SEQ ID NO: 62049
  Description of Artificial Sequence: Synthetic oligonucleotide

SEQ ID NO: 406022 - DNA, 34 bp, Artificial Sequence; identical to SEQ ID NO: 62050
  Description of Artificial Sequence: Synthetic oligonucleotide

SEQ ID NO: 406023 - DNA, 34 bp, Artificial Sequence; identical to SEQ ID NO: 62051
  Description of Artificial Sequence: Synthetic oligonucleotide

SEQ ID NO: 406024 - DNA, 34 bp, Artificial Sequence; identical to SEQ ID NO: 62052
  Description of Artificial Sequence: Synthetic oligonucleotide

SEQ ID NO: 406025 - DNA, 35 bp, Artificial Sequence; identical to SEQ ID NO: 62053
  Description of Artificial Sequence: Synthetic oligonucleotide

SEQ ID NO: 406026 - DNA, 37 bp, Artificial Sequence; identical to SEQ ID NO: 62054
  Description of Artificial Sequence: Synthetic oligonucleotide

SEQ ID NO: 406027 - DNA, 36 bp, Artificial Sequence; identical to SEQ ID NO: 62055
  Description of Artificial Sequence: Synthetic oligonucleotide

SEQ ID NO: 406028 - DNA, 35 bp, Artificial Sequence; identical to SEQ ID NO: 62056
  Description of Artificial Sequence: Synthetic oligonucleotide

SEQ ID NO: 406029 - DNA, 34 bp, Artificial Sequence; identical to SEQ ID NO: 62057
  Description of Artificial Sequence: Synthetic oligonucleotide

SEQ ID NO: 406030 - DNA, 37 bp, Artificial Sequence; identical to SEQ ID NO: 62058
  Description of Artificial Sequence: Synthetic oligonucleotide

SEQ ID NO: 406031 - DNA, 36 bp, Artificial Sequence; identical to SEQ ID NO: 62059
  Description of Artificial Sequence: Synthetic oligonucleotide

SEQ ID NO: 406032 - DNA, 35 bp, Artificial Sequence; identical to SEQ ID NO: 62060
  Description of Artificial Sequence: Synthetic oligonucleotide

SEQ ID NO: 406033 - DNA, 34 bp, Artificial Sequence; identical to SEQ ID NO: 62061
  Description of Artificial Sequence: Synthetic oligonucleotide

SEQ ID NO: 406034 - DNA, 35 bp, Artificial Sequence; identical to SEQ ID NO: 62062
  Description of Artificial Sequence: Synthetic oligonucleotide

SEQ ID NO: 406035 - DNA, 34 bp, Artificial Sequence; identical to SEQ ID NO: 62063
  Description of Artificial Sequence: Synthetic oligonucleotide

SEQ ID NO: 406036 - DNA, 33 bp, Artificial Sequence; identical to SEQ ID NO: 62064
  Description of Artificial Sequence: Synthetic oligonucleotide

SEQ ID NO: 406037 - DNA, 36 bp, Artificial Sequence; identical to SEQ ID NO: 62065
  Description of Artificial Sequence: Synthetic oligonucleotide

SEQ ID NO: 406038 - DNA, 35 bp, Artificial Sequence; identical to SEQ ID NO: 62066
  Description of Artificial Sequence: Synthetic oligonucleotide

SEQ ID NO: 406039 - DNA, 34 bp, Artificial Sequence; identical to SEQ ID NO: 62067
  Description of Artificial Sequence: Synthetic oligonucleotide

SEQ ID NO: 406040 - DNA, 34 bp, Artificial Sequence; identical to SEQ ID NO: 62068
  Description of Artificial Sequence: Synthetic oligonucleotide

SEQ ID NO: 406041 - DNA, 33 bp, Artificial Sequence; identical to SEQ ID NO: 62069
  Description of Artificial Sequence: Synthetic oligonucleotide

SEQ ID NO: 406042 - DNA, 32 bp, Artificial Sequence; identical to SEQ ID NO: 62070
  Description of Artificial Sequence: Synthetic oligonucleotide

SEQ ID NO: 406043 - DNA, 33 bp, Artificial Sequence; identical to SEQ ID NO: 62071
  Description of Artificial Sequence: Synthetic oligonucleotide

SEQ ID NO: 406044 - DNA, 32 bp, Artificial Sequence; identical to SEQ ID NO: 62072
  Description of Artificial Sequence: Synthetic oligonucleotide

SEQ ID NO: 406045 - DNA, 33 bp, Artificial Sequence; identical to SEQ ID NO: 62073
  Description of Artificial Sequence: Synthetic oligonucleotide

SEQ ID NO: 406046 - DNA, 32 bp, Artificial Sequence; identical to SEQ ID NO: 62074
  Description of Artificial Sequence: Synthetic oligonucleotide

SEQ ID NO: 406047 - DNA, 31 bp, Artificial Sequence; identical to SEQ ID NO: 62075
  Description of Artificial Sequence: Synthetic oligonucleotide

SEQ ID NO: 406048 - DNA, 31 bp, Artificial Sequence; identical to SEQ ID NO: 62076
  Description of Artificial Sequence: Synthetic oligonucleotide

SEQ ID NO: 406049 - DNA, 30 bp, Artificial Sequence; identical to SEQ ID NO: 62077
  Description of Artificial Sequence: Synthetic oligonucleotide

SEQ ID NO: 406050 - DNA, 29 bp, Artificial Sequence
  Description of Artificial Sequence: Synthetic oligonucleotide
ccaggccgagttctatctgaatcctgacc

SEQ ID NO: 406051 - DNA, 32 bp, Artificial Sequence; identical to SEQ ID NO: 62079
  Description of Artificial Sequence: Synthetic oligonucleotide

SEQ ID NO: 406052 - DNA, 33 bp, Artificial Sequence; identical to SEQ ID NO: 62080
  Description of Artificial Sequence: Synthetic oligonucleotide

SEQ ID NO: 406053 - DNA, 32 bp, Artificial Sequence; identical to SEQ ID NO: 62081
  Description of Artificial Sequence: Synthetic oligonucleotide

SEQ ID NO: 406054 - DNA, 32 bp, Artificial Sequence; identical to SEQ ID NO: 62082
  Description of Artificial Sequence: Synthetic oligonucleotide

SEQ ID NO: 406055 - DNA, 32 bp, Artificial Sequence; identical to SEQ ID NO: 62083
  Description of Artificial Sequence: Synthetic oligonucleotide

SEQ ID NO: 406056 - DNA, 32 bp, Artificial Sequence; identical to SEQ ID NO: 62084
  Description of Artificial Sequence: Synthetic oligonucleotide

SEQ ID NO: 406057 - DNA, 33 bp, Artificial Sequence; identical to SEQ ID NO: 62085
  Description of Artificial Sequence: Synthetic oligonucleotide

SEQ ID NO: 406058 - DNA, 38 bp, Artificial Sequence; identical to SEQ ID NO: 62086
  Description of Artificial Sequence: Synthetic oligonucleotide

SEQ ID NO: 406059 - DNA, 37 bp, Artificial Sequence; identical to SEQ ID NO: 62087
  Description of Artificial Sequence: Synthetic oligonucleotide

SEQ ID NO: 406060 - DNA, 40 bp, Artificial Sequence; identical to SEQ ID NO: 62088
  Description of Artificial Sequence: Synthetic oligonucleotide

SEQ ID NO: 406061 - DNA, 39 bp, Artificial Sequence; identical to SEQ ID NO: 62089
  Description of Artificial Sequence: Synthetic oligonucleotide

SEQ ID NO: 406062 - DNA, 38 bp, Artificial Sequence; identical to SEQ ID NO: 62090
  Description of Artificial Sequence: Synthetic oligonucleotide

SEQ ID NO: 406063 - DNA, 39 bp, Artificial Sequence; identical to SEQ ID NO: 62091
  Description of Artificial Sequence: Synthetic oligonucleotide

SEQ ID NO: 406064 - DNA, 38 bp, Artificial Sequence; identical to SEQ ID NO: 62092
  Description of Artificial Sequence: Synthetic oligonucleotide

SEQ ID NO: 406065 - DNA, 37 bp, Artificial Sequence; identical to SEQ ID NO: 62093
  Description of Artificial Sequence: Synthetic oligonucleotide

SEQ ID NO: 406066 - DNA, 36 bp, Artificial Sequence; identical to SEQ ID NO: 62094
  Description of Artificial Sequence: Synthetic oligonucleotide

SEQ ID NO: 406067 - DNA, 39 bp, Artificial Sequence; identical to SEQ ID NO: 62095
  Description of Artificial Sequence: Synthetic oligonucleotide

SEQ ID NO: 406068 - DNA, 38 bp, Artificial Sequence; identical to SEQ ID NO: 62096
  Description of Artificial Sequence: Synthetic oligonucleotide

SEQ ID NO: 406069 - DNA, 40 bp, Artificial Sequence; identical to SEQ ID NO: 62097
  Description of Artificial Sequence: Synthetic oligonucleotide

SEQ ID NO: 406070 - DNA, 39 bp, Artificial Sequence; identical to SEQ ID NO: 62098
  Description of Artificial Sequence: Synthetic oligonucleotide

SEQ ID NO: 406071 - DNA, 38 bp, Artificial Sequence; identical to SEQ ID NO: 62099
  Description of Artificial Sequence: Synthetic oligonucleotide

SEQ ID NO: 406072 - DNA, 37 bp, Artificial Sequence; identical to SEQ ID NO: 62100
  Description of Artificial Sequence: Synthetic oligonucleotide

SEQ ID NO: 406073 - DNA, 37 bp, Artificial Sequence; identical to SEQ ID NO: 62101
  Description of Artificial Sequence: Synthetic oligonucleotide

SEQ ID NO: 406074 - DNA, 38 bp, Artificial Sequence; identical to SEQ ID NO: 62102
  Description of Artificial Sequence: Synthetic oligonucleotide

SEQ ID NO: 406075 - DNA, 37 bp, Artificial Sequence; identical to SEQ ID NO: 62103
  Description of Artificial Sequence: Synthetic oligonucleotide

SEQ ID NO: 406076 - DNA, 39 bp, Artificial Sequence; identical to SEQ ID NO: 62104
  Description of Artificial Sequence: Synthetic oligonucleotide

SEQ ID NO: 406077 - DNA, 38 bp, Artificial Sequence; identical to SEQ ID NO: 62105
  Description of Artificial Sequence: Synthetic oligonucleotide

SEQ ID NO: 406078 - DNA, 39 bp, Artificial Sequence; identical to SEQ ID NO: 62106
  Description of Artificial Sequence: Synthetic oligonucleotide

SEQ ID NO: 406079 - DNA, 44 bp, Artificial Sequence; identical to SEQ ID NO: 62107
  Description of Artificial Sequence: Synthetic oligonucleotide

SEQ ID NO: 406080 - DNA, 43 bp, Artificial Sequence; identical to SEQ ID NO: 62108
  Description of Artificial Sequence: Synthetic oligonucleotide

SEQ ID NO: 406081 - DNA, 42 bp, Artificial Sequence; identical to SEQ ID NO: 62109
  Description of Artificial Sequence: Synthetic oligonucleotide

SEQ ID NO: 406082 - DNA, 41 bp, Artificial Sequence; identical to SEQ ID NO: 62110
  Description of Artificial Sequence: Synthetic oligonucleotide

SEQ ID NO: 406083 - DNA, 41 bp, Artificial Sequence; identical to SEQ ID NO: 62111
  Description of Artificial Sequence: Synthetic oligonucleotide

SEQ ID NO: 406084 - DNA, 40 bp, Artificial Sequence; identical to SEQ ID NO: 62112
  Description of Artificial Sequence: Synthetic oligonucleotide

SEQ ID NO: 406085 - DNA, 42 bp, Artificial Sequence; identical to SEQ ID NO: 62113
  Description of Artificial Sequence: Synthetic oligonucleotide

SEQ ID NO: 406086 - DNA, 43 bp, Artificial Sequence; identical to SEQ ID NO: 62114
  Description of Artificial Sequence: Synthetic oligonucleotide

SEQ ID NO: 406087 - DNA, 43 bp, Artificial Sequence; identical to SEQ ID NO: 62115
  Description of Artificial Sequence: Synthetic oligonucleotide

SEQ ID NO: 406088 - DNA, 47 bp, Artificial Sequence; identical to SEQ ID NO: 62116
  Description of Artificial Sequence: Synthetic oligonucleotide

SEQ ID NO: 406089 - DNA, 46 bp, Artificial Sequence; identical to SEQ ID NO: 62117
  Description of Artificial Sequence: Synthetic oligonucleotide

SEQ ID NO: 406090 - DNA, 46 bp, Artificial Sequence; identical to SEQ ID NO: 62118
  Description of Artificial Sequence: Synthetic oligonucleotide

SEQ ID NO: 406091 - DNA, 45 bp, Artificial Sequence; identical to SEQ ID NO: 62119
  Description of Artificial Sequence: Synthetic oligonucleotide

SEQ ID NO: 406092 - DNA, 44 bp, Artificial Sequence; identical to SEQ ID NO: 62120
  Description of Artificial Sequence: Synthetic oligonucleotide

SEQ ID NO: 406093 - DNA, 43 bp, Artificial Sequence; identical to SEQ ID NO: 62121
  Description of Artificial Sequence: Synthetic oligonucleotide

SEQ ID NO: 406094 - DNA, 42 bp, Artificial Sequence; identical to SEQ ID NO: 62122
  Description of Artificial Sequence: Synthetic oligonucleotide

SEQ ID NO: 406095 - DNA, 41 bp, Artificial Sequence; identical to SEQ ID NO: 62123
  Description of Artificial Sequence: Synthetic oligonucleotide

SEQ ID NO: 406096 - DNA, 41 bp, Artificial Sequence; identical to SEQ ID NO: 62124
  Description of Artificial Sequence: Synthetic oligonucleotide

SEQ ID NO: 406097 - DNA, 40 bp, Artificial Sequence; identical to SEQ ID NO: 62125
  Description of Artificial Sequence: Synthetic oligonucleotide

SEQ ID NO: 406098 - DNA, 39 bp, Artificial Sequence; identical to SEQ ID NO: 62126
  Description of Artificial Sequence: Synthetic oligonucleotide

SEQ ID NO: 406099 - DNA, 38 bp, Artificial Sequence; identical to SEQ ID NO: 62127
  Description of Artificial Sequence: Synthetic oligonucleotide

SEQ ID NO: 406100 - DNA, 41 bp, Artificial Sequence; identical to SEQ ID NO: 62128
  Description of Artificial Sequence: Synthetic oligonucleotide

SEQ ID NO: 406101 - DNA, 40 bp, Artificial Sequence; identical to SEQ ID NO: 62129
  Description of Artificial Sequence: Synthetic oligonucleotide

SEQ ID NO: 406102 - DNA, 42 bp, Artificial Sequence; identical to SEQ ID NO: 62130
  Description of Artificial Sequence: Synthetic oligonucleotide

SEQ ID NO: 406103 - DNA, 41 bp, Artificial Sequence; identical to SEQ ID NO: 62131
  Description of Artificial Sequence: Synthetic oligonucleotide

SEQ ID NO: 406104 - DNA, 40 bp, Artificial Sequence; identical to SEQ ID NO: 62132
  Description of Artificial Sequence: Synthetic oligonucleotide

SEQ ID NO: 406105 - DNA, 39 bp, Artificial Sequence; identical to SEQ ID NO: 62133
  Description of Artificial Sequence: Synthetic oligonucleotide

SEQ ID NO: 406106 - DNA, 39 bp, Artificial Sequence; identical to SEQ ID NO: 62134
  Description of Artificial Sequence: Synthetic oligonucleotide

SEQ ID NO: 406107 - DNA, 38 bp, Artificial Sequence; identical to SEQ ID NO: 62135
  Description of Artificial Sequence: Synthetic oligonucleotide

SEQ ID NO: 406108 - DNA, 37 bp, Artificial Sequence; identical to SEQ ID NO: 62136
  Description of Artificial Sequence: Synthetic oligonucleotide

SEQ ID NO: 406109 - DNA, 38 bp, Artificial Sequence; identical to SEQ ID NO: 62137
  Description of Artificial Sequence: Synthetic oligonucleotide

SEQ ID NO: 406110 - DNA, 39 bp, Artificial Sequence; identical to SEQ ID NO: 62138
  Description of Artificial Sequence: Synthetic oligonucleotide

SEQ ID NO: 406111 - DNA, 38 bp, Artificial Sequence; identical to SEQ ID NO: 62139
  Description of Artificial Sequence: Synthetic oligonucleotide

SEQ ID NO: 406112 - DNA, 38 bp, Artificial Sequence; identical to SEQ ID NO: 62140
  Description of Artificial Sequence: Synthetic oligonucleotide

SEQ ID NO: 406113 - DNA, 37 bp, Artificial Sequence; identical to SEQ ID NO: 62141
  Description of Artificial Sequence: Synthetic oligonucleotide

SEQ ID NO: 406114 - DNA, 36 bp, Artificial Sequence; identical to SEQ ID NO: 62142
  Description of Artificial Sequence: Synthetic oligonucleotide

SEQ ID NO: 406115 - DNA, 36 bp, Artificial Sequence; identical to SEQ ID NO: 62143
  Description of Artificial Sequence: Synthetic oligonucleotide

SEQ ID NO: 406116 - DNA, 35 bp, Artificial Sequence; identical to SEQ ID NO: 62144
  Description of Artificial Sequence: Synthetic oligonucleotide

SEQ ID NO: 406117 - DNA, 36 bp, Artificial Sequence; identical to SEQ ID NO: 62145
  Description of Artificial Sequence: Synthetic oligonucleotide

SEQ ID NO: 406118 - DNA, 35 bp, Artificial Sequence; identical to SEQ ID NO: 62146
  Description of Artificial Sequence: Synthetic oligonucleotide

SEQ ID NO: 406119 - DNA, 34 bp, Artificial Sequence; identical to SEQ ID NO: 62147
  Description of Artificial Sequence: Synthetic oligonucleotide

SEQ ID NO: 406120 - DNA, 33 bp, Artificial Sequence; identical to SEQ ID NO: 62148
  Description of Artificial Sequence: Synthetic oligonucleotide

SEQ ID NO: 406121 - DNA, 32 bp, Artificial Sequence; identical to SEQ ID NO: 62149
  Description of Artificial Sequence: Synthetic oligonucleotide

SEQ ID NO: 406122 - DNA, 31 bp, Artificial Sequence; identical to SEQ ID NO: 62150
  Description of Artificial Sequence: Synthetic oligonucleotide

SEQ ID NO: 406123 - DNA, 32 bp, Artificial Sequence; identical to SEQ ID NO: 62151
  Description of Artificial Sequence: Synthetic oligonucleotide

SEQ ID NO: 406124 - DNA, 32 bp, Artificial Sequence; identical to SEQ ID NO: 62152
  Description of Artificial Sequence: Synthetic oligonucleotide

SEQ ID NO: 406125 - DNA, 31 bp, Artificial Sequence; identical to SEQ ID NO: 62153
  Description of Artificial Sequence: Synthetic oligonucleotide

SEQ ID NO: 406126 - DNA, 30 bp, Artificial Sequence; identical to SEQ ID NO: 62154
  Description of Artificial Sequence: Synthetic oligonucleotide

SEQ ID NO: 406127 - DNA, 30 bp, Artificial Sequence; identical to SEQ ID NO: 62155
  Description of Artificial Sequence: Synthetic oligonucleotide

SEQ ID NO: 406128 - DNA, 29 bp, Artificial Sequence
  Description of Artificial Sequence: Synthetic oligonucleotide
ggatatggcaaagaaggagacggtctggc

SEQ ID NO: 406129 - DNA, 29 bp, Artificial Sequence
  Description of Artificial Sequence: Synthetic oligonucleotide
gatatggcaaagaaggagacggtctggcg

SEQ ID NO: 406130 - DNA, 29 bp, Artificial Sequence
  Description of Artificial Sequence: Synthetic oligonucleotide
atatggcaaagaaggagacggtctggcgg

SEQ ID NO: 406131 - DNA, 28 bp, Artificial Sequence
  Description of Artificial Sequence: Synthetic oligonucleotide
tatggcaaagaaggagacggtctggcgg

SEQ ID NO: 406132 - DNA, 27 bp, Artificial Sequence
  Description of Artificial Sequence: Synthetic oligonucleotide
atggcaaagaaggagacggtctggcgg

SEQ ID NO: 406133 - DNA, 26 bp, Artificial Sequence
  Description of Artificial Sequence: Synthetic oligonucleotide
tggcaaagaaggagacggtctggcgg

SEQ ID NO: 406134 - DNA, 25 bp, Artificial Sequence
  Description of Artificial Sequence: Synthetic oligonucleotide
ggcaaagaaggagacggtctggcgg

SEQ ID NO: 406135 - DNA, 27 bp, Artificial Sequence
  Description of Artificial Sequence: Synthetic oligonucleotide
gcaaagaaggagacggtctggcggctt

SEQ ID NO: 406136 - DNA, 27 bp, Artificial Sequence
  Description of Artificial Sequence: Synthetic oligonucleotide
caaagaaggagacggtctggcggcttg

SEQ ID NO: 406137 - DNA, 29 bp, Artificial Sequence
  Description of Artificial Sequence: Synthetic oligonucleotide
aaagaaggagacggtctggcggcttgaag

SEQ ID NO: 406138 - DNA, 28 bp, Artificial Sequence
  Description of Artificial Sequence: Synthetic oligonucleotide
aagaaggagacggtctggcggcttgaag

SEQ ID NO: 406139 - DNA, 27 bp, Artificial Sequence
  Description of Artificial Sequence: Synthetic oligonucleotide
agaaggagacggtctggcggcttgaag

SEQ ID NO: 406140 - DNA, 27 bp, Artificial Sequence
  Description of Artificial Sequence: Synthetic oligonucleotide
gaaggagacggtctggcggcttgaaga

SEQ ID NO: 406141 - DNA, 31 bp, Artificial Sequence; identical to SEQ ID NO: 62169
  Description of Artificial Sequence: Synthetic oligonucleotide

SEQ ID NO: 406142 - DNA, 30 bp, Artificial Sequence; identical to SEQ ID NO: 62170
  Description of Artificial Sequence: Synthetic oligonucleotide

SEQ ID NO: 406143 - DNA, 29 bp, Artificial Sequence
  Description of Artificial Sequence: Synthetic oligonucleotide
ggagacggtctggcggcttgaagaatttg

SEQ ID NO: 406144 - DNA, 29 bp, Artificial Sequence
  Description of Artificial Sequence: Synthetic oligonucleotide
gagacggtctggcggcttgaagaatttgg

SEQ ID NO: 406145 - DNA, 30 bp, Artificial Sequence; identical to SEQ ID NO: 62173
  Description of Artificial Sequence: Synthetic oligonucleotide

SEQ ID NO: 406146 - DNA, 29 bp, Artificial Sequence
  Description of Artificial Sequence: Synthetic oligonucleotide
gacggtctggcggcttgaagaatttggac

SEQ ID NO: 406147 - DNA, 29 bp, Artificial Sequence
  Description of Artificial Sequence: Synthetic oligonucleotide
acggtctggcggcttgaagaatttggacg

SEQ ID NO: 406148 - DNA, 28 bp, Artificial Sequence
  Description of Artificial Sequence: Synthetic oligonucleotide
cggtctggcggcttgaagaatttggacg

SEQ ID NO: 406149 - DNA, 32 bp, Artificial Sequence; identical to SEQ ID NO: 62177
  Description of Artificial Sequence: Synthetic oligonucleotide

SEQ ID NO: 406150 - DNA, 32 bp, Artificial Sequence; identical to SEQ ID NO: 62178
  Description of Artificial Sequence: Synthetic oligonucleotide

SEQ ID NO: 406151 - DNA, 32 bp, Artificial Sequence; identical to SEQ ID NO: 62179
  Description of Artificial Sequence: Synthetic oligonucleotide

SEQ ID NO: 406152 - DNA, 31 bp, Artificial Sequence; identical to SEQ ID NO: 62180
  Description of Artificial Sequence: Synthetic oligonucleotide

SEQ ID NO: 406153 - DNA, 32 bp, Artificial Sequence; identical to SEQ ID NO: 62181
  Description of Artificial Sequence: Synthetic oligonucleotide

SEQ ID NO: 406154 - DNA, 31 bp, Artificial Sequence; identical to SEQ ID NO: 62182
  Description of Artificial Sequence: Synthetic oligonucleotide

SEQ ID NO: 406155 - DNA, 31 bp, Artificial Sequence; identical to SEQ ID NO: 62183
  Description of Artificial Sequence: Synthetic oligonucleotide

SEQ ID NO: 406156 - DNA, 34 bp, Artificial Sequence; identical to SEQ ID NO: 62184
  Description of Artificial Sequence: Synthetic oligonucleotide

SEQ ID NO: 406157 - DNA, 35 bp, Artificial Sequence; identical to SEQ ID NO: 62185
  Description of Artificial Sequence: Synthetic oligonucleotide

SEQ ID NO: 406158 - DNA, 35 bp, Artificial Sequence; identical to SEQ ID NO: 62186
  Description of Artificial Sequence: Synthetic oligonucleotide

SEQ ID NO: 406159 - DNA, 35 bp, Artificial Sequence; identical to SEQ ID NO: 62187
  Description of Artificial Sequence: Synthetic oligonucleotide

SEQ ID NO: 406160 - DNA, 36 bp, Artificial Sequence; identical to SEQ ID NO: 62188
  Description of Artificial Sequence: Synthetic oligonucleotide

SEQ ID NO: 406161 - DNA, 35 bp, Artificial Sequence; identical to SEQ ID NO: 62189
  Description of Artificial Sequence: Synthetic oligonucleotide

SEQ ID NO: 406162 - DNA, 34 bp, Artificial Sequence; identical to SEQ ID NO: 62190
  Description of Artificial Sequence: Synthetic oligonucleotide

SEQ ID NO: 406163 - DNA, 36 bp, Artificial Sequence; identical to SEQ ID NO: 62191
  Description of Artificial Sequence: Synthetic oligonucleotide

SEQ ID NO: 406164 - DNA, 35 bp, Artificial Sequence; identical to SEQ ID NO: 62192
  Description of Artificial Sequence: Synthetic oligonucleotide

SEQ ID NO: 406165 - DNA, 34 bp, Artificial Sequence; identical to SEQ ID NO: 62193
  Description of Artificial Sequence: Synthetic oligonucleotide

SEQ ID NO: 406166 - DNA, 34 bp, Artificial Sequence; identical to SEQ ID NO: 62194
  Description of Artificial Sequence: Synthetic oligonucleotide

SEQ ID NO: 406167 - DNA, 33 bp, Artificial Sequence; identical to SEQ ID NO: 62195
  Description of Artificial Sequence: Synthetic oligonucleotide

SEQ ID NO: 406168 - DNA, 32 bp, Artificial Sequence; identical to SEQ ID NO: 62196
  Description of Artificial Sequence: Synthetic oligonucleotide

SEQ ID NO: 406169 - DNA, 31 bp, Artificial Sequence; identical to SEQ ID NO: 62197
  Description of Artificial Sequence: Synthetic oligonucleotide

SEQ ID NO: 406170 - DNA, 30 bp, Artificial Sequence; identical to SEQ ID NO: 62198
  Description of Artificial Sequence: Synthetic oligonucleotide

SEQ ID NO: 406171 - DNA, 29 bp, Artificial Sequence
  Description of Artificial Sequence: Synthetic oligonucleotide
ggacgatttgccagctttgaggctcaagg

SEQ ID NO: 406172 - DNA, 30 bp, Artificial Sequence; identical to SEQ ID NO: 62200
  Description of Artificial Sequence: Synthetic oligonucleotide

SEQ ID NO: 406173 - DNA, 30 bp, Artificial Sequence; identical to SEQ ID NO: 62201
  Description of Artificial Sequence: Synthetic oligonucleotide

SEQ ID NO: 406174 - DNA, 29 bp, Artificial Sequence
  Description of Artificial Sequence: Synthetic oligonucleotide
cgatttgccagctttgaggctcaaggtgc

SEQ ID NO: 406175 - DNA, 32 bp, Artificial Sequence; identical to SEQ ID NO: 62203
  Description of Artificial Sequence: Synthetic oligonucleotide

SEQ ID NO: 406176 - DNA, 32 bp, Artificial Sequence; identical to SEQ ID NO: 62204
  Description of Artificial Sequence: Synthetic oligonucleotide

SEQ ID NO: 406177 - DNA, 31 bp, Artificial Sequence; identical to SEQ ID NO: 62205
  Description of Artificial Sequence: Synthetic oligonucleotide

SEQ ID NO: 406178 - DNA, 30 bp, Artificial Sequence; identical to SEQ ID NO: 62206
  Description of Artificial Sequence: Synthetic oligonucleotide

SEQ ID NO: 406179 - DNA, 29 bp, Artificial Sequence
  Description of Artificial Sequence: Synthetic oligonucleotide
tgccagctttgaggctcaaggtgcattgg

SEQ ID NO: 406180 - DNA, 28 bp, Artificial Sequence
  Description of Artificial Sequence: Synthetic oligonucleotide
gccagctttgaggctcaaggtgcattgg

SEQ ID NO: 406181 - DNA, 28 bp, Artificial Sequence
  Description of Artificial Sequence: Synthetic oligonucleotide
ccagctttgaggctcaaggtgcattggc

SEQ ID NO: 406182 - DNA, 28 bp, Artificial Sequence
  Description of Artificial Sequence: Synthetic oligonucleotide
cagctttgaggctcaaggtgcattggcc

SEQ ID NO: 406183 - DNA, 30 bp, Artificial Sequence; identical to SEQ ID NO: 62211
  Description of Artificial Sequence: Synthetic oligonucleotide

SEQ ID NO: 406184 - DNA, 29 bp, Artificial Sequence
  Description of Artificial Sequence: Synthetic oligonucleotide
gctttgaggctcaaggtgcattggccaac

SEQ ID NO: 406185 - DNA, 32 bp, Artificial Sequence; identical to SEQ ID NO: 62213
  Description of Artificial Sequence: Synthetic oligonucleotide

SEQ ID NO: 406186 - DNA, 32 bp, Artificial Sequence; identical to SEQ ID NO: 62214
  Description of Artificial Sequence: Synthetic oligonucleotide

SEQ ID NO: 406187 - DNA, 31 bp, Artificial Sequence; identical to SEQ ID NO: 62215
  Description of Artificial Sequence: Synthetic oligonucleotide

SEQ ID NO: 406188 - DNA, 30 bp, Artificial Sequence; identical to SEQ ID NO: 62216
  Description of Artificial Sequence: Synthetic oligonucleotide

SEQ ID NO: 406189 - DNA, 29 bp, Artificial Sequence
  Description of Artificial Sequence: Synthetic oligonucleotide
gaggctcaaggtgcattggccaacatagc

SEQ ID NO: 406190 - DNA, 30 bp, Artificial Sequence; identical to SEQ ID NO: 62218
  Description of Artificial Sequence: Synthetic oligonucleotide

SEQ ID NO: 406191 - DNA, 29 bp, Artificial Sequence
  Description of Artificial Sequence: Synthetic oligonucleotide
ggctcaaggtgcattggccaacatagctg

SEQ ID NO: 406192 - DNA, 30 bp, Artificial Sequence; identical to SEQ ID NO: 62220
  Description of Artificial Sequence: Synthetic oligonucleotide

SEQ ID NO: 406193 - DNA, 30 bp, Artificial Sequence; identical to SEQ ID NO: 62221
  Description of Artificial Sequence: Synthetic oligonucleotide

SEQ ID NO: 406194 - DNA, 31 bp, Artificial Sequence; identical to SEQ ID NO: 62222
  Description of Artificial Sequence: Synthetic oligonucleotide

SEQ ID NO: 406195 - DNA, 30 bp, Artificial Sequence; identical to SEQ ID NO: 62223
  Description of Artificial Sequence: Synthetic oligonucleotide

SEQ ID NO: 406196 - DNA, 33 bp, Artificial Sequence; identical to SEQ ID NO: 62224
  Description of Artificial Sequence: Synthetic oligonucleotide

SEQ ID NO: 406197 - DNA, 32 bp, Artificial Sequence; identical to SEQ ID NO: 62225
  Description of Artificial Sequence: Synthetic oligonucleotide

SEQ ID NO: 406198 - DNA, 31 bp, Artificial Sequence; identical to SEQ ID NO: 62226
  Description of Artificial Sequence: Synthetic oligonucleotide

SEQ ID NO: 406199 - DNA, 31 bp, Artificial Sequence; identical to SEQ ID NO: 62227
  Description of Artificial Sequence: Synthetic oligonucleotide

SEQ ID NO: 406200 - DNA, 31 bp, Artificial Sequence; identical to SEQ ID NO: 62228
  Description of Artificial Sequence: Synthetic oligonucleotide

SEQ ID NO: 406201 - DNA, 30 bp, Artificial Sequence; identical to SEQ ID NO: 62229
  Description of Artificial Sequence: Synthetic oligonucleotide

SEQ ID NO: 406202 - DNA, 32 bp, Artificial Sequence; identical to SEQ ID NO: 62230
  Description of Artificial Sequence: Synthetic oligonucleotide

SEQ ID NO: 406203 - DNA, 32 bp, Artificial Sequence; identical to SEQ ID NO: 62231
  Description of Artificial Sequence: Synthetic oligonucleotide

SEQ ID NO: 406204 - DNA, 31 bp, Artificial Sequence; identical to SEQ ID NO: 62232
  Description of Artificial Sequence: Synthetic oligonucleotide

SEQ ID NO: 406205 - DNA, 30 bp, Artificial Sequence; identical to SEQ ID NO: 62233
  Description of Artificial Sequence: Synthetic oligonucleotide

SEQ ID NO: 406206 - DNA, 29 bp, Artificial Sequence
  Description of Artificial Sequence: Synthetic oligonucleotide
ggccaacatagctgtggacaaagccaacc

SEQ ID NO: 406207 - DNA, 30 bp, Artificial Sequence; identical to SEQ ID NO: 62235
  Description of Artificial Sequence: Synthetic oligonucleotide

SEQ ID NO: 406208 - DNA, 30 bp, Artificial Sequence; identical to SEQ ID NO: 62236
  Description of Artificial Sequence: Synthetic oligonucleotide

SEQ ID NO: 406209 - DNA, 34 bp, Artificial Sequence; identical to SEQ ID NO: 62237
  Description of Artificial Sequence: Synthetic oligonucleotide

SEQ ID NO: 406210 - DNA, 36 bp, Artificial Sequence; identical to SEQ ID NO: 62238
  Description of Artificial Sequence: Synthetic oligonucleotide

SEQ ID NO: 406211 - DNA, 35 bp, Artificial Sequence; identical to SEQ ID NO: 62239
  Description of Artificial Sequence: Synthetic oligonucleotide

SEQ ID NO: 406212 - DNA, 34 bp, Artificial Sequence; identical to SEQ ID NO: 62240
  Description of Artificial Sequence: Synthetic oligonucleotide

SEQ ID NO: 406213 - DNA, 35 bp, Artificial Sequence; identical to SEQ ID NO: 62241
  Description of Artificial Sequence: Synthetic oligonucleotide

SEQ ID NO: 406214 - DNA, 34 bp, Artificial Sequence; identical to SEQ ID NO: 62242
  Description of Artificial Sequence: Synthetic oligonucleotide

SEQ ID NO: 406215 - DNA, 33 bp, Artificial Sequence; identical to SEQ ID NO: 62243
  Description of Artificial Sequence: Synthetic oligonucleotide

SEQ ID NO: 406216 - DNA, 32 bp, Artificial Sequence; identical to SEQ ID NO: 62244
  Description of Artificial Sequence: Synthetic oligonucleotide

SEQ ID NO: 406217 - DNA, 35 bp, Artificial Sequence; identical to SEQ ID NO: 62245
  Description of Artificial Sequence: Synthetic oligonucleotide

SEQ ID NO: 406218 - DNA, 35 bp, Artificial Sequence; identical to SEQ ID NO: 62246
  Description of Artificial Sequence: Synthetic oligonucleotide

SEQ ID NO: 406219 - DNA, 34 bp, Artificial Sequence; identical to SEQ ID NO: 62247
  Description of Artificial Sequence: Synthetic oligonucleotide

SEQ ID NO: 406220 - DNA, 34 bp, Artificial Sequence; identical to SEQ ID NO: 62248
  Description of Artificial Sequence: Synthetic oligonucleotide

SEQ ID NO: 406221 - DNA, 33 bp, Artificial Sequence; identical to SEQ ID NO: 62249
  Description of Artificial Sequence: Synthetic oligonucleotide

SEQ ID NO: 406222 - DNA, 33 bp, Artificial Sequence; identical to SEQ ID NO: 62250
  Description of Artificial Sequence: Synthetic oligonucleotide

SEQ ID NO: 406223 - DNA, 34 bp, Artificial Sequence; identical to SEQ ID NO: 62251
  Description of Artificial Sequence: Synthetic oligonucleotide

SEQ ID NO: 406224 - DNA, 33 bp, Artificial Sequence; identical to SEQ ID NO: 62252
  Description of Artificial Sequence: Synthetic oligonucleotide

SEQ ID NO: 406225 - DNA, 33 bp, Artificial Sequence; identical to SEQ ID NO: 62253
  Description of Artificial Sequence: Synthetic oligonucleotide

SEQ ID NO: 406226 - DNA, 32 bp, Artificial Sequence; identical to SEQ ID NO: 62254
  Description of Artificial Sequence: Synthetic oligonucleotide

SEQ ID NO: 406227 - DNA, 31 bp, Artificial Sequence; identical to SEQ ID NO: 62255
  Description of Artificial Sequence: Synthetic oligonucleotide

SEQ ID NO: 406228 - DNA, 30 bp, Artificial Sequence; identical to SEQ ID NO: 62256
  Description of Artificial Sequence: Synthetic oligonucleotide

SEQ ID NO: 406229 - DNA, 32 bp, Artificial Sequence; identical to SEQ ID NO: 62257
  Description of Artificial Sequence: Synthetic oligonucleotide

SEQ ID NO: 406230 - DNA, 36 bp, Artificial Sequence; identical to SEQ ID NO: 62258
  Description of Artificial Sequence: Synthetic oligonucleotide

SEQ ID NO: 406231 - DNA, 37 bp, Artificial Sequence; identical to SEQ ID NO: 62259
  Description of Artificial Sequence: Synthetic oligonucleotide

SEQ ID NO: 406232 - DNA, 36 bp, Artificial Sequence; identical to SEQ ID NO: 62260
  Description of Artificial Sequence: Synthetic oligonucleotide

SEQ ID NO: 406233 - DNA, 35 bp, Artificial Sequence; identical to SEQ ID NO: 62261
  Description of Artificial Sequence: Synthetic oligonucleotide

SEQ ID NO: 406234 - DNA, 35 bp, Artificial Sequence; identical to SEQ ID NO: 62262
  Description of Artificial Sequence: Synthetic oligonucleotide

SEQ ID NO: 406235 - DNA, 35 bp, Artificial Sequence; identical to SEQ ID NO: 62263
  Description of Artificial Sequence: Synthetic oligonucleotide

SEQ ID NO: 406236 - DNA, 34 bp, Artificial Sequence; identical to SEQ ID NO: 62264
  Description of Artificial Sequence: Synthetic oligonucleotide

SEQ ID NO: 406237 - DNA, 36 bp, Artificial Sequence; identical to SEQ ID NO: 62265
  Description of Artificial Sequence: Synthetic oligonucleotide

SEQ ID NO: 406238 - DNA, 37 bp, Artificial Sequence; identical to SEQ ID NO: 62266
  Description of Artificial Sequence: Synthetic oligonucleotide

SEQ ID NO: 406239 - DNA, 36 bp, Artificial Sequence; identical to SEQ ID NO: 62267
  Description of Artificial Sequence: Synthetic oligonucleotide

SEQ ID NO: 406240 - DNA, 35 bp, Artificial Sequence; identical to SEQ ID NO: 62268
  Description of Artificial Sequence: Synthetic oligonucleotide

SEQ ID NO: 406241 - DNA, 34 bp, Artificial Sequence; identical to SEQ ID NO: 62269
  Description of Artificial Sequence: Synthetic oligonucleotide

SEQ ID NO: 406242 - DNA, 33 bp, Artificial Sequence; identical to SEQ ID NO: 62270
  Description of Artificial Sequence: Synthetic oligonucleotide

SEQ ID NO: 406243 - DNA, 33 bp, Artificial Sequence; identical to SEQ ID NO: 62271
  Description of Artificial Sequence: Synthetic oligonucleotide

SEQ ID NO: 406244 - DNA, 32 bp, Artificial Sequence; identical to SEQ ID NO: 62272
  Description of Artificial Sequence: Synthetic oligonucleotide

SEQ ID NO: 406245 - DNA, 31 bp, Artificial Sequence; identical to SEQ ID NO: 62273
  Description of Artificial Sequence: Synthetic oligonucleotide

SEQ ID NO: 406246 - DNA, 34 bp, Artificial Sequence; identical to SEQ ID NO: 62274
  Description of Artificial Sequence: Synthetic oligonucleotide

SEQ ID NO: 406247 - DNA, 33 bp, Artificial Sequence; identical to SEQ ID NO: 62275
  Description of Artificial Sequence: Synthetic oligonucleotide

SEQ ID NO: 406248 - DNA, 35 bp, Artificial Sequence; identical to SEQ ID NO: 62276
  Description of Artificial Sequence: Synthetic oligonucleotide

SEQ ID NO: 406249 - DNA, 34 bp, Artificial Sequence; identical to SEQ ID NO: 62277
  Description of Artificial Sequence: Synthetic oligonucleotide

SEQ ID NO: 406250 - DNA, 33 bp, Artificial Sequence; identical to SEQ ID NO: 62278
  Description of Artificial Sequence: Synthetic oligonucleotide

SEQ ID NO: 406251 - DNA, 32 bp, Artificial Sequence; identical to SEQ ID NO: 62279
  Description of Artificial Sequence: Synthetic oligonucleotide

SEQ ID NO: 406252 - DNA, 32 bp, Artificial Sequence; identical to SEQ ID NO: 62280
  Description of Artificial Sequence: Synthetic oligonucleotide

SEQ ID NO: 406253 - DNA, 33 bp, Artificial Sequence; identical to SEQ ID NO: 62281
  Description of Artificial Sequence: Synthetic oligonucleotide

SEQ ID NO: 406254 - DNA, 33 bp, Artificial Sequence; identical to SEQ ID NO: 62282
  Description of Artificial Sequence: Synthetic oligonucleotide

SEQ ID NO: 406255 - DNA, 34 bp, Artificial Sequence; identical to SEQ ID NO: 62283
  Description of Artificial Sequence: Synthetic oligonucleotide

SEQ ID NO: 406256 - DNA, 33 bp, Artificial Sequence; identical to SEQ ID NO: 62284
  Description of Artificial Sequence: Synthetic oligonucleotide

SEQ ID NO: 406257 - DNA, 34 bp, Artificial Sequence; identical to SEQ ID NO: 62285
  Description of Artificial Sequence: Synthetic oligonucleotide

SEQ ID NO: 406258 - DNA, 34 bp, Artificial Sequence; identical to SEQ ID NO: 62286
  Description of Artificial Sequence: Synthetic oligonucleotide

SEQ ID NO: 406259 - DNA, 33 bp, Artificial Sequence; identical to SEQ ID NO: 62287
  Description of Artificial Sequence: Synthetic oligonucleotide

SEQ ID NO: 406260 - DNA, 32 bp, Artificial Sequence; identical to SEQ ID NO: 62288
  Description of Artificial Sequence: Synthetic oligonucleotide

SEQ ID NO: 406261 - DNA, 35 bp, Artificial Sequence; identical to SEQ ID NO: 62289
  Description of Artificial Sequence: Synthetic oligonucleotide

SEQ ID NO: 406262 - DNA, 34 bp, Artificial Sequence; identical to SEQ ID NO: 62290
  Description of Artificial Sequence: Synthetic oligonucleotide

SEQ ID NO: 406263 - DNA, 33 bp, Artificial Sequence; identical to SEQ ID NO: 62291
  Description of Artificial Sequence: Synthetic oligonucleotide

SEQ ID NO: 406264 - DNA, 32 bp, Artificial Sequence; identical to SEQ ID NO: 62292
  Description of Artificial Sequence: Synthetic oligonucleotide

SEQ ID NO: 406265 - DNA, 31 bp, Artificial Sequence; identical to SEQ ID NO: 62293
  Description of Artificial Sequence: Synthetic oligonucleotide

SEQ ID NO: 406266 - DNA, 32 bp, Artificial Sequence; identical to SEQ ID NO: 62294
  Description of Artificial Sequence: Synthetic oligonucleotide

SEQ ID NO: 406267 - DNA, 31 bp, Artificial Sequence; identical to SEQ ID NO: 62295
  Description of Artificial Sequence: Synthetic oligonucleotide

SEQ ID NO: 406268 - DNA, 32 bp, Artificial Sequence; identical to SEQ ID NO: 62296
  Description of Artificial Sequence: Synthetic oligonucleotide

SEQ ID NO: 406269 - DNA, 32 bp, Artificial Sequence; identical to SEQ ID NO: 62297
  Description of Artificial Sequence: Synthetic oligonucleotide

SEQ ID NO: 406270 - DNA, 33 bp, Artificial Sequence; identical to SEQ ID NO: 62298
  Description of Artificial Sequence: Synthetic oligonucleotide

SEQ ID NO: 406271 - DNA, 32 bp, Artificial Sequence; identical to SEQ ID NO: 62299
  Description of Artificial Sequence: Synthetic oligonucleotide

SEQ ID NO: 406272 - DNA, 31 bp, Artificial Sequence; identical to SEQ ID NO: 62300
  Description of Artificial Sequence: Synthetic oligonucleotide

SEQ ID NO: 406273 - DNA, 32 bp, Artificial Sequence; identical to SEQ ID NO: 62301
  Description of Artificial Sequence: Synthetic oligonucleotide

SEQ ID NO: 406274 - DNA, 31 bp, Artificial Sequence; identical to SEQ ID NO: 62302
  Description of Artificial Sequence: Synthetic oligonucleotide

SEQ ID NO: 406275 - DNA, 31 bp, Artificial Sequence; identical to SEQ ID NO: 62303
  Description of Artificial Sequence: Synthetic oligonucleotide

SEQ ID NO: 406276 - DNA, 33 bp, Artificial Sequence; identical to SEQ ID NO: 62304
  Description of Artificial Sequence: Synthetic oligonucleotide

SEQ ID NO: 406277 - DNA, 32 bp, Artificial Sequence; identical to SEQ ID NO: 62305
  Description of Artificial Sequence: Synthetic oligonucleotide

SEQ ID NO: 406278 - DNA, 31 bp, Artificial Sequence; identical to SEQ ID NO: 62306
  Description of Artificial Sequence: Synthetic oligonucleotide

SEQ ID NO: 406279 - DNA, 30 bp, Artificial Sequence; identical to SEQ ID NO: 62307
  Description of Artificial Sequence: Synthetic oligonucleotide

SEQ ID NO: 406280 - DNA, 31 bp, Artificial Sequence; identical to SEQ ID NO: 62308
  Description of Artificial Sequence: Synthetic oligonucleotide

SEQ ID NO: 406281 - DNA, 30 bp, Artificial Sequence; identical to SEQ ID NO: 62309
  Description of Artificial Sequence: Synthetic oligonucleotide

SEQ ID NO: 406282 - DNA, 29 bp, Artificial Sequence
  Description of Artificial Sequence: Synthetic oligonucleotide
cctccagaggtaactgtgctcacgaacag

SEQ ID NO: 406283 - DNA, 29 bp, Artificial Sequence
  Description of Artificial Sequence: Synthetic oligonucleotide
ctccagaggtaactgtgctcacgaacagc

SEQ ID NO: 406284 - DNA, 29 bp, Artificial Sequence
  Description of Artificial Sequence: Synthetic oligonucleotide
tccagaggtaactgtgctcacgaacagcc

SEQ ID NO: 406285 - DNA, 28 bp, Artificial Sequence
  Description of Artificial Sequence: Synthetic oligonucleotide
ccagaggtaactgtgctcacgaacagcc

SEQ ID NO: 406286 - DNA, 28 bp, Artificial Sequence
  Description of Artificial Sequence: Synthetic oligonucleotide
cagaggtaactgtgctcacgaacagccc

SEQ ID NO: 406287 - DNA, 29 bp, Artificial Sequence
  Description of Artificial Sequence: Synthetic oligonucleotide
agaggtaactgtgctcacgaacagccctg

SEQ ID NO: 406288 - DNA, 28 bp, Artificial Sequence
  Description of Artificial Sequence: Synthetic oligonucleotide
gaggtaactgtgctcacgaacagccctg

SEQ ID NO: 406289 - DNA, 29 bp, Artificial Sequence
  Description of Artificial Sequence: Synthetic oligonucleotide
aggtaactgtgctcacgaacagccctgtg

SEQ ID NO: 406290 - DNA, 28 bp, Artificial Sequence
  Description of Artificial Sequence: Synthetic oligonucleotide
ggtaactgtgctcacgaacagccctgtg

SEQ ID NO: 406291 - DNA, 28 bp, Artificial Sequence
  Description of Artificial Sequence: Synthetic oligonucleotide
gtaactgtgctcacgaacagccctgtgg

SEQ ID NO: 406292 - DNA, 30 bp, Artificial Sequence; identical to SEQ ID NO: 62320
  Description of Artificial Sequence: Synthetic oligonucleotide

SEQ ID NO: 406293 - DNA, 29 bp, Artificial Sequence
  Description of Artificial Sequence: Synthetic oligonucleotide
aactgtgctcacgaacagccctgtggaac

SEQ ID NO: 406294 - DNA, 28 bp, Artificial Sequence
  Description of Artificial Sequence: Synthetic oligonucleotide
actgtgctcacgaacagccctgtggaac

SEQ ID NO: 406295 - DNA, 27 bp, Artificial Sequence
  Description of Artificial Sequence: Synthetic oligonucleotide
ctgtgctcacgaacagccctgtggaac

SEQ ID NO: 406296 - DNA, 28 bp, Artificial Sequence
  Description of Artificial Sequence: Synthetic oligonucleotide
tgtgctcacgaacagccctgtggaactg

SEQ ID NO: 406297 - DNA, 27 bp, Artificial Sequence
  Description of Artificial Sequence: Synthetic oligonucleotide
gtgctcacgaacagccctgtggaactg

SEQ ID NO: 406298 - DNA, 28 bp, Artificial Sequence
  Description of Artificial Sequence: Synthetic oligonucleotide
tgctcacgaacagccctgtggaactgag

SEQ ID NO: 406299 - DNA, 27 bp, Artificial Sequence
  Description of Artificial Sequence: Synthetic oligonucleotide
gctcacgaacagccctgtggaactgag

SEQ ID NO: 406300 - DNA, 28 bp, Artificial Sequence
  Description of Artificial Sequence: Synthetic oligonucleotide
ctcacgaacagccctgtggaactgagag

SEQ ID NO: 406301 - DNA, 29 bp, Artificial Sequence
  Description of Artificial Sequence: Synthetic oligonucleotide
tcacgaacagccctgtggaactgagagag

SEQ ID NO: 406302 - DNA, 28 bp, Artificial Sequence
  Description of Artificial Sequence: Synthetic oligonucleotide
cacgaacagccctgtggaactgagagag

SEQ ID NO: 406303 - DNA, 28 bp, Artificial Sequence
  Description of Artificial Sequence: Synthetic oligonucleotide
acgaacagccctgtggaactgagagagc

SEQ ID NO: 406304 - DNA, 27 bp, Artificial Sequence
  Description of Artificial Sequence: Synthetic oligonucleotide
cgaacagccctgtggaactgagagagc

SEQ ID NO: 406305 - DNA, 27 bp, Artificial Sequence
  Description of Artificial Sequence: Synthetic oligonucleotide
gaacagccctgtggaactgagagagcc

SEQ ID NO: 406306 - DNA, 27 bp, Artificial Sequence
  Description of Artificial Sequence: Synthetic oligonucleotide
aacagccctgtggaactgagagagccc

SEQ ID NO: 406307 - DNA, 27 bp, Artificial Sequence
  Description of Artificial Sequence: Synthetic oligonucleotide
acagccctgtggaactgagagagccca

SEQ ID NO: 406308 - DNA, 27 bp, Artificial Sequence
  Description of Artificial Sequence: Synthetic oligonucleotide
cagccctgtggaactgagagagcccaa

SEQ ID NO: 406309 - DNA, 27 bp, Artificial Sequence
  Description of Artificial Sequence: Synthetic oligonucleotide
agccctgtggaactgagagagcccaac

SEQ ID NO: 406310 - DNA, 26 bp, Artificial Sequence
  Description of Artificial Sequence: Synthetic oligonucleotide
gccctgtggaactgagagagcccaac

SEQ ID NO: 406311 - DNA, 27 bp, Artificial Sequence
  Description of Artificial Sequence: Synthetic oligonucleotide
ccctgtggaactgagagagcccaacgt

SEQ ID NO: 406312 - DNA, 27 bp, Artificial Sequence
  Description of Artificial Sequence: Synthetic oligonucleotide
cctgtggaactgagagagcccaacgtc

SEQ ID NO: 406313 - DNA, 27 bp, Artificial Sequence
  Description of Artificial Sequence: Synthetic oligonucleotide
ctgtggaactgagagagcccaacgtcc

SEQ ID NO: 406314 - DNA, 28 bp, Artificial Sequence
  Description of Artificial Sequence: Synthetic oligonucleotide
tgtggaactgagagagcccaacgtcctc

SEQ ID NO: 406315 - DNA, 27 bp, Artificial Sequence
  Description of Artificial Sequence: Synthetic oligonucleotide
gtggaactgagagagcccaacgtcctc

SEQ ID NO: 406316 - DNA, 29 bp, Artificial Sequence
  Description of Artificial Sequence: Synthetic oligonucleotide
tggaactgagagagcccaacgtcctcatc

SEQ ID NO: 406317 - DNA, 28 bp, Artificial Sequence
  Description of Artificial Sequence: Synthetic oligonucleotide
ggaactgagagagcccaacgtcctcatc

SEQ ID NO: 406318 - DNA, 29 bp, Artificial Sequence
  Description of Artificial Sequence: Synthetic oligonucleotide
gaactgagagagcccaacgtcctcatctg

SEQ ID NO: 406319 - DNA, 32 bp, Artificial Sequence; identical to SEQ ID NO: 62347
  Description of Artificial Sequence: Synthetic oligonucleotide

SEQ ID NO: 406320 - DNA, 31 bp, Artificial Sequence; identical to SEQ ID NO: 62348
  Description of Artificial Sequence: Synthetic oligonucleotide

SEQ ID NO: 406321 - DNA, 30 bp, Artificial Sequence; identical to SEQ ID NO: 62349
  Description of Artificial Sequence: Synthetic oligonucleotide

SEQ ID NO: 406322 - DNA, 32 bp, Artificial Sequence; identical to SEQ ID NO: 62350
  Description of Artificial Sequence: Synthetic oligonucleotide

SEQ ID NO: 406323 - DNA, 31 bp, Artificial Sequence; identical to SEQ ID NO: 62351
  Description of Artificial Sequence: Synthetic oligonucleotide

SEQ ID NO: 406324 - DNA, 31 bp, Artificial Sequence; identical to SEQ ID NO: 62352
  Description of Artificial Sequence: Synthetic oligonucleotide

SEQ ID NO: 406325 - DNA, 30 bp, Artificial Sequence; identical to SEQ ID NO: 62353
  Description of Artificial Sequence: Synthetic oligonucleotide

SEQ ID NO: 406326 - DNA, 31 bp, Artificial Sequence; identical to SEQ ID NO: 62354
  Description of Artificial Sequence: Synthetic oligonucleotide

SEQ ID NO: 406327 - DNA, 30 bp, Artificial Sequence; identical to SEQ ID NO: 62355
  Description of Artificial Sequence: Synthetic oligonucleotide

SEQ ID NO: 406328 - DNA, 32 bp, Artificial Sequence; identical to SEQ ID NO: 62356
  Description of Artificial Sequence: Synthetic oligonucleotide

SEQ ID NO: 406329 - DNA, 31 bp, Artificial Sequence; identical to SEQ ID NO: 62357
  Description of Artificial Sequence: Synthetic oligonucleotide

SEQ ID NO: 406330 - DNA, 33 bp, Artificial Sequence; identical to SEQ ID NO: 62358
  Description of Artificial Sequence: Synthetic oligonucleotide

SEQ ID NO: 406331 - DNA, 34 bp, Artificial Sequence; identical to SEQ ID NO: 62359
  Description of Artificial Sequence: Synthetic oligonucleotide

SEQ ID NO: 406332 - DNA, 34 bp, Artificial Sequence; identical to SEQ ID NO: 62360
  Description of Artificial Sequence: Synthetic oligonucleotide

SEQ ID NO: 406333 - DNA, 34 bp, Artificial Sequence; identical to SEQ ID NO: 62361
  Description of Artificial Sequence: Synthetic oligonucleotide

SEQ ID NO: 406334 - DNA, 33 bp, Artificial Sequence; identical to SEQ ID NO: 62362
  Description of Artificial Sequence: Synthetic oligonucleotide

SEQ ID NO: 406335 - DNA, 32 bp, Artificial Sequence; identical to SEQ ID NO: 62363
  Description of Artificial Sequence: Synthetic oligonucleotide

SEQ ID NO: 406336 - DNA, 32 bp, Artificial Sequence; identical to SEQ ID NO: 62364
  Description of Artificial Sequence: Synthetic oligonucleotide

SEQ ID NO: 406337 - DNA, 33 bp, Artificial Sequence; identical to SEQ ID NO: 62365
  Description of Artificial Sequence: Synthetic oligonucleotide

SEQ ID NO: 406338 - DNA, 32 bp, Artificial Sequence; identical to SEQ ID NO: 62366
  Description of Artificial Sequence: Synthetic oligonucleotide

SEQ ID NO: 406339 - DNA, 32 bp, Artificial Sequence; identical to SEQ ID NO: 62367
  Description of Artificial Sequence: Synthetic oligonucleotide

SEQ ID NO: 406340 - DNA, 33 bp, Artificial Sequence; identical to SEQ ID NO: 62368
  Description of Artificial Sequence: Synthetic oligonucleotide

SEQ ID NO: 406341 - DNA, 32 bp, Artificial Sequence; identical to SEQ ID NO: 62369
  Description of Artificial Sequence: Synthetic oligonucleotide

SEQ ID NO: 406342 - DNA, 33 bp, Artificial Sequence; identical to SEQ ID NO: 62370
  Description of Artificial Sequence: Synthetic oligonucleotide

SEQ ID NO: 406343 - DNA, 32 bp, Artificial Sequence; identical to SEQ ID NO: 62371
  Description of Artificial Sequence: Synthetic oligonucleotide

SEQ ID NO: 406344 - DNA, 31 bp, Artificial Sequence; identical to SEQ ID NO: 62372
  Description of Artificial Sequence: Synthetic oligonucleotide

SEQ ID NO: 406345 - DNA, 31 bp, Artificial Sequence; identical to SEQ ID NO: 62373
  Description of Artificial Sequence: Synthetic oligonucleotide

SEQ ID NO: 406346 - DNA, 30 bp, Artificial Sequence; identical to SEQ ID NO: 62374
  Description of Artificial Sequence: Synthetic oligonucleotide

SEQ ID NO: 406347 - DNA, 31 bp, Artificial Sequence; identical to SEQ ID NO: 62375
  Description of Artificial Sequence: Synthetic oligonucleotide

SEQ ID NO: 406348 - DNA, 30 bp, Artificial Sequence; identical to SEQ ID NO: 62376
  Description of Artificial Sequence: Synthetic oligonucleotide

SEQ ID NO: 406349 - DNA, 29 bp, Artificial Sequence
  Description of Artificial Sequence: Synthetic oligonucleotide
tcatcgacaagttcaccccaccagtggtc

SEQ ID NO: 406350 - DNA, 28 bp, Artificial Sequence
  Description of Artificial Sequence: Synthetic oligonucleotide
catcgacaagttcaccccaccagtggtc

SEQ ID NO: 406351 - DNA, 31 bp, Artificial Sequence; identical to SEQ ID NO: 62379
  Description of Artificial Sequence: Synthetic oligonucleotide

SEQ ID NO: 406352 - DNA, 30 bp, Artificial Sequence; identical to SEQ ID NO: 62380
  Description of Artificial Sequence: Synthetic oligonucleotide

SEQ ID NO: 406353 - DNA, 29 bp, Artificial Sequence
  Description of Artificial Sequence: Synthetic oligonucleotide
cgacaagttcaccccaccagtggtcaatg

SEQ ID NO: 406354 - DNA, 30 bp, Artificial Sequence; identical to SEQ ID NO: 62382
  Description of Artificial Sequence: Synthetic oligonucleotide

SEQ ID NO: 406355 - DNA, 31 bp, Artificial Sequence; identical to SEQ ID NO: 62383
  Description of Artificial Sequence: Synthetic oligonucleotide

SEQ ID NO: 406356 - DNA, 30 bp, Artificial Sequence; identical to SEQ ID NO: 62384
  Description of Artificial Sequence: Synthetic oligonucleotide

SEQ ID NO: 406357 - DNA, 30 bp, Artificial Sequence; identical to SEQ ID NO: 62385
  Description of Artificial Sequence: Synthetic oligonucleotide

SEQ ID NO: 406358 - DNA, 29 bp, Artificial Sequence
  Description of Artificial Sequence: Synthetic oligonucleotide
agttcaccccaccagtggtcaatgtcacg

SEQ ID NO: 406359 - DNA, 28 bp, Artificial Sequence
  Description of Artificial Sequence: Synthetic oligonucleotide
gttcaccccaccagtggtcaatgtcacg

SEQ ID NO: 406360 - DNA, 29 bp, Artificial Sequence
  Description of Artificial Sequence: Synthetic oligonucleotide
ttcaccccaccagtggtcaatgtcacgtg

SEQ ID NO: 406361 - DNA, 28 bp, Artificial Sequence
  Description of Artificial Sequence: Synthetic oligonucleotide
tcaccccaccagtggtcaatgtcacgtg

SEQ ID NO: 406362 - DNA, 27 bp, Artificial Sequence
  Description of Artificial Sequence: Synthetic oligonucleotide
caccccaccagtggtcaatgtcacgtg

SEQ ID NO: 406363 - DNA, 27 bp, Artificial Sequence
  Description of Artificial Sequence: Synthetic oligonucleotide
accccaccagtggtcaatgtcacgtgg

SEQ ID NO: 406364 - DNA, 26 bp, Artificial Sequence
  Description of Artificial Sequence: Synthetic oligonucleotide
ccccaccagtggtcaatgtcacgtgg

SEQ ID NO: 406365 - DNA, 27 bp, Artificial Sequence
  Description of Artificial Sequence: Synthetic oligonucleotide
cccaccagtggtcaatgtcacgtggct

SEQ ID NO: 406366 - DNA, 28 bp, Artificial Sequence
  Description of Artificial Sequence: Synthetic oligonucleotide
ccaccagtggtcaatgtcacgtggcttc

SEQ ID NO: 406367 - DNA, 28 bp, Artificial Sequence
  Description of Artificial Sequence: Synthetic oligonucleotide
caccagtggtcaatgtcacgtggcttcg

SEQ ID NO: 406368 - DNA, 32 bp, Artificial Sequence; identical to SEQ ID NO: 62396
  Description of Artificial Sequence: Synthetic oligonucleotide

SEQ ID NO: 406369 - DNA, 31 bp, Artificial Sequence; identical to SEQ ID NO: 62397
  Description of Artificial Sequence: Synthetic oligonucleotide

SEQ ID NO: 406370 - DNA, 31 bp, Artificial Sequence; identical to SEQ ID NO: 62398
  Description of Artificial Sequence: Synthetic oligonucleotide

SEQ ID NO: 406371 - DNA, 35 bp, Artificial Sequence; identical to SEQ ID NO: 62399
  Description of Artificial Sequence: Synthetic oligonucleotide

SEQ ID NO: 406372 - DNA, 34 bp, Artificial Sequence; identical to SEQ ID NO: 62400
  Description of Artificial Sequence: Synthetic oligonucleotide

SEQ ID NO: 406373 - DNA, 34 bp, Artificial Sequence; identical to SEQ ID NO: 62401
  Description of Artificial Sequence: Synthetic oligonucleotide

SEQ ID NO: 406374 - DNA, 33 bp, Artificial Sequence; identical to SEQ ID NO: 62402
  Description of Artificial Sequence: Synthetic oligonucleotide

SEQ ID NO: 406375 - DNA, 34 bp, Artificial Sequence; identical to SEQ ID NO: 62403
  Description of Artificial Sequence: Synthetic oligonucleotide

SEQ ID NO: 406376 - DNA, 35 bp, Artificial Sequence; identical to SEQ ID NO: 62404
  Description of Artificial Sequence: Synthetic oligonucleotide

SEQ ID NO: 406377 - DNA, 34 bp, Artificial Sequence; identical to SEQ ID NO: 62405
  Description of Artificial Sequence: Synthetic oligonucleotide

SEQ ID NO: 406378 - DNA, 35 bp, Artificial Sequence; identical to SEQ ID NO: 62406
  Description of Artificial Sequence: Synthetic oligonucleotide

SEQ ID NO: 406379 - DNA, 34 bp, Artificial Sequence; identical to SEQ ID NO: 62407
  Description of Artificial Sequence: Synthetic oligonucleotide

SEQ ID NO: 406380 - DNA, 33 bp, Artificial Sequence; identical to SEQ ID NO: 62408
  Description of Artificial Sequence: Synthetic oligonucleotide

SEQ ID NO: 406381 - DNA, 32 bp, Artificial Sequence; identical to SEQ ID NO: 62409
  Description of Artificial Sequence: Synthetic oligonucleotide

SEQ ID NO: 406382 - DNA, 32 bp, Artificial Sequence; identical to SEQ ID NO: 62410
  Description of Artificial Sequence: Synthetic oligonucleotide

SEQ ID NO: 406383 - DNA, 31 bp, Artificial Sequence; identical to SEQ ID NO: 62411
  Description of Artificial Sequence: Synthetic oligonucleotide

SEQ ID NO: 406384 - DNA, 32 bp, Artificial Sequence; identical to SEQ ID NO: 62412
  Description of Artificial Sequence: Synthetic oligonucleotide

SEQ ID NO: 406385 - DNA, 31 bp, Artificial Sequence; identical to SEQ ID NO: 62413
  Description of Artificial Sequence: Synthetic oligonucleotide

SEQ ID NO: 406386 - DNA, 32 bp, Artificial Sequence; identical to SEQ ID NO: 62414
  Description of Artificial Sequence: Synthetic oligonucleotide

SEQ ID NO: 406387 - DNA, 32 bp, Artificial Sequence; identical to SEQ ID NO: 62415
  Description of Artificial Sequence: Synthetic oligonucleotide

SEQ ID NO: 406388 - DNA, 31 bp, Artificial Sequence; identical to SEQ ID NO: 62416
  Description of Artificial Sequence: Synthetic oligonucleotide

SEQ ID NO: 406389 - DNA, 32 bp, Artificial Sequence; identical to SEQ ID NO: 62417
  Description of Artificial Sequence: Synthetic oligonucleotide

SEQ ID NO: 406390 - DNA, 33 bp, Artificial Sequence; identical to SEQ ID NO: 62418
  Description of Artificial Sequence: Synthetic oligonucleotide

SEQ ID NO: 406391 - DNA, 34 bp, Artificial Sequence; identical to SEQ ID NO: 62419
  Description of Artificial Sequence: Synthetic oligonucleotide

SEQ ID NO: 406392 - DNA, 33 bp, Artificial Sequence; identical to SEQ ID NO: 62420
  Description of Artificial Sequence: Synthetic oligonucleotide

SEQ ID NO: 406393 - DNA, 32 bp, Artificial Sequence; identical to SEQ ID NO: 62421
  Description of Artificial Sequence: Synthetic oligonucleotide

SEQ ID NO: 406394 - DNA, 33 bp, Artificial Sequence; identical to SEQ ID NO: 62422
  Description of Artificial Sequence: Synthetic oligonucleotide

SEQ ID NO: 406395 - DNA, 34 bp, Artificial Sequence; identical to SEQ ID NO: 62423
  Description of Artificial Sequence: Synthetic oligonucleotide

SEQ ID NO: 406396 - DNA, 33 bp, Artificial Sequence; identical to SEQ ID NO: 62424
  Description of Artificial Sequence: Synthetic oligonucleotide

SEQ ID NO: 406397 - DNA, 32 bp, Artificial Sequence; identical to SEQ ID NO: 62425
  Description of Artificial Sequence: Synthetic oligonucleotide

SEQ ID NO: 406398 - DNA, 31 bp, Artificial Sequence; identical to SEQ ID NO: 62426
  Description of Artificial Sequence: Synthetic oligonucleotide

SEQ ID NO: 406399 - DNA, 30 bp, Artificial Sequence; identical to SEQ ID NO: 62427
  Description of Artificial Sequence: Synthetic oligonucleotide

SEQ ID NO: 406400 - DNA, 31 bp, Artificial Sequence; identical to SEQ ID NO: 62428
  Description of Artificial Sequence: Synthetic oligonucleotide

SEQ ID NO: 406401 - DNA, 32 bp, Artificial Sequence; identical to SEQ ID NO: 62429
  Description of Artificial Sequence: Synthetic oligonucleotide

SEQ ID NO: 406402 - DNA, 31 bp, Artificial Sequence; identical to SEQ ID NO: 62430
  Description of Artificial Sequence: Synthetic oligonucleotide

SEQ ID NO: 406403 - DNA, 30 bp, Artificial Sequence; identical to SEQ ID NO: 62431
  Description of Artificial Sequence: Synthetic oligonucleotide

SEQ ID NO: 406404 - DNA, 29 bp, Artificial Sequence
  Description of Artificial Sequence: Synthetic oligonucleotide
acctgtcaccacaggagtgtcagagacag

SEQ ID NO: 406405 - DNA, 28 bp, Artificial Sequence
  Description of Artificial Sequence: Synthetic oligonucleotide
cctgtcaccacaggagtgtcagagacag

SEQ ID NO: 406406 - DNA, 29 bp, Artificial Sequence
  Description of Artificial Sequence: Synthetic oligonucleotide
ctgtcaccacaggagtgtcagagacagtc

SEQ ID NO: 406407 - DNA, 31 bp, Artificial Sequence; identical to SEQ ID NO: 62435
  Description of Artificial Sequence: Synthetic oligonucleotide

SEQ ID NO: 406408 - DNA, 30 bp, Artificial Sequence; identical to SEQ ID NO: 62436
  Description of Artificial Sequence: Synthetic oligonucleotide

SEQ ID NO: 406409 - DNA, 30 bp, Artificial Sequence; identical to SEQ ID NO: 62437
  Description of Artificial Sequence: Synthetic oligonucleotide

SEQ ID NO: 406410 - DNA, 29 bp, Artificial Sequence
  Description of Artificial Sequence: Synthetic oligonucleotide
caccacaggagtgtcagagacagtcttcc

SEQ ID NO: 406411 - DNA, 30 bp, Artificial Sequence; identical to SEQ ID NO: 62439
  Description of Artificial Sequence: Synthetic oligonucleotide

SEQ ID NO: 406412 - DNA, 29 bp, Artificial Sequence
  Description of Artificial Sequence: Synthetic oligonucleotide
ccacaggagtgtcagagacagtcttcctg

SEQ ID NO: 406413 - DNA, 29 bp, Artificial Sequence
  Description of Artificial Sequence: Synthetic oligonucleotide
cacaggagtgtcagagacagtcttcctgc

SEQ ID NO: 406414 - DNA, 29 bp, Artificial Sequence
  Description of Artificial Sequence: Synthetic oligonucleotide
acaggagtgtcagagacagtcttcctgcc

SEQ ID NO: 406415 - DNA, 28 bp, Artificial Sequence
  Description of Artificial Sequence: Synthetic oligonucleotide
caggagtgtcagagacagtcttcctgcc

SEQ ID NO: 406416 - DNA, 28 bp, Artificial Sequence
  Description of Artificial Sequence: Synthetic oligonucleotide
aggagtgtcagagacagtcttcctgccc

SEQ ID NO: 406417 - DNA, 27 bp, Artificial Sequence
  Description of Artificial Sequence: Synthetic oligonucleotide
ggagtgtcagagacagtcttcctgccc

SEQ ID NO: 406418 - DNA, 28 bp, Artificial Sequence
  Description of Artificial Sequence: Synthetic oligonucleotide
gagtgtcagagacagtcttcctgcccag

SEQ ID NO: 406419 - DNA, 28 bp, Artificial Sequence
  Description of Artificial Sequence: Synthetic oligonucleotide
agtgtcagagacagtcttcctgcccagg

SEQ ID NO: 406420 - DNA, 27 bp, Artificial Sequence
  Description of Artificial Sequence: Synthetic oligonucleotide
gtgtcagagacagtcttcctgcccagg

SEQ ID NO: 406421 - DNA, 27 bp, Artificial Sequence
  Description of Artificial Sequence: Synthetic oligonucleotide
tgtcagagacagtcttcctgcccaggg

SEQ ID NO: 406422 - DNA, 27 bp, Artificial Sequence
  Description of Artificial Sequence: Synthetic oligonucleotide
gtcagagacagtcttcctgcccaggga

SEQ ID NO: 406423 - DNA, 28 bp, Artificial Sequence
  Description of Artificial Sequence: Synthetic oligonucleotide
tcagagacagtcttcctgcccagggaag

SEQ ID NO: 406424 - DNA, 27 bp, Artificial Sequence
  Description of Artificial Sequence: Synthetic oligonucleotide
cagagacagtcttcctgcccagggaag

SEQ ID NO: 406425 - DNA, 28 bp, Artificial Sequence
  Description of Artificial Sequence: Synthetic oligonucleotide
agagacagtcttcctgcccagggaagac

SEQ ID NO: 406426 - DNA, 27 bp, Artificial Sequence
  Description of Artificial Sequence: Synthetic oligonucleotide
gagacagtcttcctgcccagggaagac

SEQ ID NO: 406427 - DNA, 27 bp, Artificial Sequence
  Description of Artificial Sequence: Synthetic oligonucleotide
agacagtcttcctgcccagggaagacc

SEQ ID NO: 406428 - DNA, 27 bp, Artificial Sequence
  Description of Artificial Sequence: Synthetic oligonucleotide
gacagtcttcctgcccagggaagacca

SEQ ID NO: 406429 - DNA, 27 bp, Artificial Sequence
  Description of Artificial Sequence: Synthetic oligonucleotide
acagtcttcctgcccagggaagaccac

SEQ ID NO: 406430 - DNA, 26 bp, Artificial Sequence
  Description of Artificial Sequence: Synthetic oligonucleotide
cagtcttcctgcccagggaagaccac

SEQ ID NO: 406431 - DNA, 27 bp, Artificial Sequence
  Description of Artificial Sequence: Synthetic oligonucleotide
agtcttcctgcccagggaagaccacct

SEQ ID NO: 406432 - DNA, 27 bp, Artificial Sequence
  Description of Artificial Sequence: Synthetic oligonucleotide
gtcttcctgcccagggaagaccacctt

SEQ ID NO: 406433 - DNA, 29 bp, Artificial Sequence
  Description of Artificial Sequence: Synthetic oligonucleotide
tcttcctgcccagggaagaccaccttttc

SEQ ID NO: 406434 - DNA, 28 bp, Artificial Sequence
  Description of Artificial Sequence: Synthetic oligonucleotide
cttcctgcccagggaagaccaccttttc

SEQ ID NO: 406435 - DNA, 28 bp, Artificial Sequence
  Description of Artificial Sequence: Synthetic oligonucleotide
ttcctgcccagggaagaccaccttttcc

SEQ ID NO: 406436 - DNA, 27 bp, Artificial Sequence
  Description of Artificial Sequence: Synthetic oligonucleotide
tcctgcccagggaagaccaccttttcc

SEQ ID NO: 406437 - DNA, 26 bp, Artificial Sequence
  Description of Artificial Sequence: Synthetic oligonucleotide
cctgcccagggaagaccaccttttcc

SEQ ID NO: 406438 - DNA, 26 bp, Artificial Sequence
  Description of Artificial Sequence: Synthetic oligonucleotide
ctgcccagggaagaccaccttttccg

SEQ ID NO: 406439 - DNA, 27 bp, Artificial Sequence
  Description of Artificial Sequence: Synthetic oligonucleotide
tgcccagggaagaccaccttttccgca

SEQ ID NO: 406440 - DNA, 27 bp, Artificial Sequence
  Description of Artificial Sequence: Synthetic oligonucleotide
gcccagggaagaccaccttttccgcaa

SEQ ID NO: 406441 - DNA, 27 bp, Artificial Sequence
  Description of Artificial Sequence: Synthetic oligonucleotide
cccagggaagaccaccttttccgcaag

SEQ ID NO: 406442 - DNA, 29 bp, Artificial Sequence
  Description of Artificial Sequence: Synthetic oligonucleotide
ccagggaagaccaccttttccgcaagttc

SEQ ID NO: 406443 - DNA, 29 bp, Artificial Sequence
  Description of Artificial Sequence: Synthetic oligonucleotide
cagggaagaccaccttttccgcaagttcc

SEQ ID NO: 406444 - DNA, 30 bp, Artificial Sequence; identical to SEQ ID NO: 62472
  Description of Artificial Sequence: Synthetic oligonucleotide

SEQ ID NO: 406445 - DNA, 29 bp, Artificial Sequence
  Description of Artificial Sequence: Synthetic oligonucleotide
gggaagaccaccttttccgcaagttccac

SEQ ID NO: 406446 - DNA, 32 bp, Artificial Sequence; identical to SEQ ID NO: 62474
  Description of Artificial Sequence: Synthetic oligonucleotide

SEQ ID NO: 406447 - DNA, 33 bp, Artificial Sequence; identical to SEQ ID NO: 62475
  Description of Artificial Sequence: Synthetic oligonucleotide

SEQ ID NO: 406448 - DNA, 33 bp, Artificial Sequence; identical to SEQ ID NO: 62476
  Description of Artificial Sequence: Synthetic oligonucleotide

SEQ ID NO: 406449 - DNA, 32 bp, Artificial Sequence; identical to SEQ ID NO: 62477
  Description of Artificial Sequence: Synthetic oligonucleotide

SEQ ID NO: 406450 - DNA, 31 bp, Artificial Sequence; identical to SEQ ID NO: 62478
  Description of Artificial Sequence: Synthetic oligonucleotide

SEQ ID NO: 406451 - DNA, 31 bp, Artificial Sequence; identical to SEQ ID NO: 62479
  Description of Artificial Sequence: Synthetic oligonucleotide

SEQ ID NO: 406452 - DNA, 30 bp, Artificial Sequence; identical to SEQ ID NO: 62480
  Description of Artificial Sequence: Synthetic oligonucleotide

SEQ ID NO: 406453 - DNA, 30 bp, Artificial Sequence; identical to SEQ ID NO: 62481
  Description of Artificial Sequence: Synthetic oligonucleotide

SEQ ID NO: 406454 - DNA, 32 bp, Artificial Sequence; identical to SEQ ID NO: 62482
  Description of Artificial Sequence: Synthetic oligonucleotide

SEQ ID NO: 406455 - DNA, 31 bp, Artificial Sequence; identical to SEQ ID NO: 62483
  Description of Artificial Sequence: Synthetic oligonucleotide

SEQ ID NO: 406456 - DNA, 31 bp, Artificial Sequence; identical to SEQ ID NO: 62484
  Description of Artificial Sequence: Synthetic oligonucleotide

SEQ ID NO: 406457 - DNA, 32 bp, Artificial Sequence; identical to SEQ ID NO: 62485
  Description of Artificial Sequence: Synthetic oligonucleotide

SEQ ID NO: 406458 - DNA, 31 bp, Artificial Sequence; identical to SEQ ID NO: 62486
  Description of Artificial Sequence: Synthetic oligonucleotide

SEQ ID NO: 406459 - DNA, 30 bp, Artificial Sequence; identical to SEQ ID NO: 62487
  Description of Artificial Sequence: Synthetic oligonucleotide

SEQ ID NO: 406460 - DNA, 29 bp, Artificial Sequence
  Description of Artificial Sequence: Synthetic oligonucleotide
tccgcaagttccactatctccccttcctg

SEQ ID NO: 406461 - DNA, 28 bp, Artificial Sequence
  Description of Artificial Sequence: Synthetic oligonucleotide
ccgcaagttccactatctccccttcctg

SEQ ID NO: 406462 - DNA, 28 bp, Artificial Sequence
  Description of Artificial Sequence: Synthetic oligonucleotide
cgcaagttccactatctccccttcctgc

SEQ ID NO: 406463 - DNA, 28 bp, Artificial Sequence
  Description of Artificial Sequence: Synthetic oligonucleotide
gcaagttccactatctccccttcctgcc

SEQ ID NO: 406464 - DNA, 28 bp, Artificial Sequence
  Description of Artificial Sequence: Synthetic oligonucleotide
caagttccactatctccccttcctgccc

SEQ ID NO: 406465 - DNA, 29 bp, Artificial Sequence
  Description of Artificial Sequence: Synthetic oligonucleotide
aagttccactatctccccttcctgccctc

SEQ ID NO: 406466 - DNA, 28 bp, Artificial Sequence
  Description of Artificial Sequence: Synthetic oligonucleotide
agttccactatctccccttcctgccctc

SEQ ID NO: 406467 - DNA, 27 bp, Artificial Sequence
  Description of Artificial Sequence: Synthetic oligonucleotide
gttccactatctccccttcctgccctc

SEQ ID NO: 406468 - DNA, 29 bp, Artificial Sequence
  Description of Artificial Sequence: Synthetic oligonucleotide
ttccactatctccccttcctgccctcaac

SEQ ID NO: 406469 - DNA, 28 bp, Artificial Sequence
  Description of Artificial Sequence: Synthetic oligonucleotide
tccactatctccccttcctgccctcaac

SEQ ID NO: 406470 - DNA, 27 bp, Artificial Sequence
  Description of Artificial Sequence: Synthetic oligonucleotide
ccactatctccccttcctgccctcaac

SEQ ID NO: 406471 - DNA, 28 bp, Artificial Sequence
  Description of Artificial Sequence: Synthetic oligonucleotide
cactatctccccttcctgccctcaactg

SEQ ID NO: 406472 - DNA, 29 bp, Artificial Sequence
  Description of Artificial Sequence: Synthetic oligonucleotide
actatctccccttcctgccctcaactgag

SEQ ID NO: 406473 - DNA, 28 bp, Artificial Sequence
  Description of Artificial Sequence: Synthetic oligonucleotide
ctatctccccttcctgccctcaactgag

SEQ ID NO: 406474 - DNA, 28 bp, Artificial Sequence
  Description of Artificial Sequence: Synthetic oligonucleotide
tatctccccttcctgccctcaactgagg

SEQ ID NO: 406475 - DNA, 27 bp, Artificial Sequence
  Description of Artificial Sequence: Synthetic oligonucleotide
atctccccttcctgccctcaactgagg

SEQ ID NO: 406476 - DNA, 27 bp, Artificial Sequence
  Description of Artificial Sequence: Synthetic oligonucleotide
tctccccttcctgccctcaactgagga

SEQ ID NO: 406477 - DNA, 26 bp, Artificial Sequence
  Description of Artificial Sequence: Synthetic oligonucleotide
ctccccttcctgccctcaactgagga

SEQ ID NO: 406478 - DNA, 26 bp, Artificial Sequence
  Description of Artificial Sequence: Synthetic oligonucleotide
tccccttcctgccctcaactgaggac

SEQ ID NO: 406479 - DNA, 25 bp, Artificial Sequence
  Description of Artificial Sequence: Synthetic oligonucleotide
ccccttcctgccctcaactgaggac

SEQ ID NO: 406480 - DNA, 27 bp, Artificial Sequence
  Description of Artificial Sequence: Synthetic oligonucleotide
cccttcctgccctcaactgaggacgtt

SEQ ID NO: 406481 - DNA, 29 bp, Artificial Sequence
  Description of Artificial Sequence: Synthetic oligonucleotide
ccttcctgccctcaactgaggacgtttac

SEQ ID NO: 406482 - DNA, 29 bp, Artificial Sequence
  Description of Artificial Sequence: Synthetic oligonucleotide
cttcctgccctcaactgaggacgtttacg

SEQ ID NO: 406483 - DNA, 30 bp, Artificial Sequence; identical to SEQ ID NO: 62511
  Description of Artificial Sequence: Synthetic oligonucleotide

SEQ ID NO: 406484 - DNA, 29 bp, Artificial Sequence
  Description of Artificial Sequence: Synthetic oligonucleotide
tcctgccctcaactgaggacgtttacgac

SEQ ID NO: 406485 - DNA, 28 bp, Artificial Sequence
  Description of Artificial Sequence: Synthetic oligonucleotide
cctgccctcaactgaggacgtttacgac

SEQ ID NO: 406486 - DNA, 29 bp, Artificial Sequence
  Description of Artificial Sequence: Synthetic oligonucleotide
ctgccctcaactgaggacgtttacgactg

SEQ ID NO: 406487 - DNA, 29 bp, Artificial Sequence
  Description of Artificial Sequence: Synthetic oligonucleotide
tgccctcaactgaggacgtttacgactgc

SEQ ID NO: 406488 - DNA, 28 bp, Artificial Sequence
  Description of Artificial Sequence: Synthetic oligonucleotide
gccctcaactgaggacgtttacgactgc

SEQ ID NO: 406489 - DNA, 29 bp, Artificial Sequence
  Description of Artificial Sequence: Synthetic oligonucleotide
ccctcaactgaggacgtttacgactgcag

SEQ ID NO: 406490 - DNA, 29 bp, Artificial Sequence
  Description of Artificial Sequence: Synthetic oligonucleotide
cctcaactgaggacgtttacgactgcagg

SEQ ID NO: 406491 - DNA, 29 bp, Artificial Sequence
  Description of Artificial Sequence: Synthetic oligonucleotide
ctcaactgaggacgtttacgactgcaggg

SEQ ID NO: 406492 - DNA, 30 bp, Artificial Sequence; identical to SEQ ID NO: 62520
  Description of Artificial Sequence: Synthetic oligonucleotide

SEQ ID NO: 406493 - DNA, 29 bp, Artificial Sequence
  Description of Artificial Sequence: Synthetic oligonucleotide
caactgaggacgtttacgactgcagggtg

SEQ ID NO: 406494 - DNA, 29 bp, Artificial Sequence
  Description of Artificial Sequence: Synthetic oligonucleotide
aactgaggacgtttacgactgcagggtgg

SEQ ID NO: 406495 - DNA, 28 bp, Artificial Sequence
  Description of Artificial Sequence: Synthetic oligonucleotide
actgaggacgtttacgactgcagggtgg

SEQ ID NO: 406496 - DNA, 27 bp, Artificial Sequence
  Description of Artificial Sequence: Synthetic oligonucleotide
ctgaggacgtttacgactgcagggtgg

SEQ ID NO: 406497 - DNA, 28 bp, Artificial Sequence
  Description of Artificial Sequence: Synthetic oligonucleotide
tgaggacgtttacgactgcagggtggag

SEQ ID NO: 406498 - DNA, 27 bp, Artificial Sequence
  Description of Artificial Sequence: Synthetic oligonucleotide
gaggacgtttacgactgcagggtggag

SEQ ID NO: 406499 - DNA, 27 bp, Artificial Sequence
  Description of Artificial Sequence: Synthetic oligonucleotide
aggacgtttacgactgcagggtggagc

SEQ ID NO: 406500 - DNA, 27 bp, Artificial Sequence
  Description of Artificial Sequence: Synthetic oligonucleotide
ggacgtttacgactgcagggtggagca

SEQ ID NO: 406501 - DNA, 27 bp, Artificial Sequence
  Description of Artificial Sequence: Synthetic oligonucleotide
gacgtttacgactgcagggtggagcac

SEQ ID NO: 406502 - DNA, 28 bp, Artificial Sequence
  Description of Artificial Sequence: Synthetic oligonucleotide
acgtttacgactgcagggtggagcactg

SEQ ID NO: 406503 - DNA, 27 bp, Artificial Sequence
  Description of Artificial Sequence: Synthetic oligonucleotide
cgtttacgactgcagggtggagcactg

SEQ ID NO: 406504 - DNA, 27 bp, Artificial Sequence
  Description of Artificial Sequence: Synthetic oligonucleotide
gtttacgactgcagggtggagcactgg

SEQ ID NO: 406505 - DNA, 27 bp, Artificial Sequence
  Description of Artificial Sequence: Synthetic oligonucleotide
tttacgactgcagggtggagcactggg

SEQ ID NO: 406506 - DNA, 26 bp, Artificial Sequence
  Description of Artificial Sequence: Synthetic oligonucleotide
ttacgactgcagggtggagcactggg

SEQ ID NO: 406507 - DNA, 25 bp, Artificial Sequence
  Description of Artificial Sequence: Synthetic oligonucleotide
tacgactgcagggtggagcactggg

SEQ ID NO: 406508 - DNA, 24 bp, Artificial Sequence
  Description of Artificial Sequence: Synthetic oligonucleotide
acgactgcagggtggagcactggg

SEQ ID NO: 406509 - DNA, 23 bp, Artificial Sequence
  Description of Artificial Sequence: Synthetic oligonucleotide
cgactgcagggtggagcactggg

SEQ ID NO: 406510 - DNA, 25 bp, Artificial Sequence
  Description of Artificial Sequence: Synthetic oligonucleotide
cagggtggagcactggggcttggat

SEQ ID NO: 406511 - DNA, 26 bp, Artificial Sequence
  Description of Artificial Sequence: Synthetic oligonucleotide
agggtggagcactggggcttggatga

SEQ ID NO: 406512 - DNA, 25 bp, Artificial Sequence
  Description of Artificial Sequence: Synthetic oligonucleotide
gggtggagcactggggcttggatga

SEQ ID NO: 406513 - DNA, 25 bp, Artificial Sequence
  Description of Artificial Sequence: Synthetic oligonucleotide
ggtggagcactggggcttggatgag

SEQ ID NO: 406514 - DNA, 25 bp, Artificial Sequence
  Description of Artificial Sequence: Synthetic oligonucleotide
gtggagcactggggcttggatgagc

SEQ ID NO: 406515 - DNA, 26 bp, Artificial Sequence
  Description of Artificial Sequence: Synthetic oligonucleotide
tggagcactggggcttggatgagcct

SEQ ID NO: 406516 - DNA, 25 bp, Artificial Sequence
  Description of Artificial Sequence: Synthetic oligonucleotide
ggagcactggggcttggatgagcct

SEQ ID NO: 406517 - DNA, 27 bp, Artificial Sequence
  Description of Artificial Sequence: Synthetic oligonucleotide
gagcactggggcttggatgagcctctt

SEQ ID NO: 406518 - DNA, 27 bp, Artificial Sequence
  Description of Artificial Sequence: Synthetic oligonucleotide
agcactggggcttggatgagcctcttc

SEQ ID NO: 406519 - DNA, 27 bp, Artificial Sequence
  Description of Artificial Sequence: Synthetic oligonucleotide
gcactggggcttggatgagcctcttct

SEQ ID NO: 406520 - DNA, 27 bp, Artificial Sequence
  Description of Artificial Sequence: Synthetic oligonucleotide
cactggggcttggatgagcctcttctc

SEQ ID NO: 406521 - DNA, 29 bp, Artificial Sequence
  Description of Artificial Sequence: Synthetic oligonucleotide
actggggcttggatgagcctcttctcaag

SEQ ID NO: 406522 - DNA, 28 bp, Artificial Sequence
  Description of Artificial Sequence: Synthetic oligonucleotide
ctggggcttggatgagcctcttctcaag

SEQ ID NO: 406523 - DNA, 28 bp, Artificial Sequence
  Description of Artificial Sequence: Synthetic oligonucleotide
tggggcttggatgagcctcttctcaagc

SEQ ID NO: 406524 - DNA, 27 bp, Artificial Sequence
  Description of Artificial Sequence: Synthetic oligonucleotide
ggggcttggatgagcctcttctcaagc

SEQ ID NO: 406525 - DNA, 28 bp, Artificial Sequence
  Description of Artificial Sequence: Synthetic oligonucleotide
gggcttggatgagcctcttctcaagcac

SEQ ID NO: 406526 - DNA, 29 bp, Artificial Sequence
  Description of Artificial Sequence: Synthetic oligonucleotide
ggcttggatgagcctcttctcaagcactg

SEQ ID NO: 406527 - DNA, 29 bp, Artificial Sequence
  Description of Artificial Sequence: Synthetic oligonucleotide
gcttggatgagcctcttctcaagcactgg

SEQ ID NO: 406528 - DNA, 29 bp, Artificial Sequence
  Description of Artificial Sequence: Synthetic oligonucleotide
cttggatgagcctcttctcaagcactggg

SEQ ID NO: 406529 - DNA, 30 bp, Artificial Sequence; identical to SEQ ID NO: 62557
  Description of Artificial Sequence: Synthetic oligonucleotide

SEQ ID NO: 406530 - DNA, 29 bp, Artificial Sequence
  Description of Artificial Sequence: Synthetic oligonucleotide
tggatgagcctcttctcaagcactgggag

SEQ ID NO: 406531 - DNA, 28 bp, Artificial Sequence
  Description of Artificial Sequence: Synthetic oligonucleotide
ggatgagcctcttctcaagcactgggag

SEQ ID NO: 406532 - DNA, 31 bp, Artificial Sequence; identical to SEQ ID NO: 62560
  Description of Artificial Sequence: Synthetic oligonucleotide

SEQ ID NO: 406533 - DNA, 33 bp, Artificial Sequence; identical to SEQ ID NO: 62561
  Description of Artificial Sequence: Synthetic oligonucleotide

SEQ ID NO: 406534 - DNA, 32 bp, Artificial Sequence; identical to SEQ ID NO: 62562
  Description of Artificial Sequence: Synthetic oligonucleotide

SEQ ID NO: 406535 - DNA, 31 bp, Artificial Sequence; identical to SEQ ID NO: 62563
  Description of Artificial Sequence: Synthetic oligonucleotide

SEQ ID NO: 406536 - DNA, 31 bp, Artificial Sequence; identical to SEQ ID NO: 62564
  Description of Artificial Sequence: Synthetic oligonucleotide

SEQ ID NO: 406537 - DNA, 30 bp, Artificial Sequence; identical to SEQ ID NO: 62565
  Description of Artificial Sequence: Synthetic oligonucleotide

SEQ ID NO: 406538 - DNA, 31 bp, Artificial Sequence; identical to SEQ ID NO: 62566
  Description of Artificial Sequence: Synthetic oligonucleotide

SEQ ID NO: 406539 - DNA, 31 bp, Artificial Sequence; identical to SEQ ID NO: 62567
  Description of Artificial Sequence: Synthetic oligonucleotide

SEQ ID NO: 406540 - DNA, 33 bp, Artificial Sequence; identical to SEQ ID NO: 62568
  Description of Artificial Sequence: Synthetic oligonucleotide

SEQ ID NO: 406541 - DNA, 32 bp, Artificial Sequence; identical to SEQ ID NO: 62569
  Description of Artificial Sequence: Synthetic oligonucleotide

SEQ ID NO: 406542 - DNA, 32 bp, Artificial Sequence; identical to SEQ ID NO: 62570
  Description of Artificial Sequence: Synthetic oligonucleotide

SEQ ID NO: 406543 - DNA, 31 bp, Artificial Sequence; identical to SEQ ID NO: 62571
  Description of Artificial Sequence: Synthetic oligonucleotide

SEQ ID NO: 406544 - DNA, 30 bp, Artificial Sequence; identical to SEQ ID NO: 62572
  Description of Artificial Sequence: Synthetic oligonucleotide

SEQ ID NO: 406545 - DNA, 30 bp, Artificial Sequence; identical to SEQ ID NO: 62573
  Description of Artificial Sequence: Synthetic oligonucleotide

SEQ ID NO: 406546 - DNA, 29 bp, Artificial Sequence
  Description of Artificial Sequence: Synthetic oligonucleotide
caagcactgggagtttgatgctccaagcc

SEQ ID NO: 406547 - DNA, 29 bp, Artificial Sequence
  Description of Artificial Sequence: Synthetic oligonucleotide
aagcactgggagtttgatgctccaagccc

SEQ ID NO: 406548 - DNA, 28 bp, Artificial Sequence
  Description of Artificial Sequence: Synthetic oligonucleotide
agcactgggagtttgatgctccaagccc

SEQ ID NO: 406549 - DNA, 27 bp, Artificial Sequence
  Description of Artificial Sequence: Synthetic oligonucleotide
gcactgggagtttgatgctccaagccc

SEQ ID NO: 406550 - DNA, 28 bp, Artificial Sequence
  Description of Artificial Sequence: Synthetic oligonucleotide
cactgggagtttgatgctccaagccctc

SEQ ID NO: 406551 - DNA, 29 bp, Artificial Sequence
  Description of Artificial Sequence: Synthetic oligonucleotide
actgggagtttgatgctccaagccctctc

SEQ ID NO: 406552 - DNA, 28 bp, Artificial Sequence
  Description of Artificial Sequence: Synthetic oligonucleotide
ctgggagtttgatgctccaagccctctc

SEQ ID NO: 406553 - DNA, 28 bp, Artificial Sequence
  Description of Artificial Sequence: Synthetic oligonucleotide
tgggagtttgatgctccaagccctctcc

SEQ ID NO: 406554 - DNA, 27 bp, Artificial Sequence
  Description of Artificial Sequence: Synthetic oligonucleotide
gggagtttgatgctccaagccctctcc

SEQ ID NO: 406555 - DNA, 27 bp, Artificial Sequence
  Description of Artificial Sequence: Synthetic oligonucleotide
ggagtttgatgctccaagccctctccc

SEQ ID NO: 406556 - DNA, 28 bp, Artificial Sequence
  Description of Artificial Sequence: Synthetic oligonucleotide
gagtttgatgctccaagccctctcccag

SEQ ID NO: 406557 - DNA, 29 bp, Artificial Sequence
  Description of Artificial Sequence: Synthetic oligonucleotide
agtttgatgctccaagccctctcccagag

SEQ ID NO: 406558 - DNA, 28 bp, Artificial Sequence
  Description of Artificial Sequence: Synthetic oligonucleotide
gtttgatgctccaagccctctcccagag

SEQ ID NO: 406559 - DNA, 29 bp, Artificial Sequence
  Description of Artificial Sequence: Synthetic oligonucleotide
tttgatgctccaagccctctcccagagac

SEQ ID NO: 406560 - DNA, 28 bp, Artificial Sequence
  Description of Artificial Sequence: Synthetic oligonucleotide
ttgatgctccaagccctctcccagagac

SEQ ID NO: 406561 - DNA, 27 bp, Artificial Sequence
  Description of Artificial Sequence: Synthetic oligonucleotide
tgatgctccaagccctctcccagagac

SEQ ID NO: 406562 - DNA, 27 bp, Artificial Sequence
  Description of Artificial Sequence: Synthetic oligonucleotide
gatgctccaagccctctcccagagact

SEQ ID NO: 406563 - DNA, 28 bp, Artificial Sequence
  Description of Artificial Sequence: Synthetic oligonucleotide
atgctccaagccctctcccagagactac

SEQ ID NO: 406564 - DNA, 27 bp, Artificial Sequence
  Description of Artificial Sequence: Synthetic oligonucleotide
tgctccaagccctctcccagagactac

SEQ ID NO: 406565 - DNA, 27 bp, Artificial Sequence
  Description of Artificial Sequence: Synthetic oligonucleotide
gctccaagccctctcccagagactaca

SEQ ID NO: 406566 - DNA, 27 bp, Artificial Sequence
  Description of Artificial Sequence: Synthetic oligonucleotide
ctccaagccctctcccagagactacag

SEQ ID NO: 406567 - DNA, 28 bp, Artificial Sequence
  Description of Artificial Sequence: Synthetic oligonucleotide
tccaagccctctcccagagactacagag

SEQ ID NO: 406568 - DNA, 27 bp, Artificial Sequence
  Description of Artificial Sequence: Synthetic oligonucleotide
ccaagccctctcccagagactacagag

SEQ ID NO: 406569 - DNA, 29 bp, Artificial Sequence
  Description of Artificial Sequence: Synthetic oligonucleotide
caagccctctcccagagactacagagaac

SEQ ID NO: 406570 - DNA, 29 bp, Artificial Sequence
  Description of Artificial Sequence: Synthetic oligonucleotide
aagccctctcccagagactacagagaacg

SEQ ID NO: 406571 - DNA, 28 bp, Artificial Sequence
  Description of Artificial Sequence: Synthetic oligonucleotide
agccctctcccagagactacagagaacg

SEQ ID NO: 406572 - DNA, 27 bp, Artificial Sequence
  Description of Artificial Sequence: Synthetic oligonucleotide
gccctctcccagagactacagagaacg

SEQ ID NO: 406573 - DNA, 28 bp, Artificial Sequence
  Description of Artificial Sequence: Synthetic oligonucleotide
ccctctcccagagactacagagaacgtg

SEQ ID NO: 406574 - DNA, 28 bp, Artificial Sequence
  Description of Artificial Sequence: Synthetic oligonucleotide
cctctcccagagactacagagaacgtgg

SEQ ID NO: 406575 - DNA, 29 bp, Artificial Sequence
  Description of Artificial Sequence: Synthetic oligonucleotide
ctctcccagagactacagagaacgtggtg

SEQ ID NO: 406576 - DNA, 30 bp, Artificial Sequence; identical to SEQ ID NO: 62604
  Description of Artificial Sequence: Synthetic oligonucleotide

SEQ ID NO: 406577 - DNA, 29 bp, Artificial Sequence
  Description of Artificial Sequence: Synthetic oligonucleotide
ctcccagagactacagagaacgtggtgtg

SEQ ID NO: 406578 - DNA, 30 bp, Artificial Sequence; identical to SEQ ID NO: 62606
  Description of Artificial Sequence: Synthetic oligonucleotide

SEQ ID NO: 406579 - DNA, 29 bp, Artificial Sequence
  Description of Artificial Sequence: Synthetic oligonucleotide
cccagagactacagagaacgtggtgtgtg

SEQ ID NO: 406580 - DNA, 29 bp, Artificial Sequence
  Description of Artificial Sequence: Synthetic oligonucleotide
ccagagactacagagaacgtggtgtgtgc

SEQ ID NO: 406581 - DNA, 29 bp, Artificial Sequence
  Description of Artificial Sequence: Synthetic oligonucleotide
cagagactacagagaacgtggtgtgtgcc

SEQ ID NO: 406582 - DNA, 29 bp, Artificial Sequence
  Description of Artificial Sequence: Synthetic oligonucleotide
agagactacagagaacgtggtgtgtgccc

SEQ ID NO: 406583 - DNA, 28 bp, Artificial Sequence
  Description of Artificial Sequence: Synthetic oligonucleotide
gagactacagagaacgtggtgtgtgccc

SEQ ID NO: 406584 - DNA, 29 bp, Artificial Sequence
  Description of Artificial Sequence: Synthetic oligonucleotide
agactacagagaacgtggtgtgtgccctg

SEQ ID NO: 406585 - DNA, 28 bp, Artificial Sequence
  Description of Artificial Sequence: Synthetic oligonucleotide
gactacagagaacgtggtgtgtgccctg

SEQ ID NO: 406586 - DNA, 28 bp, Artificial Sequence
  Description of Artificial Sequence: Synthetic oligonucleotide
actacagagaacgtggtgtgtgccctgg

SEQ ID NO: 406587 - DNA, 27 bp, Artificial Sequence
  Description of Artificial Sequence: Synthetic oligonucleotide
ctacagagaacgtggtgtgtgccctgg

SEQ ID NO: 406588 - DNA, 27 bp, Artificial Sequence
  Description of Artificial Sequence: Synthetic oligonucleotide
tacagagaacgtggtgtgtgccctggg

SEQ ID NO: 406589 - DNA, 26 bp, Artificial Sequence
  Description of Artificial Sequence: Synthetic oligonucleotide
acagagaacgtggtgtgtgccctggg

SEQ ID NO: 406590 - DNA, 25 bp, Artificial Sequence
  Description of Artificial Sequence: Synthetic oligonucleotide
cagagaacgtggtgtgtgccctggg

SEQ ID NO: 406591 - DNA, 25 bp, Artificial Sequence
  Description of Artificial Sequence: Synthetic oligonucleotide
agagaacgtggtgtgtgccctgggc

SEQ ID NO: 406592 - DNA, 24 bp, Artificial Sequence
  Description of Artificial Sequence: Synthetic oligonucleotide
gagaacgtggtgtgtgccctgggc

SEQ ID NO: 406593 - DNA, 25 bp, Artificial Sequence
  Description of Artificial Sequence: Synthetic oligonucleotide
agaacgtggtgtgtgccctgggcct

SEQ ID NO: 406594 - DNA, 24 bp, Artificial Sequence
  Description of Artificial Sequence: Synthetic oligonucleotide
gaacgtggtgtgtgccctgggcct

SEQ ID NO: 406595 - DNA, 25 bp, Artificial Sequence
  Description of Artificial Sequence: Synthetic oligonucleotide
aacgtggtgtgtgccctgggcctga

SEQ ID NO: 406596 - DNA, 24 bp, Artificial Sequence
  Description of Artificial Sequence: Synthetic oligonucleotide
acgtggtgtgtgccctgggcctga

SEQ ID NO: 406597 - DNA, 23 bp, Artificial Sequence
  Description of Artificial Sequence: Synthetic oligonucleotide
cgtggtgtgtgccctgggcctga

SEQ ID NO: 406598 - DNA, 24 bp, Artificial Sequence
  Description of Artificial Sequence: Synthetic oligonucleotide
gtggtgtgtgccctgggcctgact

SEQ ID NO: 406599 - DNA, 25 bp, Artificial Sequence
  Description of Artificial Sequence: Synthetic oligonucleotide
tggtgtgtgccctgggcctgactgt

SEQ ID NO: 406600 - DNA, 24 bp, Artificial Sequence
  Description of Artificial Sequence: Synthetic oligonucleotide
ggtgtgtgccctgggcctgactgt

SEQ ID NO: 406601 - DNA, 24 bp, Artificial Sequence
  Description of Artificial Sequence: Synthetic oligonucleotide
gtgtgtgccctgggcctgactgtg

SEQ ID NO: 406602 - DNA, 24 bp, Artificial Sequence
  Description of Artificial Sequence: Synthetic oligonucleotide
tgtgtgccctgggcctgactgtgg

SEQ ID NO: 406603 - DNA, 23 bp, Artificial Sequence
  Description of Artificial Sequence: Synthetic oligonucleotide
gtgtgccctgggcctgactgtgg

SEQ ID NO: 406604 - DNA, 24 bp, Artificial Sequence
  Description of Artificial Sequence: Synthetic oligonucleotide
tgtgccctgggcctgactgtgggt

SEQ ID NO: 406605 - DNA, 23 bp, Artificial Sequence
  Description of Artificial Sequence: Synthetic oligonucleotide
gtgccctgggcctgactgtgggt

SEQ ID NO: 406606 - DNA, 24 bp, Artificial Sequence
  Description of Artificial Sequence: Synthetic oligonucleotide
tgccctgggcctgactgtgggtct

SEQ ID NO: 406607 - DNA, 23 bp, Artificial Sequence
  Description of Artificial Sequence: Synthetic oligonucleotide
gccctgggcctgactgtgggtct

SEQ ID NO: 406608 - DNA, 23 bp, Artificial Sequence
  Description of Artificial Sequence: Synthetic oligonucleotide
ccctgggcctgactgtgggtctg

SEQ ID NO: 406609 - DNA, 24 bp, Artificial Sequence
  Description of Artificial Sequence: Synthetic oligonucleotide
cctgggcctgactgtgggtctggt

SEQ ID NO: 406610 - DNA, 24 bp, Artificial Sequence
  Description of Artificial Sequence: Synthetic oligonucleotide
ctgggcctgactgtgggtctggtg

SEQ ID NO: 406611 - DNA, 24 bp, Artificial Sequence
  Description of Artificial Sequence: Synthetic oligonucleotide
tgggcctgactgtgggtctggtgg

SEQ ID NO: 406612 - DNA, 23 bp, Artificial Sequence
  Description of Artificial Sequence: Synthetic oligonucleotide
gggcctgactgtgggtctggtgg

SEQ ID NO: 406613 - DNA, 23 bp, Artificial Sequence
  Description of Artificial Sequence: Synthetic oligonucleotide
ggcctgactgtgggtctggtggg

SEQ ID NO: 406614 - DNA, 25 bp, Artificial Sequence
  Description of Artificial Sequence: Synthetic oligonucleotide
gcctgactgtgggtctggtgggcat

SEQ ID NO: 406615 - DNA, 27 bp, Artificial Sequence
  Description of Artificial Sequence: Synthetic oligonucleotide
cctgactgtgggtctggtgggcatcat

SEQ ID NO: 406616 - DNA, 31 bp, Artificial Sequence; identical to SEQ ID NO: 62644
  Description of Artificial Sequence: Synthetic oligonucleotide

SEQ ID NO: 406617 - DNA, 31 bp, Artificial Sequence; identical to SEQ ID NO: 62645
  Description of Artificial Sequence: Synthetic oligonucleotide

SEQ ID NO: 406618 - DNA, 30 bp, Artificial Sequence; identical to SEQ ID NO: 62646
  Description of Artificial Sequence: Synthetic oligonucleotide

SEQ ID NO: 406619 - DNA, 30 bp, Artificial Sequence; identical to SEQ ID NO: 62647
  Description of Artificial Sequence: Synthetic oligonucleotide

SEQ ID NO: 406620 - DNA, 29 bp, Artificial Sequence
  Description of Artificial Sequence: Synthetic oligonucleotide
ctgtgggtctggtgggcatcattattggg

SEQ ID NO: 406621 - DNA, 30 bp, Artificial Sequence; identical to SEQ ID NO: 62649
  Description of Artificial Sequence: Synthetic oligonucleotide

SEQ ID NO: 406622 - DNA, 29 bp, Artificial Sequence
  Description of Artificial Sequence: Synthetic oligonucleotide
gtgggtctggtgggcatcattattgggac

SEQ ID NO: 406623 - DNA, 29 bp, Artificial Sequence
  Description of Artificial Sequence: Synthetic oligonucleotide
tgggtctggtgggcatcattattgggacc

SEQ ID NO: 406624 - DNA, 28 bp, Artificial Sequence
  Description of Artificial Sequence: Synthetic oligonucleotide
gggtctggtgggcatcattattgggacc

SEQ ID NO: 406625 - DNA, 30 bp, Artificial Sequence; identical to SEQ ID NO: 62653
  Description of Artificial Sequence: Synthetic oligonucleotide

SEQ ID NO: 406626 - DNA, 32 bp, Artificial Sequence; identical to SEQ ID NO: 62654
  Description of Artificial Sequence: Synthetic oligonucleotide

SEQ ID NO: 406627 - DNA, 34 bp, Artificial Sequence; identical to SEQ ID NO: 62655
  Description of Artificial Sequence: Synthetic oligonucleotide

SEQ ID NO: 406628 - DNA, 33 bp, Artificial Sequence; identical to SEQ ID NO: 62656
  Description of Artificial Sequence: Synthetic oligonucleotide

SEQ ID NO: 406629 - DNA, 35 bp, Artificial Sequence; identical to SEQ ID NO: 62657
  Description of Artificial Sequence: Synthetic oligonucleotide

SEQ ID NO: 406630 - DNA, 34 bp, Artificial Sequence; identical to SEQ ID NO: 62658
  Description of Artificial Sequence: Synthetic oligonucleotide

SEQ ID NO: 406631 - DNA, 36 bp, Artificial Sequence; identical to SEQ ID NO: 62659
  Description of Artificial Sequence: Synthetic oligonucleotide

SEQ ID NO: 406632 - DNA, 36 bp, Artificial Sequence; identical to SEQ ID NO: 62660
  Description of Artificial Sequence: Synthetic oligonucleotide

SEQ ID NO: 406633 - DNA, 35 bp, Artificial Sequence; identical to SEQ ID NO: 62661
  Description of Artificial Sequence: Synthetic oligonucleotide

SEQ ID NO: 406634 - DNA, 35 bp, Artificial Sequence; identical to SEQ ID NO: 62662
  Description of Artificial Sequence: Synthetic oligonucleotide

SEQ ID NO: 406635 - DNA, 36 bp, Artificial Sequence; identical to SEQ ID NO: 62663
  Description of Artificial Sequence: Synthetic oligonucleotide

SEQ ID NO: 406636 - DNA, 37 bp, Artificial Sequence; identical to SEQ ID NO: 62664
  Description of Artificial Sequence: Synthetic oligonucleotide

SEQ ID NO: 406637 - DNA, 37 bp, Artificial Sequence; identical to SEQ ID NO: 62665
  Description of Artificial Sequence: Synthetic oligonucleotide

SEQ ID NO: 406638 - DNA, 36 bp, Artificial Sequence; identical to SEQ ID NO: 62666
  Description of Artificial Sequence: Synthetic oligonucleotide

SEQ ID NO: 406639 - DNA, 35 bp, Artificial Sequence; identical to SEQ ID NO: 62667
  Description of Artificial Sequence: Synthetic oligonucleotide

SEQ ID NO: 406640 - DNA, 35 bp, Artificial Sequence; identical to SEQ ID NO: 62668
  Description of Artificial Sequence: Synthetic oligonucleotide

SEQ ID NO: 406641 - DNA, 34 bp, Artificial Sequence; identical to SEQ ID NO: 62669
  Description of Artificial Sequence: Synthetic oligonucleotide

SEQ ID NO: 406642 - DNA, 33 bp, Artificial Sequence; identical to SEQ ID NO: 62670
  Description of Artificial Sequence: Synthetic oligonucleotide

SEQ ID NO: 406643 - DNA, 32 bp, Artificial Sequence; identical to SEQ ID NO: 62671
  Description of Artificial Sequence: Synthetic oligonucleotide

SEQ ID NO: 406644 - DNA, 31 bp, Artificial Sequence; identical to SEQ ID NO: 62672
  Description of Artificial Sequence: Synthetic oligonucleotide

SEQ ID NO: 406645 - DNA, 30 bp, Artificial Sequence; identical to SEQ ID NO: 62673
  Description of Artificial Sequence: Synthetic oligonucleotide

SEQ ID NO: 406646 - DNA, 29 bp, Artificial Sequence
  Description of Artificial Sequence: Synthetic oligonucleotide
gggaccatcttcatcatcaagggagtgcg

SEQ ID NO: 406647 - DNA, 29 bp, Artificial Sequence
  Description of Artificial Sequence: Synthetic oligonucleotide
ggaccatcttcatcatcaagggagtgcgc

SEQ ID NO: 406648 - DNA, 33 bp, Artificial Sequence; identical to SEQ ID NO: 62676
  Description of Artificial Sequence: Synthetic oligonucleotide

SEQ ID NO: 406649 - DNA, 33 bp, Artificial Sequence; identical to SEQ ID NO: 62677
  Description of Artificial Sequence: Synthetic oligonucleotide

SEQ ID NO: 406650 - DNA, 32 bp, Artificial Sequence; identical to SEQ ID NO: 62678
  Description of Artificial Sequence: Synthetic oligonucleotide

SEQ ID NO: 406651 - DNA, 35 bp, Artificial Sequence; identical to SEQ ID NO: 62679
  Description of Artificial Sequence: Synthetic oligonucleotide

SEQ ID NO: 406652 - DNA, 35 bp, Artificial Sequence; identical to SEQ ID NO: 62680
  Description of Artificial Sequence: Synthetic oligonucleotide

SEQ ID NO: 406653 - DNA, 34 bp, Artificial Sequence; identical to SEQ ID NO: 62681
  Description of Artificial Sequence: Synthetic oligonucleotide

SEQ ID NO: 406654 - DNA, 33 bp, Artificial Sequence; identical to SEQ ID NO: 62682
  Description of Artificial Sequence: Synthetic oligonucleotide

SEQ ID NO: 406655 - DNA, 34 bp, Artificial Sequence; identical to SEQ ID NO: 62683
  Description of Artificial Sequence: Synthetic oligonucleotide

SEQ ID NO: 406656 - DNA, 33 bp, Artificial Sequence; identical to SEQ ID NO: 62684
  Description of Artificial Sequence: Synthetic oligonucleotide

SEQ ID NO: 406657 - DNA, 32 bp, Artificial Sequence; identical to SEQ ID NO: 62685
  Description of Artificial Sequence: Synthetic oligonucleotide

SEQ ID NO: 406658 - DNA, 32 bp, Artificial Sequence; identical to SEQ ID NO: 62686
  Description of Artificial Sequence: Synthetic oligonucleotide

SEQ ID NO: 406659 - DNA, 31 bp, Artificial Sequence; identical to SEQ ID NO: 62687
  Description of Artificial Sequence: Synthetic oligonucleotide

SEQ ID NO: 406660 - DNA, 30 bp, Artificial Sequence; identical to SEQ ID NO: 62688
  Description of Artificial Sequence: Synthetic oligonucleotide

SEQ ID NO: 406661 - DNA, 31 bp, Artificial Sequence; identical to SEQ ID NO: 62689
  Description of Artificial Sequence: Synthetic oligonucleotide

SEQ ID NO: 406662 - DNA, 30 bp, Artificial Sequence; identical to SEQ ID NO: 62690
  Description of Artificial Sequence: Synthetic oligonucleotide

SEQ ID NO: 406663 - DNA, 29 bp, Artificial Sequence
  Description of Artificial Sequence: Synthetic oligonucleotide
caagggagtgcgcaaaagcaatgcagcag

SEQ ID NO: 406664 - DNA, 31 bp, Artificial Sequence; identical to SEQ ID NO: 62692
  Description of Artificial Sequence: Synthetic oligonucleotide

SEQ ID NO: 406665 - DNA, 30 bp, Artificial Sequence; identical to SEQ ID NO: 62693
  Description of Artificial Sequence: Synthetic oligonucleotide

SEQ ID NO: 406666 - DNA, 29 bp, Artificial Sequence
  Description of Artificial Sequence: Synthetic oligonucleotide
gggagtgcgcaaaagcaatgcagcagaac

SEQ ID NO: 406667 - DNA, 29 bp, Artificial Sequence
  Description of Artificial Sequence: Synthetic oligonucleotide
ggagtgcgcaaaagcaatgcagcagaacg

SEQ ID NO: 406668 - DNA, 29 bp, Artificial Sequence
  Description of Artificial Sequence: Synthetic oligonucleotide
gagtgcgcaaaagcaatgcagcagaacgc

SEQ ID NO: 406669 - DNA, 30 bp, Artificial Sequence; identical to SEQ ID NO: 62697
  Description of Artificial Sequence: Synthetic oligonucleotide

SEQ ID NO: 406670 - DNA, 29 bp, Artificial Sequence
  Description of Artificial Sequence: Synthetic oligonucleotide
gtgcgcaaaagcaatgcagcagaacgcag

SEQ ID NO: 406671 - DNA, 29 bp, Artificial Sequence
  Description of Artificial Sequence: Synthetic oligonucleotide
tgcgcaaaagcaatgcagcagaacgcagg

SEQ ID NO: 406672 - DNA, 28 bp, Artificial Sequence
  Description of Artificial Sequence: Synthetic oligonucleotide
gcgcaaaagcaatgcagcagaacgcagg

SEQ ID NO: 406673 - DNA, 28 bp, Artificial Sequence
  Description of Artificial Sequence: Synthetic oligonucleotide
cgcaaaagcaatgcagcagaacgcaggg

SEQ ID NO: 406674 - DNA, 28 bp, Artificial Sequence
  Description of Artificial Sequence: Synthetic oligonucleotide
gcaaaagcaatgcagcagaacgcagggg

SEQ ID NO: 406675 - DNA, 28 bp, Artificial Sequence
  Description of Artificial Sequence: Synthetic oligonucleotide
caaaagcaatgcagcagaacgcaggggg

SEQ ID NO: 406676 - DNA, 28 bp, Artificial Sequence
  Description of Artificial Sequence: Synthetic oligonucleotide
aaaagcaatgcagcagaacgcagggggc

SEQ ID NO: 406677 - DNA, 27 bp, Artificial Sequence
  Description of Artificial Sequence: Synthetic oligonucleotide
aaagcaatgcagcagaacgcagggggc

SEQ ID NO: 406678 - DNA, 26 bp, Artificial Sequence
  Description of Artificial Sequence: Synthetic oligonucleotide
aagcaatgcagcagaacgcagggggc

SEQ ID NO: 406679 - DNA, 25 bp, Artificial Sequence
  Description of Artificial Sequence: Synthetic oligonucleotide
agcaatgcagcagaacgcagggggc

SEQ ID NO: 406680 - DNA, 24 bp, Artificial Sequence
  Description of Artificial Sequence: Synthetic oligonucleotide
gcaatgcagcagaacgcagggggc

SEQ ID NO: 406681 - DNA, 25 bp, Artificial Sequence
  Description of Artificial Sequence: Synthetic oligonucleotide
caatgcagcagaacgcagggggcct

SEQ ID NO: 406682 - DNA, 26 bp, Artificial Sequence
  Description of Artificial Sequence: Synthetic oligonucleotide
aatgcagcagaacgcagggggcctct

SEQ ID NO: 406683 - DNA, 25 bp, Artificial Sequence
  Description of Artificial Sequence: Synthetic oligonucleotide
atgcagcagaacgcagggggcctct

SEQ ID NO: 406684 - DNA, 24 bp, Artificial Sequence
  Description of Artificial Sequence: Synthetic oligonucleotide
tgcagcagaacgcagggggcctct

SEQ ID NO: 406685 - DNA, 23 bp, Artificial Sequence
  Description of Artificial Sequence: Synthetic oligonucleotide
gcagcagaacgcagggggcctct

SEQ ID NO: 406686 - DNA, 26 bp, Artificial Sequence
  Description of Artificial Sequence: Synthetic oligonucleotide
cagcagaacgcagggggcctctgtaa

SEQ ID NO: 406687 - DNA, 28 bp, Artificial Sequence
  Description of Artificial Sequence: Synthetic oligonucleotide
tcactcccgagctctactgactcccaac

SEQ ID NO: 406688 - DNA, 27 bp, Artificial Sequence
  Description of Artificial Sequence: Synthetic oligonucleotide
cactcccgagctctactgactcccaac

SEQ ID NO: 406689 - DNA, 28 bp, Artificial Sequence
  Description of Artificial Sequence: Synthetic oligonucleotide
actcccgagctctactgactcccaacag

SEQ ID NO: 406690 - DNA, 27 bp, Artificial Sequence
  Description of Artificial Sequence: Synthetic oligonucleotide
ctcccgagctctactgactcccaacag

SEQ ID NO: 406691 - DNA, 28 bp, Artificial Sequence
  Description of Artificial Sequence: Synthetic oligonucleotide
tcccgagctctactgactcccaacagag

SEQ ID NO: 406692 - DNA, 27 bp, Artificial Sequence
  Description of Artificial Sequence: Synthetic oligonucleotide
cccgagctctactgactcccaacagag

SEQ ID NO: 406693 - DNA, 27 bp, Artificial Sequence
  Description of Artificial Sequence: Synthetic oligonucleotide
ccgagctctactgactcccaacagagc

SEQ ID NO: 406694 - DNA, 27 bp, Artificial Sequence
  Description of Artificial Sequence: Synthetic oligonucleotide
cgagctctactgactcccaacagagcg

SEQ ID NO: 406695 - DNA, 27 bp, Artificial Sequence
  Description of Artificial Sequence: Synthetic oligonucleotide
gagctctactgactcccaacagagcgc

SEQ ID NO: 406696 - DNA, 27 bp, Artificial Sequence
  Description of Artificial Sequence: Synthetic oligonucleotide
agctctactgactcccaacagagcgcc

SEQ ID NO: 406697 - DNA, 26 bp, Artificial Sequence
  Description of Artificial Sequence: Synthetic oligonucleotide
gctctactgactcccaacagagcgcc

SEQ ID NO: 406698 - DNA, 27 bp, Artificial Sequence
  Description of Artificial Sequence: Synthetic oligonucleotide
ctctactgactcccaacagagcgccca

SEQ ID NO: 406699 - DNA, 28 bp, Artificial Sequence
  Description of Artificial Sequence: Synthetic oligonucleotide
tctactgactcccaacagagcgcccaag

SEQ ID NO: 406700 - DNA, 27 bp, Artificial Sequence
  Description of Artificial Sequence: Synthetic oligonucleotide
ctactgactcccaacagagcgcccaag

SEQ ID NO: 406701 - DNA, 29 bp, Artificial Sequence
  Description of Artificial Sequence: Synthetic oligonucleotide
tactgactcccaacagagcgcccaagaag

SEQ ID NO: 406702 - DNA, 28 bp, Artificial Sequence
  Description of Artificial Sequence: Synthetic oligonucleotide
actgactcccaacagagcgcccaagaag

SEQ ID NO: 406703 - DNA, 27 bp, Artificial Sequence
  Description of Artificial Sequence: Synthetic oligonucleotide
ctgactcccaacagagcgcccaagaag

SEQ ID NO: 406704 - DNA, 32 bp, Artificial Sequence
  Description of Artificial Sequence: Synthetic oligonucleotide
tgactcccaacagagcgcccaagaagaaaatg

SEQ ID NO: 406705 - DNA, 31 bp, Artificial Sequence
  Description of Artificial Sequence: Synthetic oligonucleotide
gactcccaacagagcgcccaagaagaaaatg

SEQ ID NO: 406706 - DNA, 31 bp, Artificial Sequence
  Description of Artificial Sequence: Synthetic oligonucleotide
actcccaacagagcgcccaagaagaaaatgg

SEQ ID NO: 406707 - DNA, 30 bp, Artificial Sequence
  Description of Artificial Sequence: Synthetic oligonucleotide
ctcccaacagagcgcccaagaagaaaatgg

SEQ ID NO: 406708 - DNA, 30 bp, Artificial Sequence
  Description of Artificial Sequence: Synthetic oligonucleotide
tcccaacagagcgcccaagaagaaaatggc

SEQ ID NO: 406709 - DNA, 29 bp, Artificial Sequence
  Description of Artificial Sequence: Synthetic oligonucleotide
cccaacagagcgcccaagaagaaaatggc

SEQ ID NO: 406710 - DNA, 29 bp, Artificial Sequence
  Description of Artificial Sequence: Synthetic oligonucleotide
ccaacagagcgcccaagaagaaaatggcc

SEQ ID NO: 406711 - DNA, 33 bp, Artificial Sequence
  Description of Artificial Sequence: Synthetic oligonucleotide
caacagagcgcccaagaagaaaatggccataag

SEQ ID NO: 406712 - DNA, 34 bp, Artificial Sequence
  Description of Artificial Sequence: Synthetic oligonucleotide
aacagagcgcccaagaagaaaatggccataagtg

SEQ ID NO: 406713 - DNA, 33 bp, Artificial Sequence
  Description of Artificial Sequence: Synthetic oligonucleotide
acagagcgcccaagaagaaaatggccataagtg

SEQ ID NO: 406714 - DNA, 32 bp, Artificial Sequence
  Description of Artificial Sequence: Synthetic oligonucleotide
cagagcgcccaagaagaaaatggccataagtg

SEQ ID NO: 406715 - DNA, 33 bp, Artificial Sequence; identical to SEQ ID NO: 62751
  Description of Artificial Sequence: Synthetic oligonucleotide

SEQ ID NO: 406716 - DNA, 32 bp, Artificial Sequence; identical to SEQ ID NO: 62752
  Description of Artificial Sequence: Synthetic oligonucleotide

SEQ ID NO: 406717 - DNA, 33 bp, Artificial Sequence; identical to SEQ ID NO: 62753
  Description of Artificial Sequence: Synthetic oligonucleotide

SEQ ID NO: 406718 - DNA, 32 bp, Artificial Sequence; identical to SEQ ID NO: 62754
  Description of Artificial Sequence: Synthetic oligonucleotide

SEQ ID NO: 406719 - DNA, 34 bp, Artificial Sequence; identical to SEQ ID NO: 62755
  Description of Artificial Sequence: Synthetic oligonucleotide

SEQ ID NO: 406720 - DNA, 33 bp, Artificial Sequence; identical to SEQ ID NO: 62756
  Description of Artificial Sequence: Synthetic oligonucleotide

SEQ ID NO: 406721 - DNA, 35 bp, Artificial Sequence; identical to SEQ ID NO: 62757
  Description of Artificial Sequence: Synthetic oligonucleotide

SEQ ID NO: 406722 - DNA, 34 bp, Artificial Sequence; identical to SEQ ID NO: 62758
  Description of Artificial Sequence: Synthetic oligonucleotide

SEQ ID NO: 406723 - DNA, 35 bp, Artificial Sequence; identical to SEQ ID NO: 62759
  Description of Artificial Sequence: Synthetic oligonucleotide

SEQ ID NO: 406724 - DNA, 35 bp, Artificial Sequence; identical to SEQ ID NO: 62760
  Description of Artificial Sequence: Synthetic oligonucleotide

SEQ ID NO: 406725 - DNA, 35 bp, Artificial Sequence; identical to SEQ ID NO: 62761
  Description of Artificial Sequence: Synthetic oligonucleotide

SEQ ID NO: 406726 - DNA, 35 bp, Artificial Sequence; identical to SEQ ID NO: 62762
  Description of Artificial Sequence: Synthetic oligonucleotide

SEQ ID NO: 406727 - DNA, 34 bp, Artificial Sequence; identical to SEQ ID NO: 62763
  Description of Artificial Sequence: Synthetic oligonucleotide

SEQ ID NO: 406728 - DNA, 33 bp, Artificial Sequence; identical to SEQ ID NO: 62764
  Description of Artificial Sequence: Synthetic oligonucleotide

SEQ ID NO: 406729 - DNA, 34 bp, Artificial Sequence; identical to SEQ ID NO: 62765
  Description of Artificial Sequence: Synthetic oligonucleotide

SEQ ID NO: 406730 - DNA, 34 bp, Artificial Sequence; identical to SEQ ID NO: 62766
  Description of Artificial Sequence: Synthetic oligonucleotide

SEQ ID NO: 406731 - DNA, 33 bp, Artificial Sequence; identical to SEQ ID NO: 62767
  Description of Artificial Sequence: Synthetic oligonucleotide

SEQ ID NO: 406732 - DNA, 34 bp, Artificial Sequence; identical to SEQ ID NO: 62768
  Description of Artificial Sequence: Synthetic oligonucleotide

SEQ ID NO: 406733 - DNA, 35 bp, Artificial Sequence; identical to SEQ ID NO: 62769
  Description of Artificial Sequence: Synthetic oligonucleotide

SEQ ID NO: 406734 - DNA, 34 bp, Artificial Sequence; identical to SEQ ID NO: 62770
  Description of Artificial Sequence: Synthetic oligonucleotide

SEQ ID NO: 406735 - DNA, 34 bp, Artificial Sequence; identical to SEQ ID NO: 62771
  Description of Artificial Sequence: Synthetic oligonucleotide

SEQ ID NO: 406736 - DNA, 33 bp, Artificial Sequence; identical to SEQ ID NO: 62772
  Description of Artificial Sequence: Synthetic oligonucleotide

SEQ ID NO: 406737 - DNA, 32 bp, Artificial Sequence; identical to SEQ ID NO: 62773
  Description of Artificial Sequence: Synthetic oligonucleotide

SEQ ID NO: 406738 - DNA, 33 bp, Artificial Sequence; identical to SEQ ID NO: 62774
  Description of Artificial Sequence: Synthetic oligonucleotide

SEQ ID NO: 406739 - DNA, 32 bp, Artificial Sequence; identical to SEQ ID NO: 62775
  Description of Artificial Sequence: Synthetic oligonucleotide

SEQ ID NO: 406740 - DNA, 35 bp, Artificial Sequence; identical to SEQ ID NO: 62776
  Description of Artificial Sequence: Synthetic oligonucleotide

SEQ ID NO: 406741 - DNA, 34 bp, Artificial Sequence; identical to SEQ ID NO: 62777
  Description of Artificial Sequence: Synthetic oligonucleotide

SEQ ID NO: 406742 - DNA, 33 bp, Artificial Sequence; identical to SEQ ID NO: 62778
  Description of Artificial Sequence: Synthetic oligonucleotide

SEQ ID NO: 406743 - DNA, 32 bp, Artificial Sequence; identical to SEQ ID NO: 62779
  Description of Artificial Sequence: Synthetic oligonucleotide

SEQ ID NO: 406744 - DNA, 33 bp, Artificial Sequence; identical to SEQ ID NO: 62780
  Description of Artificial Sequence: Synthetic oligonucleotide

SEQ ID NO: 406745 - DNA, 32 bp, Artificial Sequence; identical to SEQ ID NO: 62781
  Description of Artificial Sequence: Synthetic oligonucleotide

SEQ ID NO: 406746 - DNA, 31 bp, Artificial Sequence; identical to SEQ ID NO: 62782
  Description of Artificial Sequence: Synthetic oligonucleotide

SEQ ID NO: 406747 - DNA, 30 bp, Artificial Sequence
  Description of Artificial Sequence: Synthetic oligonucleotide
caagccctctcccagagactacagagaatg

SEQ ID NO: 406748 - DNA, 31 bp, Artificial Sequence
  Description of Artificial Sequence: Synthetic oligonucleotide
aagccctctcccagagactacagagaatgtg

SEQ ID NO: 406749 - DNA, 30 bp, Artificial Sequence
  Description of Artificial Sequence: Synthetic oligonucleotide
agccctctcccagagactacagagaatgtg

SEQ ID NO: 406750 - DNA, 29 bp, Artificial Sequence
  Description of Artificial Sequence: Synthetic oligonucleotide
gccctctcccagagactacagagaatgtg

SEQ ID NO: 406751 - DNA, 29 bp, Artificial Sequence
  Description of Artificial Sequence: Synthetic oligonucleotide
ccctctcccagagactacagagaatgtgg

SEQ ID NO: 406752 - DNA, 30 bp, Artificial Sequence
  Description of Artificial Sequence: Synthetic oligonucleotide
cctctcccagagactacagagaatgtggtg

SEQ ID NO: 406753 - DNA, 31 bp, Artificial Sequence
  Description of Artificial Sequence: Synthetic oligonucleotide
ctctcccagagactacagagaatgtggtgtg

SEQ ID NO: 406754 - DNA, 32 bp, Artificial Sequence
  Description of Artificial Sequence: Synthetic oligonucleotide
tctcccagagactacagagaatgtggtgtgtg

SEQ ID NO: 406755 - DNA, 31 bp, Artificial Sequence
  Description of Artificial Sequence: Synthetic oligonucleotide
ctcccagagactacagagaatgtggtgtgtg

SEQ ID NO: 406756 - DNA, 31 bp, Artificial Sequence
  Description of Artificial Sequence: Synthetic oligonucleotide
tcccagagactacagagaatgtggtgtgtgc

SEQ ID NO: 406757 - DNA, 30 bp, Artificial Sequence
  Description of Artificial Sequence: Synthetic oligonucleotide
cccagagactacagagaatgtggtgtgtgc

SEQ ID NO: 406758 - DNA, 30 bp, Artificial Sequence
  Description of Artificial Sequence: Synthetic oligonucleotide
ccagagactacagagaatgtggtgtgtgcc

SEQ ID NO: 406759 - DNA, 30 bp, Artificial Sequence
  Description of Artificial Sequence: Synthetic oligonucleotide
cagagactacagagaatgtggtgtgtgccc

SEQ ID NO: 406760 - DNA, 31 bp, Artificial Sequence
  Description of Artificial Sequence: Synthetic oligonucleotide
agagactacagagaatgtggtgtgtgccctg

SEQ ID NO: 406761 - DNA, 30 bp, Artificial Sequence
  Description of Artificial Sequence: Synthetic oligonucleotide
gagactacagagaatgtggtgtgtgccctg

SEQ ID NO: 406762 - DNA, 30 bp, Artificial Sequence
  Description of Artificial Sequence: Synthetic oligonucleotide
agactacagagaatgtggtgtgtgccctgg

SEQ ID NO: 406763 - DNA, 29 bp, Artificial Sequence
  Description of Artificial Sequence: Synthetic oligonucleotide
gactacagagaatgtggtgtgtgccctgg

SEQ ID NO: 406764 - DNA, 29 bp, Artificial Sequence
  Description of Artificial Sequence: Synthetic oligonucleotide
actacagagaatgtggtgtgtgccctggg

SEQ ID NO: 406765 - DNA, 28 bp, Artificial Sequence
  Description of Artificial Sequence: Synthetic oligonucleotide
ctacagagaatgtggtgtgtgccctggg

SEQ ID NO: 406766 - DNA, 28 bp, Artificial Sequence
  Description of Artificial Sequence: Synthetic oligonucleotide
tacagagaatgtggtgtgtgccctgggc

SEQ ID NO: 406767 - DNA, 27 bp, Artificial Sequence
  Description of Artificial Sequence: Synthetic oligonucleotide
acagagaatgtggtgtgtgccctgggc

SEQ ID NO: 406768 - DNA, 26 bp, Artificial Sequence
  Description of Artificial Sequence: Synthetic oligonucleotide
cagagaatgtggtgtgtgccctgggc

SEQ ID NO: 406769 - DNA, 27 bp, Artificial Sequence
  Description of Artificial Sequence: Synthetic oligonucleotide
agagaatgtggtgtgtgccctgggcct

SEQ ID NO: 406770 - DNA, 26 bp, Artificial Sequence
  Description of Artificial Sequence: Synthetic oligonucleotide
gagaatgtggtgtgtgccctgggcct

SEQ ID NO: 406771 - DNA, 27 bp, Artificial Sequence
  Description of Artificial Sequence: Synthetic oligonucleotide
agaatgtggtgtgtgccctgggcctga

SEQ ID NO: 406772 - DNA, 26 bp, Artificial Sequence
  Description of Artificial Sequence: Synthetic oligonucleotide
gaatgtggtgtgtgccctgggcctga

SEQ ID NO: 406773 - DNA, 27 bp, Artificial Sequence
  Description of Artificial Sequence: Synthetic oligonucleotide
aatgtggtgtgtgccctgggcctgact

SEQ ID NO: 406774 - DNA, 26 bp, Artificial Sequence
  Description of Artificial Sequence: Synthetic oligonucleotide
atgtggtgtgtgccctgggcctgact

SEQ ID NO: 406775 - DNA, 25 bp, Artificial Sequence
  Description of Artificial Sequence: Synthetic oligonucleotide
tgtggtgtgtgccctgggcctgact

SEQ ID NO: 406776 - DNA, 38 bp, Artificial Sequence; identical to SEQ ID NO: 62715
  Description of Artificial Sequence: Synthetic oligonucleotide

SEQ ID NO: 406777 - DNA, 38 bp, Artificial Sequence; identical to SEQ ID NO: 62716
  Description of Artificial Sequence: Synthetic oligonucleotide

SEQ ID NO: 406778 - DNA, 38 bp, Artificial Sequence; identical to SEQ ID NO: 62717
  Description of Artificial Sequence: Synthetic oligonucleotide

SEQ ID NO: 406779 - DNA, 37 bp, Artificial Sequence; identical to SEQ ID NO: 62718
  Description of Artificial Sequence: Synthetic oligonucleotide

SEQ ID NO: 406780 - DNA, 36 bp, Artificial Sequence; identical to SEQ ID NO: 62719
  Description of Artificial Sequence: Synthetic oligonucleotide

SEQ ID NO: 406781 - DNA, 36 bp, Artificial Sequence; identical to SEQ ID NO: 62720
  Description of Artificial Sequence: Synthetic oligonucleotide

SEQ ID NO: 406782 - DNA, 35 bp, Artificial Sequence; identical to SEQ ID NO: 62721
  Description of Artificial Sequence: Synthetic oligonucleotide

SEQ ID NO: 406783 - DNA, 34 bp, Artificial Sequence; identical to SEQ ID NO: 62722
  Description of Artificial Sequence: Synthetic oligonucleotide

SEQ ID NO: 406784 - DNA, 33 bp, Artificial Sequence; identical to SEQ ID NO: 62723
  Description of Artificial Sequence: Synthetic oligonucleotide

SEQ ID NO: 406785 - DNA, 32 bp, Artificial Sequence; identical to SEQ ID NO: 62724
  Description of Artificial Sequence: Synthetic oligonucleotide

SEQ ID NO: 406786 - DNA, 31 bp, Artificial Sequence; identical to SEQ ID NO: 62725
  Description of Artificial Sequence: Synthetic oligonucleotide

SEQ ID NO: 406787 - DNA, 30 bp, Artificial Sequence; identical to SEQ ID NO: 62726
  Description of Artificial Sequence: Synthetic oligonucleotide

SEQ ID NO: 406788 - DNA, 34 bp, Artificial Sequence; identical to SEQ ID NO: 62727
  Description of Artificial Sequence: Synthetic oligonucleotide

SEQ ID NO: 406789 - DNA, 34 bp, Artificial Sequence; identical to SEQ ID NO: 62728
  Description of Artificial Sequence: Synthetic oligonucleotide

SEQ ID NO: 406790 - DNA, 37 bp, Artificial Sequence; identical to SEQ ID NO: 62729
  Description of Artificial Sequence: Synthetic oligonucleotide

SEQ ID NO: 406791 - DNA, 36 bp, Artificial Sequence; identical to SEQ ID NO: 62730
  Description of Artificial Sequence: Synthetic oligonucleotide

SEQ ID NO: 406792 - DNA, 36 bp, Artificial Sequence; identical to SEQ ID NO: 62731
  Description of Artificial Sequence: Synthetic oligonucleotide

SEQ ID NO: 406793 - DNA, 37 bp, Artificial Sequence; identical to SEQ ID NO: 62732
  Description of Artificial Sequence: Synthetic oligonucleotide

SEQ ID NO: 406794 - DNA, 36 bp, Artificial Sequence; identical to SEQ ID NO: 62733
  Description of Artificial Sequence: Synthetic oligonucleotide

SEQ ID NO: 406795 - DNA, 35 bp, Artificial Sequence; identical to SEQ ID NO: 62734
  Description of Artificial Sequence: Synthetic oligonucleotide

SEQ ID NO: 406796 - DNA, 35 bp, Artificial Sequence; identical to SEQ ID NO: 62735
  Description of Artificial Sequence: Synthetic oligonucleotide

SEQ ID NO: 406797 - DNA, 34 bp, Artificial Sequence; identical to SEQ ID NO: 62736
  Description of Artificial Sequence: Synthetic oligonucleotide

SEQ ID NO: 406798 - DNA, 33 bp, Artificial Sequence; identical to SEQ ID NO: 62737
  Description of Artificial Sequence: Synthetic oligonucleotide

SEQ ID NO: 406799 - DNA, 34 bp, Artificial Sequence; identical to SEQ ID NO: 62738
  Description of Artificial Sequence: Synthetic oligonucleotide

SEQ ID NO: 406800 - DNA, 33 bp, Artificial Sequence; identical to SEQ ID NO: 62739
  Description of Artificial Sequence: Synthetic oligonucleotide

SEQ ID NO: 406801 - DNA, 32 bp, Artificial Sequence; identical to SEQ ID NO: 62740
  Description of Artificial Sequence: Synthetic oligonucleotide

SEQ ID NO: 406802 - DNA, 34 bp, Artificial Sequence; identical to SEQ ID NO: 62741
  Description of Artificial Sequence: Synthetic oligonucleotide

SEQ ID NO: 406803 - DNA, 33 bp, Artificial Sequence; identical to SEQ ID NO: 62742
  Description of Artificial Sequence: Synthetic oligonucleotide

SEQ ID NO: 406804 - DNA, 32 bp, Artificial Sequence; identical to SEQ ID NO: 62743
  Description of Artificial Sequence: Synthetic oligonucleotide

SEQ ID NO: 406805 - DNA, 32 bp, Artificial Sequence; identical to SEQ ID NO: 62744
  Description of Artificial Sequence: Synthetic oligonucleotide

SEQ ID NO: 406806 - DNA, 31 bp, Artificial Sequence; identical to SEQ ID NO: 62745
  Description of Artificial Sequence: Synthetic oligonucleotide

SEQ ID NO: 406807 - DNA, 30 bp, Artificial Sequence; identical to SEQ ID NO: 62746
  Description of Artificial Sequence: Synthetic oligonucleotide

SEQ ID NO: 406808 - DNA, 30 bp, Artificial Sequence; identical to SEQ ID NO: 62747
  Description of Artificial Sequence: Synthetic oligonucleotide

SEQ ID NO: 406809 - DNA, 31 bp, Artificial Sequence; identical to SEQ ID NO: 62748
  Description of Artificial Sequence: Synthetic oligonucleotide

SEQ ID NO: 406810 - DNA, 31 bp, Artificial Sequence; identical to SEQ ID NO: 62749
  Description of Artificial Sequence: Synthetic oligonucleotide

SEQ ID NO: 406811 - DNA, 30 bp, Artificial Sequence; identical to SEQ ID NO: 62750
  Description of Artificial Sequence: Synthetic oligonucleotide

SEQ ID NO: 406812 - DNA, 38 bp, Artificial Sequence
  Description of Artificial Sequence: Synthetic oligonucleotide
tcactaatgtgcttcaggtatatccctgtctagaactc

SEQ ID NO: 406813 - DNA, 37 bp, Artificial Sequence
  Description of Artificial Sequence: Synthetic oligonucleotide
cactaatgtgcttcaggtatatccctgtctagaactc

SEQ ID NO: 406814 - DNA, 38 bp, Artificial Sequence
  Description of Artificial Sequence: Synthetic oligonucleotide
actaatgtgcttcaggtatatccctgtctagaactcag

SEQ ID NO: 406815 - DNA, 37 bp, Artificial Sequence
  Description of Artificial Sequence: Synthetic oligonucleotide
ctaatgtgcttcaggtatatccctgtctagaactcag

SEQ ID NO: 406816 - DNA, 40 bp, Artificial Sequence
  Description of Artificial Sequence: Synthetic oligonucleotide
taatgtgcttcaggtatatccctgtctagaactcagattg

SEQ ID NO: 406817 - DNA, 39 bp, Artificial Sequence
  Description of Artificial Sequence: Synthetic oligonucleotide
aatgtgcttcaggtatatccctgtctagaactcagattg

SEQ ID NO: 406818 - DNA, 38 bp, Artificial Sequence
  Description of Artificial Sequence: Synthetic oligonucleotide
atgtgcttcaggtatatccctgtctagaactcagattg

SEQ ID NO: 406819 - DNA, 37 bp, Artificial Sequence
  Description of Artificial Sequence: Synthetic oligonucleotide
tgtgcttcaggtatatccctgtctagaactcagattg

SEQ ID NO: 406820 - DNA, 36 bp, Artificial Sequence
  Description of Artificial Sequence: Synthetic oligonucleotide
gtgcttcaggtatatccctgtctagaactcagattg

SEQ ID NO: 406821 - DNA, 36 bp, Artificial Sequence
  Description of Artificial Sequence: Synthetic oligonucleotide
tgcttcaggtatatccctgtctagaactcagattgg

SEQ ID NO: 406822 - DNA, 35 bp, Artificial Sequence
  Description of Artificial Sequence: Synthetic oligonucleotide
gcttcaggtatatccctgtctagaactcagattgg

SEQ ID NO: 406823 - DNA, 35 bp, Artificial Sequence
  Description of Artificial Sequence: Synthetic oligonucleotide
cttcaggtatatccctgtctagaactcagattggg

SEQ ID NO: 406824 - DNA, 35 bp, Artificial Sequence
  Description of Artificial Sequence: Synthetic oligonucleotide
ttcaggtatatccctgtctagaactcagattgggg

SEQ ID NO: 406825 - DNA, 34 bp, Artificial Sequence
  Description of Artificial Sequence: Synthetic oligonucleotide
tcaggtatatccctgtctagaactcagattgggg

SEQ ID NO: 406826 - DNA, 33 bp, Artificial Sequence
  Description of Artificial Sequence: Synthetic oligonucleotide
caggtatatccctgtctagaactcagattgggg

SEQ ID NO: 406827 - DNA, 38 bp, Artificial Sequence
  Description of Artificial Sequence: Synthetic oligonucleotide
aggtatatccctgtctagaactcagattggggttaaag

SEQ ID NO: 406828 - DNA, 37 bp, Artificial Sequence
  Description of Artificial Sequence: Synthetic oligonucleotide
ggtatatccctgtctagaactcagattggggttaaag

SEQ ID NO: 406829 - DNA, 38 bp, Artificial Sequence
  Description of Artificial Sequence: Synthetic oligonucleotide
gtatatccctgtctagaactcagattggggttaaagag

SEQ ID NO: 406830 - DNA, 39 bp, Artificial Sequence
  Description of Artificial Sequence: Synthetic oligonucleotide
tatatccctgtctagaactcagattggggttaaagagtc

SEQ ID NO: 406831 - DNA, 38 bp, Artificial Sequence
  Description of Artificial Sequence: Synthetic oligonucleotide
atatccctgtctagaactcagattggggttaaagagtc

SEQ ID NO: 406832 - DNA, 37 bp, Artificial Sequence
  Description of Artificial Sequence: Synthetic oligonucleotide
tatccctgtctagaactcagattggggttaaagagtc

SEQ ID NO: 406833 - DNA, 36 bp, Artificial Sequence
  Description of Artificial Sequence: Synthetic oligonucleotide
atccctgtctagaactcagattggggttaaagagtc

SEQ ID NO: 406834 - DNA, 35 bp, Artificial Sequence
  Description of Artificial Sequence: Synthetic oligonucleotide
tccctgtctagaactcagattggggttaaagagtc

SEQ ID NO: 406835 - DNA, 34 bp, Artificial Sequence
  Description of Artificial Sequence: Synthetic oligonucleotide
ccctgtctagaactcagattggggttaaagagtc

SEQ ID NO: 406836 - DNA, 35 bp, Artificial Sequence
  Description of Artificial Sequence: Synthetic oligonucleotide
cctgtctagaactcagattggggttaaagagtctg

SEQ ID NO: 406837 - DNA, 36 bp, Artificial Sequence
  Description of Artificial Sequence: Synthetic oligonucleotide
ctgtctagaactcagattggggttaaagagtctgtc

SEQ ID NO: 406838 - DNA, 36 bp, Artificial Sequence
  Description of Artificial Sequence: Synthetic oligonucleotide
tgtctagaactcagattggggttaaagagtctgtcc

SEQ ID NO: 406839 - DNA, 35 bp, Artificial Sequence
  Description of Artificial Sequence: Synthetic oligonucleotide
gtctagaactcagattggggttaaagagtctgtcc

SEQ ID NO: 406840 - DNA, 35 bp, Artificial Sequence
  Description of Artificial Sequence: Synthetic oligonucleotide
tctagaactcagattggggttaaagagtctgtccg

SEQ ID NO: 406841 - DNA, 34 bp, Artificial Sequence
  Description of Artificial Sequence: Synthetic oligonucleotide
ctagaactcagattggggttaaagagtctgtccg

SEQ ID NO: 406842 - DNA, 35 bp, Artificial Sequence
  Description of Artificial Sequence: Synthetic oligonucleotide
tagaactcagattggggttaaagagtctgtccgtc

SEQ ID NO: 406843 - DNA, 34 bp, Artificial Sequence
  Description of Artificial Sequence: Synthetic oligonucleotide
agaactcagattggggttaaagagtctgtccgtc

SEQ ID NO: 406844 - DNA, 33 bp, Artificial Sequence
  Description of Artificial Sequence: Synthetic oligonucleotide
gaactcagattggggttaaagagtctgtccgtc

SEQ ID NO: 406845 - DNA, 36 bp, Artificial Sequence
  Description of Artificial Sequence: Synthetic oligonucleotide
aactcagattggggttaaagagtctgtccgtcattg

SEQ ID NO: 406846 - DNA, 35 bp, Artificial Sequence
  Description of Artificial Sequence: Synthetic oligonucleotide
actcagattggggttaaagagtctgtccgtcattg

SEQ ID NO: 406847 - DNA, 34 bp, Artificial Sequence
  Description of Artificial Sequence: Synthetic oligonucleotide
ctcagattggggttaaagagtctgtccgtcattg

SEQ ID NO: 406848 - DNA, 35 bp, Artificial Sequence
  Description of Artificial Sequence: Synthetic oligonucleotide
tcagattggggttaaagagtctgtccgtcattgac

SEQ ID NO: 406849 - DNA, 34 bp, Artificial Sequence
  Description of Artificial Sequence: Synthetic oligonucleotide
cagattggggttaaagagtctgtccgtcattgac

SEQ ID NO: 406850 - DNA, 34 bp, Artificial Sequence
  Description of Artificial Sequence: Synthetic oligonucleotide
agattggggttaaagagtctgtccgtcattgacc

SEQ ID NO: 406851 - DNA, 33 bp, Artificial Sequence
  Description of Artificial Sequence: Synthetic oligonucleotide
gattggggttaaagagtctgtccgtcattgacc

SEQ ID NO: 406852 - DNA, 35 bp, Artificial Sequence
  Description of Artificial Sequence: Synthetic oligonucleotide
attggggttaaagagtctgtccgtcattgaccaac

SEQ ID NO: 406853 - DNA, 34 bp, Artificial Sequence
  Description of Artificial Sequence: Synthetic oligonucleotide
ttggggttaaagagtctgtccgtcattgaccaac

SEQ ID NO: 406854 - DNA, 33 bp, Artificial Sequence
  Description of Artificial Sequence: Synthetic oligonucleotide
tggggttaaagagtctgtccgtcattgaccaac

SEQ ID NO: 406855 - DNA, 32 bp, Artificial Sequence
  Description of Artificial Sequence: Synthetic oligonucleotide
ggggttaaagagtctgtccgtcattgaccaac

SEQ ID NO: 406856 - DNA, 33 bp, Artificial Sequence
  Description of Artificial Sequence: Synthetic oligonucleotide
gggttaaagagtctgtccgtcattgaccaacag

SEQ ID NO: 406857 - DNA, 34 bp, Artificial Sequence
  Description of Artificial Sequence: Synthetic oligonucleotide
ggttaaagagtctgtccgtcattgaccaacagtc

SEQ ID NO: 406858 - DNA, 41 bp, Artificial Sequence
  Description of Artificial Sequence: Synthetic oligonucleotide
gttaaagagtctgtccgtcattgaccaacagtcttaaatac

SEQ ID NO: 406859 - DNA, 43 bp, Artificial Sequence
  Description of Artificial Sequence: Synthetic oligonucleotide
ttaaagagtctgtccgtcattgaccaacagtcttaaatacttg

SEQ ID NO: 406860 - DNA, 42 bp, Artificial Sequence
  Description of Artificial Sequence: Synthetic oligonucleotide
taaagagtctgtccgtcattgaccaacagtcttaaatacttg

SEQ ID NO: 406861 - DNA, 41 bp, Artificial Sequence
  Description of Artificial Sequence: Synthetic oligonucleotide
aaagagtctgtccgtcattgaccaacagtcttaaatacttg

SEQ ID NO: 406862 - DNA, 40 bp, Artificial Sequence
  Description of Artificial Sequence: Synthetic oligonucleotide
aagagtctgtccgtcattgaccaacagtcttaaatacttg

SEQ ID NO: 406863 - DNA, 39 bp, Artificial Sequence
  Description of Artificial Sequence: Synthetic oligonucleotide
agagtctgtccgtcattgaccaacagtcttaaatacttg

SEQ ID NO: 406864 - DNA, 38 bp, Artificial Sequence
  Description of Artificial Sequence: Synthetic oligonucleotide
gagtctgtccgtcattgaccaacagtcttaaatacttg

SEQ ID NO: 406865 - DNA, 42 bp, Artificial Sequence
  Description of Artificial Sequence: Synthetic oligonucleotide
agtctgtccgtcattgaccaacagtcttaaatacttgatttg

SEQ ID NO: 406866 - DNA, 41 bp, Artificial Sequence
  Description of Artificial Sequence: Synthetic oligonucleotide
gtctgtccgtcattgaccaacagtcttaaatacttgatttg

SEQ ID NO: 406867 - DNA, 43 bp, Artificial Sequence
  Description of Artificial Sequence: Synthetic oligonucleotide
tctgtccgtcattgaccaacagtcttaaatacttgatttgttg

SEQ ID NO: 406868 - DNA, 42 bp, Artificial Sequence
  Description of Artificial Sequence: Synthetic oligonucleotide
ctgtccgtcattgaccaacagtcttaaatacttgatttgttg

SEQ ID NO: 406869 - DNA, 43 bp, Artificial Sequence
  Description of Artificial Sequence: Synthetic oligonucleotide
tgtccgtcattgaccaacagtcttaaatacttgatttgttgtc

SEQ ID NO: 406870 - DNA, 42 bp, Artificial Sequence
  Description of Artificial Sequence: Synthetic oligonucleotide
gtccgtcattgaccaacagtcttaaatacttgatttgttgtc

SEQ ID NO: 406871 - DNA, 42 bp, Artificial Sequence
  Description of Artificial Sequence: Synthetic oligonucleotide
tccgtcattgaccaacagtcttaaatacttgatttgttgtcg

SEQ ID NO: 406872 - DNA, 41 bp, Artificial Sequence
  Description of Artificial Sequence: Synthetic oligonucleotide
ccgtcattgaccaacagtcttaaatacttgatttgttgtcg

SEQ ID NO: 406873 - DNA, 43 bp, Artificial Sequence
  Description of Artificial Sequence: Synthetic oligonucleotide
cgtcattgaccaacagtcttaaatacttgatttgttgtcgttg

SEQ ID NO: 406874 - DNA, 45 bp, Artificial Sequence
  Description of Artificial Sequence: Synthetic oligonucleotide
gtcattgaccaacagtcttaaatacttgatttgttgtcgttgttg

SEQ ID NO: 406875 - DNA, 46 bp, Artificial Sequence
  Description of Artificial Sequence: Synthetic oligonucleotide
tcattgaccaacagtcttaaatacttgatttgttgtcgttgttgtc

SEQ ID NO: 406876 - DNA, 45 bp, Artificial Sequence
  Description of Artificial Sequence: Synthetic oligonucleotide
cattgaccaacagtcttaaatacttgatttgttgtcgttgttgtc

SEQ ID NO: 406877 - DNA, 45 bp, Artificial Sequence
  Description of Artificial Sequence: Synthetic oligonucleotide
attgaccaacagtcttaaatacttgatttgttgtcgttgttgtcc

SEQ ID NO: 406878 - DNA, 44 bp, Artificial Sequence
  Description of Artificial Sequence: Synthetic oligonucleotide
ttgaccaacagtcttaaatacttgatttgttgtcgttgttgtcc

SEQ ID NO: 406879 - DNA, 43 bp, Artificial Sequence
  Description of Artificial Sequence: Synthetic oligonucleotide
tgaccaacagtcttaaatacttgatttgttgtcgttgttgtcc

SEQ ID NO: 406880 - DNA, 42 bp, Artificial Sequence
  Description of Artificial Sequence: Synthetic oligonucleotide
gaccaacagtcttaaatacttgatttgttgtcgttgttgtcc

SEQ ID NO: 406881 - DNA, 43 bp, Artificial Sequence
  Description of Artificial Sequence: Synthetic oligonucleotide
accaacagtcttaaatacttgatttgttgtcgttgttgtcctg

SEQ ID NO: 406882 - DNA, 42 bp, Artificial Sequence
  Description of Artificial Sequence: Synthetic oligonucleotide
ccaacagtcttaaatacttgatttgttgtcgttgttgtcctg

SEQ ID NO: 406883 - DNA, 45 bp, Artificial Sequence
  Description of Artificial Sequence: Synthetic oligonucleotide
caacagtcttaaatacttgatttgttgtcgttgttgtcctgtttg

SEQ ID NO: 406884 - DNA, 50 bp, Artificial Sequence
  Description of Artificial Sequence: Synthetic oligonucleotide
aacagtcttaaatacttgatttgttgtcgttgttgtcctgtttgtttaag

SEQ ID NO: 406885 - DNA, 49 bp, Artificial Sequence
  Description of Artificial Sequence: Synthetic oligonucleotide
acagtcttaaatacttgatttgttgtcgttgttgtcctgtttgtttaag

SEQ ID NO: 406886 - DNA, 48 bp, Artificial Sequence
  Description of Artificial Sequence: Synthetic oligonucleotide
cagtcttaaatacttgatttgttgtcgttgttgtcctgtttgtttaag

SEQ ID NO: 406887 - DNA, 50 bp, Artificial Sequence
  Description of Artificial Sequence: Synthetic oligonucleotide
agtcttaaatacttgatttgttgtcgttgttgtcctgtttgtttaagaac

SEQ ID NO: 406888 - DNA, 49 bp, Artificial Sequence
  Description of Artificial Sequence: Synthetic oligonucleotide
gtcttaaatacttgatttgttgtcgttgttgtcctgtttgtttaagaac

SEQ ID NO: 406889 - DNA, 53 bp, Artificial Sequence
  Description of Artificial Sequence: Synthetic oligonucleotide
tcttaaatacttgatttgttgtcgttgttgtcctgtttgtttaagaactttac

SEQ ID NO: 406890 - DNA, 52 bp, Artificial Sequence
  Description of Artificial Sequence: Synthetic oligonucleotide
cttaaatacttgatttgttgtcgttgttgtcctgtttgtttaagaactttac

SEQ ID NO: 406891 - DNA, 54 bp, Artificial Sequence
  Description of Artificial Sequence: Synthetic oligonucleotide
ttaaatacttgatttgttgtcgttgttgtcctgtttgtttaagaactttacttc

SEQ ID NO: 406892 - DNA, 53 bp, Artificial Sequence
  Description of Artificial Sequence: Synthetic oligonucleotide
taaatacttgatttgttgtcgttgttgtcctgtttgtttaagaactttacttc

SEQ ID NO: 406893 - DNA, 52 bp, Artificial Sequence
  Description of Artificial Sequence: Synthetic oligonucleotide
aaatacttgatttgttgtcgttgttgtcctgtttgtttaagaactttacttc

SEQ ID NO: 406894 - DNA, 51 bp, Artificial Sequence
  Description of Artificial Sequence: Synthetic oligonucleotide
aatacttgatttgttgtcgttgttgtcctgtttgtttaagaactttacttc

SEQ ID NO: 406895 - DNA, 50 bp, Artificial Sequence
  Description of Artificial Sequence: Synthetic oligonucleotide
atacttgatttgttgtcgttgttgtcctgtttgtttaagaactttacttc

SEQ ID NO: 406896 - DNA, 49 bp, Artificial Sequence
  Description of Artificial Sequence: Synthetic oligonucleotide
tacttgatttgttgtcgttgttgtcctgtttgtttaagaactttacttc

SEQ ID NO: 406897 - DNA, 48 bp, Artificial Sequence
  Description of Artificial Sequence: Synthetic oligonucleotide
acttgatttgttgtcgttgttgtcctgtttgtttaagaactttacttc

SEQ ID NO: 406898 - DNA, 47 bp, Artificial Sequence
  Description of Artificial Sequence: Synthetic oligonucleotide
cttgatttgttgtcgttgttgtcctgtttgtttaagaactttacttc

SEQ ID NO: 406899 - DNA, 52 bp, Artificial Sequence
  Description of Artificial Sequence: Synthetic oligonucleotide
ttgatttgttgtcgttgttgtcctgtttgtttaagaactttacttctttatc

SEQ ID NO: 406900 - DNA, 51 bp, Artificial Sequence
  Description of Artificial Sequence: Synthetic oligonucleotide
tgatttgttgtcgttgttgtcctgtttgtttaagaactttacttctttatc

SEQ ID NO: 406901 - DNA, 50 bp, Artificial Sequence
  Description of Artificial Sequence: Synthetic oligonucleotide
gatttgttgtcgttgttgtcctgtttgtttaagaactttacttctttatc

SEQ ID NO: 406902 - DNA, 50 bp, Artificial Sequence
  Description of Artificial Sequence: Synthetic oligonucleotide
atttgttgtcgttgttgtcctgtttgtttaagaactttacttctttatcc

SEQ ID NO: 406903 - DNA, 49 bp, Artificial Sequence
  Description of Artificial Sequence: Synthetic oligonucleotide
tttgttgtcgttgttgtcctgtttgtttaagaactttacttctttatcc

SEQ ID NO: 406904 - DNA, 48 bp, Artificial Sequence
  Description of Artificial Sequence: Synthetic oligonucleotide
ttgttgtcgttgttgtcctgtttgtttaagaactttacttctttatcc

SEQ ID NO: 406905 - DNA, 47 bp, Artificial Sequence
  Description of Artificial Sequence: Synthetic oligonucleotide
tgttgtcgttgttgtcctgtttgtttaagaactttacttctttatcc

SEQ ID NO: 406906 - DNA, 46 bp, Artificial Sequence
  Description of Artificial Sequence: Synthetic oligonucleotide
gttgtcgttgttgtcctgtttgtttaagaactttacttctttatcc

SEQ ID NO: 406907 - DNA, 49 bp, Artificial Sequence
  Description of Artificial Sequence: Synthetic oligonucleotide
ttgtcgttgttgtcctgtttgtttaagaactttacttctttatccaatg

SEQ ID NO: 406908 - DNA, 48 bp, Artificial Sequence
  Description of Artificial Sequence: Synthetic oligonucleotide
tgtcgttgttgtcctgtttgtttaagaactttacttctttatccaatg

SEQ ID NO: 406909 - DNA, 47 bp, Artificial Sequence
  Description of Artificial Sequence: Synthetic oligonucleotide
gtcgttgttgtcctgtttgtttaagaactttacttctttatccaatg

SEQ ID NO: 406910 - DNA, 49 bp, Artificial Sequence
  Description of Artificial Sequence: Synthetic oligonucleotide
tcgttgttgtcctgtttgtttaagaactttacttctttatccaatgaac

SEQ ID NO: 406911 - DNA, 48 bp, Artificial Sequence
  Description of Artificial Sequence: Synthetic oligonucleotide
cgttgttgtcctgtttgtttaagaactttacttctttatccaatgaac

SEQ ID NO: 406912 - DNA, 34 bp, Artificial Sequence
  Description of Artificial Sequence: Synthetic oligonucleotide
caatgtacctccagaggtaactgtgctcacaaac

SEQ ID NO: 406913 - DNA, 35 bp, Artificial Sequence
  Description of Artificial Sequence: Synthetic oligonucleotide
aatgtacctccagaggtaactgtgctcacaaacag

SEQ ID NO: 406914 - DNA, 34 bp, Artificial Sequence
  Description of Artificial Sequence: Synthetic oligonucleotide
atgtacctccagaggtaactgtgctcacaaacag

SEQ ID NO: 406915 - DNA, 33 bp, Artificial Sequence
  Description of Artificial Sequence: Synthetic oligonucleotide
tgtacctccagaggtaactgtgctcacaaacag

SEQ ID NO: 406916 - DNA, 32 bp, Artificial Sequence
  Description of Artificial Sequence: Synthetic oligonucleotide
gtacctccagaggtaactgtgctcacaaacag

SEQ ID NO: 406917 - DNA, 32 bp, Artificial Sequence
  Description of Artificial Sequence: Synthetic oligonucleotide
tacctccagaggtaactgtgctcacaaacagc

SEQ ID NO: 406918 - DNA, 31 bp, Artificial Sequence
  Description of Artificial Sequence: Synthetic oligonucleotide
acctccagaggtaactgtgctcacaaacagc

SEQ ID NO: 406919 - DNA, 30 bp, Artificial Sequence
  Description of Artificial Sequence: Synthetic oligonucleotide
cctccagaggtaactgtgctcacaaacagc

SEQ ID NO: 406920 - DNA, 30 bp, Artificial Sequence
  Description of Artificial Sequence: Synthetic oligonucleotide
ctccagaggtaactgtgctcacaaacagcc

SEQ ID NO: 406921 - DNA, 30 bp, Artificial Sequence
  Description of Artificial Sequence: Synthetic oligonucleotide
tccagaggtaactgtgctcacaaacagccc

SEQ ID NO: 406922 - DNA, 29 bp, Artificial Sequence
  Description of Artificial Sequence: Synthetic oligonucleotide
ccagaggtaactgtgctcacaaacagccc

SEQ ID NO: 406923 - DNA, 30 bp, Artificial Sequence
  Description of Artificial Sequence: Synthetic oligonucleotide
cagaggtaactgtgctcacaaacagccctg

SEQ ID NO: 406924 - DNA, 31 bp, Artificial Sequence
  Description of Artificial Sequence: Synthetic oligonucleotide
agaggtaactgtgctcacaaacagccctgtg

SEQ ID NO: 406925 - DNA, 30 bp, Artificial Sequence
  Description of Artificial Sequence: Synthetic oligonucleotide
gaggtaactgtgctcacaaacagccctgtg

SEQ ID NO: 406926 - DNA, 30 bp, Artificial Sequence
  Description of Artificial Sequence: Synthetic oligonucleotide
aggtaactgtgctcacaaacagccctgtgg

SEQ ID NO: 406927 - DNA, 29 bp, Artificial Sequence
  Description of Artificial Sequence: Synthetic oligonucleotide
ggtaactgtgctcacaaacagccctgtgg

SEQ ID NO: 406928 - DNA, 31 bp, Artificial Sequence
  Description of Artificial Sequence: Synthetic oligonucleotide
gtaactgtgctcacaaacagccctgtggaac

SEQ ID NO: 406929 - DNA, 32 bp, Artificial Sequence
  Description of Artificial Sequence: Synthetic oligonucleotide
taactgtgctcacaaacagccctgtggaactg

SEQ ID NO: 406930 - DNA, 31 bp, Artificial Sequence
  Description of Artificial Sequence: Synthetic oligonucleotide
aactgtgctcacaaacagccctgtggaactg

SEQ ID NO: 406931 - DNA, 30 bp, Artificial Sequence
  Description of Artificial Sequence: Synthetic oligonucleotide
actgtgctcacaaacagccctgtggaactg

SEQ ID NO: 406932 - DNA, 29 bp, Artificial Sequence
  Description of Artificial Sequence: Synthetic oligonucleotide
ctgtgctcacaaacagccctgtggaactg

SEQ ID NO: 406933 - DNA, 30 bp, Artificial Sequence
  Description of Artificial Sequence: Synthetic oligonucleotide
tgtgctcacaaacagccctgtggaactgag

SEQ ID NO: 406934 - DNA, 29 bp, Artificial Sequence
  Description of Artificial Sequence: Synthetic oligonucleotide
gtgctcacaaacagccctgtggaactgag

SEQ ID NO: 406935 - DNA, 30 bp, Artificial Sequence
  Description of Artificial Sequence: Synthetic oligonucleotide
tgctcacaaacagccctgtggaactgagag

SEQ ID NO: 406936 - DNA, 29 bp, Artificial Sequence
  Description of Artificial Sequence: Synthetic oligonucleotide
gctcacaaacagccctgtggaactgagag

SEQ ID NO: 406937 - DNA, 30 bp, Artificial Sequence
  Description of Artificial Sequence: Synthetic oligonucleotide
ctcacaaacagccctgtggaactgagagag

SEQ ID NO: 406938 - DNA, 30 bp, Artificial Sequence
  Description of Artificial Sequence: Synthetic oligonucleotide
tcacaaacagccctgtggaactgagagagc

SEQ ID NO: 406939 - DNA, 29 bp, Artificial Sequence
  Description of Artificial Sequence: Synthetic oligonucleotide
cacaaacagccctgtggaactgagagagc

SEQ ID NO: 406940 - DNA, 29 bp, Artificial Sequence
  Description of Artificial Sequence: Synthetic oligonucleotide
acaaacagccctgtggaactgagagagcc

SEQ ID NO: 406941 - DNA, 28 bp, Artificial Sequence
  Description of Artificial Sequence: Synthetic oligonucleotide
caaacagccctgtggaactgagagagcc

SEQ ID NO: 406942 - DNA, 28 bp, Artificial Sequence
  Description of Artificial Sequence: Synthetic oligonucleotide
aaacagccctgtggaactgagagagccc

SEQ ID NO: 406943 - DNA, 31 bp, Artificial Sequence
  Description of Artificial Sequence: Synthetic oligonucleotide
ggaccttcatacagcatctctgaccagcaac

SEQ ID NO: 406944 - DNA, 32 bp, Artificial Sequence
  Description of Artificial Sequence: Synthetic oligonucleotide
gaccttcatacagcatctctgaccagcaactg

SEQ ID NO: 406945 - DNA, 34 bp, Artificial Sequence
  Description of Artificial Sequence: Synthetic oligonucleotide
accttcatacagcatctctgaccagcaactgatg

SEQ ID NO: 406946 - DNA, 33 bp, Artificial Sequence
  Description of Artificial Sequence: Synthetic oligonucleotide
ccttcatacagcatctctgaccagcaactgatg

SEQ ID NO: 406947 - DNA, 35 bp, Artificial Sequence
  Description of Artificial Sequence: Synthetic oligonucleotide
cttcatacagcatctctgaccagcaactgatgatg

SEQ ID NO: 406948 - DNA, 35 bp, Artificial Sequence
  Description of Artificial Sequence: Synthetic oligonucleotide
ttcatacagcatctctgaccagcaactgatgatgc

SEQ ID NO: 406949 - DNA, 34 bp, Artificial Sequence
  Description of Artificial Sequence: Synthetic oligonucleotide
tcatacagcatctctgaccagcaactgatgatgc

SEQ ID NO: 406950 - DNA, 33 bp, Artificial Sequence
  Description of Artificial Sequence: Synthetic oligonucleotide
catacagcatctctgaccagcaactgatgatgc

SEQ ID NO: 406951 - DNA, 37 bp, Artificial Sequence
  Description of Artificial Sequence: Synthetic oligonucleotide
atacagcatctctgaccagcaactgatgatgctattg

SEQ ID NO: 406952 - DNA, 36 bp, Artificial Sequence
  Description of Artificial Sequence: Synthetic oligonucleotide
tacagcatctctgaccagcaactgatgatgctattg

SEQ ID NO: 406953 - DNA, 35 bp, Artificial Sequence
  Description of Artificial Sequence: Synthetic oligonucleotide
acagcatctctgaccagcaactgatgatgctattg

SEQ ID NO: 406954 - DNA, 34 bp, Artificial Sequence
  Description of Artificial Sequence: Synthetic oligonucleotide
cagcatctctgaccagcaactgatgatgctattg

SEQ ID NO: 406955 - DNA, 36 bp, Artificial Sequence
  Description of Artificial Sequence: Synthetic oligonucleotide
agcatctctgaccagcaactgatgatgctattgaac

SEQ ID NO: 406956 - DNA, 35 bp, Artificial Sequence
  Description of Artificial Sequence: Synthetic oligonucleotide
gcatctctgaccagcaactgatgatgctattgaac

SEQ ID NO: 406957 - DNA, 36 bp, Artificial Sequence
  Description of Artificial Sequence: Synthetic oligonucleotide
catctctgaccagcaactgatgatgctattgaactc

SEQ ID NO: 406958 - DNA, 37 bp, Artificial Sequence
  Description of Artificial Sequence: Synthetic oligonucleotide
atctctgaccagcaactgatgatgctattgaactcag

SEQ ID NO: 406959 - DNA, 36 bp, Artificial Sequence
  Description of Artificial Sequence: Synthetic oligonucleotide
tctctgaccagcaactgatgatgctattgaactcag

SEQ ID NO: 406960 - DNA, 35 bp, Artificial Sequence
  Description of Artificial Sequence: Synthetic oligonucleotide
ctctgaccagcaactgatgatgctattgaactcag

SEQ ID NO: 406961 - DNA, 37 bp, Artificial Sequence
  Description of Artificial Sequence: Synthetic oligonucleotide
tctgaccagcaactgatgatgctattgaactcagatg

SEQ ID NO: 406962 - DNA, 36 bp, Artificial Sequence
  Description of Artificial Sequence: Synthetic oligonucleotide
ctgaccagcaactgatgatgctattgaactcagatg

SEQ ID NO: 406963 - DNA, 36 bp, Artificial Sequence
  Description of Artificial Sequence: Synthetic oligonucleotide
tgaccagcaactgatgatgctattgaactcagatgc

SEQ ID NO: 406964 - DNA, 35 bp, Artificial Sequence
  Description of Artificial Sequence: Synthetic oligonucleotide
gaccagcaactgatgatgctattgaactcagatgc

SEQ ID NO: 406965 - DNA, 36 bp, Artificial Sequence
  Description of Artificial Sequence: Synthetic oligonucleotide
accagcaactgatgatgctattgaactcagatgctg

SEQ ID NO: 406966 - DNA, 35 bp, Artificial Sequence
  Description of Artificial Sequence: Synthetic oligonucleotide
ccagcaactgatgatgctattgaactcagatgctg

SEQ ID NO: 406967 - DNA, 38 bp, Artificial Sequence
  Description of Artificial Sequence: Synthetic oligonucleotide
cagcaactgatgatgctattgaactcagatgctgattg

SEQ ID NO: 406968 - DNA, 38 bp, Artificial Sequence
  Description of Artificial Sequence: Synthetic oligonucleotide
agcaactgatgatgctattgaactcagatgctgattgg

SEQ ID NO: 406969 - DNA, 37 bp, Artificial Sequence
  Description of Artificial Sequence: Synthetic oligonucleotide
gcaactgatgatgctattgaactcagatgctgattgg

SEQ ID NO: 406970 - DNA, 39 bp, Artificial Sequence
  Description of Artificial Sequence: Synthetic oligonucleotide
caactgatgatgctattgaactcagatgctgattggttc

SEQ ID NO: 406971 - DNA, 40 bp, Artificial Sequence
  Description of Artificial Sequence: Synthetic oligonucleotide
aactgatgatgctattgaactcagatgctgattggttctc

SEQ ID NO: 406972 - DNA, 39 bp, Artificial Sequence
  Description of Artificial Sequence: Synthetic oligonucleotide
actgatgatgctattgaactcagatgctgattggttctc

SEQ ID NO: 406973 - DNA, 38 bp, Artificial Sequence
  Description of Artificial Sequence: Synthetic oligonucleotide
ctgatgatgctattgaactcagatgctgattggttctc

SEQ ID NO: 406974 - DNA, 38 bp, Artificial Sequence
  Description of Artificial Sequence: Synthetic oligonucleotide
tgatgatgctattgaactcagatgctgattggttctcc

SEQ ID NO: 406975 - DNA, 37 bp, Artificial Sequence
  Description of Artificial Sequence: Synthetic oligonucleotide
gatgatgctattgaactcagatgctgattggttctcc

SEQ ID NO: 406976 - DNA, 39 bp, Artificial Sequence
  Description of Artificial Sequence: Synthetic oligonucleotide
atgatgctattgaactcagatgctgattggttctccaac

SEQ ID NO: 406977 - DNA, 38 bp, Artificial Sequence
  Description of Artificial Sequence: Synthetic oligonucleotide
tgatgctattgaactcagatgctgattggttctccaac

SEQ ID NO: 406978 - DNA, 37 bp, Artificial Sequence
  Description of Artificial Sequence: Synthetic oligonucleotide
gatgctattgaactcagatgctgattggttctccaac

SEQ ID NO: 406979 - DNA, 38 bp, Artificial Sequence
  Description of Artificial Sequence: Synthetic oligonucleotide
atgctattgaactcagatgctgattggttctccaacac

SEQ ID NO: 406980 - DNA, 37 bp, Artificial Sequence
  Description of Artificial Sequence: Synthetic oligonucleotide
tgctattgaactcagatgctgattggttctccaacac

SEQ ID NO: 406981 - DNA, 36 bp, Artificial Sequence
  Description of Artificial Sequence: Synthetic oligonucleotide
gctattgaactcagatgctgattggttctccaacac

SEQ ID NO: 406982 - DNA, 36 bp, Artificial Sequence
  Description of Artificial Sequence: Synthetic oligonucleotide
ctattgaactcagatgctgattggttctccaacacg

SEQ ID NO: 406983 - DNA, 37 bp, Artificial Sequence
  Description of Artificial Sequence: Synthetic oligonucleotide
tattgaactcagatgctgattggttctccaacacgag

SEQ ID NO: 406984 - DNA, 36 bp, Artificial Sequence
  Description of Artificial Sequence: Synthetic oligonucleotide
attgaactcagatgctgattggttctccaacacgag

SEQ ID NO: 406985 - DNA, 35 bp, Artificial Sequence
  Description of Artificial Sequence: Synthetic oligonucleotide
ttgaactcagatgctgattggttctccaacacgag

SEQ ID NO: 406986 - DNA, 34 bp, Artificial Sequence
  Description of Artificial Sequence: Synthetic oligonucleotide
tgaactcagatgctgattggttctccaacacgag

SEQ ID NO: 406987 - DNA, 33 bp, Artificial Sequence
  Description of Artificial Sequence: Synthetic oligonucleotide
gaactcagatgctgattggttctccaacacgag

SEQ ID NO: 406988 - DNA, 37 bp, Artificial Sequence
  Description of Artificial Sequence: Synthetic oligonucleotide
aactcagatgctgattggttctccaacacgagattac

SEQ ID NO: 406989 - DNA, 36 bp, Artificial Sequence
  Description of Artificial Sequence: Synthetic oligonucleotide
actcagatgctgattggttctccaacacgagattac

SEQ ID NO: 406990 - DNA, 35 bp, Artificial Sequence
  Description of Artificial Sequence: Synthetic oligonucleotide
ctcagatgctgattggttctccaacacgagattac

SEQ ID NO: 406991 - DNA, 35 bp, Artificial Sequence
  Description of Artificial Sequence: Synthetic oligonucleotide
tcagatgctgattggttctccaacacgagattacc

SEQ ID NO: 406992 - DNA, 34 bp, Artificial Sequence
  Description of Artificial Sequence: Synthetic oligonucleotide
cagatgctgattggttctccaacacgagattacc

SEQ ID NO: 406993 - DNA, 34 bp, Artificial Sequence
  Description of Artificial Sequence: Synthetic oligonucleotide
agatgctgattggttctccaacacgagattaccc

SEQ ID NO: 406994 - DNA, 33 bp, Artificial Sequence
  Description of Artificial Sequence: Synthetic oligonucleotide
gatgctgattggttctccaacacgagattaccc

SEQ ID NO: 406995 - DNA, 35 bp, Artificial Sequence
  Description of Artificial Sequence: Synthetic oligonucleotide
atgctgattggttctccaacacgagattacccaac

SEQ ID NO: 406996 - DNA, 34 bp, Artificial Sequence
  Description of Artificial Sequence: Synthetic oligonucleotide
tgctgattggttctccaacacgagattacccaac

SEQ ID NO: 406997 - DNA, 33 bp, Artificial Sequence
  Description of Artificial Sequence: Synthetic oligonucleotide
gctgattggttctccaacacgagattacccaac

SEQ ID NO: 406998 - DNA, 33 bp, Artificial Sequence
  Description of Artificial Sequence: Synthetic oligonucleotide
ctgattggttctccaacacgagattacccaacc

SEQ ID NO: 406999 - DNA, 33 bp, Artificial Sequence
  Description of Artificial Sequence: Synthetic oligonucleotide
tgattggttctccaacacgagattacccaaccc

SEQ ID NO: 407000 - DNA, 32 bp, Artificial Sequence
  Description of Artificial Sequence: Synthetic oligonucleotide
gattggttctccaacacgagattacccaaccc

SEQ ID NO: 407001 - DNA, 33 bp, Artificial Sequence
  Description of Artificial Sequence: Synthetic oligonucleotide
attggttctccaacacgagattacccaacccag

SEQ ID NO: 407002 - DNA, 32 bp, Artificial Sequence
  Description of Artificial Sequence: Synthetic oligonucleotide
ttggttctccaacacgagattacccaacccag

SEQ ID NO: 407003 - DNA, 31 bp, Artificial Sequence
  Description of Artificial Sequence: Synthetic oligonucleotide
tggttctccaacacgagattacccaacccag

SEQ ID NO: 407004 - DNA, 30 bp, Artificial Sequence
  Description of Artificial Sequence: Synthetic oligonucleotide
ggttctccaacacgagattacccaacccag

SEQ ID NO: 407005 - DNA, 30 bp, Artificial Sequence
  Description of Artificial Sequence: Synthetic oligonucleotide
gttctccaacacgagattacccaacccagg

SEQ ID NO: 407006 - DNA, 31 bp, Artificial Sequence
  Description of Artificial Sequence: Synthetic oligonucleotide
ttctccaacacgagattacccaacccaggag

SEQ ID NO: 407007 - DNA, 30 bp, Artificial Sequence
  Description of Artificial Sequence: Synthetic oligonucleotide
tctccaacacgagattacccaacccaggag

SEQ ID NO: 407008 - DNA, 29 bp, Artificial Sequence
  Description of Artificial Sequence: Synthetic oligonucleotide
ctccaacacgagattacccaacccaggag

SEQ ID NO: 407009 - DNA, 29 bp, Artificial Sequence
  Description of Artificial Sequence: Synthetic oligonucleotide
tccaacacgagattacccaacccaggagc

SEQ ID NO: 407010 - DNA, 28 bp, Artificial Sequence
  Description of Artificial Sequence: Synthetic oligonucleotide
ccaacacgagattacccaacccaggagc

SEQ ID NO: 407011 - DNA, 30 bp, Artificial Sequence
  Description of Artificial Sequence: Synthetic oligonucleotide
caacacgagattacccaacccaggagcaag

SEQ ID NO: 407012 - DNA, 30 bp, Artificial Sequence
  Description of Artificial Sequence: Synthetic oligonucleotide
aacacgagattacccaacccaggagcaagg

SEQ ID NO: 407013 - DNA, 29 bp, Artificial Sequence
  Description of Artificial Sequence: Synthetic oligonucleotide
acacgagattacccaacccaggagcaagg

SEQ ID NO: 407014 - DNA, 28 bp, Artificial Sequence
  Description of Artificial Sequence: Synthetic oligonucleotide
cacgagattacccaacccaggagcaagg

SEQ ID NO: 407015 - DNA, 32 bp, Artificial Sequence
  Description of Artificial Sequence: Synthetic oligonucleotide
acgagattacccaacccaggagcaaggaaatc

SEQ ID NO: 407016 - DNA, 31 bp, Artificial Sequence
  Description of Artificial Sequence: Synthetic oligonucleotide
cgagattacccaacccaggagcaaggaaatc

SEQ ID NO: 407017 - DNA, 32 bp, Artificial Sequence
  Description of Artificial Sequence: Synthetic oligonucleotide
gagattacccaacccaggagcaaggaaatcag

SEQ ID NO: 407018 - DNA, 35 bp, Artificial Sequence
  Description of Artificial Sequence: Synthetic oligonucleotide
agattacccaacccaggagcaaggaaatcagtaac

SEQ ID NO: 407019 - DNA, 34 bp, Artificial Sequence
  Description of Artificial Sequence: Synthetic oligonucleotide
gattacccaacccaggagcaaggaaatcagtaac

SEQ ID NO: 407020 - DNA, 36 bp, Artificial Sequence
  Description of Artificial Sequence: Synthetic oligonucleotide
attacccaacccaggagcaaggaaatcagtaacttc

SEQ ID NO: 407021 - DNA, 35 bp, Artificial Sequence
  Description of Artificial Sequence: Synthetic oligonucleotide
ttacccaacccaggagcaaggaaatcagtaacttc

SEQ ID NO: 407022 - DNA, 34 bp, Artificial Sequence
  Description of Artificial Sequence: Synthetic oligonucleotide
tacccaacccaggagcaaggaaatcagtaacttc

SEQ ID NO: 407023 - DNA, 33 bp, Artificial Sequence
  Description of Artificial Sequence: Synthetic oligonucleotide
acccaacccaggagcaaggaaatcagtaacttc

SEQ ID NO: 407024 - DNA, 32 bp, Artificial Sequence
  Description of Artificial Sequence: Synthetic oligonucleotide
cccaacccaggagcaaggaaatcagtaacttc

SEQ ID NO: 407025 - DNA, 32 bp, Artificial Sequence
  Description of Artificial Sequence: Synthetic oligonucleotide
ccaacccaggagcaaggaaatcagtaacttcc

SEQ ID NO: 407026 - DNA, 33 bp, Artificial Sequence
  Description of Artificial Sequence: Synthetic oligonucleotide
caacccaggagcaaggaaatcagtaacttcctc

SEQ ID NO: 407027 - DNA, 33 bp, Artificial Sequence
  Description of Artificial Sequence: Synthetic oligonucleotide
aacccaggagcaaggaaatcagtaacttcctcc

SEQ ID NO: 407028 - DNA, 32 bp, Artificial Sequence
  Description of Artificial Sequence: Synthetic oligonucleotide
acccaggagcaaggaaatcagtaacttcctcc

SEQ ID NO: 407029 - DNA, 31 bp, Artificial Sequence
  Description of Artificial Sequence: Synthetic oligonucleotide
cccaggagcaaggaaatcagtaacttcctcc

SEQ ID NO: 407030 - DNA, 31 bp, Artificial Sequence
  Description of Artificial Sequence: Synthetic oligonucleotide
ccaggagcaaggaaatcagtaacttcctccc

SEQ ID NO: 407031 - DNA, 36 bp, Artificial Sequence
  Description of Artificial Sequence: Synthetic oligonucleotide
caggagcaaggaaatcagtaacttcctccctataac

SEQ ID NO: 407032 - DNA, 38 bp, Artificial Sequence
  Description of Artificial Sequence: Synthetic oligonucleotide
aggagcaaggaaatcagtaacttcctccctataacttg

SEQ ID NO: 407033 - DNA, 37 bp, Artificial Sequence
  Description of Artificial Sequence: Synthetic oligonucleotide
ggagcaaggaaatcagtaacttcctccctataacttg

SEQ ID NO: 407034 - DNA, 37 bp, Artificial Sequence
  Description of Artificial Sequence: Synthetic oligonucleotide
gagcaaggaaatcagtaacttcctccctataacttgg

SEQ ID NO: 407035 - DNA, 40 bp, Artificial Sequence
  Description of Artificial Sequence: Synthetic oligonucleotide
agcaaggaaatcagtaacttcctccctataacttggaatg

SEQ ID NO: 407036 - DNA, 39 bp, Artificial Sequence
  Description of Artificial Sequence: Synthetic oligonucleotide
gcaaggaaatcagtaacttcctccctataacttggaatg

SEQ ID NO: 407037 - DNA, 40 bp, Artificial Sequence
  Description of Artificial Sequence: Synthetic oligonucleotide
caaggaaatcagtaacttcctccctataacttggaatgtg

SEQ ID NO: 407038 - DNA, 40 bp, Artificial Sequence
  Description of Artificial Sequence: Synthetic oligonucleotide
aaggaaatcagtaacttcctccctataacttggaatgtgg

SEQ ID NO: 407039 - DNA, 39 bp, Artificial Sequence
  Description of Artificial Sequence: Synthetic oligonucleotide
aggaaatcagtaacttcctccctataacttggaatgtgg

SEQ ID NO: 407040 - DNA, 38 bp, Artificial Sequence
  Description of Artificial Sequence: Synthetic oligonucleotide
ggaaatcagtaacttcctccctataacttggaatgtgg

SEQ ID NO: 407041 - DNA, 38 bp, Artificial Sequence
  Description of Artificial Sequence: Synthetic oligonucleotide
gaaatcagtaacttcctccctataacttggaatgtggg

SEQ ID NO: 407042 - DNA, 39 bp, Artificial Sequence
  Description of Artificial Sequence: Synthetic oligonucleotide
aaatcagtaacttcctccctataacttggaatgtgggtg

SEQ ID NO: 407043 - DNA, 38 bp, Artificial Sequence
  Description of Artificial Sequence: Synthetic oligonucleotide
aatcagtaacttcctccctataacttggaatgtgggtg

SEQ ID NO: 407044 - DNA, 37 bp, Artificial Sequence
  Description of Artificial Sequence: Synthetic oligonucleotide
atcagtaacttcctccctataacttggaatgtgggtg

SEQ ID NO: 407045 - DNA, 36 bp, Artificial Sequence
  Description of Artificial Sequence: Synthetic oligonucleotide
tcagtaacttcctccctataacttggaatgtgggtg

SEQ ID NO: 407046 - DNA, 35 bp, Artificial Sequence
  Description of Artificial Sequence: Synthetic oligonucleotide
cagtaacttcctccctataacttggaatgtgggtg

SEQ ID NO: 407047 - DNA, 35 bp, Artificial Sequence
  Description of Artificial Sequence: Synthetic oligonucleotide
agtaacttcctccctataacttggaatgtgggtgg

SEQ ID NO: 407048 - DNA, 34 bp, Artificial Sequence
  Description of Artificial Sequence: Synthetic oligonucleotide
gtaacttcctccctataacttggaatgtgggtgg

SEQ ID NO: 407049 - DNA, 35 bp, Artificial Sequence
  Description of Artificial Sequence: Synthetic oligonucleotide
taacttcctccctataacttggaatgtgggtggag

SEQ ID NO: 407050 - DNA, 34 bp, Artificial Sequence
  Description of Artificial Sequence: Synthetic oligonucleotide
aacttcctccctataacttggaatgtgggtggag

SEQ ID NO: 407051 - DNA, 33 bp, Artificial Sequence
  Description of Artificial Sequence: Synthetic oligonucleotide
acttcctccctataacttggaatgtgggtggag

SEQ ID NO: 407052 - DNA, 32 bp, Artificial Sequence
  Description of Artificial Sequence: Synthetic oligonucleotide
cttcctccctataacttggaatgtgggtggag

SEQ ID NO: 407053 - DNA, 32 bp, Artificial Sequence
  Description of Artificial Sequence: Synthetic oligonucleotide
ttcctccctataacttggaatgtgggtggagg

SEQ ID NO: 407054 - DNA, 31 bp, Artificial Sequence
  Description of Artificial Sequence: Synthetic oligonucleotide
tcctccctataacttggaatgtgggtggagg

SEQ ID NO: 407055 - DNA, 30 bp, Artificial Sequence
  Description of Artificial Sequence: Synthetic oligonucleotide
cctccctataacttggaatgtgggtggagg

SEQ ID NO: 407056 - DNA, 30 bp, Artificial Sequence
  Description of Artificial Sequence: Synthetic oligonucleotide
ctccctataacttggaatgtgggtggaggg

SEQ ID NO: 407057 - DNA, 30 bp, Artificial Sequence
  Description of Artificial Sequence: Synthetic oligonucleotide
tccctataacttggaatgtgggtggagggg

SEQ ID NO: 407058 - DNA, 29 bp, Artificial Sequence
  Description of Artificial Sequence: Synthetic oligonucleotide
ccctataacttggaatgtgggtggagggg

SEQ ID NO: 407059 - DNA, 31 bp, Artificial Sequence
  Description of Artificial Sequence: Synthetic oligonucleotide
cctataacttggaatgtgggtggaggggttc

SEQ ID NO: 407060 - DNA, 34 bp, Artificial Sequence
  Description of Artificial Sequence: Synthetic oligonucleotide
ctataacttggaatgtgggtggaggggttcatag

SEQ ID NO: 407061 - DNA, 36 bp, Artificial Sequence
  Description of Artificial Sequence: Synthetic oligonucleotide
tataacttggaatgtgggtggaggggttcatagttc

SEQ ID NO: 407062 - DNA, 35 bp, Artificial Sequence
  Description of Artificial Sequence: Synthetic oligonucleotide
ataacttggaatgtgggtggaggggttcatagttc

SEQ ID NO: 407063 - DNA, 34 bp, Artificial Sequence
  Description of Artificial Sequence: Synthetic oligonucleotide
taacttggaatgtgggtggaggggttcatagttc

SEQ ID NO: 407064 - DNA, 33 bp, Artificial Sequence
  Description of Artificial Sequence: Synthetic oligonucleotide
aacttggaatgtgggtggaggggttcatagttc

SEQ ID NO: 407065 - DNA, 32 bp, Artificial Sequence
  Description of Artificial Sequence: Synthetic oligonucleotide
acttggaatgtgggtggaggggttcatagttc

SEQ ID NO: 407066 - DNA, 31 bp, Artificial Sequence
  Description of Artificial Sequence: Synthetic oligonucleotide
cttggaatgtgggtggaggggttcatagttc

SEQ ID NO: 407067 - DNA, 32 bp, Artificial Sequence
  Description of Artificial Sequence: Synthetic oligonucleotide
ttggaatgtgggtggaggggttcatagttctc

SEQ ID NO: 407068 - DNA, 31 bp, Artificial Sequence
  Description of Artificial Sequence: Synthetic oligonucleotide
tggaatgtgggtggaggggttcatagttctc

SEQ ID NO: 407069 - DNA, 30 bp, Artificial Sequence
  Description of Artificial Sequence: Synthetic oligonucleotide
ggaatgtgggtggaggggttcatagttctc

SEQ ID NO: 407070 - DNA, 30 bp, Artificial Sequence
  Description of Artificial Sequence: Synthetic oligonucleotide
gaatgtgggtggaggggttcatagttctcc

SEQ ID NO: 407071 - DNA, 30 bp, Artificial Sequence
  Description of Artificial Sequence: Synthetic oligonucleotide
aatgtgggtggaggggttcatagttctccc

SEQ ID NO: 407072 - DNA, 29 bp, Artificial Sequence
  Description of Artificial Sequence: Synthetic oligonucleotide
atgtgggtggaggggttcatagttctccc

SEQ ID NO: 407073 - DNA, 28 bp, Artificial Sequence
  Description of Artificial Sequence: Synthetic oligonucleotide
tgtgggtggaggggttcatagttctccc

SEQ ID NO: 407074 - DNA, 27 bp, Artificial Sequence
  Description of Artificial Sequence: Synthetic oligonucleotide
gtgggtggaggggttcatagttctccc

SEQ ID NO: 407075 - DNA, 28 bp, Artificial Sequence
  Description of Artificial Sequence: Synthetic oligonucleotide
tgggtggaggggttcatagttctccctg

SEQ ID NO: 407076 - DNA, 27 bp, Artificial Sequence
  Description of Artificial Sequence: Synthetic oligonucleotide
gggtggaggggttcatagttctccctg

SEQ ID NO: 407077 - DNA, 28 bp, Artificial Sequence
  Description of Artificial Sequence: Synthetic oligonucleotide
ggtggaggggttcatagttctccctgag

SEQ ID NO: 407078 - DNA, 29 bp, Artificial Sequence
  Description of Artificial Sequence: Synthetic oligonucleotide
gtggaggggttcatagttctccctgagtg

SEQ ID NO: 407079 - DNA, 30 bp, Artificial Sequence
  Description of Artificial Sequence: Synthetic oligonucleotide
tggaggggttcatagttctccctgagtgag

SEQ ID NO: 407080 - DNA, 29 bp, Artificial Sequence
  Description of Artificial Sequence: Synthetic oligonucleotide
ggaggggttcatagttctccctgagtgag

SEQ ID NO: 407081 - DNA, 30 bp, Artificial Sequence
  Description of Artificial Sequence: Synthetic oligonucleotide
gaggggttcatagttctccctgagtgagac

SEQ ID NO: 407082 - DNA, 32 bp, Artificial Sequence
  Description of Artificial Sequence: Synthetic oligonucleotide
aggggttcatagttctccctgagtgagacttg

SEQ ID NO: 407083 - DNA, 31 bp, Artificial Sequence
  Description of Artificial Sequence: Synthetic oligonucleotide
ggggttcatagttctccctgagtgagacttg

SEQ ID NO: 407084 - DNA, 31 bp, Artificial Sequence
  Description of Artificial Sequence: Synthetic oligonucleotide
gggttcatagttctccctgagtgagacttgc

SEQ ID NO: 407085 - DNA, 31 bp, Artificial Sequence
  Description of Artificial Sequence: Synthetic oligonucleotide
ggttcatagttctccctgagtgagacttgcc

SEQ ID NO: 407086 - DNA, 32 bp, Artificial Sequence
  Description of Artificial Sequence: Synthetic oligonucleotide
gttcatagttctccctgagtgagacttgcctg

SEQ ID NO: 407087 - DNA, 32 bp, Artificial Sequence
  Description of Artificial Sequence: Synthetic oligonucleotide
ttcatagttctccctgagtgagacttgcctgc

SEQ ID NO: 407088 - DNA, 31 bp, Artificial Sequence
  Description of Artificial Sequence: Synthetic oligonucleotide
tcatagttctccctgagtgagacttgcctgc

SEQ ID NO: 407089 - DNA, 30 bp, Artificial Sequence
  Description of Artificial Sequence: Synthetic oligonucleotide
catagttctccctgagtgagacttgcctgc

SEQ ID NO: 407090 - DNA, 32 bp, Artificial Sequence
  Description of Artificial Sequence: Synthetic oligonucleotide
atagttctccctgagtgagacttgcctgcttc

SEQ ID NO: 407091 - DNA, 31 bp, Artificial Sequence
  Description of Artificial Sequence: Synthetic oligonucleotide
tagttctccctgagtgagacttgcctgcttc

SEQ ID NO: 407092 - DNA, 30 bp, Artificial Sequence
  Description of Artificial Sequence: Synthetic oligonucleotide
agttctccctgagtgagacttgcctgcttc

SEQ ID NO: 407093 - DNA, 29 bp, Artificial Sequence
  Description of Artificial Sequence: Synthetic oligonucleotide
gttctccctgagtgagacttgcctgcttc

SEQ ID NO: 407094 - DNA, 30 bp, Artificial Sequence
  Description of Artificial Sequence: Synthetic oligonucleotide
ttctccctgagtgagacttgcctgcttctc

SEQ ID NO: 407095 - DNA, 29 bp, Artificial Sequence
  Description of Artificial Sequence: Synthetic oligonucleotide
tctccctgagtgagacttgcctgcttctc

SEQ ID NO: 407096 - DNA, 28 bp, Artificial Sequence
  Description of Artificial Sequence: Synthetic oligonucleotide
ctccctgagtgagacttgcctgcttctc

SEQ ID NO: 407097 - DNA, 29 bp, Artificial Sequence
  Description of Artificial Sequence: Synthetic oligonucleotide
tccctgagtgagacttgcctgcttctctg

SEQ ID NO: 407098 - DNA, 28 bp, Artificial Sequence
  Description of Artificial Sequence: Synthetic oligonucleotide
ccctgagtgagacttgcctgcttctctg

SEQ ID NO: 407099 - DNA, 28 bp, Artificial Sequence
  Description of Artificial Sequence: Synthetic oligonucleotide
cctgagtgagacttgcctgcttctctgg

SEQ ID NO: 407100 - DNA, 28 bp, Artificial Sequence
  Description of Artificial Sequence: Synthetic oligonucleotide
ctgagtgagacttgcctgcttctctggc

SEQ ID NO: 407101 - DNA, 28 bp, Artificial Sequence
  Description of Artificial Sequence: Synthetic oligonucleotide
tgagtgagacttgcctgcttctctggcc

SEQ ID NO: 407102 - DNA, 27 bp, Artificial Sequence
  Description of Artificial Sequence: Synthetic oligonucleotide
gagtgagacttgcctgcttctctggcc

SEQ ID NO: 407103 - DNA, 27 bp, Artificial Sequence
  Description of Artificial Sequence: Synthetic oligonucleotide
agtgagacttgcctgcttctctggccc

SEQ ID NO: 407104 - DNA, 26 bp, Artificial Sequence
  Description of Artificial Sequence: Synthetic oligonucleotide
gtgagacttgcctgcttctctggccc

SEQ ID NO: 407105 - DNA, 27 bp, Artificial Sequence
  Description of Artificial Sequence: Synthetic oligonucleotide
tgagacttgcctgcttctctggcccct

SEQ ID NO: 407106 - DNA, 26 bp, Artificial Sequence
  Description of Artificial Sequence: Synthetic oligonucleotide
gagacttgcctgcttctctggcccct

SEQ ID NO: 407107 - DNA, 26 bp, Artificial Sequence
  Description of Artificial Sequence: Synthetic oligonucleotide
agacttgcctgcttctctggcccctg

SEQ ID NO: 407108 - DNA, 25 bp, Artificial Sequence
  Description of Artificial Sequence: Synthetic oligonucleotide
gacttgcctgcttctctggcccctg

SEQ ID NO: 407109 - DNA, 26 bp, Artificial Sequence
  Description of Artificial Sequence: Synthetic oligonucleotide
acttgcctgcttctctggcccctggt

SEQ ID NO: 407110 - DNA, 25 bp, Artificial Sequence
  Description of Artificial Sequence: Synthetic oligonucleotide
cttgcctgcttctctggcccctggt

SEQ ID NO: 407111 - DNA, 25 bp, Artificial Sequence
  Description of Artificial Sequence: Synthetic oligonucleotide
ttgcctgcttctctggcccctggtc

SEQ ID NO: 407112 - DNA, 24 bp, Artificial Sequence
  Description of Artificial Sequence: Synthetic oligonucleotide
tgcctgcttctctggcccctggtc

SEQ ID NO: 407113 - DNA, 23 bp, Artificial Sequence
  Description of Artificial Sequence: Synthetic oligonucleotide
gcctgcttctctggcccctggtc

SEQ ID NO: 407114 - DNA, 24 bp, Artificial Sequence
  Description of Artificial Sequence: Synthetic oligonucleotide
cctgcttctctggcccctggtcct

SEQ ID NO: 407115 - DNA, 25 bp, Artificial Sequence
  Description of Artificial Sequence: Synthetic oligonucleotide
ctgcttctctggcccctggtcctgt

SEQ ID NO: 407116 - DNA, 25 bp, Artificial Sequence
  Description of Artificial Sequence: Synthetic oligonucleotide
tgcttctctggcccctggtcctgtc

SEQ ID NO: 407117 - DNA, 24 bp, Artificial Sequence
  Description of Artificial Sequence: Synthetic oligonucleotide
gcttctctggcccctggtcctgtc

SEQ ID NO: 407118 - DNA, 25 bp, Artificial Sequence
  Description of Artificial Sequence: Synthetic oligonucleotide
cttctctggcccctggtcctgtcct

SEQ ID NO: 407119 - DNA, 27 bp, Artificial Sequence
  Description of Artificial Sequence: Synthetic oligonucleotide
ttctctggcccctggtcctgtcctgtt

SEQ ID NO: 407120 - DNA, 26 bp, Artificial Sequence
  Description of Artificial Sequence: Synthetic oligonucleotide
tctctggcccctggtcctgtcctgtt

SEQ ID NO: 407121 - DNA, 25 bp, Artificial Sequence
  Description of Artificial Sequence: Synthetic oligonucleotide
ctctggcccctggtcctgtcctgtt

SEQ ID NO: 407122 - DNA, 26 bp, Artificial Sequence
  Description of Artificial Sequence: Synthetic oligonucleotide
tctggcccctggtcctgtcctgttct

SEQ ID NO: 407123 - DNA, 25 bp, Artificial Sequence
  Description of Artificial Sequence: Synthetic oligonucleotide
ctggcccctggtcctgtcctgttct

SEQ ID NO: 407124 - DNA, 25 bp, Artificial Sequence
  Description of Artificial Sequence: Synthetic oligonucleotide
tggcccctggtcctgtcctgttctc

SEQ ID NO: 407125 - DNA, 24 bp, Artificial Sequence
  Description of Artificial Sequence: Synthetic oligonucleotide
ggcccctggtcctgtcctgttctc

SEQ ID NO: 407126 - DNA, 25 bp, Artificial Sequence
  Description of Artificial Sequence: Synthetic oligonucleotide
gcccctggtcctgtcctgttctcca

SEQ ID NO: 407127 - DNA, 25 bp, Artificial Sequence
  Description of Artificial Sequence: Synthetic oligonucleotide
cccctggtcctgtcctgttctccag

SEQ ID NO: 407128 - DNA, 27 bp, Artificial Sequence
  Description of Artificial Sequence: Synthetic oligonucleotide
ccctggtcctgtcctgttctccagcat

SEQ ID NO: 407129 - DNA, 27 bp, Artificial Sequence
  Description of Artificial Sequence: Synthetic oligonucleotide
cctggtcctgtcctgttctccagcatg

SEQ ID NO: 407130 - DNA, 27 bp, Artificial Sequence
  Description of Artificial Sequence: Synthetic oligonucleotide
ctggtcctgtcctgttctccagcatgg

SEQ ID NO: 407131 - DNA, 28 bp, Artificial Sequence
  Description of Artificial Sequence: Synthetic oligonucleotide
tggtcctgtcctgttctccagcatggtg

SEQ ID NO: 407132 - DNA, 27 bp, Artificial Sequence
  Description of Artificial Sequence: Synthetic oligonucleotide
ggtcctgtcctgttctccagcatggtg

SEQ ID NO: 407133 - DNA, 28 bp, Artificial Sequence
  Description of Artificial Sequence: Synthetic oligonucleotide
gtcctgtcctgttctccagcatggtgtg

SEQ ID NO: 407134 - DNA, 29 bp, Artificial Sequence
  Description of Artificial Sequence: Synthetic oligonucleotide
tcctgtcctgttctccagcatggtgtgtc

SEQ ID NO: 407135 - DNA, 28 bp, Artificial Sequence
  Description of Artificial Sequence: Synthetic oligonucleotide
cctgtcctgttctccagcatggtgtgtc

SEQ ID NO: 407136 - DNA, 29 bp, Artificial Sequence
  Description of Artificial Sequence: Synthetic oligonucleotide
ctgtcctgttctccagcatggtgtgtctg

SEQ ID NO: 407137 - DNA, 31 bp, Artificial Sequence
  Description of Artificial Sequence: Synthetic oligonucleotide
tgtcctgttctccagcatggtgtgtctgaag

SEQ ID NO: 407138 - DNA, 30 bp, Artificial Sequence
  Description of Artificial Sequence: Synthetic oligonucleotide
gtcctgttctccagcatggtgtgtctgaag

SEQ ID NO: 407139 - DNA, 30 bp, Artificial Sequence
  Description of Artificial Sequence: Synthetic oligonucleotide
tcctgttctccagcatggtgtgtctgaagc

SEQ ID NO: 407140 - DNA, 29 bp, Artificial Sequence
  Description of Artificial Sequence: Synthetic oligonucleotide
cctgttctccagcatggtgtgtctgaagc

SEQ ID NO: 407141 - DNA, 30 bp, Artificial Sequence
  Description of Artificial Sequence: Synthetic oligonucleotide
ctgttctccagcatggtgtgtctgaagctc

SEQ ID NO: 407142 - DNA, 30 bp, Artificial Sequence
  Description of Artificial Sequence: Synthetic oligonucleotide
tgttctccagcatggtgtgtctgaagctcc

SEQ ID NO: 407143 - DNA, 29 bp, Artificial Sequence
  Description of Artificial Sequence: Synthetic oligonucleotide
gttctccagcatggtgtgtctgaagctcc

SEQ ID NO: 407144 - DNA, 29 bp, Artificial Sequence
  Description of Artificial Sequence: Synthetic oligonucleotide
ttctccagcatggtgtgtctgaagctccc

SEQ ID NO: 407145 - DNA, 28 bp, Artificial Sequence
  Description of Artificial Sequence: Synthetic oligonucleotide
tctccagcatggtgtgtctgaagctccc

SEQ ID NO: 407146 - DNA, 27 bp, Artificial Sequence
  Description of Artificial Sequence: Synthetic oligonucleotide
ctccagcatggtgtgtctgaagctccc

SEQ ID NO: 407147 - DNA, 28 bp, Artificial Sequence
  Description of Artificial Sequence: Synthetic oligonucleotide
tccagcatggtgtgtctgaagctccctg

SEQ ID NO: 407148 - DNA, 27 bp, Artificial Sequence
  Description of Artificial Sequence: Synthetic oligonucleotide
ccagcatggtgtgtctgaagctccctg

SEQ ID NO: 407149 - DNA, 27 bp, Artificial Sequence
  Description of Artificial Sequence: Synthetic oligonucleotide
cagcatggtgtgtctgaagctccctgg

SEQ ID NO: 407150 - DNA, 28 bp, Artificial Sequence
  Description of Artificial Sequence: Synthetic oligonucleotide
agcatggtgtgtctgaagctccctggag

SEQ ID NO: 407151 - DNA, 27 bp, Artificial Sequence
  Description of Artificial Sequence: Synthetic oligonucleotide
gcatggtgtgtctgaagctccctggag

SEQ ID NO: 407152 - DNA, 27 bp, Artificial Sequence
  Description of Artificial Sequence: Synthetic oligonucleotide
catggtgtgtctgaagctccctggagg

SEQ ID NO: 407153 - DNA, 27 bp, Artificial Sequence
  Description of Artificial Sequence: Synthetic oligonucleotide
atggtgtgtctgaagctccctggaggc

SEQ ID NO: 407154 - DNA, 27 bp, Artificial Sequence
  Description of Artificial Sequence: Synthetic oligonucleotide
tggtgtgtctgaagctccctggaggct

SEQ ID NO: 407155 - DNA, 26 bp, Artificial Sequence
  Description of Artificial Sequence: Synthetic oligonucleotide
ggtgtgtctgaagctccctggaggct

SEQ ID NO: 407156 - DNA, 26 bp, Artificial Sequence
  Description of Artificial Sequence: Synthetic oligonucleotide
gtgtgtctgaagctccctggaggctc

SEQ ID NO: 407157 - DNA, 27 bp, Artificial Sequence
  Description of Artificial Sequence: Synthetic oligonucleotide
tgtgtctgaagctccctggaggctcct

SEQ ID NO: 407158 - DNA, 26 bp, Artificial Sequence
  Description of Artificial Sequence: Synthetic oligonucleotide
gtgtctgaagctccctggaggctcct

SEQ ID NO: 407159 - DNA, 26 bp, Artificial Sequence
  Description of Artificial Sequence: Synthetic oligonucleotide
tgtctgaagctccctggaggctcctg

SEQ ID NO: 407160 - DNA, 25 bp, Artificial Sequence
  Description of Artificial Sequence: Synthetic oligonucleotide
gtctgaagctccctggaggctcctg

SEQ ID NO: 407161 - DNA, 27 bp, Artificial Sequence
  Description of Artificial Sequence: Synthetic oligonucleotide
tctgaagctccctggaggctcctgcat

SEQ ID NO: 407162 - DNA, 26 bp, Artificial Sequence
  Description of Artificial Sequence: Synthetic oligonucleotide
ctgaagctccctggaggctcctgcat

SEQ ID NO: 407163 - DNA, 27 bp, Artificial Sequence
  Description of Artificial Sequence: Synthetic oligonucleotide
tgaagctccctggaggctcctgcatga

SEQ ID NO: 407164 - DNA, 26 bp, Artificial Sequence
  Description of Artificial Sequence: Synthetic oligonucleotide
gaagctccctggaggctcctgcatga

SEQ ID NO: 407165 - DNA, 27 bp, Artificial Sequence
  Description of Artificial Sequence: Synthetic oligonucleotide
aagctccctggaggctcctgcatgaca

SEQ ID NO: 407166 - DNA, 26 bp, Artificial Sequence
  Description of Artificial Sequence: Synthetic oligonucleotide
agctccctggaggctcctgcatgaca

SEQ ID NO: 407167 - DNA, 25 bp, Artificial Sequence
  Description of Artificial Sequence: Synthetic oligonucleotide
gctccctggaggctcctgcatgaca

SEQ ID NO: 407168 - DNA, 25 bp, Artificial Sequence
  Description of Artificial Sequence: Synthetic oligonucleotide
ctccctggaggctcctgcatgacag

SEQ ID NO: 407169 - DNA, 25 bp, Artificial Sequence
  Description of Artificial Sequence: Synthetic oligonucleotide
tccctggaggctcctgcatgacagc

SEQ ID NO: 407170 - DNA, 24 bp, Artificial Sequence
  Description of Artificial Sequence: Synthetic oligonucleotide
ccctggaggctcctgcatgacagc

SEQ ID NO: 407171 - DNA, 24 bp, Artificial Sequence
  Description of Artificial Sequence: Synthetic oligonucleotide
cctggaggctcctgcatgacagcg

SEQ ID NO: 407172 - DNA, 25 bp, Artificial Sequence
  Description of Artificial Sequence: Synthetic oligonucleotide
ctggaggctcctgcatgacagcgct

SEQ ID NO: 407173 - DNA, 26 bp, Artificial Sequence
  Description of Artificial Sequence: Synthetic oligonucleotide
tggaggctcctgcatgacagcgctga

SEQ ID NO: 407174 - DNA, 25 bp, Artificial Sequence
  Description of Artificial Sequence: Synthetic oligonucleotide
ggaggctcctgcatgacagcgctga

SEQ ID NO: 407175 - DNA, 26 bp, Artificial Sequence
  Description of Artificial Sequence: Synthetic oligonucleotide
gaggctcctgcatgacagcgctgaca

SEQ ID NO: 407176 - DNA, 27 bp, Artificial Sequence
  Description of Artificial Sequence: Synthetic oligonucleotide
aggctcctgcatgacagcgctgacagt

SEQ ID NO: 407177 - DNA, 26 bp, Artificial Sequence
  Description of Artificial Sequence: Synthetic oligonucleotide
ggctcctgcatgacagcgctgacagt

SEQ ID NO: 407178 - DNA, 27 bp, Artificial Sequence
  Description of Artificial Sequence: Synthetic oligonucleotide
gctcctgcatgacagcgctgacagtga

SEQ ID NO: 407179 - DNA, 27 bp, Artificial Sequence
  Description of Artificial Sequence: Synthetic oligonucleotide
ctcctgcatgacagcgctgacagtgac

SEQ ID NO: 407180 - DNA, 28 bp, Artificial Sequence
  Description of Artificial Sequence: Synthetic oligonucleotide
tcctgcatgacagcgctgacagtgacac

SEQ ID NO: 407181 - DNA, 27 bp, Artificial Sequence
  Description of Artificial Sequence: Synthetic oligonucleotide
cctgcatgacagcgctgacagtgacac

SEQ ID NO: 407182 - DNA, 28 bp, Artificial Sequence
  Description of Artificial Sequence: Synthetic oligonucleotide
ctgcatgacagcgctgacagtgacactg

SEQ ID NO: 407183 - DNA, 30 bp, Artificial Sequence; identical to SEQ ID NO: 62813
  Description of Artificial Sequence: Synthetic oligonucleotide

SEQ ID NO: 407184 - DNA, 29 bp, Artificial Sequence
  Description of Artificial Sequence: Synthetic oligonucleotide
gcatgacagcgctgacagtgacactgatg

SEQ ID NO: 407185 - DNA, 29 bp, Artificial Sequence
  Description of Artificial Sequence: Synthetic oligonucleotide
catgacagcgctgacagtgacactgatgg

SEQ ID NO: 407186 - DNA, 30 bp, Artificial Sequence; identical to SEQ ID NO: 62816
  Description of Artificial Sequence: Synthetic oligonucleotide

SEQ ID NO: 407187 - DNA, 29 bp, Artificial Sequence
  Description of Artificial Sequence: Synthetic oligonucleotide
tgacagcgctgacagtgacactgatggtg

SEQ ID NO: 407188 - DNA, 28 bp, Artificial Sequence
  Description of Artificial Sequence: Synthetic oligonucleotide
gacagcgctgacagtgacactgatggtg

SEQ ID NO: 407189 - DNA, 28 bp, Artificial Sequence
  Description of Artificial Sequence: Synthetic oligonucleotide
acagcgctgacagtgacactgatggtgc

SEQ ID NO: 407190 - DNA, 27 bp, Artificial Sequence
  Description of Artificial Sequence: Synthetic oligonucleotide
cagcgctgacagtgacactgatggtgc

SEQ ID NO: 407191 - DNA, 28 bp, Artificial Sequence
  Description of Artificial Sequence: Synthetic oligonucleotide
agcgctgacagtgacactgatggtgctg

SEQ ID NO: 407192 - DNA, 27 bp, Artificial Sequence
  Description of Artificial Sequence: Synthetic oligonucleotide
gcgctgacagtgacactgatggtgctg

SEQ ID NO: 407193 - DNA, 28 bp, Artificial Sequence
  Description of Artificial Sequence: Synthetic oligonucleotide
cgctgacagtgacactgatggtgctgag

SEQ ID NO: 407194 - DNA, 28 bp, Artificial Sequence
  Description of Artificial Sequence: Synthetic oligonucleotide
gctgacagtgacactgatggtgctgagc

SEQ ID NO: 407195 - DNA, 29 bp, Artificial Sequence
  Description of Artificial Sequence: Synthetic oligonucleotide
ctgacagtgacactgatggtgctgagctc

SEQ ID NO: 407196 - DNA, 29 bp, Artificial Sequence
  Description of Artificial Sequence: Synthetic oligonucleotide
tgacagtgacactgatggtgctgagctcc

SEQ ID NO: 407197 - DNA, 28 bp, Artificial Sequence
  Description of Artificial Sequence: Synthetic oligonucleotide
gacagtgacactgatggtgctgagctcc

SEQ ID NO: 407198 - DNA, 28 bp, Artificial Sequence
  Description of Artificial Sequence: Synthetic oligonucleotide
acagtgacactgatggtgctgagctccc

SEQ ID NO: 407199 - DNA, 27 bp, Artificial Sequence
  Description of Artificial Sequence: Synthetic oligonucleotide
cagtgacactgatggtgctgagctccc

SEQ ID NO: 407200 - DNA, 27 bp, Artificial Sequence
  Description of Artificial Sequence: Synthetic oligonucleotide
agtgacactgatggtgctgagctcccc

SEQ ID NO: 407201 - DNA, 27 bp, Artificial Sequence
  Description of Artificial Sequence: Synthetic oligonucleotide
gtgacactgatggtgctgagctcccca

SEQ ID NO: 407202 - DNA, 27 bp, Artificial Sequence
  Description of Artificial Sequence: Synthetic oligonucleotide
tgacactgatggtgctgagctccccac

SEQ ID NO: 407203 - DNA, 27 bp, Artificial Sequence
  Description of Artificial Sequence: Synthetic oligonucleotide
gacactgatggtgctgagctccccact

SEQ ID NO: 407204 - DNA, 27 bp, Artificial Sequence
  Description of Artificial Sequence: Synthetic oligonucleotide
acactgatggtgctgagctccccactg

SEQ ID NO: 407205 - DNA, 26 bp, Artificial Sequence
  Description of Artificial Sequence: Synthetic oligonucleotide
cactgatggtgctgagctccccactg

SEQ ID NO: 407206 - DNA, 26 bp, Artificial Sequence
  Description of Artificial Sequence: Synthetic oligonucleotide
actgatggtgctgagctccccactgg

SEQ ID NO: 407207 - DNA, 25 bp, Artificial Sequence
  Description of Artificial Sequence: Synthetic oligonucleotide
ctgatggtgctgagctccccactgg

SEQ ID NO: 407208 - DNA, 27 bp, Artificial Sequence
  Description of Artificial Sequence: Synthetic oligonucleotide
tgatggtgctgagctccccactggctt

SEQ ID NO: 407209 - DNA, 27 bp, Artificial Sequence
  Description of Artificial Sequence: Synthetic oligonucleotide
gatggtgctgagctccccactggcttt

SEQ ID NO: 407210 - DNA, 27 bp, Artificial Sequence
  Description of Artificial Sequence: Synthetic oligonucleotide
atggtgctgagctccccactggctttg

SEQ ID NO: 407211 - DNA, 26 bp, Artificial Sequence
  Description of Artificial Sequence: Synthetic oligonucleotide
tggtgctgagctccccactggctttg

SEQ ID NO: 407212 - DNA, 25 bp, Artificial Sequence
  Description of Artificial Sequence: Synthetic oligonucleotide
ggtgctgagctccccactggctttg

SEQ ID NO: 407213 - DNA, 25 bp, Artificial Sequence
  Description of Artificial Sequence: Synthetic oligonucleotide
gtgctgagctccccactggctttgg

SEQ ID NO: 407214 - DNA, 26 bp, Artificial Sequence
  Description of Artificial Sequence: Synthetic oligonucleotide
tgctgagctccccactggctttggct

SEQ ID NO: 407215 - DNA, 25 bp, Artificial Sequence
  Description of Artificial Sequence: Synthetic oligonucleotide
gctgagctccccactggctttggct

SEQ ID NO: 407216 - DNA, 25 bp, Artificial Sequence
  Description of Artificial Sequence: Synthetic oligonucleotide
ctgagctccccactggctttggctg

SEQ ID NO: 407217 - DNA, 25 bp, Artificial Sequence
  Description of Artificial Sequence: Synthetic oligonucleotide
tgagctccccactggctttggctgg

SEQ ID NO: 407218 - DNA, 24 bp, Artificial Sequence
  Description of Artificial Sequence: Synthetic oligonucleotide
gagctccccactggctttggctgg

SEQ ID NO: 407219 - DNA, 24 bp, Artificial Sequence
  Description of Artificial Sequence: Synthetic oligonucleotide
agctccccactggctttggctggg

SEQ ID NO: 407220 - DNA, 23 bp, Artificial Sequence
  Description of Artificial Sequence: Synthetic oligonucleotide
gctccccactggctttggctggg

SEQ ID NO: 407221 - DNA, 24 bp, Artificial Sequence
  Description of Artificial Sequence: Synthetic oligonucleotide
ctccccactggctttggctgggga

SEQ ID NO: 407222 - DNA, 25 bp, Artificial Sequence
  Description of Artificial Sequence: Synthetic oligonucleotide
tccccactggctttggctggggaca

SEQ ID NO: 407223 - DNA, 24 bp, Artificial Sequence
  Description of Artificial Sequence: Synthetic oligonucleotide
ccccactggctttggctggggaca

SEQ ID NO: 407224 - DNA, 24 bp, Artificial Sequence
  Description of Artificial Sequence: Synthetic oligonucleotide
cccactggctttggctggggacac

SEQ ID NO: 407225 - DNA, 24 bp, Artificial Sequence
  Description of Artificial Sequence: Synthetic oligonucleotide
ccactggctttggctggggacacc

SEQ ID NO: 407226 - DNA, 24 bp, Artificial Sequence
  Description of Artificial Sequence: Synthetic oligonucleotide
cactggctttggctggggacaccc

SEQ ID NO: 407227 - DNA, 25 bp, Artificial Sequence
  Description of Artificial Sequence: Synthetic oligonucleotide
actggctttggctggggacacccga

SEQ ID NO: 407228 - DNA, 24 bp, Artificial Sequence
  Description of Artificial Sequence: Synthetic oligonucleotide
ctggctttggctggggacacccga

SEQ ID NO: 407229 - DNA, 24 bp, Artificial Sequence
  Description of Artificial Sequence: Synthetic oligonucleotide
tggctttggctggggacacccgac

SEQ ID NO: 407230 - DNA, 23 bp, Artificial Sequence
  Description of Artificial Sequence: Synthetic oligonucleotide
ggctttggctggggacacccgac

SEQ ID NO: 407231 - DNA, 24 bp, Artificial Sequence
  Description of Artificial Sequence: Synthetic oligonucleotide
gctttggctggggacacccgacca

SEQ ID NO: 407232 - DNA, 24 bp, Artificial Sequence
  Description of Artificial Sequence: Synthetic oligonucleotide
ctttggctggggacacccgaccac

SEQ ID NO: 407233 - DNA, 27 bp, Artificial Sequence
  Description of Artificial Sequence: Synthetic oligonucleotide
tttggctggggacacccgaccacgttt

SEQ ID NO: 407234 - DNA, 26 bp, Artificial Sequence
  Description of Artificial Sequence: Synthetic oligonucleotide
ttggctggggacacccgaccacgttt

SEQ ID NO: 407235 - DNA, 25 bp, Artificial Sequence
  Description of Artificial Sequence: Synthetic oligonucleotide
tggctggggacacccgaccacgttt

SEQ ID NO: 407236 - DNA, 24 bp, Artificial Sequence
  Description of Artificial Sequence: Synthetic oligonucleotide
ggctggggacacccgaccacgttt

SEQ ID NO: 407237 - DNA, 26 bp, Artificial Sequence
  Description of Artificial Sequence: Synthetic oligonucleotide
gctggggacacccgaccacgtttctt

SEQ ID NO: 407238 - DNA, 27 bp, Artificial Sequence
  Description of Artificial Sequence: Synthetic oligonucleotide
ctggggacacccgaccacgtttcttgt

SEQ ID NO: 407239 - DNA, 27 bp, Artificial Sequence
  Description of Artificial Sequence: Synthetic oligonucleotide
tggggacacccgaccacgtttcttgtg

SEQ ID NO: 407240 - DNA, 26 bp, Artificial Sequence
  Description of Artificial Sequence: Synthetic oligonucleotide
ggggacacccgaccacgtttcttgtg

SEQ ID NO: 407241 - DNA, 26 bp, Artificial Sequence
  Description of Artificial Sequence: Synthetic oligonucleotide
gggacacccgaccacgtttcttgtgg

SEQ ID NO: 407242 - DNA, 27 bp, Artificial Sequence
  Description of Artificial Sequence: Synthetic oligonucleotide
ggacacccgaccacgtttcttgtggca

SEQ ID NO: 407243 - DNA, 27 bp, Artificial Sequence
  Description of Artificial Sequence: Synthetic oligonucleotide
gacacccgaccacgtttcttgtggcag

SEQ ID NO: 407244 - DNA, 27 bp, Artificial Sequence
  Description of Artificial Sequence: Synthetic oligonucleotide
acacccgaccacgtttcttgtggcagc

SEQ ID NO: 407245 - DNA, 27 bp, Artificial Sequence
  Description of Artificial Sequence: Synthetic oligonucleotide
cacccgaccacgtttcttgtggcagct

SEQ ID NO: 407246 - DNA, 30 bp, Artificial Sequence; identical to SEQ ID NO: 62876
  Description of Artificial Sequence: Synthetic oligonucleotide

SEQ ID NO: 407247 - DNA, 29 bp, Artificial Sequence
  Description of Artificial Sequence: Synthetic oligonucleotide
cccgaccacgtttcttgtggcagcttaag

SEQ ID NO: 407248 - DNA, 32 bp, Artificial Sequence; identical to SEQ ID NO: 62878
  Description of Artificial Sequence: Synthetic oligonucleotide

SEQ ID NO: 407249 - DNA, 35 bp, Artificial Sequence; identical to SEQ ID NO: 62879
  Description of Artificial Sequence: Synthetic oligonucleotide

SEQ ID NO: 407250 - DNA, 36 bp, Artificial Sequence; identical to SEQ ID NO: 62880
  Description of Artificial Sequence: Synthetic oligonucleotide

SEQ ID NO: 407251 - DNA, 40 bp, Artificial Sequence; identical to SEQ ID NO: 62881
  Description of Artificial Sequence: Synthetic oligonucleotide

SEQ ID NO: 407252 - DNA, 39 bp, Artificial Sequence; identical to SEQ ID NO: 62882
  Description of Artificial Sequence: Synthetic oligonucleotide

SEQ ID NO: 407253 - DNA, 41 bp, Artificial Sequence; identical to SEQ ID NO: 62883
  Description of Artificial Sequence: Synthetic oligonucleotide

SEQ ID NO: 407254 - DNA, 44 bp, Artificial Sequence; identical to SEQ ID NO: 62884
  Description of Artificial Sequence: Synthetic oligonucleotide

SEQ ID NO: 407255 - DNA, 43 bp, Artificial Sequence; identical to SEQ ID NO: 62885
  Description of Artificial Sequence: Synthetic oligonucleotide

SEQ ID NO: 407256 - DNA, 43 bp, Artificial Sequence; identical to SEQ ID NO: 62886
  Description of Artificial Sequence: Synthetic oligonucleotide

SEQ ID NO: 407257 - DNA, 43 bp, Artificial Sequence; identical to SEQ ID NO: 62887
  Description of Artificial Sequence: Synthetic oligonucleotide

SEQ ID NO: 407258 - DNA, 42 bp, Artificial Sequence; identical to SEQ ID NO: 62888
  Description of Artificial Sequence: Synthetic oligonucleotide

SEQ ID NO: 407259 - DNA, 41 bp, Artificial Sequence; identical to SEQ ID NO: 62889
  Description of Artificial Sequence: Synthetic oligonucleotide

SEQ ID NO: 407260 - DNA, 40 bp, Artificial Sequence; identical to SEQ ID NO: 62890
  Description of Artificial Sequence: Synthetic oligonucleotide

SEQ ID NO: 407261 - DNA, 41 bp, Artificial Sequence; identical to SEQ ID NO: 62891
  Description of Artificial Sequence: Synthetic oligonucleotide

SEQ ID NO: 407262 - DNA, 40 bp, Artificial Sequence; identical to SEQ ID NO: 62892
  Description of Artificial Sequence: Synthetic oligonucleotide

SEQ ID NO: 407263 - DNA, 39 bp, Artificial Sequence; identical to SEQ ID NO: 62893
  Description of Artificial Sequence: Synthetic oligonucleotide

SEQ ID NO: 407264 - DNA, 39 bp, Artificial Sequence; identical to SEQ ID NO: 62894
  Description of Artificial Sequence: Synthetic oligonucleotide

SEQ ID NO: 407265 - DNA, 38 bp, Artificial Sequence; identical to SEQ ID NO: 62895
  Description of Artificial Sequence: Synthetic oligonucleotide

SEQ ID NO: 407266 - DNA, 38 bp, Artificial Sequence; identical to SEQ ID NO: 62896
  Description of Artificial Sequence: Synthetic oligonucleotide

SEQ ID NO: 407267 - DNA, 39 bp, Artificial Sequence; identical to SEQ ID NO: 62897
  Description of Artificial Sequence: Synthetic oligonucleotide

SEQ ID NO: 407268 - DNA, 39 bp, Artificial Sequence; identical to SEQ ID NO: 62898
  Description of Artificial Sequence: Synthetic oligonucleotide

SEQ ID NO: 407269 - DNA, 38 bp, Artificial Sequence; identical to SEQ ID NO: 62899
  Description of Artificial Sequence: Synthetic oligonucleotide

SEQ ID NO: 407270 - DNA, 38 bp, Artificial Sequence; identical to SEQ ID NO: 62900
  Description of Artificial Sequence: Synthetic oligonucleotide

SEQ ID NO: 407271 - DNA, 38 bp, Artificial Sequence; identical to SEQ ID NO: 62901
  Description of Artificial Sequence: Synthetic oligonucleotide

SEQ ID NO: 407272 - DNA, 37 bp, Artificial Sequence; identical to SEQ ID NO: 62902
  Description of Artificial Sequence: Synthetic oligonucleotide

SEQ ID NO: 407273 - DNA, 36 bp, Artificial Sequence; identical to SEQ ID NO: 62903
  Description of Artificial Sequence: Synthetic oligonucleotide

SEQ ID NO: 407274 - DNA, 35 bp, Artificial Sequence; identical to SEQ ID NO: 62904
  Description of Artificial Sequence: Synthetic oligonucleotide

SEQ ID NO: 407275 - DNA, 34 bp, Artificial Sequence; identical to SEQ ID NO: 62905
  Description of Artificial Sequence: Synthetic oligonucleotide

SEQ ID NO: 407276 - DNA, 34 bp, Artificial Sequence; identical to SEQ ID NO: 62906
  Description of Artificial Sequence: Synthetic oligonucleotide

SEQ ID NO: 407277 - DNA, 33 bp, Artificial Sequence; identical to SEQ ID NO: 62907
  Description of Artificial Sequence: Synthetic oligonucleotide

SEQ ID NO: 407278 - DNA, 32 bp, Artificial Sequence; identical to SEQ ID NO: 62908
  Description of Artificial Sequence: Synthetic oligonucleotide

SEQ ID NO: 407279 - DNA, 31 bp, Artificial Sequence; identical to SEQ ID NO: 62909
  Description of Artificial Sequence: Synthetic oligonucleotide

SEQ ID NO: 407280 - DNA, 32 bp, Artificial Sequence; identical to SEQ ID NO: 62910
  Description of Artificial Sequence: Synthetic oligonucleotide

SEQ ID NO: 407281 - DNA, 31 bp, Artificial Sequence; identical to SEQ ID NO: 62911
  Description of Artificial Sequence: Synthetic oligonucleotide

SEQ ID NO: 407282 - DNA, 30 bp, Artificial Sequence; identical to SEQ ID NO: 62912
  Description of Artificial Sequence: Synthetic oligonucleotide

SEQ ID NO: 407283 - DNA, 29 bp, Artificial Sequence
  Description of Artificial Sequence: Synthetic oligonucleotide
gtcatttcttcaatgggacggagcgggtg

SEQ ID NO: 407284 - DNA, 29 bp, Artificial Sequence
  Description of Artificial Sequence: Synthetic oligonucleotide
tcatttcttcaatgggacggagcgggtgc

SEQ ID NO: 407285 - DNA, 28 bp, Artificial Sequence
  Description of Artificial Sequence: Synthetic oligonucleotide
catttcttcaatgggacggagcgggtgc

SEQ ID NO: 407286 - DNA, 28 bp, Artificial Sequence
  Description of Artificial Sequence: Synthetic oligonucleotide
atttcttcaatgggacggagcgggtgcg

SEQ ID NO: 407287 - DNA, 27 bp, Artificial Sequence
  Description of Artificial Sequence: Synthetic oligonucleotide
tttcttcaatgggacggagcgggtgcg

SEQ ID NO: 407288 - DNA, 26 bp, Artificial Sequence
  Description of Artificial Sequence: Synthetic oligonucleotide
ttcttcaatgggacggagcgggtgcg

SEQ ID NO: 407289 - DNA, 25 bp, Artificial Sequence
  Description of Artificial Sequence: Synthetic oligonucleotide
tcttcaatgggacggagcgggtgcg

SEQ ID NO: 407290 - DNA, 24 bp, Artificial Sequence
  Description of Artificial Sequence: Synthetic oligonucleotide
cttcaatgggacggagcgggtgcg

SEQ ID NO: 407291 - DNA, 26 bp, Artificial Sequence
  Description of Artificial Sequence: Synthetic oligonucleotide
ttcaatgggacggagcgggtgcggtt

SEQ ID NO: 407292 - DNA, 25 bp, Artificial Sequence
  Description of Artificial Sequence: Synthetic oligonucleotide
tcaatgggacggagcgggtgcggtt

SEQ ID NO: 407293 - DNA, 24 bp, Artificial Sequence
  Description of Artificial Sequence: Synthetic oligonucleotide
caatgggacggagcgggtgcggtt

SEQ ID NO: 407294 - DNA, 24 bp, Artificial Sequence
  Description of Artificial Sequence: Synthetic oligonucleotide
aatgggacggagcgggtgcggttg

SEQ ID NO: 407295 - DNA, 23 bp, Artificial Sequence
  Description of Artificial Sequence: Synthetic oligonucleotide
atgggacggagcgggtgcggttg

SEQ ID NO: 407296 - DNA, 22 bp, Artificial Sequence
  Description of Artificial Sequence: Synthetic oligonucleotide
tgggacggagcgggtgcggttg

SEQ ID NO: 407297 - DNA, 21 bp, Artificial Sequence
  Description of Artificial Sequence: Synthetic oligonucleotide
gggacggagcgggtgcggttg

SEQ ID NO: 407298 - DNA, 22 bp, Artificial Sequence
  Description of Artificial Sequence: Synthetic oligonucleotide
ggacggagcgggtgcggttgct

SEQ ID NO: 407299 - DNA, 22 bp, Artificial Sequence
  Description of Artificial Sequence: Synthetic oligonucleotide
gacggagcgggtgcggttgctg

SEQ ID NO: 407300 - DNA, 25 bp, Artificial Sequence
  Description of Artificial Sequence: Synthetic oligonucleotide
acggagcgggtgcggttgctggaaa

SEQ ID NO: 407301 - DNA, 24 bp, Artificial Sequence
  Description of Artificial Sequence: Synthetic oligonucleotide
cggagcgggtgcggttgctggaaa

SEQ ID NO: 407302 - DNA, 26 bp, Artificial Sequence
  Description of Artificial Sequence: Synthetic oligonucleotide
ggagcgggtgcggttgctggaaagat

SEQ ID NO: 407303 - DNA, 26 bp, Artificial Sequence
  Description of Artificial Sequence: Synthetic oligonucleotide
gagcgggtgcggttgctggaaagatg

SEQ ID NO: 407304 - DNA, 27 bp, Artificial Sequence
  Description of Artificial Sequence: Synthetic oligonucleotide
agcgggtgcggttgctggaaagatgca

SEQ ID NO: 407305 - DNA, 27 bp, Artificial Sequence
  Description of Artificial Sequence: Synthetic oligonucleotide
gcgggtgcggttgctggaaagatgcat

SEQ ID NO: 407306 - DNA, 27 bp, Artificial Sequence
  Description of Artificial Sequence: Synthetic oligonucleotide
cgggtgcggttgctggaaagatgcatc

SEQ ID NO: 407307 - DNA, 32 bp, Artificial Sequence; identical to SEQ ID NO: 62937
  Description of Artificial Sequence: Synthetic oligonucleotide

SEQ ID NO: 407308 - DNA, 32 bp, Artificial Sequence; identical to SEQ ID NO: 62938
  Description of Artificial Sequence: Synthetic oligonucleotide

SEQ ID NO: 407309 - DNA, 34 bp, Artificial Sequence; identical to SEQ ID NO: 62939
  Description of Artificial Sequence: Synthetic oligonucleotide

SEQ ID NO: 407310 - DNA, 35 bp, Artificial Sequence; identical to SEQ ID NO: 62940
  Description of Artificial Sequence: Synthetic oligonucleotide

SEQ ID NO: 407311 - DNA, 34 bp, Artificial Sequence; identical to SEQ ID NO: 62941
  Description of Artificial Sequence: Synthetic oligonucleotide

SEQ ID NO: 407312 - DNA, 34 bp, Artificial Sequence; identical to SEQ ID NO: 62942
  Description of Artificial Sequence: Synthetic oligonucleotide

SEQ ID NO: 407313 - DNA, 35 bp, Artificial Sequence; identical to SEQ ID NO: 62943
  Description of Artificial Sequence: Synthetic oligonucleotide

SEQ ID NO: 407314 - DNA, 36 bp, Artificial Sequence; identical to SEQ ID NO: 62944
  Description of Artificial Sequence: Synthetic oligonucleotide

SEQ ID NO: 407315 - DNA, 36 bp, Artificial Sequence; identical to SEQ ID NO: 62945
  Description of Artificial Sequence: Synthetic oligonucleotide

SEQ ID NO: 407316 - DNA, 35 bp, Artificial Sequence; identical to SEQ ID NO: 62946
  Description of Artificial Sequence: Synthetic oligonucleotide

SEQ ID NO: 407317 - DNA, 34 bp, Artificial Sequence; identical to SEQ ID NO: 62947
  Description of Artificial Sequence: Synthetic oligonucleotide

SEQ ID NO: 407318 - DNA, 34 bp, Artificial Sequence; identical to SEQ ID NO: 62948
  Description of Artificial Sequence: Synthetic oligonucleotide

SEQ ID NO: 407319 - DNA, 35 bp, Artificial Sequence; identical to SEQ ID NO: 62949
  Description of Artificial Sequence: Synthetic oligonucleotide

SEQ ID NO: 407320 - DNA, 34 bp, Artificial Sequence; identical to SEQ ID NO: 62950
  Description of Artificial Sequence: Synthetic oligonucleotide

SEQ ID NO: 407321 - DNA, 34 bp, Artificial Sequence; identical to SEQ ID NO: 62951
  Description of Artificial Sequence: Synthetic oligonucleotide

SEQ ID NO: 407322 - DNA, 34 bp, Artificial Sequence; identical to SEQ ID NO: 62952
  Description of Artificial Sequence: Synthetic oligonucleotide

SEQ ID NO: 407323 - DNA, 33 bp, Artificial Sequence; identical to SEQ ID NO: 62953
  Description of Artificial Sequence: Synthetic oligonucleotide

SEQ ID NO: 407324 - DNA, 32 bp, Artificial Sequence; identical to SEQ ID NO: 62954
  Description of Artificial Sequence: Synthetic oligonucleotide

SEQ ID NO: 407325 - DNA, 31 bp, Artificial Sequence; identical to SEQ ID NO: 62955
  Description of Artificial Sequence: Synthetic oligonucleotide

SEQ ID NO: 407326 - DNA, 31 bp, Artificial Sequence; identical to SEQ ID NO: 62956
  Description of Artificial Sequence: Synthetic oligonucleotide

SEQ ID NO: 407327 - DNA, 30 bp, Artificial Sequence; identical to SEQ ID NO: 62957
  Description of Artificial Sequence: Synthetic oligonucleotide

SEQ ID NO: 407328 - DNA, 29 bp, Artificial Sequence
  Description of Artificial Sequence: Synthetic oligonucleotide
gcatctataaccaagaggagtccgtgcgc

SEQ ID NO: 407329 - DNA, 31 bp, Artificial Sequence; identical to SEQ ID NO: 62959
  Description of Artificial Sequence: Synthetic oligonucleotide

SEQ ID NO: 407330 - DNA, 31 bp, Artificial Sequence; identical to SEQ ID NO: 62960
  Description of Artificial Sequence: Synthetic oligonucleotide

SEQ ID NO: 407331 - DNA, 30 bp, Artificial Sequence; identical to SEQ ID NO: 62961
  Description of Artificial Sequence: Synthetic oligonucleotide

SEQ ID NO: 407332 - DNA, 29 bp, Artificial Sequence
  Description of Artificial Sequence: Synthetic oligonucleotide
ctataaccaagaggagtccgtgcgcttcg

SEQ ID NO: 407333 - DNA, 30 bp, Artificial Sequence; identical to SEQ ID NO: 62963
  Description of Artificial Sequence: Synthetic oligonucleotide

SEQ ID NO: 407334 - DNA, 29 bp, Artificial Sequence
  Description of Artificial Sequence: Synthetic oligonucleotide
ataaccaagaggagtccgtgcgcttcgac

SEQ ID NO: 407335 - DNA, 28 bp, Artificial Sequence
  Description of Artificial Sequence: Synthetic oligonucleotide
taaccaagaggagtccgtgcgcttcgac

SEQ ID NO: 407336 - DNA, 27 bp, Artificial Sequence
  Description of Artificial Sequence: Synthetic oligonucleotide
aaccaagaggagtccgtgcgcttcgac

SEQ ID NO: 407337 - DNA, 27 bp, Artificial Sequence
  Description of Artificial Sequence: Synthetic oligonucleotide
accaagaggagtccgtgcgcttcgaca

SEQ ID NO: 407338 - DNA, 26 bp, Artificial Sequence
  Description of Artificial Sequence: Synthetic oligonucleotide
ccaagaggagtccgtgcgcttcgaca

SEQ ID NO: 407339 - DNA, 26 bp, Artificial Sequence
  Description of Artificial Sequence: Synthetic oligonucleotide
caagaggagtccgtgcgcttcgacag

SEQ ID NO: 407340 - DNA, 26 bp, Artificial Sequence
  Description of Artificial Sequence: Synthetic oligonucleotide
aagaggagtccgtgcgcttcgacagc

SEQ ID NO: 407341 - DNA, 25 bp, Artificial Sequence
  Description of Artificial Sequence: Synthetic oligonucleotide
agaggagtccgtgcgcttcgacagc

SEQ ID NO: 407342 - DNA, 24 bp, Artificial Sequence
  Description of Artificial Sequence: Synthetic oligonucleotide
gaggagtccgtgcgcttcgacagc

SEQ ID NO: 407343 - DNA, 25 bp, Artificial Sequence
  Description of Artificial Sequence: Synthetic oligonucleotide
aggagtccgtgcgcttcgacagcga

SEQ ID NO: 407344 - DNA, 24 bp, Artificial Sequence
  Description of Artificial Sequence: Synthetic oligonucleotide
ggagtccgtgcgcttcgacagcga

SEQ ID NO: 407345 - DNA, 24 bp, Artificial Sequence
  Description of Artificial Sequence: Synthetic oligonucleotide
gagtccgtgcgcttcgacagcgac

SEQ ID NO: 407346 - DNA, 25 bp, Artificial Sequence
  Description of Artificial Sequence: Synthetic oligonucleotide
agtccgtgcgcttcgacagcgacgt

SEQ ID NO: 407347 - DNA, 24 bp, Artificial Sequence
  Description of Artificial Sequence: Synthetic oligonucleotide
gtccgtgcgcttcgacagcgacgt

SEQ ID NO: 407348 - DNA, 24 bp, Artificial Sequence
  Description of Artificial Sequence: Synthetic oligonucleotide
tccgtgcgcttcgacagcgacgtg

SEQ ID NO: 407349 - DNA, 23 bp, Artificial Sequence
  Description of Artificial Sequence: Synthetic oligonucleotide
ccgtgcgcttcgacagcgacgtg

SEQ ID NO: 407350 - DNA, 25 bp, Artificial Sequence
  Description of Artificial Sequence: Synthetic oligonucleotide
gcttcgacagcgacgtgggggagta

SEQ ID NO: 407351 - DNA, 25 bp, Artificial Sequence
  Description of Artificial Sequence: Synthetic oligonucleotide
cttcgacagcgacgtgggggagtac

SEQ ID NO: 407352 - DNA, 25 bp, Artificial Sequence
  Description of Artificial Sequence: Synthetic oligonucleotide
ttcgacagcgacgtgggggagtacc

SEQ ID NO: 407353 - DNA, 24 bp, Artificial Sequence
  Description of Artificial Sequence: Synthetic oligonucleotide
tcgacagcgacgtgggggagtacc

SEQ ID NO: 407354 - DNA, 23 bp, Artificial Sequence
  Description of Artificial Sequence: Synthetic oligonucleotide
cgacagcgacgtgggggagtacc

SEQ ID NO: 407355 - DNA, 23 bp, Artificial Sequence
  Description of Artificial Sequence: Synthetic oligonucleotide
gacagcgacgtgggggagtaccg

SEQ ID NO: 407356 - DNA, 23 bp, Artificial Sequence
  Description of Artificial Sequence: Synthetic oligonucleotide
acagcgacgtgggggagtaccgg

SEQ ID NO: 407357 - DNA, 22 bp, Artificial Sequence
  Description of Artificial Sequence: Synthetic oligonucleotide
cagcgacgtgggggagtaccgg

SEQ ID NO: 407358 - DNA, 22 bp, Artificial Sequence
  Description of Artificial Sequence: Synthetic oligonucleotide
agcgacgtgggggagtaccggg

SEQ ID NO: 407359 - DNA, 21 bp, Artificial Sequence
  Description of Artificial Sequence: Synthetic oligonucleotide
gcgacgtgggggagtaccggg

SEQ ID NO: 407360 - DNA, 21 bp, Artificial Sequence
  Description of Artificial Sequence: Synthetic oligonucleotide
cgacgtgggggagtaccgggc

SEQ ID NO: 407361 - DNA, 21 bp, Artificial Sequence
  Description of Artificial Sequence: Synthetic oligonucleotide
gacgtgggggagtaccgggcg

SEQ ID NO: 407362 - DNA, 22 bp, Artificial Sequence
  Description of Artificial Sequence: Synthetic oligonucleotide
acgtgggggagtaccgggcggt

SEQ ID NO: 407363 - DNA, 21 bp, Artificial Sequence
  Description of Artificial Sequence: Synthetic oligonucleotide
cgtgggggagtaccgggcggt

SEQ ID NO: 407364 - DNA, 22 bp, Artificial Sequence
  Description of Artificial Sequence: Synthetic oligonucleotide
gtgggggagtaccgggcggtga

SEQ ID NO: 407365 - DNA, 22 bp, Artificial Sequence
  Description of Artificial Sequence: Synthetic oligonucleotide
tgggggagtaccgggcggtgac

SEQ ID NO: 407366 - DNA, 21 bp, Artificial Sequence
  Description of Artificial Sequence: Synthetic oligonucleotide
gggggagtaccgggcggtgac

SEQ ID NO: 407367 - DNA, 21 bp, Artificial Sequence
  Description of Artificial Sequence: Synthetic oligonucleotide
ggggagtaccgggcggtgacg

SEQ ID NO: 407368 - DNA, 22 bp, Artificial Sequence
  Description of Artificial Sequence: Synthetic oligonucleotide
gggagtaccgggcggtgacgga

SEQ ID NO: 407369 - DNA, 22 bp, Artificial Sequence
  Description of Artificial Sequence: Synthetic oligonucleotide
ggagtaccgggcggtgacggag

SEQ ID NO: 407370 - DNA, 23 bp, Artificial Sequence
  Description of Artificial Sequence: Synthetic oligonucleotide
gagtaccgggcggtgacggagct

SEQ ID NO: 407371 - DNA, 23 bp, Artificial Sequence
  Description of Artificial Sequence: Synthetic oligonucleotide
agtaccgggcggtgacggagctg

SEQ ID NO: 407372 - DNA, 22 bp, Artificial Sequence
  Description of Artificial Sequence: Synthetic oligonucleotide
gtaccgggcggtgacggagctg

SEQ ID NO: 407373 - DNA, 22 bp, Artificial Sequence
  Description of Artificial Sequence: Synthetic oligonucleotide
taccgggcggtgacggagctgg

SEQ ID NO: 407374 - DNA, 21 bp, Artificial Sequence
  Description of Artificial Sequence: Synthetic oligonucleotide
accgggcggtgacggagctgg

SEQ ID NO: 407375 - DNA, 22 bp, Artificial Sequence
  Description of Artificial Sequence: Synthetic oligonucleotide
acggagctggggcggcctgatg

SEQ ID NO: 407376 - DNA, 21 bp, Artificial Sequence
  Description of Artificial Sequence: Synthetic oligonucleotide
cggagctggggcggcctgatg

SEQ ID NO: 407377 - DNA, 21 bp, Artificial Sequence
  Description of Artificial Sequence: Synthetic oligonucleotide
ggagctggggcggcctgatgc

SEQ ID NO: 407378 - DNA, 21 bp, Artificial Sequence
  Description of Artificial Sequence: Synthetic oligonucleotide
gagctggggcggcctgatgcc

SEQ ID NO: 407379 - DNA, 22 bp, Artificial Sequence
  Description of Artificial Sequence: Synthetic oligonucleotide
agctggggcggcctgatgccga

SEQ ID NO: 407380 - DNA, 29 bp, Artificial Sequence
  Description of Artificial Sequence: Synthetic oligonucleotide
atgccgagtactggaacagccagaaggac

SEQ ID NO: 407381 - DNA, 28 bp, Artificial Sequence
  Description of Artificial Sequence: Synthetic oligonucleotide
tgccgagtactggaacagccagaaggac

SEQ ID NO: 407382 - DNA, 27 bp, Artificial Sequence
  Description of Artificial Sequence: Synthetic oligonucleotide
ccgagtactggaacagccagaaggacc

SEQ ID NO: 407383 - DNA, 28 bp, Artificial Sequence
  Description of Artificial Sequence: Synthetic oligonucleotide
cgagtactggaacagccagaaggacctc

SEQ ID NO: 407384 - DNA, 27 bp, Artificial Sequence
  Description of Artificial Sequence: Synthetic oligonucleotide
gaacagccagaaggacctcctggagca

SEQ ID NO: 407385 - DNA, 27 bp, Artificial Sequence
  Description of Artificial Sequence: Synthetic oligonucleotide
aacagccagaaggacctcctggagcag

SEQ ID NO: 407386 - DNA, 27 bp, Artificial Sequence
  Description of Artificial Sequence: Synthetic oligonucleotide
acagccagaaggacctcctggagcaga

SEQ ID NO: 407387 - DNA, 26 bp, Artificial Sequence
  Description of Artificial Sequence: Synthetic oligonucleotide
cagccagaaggacctcctggagcaga

SEQ ID NO: 407388 - DNA, 26 bp, Artificial Sequence
  Description of Artificial Sequence: Synthetic oligonucleotide
agccagaaggacctcctggagcagag

SEQ ID NO: 407389 - DNA, 25 bp, Artificial Sequence
  Description of Artificial Sequence: Synthetic oligonucleotide
gccagaaggacctcctggagcagag

SEQ ID NO: 407390 - DNA, 25 bp, Artificial Sequence
  Description of Artificial Sequence: Synthetic oligonucleotide
ccagaaggacctcctggagcagagg

SEQ ID NO: 407391 - DNA, 25 bp, Artificial Sequence
  Description of Artificial Sequence: Synthetic oligonucleotide
cagaaggacctcctggagcagaggc

SEQ ID NO: 407392 - DNA, 25 bp, Artificial Sequence
  Description of Artificial Sequence: Synthetic oligonucleotide
agaaggacctcctggagcagaggcg

SEQ ID NO: 407393 - DNA, 24 bp, Artificial Sequence
  Description of Artificial Sequence: Synthetic oligonucleotide
gaaggacctcctggagcagaggcg

SEQ ID NO: 407394 - DNA, 24 bp, Artificial Sequence
  Description of Artificial Sequence: Synthetic oligonucleotide
aaggacctcctggagcagaggcgg

SEQ ID NO: 407395 - DNA, 23 bp, Artificial Sequence
  Description of Artificial Sequence: Synthetic oligonucleotide
aggacctcctggagcagaggcgg

SEQ ID NO: 407396 - DNA, 22 bp, Artificial Sequence
  Description of Artificial Sequence: Synthetic oligonucleotide
ggacctcctggagcagaggcgg

SEQ ID NO: 407397 - DNA, 22 bp, Artificial Sequence
  Description of Artificial Sequence: Synthetic oligonucleotide
gacctcctggagcagaggcggg

SEQ ID NO: 407398 - DNA, 22 bp, Artificial Sequence
  Description of Artificial Sequence: Synthetic oligonucleotide
acctcctggagcagaggcgggc

SEQ ID NO: 407399 - DNA, 21 bp, Artificial Sequence
  Description of Artificial Sequence: Synthetic oligonucleotide
cctcctggagcagaggcgggc

SEQ ID NO: 407400 - DNA, 21 bp, Artificial Sequence
  Description of Artificial Sequence: Synthetic oligonucleotide
ctcctggagcagaggcgggcc

SEQ ID NO: 407401 - DNA, 21 bp, Artificial Sequence
  Description of Artificial Sequence: Synthetic oligonucleotide
tcctggagcagaggcgggccg

SEQ ID NO: 407402 - DNA, 20 bp, Artificial Sequence
  Description of Artificial Sequence: Synthetic oligonucleotide
cctggagcagaggcgggccg

SEQ ID NO: 407403 - DNA, 20 bp, Artificial Sequence
  Description of Artificial Sequence: Synthetic oligonucleotide
ctggagcagaggcgggccgc

SEQ ID NO: 407404 - DNA, 20 bp, Artificial Sequence
  Description of Artificial Sequence: Synthetic oligonucleotide
tggagcagaggcgggccgcg

SEQ ID NO: 407405 - DNA, 20 bp, Artificial Sequence
  Description of Artificial Sequence: Synthetic oligonucleotide
ggagcagaggcgggccgcgt

SEQ ID NO: 407406 - DNA, 20 bp, Artificial Sequence
  Description of Artificial Sequence: Synthetic oligonucleotide
gagcagaggcgggccgcggt

SEQ ID NO: 407407 - DNA, 20 bp, Artificial Sequence
  Description of Artificial Sequence: Synthetic oligonucleotide
agcagaggcgggccgcggtg

SEQ ID NO: 407408 - DNA, 20 bp, Artificial Sequence
  Description of Artificial Sequence: Synthetic oligonucleotide
gcagaggcgggccgcggtgt

SEQ ID NO: 407409 - DNA, 20 bp, Artificial Sequence
  Description of Artificial Sequence: Synthetic oligonucleotide
cagaggcgggccgcggtgga

SEQ ID NO: 407410 - DNA, 21 bp, Artificial Sequence
  Description of Artificial Sequence: Synthetic oligonucleotide
agaggcgggccgcggtggaca

SEQ ID NO: 407411 - DNA, 20 bp, Artificial Sequence
  Description of Artificial Sequence: Synthetic oligonucleotide
gaggcgggccgcggtggaca

SEQ ID NO: 407412 - DNA, 20 bp, Artificial Sequence
  Description of Artificial Sequence: Synthetic oligonucleotide
aggcgggccgcggtggacac

SEQ ID NO: 407413 - DNA, 20 bp, Artificial Sequence
  Description of Artificial Sequence: Synthetic oligonucleotide
ggcgggccgcggtggacact

SEQ ID NO: 407414 - DNA, 21 bp, Artificial Sequence
  Description of Artificial Sequence: Synthetic oligonucleotide
gcgggccgcggtggacaccta

SEQ ID NO: 407415 - DNA, 22 bp, Artificial Sequence
  Description of Artificial Sequence: Synthetic oligonucleotide
cgggccgcggtggacacctact

SEQ ID NO: 407416 - DNA, 22 bp, Artificial Sequence
  Description of Artificial Sequence: Synthetic oligonucleotide
gggccgcggtggacacctactg

SEQ ID NO: 407417 - DNA, 23 bp, Artificial Sequence
  Description of Artificial Sequence: Synthetic oligonucleotide
ggccgcggtggacacctactgca

SEQ ID NO: 407418 - DNA, 24 bp, Artificial Sequence
  Description of Artificial Sequence: Synthetic oligonucleotide
gccgcggtggacacctactgcaga

SEQ ID NO: 407419 - DNA, 25 bp, Artificial Sequence
  Description of Artificial Sequence: Synthetic oligonucleotide
ccgcggtggacacctactgcagaca

SEQ ID NO: 407420 - DNA, 27 bp, Artificial Sequence
  Description of Artificial Sequence: Synthetic oligonucleotide
cgcggtggacacctactgcagacacaa

SEQ ID NO: 407421 - DNA, 27 bp, Artificial Sequence
  Description of Artificial Sequence: Synthetic oligonucleotide
gcggtggacacctactgcagacacaac

SEQ ID NO: 407422 - DNA, 29 bp, Artificial Sequence
  Description of Artificial Sequence: Synthetic oligonucleotide
cggtggacacctactgcagacacaactac

SEQ ID NO: 407423 - DNA, 29 bp, Artificial Sequence
  Description of Artificial Sequence: Synthetic oligonucleotide
ggtggacacctactgcagacacaactacg

SEQ ID NO: 407424 - DNA, 29 bp, Artificial Sequence
  Description of Artificial Sequence: Synthetic oligonucleotide
gtggacacctactgcagacacaactacgg

SEQ ID NO: 407425 - DNA, 29 bp, Artificial Sequence
  Description of Artificial Sequence: Synthetic oligonucleotide
tggacacctactgcagacacaactacggg

SEQ ID NO: 407426 - DNA, 28 bp, Artificial Sequence
  Description of Artificial Sequence: Synthetic oligonucleotide
ggacacctactgcagacacaactacggg

SEQ ID NO: 407427 - DNA, 28 bp, Artificial Sequence
  Description of Artificial Sequence: Synthetic oligonucleotide
gacacctactgcagacacaactacgggg

SEQ ID NO: 407428 - DNA, 30 bp, Artificial Sequence; identical to SEQ ID NO: 63058
  Description of Artificial Sequence: Synthetic oligonucleotide

SEQ ID NO: 407429 - DNA, 29 bp, Artificial Sequence
  Description of Artificial Sequence: Synthetic oligonucleotide
cacctactgcagacacaactacggggttg

SEQ ID NO: 407430 - DNA, 29 bp, Artificial Sequence
  Description of Artificial Sequence: Synthetic oligonucleotide
acctactgcagacacaactacggggttgg

SEQ ID NO: 407431 - DNA, 28 bp, Artificial Sequence
  Description of Artificial Sequence: Synthetic oligonucleotide
cctactgcagacacaactacggggttgg

SEQ ID NO: 407432 - DNA, 29 bp, Artificial Sequence
  Description of Artificial Sequence: Synthetic oligonucleotide
ctactgcagacacaactacggggttggtg

SEQ ID NO: 407433 - DNA, 30 bp, Artificial Sequence; identical to SEQ ID NO: 63063
  Description of Artificial Sequence: Synthetic oligonucleotide

SEQ ID NO: 407434 - DNA, 29 bp, Artificial Sequence
  Description of Artificial Sequence: Synthetic oligonucleotide
actgcagacacaactacggggttggtgag

SEQ ID NO: 407435 - DNA, 28 bp, Artificial Sequence
  Description of Artificial Sequence: Synthetic oligonucleotide
ctgcagacacaactacggggttggtgag

SEQ ID NO: 407436 - DNA, 29 bp, Artificial Sequence
  Description of Artificial Sequence: Synthetic oligonucleotide
tgcagacacaactacggggttggtgagag

SEQ ID NO: 407437 - DNA, 28 bp, Artificial Sequence
  Description of Artificial Sequence: Synthetic oligonucleotide
gcagacacaactacggggttggtgagag

SEQ ID NO: 407438 - DNA, 28 bp, Artificial Sequence
  Description of Artificial Sequence: Synthetic oligonucleotide
cagacacaactacggggttggtgagagc

SEQ ID NO: 407439 - DNA, 30 bp, Artificial Sequence; identical to SEQ ID NO: 63069
  Description of Artificial Sequence: Synthetic oligonucleotide

SEQ ID NO: 407440 - DNA, 29 bp, Artificial Sequence
  Description of Artificial Sequence: Synthetic oligonucleotide
gacacaactacggggttggtgagagcttc

SEQ ID NO: 407441 - DNA, 30 bp, Artificial Sequence; identical to SEQ ID NO: 63071
  Description of Artificial Sequence: Synthetic oligonucleotide

SEQ ID NO: 407442 - DNA, 29 bp, Artificial Sequence
  Description of Artificial Sequence: Synthetic oligonucleotide
cacaactacggggttggtgagagcttcac

SEQ ID NO: 407443 - DNA, 30 bp, Artificial Sequence; identical to SEQ ID NO: 63073
  Description of Artificial Sequence: Synthetic oligonucleotide

SEQ ID NO: 407444 - DNA, 29 bp, Artificial Sequence
  Description of Artificial Sequence: Synthetic oligonucleotide
caactacggggttggtgagagcttcacag

SEQ ID NO: 407445 - DNA, 30 bp, Artificial Sequence; identical to SEQ ID NO: 63075
  Description of Artificial Sequence: Synthetic oligonucleotide

SEQ ID NO: 407446 - DNA, 29 bp, Artificial Sequence
  Description of Artificial Sequence: Synthetic oligonucleotide
actacggggttggtgagagcttcacagtg

SEQ ID NO: 407447 - DNA, 28 bp, Artificial Sequence
  Description of Artificial Sequence: Synthetic oligonucleotide
ctacggggttggtgagagcttcacagtg

SEQ ID NO: 407448 - DNA, 28 bp, Artificial Sequence
  Description of Artificial Sequence: Synthetic oligonucleotide
tacggggttggtgagagcttcacagtgc

SEQ ID NO: 407449 - DNA, 27 bp, Artificial Sequence
  Description of Artificial Sequence: Synthetic oligonucleotide
acggggttggtgagagcttcacagtgc

SEQ ID NO: 407450 - DNA, 27 bp, Artificial Sequence
  Description of Artificial Sequence: Synthetic oligonucleotide
cggggttggtgagagcttcacagtgca

SEQ ID NO: 407451 - DNA, 27 bp, Artificial Sequence
  Description of Artificial Sequence: Synthetic oligonucleotide
ggggttggtgagagcttcacagtgcag

SEQ ID NO: 407452 - DNA, 27 bp, Artificial Sequence
  Description of Artificial Sequence: Synthetic oligonucleotide
gggttggtgagagcttcacagtgcagc

SEQ ID NO: 407453 - DNA, 27 bp, Artificial Sequence
  Description of Artificial Sequence: Synthetic oligonucleotide
ggttggtgagagcttcacagtgcagcg

SEQ ID NO: 407454 - DNA, 27 bp, Artificial Sequence
  Description of Artificial Sequence: Synthetic oligonucleotide
gttggtgagagcttcacagtgcagcgg

SEQ ID NO: 407455 - DNA, 27 bp, Artificial Sequence
  Description of Artificial Sequence: Synthetic oligonucleotide
ttggtgagagcttcacagtgcagcggc

SEQ ID NO: 407456 - DNA, 26 bp, Artificial Sequence
  Description of Artificial Sequence: Synthetic oligonucleotide
tggtgagagcttcacagtgcagcggc

SEQ ID NO: 407457 - DNA, 25 bp, Artificial Sequence
  Description of Artificial Sequence: Synthetic oligonucleotide
ggtgagagcttcacagtgcagcggc

SEQ ID NO: 407458 - DNA, 26 bp, Artificial Sequence
  Description of Artificial Sequence: Synthetic oligonucleotide
gtgagagcttcacagtgcagcggcga

SEQ ID NO: 407459 - DNA, 27 bp, Artificial Sequence
  Description of Artificial Sequence: Synthetic oligonucleotide
tgagagcttcacagtgcagcggcgagt

SEQ ID NO: 407460 - DNA, 27 bp, Artificial Sequence
  Description of Artificial Sequence: Synthetic oligonucleotide
gagagcttcacagtgcagcggcgagtt

SEQ ID NO: 407461 - DNA, 27 bp, Artificial Sequence
  Description of Artificial Sequence: Synthetic oligonucleotide
agagcttcacagtgcagcggcgagttg

SEQ ID NO: 407462 - DNA, 27 bp, Artificial Sequence
  Description of Artificial Sequence: Synthetic oligonucleotide
gagcttcacagtgcagcggcgagttga

SEQ ID NO: 407463 - DNA, 27 bp, Artificial Sequence
  Description of Artificial Sequence: Synthetic oligonucleotide
agcttcacagtgcagcggcgagttgag

SEQ ID NO: 407464 - DNA, 26 bp, Artificial Sequence
  Description of Artificial Sequence: Synthetic oligonucleotide
gcttcacagtgcagcggcgagttgag

SEQ ID NO: 407465 - DNA, 26 bp, Artificial Sequence
  Description of Artificial Sequence: Synthetic oligonucleotide
cttcacagtgcagcggcgagttgagc

SEQ ID NO: 407466 - DNA, 27 bp, Artificial Sequence
  Description of Artificial Sequence: Synthetic oligonucleotide
ttcacagtgcagcggcgagttgagcct

SEQ ID NO: 407467 - DNA, 27 bp, Artificial Sequence
  Description of Artificial Sequence: Synthetic oligonucleotide
tcacagtgcagcggcgagttgagccta

SEQ ID NO: 407468 - DNA, 27 bp, Artificial Sequence
  Description of Artificial Sequence: Synthetic oligonucleotide
cacagtgcagcggcgagttgagcctaa

SEQ ID NO: 407469 - DNA, 27 bp, Artificial Sequence
  Description of Artificial Sequence: Synthetic oligonucleotide
acagtgcagcggcgagttgagcctaag

SEQ ID NO: 407470 - DNA, 26 bp, Artificial Sequence
  Description of Artificial Sequence: Synthetic oligonucleotide
cagtgcagcggcgagttgagcctaag

SEQ ID NO: 407471 - DNA, 27 bp, Artificial Sequence
  Description of Artificial Sequence: Synthetic oligonucleotide
agtgcagcggcgagttgagcctaaggt

SEQ ID NO: 407472 - DNA, 26 bp, Artificial Sequence
  Description of Artificial Sequence: Synthetic oligonucleotide
gtgcagcggcgagttgagcctaaggt

SEQ ID NO: 407473 - DNA, 27 bp, Artificial Sequence
  Description of Artificial Sequence: Synthetic oligonucleotide
tgcagcggcgagttgagcctaaggtga

SEQ ID NO: 407474 - DNA, 26 bp, Artificial Sequence
  Description of Artificial Sequence: Synthetic oligonucleotide
gcagcggcgagttgagcctaaggtga

SEQ ID NO: 407475 - DNA, 27 bp, Artificial Sequence
  Description of Artificial Sequence: Synthetic oligonucleotide
cagcggcgagttgagcctaaggtgact

SEQ ID NO: 407476 - DNA, 27 bp, Artificial Sequence
  Description of Artificial Sequence: Synthetic oligonucleotide
agcggcgagttgagcctaaggtgactg

SEQ ID NO: 407477 - DNA, 27 bp, Artificial Sequence
  Description of Artificial Sequence: Synthetic oligonucleotide
gcggcgagttgagcctaaggtgactgt

SEQ ID NO: 407478 - DNA, 27 bp, Artificial Sequence
  Description of Artificial Sequence: Synthetic oligonucleotide
cggcgagttgagcctaaggtgactgtg

SEQ ID NO: 407479 - DNA, 30 bp, Artificial Sequence; identical to SEQ ID NO: 63109
  Description of Artificial Sequence: Synthetic oligonucleotide

SEQ ID NO: 407480 - DNA, 30 bp, Artificial Sequence; identical to SEQ ID NO: 63110
  Description of Artificial Sequence: Synthetic oligonucleotide

SEQ ID NO: 407481 - DNA, 32 bp, Artificial Sequence; identical to SEQ ID NO: 63111
  Description of Artificial Sequence: Synthetic oligonucleotide

SEQ ID NO: 407482 - DNA, 35 bp, Artificial Sequence; identical to SEQ ID NO: 63112
  Description of Artificial Sequence: Synthetic oligonucleotide

SEQ ID NO: 407483 - DNA, 36 bp, Artificial Sequence; identical to SEQ ID NO: 63113
  Description of Artificial Sequence: Synthetic oligonucleotide

SEQ ID NO: 407484 - DNA, 35 bp, Artificial Sequence; identical to SEQ ID NO: 63114
  Description of Artificial Sequence: Synthetic oligonucleotide

SEQ ID NO: 407485 - DNA, 35 bp, Artificial Sequence; identical to SEQ ID NO: 63115
  Description of Artificial Sequence: Synthetic oligonucleotide

SEQ ID NO: 407486 - DNA, 34 bp, Artificial Sequence; identical to SEQ ID NO: 63116
  Description of Artificial Sequence: Synthetic oligonucleotide

SEQ ID NO: 407487 - DNA, 33 bp, Artificial Sequence; identical to SEQ ID NO: 63117
  Description of Artificial Sequence: Synthetic oligonucleotide

SEQ ID NO: 407488 - DNA, 33 bp, Artificial Sequence; identical to SEQ ID NO: 63118
  Description of Artificial Sequence: Synthetic oligonucleotide

SEQ ID NO: 407489 - DNA, 32 bp, Artificial Sequence; identical to SEQ ID NO: 63119
  Description of Artificial Sequence: Synthetic oligonucleotide

SEQ ID NO: 407490 - DNA, 33 bp, Artificial Sequence; identical to SEQ ID NO: 63120
  Description of Artificial Sequence: Synthetic oligonucleotide

SEQ ID NO: 407491 - DNA, 33 bp, Artificial Sequence; identical to SEQ ID NO: 63121
  Description of Artificial Sequence: Synthetic oligonucleotide

SEQ ID NO: 407492 - DNA, 33 bp, Artificial Sequence; identical to SEQ ID NO: 63122
  Description of Artificial Sequence: Synthetic oligonucleotide

SEQ ID NO: 407493 - DNA, 32 bp, Artificial Sequence; identical to SEQ ID NO: 63123
  Description of Artificial Sequence: Synthetic oligonucleotide

SEQ ID NO: 407494 - DNA, 31 bp, Artificial Sequence; identical to SEQ ID NO: 63124
  Description of Artificial Sequence: Synthetic oligonucleotide

SEQ ID NO: 407495 - DNA, 30 bp, Artificial Sequence; identical to SEQ ID NO: 63125
  Description of Artificial Sequence: Synthetic oligonucleotide

SEQ ID NO: 407496 - DNA, 30 bp, Artificial Sequence; identical to SEQ ID NO: 63126
  Description of Artificial Sequence: Synthetic oligonucleotide

SEQ ID NO: 407497 - DNA, 30 bp, Artificial Sequence; identical to SEQ ID NO: 63127
  Description of Artificial Sequence: Synthetic oligonucleotide

SEQ ID NO: 407498 - DNA, 29 bp, Artificial Sequence
  Description of Artificial Sequence: Synthetic oligonucleotide
gactgtgtatccttcaaagacccagcccc

SEQ ID NO: 407499 - DNA, 30 bp, Artificial Sequence; identical to SEQ ID NO: 63129
  Description of Artificial Sequence: Synthetic oligonucleotide

SEQ ID NO: 407500 - DNA, 29 bp, Artificial Sequence
  Description of Artificial Sequence: Synthetic oligonucleotide
ctgtgtatccttcaaagacccagcccctg

SEQ ID NO: 407501 - DNA, 29 bp, Artificial Sequence
  Description of Artificial Sequence: Synthetic oligonucleotide
tgtgtatccttcaaagacccagcccctgc

SEQ ID NO: 407502 - DNA, 28 bp, Artificial Sequence
  Description of Artificial Sequence: Synthetic oligonucleotide
gtgtatccttcaaagacccagcccctgc

SEQ ID NO: 407503 - DNA, 29 bp, Artificial Sequence
  Description of Artificial Sequence: Synthetic oligonucleotide
tgtatccttcaaagacccagcccctgcag

SEQ ID NO: 407504 - DNA, 28 bp, Artificial Sequence
  Description of Artificial Sequence: Synthetic oligonucleotide
gtatccttcaaagacccagcccctgcag

SEQ ID NO: 407505 - DNA, 28 bp, Artificial Sequence
  Description of Artificial Sequence: Synthetic oligonucleotide
tatccttcaaagacccagcccctgcagc

SEQ ID NO: 407506 - DNA, 27 bp, Artificial Sequence
  Description of Artificial Sequence: Synthetic oligonucleotide
atccttcaaagacccagcccctgcagc

SEQ ID NO: 407507 - DNA, 27 bp, Artificial Sequence
  Description of Artificial Sequence: Synthetic oligonucleotide
tccttcaaagacccagcccctgcagca

SEQ ID NO: 407508 - DNA, 26 bp, Artificial Sequence
  Description of Artificial Sequence: Synthetic oligonucleotide
ccttcaaagacccagcccctgcagca

SEQ ID NO: 407509 - DNA, 26 bp, Artificial Sequence
  Description of Artificial Sequence: Synthetic oligonucleotide
cttcaaagacccagcccctgcagcac

SEQ ID NO: 407510 - DNA, 27 bp, Artificial Sequence
  Description of Artificial Sequence: Synthetic oligonucleotide
ttcaaagacccagcccctgcagcacca

SEQ ID NO: 407511 - DNA, 26 bp, Artificial Sequence
  Description of Artificial Sequence: Synthetic oligonucleotide
tcaaagacccagcccctgcagcacca

SEQ ID NO: 407512 - DNA, 25 bp, Artificial Sequence
  Description of Artificial Sequence: Synthetic oligonucleotide
caaagacccagcccctgcagcacca

SEQ ID NO: 407513 - DNA, 27 bp, Artificial Sequence
  Description of Artificial Sequence: Synthetic oligonucleotide
aaagacccagcccctgcagcaccacaa

SEQ ID NO: 407514 - DNA, 26 bp, Artificial Sequence
  Description of Artificial Sequence: Synthetic oligonucleotide
aagacccagcccctgcagcaccacaa

SEQ ID NO: 407515 - DNA, 25 bp, Artificial Sequence
  Description of Artificial Sequence: Synthetic oligonucleotide
agacccagcccctgcagcaccacaa

SEQ ID NO: 407516 - DNA, 24 bp, Artificial Sequence
  Description of Artificial Sequence: Synthetic oligonucleotide
gacccagcccctgcagcaccacaa

SEQ ID NO: 407517 - DNA, 24 bp, Artificial Sequence
  Description of Artificial Sequence: Synthetic oligonucleotide
acccagcccctgcagcaccacaac

SEQ ID NO: 407518 - DNA, 23 bp, Artificial Sequence
  Description of Artificial Sequence: Synthetic oligonucleotide
cccagcccctgcagcaccacaac

SEQ ID NO: 407519 - DNA, 24 bp, Artificial Sequence
  Description of Artificial Sequence: Synthetic oligonucleotide
ccagcccctgcagcaccacaacct

SEQ ID NO: 407520 - DNA, 24 bp, Artificial Sequence
  Description of Artificial Sequence: Synthetic oligonucleotide
cagcccctgcagcaccacaacctc

SEQ ID NO: 407521 - DNA, 25 bp, Artificial Sequence
  Description of Artificial Sequence: Synthetic oligonucleotide
agcccctgcagcaccacaacctcct

SEQ ID NO: 407522 - DNA, 24 bp, Artificial Sequence
  Description of Artificial Sequence: Synthetic oligonucleotide
gcccctgcagcaccacaacctcct

SEQ ID NO: 407523 - DNA, 24 bp, Artificial Sequence
  Description of Artificial Sequence: Synthetic oligonucleotide
cccctgcagcaccacaacctcctg

SEQ ID NO: 407524 - DNA, 25 bp, Artificial Sequence
  Description of Artificial Sequence: Synthetic oligonucleotide
ccctgcagcaccacaacctcctggt

SEQ ID NO: 407525 - DNA, 26 bp, Artificial Sequence
  Description of Artificial Sequence: Synthetic oligonucleotide
cctgcagcaccacaacctcctggtct

SEQ ID NO: 407526 - DNA, 26 bp, Artificial Sequence
  Description of Artificial Sequence: Synthetic oligonucleotide
ctgcagcaccacaacctcctggtctg

SEQ ID NO: 407527 - DNA, 27 bp, Artificial Sequence
  Description of Artificial Sequence: Synthetic oligonucleotide
tgcagcaccacaacctcctggtctgct

SEQ ID NO: 407528 - DNA, 26 bp, Artificial Sequence
  Description of Artificial Sequence: Synthetic oligonucleotide
gcagcaccacaacctcctggtctgct

SEQ ID NO: 407529 - DNA, 27 bp, Artificial Sequence
  Description of Artificial Sequence: Synthetic oligonucleotide
cagcaccacaacctcctggtctgctct

SEQ ID NO: 407530 - DNA, 27 bp, Artificial Sequence
  Description of Artificial Sequence: Synthetic oligonucleotide
agcaccacaacctcctggtctgctctg

SEQ ID NO: 407531 - DNA, 27 bp, Artificial Sequence
  Description of Artificial Sequence: Synthetic oligonucleotide
gcaccacaacctcctggtctgctctgt

SEQ ID NO: 407532 - DNA, 27 bp, Artificial Sequence
  Description of Artificial Sequence: Synthetic oligonucleotide
caccacaacctcctggtctgctctgtg

SEQ ID NO: 407533 - DNA, 28 bp, Artificial Sequence
  Description of Artificial Sequence: Synthetic oligonucleotide
accacaacctcctggtctgctctgtgag

SEQ ID NO: 407534 - DNA, 27 bp, Artificial Sequence
  Description of Artificial Sequence: Synthetic oligonucleotide
ccacaacctcctggtctgctctgtgag

SEQ ID NO: 407535 - DNA, 28 bp, Artificial Sequence
  Description of Artificial Sequence: Synthetic oligonucleotide
cacaacctcctggtctgctctgtgagtg

SEQ ID NO: 407536 - DNA, 28 bp, Artificial Sequence
  Description of Artificial Sequence: Synthetic oligonucleotide
acaacctcctggtctgctctgtgagtgg

SEQ ID NO: 407537 - DNA, 27 bp, Artificial Sequence
  Description of Artificial Sequence: Synthetic oligonucleotide
caacctcctggtctgctctgtgagtgg

SEQ ID NO: 407538 - DNA, 30 bp, Artificial Sequence; identical to SEQ ID NO: 63168
  Description of Artificial Sequence: Synthetic oligonucleotide

SEQ ID NO: 407539 - DNA, 29 bp, Artificial Sequence
  Description of Artificial Sequence: Synthetic oligonucleotide
acctcctggtctgctctgtgagtggtttc

SEQ ID NO: 407540 - DNA, 28 bp, Artificial Sequence
  Description of Artificial Sequence: Synthetic oligonucleotide
cctcctggtctgctctgtgagtggtttc

SEQ ID NO: 407541 - DNA, 31 bp, Artificial Sequence; identical to SEQ ID NO: 63171
  Description of Artificial Sequence: Synthetic oligonucleotide

SEQ ID NO: 407542 - DNA, 31 bp, Artificial Sequence; identical to SEQ ID NO: 63172
  Description of Artificial Sequence: Synthetic oligonucleotide

SEQ ID NO: 407543 - DNA, 30 bp, Artificial Sequence; identical to SEQ ID NO: 63173
  Description of Artificial Sequence: Synthetic oligonucleotide

SEQ ID NO: 407544 - DNA, 31 bp, Artificial Sequence; identical to SEQ ID NO: 63174
  Description of Artificial Sequence: Synthetic oligonucleotide

SEQ ID NO: 407545 - DNA, 31 bp, Artificial Sequence; identical to SEQ ID NO: 63175
  Description of Artificial Sequence: Synthetic oligonucleotide

SEQ ID NO: 407546 - DNA, 30 bp, Artificial Sequence; identical to SEQ ID NO: 63176
  Description of Artificial Sequence: Synthetic oligonucleotide

SEQ ID NO: 407547 - DNA, 30 bp, Artificial Sequence; identical to SEQ ID NO: 63177
  Description of Artificial Sequence: Synthetic oligonucleotide

SEQ ID NO: 407548 - DNA, 31 bp, Artificial Sequence; identical to SEQ ID NO: 63178
  Description of Artificial Sequence: Synthetic oligonucleotide

SEQ ID NO: 407549 - DNA, 30 bp, Artificial Sequence; identical to SEQ ID NO: 63179
  Description of Artificial Sequence: Synthetic oligonucleotide

SEQ ID NO: 407550 - DNA, 30 bp, Artificial Sequence; identical to SEQ ID NO: 63180
  Description of Artificial Sequence: Synthetic oligonucleotide

SEQ ID NO: 407551 - DNA, 29 bp, Artificial Sequence
  Description of Artificial Sequence: Synthetic oligonucleotide
gctctgtgagtggtttctatccaggcagc

SEQ ID NO: 407552 - DNA, 32 bp, Artificial Sequence; identical to SEQ ID NO: 63182
  Description of Artificial Sequence: Synthetic oligonucleotide

SEQ ID NO: 407553 - DNA, 34 bp, Artificial Sequence; identical to SEQ ID NO: 63183
  Description of Artificial Sequence: Synthetic oligonucleotide

SEQ ID NO: 407554 - DNA, 33 bp, Artificial Sequence; identical to SEQ ID NO: 63184
  Description of Artificial Sequence: Synthetic oligonucleotide

SEQ ID NO: 407555 - DNA, 34 bp, Artificial Sequence; identical to SEQ ID NO: 63185
  Description of Artificial Sequence: Synthetic oligonucleotide

SEQ ID NO: 407556 - DNA, 33 bp, Artificial Sequence; identical to SEQ ID NO: 63186
  Description of Artificial Sequence: Synthetic oligonucleotide

SEQ ID NO: 407557 - DNA, 34 bp, Artificial Sequence; identical to SEQ ID NO: 63187
  Description of Artificial Sequence: Synthetic oligonucleotide

SEQ ID NO: 407558 - DNA, 33 bp, Artificial Sequence; identical to SEQ ID NO: 63188
  Description of Artificial Sequence: Synthetic oligonucleotide

SEQ ID NO: 407559 - DNA, 33 bp, Artificial Sequence; identical to SEQ ID NO: 63189
  Description of Artificial Sequence: Synthetic oligonucleotide

SEQ ID NO: 407560 - DNA, 32 bp, Artificial Sequence; identical to SEQ ID NO: 63190
  Description of Artificial Sequence: Synthetic oligonucleotide

SEQ ID NO: 407561 - DNA, 33 bp, Artificial Sequence; identical to SEQ ID NO: 63191
  Description of Artificial Sequence: Synthetic oligonucleotide

SEQ ID NO: 407562 - DNA, 32 bp, Artificial Sequence; identical to SEQ ID NO: 63192
  Description of Artificial Sequence: Synthetic oligonucleotide

SEQ ID NO: 407563 - DNA, 32 bp, Artificial Sequence; identical to SEQ ID NO: 63193
  Description of Artificial Sequence: Synthetic oligonucleotide

SEQ ID NO: 407564 - DNA, 34 bp, Artificial Sequence; identical to SEQ ID NO: 63194
  Description of Artificial Sequence: Synthetic oligonucleotide

SEQ ID NO: 407565 - DNA, 33 bp, Artificial Sequence; identical to SEQ ID NO: 63195
  Description of Artificial Sequence: Synthetic oligonucleotide

SEQ ID NO: 407566 - DNA, 32 bp, Artificial Sequence; identical to SEQ ID NO: 63196
  Description of Artificial Sequence: Synthetic oligonucleotide

SEQ ID NO: 407567 - DNA, 31 bp, Artificial Sequence; identical to SEQ ID NO: 63197
  Description of Artificial Sequence: Synthetic oligonucleotide

SEQ ID NO: 407568 - DNA, 31 bp, Artificial Sequence; identical to SEQ ID NO: 63198
  Description of Artificial Sequence: Synthetic oligonucleotide

SEQ ID NO: 407569 - DNA, 30 bp, Artificial Sequence; identical to SEQ ID NO: 63199
  Description of Artificial Sequence: Synthetic oligonucleotide

SEQ ID NO: 407570 - DNA, 29 bp, Artificial Sequence
  Description of Artificial Sequence: Synthetic oligonucleotide
tccaggcagcattgaagtcaggtggttcc

SEQ ID NO: 407571 - DNA, 28 bp, Artificial Sequence
  Description of Artificial Sequence: Synthetic oligonucleotide
ccaggcagcattgaagtcaggtggttcc

SEQ ID NO: 407572 - DNA, 28 bp, Artificial Sequence
  Description of Artificial Sequence: Synthetic oligonucleotide
caggcagcattgaagtcaggtggttccg

SEQ ID NO: 407573 - DNA, 28 bp, Artificial Sequence
  Description of Artificial Sequence: Synthetic oligonucleotide
aggcagcattgaagtcaggtggttccgg

SEQ ID NO: 407574 - DNA, 27 bp, Artificial Sequence
  Description of Artificial Sequence: Synthetic oligonucleotide
ggcagcattgaagtcaggtggttccgg

SEQ ID NO: 407575 - DNA, 29 bp, Artificial Sequence
  Description of Artificial Sequence: Synthetic oligonucleotide
gcagcattgaagtcaggtggttccggaac

SEQ ID NO: 407576 - DNA, 29 bp, Artificial Sequence
  Description of Artificial Sequence: Synthetic oligonucleotide
cagcattgaagtcaggtggttccggaacg

SEQ ID NO: 407577 - DNA, 29 bp, Artificial Sequence
  Description of Artificial Sequence: Synthetic oligonucleotide
agcattgaagtcaggtggttccggaacgg

SEQ ID NO: 407578 - DNA, 28 bp, Artificial Sequence
  Description of Artificial Sequence: Synthetic oligonucleotide
gcattgaagtcaggtggttccggaacgg

SEQ ID NO: 407579 - DNA, 28 bp, Artificial Sequence
  Description of Artificial Sequence: Synthetic oligonucleotide
cattgaagtcaggtggttccggaacggc

SEQ ID NO: 407580 - DNA, 28 bp, Artificial Sequence
  Description of Artificial Sequence: Synthetic oligonucleotide
attgaagtcaggtggttccggaacggcc

SEQ ID NO: 407581 - DNA, 27 bp, Artificial Sequence
  Description of Artificial Sequence: Synthetic oligonucleotide
ttgaagtcaggtggttccggaacggcc

SEQ ID NO: 407582 - DNA, 27 bp, Artificial Sequence
  Description of Artificial Sequence: Synthetic oligonucleotide
tgaagtcaggtggttccggaacggcca

SEQ ID NO: 407583 - DNA, 26 bp, Artificial Sequence
  Description of Artificial Sequence: Synthetic oligonucleotide
gaagtcaggtggttccggaacggcca

SEQ ID NO: 407584 - DNA, 26 bp, Artificial Sequence
  Description of Artificial Sequence: Synthetic oligonucleotide
aagtcaggtggttccggaacggccag

SEQ ID NO: 407585 - DNA, 25 bp, Artificial Sequence
  Description of Artificial Sequence: Synthetic oligonucleotide
agtcaggtggttccggaacggccag

SEQ ID NO: 407586 - DNA, 24 bp, Artificial Sequence
  Description of Artificial Sequence: Synthetic oligonucleotide
gtcaggtggttccggaacggccag

SEQ ID NO: 407587 - DNA, 26 bp, Artificial Sequence
  Description of Artificial Sequence: Synthetic oligonucleotide
tcaggtggttccggaacggccaggaa

SEQ ID NO: 407588 - DNA, 25 bp, Artificial Sequence
  Description of Artificial Sequence: Synthetic oligonucleotide
caggtggttccggaacggccaggaa

SEQ ID NO: 407589 - DNA, 26 bp, Artificial Sequence
  Description of Artificial Sequence: Synthetic oligonucleotide
aggtggttccggaacggccaggaaga

SEQ ID NO: 407590 - DNA, 25 bp, Artificial Sequence
  Description of Artificial Sequence: Synthetic oligonucleotide
ggtggttccggaacggccaggaaga

SEQ ID NO: 407591 - DNA, 27 bp, Artificial Sequence
  Description of Artificial Sequence: Synthetic oligonucleotide
gtggttccggaacggccaggaagagaa

SEQ ID NO: 407592 - DNA, 27 bp, Artificial Sequence
  Description of Artificial Sequence: Synthetic oligonucleotide
tggttccggaacggccaggaagagaag

SEQ ID NO: 407593 - DNA, 26 bp, Artificial Sequence
  Description of Artificial Sequence: Synthetic oligonucleotide
ggttccggaacggccaggaagagaag

SEQ ID NO: 407594 - DNA, 26 bp, Artificial Sequence
  Description of Artificial Sequence: Synthetic oligonucleotide
gttccggaacggccaggaagagaagg

SEQ ID NO: 407595 - DNA, 27 bp, Artificial Sequence
  Description of Artificial Sequence: Synthetic oligonucleotide
ttccggaacggccaggaagagaaggct

SEQ ID NO: 407596 - DNA, 26 bp, Artificial Sequence
  Description of Artificial Sequence: Synthetic oligonucleotide
tccggaacggccaggaagagaaggct

SEQ ID NO: 407597 - DNA, 25 bp, Artificial Sequence
  Description of Artificial Sequence: Synthetic oligonucleotide
ccggaacggccaggaagagaaggct

SEQ ID NO: 407598 - DNA, 25 bp, Artificial Sequence
  Description of Artificial Sequence: Synthetic oligonucleotide
cggaacggccaggaagagaaggctg

SEQ ID NO: 407599 - DNA, 25 bp, Artificial Sequence
  Description of Artificial Sequence: Synthetic oligonucleotide
ggaacggccaggaagagaaggctgg

SEQ ID NO: 407600 - DNA, 25 bp, Artificial Sequence
  Description of Artificial Sequence: Synthetic oligonucleotide
gaacggccaggaagagaaggctggg

SEQ ID NO: 407601 - DNA, 26 bp, Artificial Sequence
  Description of Artificial Sequence: Synthetic oligonucleotide
aacggccaggaagagaaggctggggt

SEQ ID NO: 407602 - DNA, 25 bp, Artificial Sequence
  Description of Artificial Sequence: Synthetic oligonucleotide
acggccaggaagagaaggctggggt

SEQ ID NO: 407603 - DNA, 24 bp, Artificial Sequence
  Description of Artificial Sequence: Synthetic oligonucleotide
cggccaggaagagaaggctggggt

SEQ ID NO: 407604 - DNA, 24 bp, Artificial Sequence
  Description of Artificial Sequence: Synthetic oligonucleotide
ggccaggaagagaaggctggggtg

SEQ ID NO: 407605 - DNA, 25 bp, Artificial Sequence
  Description of Artificial Sequence: Synthetic oligonucleotide
gccaggaagagaaggctggggtggt

SEQ ID NO: 407606 - DNA, 26 bp, Artificial Sequence
  Description of Artificial Sequence: Synthetic oligonucleotide
ccaggaagagaaggctggggtggtgt

SEQ ID NO: 407607 - DNA, 26 bp, Artificial Sequence
  Description of Artificial Sequence: Synthetic oligonucleotide
caggaagagaaggctggggtggtgtc

SEQ ID NO: 407608 - DNA, 27 bp, Artificial Sequence
  Description of Artificial Sequence: Synthetic oligonucleotide
aggaagagaaggctggggtggtgtcca

SEQ ID NO: 407609 - DNA, 26 bp, Artificial Sequence
  Description of Artificial Sequence: Synthetic oligonucleotide
ggaagagaaggctggggtggtgtcca

SEQ ID NO: 407610 - DNA, 27 bp, Artificial Sequence
  Description of Artificial Sequence: Synthetic oligonucleotide
gaagagaaggctggggtggtgtccaca

SEQ ID NO: 407611 - DNA, 27 bp, Artificial Sequence
  Description of Artificial Sequence: Synthetic oligonucleotide
aagagaaggctggggtggtgtccacag

SEQ ID NO: 407612 - DNA, 26 bp, Artificial Sequence
  Description of Artificial Sequence: Synthetic oligonucleotide
agagaaggctggggtggtgtccacag

SEQ ID NO: 407613 - DNA, 25 bp, Artificial Sequence
  Description of Artificial Sequence: Synthetic oligonucleotide
gagaaggctggggtggtgtccacag

SEQ ID NO: 407614 - DNA, 25 bp, Artificial Sequence
  Description of Artificial Sequence: Synthetic oligonucleotide
agaaggctggggtggtgtccacagg

SEQ ID NO: 407615 - DNA, 24 bp, Artificial Sequence
  Description of Artificial Sequence: Synthetic oligonucleotide
gaaggctggggtggtgtccacagg

SEQ ID NO: 407616 - DNA, 24 bp, Artificial Sequence
  Description of Artificial Sequence: Synthetic oligonucleotide
aaggctggggtggtgtccacaggc

SEQ ID NO: 407617 - DNA, 23 bp, Artificial Sequence
  Description of Artificial Sequence: Synthetic oligonucleotide
aggctggggtggtgtccacaggc

SEQ ID NO: 407618 - DNA, 22 bp, Artificial Sequence
  Description of Artificial Sequence: Synthetic oligonucleotide
ggctggggtggtgtccacaggc

SEQ ID NO: 407619 - DNA, 23 bp, Artificial Sequence
  Description of Artificial Sequence: Synthetic oligonucleotide
gctggggtggtgtccacaggcct

SEQ ID NO: 407620 - DNA, 25 bp, Artificial Sequence
  Description of Artificial Sequence: Synthetic oligonucleotide
ctggggtggtgtccacaggcctgat

SEQ ID NO: 407621 - DNA, 25 bp, Artificial Sequence
  Description of Artificial Sequence: Synthetic oligonucleotide
tggggtggtgtccacaggcctgatc

SEQ ID NO: 407622 - DNA, 24 bp, Artificial Sequence
  Description of Artificial Sequence: Synthetic oligonucleotide
ggggtggtgtccacaggcctgatc

SEQ ID NO: 407623 - DNA, 25 bp, Artificial Sequence
  Description of Artificial Sequence: Synthetic oligonucleotide
gggtggtgtccacaggcctgatcca

SEQ ID NO: 407624 - DNA, 27 bp, Artificial Sequence
  Description of Artificial Sequence: Synthetic oligonucleotide
ggtggtgtccacaggcctgatccagaa

SEQ ID NO: 407625 - DNA, 28 bp, Artificial Sequence
  Description of Artificial Sequence: Synthetic oligonucleotide
gtggtgtccacaggcctgatccagaatg

SEQ ID NO: 407626 - DNA, 28 bp, Artificial Sequence
  Description of Artificial Sequence: Synthetic oligonucleotide
tggtgtccacaggcctgatccagaatgg

SEQ ID NO: 407627 - DNA, 27 bp, Artificial Sequence
  Description of Artificial Sequence: Synthetic oligonucleotide
ggtgtccacaggcctgatccagaatgg

SEQ ID NO: 407628 - DNA, 28 bp, Artificial Sequence
  Description of Artificial Sequence: Synthetic oligonucleotide
gtgtccacaggcctgatccagaatggag

SEQ ID NO: 407629 - DNA, 31 bp, Artificial Sequence; identical to SEQ ID NO: 63259
  Description of Artificial Sequence: Synthetic oligonucleotide

SEQ ID NO: 407630 - DNA, 30 bp, Artificial Sequence; identical to SEQ ID NO: 63260
  Description of Artificial Sequence: Synthetic oligonucleotide

SEQ ID NO: 407631 - DNA, 30 bp, Artificial Sequence; identical to SEQ ID NO: 63261
  Description of Artificial Sequence: Synthetic oligonucleotide

SEQ ID NO: 407632 - DNA, 29 bp, Artificial Sequence
  Description of Artificial Sequence: Synthetic oligonucleotide
ccacaggcctgatccagaatggagattgg

SEQ ID NO: 407633 - DNA, 30 bp, Artificial Sequence; identical to SEQ ID NO: 63263
  Description of Artificial Sequence: Synthetic oligonucleotide

SEQ ID NO: 407634 - DNA, 30 bp, Artificial Sequence; identical to SEQ ID NO: 63264
  Description of Artificial Sequence: Synthetic oligonucleotide

SEQ ID NO: 407635 - DNA, 29 bp, Artificial Sequence
  Description of Artificial Sequence: Synthetic oligonucleotide
caggcctgatccagaatggagattggacc

SEQ ID NO: 407636 - DNA, 31 bp, Artificial Sequence; identical to SEQ ID NO: 63266
  Description of Artificial Sequence: Synthetic oligonucleotide

SEQ ID NO: 407637 - DNA, 30 bp, Artificial Sequence; identical to SEQ ID NO: 63267
  Description of Artificial Sequence: Synthetic oligonucleotide

SEQ ID NO: 407638 - DNA, 30 bp, Artificial Sequence; identical to SEQ ID NO: 63268
  Description of Artificial Sequence: Synthetic oligonucleotide

SEQ ID NO: 407639 - DNA, 31 bp, Artificial Sequence; identical to SEQ ID NO: 63269
  Description of Artificial Sequence: Synthetic oligonucleotide

SEQ ID NO: 407640 - DNA, 32 bp, Artificial Sequence; identical to SEQ ID NO: 63270
  Description of Artificial Sequence: Synthetic oligonucleotide

SEQ ID NO: 407641 - DNA, 32 bp, Artificial Sequence; identical to SEQ ID NO: 63271
  Description of Artificial Sequence: Synthetic oligonucleotide

SEQ ID NO: 407642 - DNA, 31 bp, Artificial Sequence; identical to SEQ ID NO: 63272
  Description of Artificial Sequence: Synthetic oligonucleotide

SEQ ID NO: 407643 - DNA, 31 bp, Artificial Sequence; identical to SEQ ID NO: 63273
  Description of Artificial Sequence: Synthetic oligonucleotide

SEQ ID NO: 407644 - DNA, 30 bp, Artificial Sequence; identical to SEQ ID NO: 63274
  Description of Artificial Sequence: Synthetic oligonucleotide

SEQ ID NO: 407645 - DNA, 29 bp, Artificial Sequence
  Description of Artificial Sequence: Synthetic oligonucleotide
ccagaatggagattggaccttccagaccc

SEQ ID NO: 407646 - DNA, 30 bp, Artificial Sequence; identical to SEQ ID NO: 63276
  Description of Artificial Sequence: Synthetic oligonucleotide

SEQ ID NO: 407647 - DNA, 30 bp, Artificial Sequence; identical to SEQ ID NO: 63277
  Description of Artificial Sequence: Synthetic oligonucleotide

SEQ ID NO: 407648 - DNA, 29 bp, Artificial Sequence
  Description of Artificial Sequence: Synthetic oligonucleotide
gaatggagattggaccttccagaccctgg

SEQ ID NO: 407649 - DNA, 30 bp, Artificial Sequence; identical to SEQ ID NO: 63279
  Description of Artificial Sequence: Synthetic oligonucleotide

SEQ ID NO: 407650 - DNA, 29 bp, Artificial Sequence
  Description of Artificial Sequence: Synthetic oligonucleotide
atggagattggaccttccagaccctggtg

SEQ ID NO: 407651 - DNA, 28 bp, Artificial Sequence
  Description of Artificial Sequence: Synthetic oligonucleotide
tggagattggaccttccagaccctggtg

SEQ ID NO: 407652 - DNA, 27 bp, Artificial Sequence
  Description of Artificial Sequence: Synthetic oligonucleotide
ggagattggaccttccagaccctggtg

SEQ ID NO: 407653 - DNA, 29 bp, Artificial Sequence
  Description of Artificial Sequence: Synthetic oligonucleotide
gagattggaccttccagaccctggtgatg

SEQ ID NO: 407654 - DNA, 29 bp, Artificial Sequence
  Description of Artificial Sequence: Synthetic oligonucleotide
agattggaccttccagaccctggtgatgc

SEQ ID NO: 407655 - DNA, 28 bp, Artificial Sequence
  Description of Artificial Sequence: Synthetic oligonucleotide
gattggaccttccagaccctggtgatgc

SEQ ID NO: 407656 - DNA, 29 bp, Artificial Sequence
  Description of Artificial Sequence: Synthetic oligonucleotide
attggaccttccagaccctggtgatgctg

SEQ ID NO: 407657 - DNA, 28 bp, Artificial Sequence
  Description of Artificial Sequence: Synthetic oligonucleotide
ttggaccttccagaccctggtgatgctg

SEQ ID NO: 407658 - DNA, 27 bp, Artificial Sequence
  Description of Artificial Sequence: Synthetic oligonucleotide
tggaccttccagaccctggtgatgctg

SEQ ID NO: 407659 - DNA, 26 bp, Artificial Sequence
  Description of Artificial Sequence: Synthetic oligonucleotide
ggaccttccagaccctggtgatgctg

SEQ ID NO: 407660 - DNA, 27 bp, Artificial Sequence
  Description of Artificial Sequence: Synthetic oligonucleotide
gaccttccagaccctggtgatgctgga

SEQ ID NO: 407661 - DNA, 29 bp, Artificial Sequence
  Description of Artificial Sequence: Synthetic oligonucleotide
accttccagaccctggtgatgctggaaac

SEQ ID NO: 407662 - DNA, 28 bp, Artificial Sequence
  Description of Artificial Sequence: Synthetic oligonucleotide
ccttccagaccctggtgatgctggaaac

SEQ ID NO: 407663 - DNA, 29 bp, Artificial Sequence
  Description of Artificial Sequence: Synthetic oligonucleotide
cttccagaccctggtgatgctggaaacag

SEQ ID NO: 407664 - DNA, 31 bp, Artificial Sequence; identical to SEQ ID NO: 63294
  Description of Artificial Sequence: Synthetic oligonucleotide

SEQ ID NO: 407665 - DNA, 30 bp, Artificial Sequence; identical to SEQ ID NO: 63295
  Description of Artificial Sequence: Synthetic oligonucleotide

SEQ ID NO: 407666 - DNA, 29 bp, Artificial Sequence
  Description of Artificial Sequence: Synthetic oligonucleotide
ccagaccctggtgatgctggaaacagttc

SEQ ID NO: 407667 - DNA, 29 bp, Artificial Sequence
  Description of Artificial Sequence: Synthetic oligonucleotide
cagaccctggtgatgctggaaacagttcc

SEQ ID NO: 407668 - DNA, 30 bp, Artificial Sequence; identical to SEQ ID NO: 63298
  Description of Artificial Sequence: Synthetic oligonucleotide

SEQ ID NO: 407669 - DNA, 29 bp, Artificial Sequence
  Description of Artificial Sequence: Synthetic oligonucleotide
gaccctggtgatgctggaaacagttcctc

SEQ ID NO: 407670 - DNA, 29 bp, Artificial Sequence
  Description of Artificial Sequence: Synthetic oligonucleotide
accctggtgatgctggaaacagttcctcg

SEQ ID NO: 407671 - DNA, 28 bp, Artificial Sequence
  Description of Artificial Sequence: Synthetic oligonucleotide
ccctggtgatgctggaaacagttcctcg

SEQ ID NO: 407672 - DNA, 28 bp, Artificial Sequence
  Description of Artificial Sequence: Synthetic oligonucleotide
cctggtgatgctggaaacagttcctcgg

SEQ ID NO: 407673 - DNA, 29 bp, Artificial Sequence
  Description of Artificial Sequence: Synthetic oligonucleotide
ctggtgatgctggaaacagttcctcggag

SEQ ID NO: 407674 - DNA, 30 bp, Artificial Sequence; identical to SEQ ID NO: 63304
  Description of Artificial Sequence: Synthetic oligonucleotide

SEQ ID NO: 407675 - DNA, 29 bp, Artificial Sequence
  Description of Artificial Sequence: Synthetic oligonucleotide
ggtgatgctggaaacagttcctcggagtg

SEQ ID NO: 407676 - DNA, 29 bp, Artificial Sequence
  Description of Artificial Sequence: Synthetic oligonucleotide
gtgatgctggaaacagttcctcggagtgg

SEQ ID NO: 407677 - DNA, 30 bp, Artificial Sequence; identical to SEQ ID NO: 63307
  Description of Artificial Sequence: Synthetic oligonucleotide

SEQ ID NO: 407678 - DNA, 29 bp, Artificial Sequence
  Description of Artificial Sequence: Synthetic oligonucleotide
gatgctggaaacagttcctcggagtggag

SEQ ID NO: 407679 - DNA, 30 bp, Artificial Sequence; identical to SEQ ID NO: 63309
  Description of Artificial Sequence: Synthetic oligonucleotide

SEQ ID NO: 407680 - DNA, 29 bp, Artificial Sequence
  Description of Artificial Sequence: Synthetic oligonucleotide
tgctggaaacagttcctcggagtggagag

SEQ ID NO: 407681 - DNA, 28 bp, Artificial Sequence
  Description of Artificial Sequence: Synthetic oligonucleotide
gctggaaacagttcctcggagtggagag

SEQ ID NO: 407682 - DNA, 28 bp, Artificial Sequence
  Description of Artificial Sequence: Synthetic oligonucleotide
ctggaaacagttcctcggagtggagagg

SEQ ID NO: 407683 - DNA, 32 bp, Artificial Sequence; identical to SEQ ID NO: 63313
  Description of Artificial Sequence: Synthetic oligonucleotide

SEQ ID NO: 407684 - DNA, 31 bp, Artificial Sequence; identical to SEQ ID NO: 63314
  Description of Artificial Sequence: Synthetic oligonucleotide

SEQ ID NO: 407685 - DNA, 32 bp, Artificial Sequence; identical to SEQ ID NO: 63315
  Description of Artificial Sequence: Synthetic oligonucleotide

SEQ ID NO: 407686 - DNA, 32 bp, Artificial Sequence; identical to SEQ ID NO: 63316
  Description of Artificial Sequence: Synthetic oligonucleotide

SEQ ID NO: 407687 - DNA, 31 bp, Artificial Sequence; identical to SEQ ID NO: 63317
  Description of Artificial Sequence: Synthetic oligonucleotide

SEQ ID NO: 407688 - DNA, 30 bp, Artificial Sequence; identical to SEQ ID NO: 63318
  Description of Artificial Sequence: Synthetic oligonucleotide

SEQ ID NO: 407689 - DNA, 29 bp, Artificial Sequence
  Description of Artificial Sequence: Synthetic oligonucleotide
cagttcctcggagtggagaggtttacacc

SEQ ID NO: 407690 - DNA, 30 bp, Artificial Sequence; identical to SEQ ID NO: 63320
  Description of Artificial Sequence: Synthetic oligonucleotide

SEQ ID NO: 407691 - DNA, 29 bp, Artificial Sequence
  Description of Artificial Sequence: Synthetic oligonucleotide
gttcctcggagtggagaggtttacacctg

SEQ ID NO: 407692 - DNA, 29 bp, Artificial Sequence
  Description of Artificial Sequence: Synthetic oligonucleotide
ttcctcggagtggagaggtttacacctgc

SEQ ID NO: 407693 - DNA, 28 bp, Artificial Sequence
  Description of Artificial Sequence: Synthetic oligonucleotide
tcctcggagtggagaggtttacacctgc

SEQ ID NO: 407694 - DNA, 27 bp, Artificial Sequence
  Description of Artificial Sequence: Synthetic oligonucleotide
cctcggagtggagaggtttacacctgc

SEQ ID NO: 407695 - DNA, 27 bp, Artificial Sequence
  Description of Artificial Sequence: Synthetic oligonucleotide
ctcggagtggagaggtttacacctgcc

SEQ ID NO: 407696 - DNA, 29 bp, Artificial Sequence
  Description of Artificial Sequence: Synthetic oligonucleotide
tcggagtggagaggtttacacctgccaag

SEQ ID NO: 407697 - DNA, 28 bp, Artificial Sequence
  Description of Artificial Sequence: Synthetic oligonucleotide
cggagtggagaggtttacacctgccaag

SEQ ID NO: 407698 - DNA, 29 bp, Artificial Sequence
  Description of Artificial Sequence: Synthetic oligonucleotide
ggagtggagaggtttacacctgccaagtg

SEQ ID NO: 407699 - DNA, 29 bp, Artificial Sequence
  Description of Artificial Sequence: Synthetic oligonucleotide
gagtggagaggtttacacctgccaagtgg

SEQ ID NO: 407700 - DNA, 30 bp, Artificial Sequence; identical to SEQ ID NO: 63330
  Description of Artificial Sequence: Synthetic oligonucleotide

SEQ ID NO: 407701 - DNA, 29 bp, Artificial Sequence
  Description of Artificial Sequence: Synthetic oligonucleotide
gtggagaggtttacacctgccaagtggag

SEQ ID NO: 407702 - DNA, 29 bp, Artificial Sequence
  Description of Artificial Sequence: Synthetic oligonucleotide
tggagaggtttacacctgccaagtggagc

SEQ ID NO: 407703 - DNA, 28 bp, Artificial Sequence
  Description of Artificial Sequence: Synthetic oligonucleotide
ggagaggtttacacctgccaagtggagc

SEQ ID NO: 407704 - DNA, 29 bp, Artificial Sequence
  Description of Artificial Sequence: Synthetic oligonucleotide
gagaggtttacacctgccaagtggagcac

SEQ ID NO: 407705 - DNA, 29 bp, Artificial Sequence
  Description of Artificial Sequence: Synthetic oligonucleotide
agaggtttacacctgccaagtggagcacc

SEQ ID NO: 407706 - DNA, 28 bp, Artificial Sequence
  Description of Artificial Sequence: Synthetic oligonucleotide
gaggtttacacctgccaagtggagcacc

SEQ ID NO: 407707 - DNA, 28 bp, Artificial Sequence
  Description of Artificial Sequence: Synthetic oligonucleotide
aggtttacacctgccaagtggagcaccc

SEQ ID NO: 407708 - DNA, 27 bp, Artificial Sequence
  Description of Artificial Sequence: Synthetic oligonucleotide
ggtttacacctgccaagtggagcaccc

SEQ ID NO: 407709 - DNA, 29 bp, Artificial Sequence
  Description of Artificial Sequence: Synthetic oligonucleotide
gtttacacctgccaagtggagcacccaag

SEQ ID NO: 407710 - DNA, 30 bp, Artificial Sequence; identical to SEQ ID NO: 63340
  Description of Artificial Sequence: Synthetic oligonucleotide

SEQ ID NO: 407711 - DNA, 29 bp, Artificial Sequence
  Description of Artificial Sequence: Synthetic oligonucleotide
ttacacctgccaagtggagcacccaagtg

SEQ ID NO: 407712 - DNA, 28 bp, Artificial Sequence
  Description of Artificial Sequence: Synthetic oligonucleotide
tacacctgccaagtggagcacccaagtg

SEQ ID NO: 407713 - DNA, 27 bp, Artificial Sequence
  Description of Artificial Sequence: Synthetic oligonucleotide
acacctgccaagtggagcacccaagtg

SEQ ID NO: 407714 - DNA, 27 bp, Artificial Sequence
  Description of Artificial Sequence: Synthetic oligonucleotide
cacctgccaagtggagcacccaagtgt

SEQ ID NO: 407715 - DNA, 27 bp, Artificial Sequence
  Description of Artificial Sequence: Synthetic oligonucleotide
acctgccaagtggagcacccaagtgtg

SEQ ID NO: 407716 - DNA, 27 bp, Artificial Sequence
  Description of Artificial Sequence: Synthetic oligonucleotide
cctgccaagtggagcacccaagtgtga

SEQ ID NO: 407717 - DNA, 27 bp, Artificial Sequence
  Description of Artificial Sequence: Synthetic oligonucleotide
ctgccaagtggagcacccaagtgtgac

SEQ ID NO: 407718 - DNA, 27 bp, Artificial Sequence
  Description of Artificial Sequence: Synthetic oligonucleotide
tgccaagtggagcacccaagtgtgacg

SEQ ID NO: 407719 - DNA, 27 bp, Artificial Sequence
  Description of Artificial Sequence: Synthetic oligonucleotide
gccaagtggagcacccaagtgtgacga

SEQ ID NO: 407720 - DNA, 27 bp, Artificial Sequence
  Description of Artificial Sequence: Synthetic oligonucleotide
ccaagtggagcacccaagtgtgacgag

SEQ ID NO: 407721 - DNA, 27 bp, Artificial Sequence
  Description of Artificial Sequence: Synthetic oligonucleotide
caagtggagcacccaagtgtgacgagc

SEQ ID NO: 407722 - DNA, 27 bp, Artificial Sequence
  Description of Artificial Sequence: Synthetic oligonucleotide
aagtggagcacccaagtgtgacgagcc

SEQ ID NO: 407723 - DNA, 26 bp, Artificial Sequence
  Description of Artificial Sequence: Synthetic oligonucleotide
agtggagcacccaagtgtgacgagcc

SEQ ID NO: 407724 - DNA, 25 bp, Artificial Sequence
  Description of Artificial Sequence: Synthetic oligonucleotide
gtggagcacccaagtgtgacgagcc

SEQ ID NO: 407725 - DNA, 26 bp, Artificial Sequence
  Description of Artificial Sequence: Synthetic oligonucleotide
tggagcacccaagtgtgacgagccct

SEQ ID NO: 407726 - DNA, 25 bp, Artificial Sequence
  Description of Artificial Sequence: Synthetic oligonucleotide
ggagcacccaagtgtgacgagccct

SEQ ID NO: 407727 - DNA, 26 bp, Artificial Sequence
  Description of Artificial Sequence: Synthetic oligonucleotide
gagcacccaagtgtgacgagccctct

SEQ ID NO: 407728 - DNA, 27 bp, Artificial Sequence
  Description of Artificial Sequence: Synthetic oligonucleotide
agcacccaagtgtgacgagccctctca

SEQ ID NO: 407729 - DNA, 26 bp, Artificial Sequence
  Description of Artificial Sequence: Synthetic oligonucleotide
gcacccaagtgtgacgagccctctca

SEQ ID NO: 407730 - DNA, 27 bp, Artificial Sequence
  Description of Artificial Sequence: Synthetic oligonucleotide
cacccaagtgtgacgagccctctcaca

SEQ ID NO: 407731 - DNA, 27 bp, Artificial Sequence
  Description of Artificial Sequence: Synthetic oligonucleotide
acccaagtgtgacgagccctctcacag

SEQ ID NO: 407732 - DNA, 27 bp, Artificial Sequence
  Description of Artificial Sequence: Synthetic oligonucleotide
cccaagtgtgacgagccctctcacagt

SEQ ID NO: 407733 - DNA, 27 bp, Artificial Sequence
  Description of Artificial Sequence: Synthetic oligonucleotide
ccaagtgtgacgagccctctcacagtg

SEQ ID NO: 407734 - DNA, 27 bp, Artificial Sequence
  Description of Artificial Sequence: Synthetic oligonucleotide
caagtgtgacgagccctctcacagtgg

SEQ ID NO: 407735 - DNA, 30 bp, Artificial Sequence; identical to SEQ ID NO: 63365
  Description of Artificial Sequence: Synthetic oligonucleotide

SEQ ID NO: 407736 - DNA, 29 bp, Artificial Sequence
  Description of Artificial Sequence: Synthetic oligonucleotide
agtgtgacgagccctctcacagtggaatg

SEQ ID NO: 407737 - DNA, 28 bp, Artificial Sequence
  Description of Artificial Sequence: Synthetic oligonucleotide
gtgtgacgagccctctcacagtggaatg

SEQ ID NO: 407738 - DNA, 28 bp, Artificial Sequence
  Description of Artificial Sequence: Synthetic oligonucleotide
tgtgacgagccctctcacagtggaatgg

SEQ ID NO: 407739 - DNA, 27 bp, Artificial Sequence
  Description of Artificial Sequence: Synthetic oligonucleotide
gtgacgagccctctcacagtggaatgg

SEQ ID NO: 407740 - DNA, 28 bp, Artificial Sequence
  Description of Artificial Sequence: Synthetic oligonucleotide
tgacgagccctctcacagtggaatggag

SEQ ID NO: 407741 - DNA, 27 bp, Artificial Sequence
  Description of Artificial Sequence: Synthetic oligonucleotide
gacgagccctctcacagtggaatggag

SEQ ID NO: 407742 - DNA, 28 bp, Artificial Sequence
  Description of Artificial Sequence: Synthetic oligonucleotide
acgagccctctcacagtggaatggagag

SEQ ID NO: 407743 - DNA, 27 bp, Artificial Sequence
  Description of Artificial Sequence: Synthetic oligonucleotide
cgagccctctcacagtggaatggagag

SEQ ID NO: 407744 - DNA, 27 bp, Artificial Sequence
  Description of Artificial Sequence: Synthetic oligonucleotide
gagccctctcacagtggaatggagagc

SEQ ID NO: 407745 - DNA, 28 bp, Artificial Sequence
  Description of Artificial Sequence: Synthetic oligonucleotide
agccctctcacagtggaatggagagcac

SEQ ID NO: 407746 - DNA, 27 bp, Artificial Sequence
  Description of Artificial Sequence: Synthetic oligonucleotide
gccctctcacagtggaatggagagcac

SEQ ID NO: 407747 - DNA, 27 bp, Artificial Sequence
  Description of Artificial Sequence: Synthetic oligonucleotide
ccctctcacagtggaatggagagcacg

SEQ ID NO: 407748 - DNA, 27 bp, Artificial Sequence
  Description of Artificial Sequence: Synthetic oligonucleotide
cctctcacagtggaatggagagcacgg

SEQ ID NO: 407749 - DNA, 28 bp, Artificial Sequence
  Description of Artificial Sequence: Synthetic oligonucleotide
ctctcacagtggaatggagagcacggtc

SEQ ID NO: 407750 - DNA, 29 bp, Artificial Sequence
  Description of Artificial Sequence: Synthetic oligonucleotide
tctcacagtggaatggagagcacggtctg

SEQ ID NO: 407751 - DNA, 28 bp, Artificial Sequence
  Description of Artificial Sequence: Synthetic oligonucleotide
ctcacagtggaatggagagcacggtctg

SEQ ID NO: 407752 - DNA, 31 bp, Artificial Sequence; identical to SEQ ID NO: 63382
  Description of Artificial Sequence: Synthetic oligonucleotide

SEQ ID NO: 407753 - DNA, 30 bp, Artificial Sequence; identical to SEQ ID NO: 63383
  Description of Artificial Sequence: Synthetic oligonucleotide

SEQ ID NO: 407754 - DNA, 31 bp, Artificial Sequence; identical to SEQ ID NO: 63384
  Description of Artificial Sequence: Synthetic oligonucleotide

SEQ ID NO: 407755 - DNA, 30 bp, Artificial Sequence; identical to SEQ ID NO: 63385
  Description of Artificial Sequence: Synthetic oligonucleotide

SEQ ID NO: 407756 - DNA, 30 bp, Artificial Sequence; identical to SEQ ID NO: 63386
  Description of Artificial Sequence: Synthetic oligonucleotide

SEQ ID NO: 407757 - DNA, 29 bp, Artificial Sequence
  Description of Artificial Sequence: Synthetic oligonucleotide
gtggaatggagagcacggtctgaatctgc

SEQ ID NO: 407758 - DNA, 30 bp, Artificial Sequence; identical to SEQ ID NO: 63388
  Description of Artificial Sequence: Synthetic oligonucleotide

SEQ ID NO: 407759 - DNA, 29 bp, Artificial Sequence
  Description of Artificial Sequence: Synthetic oligonucleotide
ggaatggagagcacggtctgaatctgcac

SEQ ID NO: 407760 - DNA, 30 bp, Artificial Sequence; identical to SEQ ID NO: 63390
  Description of Artificial Sequence: Synthetic oligonucleotide

SEQ ID NO: 407761 - DNA, 31 bp, Artificial Sequence; identical to SEQ ID NO: 63391
  Description of Artificial Sequence: Synthetic oligonucleotide

SEQ ID NO: 407762 - DNA, 30 bp, Artificial Sequence; identical to SEQ ID NO: 63392
  Description of Artificial Sequence: Synthetic oligonucleotide

SEQ ID NO: 407763 - DNA, 29 bp, Artificial Sequence
  Description of Artificial Sequence: Synthetic oligonucleotide
tggagagcacggtctgaatctgcacagag

SEQ ID NO: 407764 - DNA, 28 bp, Artificial Sequence
  Description of Artificial Sequence: Synthetic oligonucleotide
ggagagcacggtctgaatctgcacagag

SEQ ID NO: 407765 - DNA, 28 bp, Artificial Sequence
  Description of Artificial Sequence: Synthetic oligonucleotide
gagagcacggtctgaatctgcacagagc

SEQ ID NO: 407766 - DNA, 30 bp, Artificial Sequence; identical to SEQ ID NO: 63396
  Description of Artificial Sequence: Synthetic oligonucleotide

SEQ ID NO: 407767 - DNA, 29 bp, Artificial Sequence
  Description of Artificial Sequence: Synthetic oligonucleotide
gagcacggtctgaatctgcacagagcaag

SEQ ID NO: 407768 - DNA, 31 bp, Artificial Sequence; identical to SEQ ID NO: 63398
  Description of Artificial Sequence: Synthetic oligonucleotide

SEQ ID NO: 407769 - DNA, 30 bp, Artificial Sequence; identical to SEQ ID NO: 63399
  Description of Artificial Sequence: Synthetic oligonucleotide

SEQ ID NO: 407770 - DNA, 30 bp, Artificial Sequence; identical to SEQ ID NO: 63400
  Description of Artificial Sequence: Synthetic oligonucleotide

SEQ ID NO: 407771 - DNA, 31 bp, Artificial Sequence; identical to SEQ ID NO: 63401
  Description of Artificial Sequence: Synthetic oligonucleotide

SEQ ID NO: 407772 - DNA, 30 bp, Artificial Sequence; identical to SEQ ID NO: 63402
  Description of Artificial Sequence: Synthetic oligonucleotide

SEQ ID NO: 407773 - DNA, 31 bp, Artificial Sequence; identical to SEQ ID NO: 63403
  Description of Artificial Sequence: Synthetic oligonucleotide

SEQ ID NO: 407774 - DNA, 32 bp, Artificial Sequence; identical to SEQ ID NO: 63404
  Description of Artificial Sequence: Synthetic oligonucleotide

SEQ ID NO: 407775 - DNA, 32 bp, Artificial Sequence; identical to SEQ ID NO: 63405
  Description of Artificial Sequence: Synthetic oligonucleotide

SEQ ID NO: 407776 - DNA, 31 bp, Artificial Sequence; identical to SEQ ID NO: 63406
  Description of Artificial Sequence: Synthetic oligonucleotide

SEQ ID NO: 407777 - DNA, 32 bp, Artificial Sequence; identical to SEQ ID NO: 63407
  Description of Artificial Sequence: Synthetic oligonucleotide

SEQ ID NO: 407778 - DNA, 31 bp, Artificial Sequence; identical to SEQ ID NO: 63408
  Description of Artificial Sequence: Synthetic oligonucleotide

SEQ ID NO: 407779 - DNA, 32 bp, Artificial Sequence; identical to SEQ ID NO: 63409
  Description of Artificial Sequence: Synthetic oligonucleotide

SEQ ID NO: 407780 - DNA, 31 bp, Artificial Sequence; identical to SEQ ID NO: 63410
  Description of Artificial Sequence: Synthetic oligonucleotide

SEQ ID NO: 407781 - DNA, 30 bp, Artificial Sequence; identical to SEQ ID NO: 63411
  Description of Artificial Sequence: Synthetic oligonucleotide

SEQ ID NO: 407782 - DNA, 29 bp, Artificial Sequence
  Description of Artificial Sequence: Synthetic oligonucleotide
ctgcacagagcaagatgctgagtggagtc

SEQ ID NO: 407783 - DNA, 29 bp, Artificial Sequence
  Description of Artificial Sequence: Synthetic oligonucleotide
tgcacagagcaagatgctgagtggagtcg

SEQ ID NO: 407784 - DNA, 28 bp, Artificial Sequence
  Description of Artificial Sequence: Synthetic oligonucleotide
gcacagagcaagatgctgagtggagtcg

SEQ ID NO: 407785 - DNA, 28 bp, Artificial Sequence
  Description of Artificial Sequence: Synthetic oligonucleotide
cacagagcaagatgctgagtggagtcgg

SEQ ID NO: 407786 - DNA, 28 bp, Artificial Sequence
  Description of Artificial Sequence: Synthetic oligonucleotide
acagagcaagatgctgagtggagtcggg

SEQ ID NO: 407787 - DNA, 27 bp, Artificial Sequence
  Description of Artificial Sequence: Synthetic oligonucleotide
cagagcaagatgctgagtggagtcggg

SEQ ID NO: 407788 - DNA, 27 bp, Artificial Sequence
  Description of Artificial Sequence: Synthetic oligonucleotide
agagcaagatgctgagtggagtcgggg

SEQ ID NO: 407789 - DNA, 26 bp, Artificial Sequence
  Description of Artificial Sequence: Synthetic oligonucleotide
gagcaagatgctgagtggagtcgggg

SEQ ID NO: 407790 - DNA, 26 bp, Artificial Sequence
  Description of Artificial Sequence: Synthetic oligonucleotide
agcaagatgctgagtggagtcggggg

SEQ ID NO: 407791 - DNA, 25 bp, Artificial Sequence
  Description of Artificial Sequence: Synthetic oligonucleotide
gcaagatgctgagtggagtcggggg

SEQ ID NO: 407792 - DNA, 27 bp, Artificial Sequence
  Description of Artificial Sequence: Synthetic oligonucleotide
caagatgctgagtggagtcgggggctt

SEQ ID NO: 407793 - DNA, 27 bp, Artificial Sequence
  Description of Artificial Sequence: Synthetic oligonucleotide
aagatgctgagtggagtcgggggcttc

SEQ ID NO: 407794 - DNA, 26 bp, Artificial Sequence
  Description of Artificial Sequence: Synthetic oligonucleotide
agatgctgagtggagtcgggggcttc

SEQ ID NO: 407795 - DNA, 25 bp, Artificial Sequence
  Description of Artificial Sequence: Synthetic oligonucleotide
gatgctgagtggagtcgggggcttc

SEQ ID NO: 407796 - DNA, 26 bp, Artificial Sequence
  Description of Artificial Sequence: Synthetic oligonucleotide
atgctgagtggagtcgggggcttcgt

SEQ ID NO: 407797 - DNA, 25 bp, Artificial Sequence
  Description of Artificial Sequence: Synthetic oligonucleotide
tgctgagtggagtcgggggcttcgt

SEQ ID NO: 407798 - DNA, 24 bp, Artificial Sequence
  Description of Artificial Sequence: Synthetic oligonucleotide
gctgagtggagtcgggggcttcgt

SEQ ID NO: 407799 - DNA, 24 bp, Artificial Sequence
  Description of Artificial Sequence: Synthetic oligonucleotide
ctgagtggagtcgggggcttcgtg

SEQ ID NO: 407800 - DNA, 25 bp, Artificial Sequence
  Description of Artificial Sequence: Synthetic oligonucleotide
tgagtggagtcgggggcttcgtgct

SEQ ID NO: 407801 - DNA, 24 bp, Artificial Sequence
  Description of Artificial Sequence: Synthetic oligonucleotide
gagtggagtcgggggcttcgtgct

SEQ ID NO: 407802 - DNA, 24 bp, Artificial Sequence
  Description of Artificial Sequence: Synthetic oligonucleotide
agtggagtcgggggcttcgtgctg

SEQ ID NO: 407803 - DNA, 23 bp, Artificial Sequence
  Description of Artificial Sequence: Synthetic oligonucleotide
gtggagtcgggggcttcgtgctg

SEQ ID NO: 407804 - DNA, 23 bp, Artificial Sequence
  Description of Artificial Sequence: Synthetic oligonucleotide
tggagtcgggggcttcgtgctgg

SEQ ID NO: 407805 - DNA, 22 bp, Artificial Sequence
  Description of Artificial Sequence: Synthetic oligonucleotide
ggagtcgggggcttcgtgctgg

SEQ ID NO: 407806 - DNA, 22 bp, Artificial Sequence
  Description of Artificial Sequence: Synthetic oligonucleotide
gagtcgggggcttcgtgctggg

SEQ ID NO: 407807 - DNA, 22 bp, Artificial Sequence
  Description of Artificial Sequence: Synthetic oligonucleotide
agtcgggggcttcgtgctgggc

SEQ ID NO: 407808 - DNA, 21 bp, Artificial Sequence
  Description of Artificial Sequence: Synthetic oligonucleotide
gtcgggggcttcgtgctgggc

SEQ ID NO: 407809 - DNA, 22 bp, Artificial Sequence
  Description of Artificial Sequence: Synthetic oligonucleotide
tcgggggcttcgtgctgggcct

SEQ ID NO: 407810 - DNA, 21 bp, Artificial Sequence
  Description of Artificial Sequence: Synthetic oligonucleotide
cgggggcttcgtgctgggcct

SEQ ID NO: 407811 - DNA, 21 bp, Artificial Sequence
  Description of Artificial Sequence: Synthetic oligonucleotide
gggggcttcgtgctgggcctg

SEQ ID NO: 407812 - DNA, 22 bp, Artificial Sequence
  Description of Artificial Sequence: Synthetic oligonucleotide
ggggcttcgtgctgggcctgct

SEQ ID NO: 407813 - DNA, 24 bp, Artificial Sequence
  Description of Artificial Sequence: Synthetic oligonucleotide
gggcttcgtgctgggcctgctctt

SEQ ID NO: 407814 - DNA, 24 bp, Artificial Sequence
  Description of Artificial Sequence: Synthetic oligonucleotide
ggcttcgtgctgggcctgctcttc

SEQ ID NO: 407815 - DNA, 26 bp, Artificial Sequence
  Description of Artificial Sequence: Synthetic oligonucleotide
gcttcgtgctgggcctgctcttcctt

SEQ ID NO: 407816 - DNA, 26 bp, Artificial Sequence
  Description of Artificial Sequence: Synthetic oligonucleotide
cttcgtgctgggcctgctcttccttg

SEQ ID NO: 407817 - DNA, 26 bp, Artificial Sequence
  Description of Artificial Sequence: Synthetic oligonucleotide
ttcgtgctgggcctgctcttccttgg

SEQ ID NO: 407818 - DNA, 25 bp, Artificial Sequence
  Description of Artificial Sequence: Synthetic oligonucleotide
tcgtgctgggcctgctcttccttgg

SEQ ID NO: 407819 - DNA, 24 bp, Artificial Sequence
  Description of Artificial Sequence: Synthetic oligonucleotide
cgtgctgggcctgctcttccttgg

SEQ ID NO: 407820 - DNA, 24 bp, Artificial Sequence
  Description of Artificial Sequence: Synthetic oligonucleotide
gtgctgggcctgctcttccttggg

SEQ ID NO: 407821 - DNA, 24 bp, Artificial Sequence
  Description of Artificial Sequence: Synthetic oligonucleotide
tgctgggcctgctcttccttgggg

SEQ ID NO: 407822 - DNA, 23 bp, Artificial Sequence
  Description of Artificial Sequence: Synthetic oligonucleotide
gctgggcctgctcttccttgggg

SEQ ID NO: 407823 - DNA, 23 bp, Artificial Sequence
  Description of Artificial Sequence: Synthetic oligonucleotide
ctgggcctgctcttccttggggc

SEQ ID NO: 407824 - DNA, 23 bp, Artificial Sequence
  Description of Artificial Sequence: Synthetic oligonucleotide
tgggcctgctcttccttggggcc

SEQ ID NO: 407825 - DNA, 22 bp, Artificial Sequence
  Description of Artificial Sequence: Synthetic oligonucleotide
gggcctgctcttccttggggcc

SEQ ID NO: 407826 - DNA, 22 bp, Artificial Sequence
  Description of Artificial Sequence: Synthetic oligonucleotide
ggcctgctcttccttggggccg

SEQ ID NO: 407827 - DNA, 22 bp, Artificial Sequence
  Description of Artificial Sequence: Synthetic oligonucleotide
gcctgctcttccttggggccgg

SEQ ID NO: 407828 - DNA, 22 bp, Artificial Sequence
  Description of Artificial Sequence: Synthetic oligonucleotide
cctgctcttccttggggccggg

SEQ ID NO: 407829 - DNA, 23 bp, Artificial Sequence
  Description of Artificial Sequence: Synthetic oligonucleotide
ctgctcttccttggggccgggct

SEQ ID NO: 407830 - DNA, 25 bp, Artificial Sequence
  Description of Artificial Sequence: Synthetic oligonucleotide
tgctcttccttggggccgggctgtt

SEQ ID NO: 407831 - DNA, 24 bp, Artificial Sequence
  Description of Artificial Sequence: Synthetic oligonucleotide
gctcttccttggggccgggctgtt

SEQ ID NO: 407832 - DNA, 26 bp, Artificial Sequence
  Description of Artificial Sequence: Synthetic oligonucleotide
ctcttccttggggccgggctgttcat

SEQ ID NO: 407833 - DNA, 27 bp, Artificial Sequence
  Description of Artificial Sequence: Synthetic oligonucleotide
tcttccttggggccgggctgttcatct

SEQ ID NO: 407834 - DNA, 27 bp, Artificial Sequence
  Description of Artificial Sequence: Synthetic oligonucleotide
cttccttggggccgggctgttcatcta

SEQ ID NO: 407835 - DNA, 27 bp, Artificial Sequence
  Description of Artificial Sequence: Synthetic oligonucleotide
ttccttggggccgggctgttcatctac

SEQ ID NO: 407836 - DNA, 27 bp, Artificial Sequence
  Description of Artificial Sequence: Synthetic oligonucleotide
tccttggggccgggctgttcatctact

SEQ ID NO: 407837 - DNA, 27 bp, Artificial Sequence
  Description of Artificial Sequence: Synthetic oligonucleotide
ccttggggccgggctgttcatctactt

SEQ ID NO: 407838 - DNA, 27 bp, Artificial Sequence
  Description of Artificial Sequence: Synthetic oligonucleotide
cttggggccgggctgttcatctacttc

SEQ ID NO: 407839 - DNA, 28 bp, Artificial Sequence
  Description of Artificial Sequence: Synthetic oligonucleotide
ttggggccgggctgttcatctacttcag

SEQ ID NO: 407840 - DNA, 27 bp, Artificial Sequence
  Description of Artificial Sequence: Synthetic oligonucleotide
tggggccgggctgttcatctacttcag

SEQ ID NO: 407841 - DNA, 26 bp, Artificial Sequence
  Description of Artificial Sequence: Synthetic oligonucleotide
ggggccgggctgttcatctacttcag

SEQ ID NO: 407842 - DNA, 27 bp, Artificial Sequence
  Description of Artificial Sequence: Synthetic oligonucleotide
gggccgggctgttcatctacttcagga

SEQ ID NO: 407843 - DNA, 29 bp, Artificial Sequence
  Description of Artificial Sequence: Synthetic oligonucleotide
ggccgggctgttcatctacttcaggaatc

SEQ ID NO: 407844 - DNA, 30 bp, Artificial Sequence; identical to SEQ ID NO: 63474
  Description of Artificial Sequence: Synthetic oligonucleotide

SEQ ID NO: 407845 - DNA, 33 bp, Artificial Sequence; identical to SEQ ID NO: 63475
  Description of Artificial Sequence: Synthetic oligonucleotide

SEQ ID NO: 407846 - DNA, 33 bp, Artificial Sequence; identical to SEQ ID NO: 63476
  Description of Artificial Sequence: Synthetic oligonucleotide

SEQ ID NO: 407847 - DNA, 34 bp, Artificial Sequence; identical to SEQ ID NO: 63477
  Description of Artificial Sequence: Synthetic oligonucleotide

SEQ ID NO: 407848 - DNA, 35 bp, Artificial Sequence; identical to SEQ ID NO: 63478
  Description of Artificial Sequence: Synthetic oligonucleotide

SEQ ID NO: 407849 - DNA, 36 bp, Artificial Sequence; identical to SEQ ID NO: 63479
  Description of Artificial Sequence: Synthetic oligonucleotide

SEQ ID NO: 407850 - DNA, 37 bp, Artificial Sequence; identical to SEQ ID NO: 63480
  Description of Artificial Sequence: Synthetic oligonucleotide

SEQ ID NO: 407851 - DNA, 37 bp, Artificial Sequence; identical to SEQ ID NO: 63481
  Description of Artificial Sequence: Synthetic oligonucleotide

SEQ ID NO: 407852 - DNA, 36 bp, Artificial Sequence; identical to SEQ ID NO: 63482
  Description of Artificial Sequence: Synthetic oligonucleotide

SEQ ID NO: 407853 - DNA, 37 bp, Artificial Sequence; identical to SEQ ID NO: 63483
  Description of Artificial Sequence: Synthetic oligonucleotide

SEQ ID NO: 407854 - DNA, 36 bp, Artificial Sequence; identical to SEQ ID NO: 63484
  Description of Artificial Sequence: Synthetic oligonucleotide

SEQ ID NO: 407855 - DNA, 35 bp, Artificial Sequence; identical to SEQ ID NO: 63485
  Description of Artificial Sequence: Synthetic oligonucleotide

SEQ ID NO: 407856 - DNA, 37 bp, Artificial Sequence; identical to SEQ ID NO: 63486
  Description of Artificial Sequence: Synthetic oligonucleotide

SEQ ID NO: 407857 - DNA, 36 bp, Artificial Sequence; identical to SEQ ID NO: 63487
  Description of Artificial Sequence: Synthetic oligonucleotide

SEQ ID NO: 407858 - DNA, 35 bp, Artificial Sequence; identical to SEQ ID NO: 63488
  Description of Artificial Sequence: Synthetic oligonucleotide

SEQ ID NO: 407859 - DNA, 36 bp, Artificial Sequence; identical to SEQ ID NO: 63489
  Description of Artificial Sequence: Synthetic oligonucleotide

SEQ ID NO: 407860 - DNA, 35 bp, Artificial Sequence; identical to SEQ ID NO: 63490
  Description of Artificial Sequence: Synthetic oligonucleotide

SEQ ID NO: 407861 - DNA, 34 bp, Artificial Sequence; identical to SEQ ID NO: 63491
  Description of Artificial Sequence: Synthetic oligonucleotide

SEQ ID NO: 407862 - DNA, 34 bp, Artificial Sequence; identical to SEQ ID NO: 63492
  Description of Artificial Sequence: Synthetic oligonucleotide

SEQ ID NO: 407863 - DNA, 33 bp, Artificial Sequence; identical to SEQ ID NO: 63493
  Description of Artificial Sequence: Synthetic oligonucleotide

SEQ ID NO: 407864 - DNA, 32 bp, Artificial Sequence; identical to SEQ ID NO: 63494
  Description of Artificial Sequence: Synthetic oligonucleotide

SEQ ID NO: 407865 - DNA, 32 bp, Artificial Sequence; identical to SEQ ID NO: 63495
  Description of Artificial Sequence: Synthetic oligonucleotide

SEQ ID NO: 407866 - DNA, 31 bp, Artificial Sequence; identical to SEQ ID NO: 63496
  Description of Artificial Sequence: Synthetic oligonucleotide

SEQ ID NO: 407867 - DNA, 33 bp, Artificial Sequence; identical to SEQ ID NO: 63497
  Description of Artificial Sequence: Synthetic oligonucleotide

SEQ ID NO: 407868 - DNA, 34 bp, Artificial Sequence; identical to SEQ ID NO: 63498
  Description of Artificial Sequence: Synthetic oligonucleotide

SEQ ID NO: 407869 - DNA, 33 bp, Artificial Sequence; identical to SEQ ID NO: 63499
  Description of Artificial Sequence: Synthetic oligonucleotide

SEQ ID NO: 407870 - DNA, 32 bp, Artificial Sequence; identical to SEQ ID NO: 63500
  Description of Artificial Sequence: Synthetic oligonucleotide

SEQ ID NO: 407871 - DNA, 31 bp, Artificial Sequence; identical to SEQ ID NO: 63501
  Description of Artificial Sequence: Synthetic oligonucleotide

SEQ ID NO: 407872 - DNA, 31 bp, Artificial Sequence; identical to SEQ ID NO: 63502
  Description of Artificial Sequence: Synthetic oligonucleotide

SEQ ID NO: 407873 - DNA, 30 bp, Artificial Sequence; identical to SEQ ID NO: 63503
  Description of Artificial Sequence: Synthetic oligonucleotide

SEQ ID NO: 407874 - DNA, 33 bp, Artificial Sequence; identical to SEQ ID NO: 63504
  Description of Artificial Sequence: Synthetic oligonucleotide

SEQ ID NO: 407875 - DNA, 32 bp, Artificial Sequence; identical to SEQ ID NO: 63505
  Description of Artificial Sequence: Synthetic oligonucleotide

SEQ ID NO: 407876 - DNA, 31 bp, Artificial Sequence; identical to SEQ ID NO: 63506
  Description of Artificial Sequence: Synthetic oligonucleotide

SEQ ID NO: 407877 - DNA, 30 bp, Artificial Sequence; identical to SEQ ID NO: 63507
  Description of Artificial Sequence: Synthetic oligonucleotide

SEQ ID NO: 407878 - DNA, 30 bp, Artificial Sequence; identical to SEQ ID NO: 63508
  Description of Artificial Sequence: Synthetic oligonucleotide

SEQ ID NO: 407879 - DNA, 31 bp, Artificial Sequence; identical to SEQ ID NO: 63509
  Description of Artificial Sequence: Synthetic oligonucleotide

SEQ ID NO: 407880 - DNA, 30 bp, Artificial Sequence; identical to SEQ ID NO: 63510
  Description of Artificial Sequence: Synthetic oligonucleotide

SEQ ID NO: 407881 - DNA, 31 bp, Artificial Sequence; identical to SEQ ID NO: 63511
  Description of Artificial Sequence: Synthetic oligonucleotide

SEQ ID NO: 407882 - DNA, 30 bp, Artificial Sequence; identical to SEQ ID NO: 63512
  Description of Artificial Sequence: Synthetic oligonucleotide

SEQ ID NO: 407883 - DNA, 30 bp, Artificial Sequence; identical to SEQ ID NO: 63513
  Description of Artificial Sequence: Synthetic oligonucleotide

SEQ ID NO: 407884 - DNA, 29 bp, Artificial Sequence
  Description of Artificial Sequence: Synthetic oligonucleotide
ctggacttcagccaacaggattcctgagc

SEQ ID NO: 407885 - DNA, 30 bp, Artificial Sequence; identical to SEQ ID NO: 63515
  Description of Artificial Sequence: Synthetic oligonucleotide

SEQ ID NO: 407886 - DNA, 29 bp, Artificial Sequence
  Description of Artificial Sequence: Synthetic oligonucleotide
ggacttcagccaacaggattcctgagctg

SEQ ID NO: 407887 - DNA, 37 bp, Artificial Sequence; identical to SEQ ID NO: 63517
  Description of Artificial Sequence: Synthetic oligonucleotide

SEQ ID NO: 407888 - DNA, 37 bp, Artificial Sequence; identical to SEQ ID NO: 63518
  Description of Artificial Sequence: Synthetic oligonucleotide

SEQ ID NO: 407889 - DNA, 37 bp, Artificial Sequence; identical to SEQ ID NO: 63519
  Description of Artificial Sequence: Synthetic oligonucleotide

SEQ ID NO: 407890 - DNA, 36 bp, Artificial Sequence; identical to SEQ ID NO: 63520
  Description of Artificial Sequence: Synthetic oligonucleotide

SEQ ID NO: 407891 - DNA, 35 bp, Artificial Sequence; identical to SEQ ID NO: 63521
  Description of Artificial Sequence: Synthetic oligonucleotide

SEQ ID NO: 407892 - DNA, 36 bp, Artificial Sequence; identical to SEQ ID NO: 63522
  Description of Artificial Sequence: Synthetic oligonucleotide

SEQ ID NO: 407893 - DNA, 36 bp, Artificial Sequence; identical to SEQ ID NO: 63523
  Description of Artificial Sequence: Synthetic oligonucleotide

SEQ ID NO: 407894 - DNA, 35 bp, Artificial Sequence; identical to SEQ ID NO: 63524
  Description of Artificial Sequence: Synthetic oligonucleotide

SEQ ID NO: 407895 - DNA, 35 bp, Artificial Sequence; identical to SEQ ID NO: 63525
  Description of Artificial Sequence: Synthetic oligonucleotide

SEQ ID NO: 407896 - DNA, 35 bp, Artificial Sequence; identical to SEQ ID NO: 63526
  Description of Artificial Sequence: Synthetic oligonucleotide

SEQ ID NO: 407897 - DNA, 34 bp, Artificial Sequence; identical to SEQ ID NO: 63527
  Description of Artificial Sequence: Synthetic oligonucleotide

SEQ ID NO: 407898 - DNA, 33 bp, Artificial Sequence; identical to SEQ ID NO: 63528
  Description of Artificial Sequence: Synthetic oligonucleotide

SEQ ID NO: 407899 - DNA, 32 bp, Artificial Sequence; identical to SEQ ID NO: 63529
  Description of Artificial Sequence: Synthetic oligonucleotide

SEQ ID NO: 407900 - DNA, 34 bp, Artificial Sequence; identical to SEQ ID NO: 63530
  Description of Artificial Sequence: Synthetic oligonucleotide

SEQ ID NO: 407901 - DNA, 33 bp, Artificial Sequence; identical to SEQ ID NO: 63531
  Description of Artificial Sequence: Synthetic oligonucleotide

SEQ ID NO: 407902 - DNA, 32 bp, Artificial Sequence; identical to SEQ ID NO: 63532
  Description of Artificial Sequence: Synthetic oligonucleotide

SEQ ID NO: 407903 - DNA, 32 bp, Artificial Sequence; identical to SEQ ID NO: 63533
  Description of Artificial Sequence: Synthetic oligonucleotide

SEQ ID NO: 407904 - DNA, 33 bp, Artificial Sequence; identical to SEQ ID NO: 63534
  Description of Artificial Sequence: Synthetic oligonucleotide

SEQ ID NO: 407905 - DNA, 32 bp, Artificial Sequence; identical to SEQ ID NO: 63535
  Description of Artificial Sequence: Synthetic oligonucleotide

SEQ ID NO: 407906 - DNA, 31 bp, Artificial Sequence; identical to SEQ ID NO: 63536
  Description of Artificial Sequence: Synthetic oligonucleotide

SEQ ID NO: 407907 - DNA, 32 bp, Artificial Sequence; identical to SEQ ID NO: 63537
  Description of Artificial Sequence: Synthetic oligonucleotide

SEQ ID NO: 407908 - DNA, 31 bp, Artificial Sequence; identical to SEQ ID NO: 63538
  Description of Artificial Sequence: Synthetic oligonucleotide

SEQ ID NO: 407909 - DNA, 30 bp, Artificial Sequence; identical to SEQ ID NO: 63539
  Description of Artificial Sequence: Synthetic oligonucleotide

SEQ ID NO: 407910 - DNA, 29 bp, Artificial Sequence
  Description of Artificial Sequence: Synthetic oligonucleotide
aaccaagaggaatccgtgcgcttcgacag

SEQ ID NO: 407911 - DNA, 28 bp, Artificial Sequence
  Description of Artificial Sequence: Synthetic oligonucleotide
accaagaggaatccgtgcgcttcgacag

SEQ ID NO: 407912 - DNA, 27 bp, Artificial Sequence
  Description of Artificial Sequence: Synthetic oligonucleotide
ccaagaggaatccgtgcgcttcgacag

SEQ ID NO: 407913 - DNA, 27 bp, Artificial Sequence
  Description of Artificial Sequence: Synthetic oligonucleotide
caagaggaatccgtgcgcttcgacagc

SEQ ID NO: 407914 - DNA, 27 bp, Artificial Sequence
  Description of Artificial Sequence: Synthetic oligonucleotide
aagaggaatccgtgcgcttcgacagcg

SEQ ID NO: 407915 - DNA, 27 bp, Artificial Sequence
  Description of Artificial Sequence: Synthetic oligonucleotide
agaggaatccgtgcgcttcgacagcga

SEQ ID NO: 407916 - DNA, 26 bp, Artificial Sequence
  Description of Artificial Sequence: Synthetic oligonucleotide
gaggaatccgtgcgcttcgacagcga

SEQ ID NO: 407917 - DNA, 26 bp, Artificial Sequence
  Description of Artificial Sequence: Synthetic oligonucleotide
aggaatccgtgcgcttcgacagcgac

SEQ ID NO: 407918 - DNA, 25 bp, Artificial Sequence
  Description of Artificial Sequence: Synthetic oligonucleotide
ggaatccgtgcgcttcgacagcgac

SEQ ID NO: 407919 - DNA, 26 bp, Artificial Sequence
  Description of Artificial Sequence: Synthetic oligonucleotide
gaatccgtgcgcttcgacagcgacgt

SEQ ID NO: 407920 - DNA, 26 bp, Artificial Sequence
  Description of Artificial Sequence: Synthetic oligonucleotide
aatccgtgcgcttcgacagcgacgtg

SEQ ID NO: 407921 - DNA, 25 bp, Artificial Sequence
  Description of Artificial Sequence: Synthetic oligonucleotide
atccgtgcgcttcgacagcgacgtg

SEQ ID NO: 407922 - DNA, 26 bp, Artificial Sequence
  Description of Artificial Sequence: Synthetic oligonucleotide
tgagagcttcacagtgcagcggcgag

SEQ ID NO: 407923 - DNA, 30 bp, Artificial Sequence; identical to SEQ ID NO: 63553
  Description of Artificial Sequence: Synthetic oligonucleotide

SEQ ID NO: 407924 - DNA, 30 bp, Artificial Sequence; identical to SEQ ID NO: 63554
  Description of Artificial Sequence: Synthetic oligonucleotide

SEQ ID NO: 407925 - DNA, 29 bp, Artificial Sequence
  Description of Artificial Sequence: Synthetic oligonucleotide
gtactggaacagccagaaggacctcttgg

SEQ ID NO: 407926 - DNA, 30 bp, Artificial Sequence; identical to SEQ ID NO: 63556
  Description of Artificial Sequence: Synthetic oligonucleotide

SEQ ID NO: 407927 - DNA, 29 bp, Artificial Sequence
  Description of Artificial Sequence: Synthetic oligonucleotide
actggaacagccagaaggacctcttggag

SEQ ID NO: 407928 - DNA, 28 bp, Artificial Sequence
  Description of Artificial Sequence: Synthetic oligonucleotide
ctggaacagccagaaggacctcttggag

SEQ ID NO: 407929 - DNA, 28 bp, Artificial Sequence
  Description of Artificial Sequence: Synthetic oligonucleotide
tggaacagccagaaggacctcttggagc

SEQ ID NO: 407930 - DNA, 27 bp, Artificial Sequence
  Description of Artificial Sequence: Synthetic oligonucleotide
ggaacagccagaaggacctcttggagc

SEQ ID NO: 407931 - DNA, 28 bp, Artificial Sequence
  Description of Artificial Sequence: Synthetic oligonucleotide
gaacagccagaaggacctcttggagcag

SEQ ID NO: 407932 - DNA, 29 bp, Artificial Sequence
  Description of Artificial Sequence: Synthetic oligonucleotide
aacagccagaaggacctcttggagcagag

SEQ ID NO: 407933 - DNA, 28 bp, Artificial Sequence
  Description of Artificial Sequence: Synthetic oligonucleotide
acagccagaaggacctcttggagcagag

SEQ ID NO: 407934 - DNA, 27 bp, Artificial Sequence
  Description of Artificial Sequence: Synthetic oligonucleotide
cagccagaaggacctcttggagcagag

SEQ ID NO: 407935 - DNA, 27 bp, Artificial Sequence
  Description of Artificial Sequence: Synthetic oligonucleotide
agccagaaggacctcttggagcagagg

SEQ ID NO: 407936 - DNA, 26 bp, Artificial Sequence
  Description of Artificial Sequence: Synthetic oligonucleotide
gccagaaggacctcttggagcagagg

SEQ ID NO: 407937 - DNA, 26 bp, Artificial Sequence
  Description of Artificial Sequence: Synthetic oligonucleotide
ccagaaggacctcttggagcagaggc

SEQ ID NO: 407938 - DNA, 26 bp, Artificial Sequence
  Description of Artificial Sequence: Synthetic oligonucleotide
cagaaggacctcttggagcagaggcg

SEQ ID NO: 407939 - DNA, 26 bp, Artificial Sequence
  Description of Artificial Sequence: Synthetic oligonucleotide
agaaggacctcttggagcagaggcgg

SEQ ID NO: 407940 - DNA, 25 bp, Artificial Sequence
  Description of Artificial Sequence: Synthetic oligonucleotide
gaaggacctcttggagcagaggcgg

SEQ ID NO: 407941 - DNA, 25 bp, Artificial Sequence
  Description of Artificial Sequence: Synthetic oligonucleotide
aaggacctcttggagcagaggcggg

SEQ ID NO: 407942 - DNA, 24 bp, Artificial Sequence
  Description of Artificial Sequence: Synthetic oligonucleotide
aggacctcttggagcagaggcggg

SEQ ID NO: 407943 - DNA, 23 bp, Artificial Sequence
  Description of Artificial Sequence: Synthetic oligonucleotide
ggacctcttggagcagaggcggg

SEQ ID NO: 407944 - DNA, 23 bp, Artificial Sequence
  Description of Artificial Sequence: Synthetic oligonucleotide
gacctcttggagcagaggcgggc

SEQ ID NO: 407945 - DNA, 23 bp, Artificial Sequence
  Description of Artificial Sequence: Synthetic oligonucleotide
acctcttggagcagaggcgggcc

SEQ ID NO: 407946 - DNA, 22 bp, Artificial Sequence
  Description of Artificial Sequence: Synthetic oligonucleotide
cctcttggagcagaggcgggcc

SEQ ID NO: 407947 - DNA, 22 bp, Artificial Sequence
  Description of Artificial Sequence: Synthetic oligonucleotide
ctcttggagcagaggcgggccg

SEQ ID NO: 407948 - DNA, 22 bp, Artificial Sequence
  Description of Artificial Sequence: Synthetic oligonucleotide
tcttggagcagaggcgggccgc

SEQ ID NO: 407949 - DNA, 21 bp, Artificial Sequence
  Description of Artificial Sequence: Synthetic oligonucleotide
cttggagcagaggcgggccgc

SEQ ID NO: 407950 - DNA, 21 bp, Artificial Sequence
  Description of Artificial Sequence: Synthetic oligonucleotide
ttggagcagaggcgggccgcg

SEQ ID NO: 407951 - DNA, 33 bp, Artificial Sequence; identical to SEQ ID NO: 63581
  Description of Artificial Sequence: Synthetic oligonucleotide

SEQ ID NO: 407952 - DNA, 35 bp, Artificial Sequence; identical to SEQ ID NO: 63582
  Description of Artificial Sequence: Synthetic oligonucleotide

SEQ ID NO: 407953 - DNA, 36 bp, Artificial Sequence; identical to SEQ ID NO: 63583
  Description of Artificial Sequence: Synthetic oligonucleotide

SEQ ID NO: 407954 - DNA, 36 bp, Artificial Sequence; identical to SEQ ID NO: 63584
  Description of Artificial Sequence: Synthetic oligonucleotide

SEQ ID NO: 407955 - DNA, 35 bp, Artificial Sequence; identical to SEQ ID NO: 63585
  Description of Artificial Sequence: Synthetic oligonucleotide

SEQ ID NO: 407956 - DNA, 36 bp, Artificial Sequence; identical to SEQ ID NO: 63586
  Description of Artificial Sequence: Synthetic oligonucleotide

SEQ ID NO: 407957 - DNA, 37 bp, Artificial Sequence; identical to SEQ ID NO: 63587
  Description of Artificial Sequence: Synthetic oligonucleotide

SEQ ID NO: 407958 - DNA, 37 bp, Artificial Sequence; identical to SEQ ID NO: 63588
  Description of Artificial Sequence: Synthetic oligonucleotide

SEQ ID NO: 407959 - DNA, 37 bp, Artificial Sequence; identical to SEQ ID NO: 63589
  Description of Artificial Sequence: Synthetic oligonucleotide

SEQ ID NO: 407960 - DNA, 36 bp, Artificial Sequence; identical to SEQ ID NO: 63590
  Description of Artificial Sequence: Synthetic oligonucleotide

SEQ ID NO: 407961 - DNA, 35 bp, Artificial Sequence; identical to SEQ ID NO: 63591
  Description of Artificial Sequence: Synthetic oligonucleotide

SEQ ID NO: 407962 - DNA, 36 bp, Artificial Sequence; identical to SEQ ID NO: 63592
  Description of Artificial Sequence: Synthetic oligonucleotide

SEQ ID NO: 407963 - DNA, 36 bp, Artificial Sequence; identical to SEQ ID NO: 63593
  Description of Artificial Sequence: Synthetic oligonucleotide

SEQ ID NO: 407964 - DNA, 35 bp, Artificial Sequence; identical to SEQ ID NO: 63594
  Description of Artificial Sequence: Synthetic oligonucleotide

SEQ ID NO: 407965 - DNA, 35 bp, Artificial Sequence; identical to SEQ ID NO: 63595
  Description of Artificial Sequence: Synthetic oligonucleotide

SEQ ID NO: 407966 - DNA, 35 bp, Artificial Sequence; identical to SEQ ID NO: 63596
  Description of Artificial Sequence: Synthetic oligonucleotide

SEQ ID NO: 407967 - DNA, 34 bp, Artificial Sequence; identical to SEQ ID NO: 63597
  Description of Artificial Sequence: Synthetic oligonucleotide

SEQ ID NO: 407968 - DNA, 33 bp, Artificial Sequence; identical to SEQ ID NO: 63598
  Description of Artificial Sequence: Synthetic oligonucleotide

SEQ ID NO: 407969 - DNA, 32 bp, Artificial Sequence; identical to SEQ ID NO: 63599
  Description of Artificial Sequence: Synthetic oligonucleotide

SEQ ID NO: 407970 - DNA, 34 bp, Artificial Sequence; identical to SEQ ID NO: 63600
  Description of Artificial Sequence: Synthetic oligonucleotide

SEQ ID NO: 407971 - DNA, 33 bp, Artificial Sequence; identical to SEQ ID NO: 63601
  Description of Artificial Sequence: Synthetic oligonucleotide

SEQ ID NO: 407972 - DNA, 32 bp, Artificial Sequence; identical to SEQ ID NO: 63602
  Description of Artificial Sequence: Synthetic oligonucleotide

SEQ ID NO: 407973 - DNA, 32 bp, Artificial Sequence; identical to SEQ ID NO: 63603
  Description of Artificial Sequence: Synthetic oligonucleotide

SEQ ID NO: 407974 - DNA, 33 bp, Artificial Sequence; identical to SEQ ID NO: 63604
  Description of Artificial Sequence: Synthetic oligonucleotide

SEQ ID NO: 407975 - DNA, 32 bp, Artificial Sequence; identical to SEQ ID NO: 63605
  Description of Artificial Sequence: Synthetic oligonucleotide

SEQ ID NO: 407976 - DNA, 31 bp, Artificial Sequence; identical to SEQ ID NO: 63606
  Description of Artificial Sequence: Synthetic oligonucleotide

SEQ ID NO: 407977 - DNA, 32 bp, Artificial Sequence; identical to SEQ ID NO: 63607
  Description of Artificial Sequence: Synthetic oligonucleotide

SEQ ID NO: 407978 - DNA, 31 bp, Artificial Sequence; identical to SEQ ID NO: 63608
  Description of Artificial Sequence: Synthetic oligonucleotide

SEQ ID NO: 407979 - DNA, 30 bp, Artificial Sequence; identical to SEQ ID NO: 63609
  Description of Artificial Sequence: Synthetic oligonucleotide

SEQ ID NO: 407980 - DNA, 29 bp, Artificial Sequence
  Description of Artificial Sequence: Synthetic oligonucleotide
aatcaagaggagtccgtgcgcttcgacag

SEQ ID NO: 407981 - DNA, 28 bp, Artificial Sequence
  Description of Artificial Sequence: Synthetic oligonucleotide
atcaagaggagtccgtgcgcttcgacag

SEQ ID NO: 407982 - DNA, 27 bp, Artificial Sequence
  Description of Artificial Sequence: Synthetic oligonucleotide
tcaagaggagtccgtgcgcttcgacag

SEQ ID NO: 407983 - DNA, 29 bp, Artificial Sequence
  Description of Artificial Sequence: Synthetic oligonucleotide
acaactacggggttggtgagagcttcacg

SEQ ID NO: 407984 - DNA, 28 bp, Artificial Sequence
  Description of Artificial Sequence: Synthetic oligonucleotide
caactacggggttggtgagagcttcacg

SEQ ID NO: 407985 - DNA, 28 bp, Artificial Sequence
  Description of Artificial Sequence: Synthetic oligonucleotide
aactacggggttggtgagagcttcacgg

SEQ ID NO: 407986 - DNA, 27 bp, Artificial Sequence
  Description of Artificial Sequence: Synthetic oligonucleotide
actacggggttggtgagagcttcacgg

SEQ ID NO: 407987 - DNA, 27 bp, Artificial Sequence
  Description of Artificial Sequence: Synthetic oligonucleotide
ctacggggttggtgagagcttcacggt

SEQ ID NO: 407988 - DNA, 27 bp, Artificial Sequence
  Description of Artificial Sequence: Synthetic oligonucleotide
tacggggttggtgagagcttcacggtg

SEQ ID NO: 407989 - DNA, 26 bp, Artificial Sequence
  Description of Artificial Sequence: Synthetic oligonucleotide
acggggttggtgagagcttcacggtg

SEQ ID NO: 407990 - DNA, 25 bp, Artificial Sequence
  Description of Artificial Sequence: Synthetic oligonucleotide
cggggttggtgagagcttcacggtg

SEQ ID NO: 407991 - DNA, 26 bp, Artificial Sequence
  Description of Artificial Sequence: Synthetic oligonucleotide
ggggttggtgagagcttcacggtgca

SEQ ID NO: 407992 - DNA, 26 bp, Artificial Sequence
  Description of Artificial Sequence: Synthetic oligonucleotide
gggttggtgagagcttcacggtgcag

SEQ ID NO: 407993 - DNA, 26 bp, Artificial Sequence
  Description of Artificial Sequence: Synthetic oligonucleotide
ggttggtgagagcttcacggtgcagc

SEQ ID NO: 407994 - DNA, 26 bp, Artificial Sequence
  Description of Artificial Sequence: Synthetic oligonucleotide
gttggtgagagcttcacggtgcagcg

SEQ ID NO: 407995 - DNA, 26 bp, Artificial Sequence
  Description of Artificial Sequence: Synthetic oligonucleotide
ttggtgagagcttcacggtgcagcgg

SEQ ID NO: 407996 - DNA, 25 bp, Artificial Sequence
  Description of Artificial Sequence: Synthetic oligonucleotide
tggtgagagcttcacggtgcagcgg

SEQ ID NO: 407997 - DNA, 24 bp, Artificial Sequence
  Description of Artificial Sequence: Synthetic oligonucleotide
ggtgagagcttcacggtgcagcgg

SEQ ID NO: 407998 - DNA, 24 bp, Artificial Sequence
  Description of Artificial Sequence: Synthetic oligonucleotide
gtgagagcttcacggtgcagcggc

SEQ ID NO: 407999 - DNA, 25 bp, Artificial Sequence
  Description of Artificial Sequence: Synthetic oligonucleotide
tgagagcttcacggtgcagcggcga

SEQ ID NO: 408000 - DNA, 24 bp, Artificial Sequence
  Description of Artificial Sequence: Synthetic oligonucleotide
gagagcttcacggtgcagcggcga

SEQ ID NO: 408001 - DNA, 24 bp, Artificial Sequence
  Description of Artificial Sequence: Synthetic oligonucleotide
agagcttcacggtgcagcggcgag

SEQ ID NO: 408002 - DNA, 37 bp, Artificial Sequence; identical to SEQ ID NO: 63632
  Description of Artificial Sequence: Synthetic oligonucleotide

SEQ ID NO: 408003 - DNA, 36 bp, Artificial Sequence; identical to SEQ ID NO: 63633
  Description of Artificial Sequence: Synthetic oligonucleotide

SEQ ID NO: 408004 - DNA, 35 bp, Artificial Sequence; identical to SEQ ID NO: 63634
  Description of Artificial Sequence: Synthetic oligonucleotide

SEQ ID NO: 408005 - DNA, 36 bp, Artificial Sequence; identical to SEQ ID NO: 63635
  Description of Artificial Sequence: Synthetic oligonucleotide

SEQ ID NO: 408006 - DNA, 36 bp, Artificial Sequence; identical to SEQ ID NO: 63636
  Description of Artificial Sequence: Synthetic oligonucleotide

SEQ ID NO: 408007 - DNA, 35 bp, Artificial Sequence; identical to SEQ ID NO: 63637
  Description of Artificial Sequence: Synthetic oligonucleotide

SEQ ID NO: 408008 - DNA, 35 bp, Artificial Sequence; identical to SEQ ID NO: 63638
  Description of Artificial Sequence: Synthetic oligonucleotide

SEQ ID NO: 408009 - DNA, 35 bp, Artificial Sequence; identical to SEQ ID NO: 63639
  Description of Artificial Sequence: Synthetic oligonucleotide

SEQ ID NO: 408010 - DNA, 34 bp, Artificial Sequence; identical to SEQ ID NO: 63640
  Description of Artificial Sequence: Synthetic oligonucleotide

SEQ ID NO: 408011 - DNA, 33 bp, Artificial Sequence; identical to SEQ ID NO: 63641
  Description of Artificial Sequence: Synthetic oligonucleotide

SEQ ID NO: 408012 - DNA, 32 bp, Artificial Sequence; identical to SEQ ID NO: 63642
  Description of Artificial Sequence: Synthetic oligonucleotide

SEQ ID NO: 408013 - DNA, 34 bp, Artificial Sequence; identical to SEQ ID NO: 63643
  Description of Artificial Sequence: Synthetic oligonucleotide

SEQ ID NO: 408014 - DNA, 33 bp, Artificial Sequence; identical to SEQ ID NO: 63644
  Description of Artificial Sequence: Synthetic oligonucleotide

SEQ ID NO: 408015 - DNA, 32 bp, Artificial Sequence; identical to SEQ ID NO: 63645
  Description of Artificial Sequence: Synthetic oligonucleotide

SEQ ID NO: 408016 - DNA, 32 bp, Artificial Sequence; identical to SEQ ID NO: 63646
  Description of Artificial Sequence: Synthetic oligonucleotide

SEQ ID NO: 408017 - DNA, 33 bp, Artificial Sequence; identical to SEQ ID NO: 63647
  Description of Artificial Sequence: Synthetic oligonucleotide

SEQ ID NO: 408018 - DNA, 32 bp, Artificial Sequence; identical to SEQ ID NO: 63648
  Description of Artificial Sequence: Synthetic oligonucleotide

SEQ ID NO: 408019 - DNA, 31 bp, Artificial Sequence; identical to SEQ ID NO: 63649
  Description of Artificial Sequence: Synthetic oligonucleotide

SEQ ID NO: 408020 - DNA, 32 bp, Artificial Sequence; identical to SEQ ID NO: 63650
  Description of Artificial Sequence: Synthetic oligonucleotide

SEQ ID NO: 408021 - DNA, 31 bp, Artificial Sequence; identical to SEQ ID NO: 63651
  Description of Artificial Sequence: Synthetic oligonucleotide

SEQ ID NO: 408022 - DNA, 30 bp, Artificial Sequence; identical to SEQ ID NO: 63652
  Description of Artificial Sequence: Synthetic oligonucleotide

SEQ ID NO: 408023 - DNA, 29 bp, Artificial Sequence
  Description of Artificial Sequence: Synthetic oligonucleotide
aaccaagaggagtctgtgcgcttcgacag

SEQ ID NO: 408024 - DNA, 28 bp, Artificial Sequence
  Description of Artificial Sequence: Synthetic oligonucleotide
accaagaggagtctgtgcgcttcgacag

SEQ ID NO: 408025 - DNA, 27 bp, Artificial Sequence
  Description of Artificial Sequence: Synthetic oligonucleotide
ccaagaggagtctgtgcgcttcgacag

SEQ ID NO: 408026 - DNA, 27 bp, Artificial Sequence
  Description of Artificial Sequence: Synthetic oligonucleotide
caagaggagtctgtgcgcttcgacagc

SEQ ID NO: 408027 - DNA, 27 bp, Artificial Sequence
  Description of Artificial Sequence: Synthetic oligonucleotide
aagaggagtctgtgcgcttcgacagcg

SEQ ID NO: 408028 - DNA, 27 bp, Artificial Sequence
  Description of Artificial Sequence: Synthetic oligonucleotide
agaggagtctgtgcgcttcgacagcga

SEQ ID NO: 408029 - DNA, 26 bp, Artificial Sequence
  Description of Artificial Sequence: Synthetic oligonucleotide
gaggagtctgtgcgcttcgacagcga

SEQ ID NO: 408030 - DNA, 26 bp, Artificial Sequence
  Description of Artificial Sequence: Synthetic oligonucleotide
aggagtctgtgcgcttcgacagcgac

SEQ ID NO: 408031 - DNA, 25 bp, Artificial Sequence
  Description of Artificial Sequence: Synthetic oligonucleotide
ggagtctgtgcgcttcgacagcgac

SEQ ID NO: 408032 - DNA, 26 bp, Artificial Sequence
  Description of Artificial Sequence: Synthetic oligonucleotide
gagtctgtgcgcttcgacagcgacgt

SEQ ID NO: 408033 - DNA, 26 bp, Artificial Sequence
  Description of Artificial Sequence: Synthetic oligonucleotide
agtctgtgcgcttcgacagcgacgtg

SEQ ID NO: 408034 - DNA, 25 bp, Artificial Sequence
  Description of Artificial Sequence: Synthetic oligonucleotide
gtctgtgcgcttcgacagcgacgtg

SEQ ID NO: 408035 - DNA, 25 bp, Artificial Sequence
  Description of Artificial Sequence: Synthetic oligonucleotide
tctgtgcgcttcgacagcgacgtgg

SEQ ID NO: 408036 - DNA, 24 bp, Artificial Sequence
  Description of Artificial Sequence: Synthetic oligonucleotide
ctgtgcgcttcgacagcgacgtgg

SEQ ID NO: 408037 - DNA, 26 bp, Artificial Sequence
  Description of Artificial Sequence: Synthetic oligonucleotide
agtccgtgcgcttcgacagcgacgta

SEQ ID NO: 408038 - DNA, 25 bp, Artificial Sequence
  Description of Artificial Sequence: Synthetic oligonucleotide
gtccgtgcgcttcgacagcgacgta

SEQ ID NO: 408039 - DNA, 25 bp, Artificial Sequence
  Description of Artificial Sequence: Synthetic oligonucleotide
tccgtgcgcttcgacagcgacgtag

SEQ ID NO: 408040 - DNA, 24 bp, Artificial Sequence
  Description of Artificial Sequence: Synthetic oligonucleotide
ccgtgcgcttcgacagcgacgtag

SEQ ID NO: 408041 - DNA, 24 bp, Artificial Sequence
  Description of Artificial Sequence: Synthetic oligonucleotide
cgtgcgcttcgacagcgacgtagg

SEQ ID NO: 408042 - DNA, 24 bp, Artificial Sequence
  Description of Artificial Sequence: Synthetic oligonucleotide
gtgcgcttcgacagcgacgtaggg

SEQ ID NO: 408043 - DNA, 25 bp, Artificial Sequence
  Description of Artificial Sequence: Synthetic oligonucleotide
tgcgcttcgacagcgacgtagggga

SEQ ID NO: 408044 - DNA, 24 bp, Artificial Sequence
  Description of Artificial Sequence: Synthetic oligonucleotide
gcgcttcgacagcgacgtagggga

SEQ ID NO: 408045 - DNA, 26 bp, Artificial Sequence
  Description of Artificial Sequence: Synthetic oligonucleotide
cgcttcgacagcgacgtaggggagta

SEQ ID NO: 408046 - DNA, 26 bp, Artificial Sequence
  Description of Artificial Sequence: Synthetic oligonucleotide
gcttcgacagcgacgtaggggagtac

SEQ ID NO: 408047 - DNA, 26 bp, Artificial Sequence
  Description of Artificial Sequence: Synthetic oligonucleotide
cttcgacagcgacgtaggggagtacc

SEQ ID NO: 408048 - DNA, 26 bp, Artificial Sequence
  Description of Artificial Sequence: Synthetic oligonucleotide
ttcgacagcgacgtaggggagtaccg

SEQ ID NO: 408049 - DNA, 25 bp, Artificial Sequence
  Description of Artificial Sequence: Synthetic oligonucleotide
tcgacagcgacgtaggggagtaccg

SEQ ID NO: 408050 - DNA, 24 bp, Artificial Sequence
  Description of Artificial Sequence: Synthetic oligonucleotide
cgacagcgacgtaggggagtaccg

SEQ ID NO: 408051 - DNA, 24 bp, Artificial Sequence
  Description of Artificial Sequence: Synthetic oligonucleotide
gacagcgacgtaggggagtaccgg

SEQ ID NO: 408052 - DNA, 24 bp, Artificial Sequence
  Description of Artificial Sequence: Synthetic oligonucleotide
acagcgacgtaggggagtaccggg

SEQ ID NO: 408053 - DNA, 23 bp, Artificial Sequence
  Description of Artificial Sequence: Synthetic oligonucleotide
cagcgacgtaggggagtaccggg

SEQ ID NO: 408054 - DNA, 23 bp, Artificial Sequence
  Description of Artificial Sequence: Synthetic oligonucleotide
agcgacgtaggggagtaccgggc

SEQ ID NO: 408055 - DNA, 22 bp, Artificial Sequence
  Description of Artificial Sequence: Synthetic oligonucleotide
gcgacgtaggggagtaccgggc

SEQ ID NO: 408056 - DNA, 22 bp, Artificial Sequence
  Description of Artificial Sequence: Synthetic oligonucleotide
cgacgtaggggagtaccgggcg

SEQ ID NO: 408057 - DNA, 23 bp, Artificial Sequence
  Description of Artificial Sequence: Synthetic oligonucleotide
gacgtaggggagtaccgggcggt

SEQ ID NO: 408058 - DNA, 24 bp, Artificial Sequence
  Description of Artificial Sequence: Synthetic oligonucleotide
acgtaggggagtaccgggcggtga

SEQ ID NO: 408059 - DNA, 23 bp, Artificial Sequence
  Description of Artificial Sequence: Synthetic oligonucleotide
cgtaggggagtaccgggcggtga

SEQ ID NO: 408060 - DNA, 23 bp, Artificial Sequence
  Description of Artificial Sequence: Synthetic oligonucleotide
gtaggggagtaccgggcggtgac

SEQ ID NO: 408061 - DNA, 23 bp, Artificial Sequence
  Description of Artificial Sequence: Synthetic oligonucleotide
taggggagtaccgggcggtgacg

SEQ ID NO: 408062 - DNA, 22 bp, Artificial Sequence
  Description of Artificial Sequence: Synthetic oligonucleotide
aggggagtaccgggcggtgacg

SEQ ID NO: 408063 - DNA, 27 bp, Artificial Sequence
  Description of Artificial Sequence: Synthetic oligonucleotide
ttcttcaatgggacggagcgggtgcgt

SEQ ID NO: 408064 - DNA, 27 bp, Artificial Sequence
  Description of Artificial Sequence: Synthetic oligonucleotide
tcttcaatgggacggagcgggtgcgtt

SEQ ID NO: 408065 - DNA, 27 bp, Artificial Sequence
  Description of Artificial Sequence: Synthetic oligonucleotide
cttcaatgggacggagcgggtgcgttt

SEQ ID NO: 408066 - DNA, 27 bp, Artificial Sequence
  Description of Artificial Sequence: Synthetic oligonucleotide
ttcaatgggacggagcgggtgcgtttg

SEQ ID NO: 408067 - DNA, 26 bp, Artificial Sequence
  Description of Artificial Sequence: Synthetic oligonucleotide
tcaatgggacggagcgggtgcgtttg

SEQ ID NO: 408068 - DNA, 25 bp, Artificial Sequence
  Description of Artificial Sequence: Synthetic oligonucleotide
caatgggacggagcgggtgcgtttg

SEQ ID NO: 408069 - DNA, 26 bp, Artificial Sequence
  Description of Artificial Sequence: Synthetic oligonucleotide
aatgggacggagcgggtgcgtttgct

SEQ ID NO: 408070 - DNA, 25 bp, Artificial Sequence
  Description of Artificial Sequence: Synthetic oligonucleotide
atgggacggagcgggtgcgtttgct

SEQ ID NO: 408071 - DNA, 24 bp, Artificial Sequence
  Description of Artificial Sequence: Synthetic oligonucleotide
tgggacggagcgggtgcgtttgct

SEQ ID NO: 408072 - DNA, 23 bp, Artificial Sequence
  Description of Artificial Sequence: Synthetic oligonucleotide
gggacggagcgggtgcgtttgct

SEQ ID NO: 408073 - DNA, 23 bp, Artificial Sequence
  Description of Artificial Sequence: Synthetic oligonucleotide
ggacggagcgggtgcgtttgctg

SEQ ID NO: 408074 - DNA, 26 bp, Artificial Sequence
  Description of Artificial Sequence: Synthetic oligonucleotide
gacggagcgggtgcgtttgctggaaa

SEQ ID NO: 408075 - DNA, 27 bp, Artificial Sequence
  Description of Artificial Sequence: Synthetic oligonucleotide
acggagcgggtgcgtttgctggaaaga

SEQ ID NO: 408076 - DNA, 27 bp, Artificial Sequence
  Description of Artificial Sequence: Synthetic oligonucleotide
cggagcgggtgcgtttgctggaaagat

SEQ ID NO: 408077 - DNA, 27 bp, Artificial Sequence
  Description of Artificial Sequence: Synthetic oligonucleotide
ggagcgggtgcgtttgctggaaagatg

SEQ ID NO: 408078 - DNA, 27 bp, Artificial Sequence
  Description of Artificial Sequence: Synthetic oligonucleotide
gagcgggtgcgtttgctggaaagatgc

SEQ ID NO: 408079 - DNA, 29 bp, Artificial Sequence
  Description of Artificial Sequence: Synthetic oligonucleotide
agcgggtgcgtttgctggaaagatgcatc

SEQ ID NO: 408080 - DNA, 28 bp, Artificial Sequence
  Description of Artificial Sequence: Synthetic oligonucleotide
gcgggtgcgtttgctggaaagatgcatc

SEQ ID NO: 408081 - DNA, 33 bp, Artificial Sequence; identical to SEQ ID NO: 63711
  Description of Artificial Sequence: Synthetic oligonucleotide

SEQ ID NO: 408082 - DNA, 33 bp, Artificial Sequence; identical to SEQ ID NO: 63712
  Description of Artificial Sequence: Synthetic oligonucleotide

SEQ ID NO: 408083 - DNA, 35 bp, Artificial Sequence; identical to SEQ ID NO: 63713
  Description of Artificial Sequence: Synthetic oligonucleotide

SEQ ID NO: 408084 - DNA, 36 bp, Artificial Sequence; identical to SEQ ID NO: 63714
  Description of Artificial Sequence: Synthetic oligonucleotide

SEQ ID NO: 408085 - DNA, 36 bp, Artificial Sequence; identical to SEQ ID NO: 63715
  Description of Artificial Sequence: Synthetic oligonucleotide

SEQ ID NO: 408086 - DNA, 35 bp, Artificial Sequence; identical to SEQ ID NO: 63716
  Description of Artificial Sequence: Synthetic oligonucleotide

SEQ ID NO: 408087 - DNA, 36 bp, Artificial Sequence; identical to SEQ ID NO: 63717
  Description of Artificial Sequence: Synthetic oligonucleotide

SEQ ID NO: 408088 - DNA, 37 bp, Artificial Sequence; identical to SEQ ID NO: 63718
  Description of Artificial Sequence: Synthetic oligonucleotide

SEQ ID NO: 408089 - DNA, 37 bp, Artificial Sequence; identical to SEQ ID NO: 63719
  Description of Artificial Sequence: Synthetic oligonucleotide

SEQ ID NO: 408090 - DNA, 26 bp, Artificial Sequence
  Description of Artificial Sequence: Synthetic oligonucleotide
aggagtccgtgcgcttcgacagcgat

SEQ ID NO: 408091 - DNA, 25 bp, Artificial Sequence
  Description of Artificial Sequence: Synthetic oligonucleotide
ggagtccgtgcgcttcgacagcgat

SEQ ID NO: 408092 - DNA, 26 bp, Artificial Sequence
  Description of Artificial Sequence: Synthetic oligonucleotide
gagtccgtgcgcttcgacagcgatgt

SEQ ID NO: 408093 - DNA, 26 bp, Artificial Sequence
  Description of Artificial Sequence: Synthetic oligonucleotide
agtccgtgcgcttcgacagcgatgtg

SEQ ID NO: 408094 - DNA, 25 bp, Artificial Sequence
  Description of Artificial Sequence: Synthetic oligonucleotide
gtccgtgcgcttcgacagcgatgtg

SEQ ID NO: 408095 - DNA, 25 bp, Artificial Sequence
  Description of Artificial Sequence: Synthetic oligonucleotide
tccgtgcgcttcgacagcgatgtgg

SEQ ID NO: 408096 - DNA, 24 bp, Artificial Sequence
  Description of Artificial Sequence: Synthetic oligonucleotide
ccgtgcgcttcgacagcgatgtgg

SEQ ID NO: 408097 - DNA, 24 bp, Artificial Sequence
  Description of Artificial Sequence: Synthetic oligonucleotide
cgtgcgcttcgacagcgatgtggg

SEQ ID NO: 408098 - DNA, 24 bp, Artificial Sequence
  Description of Artificial Sequence: Synthetic oligonucleotide
gtgcgcttcgacagcgatgtgggg

SEQ ID NO: 408099 - DNA, 25 bp, Artificial Sequence
  Description of Artificial Sequence: Synthetic oligonucleotide
tgcgcttcgacagcgatgtggggga

SEQ ID NO: 408100 - DNA, 24 bp, Artificial Sequence
  Description of Artificial Sequence: Synthetic oligonucleotide
gcgcttcgacagcgatgtggggga

SEQ ID NO: 408101 - DNA, 26 bp, Artificial Sequence
  Description of Artificial Sequence: Synthetic oligonucleotide
cgcttcgacagcgatgtgggggagta

SEQ ID NO: 408102 - DNA, 26 bp, Artificial Sequence
  Description of Artificial Sequence: Synthetic oligonucleotide
gcttcgacagcgatgtgggggagtac

SEQ ID NO: 408103 - DNA, 26 bp, Artificial Sequence
  Description of Artificial Sequence: Synthetic oligonucleotide
cttcgacagcgatgtgggggagtacc

SEQ ID NO: 408104 - DNA, 26 bp, Artificial Sequence
  Description of Artificial Sequence: Synthetic oligonucleotide
ttcgacagcgatgtgggggagtaccg

SEQ ID NO: 408105 - DNA, 25 bp, Artificial Sequence
  Description of Artificial Sequence: Synthetic oligonucleotide
tcgacagcgatgtgggggagtaccg

SEQ ID NO: 408106 - DNA, 24 bp, Artificial Sequence
  Description of Artificial Sequence: Synthetic oligonucleotide
cgacagcgatgtgggggagtaccg

SEQ ID NO: 408107 - DNA, 24 bp, Artificial Sequence
  Description of Artificial Sequence: Synthetic oligonucleotide
gacagcgatgtgggggagtaccgg

SEQ ID NO: 408108 - DNA, 24 bp, Artificial Sequence
  Description of Artificial Sequence: Synthetic oligonucleotide
acagcgatgtgggggagtaccggg

SEQ ID NO: 408109 - DNA, 23 bp, Artificial Sequence
  Description of Artificial Sequence: Synthetic oligonucleotide
cagcgatgtgggggagtaccggg

SEQ ID NO: 408110 - DNA, 23 bp, Artificial Sequence
  Description of Artificial Sequence: Synthetic oligonucleotide
agcgatgtgggggagtaccgggc

SEQ ID NO: 408111 - DNA, 22 bp, Artificial Sequence
  Description of Artificial Sequence: Synthetic oligonucleotide
gcgatgtgggggagtaccgggc

SEQ ID NO: 408112 - DNA, 22 bp, Artificial Sequence
  Description of Artificial Sequence: Synthetic oligonucleotide
cgatgtgggggagtaccgggcg

SEQ ID NO: 408113 - DNA, 23 bp, Artificial Sequence
  Description of Artificial Sequence: Synthetic oligonucleotide
gatgtgggggagtaccgggcggt

SEQ ID NO: 408114 - DNA, 24 bp, Artificial Sequence
  Description of Artificial Sequence: Synthetic oligonucleotide
atgtgggggagtaccgggcggtga

SEQ ID NO: 408115 - DNA, 23 bp, Artificial Sequence
  Description of Artificial Sequence: Synthetic oligonucleotide
tgtgggggagtaccgggcggtga

SEQ ID NO: 408116 - DNA, 33 bp, Artificial Sequence; identical to SEQ ID NO: 63746
  Description of Artificial Sequence: Synthetic oligonucleotide

SEQ ID NO: 408117 - DNA, 32 bp, Artificial Sequence; identical to SEQ ID NO: 63747
  Description of Artificial Sequence: Synthetic oligonucleotide

SEQ ID NO: 408118 - DNA, 31 bp, Artificial Sequence; identical to SEQ ID NO: 63748
  Description of Artificial Sequence: Synthetic oligonucleotide

SEQ ID NO: 408119 - DNA, 30 bp, Artificial Sequence; identical to SEQ ID NO: 63749
  Description of Artificial Sequence: Synthetic oligonucleotide

SEQ ID NO: 408120 - DNA, 30 bp, Artificial Sequence; identical to SEQ ID NO: 63750
  Description of Artificial Sequence: Synthetic oligonucleotide

SEQ ID NO: 408121 - DNA, 29 bp, Artificial Sequence
  Description of Artificial Sequence: Synthetic oligonucleotide
catttcttcaatgggacggagcgggtacg

SEQ ID NO: 408122 - DNA, 29 bp, Artificial Sequence
  Description of Artificial Sequence: Synthetic oligonucleotide
atttcttcaatgggacggagcgggtacgg

SEQ ID NO: 408123 - DNA, 28 bp, Artificial Sequence
  Description of Artificial Sequence: Synthetic oligonucleotide
tttcttcaatgggacggagcgggtacgg

SEQ ID NO: 408124 - DNA, 27 bp, Artificial Sequence
  Description of Artificial Sequence: Synthetic oligonucleotide
ttcttcaatgggacggagcgggtacgg

SEQ ID NO: 408125 - DNA, 27 bp, Artificial Sequence
  Description of Artificial Sequence: Synthetic oligonucleotide
tcttcaatgggacggagcgggtacggt

SEQ ID NO: 408126 - DNA, 27 bp, Artificial Sequence
  Description of Artificial Sequence: Synthetic oligonucleotide
cttcaatgggacggagcgggtacggtt

SEQ ID NO: 408127 - DNA, 27 bp, Artificial Sequence
  Description of Artificial Sequence: Synthetic oligonucleotide
ttcaatgggacggagcgggtacggttg

SEQ ID NO: 408128 - DNA, 26 bp, Artificial Sequence
  Description of Artificial Sequence: Synthetic oligonucleotide
tcaatgggacggagcgggtacggttg

SEQ ID NO: 408129 - DNA, 25 bp, Artificial Sequence
  Description of Artificial Sequence: Synthetic oligonucleotide
caatgggacggagcgggtacggttg

SEQ ID NO: 408130 - DNA, 26 bp, Artificial Sequence
  Description of Artificial Sequence: Synthetic oligonucleotide
aatgggacggagcgggtacggttgct

SEQ ID NO: 408131 - DNA, 25 bp, Artificial Sequence
  Description of Artificial Sequence: Synthetic oligonucleotide
atgggacggagcgggtacggttgct

SEQ ID NO: 408132 - DNA, 24 bp, Artificial Sequence
  Description of Artificial Sequence: Synthetic oligonucleotide
tgggacggagcgggtacggttgct

SEQ ID NO: 408133 - DNA, 23 bp, Artificial Sequence
  Description of Artificial Sequence: Synthetic oligonucleotide
gggacggagcgggtacggttgct

SEQ ID NO: 408134 - DNA, 23 bp, Artificial Sequence
  Description of Artificial Sequence: Synthetic oligonucleotide
ggacggagcgggtacggttgctg

SEQ ID NO: 408135 - DNA, 26 bp, Artificial Sequence
  Description of Artificial Sequence: Synthetic oligonucleotide
gacggagcgggtacggttgctggaaa

SEQ ID NO: 408136 - DNA, 27 bp, Artificial Sequence
  Description of Artificial Sequence: Synthetic oligonucleotide
acggagcgggtacggttgctggaaaga

SEQ ID NO: 408137 - DNA, 27 bp, Artificial Sequence
  Description of Artificial Sequence: Synthetic oligonucleotide
cggagcgggtacggttgctggaaagat

SEQ ID NO: 408138 - DNA, 27 bp, Artificial Sequence
  Description of Artificial Sequence: Synthetic oligonucleotide
ggagcgggtacggttgctggaaagatg

SEQ ID NO: 408139 - DNA, 27 bp, Artificial Sequence
  Description of Artificial Sequence: Synthetic oligonucleotide
gagcgggtacggttgctggaaagatgc

SEQ ID NO: 408140 - DNA, 29 bp, Artificial Sequence
  Description of Artificial Sequence: Synthetic oligonucleotide
agcgggtacggttgctggaaagatgcatc

SEQ ID NO: 408141 - DNA, 28 bp, Artificial Sequence
  Description of Artificial Sequence: Synthetic oligonucleotide
gcgggtacggttgctggaaagatgcatc

SEQ ID NO: 408142 - DNA, 33 bp, Artificial Sequence; identical to SEQ ID NO: 63772
  Description of Artificial Sequence: Synthetic oligonucleotide

SEQ ID NO: 408143 - DNA, 33 bp, Artificial Sequence; identical to SEQ ID NO: 63773
  Description of Artificial Sequence: Synthetic oligonucleotide

SEQ ID NO: 408144 - DNA, 35 bp, Artificial Sequence; identical to SEQ ID NO: 63774
  Description of Artificial Sequence: Synthetic oligonucleotide

SEQ ID NO: 408145 - DNA, 36 bp, Artificial Sequence; identical to SEQ ID NO: 63775
  Description of Artificial Sequence: Synthetic oligonucleotide

SEQ ID NO: 408146 - DNA, 36 bp, Artificial Sequence; identical to SEQ ID NO: 63776
  Description of Artificial Sequence: Synthetic oligonucleotide

SEQ ID NO: 408147 - DNA, 35 bp, Artificial Sequence; identical to SEQ ID NO: 63777
  Description of Artificial Sequence: Synthetic oligonucleotide

SEQ ID NO: 408148 - DNA, 36 bp, Artificial Sequence; identical to SEQ ID NO: 63778
  Description of Artificial Sequence: Synthetic oligonucleotide

SEQ ID NO: 408149 - DNA, 35 bp, Artificial Sequence; identical to SEQ ID NO: 63779
  Description of Artificial Sequence: Synthetic oligonucleotide

SEQ ID NO: 408150 - DNA, 34 bp, Artificial Sequence; identical to SEQ ID NO: 63780
  Description of Artificial Sequence: Synthetic oligonucleotide

SEQ ID NO: 408151 - DNA, 34 bp, Artificial Sequence; identical to SEQ ID NO: 63781
  Description of Artificial Sequence: Synthetic oligonucleotide

SEQ ID NO: 408152 - DNA, 35 bp, Artificial Sequence; identical to SEQ ID NO: 63782
  Description of Artificial Sequence: Synthetic oligonucleotide

SEQ ID NO: 408153 - DNA, 34 bp, Artificial Sequence; identical to SEQ ID NO: 63783
  Description of Artificial Sequence: Synthetic oligonucleotide

SEQ ID NO: 408154 - DNA, 34 bp, Artificial Sequence; identical to SEQ ID NO: 63784
  Description of Artificial Sequence: Synthetic oligonucleotide

SEQ ID NO: 408155 - DNA, 34 bp, Artificial Sequence; identical to SEQ ID NO: 63785
  Description of Artificial Sequence: Synthetic oligonucleotide

SEQ ID NO: 408156 - DNA, 33 bp, Artificial Sequence; identical to SEQ ID NO: 63786
  Description of Artificial Sequence: Synthetic oligonucleotide

SEQ ID NO: 408157 - DNA, 32 bp, Artificial Sequence; identical to SEQ ID NO: 63787
  Description of Artificial Sequence: Synthetic oligonucleotide

SEQ ID NO: 408158 - DNA, 31 bp, Artificial Sequence; identical to SEQ ID NO: 63788
  Description of Artificial Sequence: Synthetic oligonucleotide

SEQ ID NO: 408159 - DNA, 31 bp, Artificial Sequence; identical to SEQ ID NO: 63789
  Description of Artificial Sequence: Synthetic oligonucleotide

SEQ ID NO: 408160 - DNA, 30 bp, Artificial Sequence; identical to SEQ ID NO: 63790
  Description of Artificial Sequence: Synthetic oligonucleotide

SEQ ID NO: 408161 - DNA, 29 bp, Artificial Sequence
  Description of Artificial Sequence: Synthetic oligonucleotide
gcatctataaccaagaggagtcggtgcgc

SEQ ID NO: 408162 - DNA, 31 bp, Artificial Sequence; identical to SEQ ID NO: 63792
  Description of Artificial Sequence: Synthetic oligonucleotide

SEQ ID NO: 408163 - DNA, 31 bp, Artificial Sequence; identical to SEQ ID NO: 63793
  Description of Artificial Sequence: Synthetic oligonucleotide

SEQ ID NO: 408164 - DNA, 30 bp, Artificial Sequence; identical to SEQ ID NO: 63794
  Description of Artificial Sequence: Synthetic oligonucleotide

SEQ ID NO: 408165 - DNA, 29 bp, Artificial Sequence
  Description of Artificial Sequence: Synthetic oligonucleotide
ctataaccaagaggagtcggtgcgcttcg

SEQ ID NO: 408166 - DNA, 30 bp, Artificial Sequence; identical to SEQ ID NO: 63796
  Description of Artificial Sequence: Synthetic oligonucleotide

SEQ ID NO: 408167 - DNA, 29 bp, Artificial Sequence
  Description of Artificial Sequence: Synthetic oligonucleotide
ataaccaagaggagtcggtgcgcttcgac

SEQ ID NO: 408168 - DNA, 28 bp, Artificial Sequence
  Description of Artificial Sequence: Synthetic oligonucleotide
taaccaagaggagtcggtgcgcttcgac

SEQ ID NO: 408169 - DNA, 27 bp, Artificial Sequence
  Description of Artificial Sequence: Synthetic oligonucleotide
aaccaagaggagtcggtgcgcttcgac

SEQ ID NO: 408170 - DNA, 27 bp, Artificial Sequence
  Description of Artificial Sequence: Synthetic oligonucleotide
accaagaggagtcggtgcgcttcgaca

SEQ ID NO: 408171 - DNA, 26 bp, Artificial Sequence
  Description of Artificial Sequence: Synthetic oligonucleotide
ccaagaggagtcggtgcgcttcgaca

SEQ ID NO: 408172 - DNA, 26 bp, Artificial Sequence
  Description of Artificial Sequence: Synthetic oligonucleotide
caagaggagtcggtgcgcttcgacag

SEQ ID NO: 408173 - DNA, 26 bp, Artificial Sequence
  Description of Artificial Sequence: Synthetic oligonucleotide
aagaggagtcggtgcgcttcgacagc

SEQ ID NO: 408174 - DNA, 25 bp, Artificial Sequence
  Description of Artificial Sequence: Synthetic oligonucleotide
agaggagtcggtgcgcttcgacagc

SEQ ID NO: 408175 - DNA, 24 bp, Artificial Sequence
  Description of Artificial Sequence: Synthetic oligonucleotide
gaggagtcggtgcgcttcgacagc

SEQ ID NO: 408176 - DNA, 25 bp, Artificial Sequence
  Description of Artificial Sequence: Synthetic oligonucleotide
aggagtcggtgcgcttcgacagcga

SEQ ID NO: 408177 - DNA, 24 bp, Artificial Sequence
  Description of Artificial Sequence: Synthetic oligonucleotide
ggagtcggtgcgcttcgacagcga

SEQ ID NO: 408178 - DNA, 24 bp, Artificial Sequence
  Description of Artificial Sequence: Synthetic oligonucleotide
gagtcggtgcgcttcgacagcgac

SEQ ID NO: 408179 - DNA, 25 bp, Artificial Sequence
  Description of Artificial Sequence: Synthetic oligonucleotide
agtcggtgcgcttcgacagcgacgt

SEQ ID NO: 408180 - DNA, 24 bp, Artificial Sequence
  Description of Artificial Sequence: Synthetic oligonucleotide
gtcggtgcgcttcgacagcgacgt

SEQ ID NO: 408181 - DNA, 24 bp, Artificial Sequence
  Description of Artificial Sequence: Synthetic oligonucleotide
tcggtgcgcttcgacagcgacgtg

SEQ ID NO: 408182 - DNA, 23 bp, Artificial Sequence
  Description of Artificial Sequence: Synthetic oligonucleotide
cggtgcgcttcgacagcgacgtg

SEQ ID NO: 408183 - DNA, 23 bp, Artificial Sequence
  Description of Artificial Sequence: Synthetic oligonucleotide
ggtgcgcttcgacagcgacgtgg

SEQ ID NO: 408184 - DNA, 24 bp, Artificial Sequence
  Description of Artificial Sequence: Synthetic oligonucleotide
tccgtgcgcttcgacagcgacgtc

SEQ ID NO: 408185 - DNA, 23 bp, Artificial Sequence
  Description of Artificial Sequence: Synthetic oligonucleotide
ccgtgcgcttcgacagcgacgtc

SEQ ID NO: 408186 - DNA, 23 bp, Artificial Sequence
  Description of Artificial Sequence: Synthetic oligonucleotide
cgtgcgcttcgacagcgacgtcg

SEQ ID NO: 408187 - DNA, 23 bp, Artificial Sequence
  Description of Artificial Sequence: Synthetic oligonucleotide
gtgcgcttcgacagcgacgtcgg

SEQ ID NO: 408188 - DNA, 23 bp, Artificial Sequence
  Description of Artificial Sequence: Synthetic oligonucleotide
tgcgcttcgacagcgacgtcggg

SEQ ID NO: 408189 - DNA, 22 bp, Artificial Sequence
  Description of Artificial Sequence: Synthetic oligonucleotide
gcgcttcgacagcgacgtcggg

SEQ ID NO: 408190 - DNA, 23 bp, Artificial Sequence
  Description of Artificial Sequence: Synthetic oligonucleotide
cgcttcgacagcgacgtcgggga

SEQ ID NO: 408191 - DNA, 25 bp, Artificial Sequence
  Description of Artificial Sequence: Synthetic oligonucleotide
gcttcgacagcgacgtcggggagta

SEQ ID NO: 408192 - DNA, 25 bp, Artificial Sequence
  Description of Artificial Sequence: Synthetic oligonucleotide
cttcgacagcgacgtcggggagtac

SEQ ID NO: 408193 - DNA, 25 bp, Artificial Sequence
  Description of Artificial Sequence: Synthetic oligonucleotide
ttcgacagcgacgtcggggagtacc

SEQ ID NO: 408194 - DNA, 24 bp, Artificial Sequence
  Description of Artificial Sequence: Synthetic oligonucleotide
tcgacagcgacgtcggggagtacc

SEQ ID NO: 408195 - DNA, 23 bp, Artificial Sequence
  Description of Artificial Sequence: Synthetic oligonucleotide
cgacagcgacgtcggggagtacc

SEQ ID NO: 408196 - DNA, 23 bp, Artificial Sequence
  Description of Artificial Sequence: Synthetic oligonucleotide
gacagcgacgtcggggagtaccg

SEQ ID NO: 408197 - DNA, 23 bp, Artificial Sequence
  Description of Artificial Sequence: Synthetic oligonucleotide
acagcgacgtcggggagtaccgg

SEQ ID NO: 408198 - DNA, 22 bp, Artificial Sequence
  Description of Artificial Sequence: Synthetic oligonucleotide
cagcgacgtcggggagtaccgg

SEQ ID NO: 408199 - DNA, 22 bp, Artificial Sequence
  Description of Artificial Sequence: Synthetic oligonucleotide
agcgacgtcggggagtaccggg

SEQ ID NO: 408200 - DNA, 21 bp, Artificial Sequence
  Description of Artificial Sequence: Synthetic oligonucleotide
gcgacgtcggggagtaccggg

SEQ ID NO: 408201 - DNA, 21 bp, Artificial Sequence
  Description of Artificial Sequence: Synthetic oligonucleotide
cgacgtcggggagtaccgggc

SEQ ID NO: 408202 - DNA, 21 bp, Artificial Sequence
  Description of Artificial Sequence: Synthetic oligonucleotide
gacgtcggggagtaccgggcg

SEQ ID NO: 408203 - DNA, 22 bp, Artificial Sequence
  Description of Artificial Sequence: Synthetic oligonucleotide
acgtcggggagtaccgggcggt

SEQ ID NO: 408204 - DNA, 21 bp, Artificial Sequence
  Description of Artificial Sequence: Synthetic oligonucleotide
cgtcggggagtaccgggcggt

SEQ ID NO: 408205 - DNA, 22 bp, Artificial Sequence
  Description of Artificial Sequence: Synthetic oligonucleotide
gtcggggagtaccgggcggtga

SEQ ID NO: 408206 - DNA, 22 bp, Artificial Sequence
  Description of Artificial Sequence: Synthetic oligonucleotide
tcggggagtaccgggcggtgac

SEQ ID NO: 408207 - DNA, 21 bp, Artificial Sequence
  Description of Artificial Sequence: Synthetic oligonucleotide
cggggagtaccgggcggtgac

SEQ ID NO: 408208 - DNA, 39 bp, Artificial Sequence; identical to SEQ ID NO: 63838
  Description of Artificial Sequence: Synthetic oligonucleotide

SEQ ID NO: 408209 - DNA, 38 bp, Artificial Sequence; identical to SEQ ID NO: 63839
  Description of Artificial Sequence: Synthetic oligonucleotide

SEQ ID NO: 408210 - DNA, 37 bp, Artificial Sequence; identical to SEQ ID NO: 63840
  Description of Artificial Sequence: Synthetic oligonucleotide

SEQ ID NO: 408211 - DNA, 36 bp, Artificial Sequence; identical to SEQ ID NO: 63841
  Description of Artificial Sequence: Synthetic oligonucleotide

SEQ ID NO: 408212 - DNA, 35 bp, Artificial Sequence; identical to SEQ ID NO: 63842
  Description of Artificial Sequence: Synthetic oligonucleotide

SEQ ID NO: 408213 - DNA, 36 bp, Artificial Sequence; identical to SEQ ID NO: 63843
  Description of Artificial Sequence: Synthetic oligonucleotide

SEQ ID NO: 408214 - DNA, 35 bp, Artificial Sequence; identical to SEQ ID NO: 63844
  Description of Artificial Sequence: Synthetic oligonucleotide

SEQ ID NO: 408215 - DNA, 34 bp, Artificial Sequence; identical to SEQ ID NO: 63845
  Description of Artificial Sequence: Synthetic oligonucleotide

SEQ ID NO: 408216 - DNA, 33 bp, Artificial Sequence; identical to SEQ ID NO: 63846
  Description of Artificial Sequence: Synthetic oligonucleotide

SEQ ID NO: 408217 - DNA, 33 bp, Artificial Sequence; identical to SEQ ID NO: 63847
  Description of Artificial Sequence: Synthetic oligonucleotide

SEQ ID NO: 408218 - DNA, 32 bp, Artificial Sequence; identical to SEQ ID NO: 63848
  Description of Artificial Sequence: Synthetic oligonucleotide

SEQ ID NO: 408219 - DNA, 31 bp, Artificial Sequence; identical to SEQ ID NO: 63849
  Description of Artificial Sequence: Synthetic oligonucleotide

SEQ ID NO: 408220 - DNA, 30 bp, Artificial Sequence; identical to SEQ ID NO: 63850
  Description of Artificial Sequence: Synthetic oligonucleotide

SEQ ID NO: 408221 - DNA, 30 bp, Artificial Sequence; identical to SEQ ID NO: 63851
  Description of Artificial Sequence: Synthetic oligonucleotide

SEQ ID NO: 408222 - DNA, 29 bp, Artificial Sequence
  Description of Artificial Sequence: Synthetic oligonucleotide
catttcttcaatgggacggagcgtgtgcg

SEQ ID NO: 408223 - DNA, 29 bp, Artificial Sequence
  Description of Artificial Sequence: Synthetic oligonucleotide
atttcttcaatgggacggagcgtgtgcgg

SEQ ID NO: 408224 - DNA, 28 bp, Artificial Sequence
  Description of Artificial Sequence: Synthetic oligonucleotide
tttcttcaatgggacggagcgtgtgcgg

SEQ ID NO: 408225 - DNA, 27 bp, Artificial Sequence
  Description of Artificial Sequence: Synthetic oligonucleotide
ttcttcaatgggacggagcgtgtgcgg

SEQ ID NO: 408226 - DNA, 27 bp, Artificial Sequence
  Description of Artificial Sequence: Synthetic oligonucleotide
tcttcaatgggacggagcgtgtgcggt

SEQ ID NO: 408227 - DNA, 27 bp, Artificial Sequence
  Description of Artificial Sequence: Synthetic oligonucleotide
cttcaatgggacggagcgtgtgcggtt

SEQ ID NO: 408228 - DNA, 27 bp, Artificial Sequence
  Description of Artificial Sequence: Synthetic oligonucleotide
ttcaatgggacggagcgtgtgcggttg

SEQ ID NO: 408229 - DNA, 26 bp, Artificial Sequence
  Description of Artificial Sequence: Synthetic oligonucleotide
tcaatgggacggagcgtgtgcggttg

SEQ ID NO: 408230 - DNA, 25 bp, Artificial Sequence
  Description of Artificial Sequence: Synthetic oligonucleotide
caatgggacggagcgtgtgcggttg

SEQ ID NO: 408231 - DNA, 26 bp, Artificial Sequence
  Description of Artificial Sequence: Synthetic oligonucleotide
aatgggacggagcgtgtgcggttgct

SEQ ID NO: 408232 - DNA, 25 bp, Artificial Sequence
  Description of Artificial Sequence: Synthetic oligonucleotide
atgggacggagcgtgtgcggttgct

SEQ ID NO: 408233 - DNA, 24 bp, Artificial Sequence
  Description of Artificial Sequence: Synthetic oligonucleotide
tgggacggagcgtgtgcggttgct

SEQ ID NO: 408234 - DNA, 23 bp, Artificial Sequence
  Description of Artificial Sequence: Synthetic oligonucleotide
gggacggagcgtgtgcggttgct

SEQ ID NO: 408235 - DNA, 23 bp, Artificial Sequence
  Description of Artificial Sequence: Synthetic oligonucleotide
ggacggagcgtgtgcggttgctg

SEQ ID NO: 408236 - DNA, 26 bp, Artificial Sequence
  Description of Artificial Sequence: Synthetic oligonucleotide
gacggagcgtgtgcggttgctggaaa

SEQ ID NO: 408237 - DNA, 27 bp, Artificial Sequence
  Description of Artificial Sequence: Synthetic oligonucleotide
acggagcgtgtgcggttgctggaaaga

SEQ ID NO: 408238 - DNA, 27 bp, Artificial Sequence
  Description of Artificial Sequence: Synthetic oligonucleotide
cggagcgtgtgcggttgctggaaagat

SEQ ID NO: 408239 - DNA, 27 bp, Artificial Sequence
  Description of Artificial Sequence: Synthetic oligonucleotide
ggagcgtgtgcggttgctggaaagatg

SEQ ID NO: 408240 - DNA, 27 bp, Artificial Sequence
  Description of Artificial Sequence: Synthetic oligonucleotide
gagcgtgtgcggttgctggaaagatgc

SEQ ID NO: 408241 - DNA, 29 bp, Artificial Sequence
  Description of Artificial Sequence: Synthetic oligonucleotide
agcgtgtgcggttgctggaaagatgcatc

SEQ ID NO: 408242 - DNA, 28 bp, Artificial Sequence
  Description of Artificial Sequence: Synthetic oligonucleotide
gcgtgtgcggttgctggaaagatgcatc

SEQ ID NO: 408243 - DNA, 33 bp, Artificial Sequence; identical to SEQ ID NO: 63873
  Description of Artificial Sequence: Synthetic oligonucleotide

SEQ ID NO: 408244 - DNA, 33 bp, Artificial Sequence; identical to SEQ ID NO: 63874
  Description of Artificial Sequence: Synthetic oligonucleotide

SEQ ID NO: 408245 - DNA, 35 bp, Artificial Sequence; identical to SEQ ID NO: 63875
  Description of Artificial Sequence: Synthetic oligonucleotide

SEQ ID NO: 408246 - DNA, 27 bp, Artificial Sequence
  Description of Artificial Sequence: Synthetic oligonucleotide
gagcgggtgcggttgctggaaagatgt

SEQ ID NO: 408247 - DNA, 29 bp, Artificial Sequence
  Description of Artificial Sequence: Synthetic oligonucleotide
agcgggtgcggttgctggaaagatgtatc

SEQ ID NO: 408248 - DNA, 28 bp, Artificial Sequence
  Description of Artificial Sequence: Synthetic oligonucleotide
gcgggtgcggttgctggaaagatgtatc

SEQ ID NO: 408249 - DNA, 33 bp, Artificial Sequence; identical to SEQ ID NO: 63879
  Description of Artificial Sequence: Synthetic oligonucleotide

SEQ ID NO: 408250 - DNA, 33 bp, Artificial Sequence; identical to SEQ ID NO: 63880
  Description of Artificial Sequence: Synthetic oligonucleotide

SEQ ID NO: 408251 - DNA, 35 bp, Artificial Sequence; identical to SEQ ID NO: 63881
  Description of Artificial Sequence: Synthetic oligonucleotide

SEQ ID NO: 408252 - DNA, 36 bp, Artificial Sequence; identical to SEQ ID NO: 63882
  Description of Artificial Sequence: Synthetic oligonucleotide

SEQ ID NO: 408253 - DNA, 36 bp, Artificial Sequence; identical to SEQ ID NO: 63883
  Description of Artificial Sequence: Synthetic oligonucleotide

SEQ ID NO: 408254 - DNA, 35 bp, Artificial Sequence; identical to SEQ ID NO: 63884
  Description of Artificial Sequence: Synthetic oligonucleotide

SEQ ID NO: 408255 - DNA, 36 bp, Artificial Sequence; identical to SEQ ID NO: 63885
  Description of Artificial Sequence: Synthetic oligonucleotide

SEQ ID NO: 408256 - DNA, 37 bp, Artificial Sequence; identical to SEQ ID NO: 63886
  Description of Artificial Sequence: Synthetic oligonucleotide

SEQ ID NO: 408257 - DNA, 37 bp, Artificial Sequence; identical to SEQ ID NO: 63887
  Description of Artificial Sequence: Synthetic oligonucleotide

SEQ ID NO: 408258 - DNA, 37 bp, Artificial Sequence; identical to SEQ ID NO: 63888
  Description of Artificial Sequence: Synthetic oligonucleotide

SEQ ID NO: 408259 - DNA, 36 bp, Artificial Sequence; identical to SEQ ID NO: 63889
  Description of Artificial Sequence: Synthetic oligonucleotide

SEQ ID NO: 408260 - DNA, 35 bp, Artificial Sequence; identical to SEQ ID NO: 63890
  Description of Artificial Sequence: Synthetic oligonucleotide

SEQ ID NO: 408261 - DNA, 36 bp, Artificial Sequence; identical to SEQ ID NO: 63891
  Description of Artificial Sequence: Synthetic oligonucleotide

SEQ ID NO: 408262 - DNA, 36 bp, Artificial Sequence; identical to SEQ ID NO: 63892
  Description of Artificial Sequence: Synthetic oligonucleotide

SEQ ID NO: 408263 - DNA, 35 bp, Artificial Sequence; identical to SEQ ID NO: 63893
  Description of Artificial Sequence: Synthetic oligonucleotide

SEQ ID NO: 408264 - DNA, 35 bp, Artificial Sequence; identical to SEQ ID NO: 63894
  Description of Artificial Sequence: Synthetic oligonucleotide

SEQ ID NO: 408265 - DNA, 35 bp, Artificial Sequence; identical to SEQ ID NO: 63895
  Description of Artificial Sequence: Synthetic oligonucleotide

SEQ ID NO: 408266 - DNA, 34 bp, Artificial Sequence; identical to SEQ ID NO: 63896
  Description of Artificial Sequence: Synthetic oligonucleotide

SEQ ID NO: 408267 - DNA, 33 bp, Artificial Sequence; identical to SEQ ID NO: 63897
  Description of Artificial Sequence: Synthetic oligonucleotide

SEQ ID NO: 408268 - DNA, 32 bp, Artificial Sequence; identical to SEQ ID NO: 63898
  Description of Artificial Sequence: Synthetic oligonucleotide

SEQ ID NO: 408269 - DNA, 34 bp, Artificial Sequence; identical to SEQ ID NO: 63899
  Description of Artificial Sequence: Synthetic oligonucleotide

SEQ ID NO: 408270 - DNA, 33 bp, Artificial Sequence; identical to SEQ ID NO: 63900
  Description of Artificial Sequence: Synthetic oligonucleotide

SEQ ID NO: 408271 - DNA, 32 bp, Artificial Sequence; identical to SEQ ID NO: 63901
  Description of Artificial Sequence: Synthetic oligonucleotide

SEQ ID NO: 408272 - DNA, 32 bp, Artificial Sequence; identical to SEQ ID NO: 63902
  Description of Artificial Sequence: Synthetic oligonucleotide

SEQ ID NO: 408273 - DNA, 23 bp, Artificial Sequence
  Description of Artificial Sequence: Synthetic oligonucleotide
acctcctggagcagaggcgggca

SEQ ID NO: 408274 - DNA, 22 bp, Artificial Sequence
  Description of Artificial Sequence: Synthetic oligonucleotide
cctcctggagcagaggcgggca

SEQ ID NO: 408275 - DNA, 22 bp, Artificial Sequence
  Description of Artificial Sequence: Synthetic oligonucleotide
ctcctggagcagaggcgggcag

SEQ ID NO: 408276 - DNA, 22 bp, Artificial Sequence
  Description of Artificial Sequence: Synthetic oligonucleotide
tcctggagcagaggcgggcagc

SEQ ID NO: 408277 - DNA, 21 bp, Artificial Sequence
  Description of Artificial Sequence: Synthetic oligonucleotide
cctggagcagaggcgggcagc

SEQ ID NO: 408278 - DNA, 21 bp, Artificial Sequence
  Description of Artificial Sequence: Synthetic oligonucleotide
ctggagcagaggcgggcagcg

SEQ ID NO: 408279 - DNA, 22 bp, Artificial Sequence
  Description of Artificial Sequence: Synthetic oligonucleotide
tggagcagaggcgggcagcggt

SEQ ID NO: 408280 - DNA, 21 bp, Artificial Sequence
  Description of Artificial Sequence: Synthetic oligonucleotide
ggagcagaggcgggcagcggt

SEQ ID NO: 408281 - DNA, 21 bp, Artificial Sequence
  Description of Artificial Sequence: Synthetic oligonucleotide
gagcagaggcgggcagcggtg

SEQ ID NO: 408282 - DNA, 22 bp, Artificial Sequence
  Description of Artificial Sequence: Synthetic oligonucleotide
agcagaggcgggcagcggtgga

SEQ ID NO: 408283 - DNA, 21 bp, Artificial Sequence
  Description of Artificial Sequence: Synthetic oligonucleotide
gcagaggcgggcagcggtgga

SEQ ID NO: 408284 - DNA, 22 bp, Artificial Sequence
  Description of Artificial Sequence: Synthetic oligonucleotide
cagaggcgggcagcggtggaca

SEQ ID NO: 408285 - DNA, 22 bp, Artificial Sequence
  Description of Artificial Sequence: Synthetic oligonucleotide
agaggcgggcagcggtggacac

SEQ ID NO: 408286 - DNA, 21 bp, Artificial Sequence
  Description of Artificial Sequence: Synthetic oligonucleotide
gaggcgggcagcggtggacac

SEQ ID NO: 408287 - DNA, 23 bp, Artificial Sequence
  Description of Artificial Sequence: Synthetic oligonucleotide
aggcgggcagcggtggacaccta

SEQ ID NO: 408288 - DNA, 22 bp, Artificial Sequence
  Description of Artificial Sequence: Synthetic oligonucleotide
ggcgggcagcggtggacaccta

SEQ ID NO: 408289 - DNA, 23 bp, Artificial Sequence
  Description of Artificial Sequence: Synthetic oligonucleotide
gcgggcagcggtggacacctact

SEQ ID NO: 408290 - DNA, 23 bp, Artificial Sequence
  Description of Artificial Sequence: Synthetic oligonucleotide
cgggcagcggtggacacctactg

SEQ ID NO: 408291 - DNA, 24 bp, Artificial Sequence
  Description of Artificial Sequence: Synthetic oligonucleotide
gggcagcggtggacacctactgca

SEQ ID NO: 408292 - DNA, 25 bp, Artificial Sequence
  Description of Artificial Sequence: Synthetic oligonucleotide
ggcagcggtggacacctactgcaga

SEQ ID NO: 408293 - DNA, 26 bp, Artificial Sequence
  Description of Artificial Sequence: Synthetic oligonucleotide
gcagcggtggacacctactgcagaca

SEQ ID NO: 408294 - DNA, 27 bp, Artificial Sequence
  Description of Artificial Sequence: Synthetic oligonucleotide
cagcggtggacacctactgcagacaca

SEQ ID NO: 408295 - DNA, 28 bp, Artificial Sequence
  Description of Artificial Sequence: Synthetic oligonucleotide
agcggtggacacctactgcagacacaac

SEQ ID NO: 408296 - DNA, 21 bp, Artificial Sequence
  Description of Artificial Sequence: Synthetic oligonucleotide
gagctggggcggcctgatgcg

SEQ ID NO: 408297 - DNA, 22 bp, Artificial Sequence
  Description of Artificial Sequence: Synthetic oligonucleotide
agctggggcggcctgatgcgga

SEQ ID NO: 408298 - DNA, 21 bp, Artificial Sequence
  Description of Artificial Sequence: Synthetic oligonucleotide
gctggggcggcctgatgcgga

SEQ ID NO: 408299 - DNA, 23 bp, Artificial Sequence
  Description of Artificial Sequence: Synthetic oligonucleotide
ctggggcggcctgatgcggagta

SEQ ID NO: 408300 - DNA, 24 bp, Artificial Sequence
  Description of Artificial Sequence: Synthetic oligonucleotide
tggggcggcctgatgcggagtact

SEQ ID NO: 408301 - DNA, 23 bp, Artificial Sequence
  Description of Artificial Sequence: Synthetic oligonucleotide
ggggcggcctgatgcggagtact

SEQ ID NO: 408302 - DNA, 23 bp, Artificial Sequence
  Description of Artificial Sequence: Synthetic oligonucleotide
gggcggcctgatgcggagtactg

SEQ ID NO: 408303 - DNA, 25 bp, Artificial Sequence
  Description of Artificial Sequence: Synthetic oligonucleotide
ggcggcctgatgcggagtactggaa

SEQ ID NO: 408304 - DNA, 26 bp, Artificial Sequence
  Description of Artificial Sequence: Synthetic oligonucleotide
gcggcctgatgcggagtactggaaca

SEQ ID NO: 408305 - DNA, 26 bp, Artificial Sequence
  Description of Artificial Sequence: Synthetic oligonucleotide
cggcctgatgcggagtactggaacag

SEQ ID NO: 408306 - DNA, 26 bp, Artificial Sequence
  Description of Artificial Sequence: Synthetic oligonucleotide
ggcctgatgcggagtactggaacagc

SEQ ID NO: 408307 - DNA, 27 bp, Artificial Sequence
  Description of Artificial Sequence: Synthetic oligonucleotide
gcctgatgcggagtactggaacagcca

SEQ ID NO: 408308 - DNA, 27 bp, Artificial Sequence
  Description of Artificial Sequence: Synthetic oligonucleotide
cctgatgcggagtactggaacagccag

SEQ ID NO: 408309 - DNA, 29 bp, Artificial Sequence
  Description of Artificial Sequence: Synthetic oligonucleotide
ctgatgcggagtactggaacagccagaag

SEQ ID NO: 408310 - DNA, 29 bp, Artificial Sequence
  Description of Artificial Sequence: Synthetic oligonucleotide
tgatgcggagtactggaacagccagaagg

SEQ ID NO: 408311 - DNA, 28 bp, Artificial Sequence
  Description of Artificial Sequence: Synthetic oligonucleotide
gatgcggagtactggaacagccagaagg

SEQ ID NO: 408312 - DNA, 29 bp, Artificial Sequence
  Description of Artificial Sequence: Synthetic oligonucleotide
atgcggagtactggaacagccagaaggac

SEQ ID NO: 408313 - DNA, 26 bp, Artificial Sequence
  Description of Artificial Sequence: Synthetic oligonucleotide
agtccgtgcgcttcgacagcgacgtt

SEQ ID NO: 408314 - DNA, 25 bp, Artificial Sequence
  Description of Artificial Sequence: Synthetic oligonucleotide
gtccgtgcgcttcgacagcgacgtt

SEQ ID NO: 408315 - DNA, 25 bp, Artificial Sequence
  Description of Artificial Sequence: Synthetic oligonucleotide
tccgtgcgcttcgacagcgacgttg

SEQ ID NO: 408316 - DNA, 24 bp, Artificial Sequence
  Description of Artificial Sequence: Synthetic oligonucleotide
ccgtgcgcttcgacagcgacgttg

SEQ ID NO: 408317 - DNA, 24 bp, Artificial Sequence
  Description of Artificial Sequence: Synthetic oligonucleotide
cgtgcgcttcgacagcgacgttgg

SEQ ID NO: 408318 - DNA, 24 bp, Artificial Sequence
  Description of Artificial Sequence: Synthetic oligonucleotide
gtgcgcttcgacagcgacgttggg

SEQ ID NO: 408319 - DNA, 25 bp, Artificial Sequence
  Description of Artificial Sequence: Synthetic oligonucleotide
tgcgcttcgacagcgacgttgggga

SEQ ID NO: 408320 - DNA, 24 bp, Artificial Sequence
  Description of Artificial Sequence: Synthetic oligonucleotide
gcgcttcgacagcgacgttgggga

SEQ ID NO: 408321 - DNA, 26 bp, Artificial Sequence
  Description of Artificial Sequence: Synthetic oligonucleotide
cgcttcgacagcgacgttggggagta

SEQ ID NO: 408322 - DNA, 26 bp, Artificial Sequence
  Description of Artificial Sequence: Synthetic oligonucleotide
gcttcgacagcgacgttggggagtac

SEQ ID NO: 408323 - DNA, 26 bp, Artificial Sequence
  Description of Artificial Sequence: Synthetic oligonucleotide
cttcgacagcgacgttggggagtacc

SEQ ID NO: 408324 - DNA, 26 bp, Artificial Sequence
  Description of Artificial Sequence: Synthetic oligonucleotide
ttcgacagcgacgttggggagtaccg

SEQ ID NO: 408325 - DNA, 25 bp, Artificial Sequence
  Description of Artificial Sequence: Synthetic oligonucleotide
tcgacagcgacgttggggagtaccg

SEQ ID NO: 408326 - DNA, 24 bp, Artificial Sequence
  Description of Artificial Sequence: Synthetic oligonucleotide
cgacagcgacgttggggagtaccg

SEQ ID NO: 408327 - DNA, 24 bp, Artificial Sequence
  Description of Artificial Sequence: Synthetic oligonucleotide
gacagcgacgttggggagtaccgg

SEQ ID NO: 408328 - DNA, 24 bp, Artificial Sequence
  Description of Artificial Sequence: Synthetic oligonucleotide
acagcgacgttggggagtaccggg

SEQ ID NO: 408329 - DNA, 23 bp, Artificial Sequence
  Description of Artificial Sequence: Synthetic oligonucleotide
cagcgacgttggggagtaccggg

SEQ ID NO: 408330 - DNA, 23 bp, Artificial Sequence
  Description of Artificial Sequence: Synthetic oligonucleotide
agcgacgttggggagtaccgggc

SEQ ID NO: 408331 - DNA, 22 bp, Artificial Sequence
  Description of Artificial Sequence: Synthetic oligonucleotide
gcgacgttggggagtaccgggc

SEQ ID NO: 408332 - DNA, 22 bp, Artificial Sequence
  Description of Artificial Sequence: Synthetic oligonucleotide
cgacgttggggagtaccgggcg

SEQ ID NO: 408333 - DNA, 23 bp, Artificial Sequence
  Description of Artificial Sequence: Synthetic oligonucleotide
gacgttggggagtaccgggcggt

SEQ ID NO: 408334 - DNA, 24 bp, Artificial Sequence
  Description of Artificial Sequence: Synthetic oligonucleotide
acgttggggagtaccgggcggtga

SEQ ID NO: 408335 - DNA, 23 bp, Artificial Sequence
  Description of Artificial Sequence: Synthetic oligonucleotide
cgttggggagtaccgggcggtga

SEQ ID NO: 408336 - DNA, 23 bp, Artificial Sequence
  Description of Artificial Sequence: Synthetic oligonucleotide
gttggggagtaccgggcggtgac

SEQ ID NO: 408337 - DNA, 23 bp, Artificial Sequence
  Description of Artificial Sequence: Synthetic oligonucleotide
ttggggagtaccgggcggtgacg

SEQ ID NO: 408338 - DNA, 22 bp, Artificial Sequence
  Description of Artificial Sequence: Synthetic oligonucleotide
tggggagtaccgggcggtgacg

SEQ ID NO: 408339 - DNA, 20 bp, Artificial Sequence
  Description of Artificial Sequence: Synthetic oligonucleotide
ggagctggggcggcctgacg

SEQ ID NO: 408340 - DNA, 21 bp, Artificial Sequence
  Description of Artificial Sequence: Synthetic oligonucleotide
gagctggggcggcctgacgct

SEQ ID NO: 408341 - DNA, 22 bp, Artificial Sequence
  Description of Artificial Sequence: Synthetic oligonucleotide
agctggggcggcctgacgctga

SEQ ID NO: 408342 - DNA, 21 bp, Artificial Sequence
  Description of Artificial Sequence: Synthetic oligonucleotide
gctggggcggcctgacgctga

SEQ ID NO: 408343 - DNA, 23 bp, Artificial Sequence
  Description of Artificial Sequence: Synthetic oligonucleotide
ctggggcggcctgacgctgagta

SEQ ID NO: 408344 - DNA, 24 bp, Artificial Sequence
  Description of Artificial Sequence: Synthetic oligonucleotide
tggggcggcctgacgctgagtact

SEQ ID NO: 408345 - DNA, 23 bp, Artificial Sequence
  Description of Artificial Sequence: Synthetic oligonucleotide
ggggcggcctgacgctgagtact

SEQ ID NO: 408346 - DNA, 23 bp, Artificial Sequence
  Description of Artificial Sequence: Synthetic oligonucleotide
gggcggcctgacgctgagtactg

SEQ ID NO: 408347 - DNA, 25 bp, Artificial Sequence
  Description of Artificial Sequence: Synthetic oligonucleotide
ggcggcctgacgctgagtactggaa

SEQ ID NO: 408348 - DNA, 26 bp, Artificial Sequence
  Description of Artificial Sequence: Synthetic oligonucleotide
gcggcctgacgctgagtactggaaca

SEQ ID NO: 408349 - DNA, 26 bp, Artificial Sequence
  Description of Artificial Sequence: Synthetic oligonucleotide
cggcctgacgctgagtactggaacag

SEQ ID NO: 408350 - DNA, 26 bp, Artificial Sequence
  Description of Artificial Sequence: Synthetic oligonucleotide
ggcctgacgctgagtactggaacagc

SEQ ID NO: 408351 - DNA, 27 bp, Artificial Sequence
  Description of Artificial Sequence: Synthetic oligonucleotide
gcctgacgctgagtactggaacagcca

SEQ ID NO: 408352 - DNA, 27 bp, Artificial Sequence
  Description of Artificial Sequence: Synthetic oligonucleotide
cctgacgctgagtactggaacagccag

SEQ ID NO: 408353 - DNA, 29 bp, Artificial Sequence
  Description of Artificial Sequence: Synthetic oligonucleotide
ctgacgctgagtactggaacagccagaag

SEQ ID NO: 408354 - DNA, 29 bp, Artificial Sequence
  Description of Artificial Sequence: Synthetic oligonucleotide
tgacgctgagtactggaacagccagaagg

SEQ ID NO: 408355 - DNA, 28 bp, Artificial Sequence
  Description of Artificial Sequence: Synthetic oligonucleotide
gacgctgagtactggaacagccagaagg

SEQ ID NO: 408356 - DNA, 29 bp, Artificial Sequence
  Description of Artificial Sequence: Synthetic oligonucleotide
acgctgagtactggaacagccagaaggac

SEQ ID NO: 408357 - DNA, 28 bp, Artificial Sequence
  Description of Artificial Sequence: Synthetic oligonucleotide
cgctgagtactggaacagccagaaggac

SEQ ID NO: 408358 - DNA, 28 bp, Artificial Sequence
  Description of Artificial Sequence: Synthetic oligonucleotide
gctgagtactggaacagccagaaggacc

SEQ ID NO: 408359 - DNA, 29 bp, Artificial Sequence
  Description of Artificial Sequence: Synthetic oligonucleotide
ctgagtactggaacagccagaaggacctc

SEQ ID NO: 408360 - DNA, 29 bp, Artificial Sequence
  Description of Artificial Sequence: Synthetic oligonucleotide
tgagtactggaacagccagaaggacctcc

SEQ ID NO: 408361 - DNA, 30 bp, Artificial Sequence
  Description of Artificial Sequence: Synthetic oligonucleotide
ctgatgccgagtactggaacagccagaaag

SEQ ID NO: 408362 - DNA, 31 bp, Artificial Sequence
  Description of Artificial Sequence: Synthetic oligonucleotide
tgatgccgagtactggaacagccagaaagac

SEQ ID NO: 408363 - DNA, 30 bp, Artificial Sequence
  Description of Artificial Sequence: Synthetic oligonucleotide
gatgccgagtactggaacagccagaaagac

SEQ ID NO: 408364 - DNA, 30 bp, Artificial Sequence
  Description of Artificial Sequence: Synthetic oligonucleotide
atgccgagtactggaacagccagaaagacc

SEQ ID NO: 408365 - DNA, 29 bp, Artificial Sequence
  Description of Artificial Sequence: Synthetic oligonucleotide
tgccgagtactggaacagccagaaagacc

SEQ ID NO: 408366 - DNA, 28 bp, Artificial Sequence
  Description of Artificial Sequence: Synthetic oligonucleotide
gccgagtactggaacagccagaaagacc

SEQ ID NO: 408367 - DNA, 29 bp, Artificial Sequence
  Description of Artificial Sequence: Synthetic oligonucleotide
ccgagtactggaacagccagaaagacctc

SEQ ID NO: 408368 - DNA, 29 bp, Artificial Sequence
  Description of Artificial Sequence: Synthetic oligonucleotide
cgagtactggaacagccagaaagacctcc

SEQ ID NO: 408369 - DNA, 30 bp, Artificial Sequence
  Description of Artificial Sequence: Synthetic oligonucleotide
gagtactggaacagccagaaagacctcctg

SEQ ID NO: 408370 - DNA, 30 bp, Artificial Sequence
  Description of Artificial Sequence: Synthetic oligonucleotide
agtactggaacagccagaaagacctcctgg

SEQ ID NO: 408371 - DNA, 29 bp, Artificial Sequence
  Description of Artificial Sequence: Synthetic oligonucleotide
gtactggaacagccagaaagacctcctgg

SEQ ID NO: 408372 - DNA, 30 bp, Artificial Sequence
  Description of Artificial Sequence: Synthetic oligonucleotide
tactggaacagccagaaagacctcctggag

SEQ ID NO: 408373 - DNA, 29 bp, Artificial Sequence
  Description of Artificial Sequence: Synthetic oligonucleotide
actggaacagccagaaagacctcctggag

SEQ ID NO: 408374 - DNA, 28 bp, Artificial Sequence
  Description of Artificial Sequence: Synthetic oligonucleotide
ctggaacagccagaaagacctcctggag

SEQ ID NO: 408375 - DNA, 28 bp, Artificial Sequence
  Description of Artificial Sequence: Synthetic oligonucleotide
tggaacagccagaaagacctcctggagc

SEQ ID NO: 408376 - DNA, 27 bp, Artificial Sequence
  Description of Artificial Sequence: Synthetic oligonucleotide
ggaacagccagaaagacctcctggagc

SEQ ID NO: 408377 - DNA, 28 bp, Artificial Sequence
  Description of Artificial Sequence: Synthetic oligonucleotide
gaacagccagaaagacctcctggagcag

SEQ ID NO: 408378 - DNA, 29 bp, Artificial Sequence
  Description of Artificial Sequence: Synthetic oligonucleotide
aacagccagaaagacctcctggagcagag

SEQ ID NO: 408379 - DNA, 28 bp, Artificial Sequence
  Description of Artificial Sequence: Synthetic oligonucleotide
acagccagaaagacctcctggagcagag

SEQ ID NO: 408380 - DNA, 27 bp, Artificial Sequence
  Description of Artificial Sequence: Synthetic oligonucleotide
cagccagaaagacctcctggagcagag

SEQ ID NO: 408381 - DNA, 27 bp, Artificial Sequence
  Description of Artificial Sequence: Synthetic oligonucleotide
agccagaaagacctcctggagcagagg

SEQ ID NO: 408382 - DNA, 26 bp, Artificial Sequence
  Description of Artificial Sequence: Synthetic oligonucleotide
gccagaaagacctcctggagcagagg

SEQ ID NO: 408383 - DNA, 26 bp, Artificial Sequence
  Description of Artificial Sequence: Synthetic oligonucleotide
ccagaaagacctcctggagcagaggc

SEQ ID NO: 408384 - DNA, 26 bp, Artificial Sequence
  Description of Artificial Sequence: Synthetic oligonucleotide
cagaaagacctcctggagcagaggcg

SEQ ID NO: 408385 - DNA, 26 bp, Artificial Sequence
  Description of Artificial Sequence: Synthetic oligonucleotide
agaaagacctcctggagcagaggcgg

SEQ ID NO: 408386 - DNA, 25 bp, Artificial Sequence
  Description of Artificial Sequence: Synthetic oligonucleotide
gaaagacctcctggagcagaggcgg

SEQ ID NO: 408387 - DNA, 25 bp, Artificial Sequence
  Description of Artificial Sequence: Synthetic oligonucleotide
aaagacctcctggagcagaggcggg

SEQ ID NO: 408388 - DNA, 24 bp, Artificial Sequence
  Description of Artificial Sequence: Synthetic oligonucleotide
aagacctcctggagcagaggcggg

SEQ ID NO: 408389 - DNA, 23 bp, Artificial Sequence
  Description of Artificial Sequence: Synthetic oligonucleotide
agacctcctggagcagaggcggg

SEQ ID NO: 408390 - DNA, 28 bp, Artificial Sequence
  Description of Artificial Sequence: Synthetic oligonucleotide
tggaacagccagaaggacctcctggaac

SEQ ID NO: 408391 - DNA, 27 bp, Artificial Sequence
  Description of Artificial Sequence: Synthetic oligonucleotide
ggaacagccagaaggacctcctggaac

SEQ ID NO: 408392 - DNA, 28 bp, Artificial Sequence
  Description of Artificial Sequence: Synthetic oligonucleotide
gaacagccagaaggacctcctggaacag

SEQ ID NO: 408393 - DNA, 29 bp, Artificial Sequence
  Description of Artificial Sequence: Synthetic oligonucleotide
aacagccagaaggacctcctggaacagag

SEQ ID NO: 408394 - DNA, 28 bp, Artificial Sequence
  Description of Artificial Sequence: Synthetic oligonucleotide
acagccagaaggacctcctggaacagag

SEQ ID NO: 408395 - DNA, 27 bp, Artificial Sequence
  Description of Artificial Sequence: Synthetic oligonucleotide
cagccagaaggacctcctggaacagag

SEQ ID NO: 408396 - DNA, 27 bp, Artificial Sequence
  Description of Artificial Sequence: Synthetic oligonucleotide
agccagaaggacctcctggaacagagg

SEQ ID NO: 408397 - DNA, 26 bp, Artificial Sequence
  Description of Artificial Sequence: Synthetic oligonucleotide
gccagaaggacctcctggaacagagg

SEQ ID NO: 408398 - DNA, 26 bp, Artificial Sequence
  Description of Artificial Sequence: Synthetic oligonucleotide
ccagaaggacctcctggaacagaggc

SEQ ID NO: 408399 - DNA, 26 bp, Artificial Sequence
  Description of Artificial Sequence: Synthetic oligonucleotide
cagaaggacctcctggaacagaggcg

SEQ ID NO: 408400 - DNA, 26 bp, Artificial Sequence
  Description of Artificial Sequence: Synthetic oligonucleotide
agaaggacctcctggaacagaggcgg

SEQ ID NO: 408401 - DNA, 25 bp, Artificial Sequence
  Description of Artificial Sequence: Synthetic oligonucleotide
gaaggacctcctggaacagaggcgg

SEQ ID NO: 408402 - DNA, 25 bp, Artificial Sequence
  Description of Artificial Sequence: Synthetic oligonucleotide
aaggacctcctggaacagaggcggg

SEQ ID NO: 408403 - DNA, 24 bp, Artificial Sequence
  Description of Artificial Sequence: Synthetic oligonucleotide
aggacctcctggaacagaggcggg

SEQ ID NO: 408404 - DNA, 23 bp, Artificial Sequence
  Description of Artificial Sequence: Synthetic oligonucleotide
ggacctcctggaacagaggcggg

SEQ ID NO: 408405 - DNA, 23 bp, Artificial Sequence
  Description of Artificial Sequence: Synthetic oligonucleotide
gacctcctggaacagaggcgggc

SEQ ID NO: 408406 - DNA, 23 bp, Artificial Sequence
  Description of Artificial Sequence: Synthetic oligonucleotide
acctcctggaacagaggcgggcc

SEQ ID NO: 408407 - DNA, 22 bp, Artificial Sequence
  Description of Artificial Sequence: Synthetic oligonucleotide
cctcctggaacagaggcgggcc

SEQ ID NO: 408408 - DNA, 22 bp, Artificial Sequence
  Description of Artificial Sequence: Synthetic oligonucleotide
ctcctggaacagaggcgggccg

SEQ ID NO: 408409 - DNA, 22 bp, Artificial Sequence
  Description of Artificial Sequence: Synthetic oligonucleotide
tcctggaacagaggcgggccgc

SEQ ID NO: 408410 - DNA, 21 bp, Artificial Sequence
  Description of Artificial Sequence: Synthetic oligonucleotide
cctggaacagaggcgggccgc

SEQ ID NO: 408411 - DNA, 21 bp, Artificial Sequence
  Description of Artificial Sequence: Synthetic oligonucleotide
ctggaacagaggcgggccgcg

SEQ ID NO: 408412 - DNA, 22 bp, Artificial Sequence
  Description of Artificial Sequence: Synthetic oligonucleotide
tggaacagaggcgggccgcggt

SEQ ID NO: 408413 - DNA, 21 bp, Artificial Sequence
  Description of Artificial Sequence: Synthetic oligonucleotide
ggaacagaggcgggccgcggt

SEQ ID NO: 408414 - DNA, 21 bp, Artificial Sequence
  Description of Artificial Sequence: Synthetic oligonucleotide
gaacagaggcgggccgcggtg

SEQ ID NO: 408415 - DNA, 22 bp, Artificial Sequence
  Description of Artificial Sequence: Synthetic oligonucleotide
aacagaggcgggccgcggtgga

SEQ ID NO: 408416 - DNA, 21 bp, Artificial Sequence
  Description of Artificial Sequence: Synthetic oligonucleotide
acagaggcgggccgcggtgga

SEQ ID NO: 408417 - DNA, 39 bp, Artificial Sequence
  Description of Artificial Sequence: Synthetic oligonucleotide
gcatccacagaatcacattttctagtgttgaaagacctg

SEQ ID NO: 408418 - DNA, 42 bp, Artificial Sequence
  Description of Artificial Sequence: Synthetic oligonucleotide
catccacagaatcacattttctagtgttgaaagacctgaaag

SEQ ID NO: 408419 - DNA, 44 bp, Artificial Sequence
  Description of Artificial Sequence: Synthetic oligonucleotide
atccacagaatcacattttctagtgttgaaagacctgaaagatc

SEQ ID NO: 408420 - DNA, 43 bp, Artificial Sequence
  Description of Artificial Sequence: Synthetic oligonucleotide
tccacagaatcacattttctagtgttgaaagacctgaaagatc

SEQ ID NO: 408421 - DNA, 42 bp, Artificial Sequence
  Description of Artificial Sequence: Synthetic oligonucleotide
ccacagaatcacattttctagtgttgaaagacctgaaagatc

SEQ ID NO: 408422 - DNA, 43 bp, Artificial Sequence
  Description of Artificial Sequence: Synthetic oligonucleotide
cacagaatcacattttctagtgttgaaagacctgaaagatcac

SEQ ID NO: 408423 - DNA, 43 bp, Artificial Sequence
  Description of Artificial Sequence: Synthetic oligonucleotide
acagaatcacattttctagtgttgaaagacctgaaagatcacg

SEQ ID NO: 408424 - DNA, 42 bp, Artificial Sequence
  Description of Artificial Sequence: Synthetic oligonucleotide
cagaatcacattttctagtgttgaaagacctgaaagatcacg

SEQ ID NO: 408425 - DNA, 42 bp, Artificial Sequence
  Description of Artificial Sequence: Synthetic oligonucleotide
agaatcacattttctagtgttgaaagacctgaaagatcacgg

SEQ ID NO: 408426 - DNA, 41 bp, Artificial Sequence
  Description of Artificial Sequence: Synthetic oligonucleotide
gaatcacattttctagtgttgaaagacctgaaagatcacgg

SEQ ID NO: 408427 - DNA, 42 bp, Artificial Sequence
  Description of Artificial Sequence: Synthetic oligonucleotide
aatcacattttctagtgttgaaagacctgaaagatcacggtg

SEQ ID NO: 408428 - DNA, 41 bp, Artificial Sequence
  Description of Artificial Sequence: Synthetic oligonucleotide
atcacattttctagtgttgaaagacctgaaagatcacggtg

SEQ ID NO: 408429 - DNA, 40 bp, Artificial Sequence
  Description of Artificial Sequence: Synthetic oligonucleotide
tcacattttctagtgttgaaagacctgaaagatcacggtg

SEQ ID NO: 408430 - DNA, 39 bp, Artificial Sequence
  Description of Artificial Sequence: Synthetic oligonucleotide
cacattttctagtgttgaaagacctgaaagatcacggtg

SEQ ID NO: 408431 - DNA, 39 bp, Artificial Sequence
  Description of Artificial Sequence: Synthetic oligonucleotide
acattttctagtgttgaaagacctgaaagatcacggtgc

SEQ ID NO: 408432 - DNA, 38 bp, Artificial Sequence
  Description of Artificial Sequence: Synthetic oligonucleotide
cattttctagtgttgaaagacctgaaagatcacggtgc

SEQ ID NO: 408433 - DNA, 38 bp, Artificial Sequence
  Description of Artificial Sequence: Synthetic oligonucleotide
attttctagtgttgaaagacctgaaagatcacggtgcc

SEQ ID NO: 408434 - DNA, 37 bp, Artificial Sequence
  Description of Artificial Sequence: Synthetic oligonucleotide
ttttctagtgttgaaagacctgaaagatcacggtgcc

SEQ ID NO: 408435 - DNA, 36 bp, Artificial Sequence
  Description of Artificial Sequence: Synthetic oligonucleotide
tttctagtgttgaaagacctgaaagatcacggtgcc

SEQ ID NO: 408436 - DNA, 35 bp, Artificial Sequence
  Description of Artificial Sequence: Synthetic oligonucleotide
ttctagtgttgaaagacctgaaagatcacggtgcc

SEQ ID NO: 408437 - DNA, 34 bp, Artificial Sequence
  Description of Artificial Sequence: Synthetic oligonucleotide
tctagtgttgaaagacctgaaagatcacggtgcc

SEQ ID NO: 408438 - DNA, 33 bp, Artificial Sequence
  Description of Artificial Sequence: Synthetic oligonucleotide
ctagtgttgaaagacctgaaagatcacggtgcc

SEQ ID NO: 408439 - DNA, 35 bp, Artificial Sequence
  Description of Artificial Sequence: Synthetic oligonucleotide
tagtgttgaaagacctgaaagatcacggtgccttc

SEQ ID NO: 408440 - DNA, 34 bp, Artificial Sequence
  Description of Artificial Sequence: Synthetic oligonucleotide
agtgttgaaagacctgaaagatcacggtgccttc

SEQ ID NO: 408441 - DNA, 33 bp, Artificial Sequence
  Description of Artificial Sequence: Synthetic oligonucleotide
gtgttgaaagacctgaaagatcacggtgccttc

SEQ ID NO: 408442 - DNA, 37 bp, Artificial Sequence
  Description of Artificial Sequence: Synthetic oligonucleotide
tgttgaaagacctgaaagatcacggtgccttcatttc

SEQ ID NO: 408443 - DNA, 36 bp, Artificial Sequence
  Description of Artificial Sequence: Synthetic oligonucleotide
gttgaaagacctgaaagatcacggtgccttcatttc

SEQ ID NO: 408444 - DNA, 38 bp, Artificial Sequence
  Description of Artificial Sequence: Synthetic oligonucleotide
ttgaaagacctgaaagatcacggtgccttcatttcaac

SEQ ID NO: 408445 - DNA, 37 bp, Artificial Sequence
  Description of Artificial Sequence: Synthetic oligonucleotide
tgaaagacctgaaagatcacggtgccttcatttcaac

SEQ ID NO: 408446 - DNA, 36 bp, Artificial Sequence
  Description of Artificial Sequence: Synthetic oligonucleotide
gaaagacctgaaagatcacggtgccttcatttcaac

SEQ ID NO: 408447 - DNA, 37 bp, Artificial Sequence
  Description of Artificial Sequence: Synthetic oligonucleotide
aaagacctgaaagatcacggtgccttcatttcaactg

SEQ ID NO: 408448 - DNA, 36 bp, Artificial Sequence
  Description of Artificial Sequence: Synthetic oligonucleotide
aagacctgaaagatcacggtgccttcatttcaactg

SEQ ID NO: 408449 - DNA, 35 bp, Artificial Sequence
  Description of Artificial Sequence: Synthetic oligonucleotide
agacctgaaagatcacggtgccttcatttcaactg

SEQ ID NO: 408450 - DNA, 34 bp, Artificial Sequence
  Description of Artificial Sequence: Synthetic oligonucleotide
gacctgaaagatcacggtgccttcatttcaactg

SEQ ID NO: 408451 - DNA, 35 bp, Artificial Sequence
  Description of Artificial Sequence: Synthetic oligonucleotide
acctgaaagatcacggtgccttcatttcaactgtg

SEQ ID NO: 408452 - DNA, 34 bp, Artificial Sequence
  Description of Artificial Sequence: Synthetic oligonucleotide
cctgaaagatcacggtgccttcatttcaactgtg

SEQ ID NO: 408453 - DNA, 35 bp, Artificial Sequence
  Description of Artificial Sequence: Synthetic oligonucleotide
ctgaaagatcacggtgccttcatttcaactgtgag

SEQ ID NO: 408454 - DNA, 36 bp, Artificial Sequence
  Description of Artificial Sequence: Synthetic oligonucleotide
tgaaagatcacggtgccttcatttcaactgtgagac

SEQ ID NO: 408455 - DNA, 35 bp, Artificial Sequence
  Description of Artificial Sequence: Synthetic oligonucleotide
gaaagatcacggtgccttcatttcaactgtgagac

SEQ ID NO: 408456 - DNA, 37 bp, Artificial Sequence
  Description of Artificial Sequence: Synthetic oligonucleotide
aaagatcacggtgccttcatttcaactgtgagacatg

SEQ ID NO: 408457 - DNA, 36 bp, Artificial Sequence
  Description of Artificial Sequence: Synthetic oligonucleotide
aagatcacggtgccttcatttcaactgtgagacatg

SEQ ID NO: 408458 - DNA, 35 bp, Artificial Sequence
  Description of Artificial Sequence: Synthetic oligonucleotide
agatcacggtgccttcatttcaactgtgagacatg

SEQ ID NO: 408459 - DNA, 34 bp, Artificial Sequence
  Description of Artificial Sequence: Synthetic oligonucleotide
gatcacggtgccttcatttcaactgtgagacatg

SEQ ID NO: 408460 - DNA, 36 bp, Artificial Sequence
  Description of Artificial Sequence: Synthetic oligonucleotide
atcacggtgccttcatttcaactgtgagacatgaag

SEQ ID NO: 408461 - DNA, 35 bp, Artificial Sequence
  Description of Artificial Sequence: Synthetic oligonucleotide
tcacggtgccttcatttcaactgtgagacatgaag

SEQ ID NO: 408462 - DNA, 34 bp, Artificial Sequence
  Description of Artificial Sequence: Synthetic oligonucleotide
cacggtgccttcatttcaactgtgagacatgaag

SEQ ID NO: 408463 - DNA, 41 bp, Artificial Sequence
  Description of Artificial Sequence: Synthetic oligonucleotide
acggtgccttcatttcaactgtgagacatgaagtaattttc

SEQ ID NO: 408464 - DNA, 40 bp, Artificial Sequence
  Description of Artificial Sequence: Synthetic oligonucleotide
cggtgccttcatttcaactgtgagacatgaagtaattttc

SEQ ID NO: 408465 - DNA, 40 bp, Artificial Sequence
  Description of Artificial Sequence: Synthetic oligonucleotide
ggtgccttcatttcaactgtgagacatgaagtaattttcc

SEQ ID NO: 408466 - DNA, 40 bp, Artificial Sequence
  Description of Artificial Sequence: Synthetic oligonucleotide
gtgccttcatttcaactgtgagacatgaagtaattttccc

SEQ ID NO: 408467 - DNA, 44 bp, Artificial Sequence
  Description of Artificial Sequence: Synthetic oligonucleotide
tgccttcatttcaactgtgagacatgaagtaattttcccaaatc

SEQ ID NO: 408468 - DNA, 43 bp, Artificial Sequence
  Description of Artificial Sequence: Synthetic oligonucleotide
gccttcatttcaactgtgagacatgaagtaattttcccaaatc

SEQ ID NO: 408469 - DNA, 45 bp, Artificial Sequence
  Description of Artificial Sequence: Synthetic oligonucleotide
ccttcatttcaactgtgagacatgaagtaattttcccaaatctac

SEQ ID NO: 408470 - DNA, 47 bp, Artificial Sequence
  Description of Artificial Sequence: Synthetic oligonucleotide
cttcatttcaactgtgagacatgaagtaattttcccaaatctacaac

SEQ ID NO: 408471 - DNA, 52 bp, Artificial Sequence
  Description of Artificial Sequence: Synthetic oligonucleotide
ttcatttcaactgtgagacatgaagtaattttcccaaatctacaacattaag

SEQ ID NO: 408472 - DNA, 51 bp, Artificial Sequence
  Description of Artificial Sequence: Synthetic oligonucleotide
tcatttcaactgtgagacatgaagtaattttcccaaatctacaacattaag

SEQ ID NO: 408473 - DNA, 50 bp, Artificial Sequence
  Description of Artificial Sequence: Synthetic oligonucleotide
catttcaactgtgagacatgaagtaattttcccaaatctacaacattaag

SEQ ID NO: 408474 - DNA, 54 bp, Artificial Sequence
  Description of Artificial Sequence: Synthetic oligonucleotide
atttcaactgtgagacatgaagtaattttcccaaatctacaacattaagatatg

SEQ ID NO: 408475 - DNA, 53 bp, Artificial Sequence
  Description of Artificial Sequence: Synthetic oligonucleotide
tttcaactgtgagacatgaagtaattttcccaaatctacaacattaagatatg

SEQ ID NO: 408476 - DNA, 52 bp, Artificial Sequence
  Description of Artificial Sequence: Synthetic oligonucleotide
ttcaactgtgagacatgaagtaattttcccaaatctacaacattaagatatg

SEQ ID NO: 408477 - DNA, 51 bp, Artificial Sequence
  Description of Artificial Sequence: Synthetic oligonucleotide
tcaactgtgagacatgaagtaattttcccaaatctacaacattaagatatg

SEQ ID NO: 408478 - DNA, 50 bp, Artificial Sequence
  Description of Artificial Sequence: Synthetic oligonucleotide
caactgtgagacatgaagtaattttcccaaatctacaacattaagatatg

SEQ ID NO: 408479 - DNA, 50 bp, Artificial Sequence
  Description of Artificial Sequence: Synthetic oligonucleotide
aactgtgagacatgaagtaattttcccaaatctacaacattaagatatgg

SEQ ID NO: 408480 - DNA, 49 bp, Artificial Sequence
  Description of Artificial Sequence: Synthetic oligonucleotide
actgtgagacatgaagtaattttcccaaatctacaacattaagatatgg

SEQ ID NO: 408481 - DNA, 48 bp, Artificial Sequence
  Description of Artificial Sequence: Synthetic oligonucleotide
ctgtgagacatgaagtaattttcccaaatctacaacattaagatatgg

SEQ ID NO: 408482 - DNA, 49 bp, Artificial Sequence
  Description of Artificial Sequence: Synthetic oligonucleotide
tgtgagacatgaagtaattttcccaaatctacaacattaagatatggtg

SEQ ID NO: 408483 - DNA, 48 bp, Artificial Sequence
  Description of Artificial Sequence: Synthetic oligonucleotide
gtgagacatgaagtaattttcccaaatctacaacattaagatatggtg

SEQ ID NO: 408484 - DNA, 48 bp, Artificial Sequence
  Description of Artificial Sequence: Synthetic oligonucleotide
tgagacatgaagtaattttcccaaatctacaacattaagatatggtgc

SEQ ID NO: 408485 - DNA, 47 bp, Artificial Sequence
  Description of Artificial Sequence: Synthetic oligonucleotide
gagacatgaagtaattttcccaaatctacaacattaagatatggtgc

SEQ ID NO: 408486 - DNA, 52 bp, Artificial Sequence
  Description of Artificial Sequence: Synthetic oligonucleotide
agacatgaagtaattttcccaaatctacaacattaagatatggtgcaataag

SEQ ID NO: 408487 - DNA, 51 bp, Artificial Sequence
  Description of Artificial Sequence: Synthetic oligonucleotide
gacatgaagtaattttcccaaatctacaacattaagatatggtgcaataag

SEQ ID NO: 408488 - DNA, 51 bp, Artificial Sequence
  Description of Artificial Sequence: Synthetic oligonucleotide
acatgaagtaattttcccaaatctacaacattaagatatggtgcaataagg

SEQ ID NO: 408489 - DNA, 50 bp, Artificial Sequence
  Description of Artificial Sequence: Synthetic oligonucleotide
catgaagtaattttcccaaatctacaacattaagatatggtgcaataagg

SEQ ID NO: 408490 - DNA, 51 bp, Artificial Sequence
  Description of Artificial Sequence: Synthetic oligonucleotide
atgaagtaattttcccaaatctacaacattaagatatggtgcaataaggac

SEQ ID NO: 408491 - DNA, 50 bp, Artificial Sequence
  Description of Artificial Sequence: Synthetic oligonucleotide
tgaagtaattttcccaaatctacaacattaagatatggtgcaataaggac

SEQ ID NO: 408492 - DNA, 49 bp, Artificial Sequence
  Description of Artificial Sequence: Synthetic oligonucleotide
gaagtaattttcccaaatctacaacattaagatatggtgcaataaggac

SEQ ID NO: 408493 - DNA, 49 bp, Artificial Sequence
  Description of Artificial Sequence: Synthetic oligonucleotide
aagtaattttcccaaatctacaacattaagatatggtgcaataaggacc

SEQ ID NO: 408494 - DNA, 48 bp, Artificial Sequence
  Description of Artificial Sequence: Synthetic oligonucleotide
agtaattttcccaaatctacaacattaagatatggtgcaataaggacc

SEQ ID NO: 408495 - DNA, 47 bp, Artificial Sequence
  Description of Artificial Sequence: Synthetic oligonucleotide
gtaattttcccaaatctacaacattaagatatggtgcaataaggacc

SEQ ID NO: 408496 - DNA, 48 bp, Artificial Sequence
  Description of Artificial Sequence: Synthetic oligonucleotide
taattttcccaaatctacaacattaagatatggtgcaataaggaccag

SEQ ID NO: 408497 - DNA, 47 bp, Artificial Sequence
  Description of Artificial Sequence: Synthetic oligonucleotide
aattttcccaaatctacaacattaagatatggtgcaataaggaccag

SEQ ID NO: 408498 - DNA, 46 bp, Artificial Sequence
  Description of Artificial Sequence: Synthetic oligonucleotide
attttcccaaatctacaacattaagatatggtgcaataaggaccag

SEQ ID NO: 408499 - DNA, 45 bp, Artificial Sequence
  Description of Artificial Sequence: Synthetic oligonucleotide
ttttcccaaatctacaacattaagatatggtgcaataaggaccag

SEQ ID NO: 408500 - DNA, 44 bp, Artificial Sequence
  Description of Artificial Sequence: Synthetic oligonucleotide
tttcccaaatctacaacattaagatatggtgcaataaggaccag

SEQ ID NO: 408501 - DNA, 43 bp, Artificial Sequence
  Description of Artificial Sequence: Synthetic oligonucleotide
ttcccaaatctacaacattaagatatggtgcaataaggaccag

SEQ ID NO: 408502 - DNA, 42 bp, Artificial Sequence
  Description of Artificial Sequence: Synthetic oligonucleotide
tcccaaatctacaacattaagatatggtgcaataaggaccag

SEQ ID NO: 408503 - DNA, 41 bp, Artificial Sequence
  Description of Artificial Sequence: Synthetic oligonucleotide
cccaaatctacaacattaagatatggtgcaataaggaccag

SEQ ID NO: 408504 - DNA, 47 bp, Artificial Sequence
  Description of Artificial Sequence: Synthetic oligonucleotide
ccaaatctacaacattaagatatggtgcaataaggaccagattaaag

SEQ ID NO: 408505 - DNA, 47 bp, Artificial Sequence
  Description of Artificial Sequence: Synthetic oligonucleotide
caaatctacaacattaagatatggtgcaataaggaccagattaaagg

SEQ ID NO: 408506 - DNA, 48 bp, Artificial Sequence
  Description of Artificial Sequence: Synthetic oligonucleotide
aaatctacaacattaagatatggtgcaataaggaccagattaaaggtc

SEQ ID NO: 408507 - DNA, 47 bp, Artificial Sequence
  Description of Artificial Sequence: Synthetic oligonucleotide
aatctacaacattaagatatggtgcaataaggaccagattaaaggtc

SEQ ID NO: 408508 - DNA, 46 bp, Artificial Sequence
  Description of Artificial Sequence: Synthetic oligonucleotide
atctacaacattaagatatggtgcaataaggaccagattaaaggtc

SEQ ID NO: 408509 - DNA, 45 bp, Artificial Sequence
  Description of Artificial Sequence: Synthetic oligonucleotide
tctacaacattaagatatggtgcaataaggaccagattaaaggtc

SEQ ID NO: 408510 - DNA, 44 bp, Artificial Sequence
  Description of Artificial Sequence: Synthetic oligonucleotide
ctacaacattaagatatggtgcaataaggaccagattaaaggtc

SEQ ID NO: 408511 - DNA, 45 bp, Artificial Sequence
  Description of Artificial Sequence: Synthetic oligonucleotide
tacaacattaagatatggtgcaataaggaccagattaaaggtctc

SEQ ID NO: 408512 - DNA, 44 bp, Artificial Sequence
  Description of Artificial Sequence: Synthetic oligonucleotide
acaacattaagatatggtgcaataaggaccagattaaaggtctc

SEQ ID NO: 408513 - DNA, 43 bp, Artificial Sequence
  Description of Artificial Sequence: Synthetic oligonucleotide
caacattaagatatggtgcaataaggaccagattaaaggtctc

SEQ ID NO: 408514 - DNA, 43 bp, Artificial Sequence
  Description of Artificial Sequence: Synthetic oligonucleotide
aacattaagatatggtgcaataaggaccagattaaaggtctcc

SEQ ID NO: 408515 - DNA, 42 bp, Artificial Sequence
  Description of Artificial Sequence: Synthetic oligonucleotide
acattaagatatggtgcaataaggaccagattaaaggtctcc

SEQ ID NO: 408516 - DNA, 41 bp, Artificial Sequence
  Description of Artificial Sequence: Synthetic oligonucleotide
cattaagatatggtgcaataaggaccagattaaaggtctcc

SEQ ID NO: 408517 - DNA, 42 bp, Artificial Sequence
  Description of Artificial Sequence: Synthetic oligonucleotide
attaagatatggtgcaataaggaccagattaaaggtctcctg

SEQ ID NO: 408518 - DNA, 41 bp, Artificial Sequence
  Description of Artificial Sequence: Synthetic oligonucleotide
ttaagatatggtgcaataaggaccagattaaaggtctcctg

SEQ ID NO: 408519 - DNA, 40 bp, Artificial Sequence
  Description of Artificial Sequence: Synthetic oligonucleotide
taagatatggtgcaataaggaccagattaaaggtctcctg

SEQ ID NO: 408520 - DNA, 39 bp, Artificial Sequence
  Description of Artificial Sequence: Synthetic oligonucleotide
aagatatggtgcaataaggaccagattaaaggtctcctg

SEQ ID NO: 408521 - DNA, 38 bp, Artificial Sequence
  Description of Artificial Sequence: Synthetic oligonucleotide
agatatggtgcaataaggaccagattaaaggtctcctg

SEQ ID NO: 408522 - DNA, 37 bp, Artificial Sequence
  Description of Artificial Sequence: Synthetic oligonucleotide
gatatggtgcaataaggaccagattaaaggtctcctg

SEQ ID NO: 408523 - DNA, 41 bp, Artificial Sequence
  Description of Artificial Sequence: Synthetic oligonucleotide
atatggtgcaataaggaccagattaaaggtctcctgatttg

SEQ ID NO: 408524 - DNA, 40 bp, Artificial Sequence
  Description of Artificial Sequence: Synthetic oligonucleotide
tatggtgcaataaggaccagattaaaggtctcctgatttg

SEQ ID NO: 408525 - DNA, 39 bp, Artificial Sequence
  Description of Artificial Sequence: Synthetic oligonucleotide
atggtgcaataaggaccagattaaaggtctcctgatttg

SEQ ID NO: 408526 - DNA, 38 bp, Artificial Sequence
  Description of Artificial Sequence: Synthetic oligonucleotide
tggtgcaataaggaccagattaaaggtctcctgatttg

SEQ ID NO: 408527 - DNA, 37 bp, Artificial Sequence
  Description of Artificial Sequence: Synthetic oligonucleotide
ggtgcaataaggaccagattaaaggtctcctgatttg

SEQ ID NO: 408528 - DNA, 37 bp, Artificial Sequence
  Description of Artificial Sequence: Synthetic oligonucleotide
gtgcaataaggaccagattaaaggtctcctgatttgc

SEQ ID NO: 408529 - DNA, 37 bp, Artificial Sequence
  Description of Artificial Sequence: Synthetic oligonucleotide
tgcaataaggaccagattaaaggtctcctgatttgcg

SEQ ID NO: 408530 - DNA, 36 bp, Artificial Sequence
  Description of Artificial Sequence: Synthetic oligonucleotide
gcaataaggaccagattaaaggtctcctgatttgcg

SEQ ID NO: 408531 - DNA, 36 bp, Artificial Sequence
  Description of Artificial Sequence: Synthetic oligonucleotide
caataaggaccagattaaaggtctcctgatttgcgg

SEQ ID NO: 408532 - DNA, 36 bp, Artificial Sequence
  Description of Artificial Sequence: Synthetic oligonucleotide
aataaggaccagattaaaggtctcctgatttgcggc

SEQ ID NO: 408533 - DNA, 35 bp, Artificial Sequence
  Description of Artificial Sequence: Synthetic oligonucleotide
ataaggaccagattaaaggtctcctgatttgcggc

SEQ ID NO: 408534 - DNA, 34 bp, Artificial Sequence
  Description of Artificial Sequence: Synthetic oligonucleotide
taaggaccagattaaaggtctcctgatttgcggc

SEQ ID NO: 408535 - DNA, 33 bp, Artificial Sequence
  Description of Artificial Sequence: Synthetic oligonucleotide
aaggaccagattaaaggtctcctgatttgcggc

SEQ ID NO: 408536 - DNA, 32 bp, Artificial Sequence
  Description of Artificial Sequence: Synthetic oligonucleotide
aggaccagattaaaggtctcctgatttgcggc

SEQ ID NO: 408537 - DNA, 31 bp, Artificial Sequence
  Description of Artificial Sequence: Synthetic oligonucleotide
ggaccagattaaaggtctcctgatttgcggc

SEQ ID NO: 408538 - DNA, 31 bp, Artificial Sequence
  Description of Artificial Sequence: Synthetic oligonucleotide
gaccagattaaaggtctcctgatttgcggcc

SEQ ID NO: 408539 - DNA, 33 bp, Artificial Sequence
  Description of Artificial Sequence: Synthetic oligonucleotide
accagattaaaggtctcctgatttgcggccatg

SEQ ID NO: 408540 - DNA, 32 bp, Artificial Sequence
  Description of Artificial Sequence: Synthetic oligonucleotide
ccagattaaaggtctcctgatttgcggccatg

SEQ ID NO: 408541 - DNA, 34 bp, Artificial Sequence
  Description of Artificial Sequence: Synthetic oligonucleotide
cagattaaaggtctcctgatttgcggccatgttc

SEQ ID NO: 408542 - DNA, 34 bp, Artificial Sequence
  Description of Artificial Sequence: Synthetic oligonucleotide
agattaaaggtctcctgatttgcggccatgttcc

SEQ ID NO: 408543 - DNA, 33 bp, Artificial Sequence
  Description of Artificial Sequence: Synthetic oligonucleotide
gattaaaggtctcctgatttgcggccatgttcc

SEQ ID NO: 408544 - DNA, 33 bp, Artificial Sequence
  Description of Artificial Sequence: Synthetic oligonucleotide
attaaaggtctcctgatttgcggccatgttccc

SEQ ID NO: 408545 - DNA, 32 bp, Artificial Sequence
  Description of Artificial Sequence: Synthetic oligonucleotide
ttaaaggtctcctgatttgcggccatgttccc

SEQ ID NO: 408546 - DNA, 31 bp, Artificial Sequence
  Description of Artificial Sequence: Synthetic oligonucleotide
taaaggtctcctgatttgcggccatgttccc

SEQ ID NO: 408547 - DNA, 30 bp, Artificial Sequence
  Description of Artificial Sequence: Synthetic oligonucleotide
aaaggtctcctgatttgcggccatgttccc

SEQ ID NO: 408548 - DNA, 29 bp, Artificial Sequence
  Description of Artificial Sequence: Synthetic oligonucleotide
aaggtctcctgatttgcggccatgttccc

SEQ ID NO: 408549 - DNA, 28 bp, Artificial Sequence
  Description of Artificial Sequence: Synthetic oligonucleotide
aggtctcctgatttgcggccatgttccc

SEQ ID NO: 408550 - DNA, 27 bp, Artificial Sequence
  Description of Artificial Sequence: Synthetic oligonucleotide
ggtctcctgatttgcggccatgttccc

SEQ ID NO: 408551 - DNA, 28 bp, Artificial Sequence
  Description of Artificial Sequence: Synthetic oligonucleotide
gtctcctgatttgcggccatgttccctc

SEQ ID NO: 408552 - DNA, 28 bp, Artificial Sequence
  Description of Artificial Sequence: Synthetic oligonucleotide
tctcctgatttgcggccatgttccctcc

SEQ ID NO: 408553 - DNA, 27 bp, Artificial Sequence
  Description of Artificial Sequence: Synthetic oligonucleotide
ctcctgatttgcggccatgttccctcc

SEQ ID NO: 408554 - DNA, 29 bp, Artificial Sequence
  Description of Artificial Sequence: Synthetic oligonucleotide
tcctgatttgcggccatgttccctccatc

SEQ ID NO: 408555 - DNA, 28 bp, Artificial Sequence
  Description of Artificial Sequence: Synthetic oligonucleotide
cctgatttgcggccatgttccctccatc

SEQ ID NO: 408556 - DNA, 29 bp, Artificial Sequence
  Description of Artificial Sequence: Synthetic oligonucleotide
ctgatttgcggccatgttccctccatctc

SEQ ID NO: 408557 - DNA, 29 bp, Artificial Sequence
  Description of Artificial Sequence: Synthetic oligonucleotide
tgatttgcggccatgttccctccatctcc

SEQ ID NO: 408558 - DNA, 28 bp, Artificial Sequence
  Description of Artificial Sequence: Synthetic oligonucleotide
gatttgcggccatgttccctccatctcc

SEQ ID NO: 408559 - DNA, 32 bp, Artificial Sequence
  Description of Artificial Sequence: Synthetic oligonucleotide
atttgcggccatgttccctccatctcctttac

SEQ ID NO: 408560 - DNA, 31 bp, Artificial Sequence
  Description of Artificial Sequence: Synthetic oligonucleotide
tttgcggccatgttccctccatctcctttac

SEQ ID NO: 408561 - DNA, 30 bp, Artificial Sequence
  Description of Artificial Sequence: Synthetic oligonucleotide
ttgcggccatgttccctccatctcctttac

SEQ ID NO: 408562 - DNA, 29 bp, Artificial Sequence
  Description of Artificial Sequence: Synthetic oligonucleotide
tgcggccatgttccctccatctcctttac

SEQ ID NO: 408563 - DNA, 28 bp, Artificial Sequence
  Description of Artificial Sequence: Synthetic oligonucleotide
gcggccatgttccctccatctcctttac

SEQ ID NO: 408564 - DNA, 29 bp, Artificial Sequence
  Description of Artificial Sequence: Synthetic oligonucleotide
cggccatgttccctccatctcctttactc

SEQ ID NO: 408565 - DNA, 29 bp, Artificial Sequence
  Description of Artificial Sequence: Synthetic oligonucleotide
ggccatgttccctccatctcctttactcc

SEQ ID NO: 408566 - DNA, 33 bp, Artificial Sequence
  Description of Artificial Sequence: Synthetic oligonucleotide
gccatgttccctccatctcctttactcctaaac

SEQ ID NO: 408567 - DNA, 34 bp, Artificial Sequence
  Description of Artificial Sequence: Synthetic oligonucleotide
ccatgttccctccatctcctttactcctaaacac

SEQ ID NO: 408568 - DNA, 35 bp, Artificial Sequence
  Description of Artificial Sequence: Synthetic oligonucleotide
catgttccctccatctcctttactcctaaacacac

SEQ ID NO: 408569 - DNA, 36 bp, Artificial Sequence
  Description of Artificial Sequence: Synthetic oligonucleotide
atgttccctccatctcctttactcctaaacacactc

SEQ ID NO: 408570 - DNA, 35 bp, Artificial Sequence
  Description of Artificial Sequence: Synthetic oligonucleotide
tgttccctccatctcctttactcctaaacacactc

SEQ ID NO: 408571 - DNA, 34 bp, Artificial Sequence
  Description of Artificial Sequence: Synthetic oligonucleotide
gttccctccatctcctttactcctaaacacactc

SEQ ID NO: 408572 - DNA, 35 bp, Artificial Sequence
  Description of Artificial Sequence: Synthetic oligonucleotide
ttccctccatctcctttactcctaaacacactcac

SEQ ID NO: 408573 - DNA, 34 bp, Artificial Sequence
  Description of Artificial Sequence: Synthetic oligonucleotide
tccctccatctcctttactcctaaacacactcac

SEQ ID NO: 408574 - DNA, 33 bp, Artificial Sequence
  Description of Artificial Sequence: Synthetic oligonucleotide
ccctccatctcctttactcctaaacacactcac

SEQ ID NO: 408575 - DNA, 34 bp, Artificial Sequence
  Description of Artificial Sequence: Synthetic oligonucleotide
cctccatctcctttactcctaaacacactcacac

SEQ ID NO: 408576 - DNA, 35 bp, Artificial Sequence
  Description of Artificial Sequence: Synthetic oligonucleotide
ctccatctcctttactcctaaacacactcacactc

SEQ ID NO: 408577 - DNA, 36 bp, Artificial Sequence
  Description of Artificial Sequence: Synthetic oligonucleotide
tccatctcctttactcctaaacacactcacactcac

SEQ ID NO: 408578 - DNA, 35 bp, Artificial Sequence
  Description of Artificial Sequence: Synthetic oligonucleotide
ccatctcctttactcctaaacacactcacactcac

SEQ ID NO: 408579 - DNA, 37 bp, Artificial Sequence
  Description of Artificial Sequence: Synthetic oligonucleotide
catctcctttactcctaaacacactcacactcactac

SEQ ID NO: 408580 - DNA, 38 bp, Artificial Sequence
  Description of Artificial Sequence: Synthetic oligonucleotide
atctcctttactcctaaacacactcacactcactactg

SEQ ID NO: 408581 - DNA, 37 bp, Artificial Sequence
  Description of Artificial Sequence: Synthetic oligonucleotide
tctcctttactcctaaacacactcacactcactactg

SEQ ID NO: 408582 - DNA, 36 bp, Artificial Sequence
  Description of Artificial Sequence: Synthetic oligonucleotide
ctcctttactcctaaacacactcacactcactactg

SEQ ID NO: 408583 - DNA, 36 bp, Artificial Sequence
  Description of Artificial Sequence: Synthetic oligonucleotide
tcctttactcctaaacacactcacactcactactgc

SEQ ID NO: 408584 - DNA, 35 bp, Artificial Sequence
  Description of Artificial Sequence: Synthetic oligonucleotide
cctttactcctaaacacactcacactcactactgc

SEQ ID NO: 408585 - DNA, 40 bp, Artificial Sequence
  Description of Artificial Sequence: Synthetic oligonucleotide
ctttactcctaaacacactcacactcactactgcaaatag

SEQ ID NO: 408586 - DNA, 42 bp, Artificial Sequence
  Description of Artificial Sequence: Synthetic oligonucleotide
tttactcctaaacacactcacactcactactgcaaatagttg

SEQ ID NO: 408587 - DNA, 41 bp, Artificial Sequence
  Description of Artificial Sequence: Synthetic oligonucleotide
ttactcctaaacacactcacactcactactgcaaatagttg

SEQ ID NO: 408588 - DNA, 40 bp, Artificial Sequence
  Description of Artificial Sequence: Synthetic oligonucleotide
tactcctaaacacactcacactcactactgcaaatagttg

SEQ ID NO: 408589 - DNA, 39 bp, Artificial Sequence
  Description of Artificial Sequence: Synthetic oligonucleotide
actcctaaacacactcacactcactactgcaaatagttg

SEQ ID NO: 408590 - DNA, 38 bp, Artificial Sequence
  Description of Artificial Sequence: Synthetic oligonucleotide
ctcctaaacacactcacactcactactgcaaatagttg

SEQ ID NO: 408591 - DNA, 39 bp, Artificial Sequence
  Description of Artificial Sequence: Synthetic oligonucleotide
tcctaaacacactcacactcactactgcaaatagttgtc

SEQ ID NO: 408592 - DNA, 38 bp, Artificial Sequence
  Description of Artificial Sequence: Synthetic oligonucleotide
cctaaacacactcacactcactactgcaaatagttgtc

SEQ ID NO: 408593 - DNA, 40 bp, Artificial Sequence
  Description of Artificial Sequence: Synthetic oligonucleotide
ctaaacacactcacactcactactgcaaatagttgtcttg

SEQ ID NO: 408594 - DNA, 41 bp, Artificial Sequence
  Description of Artificial Sequence: Synthetic oligonucleotide
taaacacactcacactcactactgcaaatagttgtcttgtc

SEQ ID NO: 408595 - DNA, 40 bp, Artificial Sequence
  Description of Artificial Sequence: Synthetic oligonucleotide
aaacacactcacactcactactgcaaatagttgtcttgtc

SEQ ID NO: 408596 - DNA, 39 bp, Artificial Sequence
  Description of Artificial Sequence: Synthetic oligonucleotide
aacacactcacactcactactgcaaatagttgtcttgtc

SEQ ID NO: 408597 - DNA, 38 bp, Artificial Sequence
  Description of Artificial Sequence: Synthetic oligonucleotide
acacactcacactcactactgcaaatagttgtcttgtc

SEQ ID NO: 408598 - DNA, 37 bp, Artificial Sequence
  Description of Artificial Sequence: Synthetic oligonucleotide
cacactcacactcactactgcaaatagttgtcttgtc

SEQ ID NO: 408599 - DNA, 39 bp, Artificial Sequence
  Description of Artificial Sequence: Synthetic oligonucleotide
acactcacactcactactgcaaatagttgtcttgtcaag

SEQ ID NO: 408600 - DNA, 38 bp, Artificial Sequence
  Description of Artificial Sequence: Synthetic oligonucleotide
cactcacactcactactgcaaatagttgtcttgtcaag

SEQ ID NO: 408601 - DNA, 39 bp, Artificial Sequence
  Description of Artificial Sequence: Synthetic oligonucleotide
actcacactcactactgcaaatagttgtcttgtcaagtg

SEQ ID NO: 408602 - DNA, 38 bp, Artificial Sequence
  Description of Artificial Sequence: Synthetic oligonucleotide
ctcacactcactactgcaaatagttgtcttgtcaagtg

SEQ ID NO: 408603 - DNA, 38 bp, Artificial Sequence
  Description of Artificial Sequence: Synthetic oligonucleotide
tcacactcactactgcaaatagttgtcttgtcaagtgg

SEQ ID NO: 408604 - DNA, 37 bp, Artificial Sequence
  Description of Artificial Sequence: Synthetic oligonucleotide
cacactcactactgcaaatagttgtcttgtcaagtgg

SEQ ID NO: 408605 - DNA, 37 bp, Artificial Sequence
  Description of Artificial Sequence: Synthetic oligonucleotide
acactcactactgcaaatagttgtcttgtcaagtggg

SEQ ID NO: 408606 - DNA, 36 bp, Artificial Sequence
  Description of Artificial Sequence: Synthetic oligonucleotide
cactcactactgcaaatagttgtcttgtcaagtggg

SEQ ID NO: 408607 - DNA, 40 bp, Artificial Sequence
  Description of Artificial Sequence: Synthetic oligonucleotide
actcactactgcaaatagttgtcttgtcaagtgggaaatg

SEQ ID NO: 408608 - DNA, 39 bp, Artificial Sequence
  Description of Artificial Sequence: Synthetic oligonucleotide
ctcactactgcaaatagttgtcttgtcaagtgggaaatg

SEQ ID NO: 408609 - DNA, 42 bp, Artificial Sequence
  Description of Artificial Sequence: Synthetic oligonucleotide
tcactactgcaaatagttgtcttgtcaagtgggaaatgaatg

SEQ ID NO: 408610 - DNA, 41 bp, Artificial Sequence
  Description of Artificial Sequence: Synthetic oligonucleotide
cactactgcaaatagttgtcttgtcaagtgggaaatgaatg

SEQ ID NO: 408611 - DNA, 41 bp, Artificial Sequence
  Description of Artificial Sequence: Synthetic oligonucleotide
actactgcaaatagttgtcttgtcaagtgggaaatgaatgc

SEQ ID NO: 408612 - DNA, 40 bp, Artificial Sequence
  Description of Artificial Sequence: Synthetic oligonucleotide
ctactgcaaatagttgtcttgtcaagtgggaaatgaatgc

SEQ ID NO: 408613 - DNA, 41 bp, Artificial Sequence
  Description of Artificial Sequence: Synthetic oligonucleotide
tactgcaaatagttgtcttgtcaagtgggaaatgaatgctc

SEQ ID NO: 408614 - DNA, 40 bp, Artificial Sequence
  Description of Artificial Sequence: Synthetic oligonucleotide
actgcaaatagttgtcttgtcaagtgggaaatgaatgctc

SEQ ID NO: 408615 - DNA, 39 bp, Artificial Sequence
  Description of Artificial Sequence: Synthetic oligonucleotide
ctgcaaatagttgtcttgtcaagtgggaaatgaatgctc

SEQ ID NO: 408616 - DNA, 42 bp, Artificial Sequence
  Description of Artificial Sequence: Synthetic oligonucleotide
tgcaaatagttgtcttgtcaagtgggaaatgaatgctcttac

SEQ ID NO: 408617 - DNA, 41 bp, Artificial Sequence
  Description of Artificial Sequence: Synthetic oligonucleotide
gcaaatagttgtcttgtcaagtgggaaatgaatgctcttac

SEQ ID NO: 408618 - DNA, 43 bp, Artificial Sequence
  Description of Artificial Sequence: Synthetic oligonucleotide
caaatagttgtcttgtcaagtgggaaatgaatgctcttacaag

SEQ ID NO: 408619 - DNA, 43 bp, Artificial Sequence
  Description of Artificial Sequence: Synthetic oligonucleotide
aaatagttgtcttgtcaagtgggaaatgaatgctcttacaagg

SEQ ID NO: 408620 - DNA, 42 bp, Artificial Sequence
  Description of Artificial Sequence: Synthetic oligonucleotide
aatagttgtcttgtcaagtgggaaatgaatgctcttacaagg

SEQ ID NO: 408621 - DNA, 41 bp, Artificial Sequence
  Description of Artificial Sequence: Synthetic oligonucleotide
atagttgtcttgtcaagtgggaaatgaatgctcttacaagg

SEQ ID NO: 408622 - DNA, 40 bp, Artificial Sequence
  Description of Artificial Sequence: Synthetic oligonucleotide
tagttgtcttgtcaagtgggaaatgaatgctcttacaagg

SEQ ID NO: 408623 - DNA, 39 bp, Artificial Sequence
  Description of Artificial Sequence: Synthetic oligonucleotide
agttgtcttgtcaagtgggaaatgaatgctcttacaagg

SEQ ID NO: 408624 - DNA, 38 bp, Artificial Sequence
  Description of Artificial Sequence: Synthetic oligonucleotide
gttgtcttgtcaagtgggaaatgaatgctcttacaagg

SEQ ID NO: 408625 - DNA, 38 bp, Artificial Sequence
  Description of Artificial Sequence: Synthetic oligonucleotide
ttgtcttgtcaagtgggaaatgaatgctcttacaaggc

SEQ ID NO: 408626 - DNA, 37 bp, Artificial Sequence
  Description of Artificial Sequence: Synthetic oligonucleotide
tgtcttgtcaagtgggaaatgaatgctcttacaaggc

SEQ ID NO: 408627 - DNA, 36 bp, Artificial Sequence
  Description of Artificial Sequence: Synthetic oligonucleotide
gtcttgtcaagtgggaaatgaatgctcttacaaggc

SEQ ID NO: 408628 - DNA, 37 bp, Artificial Sequence
  Description of Artificial Sequence: Synthetic oligonucleotide
tcttgtcaagtgggaaatgaatgctcttacaaggctc

SEQ ID NO: 408629 - DNA, 36 bp, Artificial Sequence
  Description of Artificial Sequence: Synthetic oligonucleotide
cttgtcaagtgggaaatgaatgctcttacaaggctc

SEQ ID NO: 408630 - DNA, 39 bp, Artificial Sequence
  Description of Artificial Sequence: Synthetic oligonucleotide
ttgtcaagtgggaaatgaatgctcttacaaggctcaaac

SEQ ID NO: 408631 - DNA, 38 bp, Artificial Sequence
  Description of Artificial Sequence: Synthetic oligonucleotide
tgtcaagtgggaaatgaatgctcttacaaggctcaaac

SEQ ID NO: 408632 - DNA, 37 bp, Artificial Sequence
  Description of Artificial Sequence: Synthetic oligonucleotide
gtcaagtgggaaatgaatgctcttacaaggctcaaac

SEQ ID NO: 408633 - DNA, 39 bp, Artificial Sequence
  Description of Artificial Sequence: Synthetic oligonucleotide
tcaagtgggaaatgaatgctcttacaaggctcaaacttg

SEQ ID NO: 408634 - DNA, 38 bp, Artificial Sequence
  Description of Artificial Sequence: Synthetic oligonucleotide
caagtgggaaatgaatgctcttacaaggctcaaacttg

SEQ ID NO: 408635 - DNA, 39 bp, Artificial Sequence
  Description of Artificial Sequence: Synthetic oligonucleotide
aagtgggaaatgaatgctcttacaaggctcaaacttgtg

SEQ ID NO: 408636 - DNA, 38 bp, Artificial Sequence
  Description of Artificial Sequence: Synthetic oligonucleotide
agtgggaaatgaatgctcttacaaggctcaaacttgtg

SEQ ID NO: 408637 - DNA, 37 bp, Artificial Sequence
  Description of Artificial Sequence: Synthetic oligonucleotide
gtgggaaatgaatgctcttacaaggctcaaacttgtg

SEQ ID NO: 408638 - DNA, 39 bp, Artificial Sequence
  Description of Artificial Sequence: Synthetic oligonucleotide
tgggaaatgaatgctcttacaaggctcaaacttgtgaac

SEQ ID NO: 408639 - DNA, 38 bp, Artificial Sequence
  Description of Artificial Sequence: Synthetic oligonucleotide
gggaaatgaatgctcttacaaggctcaaacttgtgaac

SEQ ID NO: 408640 - DNA, 39 bp, Artificial Sequence
  Description of Artificial Sequence: Synthetic oligonucleotide
ggaaatgaatgctcttacaaggctcaaacttgtgaacac

SEQ ID NO: 408641 - DNA, 41 bp, Artificial Sequence
  Description of Artificial Sequence: Synthetic oligonucleotide
gaaatgaatgctcttacaaggctcaaacttgtgaacacatc

SEQ ID NO: 408642 - DNA, 42 bp, Artificial Sequence
  Description of Artificial Sequence: Synthetic oligonucleotide
aaatgaatgctcttacaaggctcaaacttgtgaacacatcac

SEQ ID NO: 408643 - DNA, 41 bp, Artificial Sequence
  Description of Artificial Sequence: Synthetic oligonucleotide
aatgaatgctcttacaaggctcaaacttgtgaacacatcac

SEQ ID NO: 408644 - DNA, 40 bp, Artificial Sequence
  Description of Artificial Sequence: Synthetic oligonucleotide
atgaatgctcttacaaggctcaaacttgtgaacacatcac

SEQ ID NO: 408645 - DNA, 39 bp, Artificial Sequence
  Description of Artificial Sequence: Synthetic oligonucleotide
tgaatgctcttacaaggctcaaacttgtgaacacatcac

SEQ ID NO: 408646 - DNA, 38 bp, Artificial Sequence
  Description of Artificial Sequence: Synthetic oligonucleotide
gaatgctcttacaaggctcaaacttgtgaacacatcac

SEQ ID NO: 408647 - DNA, 39 bp, Artificial Sequence
  Description of Artificial Sequence: Synthetic oligonucleotide
aatgctcttacaaggctcaaacttgtgaacacatcactg

SEQ ID NO: 408648 - DNA, 38 bp, Artificial Sequence
  Description of Artificial Sequence: Synthetic oligonucleotide
atgctcttacaaggctcaaacttgtgaacacatcactg

SEQ ID NO: 408649 - DNA, 37 bp, Artificial Sequence
  Description of Artificial Sequence: Synthetic oligonucleotide
tgctcttacaaggctcaaacttgtgaacacatcactg

SEQ ID NO: 408650 - DNA, 36 bp, Artificial Sequence
  Description of Artificial Sequence: Synthetic oligonucleotide
gctcttacaaggctcaaacttgtgaacacatcactg

SEQ ID NO: 408651 - DNA, 37 bp, Artificial Sequence
  Description of Artificial Sequence: Synthetic oligonucleotide
ctcttacaaggctcaaacttgtgaacacatcactgac

SEQ ID NO: 408652 - DNA, 37 bp, Artificial Sequence
  Description of Artificial Sequence: Synthetic oligonucleotide
tcttacaaggctcaaacttgtgaacacatcactgacc

SEQ ID NO: 408653 - DNA, 36 bp, Artificial Sequence
  Description of Artificial Sequence: Synthetic oligonucleotide
cttacaaggctcaaacttgtgaacacatcactgacc

SEQ ID NO: 408654 - DNA, 37 bp, Artificial Sequence
  Description of Artificial Sequence: Synthetic oligonucleotide
ttacaaggctcaaacttgtgaacacatcactgaccag

SEQ ID NO: 408655 - DNA, 36 bp, Artificial Sequence
  Description of Artificial Sequence: Synthetic oligonucleotide
tacaaggctcaaacttgtgaacacatcactgaccag

SEQ ID NO: 408656 - DNA, 35 bp, Artificial Sequence
  Description of Artificial Sequence: Synthetic oligonucleotide
acaaggctcaaacttgtgaacacatcactgaccag

SEQ ID NO: 408657 - DNA, 34 bp, Artificial Sequence
  Description of Artificial Sequence: Synthetic oligonucleotide
caaggctcaaacttgtgaacacatcactgaccag

SEQ ID NO: 408658 - DNA, 34 bp, Artificial Sequence
  Description of Artificial Sequence: Synthetic oligonucleotide
aaggctcaaacttgtgaacacatcactgaccagc

SEQ ID NO: 408659 - DNA, 33 bp, Artificial Sequence
  Description of Artificial Sequence: Synthetic oligonucleotide
aggctcaaacttgtgaacacatcactgaccagc

SEQ ID NO: 408660 - DNA, 32 bp, Artificial Sequence
  Description of Artificial Sequence: Synthetic oligonucleotide
ggctcaaacttgtgaacacatcactgaccagc

SEQ ID NO: 408661 - DNA, 33 bp, Artificial Sequence
  Description of Artificial Sequence: Synthetic oligonucleotide
gctcaaacttgtgaacacatcactgaccagcac

SEQ ID NO: 408662 - DNA, 34 bp, Artificial Sequence
  Description of Artificial Sequence: Synthetic oligonucleotide
ctcaaacttgtgaacacatcactgaccagcacag

SEQ ID NO: 408663 - DNA, 35 bp, Artificial Sequence
  Description of Artificial Sequence: Synthetic oligonucleotide
tcaaacttgtgaacacatcactgaccagcacagag

SEQ ID NO: 408664 - DNA, 34 bp, Artificial Sequence
  Description of Artificial Sequence: Synthetic oligonucleotide
caaacttgtgaacacatcactgaccagcacagag

SEQ ID NO: 408665 - DNA, 34 bp, Artificial Sequence
  Description of Artificial Sequence: Synthetic oligonucleotide
aaacttgtgaacacatcactgaccagcacagagc

SEQ ID NO: 408666 - DNA, 33 bp, Artificial Sequence
  Description of Artificial Sequence: Synthetic oligonucleotide
aacttgtgaacacatcactgaccagcacagagc

SEQ ID NO: 408667 - DNA, 32 bp, Artificial Sequence
  Description of Artificial Sequence: Synthetic oligonucleotide
acttgtgaacacatcactgaccagcacagagc

SEQ ID NO: 408668 - DNA, 31 bp, Artificial Sequence
  Description of Artificial Sequence: Synthetic oligonucleotide
cttgtgaacacatcactgaccagcacagagc

SEQ ID NO: 408669 - DNA, 32 bp, Artificial Sequence
  Description of Artificial Sequence: Synthetic oligonucleotide
ttgtgaacacatcactgaccagcacagagctg

SEQ ID NO: 408670 - DNA, 31 bp, Artificial Sequence
  Description of Artificial Sequence: Synthetic oligonucleotide
tgtgaacacatcactgaccagcacagagctg

SEQ ID NO: 408671 - DNA, 30 bp, Artificial Sequence
  Description of Artificial Sequence: Synthetic oligonucleotide
gtgaacacatcactgaccagcacagagctg

SEQ ID NO: 408672 - DNA, 30 bp, Artificial Sequence
  Description of Artificial Sequence: Synthetic oligonucleotide
tgaacacatcactgaccagcacagagctgg

SEQ ID NO: 408673 - DNA, 29 bp, Artificial Sequence
  Description of Artificial Sequence: Synthetic oligonucleotide
gaacacatcactgaccagcacagagctgg

SEQ ID NO: 408674 - DNA, 29 bp, Artificial Sequence
  Description of Artificial Sequence: Synthetic oligonucleotide
aacacatcactgaccagcacagagctggc

SEQ ID NO: 408675 - DNA, 28 bp, Artificial Sequence
  Description of Artificial Sequence: Synthetic oligonucleotide
acacatcactgaccagcacagagctggc

SEQ ID NO: 408676 - DNA, 27 bp, Artificial Sequence
  Description of Artificial Sequence: Synthetic oligonucleotide
cacatcactgaccagcacagagctggc

SEQ ID NO: 408677 - DNA, 29 bp, Artificial Sequence
  Description of Artificial Sequence: Synthetic oligonucleotide
acatcactgaccagcacagagctggctac

SEQ ID NO: 408678 - DNA, 28 bp, Artificial Sequence
  Description of Artificial Sequence: Synthetic oligonucleotide
catcactgaccagcacagagctggctac

SEQ ID NO: 408679 - DNA, 32 bp, Artificial Sequence
  Description of Artificial Sequence: Synthetic oligonucleotide
atcactgaccagcacagagctggctacaatag

SEQ ID NO: 408680 - DNA, 31 bp, Artificial Sequence
  Description of Artificial Sequence: Synthetic oligonucleotide
tcactgaccagcacagagctggctacaatag

SEQ ID NO: 408681 - DNA, 30 bp, Artificial Sequence
  Description of Artificial Sequence: Synthetic oligonucleotide
cactgaccagcacagagctggctacaatag

SEQ ID NO: 408682 - DNA, 30 bp, Artificial Sequence
  Description of Artificial Sequence: Synthetic oligonucleotide
actgaccagcacagagctggctacaatagc

SEQ ID NO: 408683 - DNA, 29 bp, Artificial Sequence
  Description of Artificial Sequence: Synthetic oligonucleotide
ctgaccagcacagagctggctacaatagc

SEQ ID NO: 408684 - DNA, 30 bp, Artificial Sequence
  Description of Artificial Sequence: Synthetic oligonucleotide
tgaccagcacagagctggctacaatagctc

SEQ ID NO: 408685 - DNA, 29 bp, Artificial Sequence
  Description of Artificial Sequence: Synthetic oligonucleotide
gaccagcacagagctggctacaatagctc

SEQ ID NO: 408686 - DNA, 29 bp, Artificial Sequence
  Description of Artificial Sequence: Synthetic oligonucleotide
accagcacagagctggctacaatagctcc

SEQ ID NO: 408687 - DNA, 28 bp, Artificial Sequence
  Description of Artificial Sequence: Synthetic oligonucleotide
ccagcacagagctggctacaatagctcc

SEQ ID NO: 408688 - DNA, 28 bp, Artificial Sequence
  Description of Artificial Sequence: Synthetic oligonucleotide
cagcacagagctggctacaatagctccc

SEQ ID NO: 408689 - DNA, 28 bp, Artificial Sequence
  Description of Artificial Sequence: Synthetic oligonucleotide
agcacagagctggctacaatagctcccc

SEQ ID NO: 408690 - DNA, 27 bp, Artificial Sequence
  Description of Artificial Sequence: Synthetic oligonucleotide
gcacagagctggctacaatagctcccc

SEQ ID NO: 408691 - DNA, 33 bp, Artificial Sequence
  Description of Artificial Sequence: Synthetic oligonucleotide
cacagagctggctacaatagctccccaattaag

SEQ ID NO: 408692 - DNA, 33 bp, Artificial Sequence
  Description of Artificial Sequence: Synthetic oligonucleotide
acagagctggctacaatagctccccaattaagg

SEQ ID NO: 408693 - DNA, 32 bp, Artificial Sequence
  Description of Artificial Sequence: Synthetic oligonucleotide
cagagctggctacaatagctccccaattaagg

SEQ ID NO: 408694 - DNA, 33 bp, Artificial Sequence
  Description of Artificial Sequence: Synthetic oligonucleotide
agagctggctacaatagctccccaattaaggtg

SEQ ID NO: 408695 - DNA, 32 bp, Artificial Sequence
  Description of Artificial Sequence: Synthetic oligonucleotide
gagctggctacaatagctccccaattaaggtg

SEQ ID NO: 408696 - DNA, 37 bp, Artificial Sequence
  Description of Artificial Sequence: Synthetic oligonucleotide
agctggctacaatagctccccaattaaggtgttttac

SEQ ID NO: 408697 - DNA, 36 bp, Artificial Sequence
  Description of Artificial Sequence: Synthetic oligonucleotide
gctggctacaatagctccccaattaaggtgttttac

SEQ ID NO: 408698 - DNA, 38 bp, Artificial Sequence
  Description of Artificial Sequence: Synthetic oligonucleotide
ctggctacaatagctccccaattaaggtgttttacatg

SEQ ID NO: 408699 - DNA, 38 bp, Artificial Sequence
  Description of Artificial Sequence: Synthetic oligonucleotide
tggctacaatagctccccaattaaggtgttttacatgc

SEQ ID NO: 408700 - DNA, 37 bp, Artificial Sequence
  Description of Artificial Sequence: Synthetic oligonucleotide
ggctacaatagctccccaattaaggtgttttacatgc

SEQ ID NO: 408701 - DNA, 39 bp, Artificial Sequence
  Description of Artificial Sequence: Synthetic oligonucleotide
gctacaatagctccccaattaaggtgttttacatgcaac

SEQ ID NO: 408702 - DNA, 40 bp, Artificial Sequence
  Description of Artificial Sequence: Synthetic oligonucleotide
ctacaatagctccccaattaaggtgttttacatgcaactg

SEQ ID NO: 408703 - DNA, 40 bp, Artificial Sequence
  Description of Artificial Sequence: Synthetic oligonucleotide
tacaatagctccccaattaaggtgttttacatgcaactgg

SEQ ID NO: 408704 - DNA, 39 bp, Artificial Sequence
  Description of Artificial Sequence: Synthetic oligonucleotide
acaatagctccccaattaaggtgttttacatgcaactgg

SEQ ID NO: 408705 - DNA, 38 bp, Artificial Sequence
  Description of Artificial Sequence: Synthetic oligonucleotide
caatagctccccaattaaggtgttttacatgcaactgg

SEQ ID NO: 408706 - DNA, 40 bp, Artificial Sequence
  Description of Artificial Sequence: Synthetic oligonucleotide
aatagctccccaattaaggtgttttacatgcaactggttc

SEQ ID NO: 408707 - DNA, 39 bp, Artificial Sequence
  Description of Artificial Sequence: Synthetic oligonucleotide
atagctccccaattaaggtgttttacatgcaactggttc

SEQ ID NO: 408708 - DNA, 38 bp, Artificial Sequence
  Description of Artificial Sequence: Synthetic oligonucleotide
tagctccccaattaaggtgttttacatgcaactggttc

SEQ ID NO: 408709 - DNA, 37 bp, Artificial Sequence
  Description of Artificial Sequence: Synthetic oligonucleotide
agctccccaattaaggtgttttacatgcaactggttc

SEQ ID NO: 408710 - DNA, 36 bp, Artificial Sequence
  Description of Artificial Sequence: Synthetic oligonucleotide
gctccccaattaaggtgttttacatgcaactggttc

SEQ ID NO: 408711 - DNA, 39 bp, Artificial Sequence
  Description of Artificial Sequence: Synthetic oligonucleotide
ctccccaattaaggtgttttacatgcaactggttcaaac

SEQ ID NO: 408712 - DNA, 39 bp, Artificial Sequence
  Description of Artificial Sequence: Synthetic oligonucleotide
tccccaattaaggtgttttacatgcaactggttcaaacc

SEQ ID NO: 408713 - DNA, 38 bp, Artificial Sequence
  Description of Artificial Sequence: Synthetic oligonucleotide
ccccaattaaggtgttttacatgcaactggttcaaacc

SEQ ID NO: 408714 - DNA, 40 bp, Artificial Sequence
  Description of Artificial Sequence: Synthetic oligonucleotide
cccaattaaggtgttttacatgcaactggttcaaaccttc

SEQ ID NO: 408715 - DNA, 40 bp, Artificial Sequence
  Description of Artificial Sequence: Synthetic oligonucleotide
ccaattaaggtgttttacatgcaactggttcaaaccttcc

SEQ ID NO: 408716 - DNA, 42 bp, Artificial Sequence
  Description of Artificial Sequence: Synthetic oligonucleotide
caattaaggtgttttacatgcaactggttcaaaccttccaag

SEQ ID NO: 408717 - DNA, 43 bp, Artificial Sequence
  Description of Artificial Sequence: Synthetic oligonucleotide
aattaaggtgttttacatgcaactggttcaaaccttccaagtg

SEQ ID NO: 408718 - DNA, 42 bp, Artificial Sequence
  Description of Artificial Sequence: Synthetic oligonucleotide
attaaggtgttttacatgcaactggttcaaaccttccaagtg

SEQ ID NO: 408719 - DNA, 41 bp, Artificial Sequence
  Description of Artificial Sequence: Synthetic oligonucleotide
ttaaggtgttttacatgcaactggttcaaaccttccaagtg

SEQ ID NO: 408720 - DNA, 40 bp, Artificial Sequence
  Description of Artificial Sequence: Synthetic oligonucleotide
taaggtgttttacatgcaactggttcaaaccttccaagtg

SEQ ID NO: 408721 - DNA, 39 bp, Artificial Sequence
  Description of Artificial Sequence: Synthetic oligonucleotide
aaggtgttttacatgcaactggttcaaaccttccaagtg

SEQ ID NO: 408722 - DNA, 38 bp, Artificial Sequence
  Description of Artificial Sequence: Synthetic oligonucleotide
aggtgttttacatgcaactggttcaaaccttccaagtg

SEQ ID NO: 408723 - DNA, 37 bp, Artificial Sequence
  Description of Artificial Sequence: Synthetic oligonucleotide
ggtgttttacatgcaactggttcaaaccttccaagtg

SEQ ID NO: 408724 - DNA, 37 bp, Artificial Sequence
  Description of Artificial Sequence: Synthetic oligonucleotide
gtgttttacatgcaactggttcaaaccttccaagtgc

SEQ ID NO: 408725 - DNA, 47 bp, Artificial Sequence
  Description of Artificial Sequence: Synthetic oligonucleotide
tgttttacatgcaactggttcaaaccttccaagtgctaaattaaaac

SEQ ID NO: 408726 - DNA, 46 bp, Artificial Sequence
  Description of Artificial Sequence: Synthetic oligonucleotide
gttttacatgcaactggttcaaaccttccaagtgctaaattaaaac

SEQ ID NO: 408727 - DNA, 49 bp, Artificial Sequence
  Description of Artificial Sequence: Synthetic oligonucleotide
ttttacatgcaactggttcaaaccttccaagtgctaaattaaaacaatc

SEQ ID NO: 408728 - DNA, 48 bp, Artificial Sequence
  Description of Artificial Sequence: Synthetic oligonucleotide
tttacatgcaactggttcaaaccttccaagtgctaaattaaaacaatc

SEQ ID NO: 408729 - DNA, 47 bp, Artificial Sequence
  Description of Artificial Sequence: Synthetic oligonucleotide
ttacatgcaactggttcaaaccttccaagtgctaaattaaaacaatc

SEQ ID NO: 408730 - DNA, 46 bp, Artificial Sequence
  Description of Artificial Sequence: Synthetic oligonucleotide
tacatgcaactggttcaaaccttccaagtgctaaattaaaacaatc

SEQ ID NO: 408731 - DNA, 45 bp, Artificial Sequence
  Description of Artificial Sequence: Synthetic oligonucleotide
acatgcaactggttcaaaccttccaagtgctaaattaaaacaatc

SEQ ID NO: 408732 - DNA, 44 bp, Artificial Sequence
  Description of Artificial Sequence: Synthetic oligonucleotide
catgcaactggttcaaaccttccaagtgctaaattaaaacaatc

SEQ ID NO: 408733 - DNA, 44 bp, Artificial Sequence
  Description of Artificial Sequence: Synthetic oligonucleotide
atgcaactggttcaaaccttccaagtgctaaattaaaacaatcc

SEQ ID NO: 408734 - DNA, 43 bp, Artificial Sequence
  Description of Artificial Sequence: Synthetic oligonucleotide
tgcaactggttcaaaccttccaagtgctaaattaaaacaatcc

SEQ ID NO: 408735 - DNA, 42 bp, Artificial Sequence
  Description of Artificial Sequence: Synthetic oligonucleotide
gcaactggttcaaaccttccaagtgctaaattaaaacaatcc

SEQ ID NO: 408736 - DNA, 48 bp, Artificial Sequence
  Description of Artificial Sequence: Synthetic oligonucleotide
caactggttcaaaccttccaagtgctaaattaaaacaatcctttaaag

SEQ ID NO: 408737 - DNA, 50 bp, Artificial Sequence
  Description of Artificial Sequence: Synthetic oligonucleotide
aactggttcaaaccttccaagtgctaaattaaaacaatcctttaaagaag

SEQ ID NO: 408738 - DNA, 49 bp, Artificial Sequence
  Description of Artificial Sequence: Synthetic oligonucleotide
actggttcaaaccttccaagtgctaaattaaaacaatcctttaaagaag

SEQ ID NO: 408739 - DNA, 48 bp, Artificial Sequence
  Description of Artificial Sequence: Synthetic oligonucleotide
ctggttcaaaccttccaagtgctaaattaaaacaatcctttaaagaag

SEQ ID NO: 408740 - DNA, 48 bp, Artificial Sequence
  Description of Artificial Sequence: Synthetic oligonucleotide
tggttcaaaccttccaagtgctaaattaaaacaatcctttaaagaagg

SEQ ID NO: 408741 - DNA, 47 bp, Artificial Sequence
  Description of Artificial Sequence: Synthetic oligonucleotide
ggttcaaaccttccaagtgctaaattaaaacaatcctttaaagaagg

SEQ ID NO: 408742 - DNA, 52 bp, Artificial Sequence
  Description of Artificial Sequence: Synthetic oligonucleotide
gttcaaaccttccaagtgctaaattaaaacaatcctttaaagaaggaaattc

SEQ ID NO: 408743 - DNA, 53 bp, Artificial Sequence
  Description of Artificial Sequence: Synthetic oligonucleotide
ttcaaaccttccaagtgctaaattaaaacaatcctttaaagaaggaaattctg

SEQ ID NO: 408744 - DNA, 52 bp, Artificial Sequence
  Description of Artificial Sequence: Synthetic oligonucleotide
tcaaaccttccaagtgctaaattaaaacaatcctttaaagaaggaaattctg

SEQ ID NO: 408745 - DNA, 51 bp, Artificial Sequence
  Description of Artificial Sequence: Synthetic oligonucleotide
caaaccttccaagtgctaaattaaaacaatcctttaaagaaggaaattctg

SEQ ID NO: 408746 - DNA, 54 bp, Artificial Sequence
  Description of Artificial Sequence: Synthetic oligonucleotide
aaaccttccaagtgctaaattaaaacaatcctttaaagaaggaaattctgtttc

SEQ ID NO: 408747 - DNA, 53 bp, Artificial Sequence
  Description of Artificial Sequence: Synthetic oligonucleotide
aaccttccaagtgctaaattaaaacaatcctttaaagaaggaaattctgtttc

SEQ ID NO: 408748 - DNA, 52 bp, Artificial Sequence
  Description of Artificial Sequence: Synthetic oligonucleotide
accttccaagtgctaaattaaaacaatcctttaaagaaggaaattctgtttc

SEQ ID NO: 408749 - DNA, 51 bp, Artificial Sequence
  Description of Artificial Sequence: Synthetic oligonucleotide
ccttccaagtgctaaattaaaacaatcctttaaagaaggaaattctgtttc

SEQ ID NO: 408750 - DNA, 52 bp, Artificial Sequence
  Description of Artificial Sequence: Synthetic oligonucleotide
cttccaagtgctaaattaaaacaatcctttaaagaaggaaattctgtttcag

SEQ ID NO: 408751 - DNA, 54 bp, Artificial Sequence
  Description of Artificial Sequence: Synthetic oligonucleotide
ttccaagtgctaaattaaaacaatcctttaaagaaggaaattctgtttcagaag

SEQ ID NO: 408752 - DNA, 53 bp, Artificial Sequence
  Description of Artificial Sequence: Synthetic oligonucleotide
tccaagtgctaaattaaaacaatcctttaaagaaggaaattctgtttcagaag

SEQ ID NO: 408753 - DNA, 52 bp, Artificial Sequence
  Description of Artificial Sequence: Synthetic oligonucleotide
ccaagtgctaaattaaaacaatcctttaaagaaggaaattctgtttcagaag

SEQ ID NO: 408754 - DNA, 53 bp, Artificial Sequence
  Description of Artificial Sequence: Synthetic oligonucleotide
caagtgctaaattaaaacaatcctttaaagaaggaaattctgtttcagaagag

SEQ ID NO: 408755 - DNA, 53 bp, Artificial Sequence
  Description of Artificial Sequence: Synthetic oligonucleotide
aagtgctaaattaaaacaatcctttaaagaaggaaattctgtttcagaagagg

SEQ ID NO: 408756 - DNA, 52 bp, Artificial Sequence
  Description of Artificial Sequence: Synthetic oligonucleotide
agtgctaaattaaaacaatcctttaaagaaggaaattctgtttcagaagagg

SEQ ID NO: 408757 - DNA, 51 bp, Artificial Sequence
  Description of Artificial Sequence: Synthetic oligonucleotide
gtgctaaattaaaacaatcctttaaagaaggaaattctgtttcagaagagg

SEQ ID NO: 408758 - DNA, 52 bp, Artificial Sequence
  Description of Artificial Sequence: Synthetic oligonucleotide
tgctaaattaaaacaatcctttaaagaaggaaattctgtttcagaagaggac

SEQ ID NO: 408759 - DNA, 51 bp, Artificial Sequence
  Description of Artificial Sequence: Synthetic oligonucleotide
gctaaattaaaacaatcctttaaagaaggaaattctgtttcagaagaggac

SEQ ID NO: 408760 - DNA, 51 bp, Artificial Sequence
  Description of Artificial Sequence: Synthetic oligonucleotide
ctaaattaaaacaatcctttaaagaaggaaattctgtttcagaagaggacc

SEQ ID NO: 408761 - DNA, 53 bp, Artificial Sequence
  Description of Artificial Sequence: Synthetic oligonucleotide
taaattaaaacaatcctttaaagaaggaaattctgtttcagaagaggaccttc

SEQ ID NO: 408762 - DNA, 52 bp, Artificial Sequence
  Description of Artificial Sequence: Synthetic oligonucleotide
aaattaaaacaatcctttaaagaaggaaattctgtttcagaagaggaccttc

SEQ ID NO: 408763 - DNA, 51 bp, Artificial Sequence
  Description of Artificial Sequence: Synthetic oligonucleotide
aattaaaacaatcctttaaagaaggaaattctgtttcagaagaggaccttc

SEQ ID NO: 408764 - DNA, 50 bp, Artificial Sequence
  Description of Artificial Sequence: Synthetic oligonucleotide
attaaaacaatcctttaaagaaggaaattctgtttcagaagaggaccttc

SEQ ID NO: 408765 - DNA, 49 bp, Artificial Sequence
  Description of Artificial Sequence: Synthetic oligonucleotide
ttaaaacaatcctttaaagaaggaaattctgtttcagaagaggaccttc

SEQ ID NO: 408766 - DNA, 48 bp, Artificial Sequence
  Description of Artificial Sequence: Synthetic oligonucleotide
taaaacaatcctttaaagaaggaaattctgtttcagaagaggaccttc

SEQ ID NO: 408767 - DNA, 47 bp, Artificial Sequence
  Description of Artificial Sequence: Synthetic oligonucleotide
aaaacaatcctttaaagaaggaaattctgtttcagaagaggaccttc

SEQ ID NO: 408768 - DNA, 46 bp, Artificial Sequence
  Description of Artificial Sequence: Synthetic oligonucleotide
aaacaatcctttaaagaaggaaattctgtttcagaagaggaccttc

SEQ ID NO: 408769 - DNA, 45 bp, Artificial Sequence
  Description of Artificial Sequence: Synthetic oligonucleotide
aacaatcctttaaagaaggaaattctgtttcagaagaggaccttc

SEQ ID NO: 408770 - DNA, 44 bp, Artificial Sequence
  Description of Artificial Sequence: Synthetic oligonucleotide
acaatcctttaaagaaggaaattctgtttcagaagaggaccttc

SEQ ID NO: 408771 - DNA, 43 bp, Artificial Sequence
  Description of Artificial Sequence: Synthetic oligonucleotide
caatcctttaaagaaggaaattctgtttcagaagaggaccttc

SEQ ID NO: 408772 - DNA, 46 bp, Artificial Sequence
  Description of Artificial Sequence: Synthetic oligonucleotide
aatcctttaaagaaggaaattctgtttcagaagaggaccttcatac

SEQ ID NO: 408773 - DNA, 45 bp, Artificial Sequence
  Description of Artificial Sequence: Synthetic oligonucleotide
atcctttaaagaaggaaattctgtttcagaagaggaccttcatac

SEQ ID NO: 408774 - DNA, 44 bp, Artificial Sequence
  Description of Artificial Sequence: Synthetic oligonucleotide
tcctttaaagaaggaaattctgtttcagaagaggaccttcatac

SEQ ID NO: 408775 - DNA, 43 bp, Artificial Sequence
  Description of Artificial Sequence: Synthetic oligonucleotide
cctttaaagaaggaaattctgtttcagaagaggaccttcatac

SEQ ID NO: 408776 - DNA, 44 bp, Artificial Sequence
  Description of Artificial Sequence: Synthetic oligonucleotide
ctttaaagaaggaaattctgtttcagaagaggaccttcatacag

SEQ ID NO: 408777 - DNA, 44 bp, Artificial Sequence
  Description of Artificial Sequence: Synthetic oligonucleotide
tttaaagaaggaaattctgtttcagaagaggaccttcatacagc

SEQ ID NO: 408778 - DNA, 43 bp, Artificial Sequence
  Description of Artificial Sequence: Synthetic oligonucleotide
ttaaagaaggaaattctgtttcagaagaggaccttcatacagc

SEQ ID NO: 408779 - DNA, 42 bp, Artificial Sequence
  Description of Artificial Sequence: Synthetic oligonucleotide
taaagaaggaaattctgtttcagaagaggaccttcatacagc

SEQ ID NO: 408780 - DNA, 41 bp, Artificial Sequence
  Description of Artificial Sequence: Synthetic oligonucleotide
aaagaaggaaattctgtttcagaagaggaccttcatacagc

SEQ ID NO: 408781 - DNA, 40 bp, Artificial Sequence
  Description of Artificial Sequence: Synthetic oligonucleotide
aagaaggaaattctgtttcagaagaggaccttcatacagc

SEQ ID NO: 408782 - DNA, 39 bp, Artificial Sequence
  Description of Artificial Sequence: Synthetic oligonucleotide
agaaggaaattctgtttcagaagaggaccttcatacagc

SEQ ID NO: 408783 - DNA, 38 bp, Artificial Sequence
  Description of Artificial Sequence: Synthetic oligonucleotide
gaaggaaattctgtttcagaagaggaccttcatacagc

SEQ ID NO: 408784 - DNA, 40 bp, Artificial Sequence
  Description of Artificial Sequence: Synthetic oligonucleotide
aaggaaattctgtttcagaagaggaccttcatacagcatc

SEQ ID NO: 408785 - DNA, 39 bp, Artificial Sequence
  Description of Artificial Sequence: Synthetic oligonucleotide
aggaaattctgtttcagaagaggaccttcatacagcatc

SEQ ID NO: 408786 - DNA, 38 bp, Artificial Sequence
  Description of Artificial Sequence: Synthetic oligonucleotide
ggaaattctgtttcagaagaggaccttcatacagcatc

SEQ ID NO: 408787 - DNA, 39 bp, Artificial Sequence
  Description of Artificial Sequence: Synthetic oligonucleotide
gaaattctgtttcagaagaggaccttcatacagcatctc

SEQ ID NO: 408788 - DNA, 40 bp, Artificial Sequence
  Description of Artificial Sequence: Synthetic oligonucleotide
aaattctgtttcagaagaggaccttcatacagcatctctg

SEQ ID NO: 408789 - DNA, 39 bp, Artificial Sequence
  Description of Artificial Sequence: Synthetic oligonucleotide
aattctgtttcagaagaggaccttcatacagcatctctg

SEQ ID NO: 408790 - DNA, 38 bp, Artificial Sequence
  Description of Artificial Sequence: Synthetic oligonucleotide
attctgtttcagaagaggaccttcatacagcatctctg

SEQ ID NO: 408791 - DNA, 37 bp, Artificial Sequence
  Description of Artificial Sequence: Synthetic oligonucleotide
ttctgtttcagaagaggaccttcatacagcatctctg

SEQ ID NO: 408792 - DNA, 36 bp, Artificial Sequence
  Description of Artificial Sequence: Synthetic oligonucleotide
tctgtttcagaagaggaccttcatacagcatctctg

SEQ ID NO: 408793 - DNA, 35 bp, Artificial Sequence
  Description of Artificial Sequence: Synthetic oligonucleotide
ctgtttcagaagaggaccttcatacagcatctctg

SEQ ID NO: 408794 - DNA, 36 bp, Artificial Sequence
  Description of Artificial Sequence: Synthetic oligonucleotide
tgtttcagaagaggaccttcatacagcatctctgac

SEQ ID NO: 408795 - DNA, 35 bp, Artificial Sequence
  Description of Artificial Sequence: Synthetic oligonucleotide
gtttcagaagaggaccttcatacagcatctctgac

SEQ ID NO: 408796 - DNA, 35 bp, Artificial Sequence
  Description of Artificial Sequence: Synthetic oligonucleotide
tttcagaagaggaccttcatacagcatctctgacc

SEQ ID NO: 408797 - DNA, 34 bp, Artificial Sequence
  Description of Artificial Sequence: Synthetic oligonucleotide
ttcagaagaggaccttcatacagcatctctgacc

SEQ ID NO: 408798 - DNA, 33 bp, Artificial Sequence
  Description of Artificial Sequence: Synthetic oligonucleotide
tcagaagaggaccttcatacagcatctctgacc

SEQ ID NO: 408799 - DNA, 32 bp, Artificial Sequence
  Description of Artificial Sequence: Synthetic oligonucleotide
cagaagaggaccttcatacagcatctctgacc

SEQ ID NO: 408800 - DNA, 33 bp, Artificial Sequence
  Description of Artificial Sequence: Synthetic oligonucleotide
agaagaggaccttcatacagcatctctgaccag

SEQ ID NO: 408801 - DNA, 32 bp, Artificial Sequence
  Description of Artificial Sequence: Synthetic oligonucleotide
gaagaggaccttcatacagcatctctgaccag

SEQ ID NO: 408802 - DNA, 32 bp, Artificial Sequence
  Description of Artificial Sequence: Synthetic oligonucleotide
aagaggaccttcatacagcatctctgaccagc

SEQ ID NO: 408803 - DNA, 31 bp, Artificial Sequence
  Description of Artificial Sequence: Synthetic oligonucleotide
agaggaccttcatacagcatctctgaccagc

SEQ ID NO: 408804 - DNA, 30 bp, Artificial Sequence
  Description of Artificial Sequence: Synthetic oligonucleotide
gaggaccttcatacagcatctctgaccagc

SEQ ID NO: 408805 - DNA, 32 bp, Artificial Sequence
  Description of Artificial Sequence: Synthetic oligonucleotide
aggaccttcatacagcatctctgaccagcaac

SEQ ID NO: 408806 - DNA, 23 bp, Artificial Sequence
  Description of Artificial Sequence: Synthetic oligonucleotide
gcgggccgcggtggacacctatt

SEQ ID NO: 408807 - DNA, 23 bp, Artificial Sequence
  Description of Artificial Sequence: Synthetic oligonucleotide
cgggccgcggtggacacctattg

SEQ ID NO: 408808 - DNA, 24 bp, Artificial Sequence
  Description of Artificial Sequence: Synthetic oligonucleotide
gggccgcggtggacacctattgca

SEQ ID NO: 408809 - DNA, 25 bp, Artificial Sequence
  Description of Artificial Sequence: Synthetic oligonucleotide
ggccgcggtggacacctattgcaga

SEQ ID NO: 408810 - DNA, 26 bp, Artificial Sequence
  Description of Artificial Sequence: Synthetic oligonucleotide
gccgcggtggacacctattgcagaca

SEQ ID NO: 408811 - DNA, 27 bp, Artificial Sequence
  Description of Artificial Sequence: Synthetic oligonucleotide
ccgcggtggacacctattgcagacaca

SEQ ID NO: 408812 - DNA, 28 bp, Artificial Sequence
  Description of Artificial Sequence: Synthetic oligonucleotide
cgcggtggacacctattgcagacacaac

SEQ ID NO: 408813 - DNA, 30 bp, Artificial Sequence; identical to SEQ ID NO: 63998
  Description of Artificial Sequence: Synthetic oligonucleotide

SEQ ID NO: 408814 - DNA, 30 bp, Artificial Sequence; identical to SEQ ID NO: 63999
  Description of Artificial Sequence: Synthetic oligonucleotide

SEQ ID NO: 408815 - DNA, 30 bp, Artificial Sequence; identical to SEQ ID NO: 64000
  Description of Artificial Sequence: Synthetic oligonucleotide

SEQ ID NO: 408816 - DNA, 30 bp, Artificial Sequence; identical to SEQ ID NO: 64001
  Description of Artificial Sequence: Synthetic oligonucleotide

SEQ ID NO: 408817 - DNA, 30 bp, Artificial Sequence; identical to SEQ ID NO: 64002
  Description of Artificial Sequence: Synthetic oligonucleotide

SEQ ID NO: 408818 - DNA, 29 bp, Artificial Sequence
  Description of Artificial Sequence: Synthetic oligonucleotide
ggacacctattgcagacacaactacgggg

SEQ ID NO: 408819 - DNA, 29 bp, Artificial Sequence
  Description of Artificial Sequence: Synthetic oligonucleotide
gacacctattgcagacacaactacggggc

SEQ ID NO: 408820 - DNA, 30 bp, Artificial Sequence; identical to SEQ ID NO: 64005
  Description of Artificial Sequence: Synthetic oligonucleotide

SEQ ID NO: 408821 - DNA, 29 bp, Artificial Sequence
  Description of Artificial Sequence: Synthetic oligonucleotide
cacctattgcagacacaactacggggctg

SEQ ID NO: 408822 - DNA, 30 bp, Artificial Sequence; identical to SEQ ID NO: 64007
  Description of Artificial Sequence: Synthetic oligonucleotide

SEQ ID NO: 408823 - DNA, 29 bp, Artificial Sequence
  Description of Artificial Sequence: Synthetic oligonucleotide
cctattgcagacacaactacggggctgtg

SEQ ID NO: 408824 - DNA, 29 bp, Artificial Sequence
  Description of Artificial Sequence: Synthetic oligonucleotide
ctattgcagacacaactacggggctgtgg

SEQ ID NO: 408825 - DNA, 30 bp, Artificial Sequence; identical to SEQ ID NO: 64010
  Description of Artificial Sequence: Synthetic oligonucleotide

SEQ ID NO: 408826 - DNA, 29 bp, Artificial Sequence
  Description of Artificial Sequence: Synthetic oligonucleotide
attgcagacacaactacggggctgtggag

SEQ ID NO: 408827 - DNA, 28 bp, Artificial Sequence
  Description of Artificial Sequence: Synthetic oligonucleotide
ttgcagacacaactacggggctgtggag

SEQ ID NO: 408828 - DNA, 27 bp, Artificial Sequence
  Description of Artificial Sequence: Synthetic oligonucleotide
tgcagacacaactacggggctgtggag

SEQ ID NO: 408829 - DNA, 27 bp, Artificial Sequence
  Description of Artificial Sequence: Synthetic oligonucleotide
gcagacacaactacggggctgtggaga

SEQ ID NO: 408830 - DNA, 27 bp, Artificial Sequence
  Description of Artificial Sequence: Synthetic oligonucleotide
cagacacaactacggggctgtggagag

SEQ ID NO: 408831 - DNA, 27 bp, Artificial Sequence
  Description of Artificial Sequence: Synthetic oligonucleotide
agacacaactacggggctgtggagagc

SEQ ID NO: 408832 - DNA, 27 bp, Artificial Sequence
  Description of Artificial Sequence: Synthetic oligonucleotide
gacacaactacggggctgtggagagct

SEQ ID NO: 408833 - DNA, 28 bp, Artificial Sequence
  Description of Artificial Sequence: Synthetic oligonucleotide
acacaactacggggctgtggagagcttc

SEQ ID NO: 408834 - DNA, 27 bp, Artificial Sequence
  Description of Artificial Sequence: Synthetic oligonucleotide
cacaactacggggctgtggagagcttc

SEQ ID NO: 408835 - DNA, 28 bp, Artificial Sequence
  Description of Artificial Sequence: Synthetic oligonucleotide
acaactacggggctgtggagagcttcac

SEQ ID NO: 408836 - DNA, 27 bp, Artificial Sequence
  Description of Artificial Sequence: Synthetic oligonucleotide
caactacggggctgtggagagcttcac

SEQ ID NO: 408837 - DNA, 28 bp, Artificial Sequence
  Description of Artificial Sequence: Synthetic oligonucleotide
aactacggggctgtggagagcttcacag

SEQ ID NO: 408838 - DNA, 27 bp, Artificial Sequence
  Description of Artificial Sequence: Synthetic oligonucleotide
actacggggctgtggagagcttcacag

SEQ ID NO: 408839 - DNA, 27 bp, Artificial Sequence
  Description of Artificial Sequence: Synthetic oligonucleotide
ctacggggctgtggagagcttcacagt

SEQ ID NO: 408840 - DNA, 27 bp, Artificial Sequence
  Description of Artificial Sequence: Synthetic oligonucleotide
tacggggctgtggagagcttcacagtg

SEQ ID NO: 408841 - DNA, 26 bp, Artificial Sequence
  Description of Artificial Sequence: Synthetic oligonucleotide
acggggctgtggagagcttcacagtg

SEQ ID NO: 408842 - DNA, 25 bp, Artificial Sequence
  Description of Artificial Sequence: Synthetic oligonucleotide
cggggctgtggagagcttcacagtg

SEQ ID NO: 408843 - DNA, 26 bp, Artificial Sequence
  Description of Artificial Sequence: Synthetic oligonucleotide
ggggctgtggagagcttcacagtgca

SEQ ID NO: 408844 - DNA, 26 bp, Artificial Sequence
  Description of Artificial Sequence: Synthetic oligonucleotide
gggctgtggagagcttcacagtgcag

SEQ ID NO: 408845 - DNA, 26 bp, Artificial Sequence
  Description of Artificial Sequence: Synthetic oligonucleotide
ggctgtggagagcttcacagtgcagc

SEQ ID NO: 408846 - DNA, 26 bp, Artificial Sequence
  Description of Artificial Sequence: Synthetic oligonucleotide
gctgtggagagcttcacagtgcagcg

SEQ ID NO: 408847 - DNA, 26 bp, Artificial Sequence
  Description of Artificial Sequence: Synthetic oligonucleotide
ctgtggagagcttcacagtgcagcgg

SEQ ID NO: 408848 - DNA, 26 bp, Artificial Sequence
  Description of Artificial Sequence: Synthetic oligonucleotide
tgtggagagcttcacagtgcagcggc

SEQ ID NO: 408849 - DNA, 25 bp, Artificial Sequence
  Description of Artificial Sequence: Synthetic oligonucleotide
gtggagagcttcacagtgcagcggc

SEQ ID NO: 408850 - DNA, 26 bp, Artificial Sequence
  Description of Artificial Sequence: Synthetic oligonucleotide
tggagagcttcacagtgcagcggcga

SEQ ID NO: 408851 - DNA, 25 bp, Artificial Sequence
  Description of Artificial Sequence: Synthetic oligonucleotide
ggagagcttcacagtgcagcggcga

SEQ ID NO: 408852 - DNA, 20 bp, Artificial Sequence
  Description of Artificial Sequence: Synthetic oligonucleotide
tggagcagaggcgggccgcc

SEQ ID NO: 408853 - DNA, 20 bp, Artificial Sequence
  Description of Artificial Sequence: Synthetic oligonucleotide
ggagcagaggcgggccgcct

SEQ ID NO: 408854 - DNA, 20 bp, Artificial Sequence
  Description of Artificial Sequence: Synthetic oligonucleotide
gagcagaggcgggccgccgt

SEQ ID NO: 408855 - DNA, 20 bp, Artificial Sequence
  Description of Artificial Sequence: Synthetic oligonucleotide
agcagaggcgggccgccgtg

SEQ ID NO: 408856 - DNA, 20 bp, Artificial Sequence
  Description of Artificial Sequence: Synthetic oligonucleotide
gcagaggcgggccgccgtgt

SEQ ID NO: 408857 - DNA, 20 bp, Artificial Sequence
  Description of Artificial Sequence: Synthetic oligonucleotide
cagaggcgggccgccgtgga

SEQ ID NO: 408858 - DNA, 21 bp, Artificial Sequence
  Description of Artificial Sequence: Synthetic oligonucleotide
agaggcgggccgccgtggaca

SEQ ID NO: 408859 - DNA, 20 bp, Artificial Sequence
  Description of Artificial Sequence: Synthetic oligonucleotide
gaggcgggccgccgtggaca

SEQ ID NO: 408860 - DNA, 20 bp, Artificial Sequence
  Description of Artificial Sequence: Synthetic oligonucleotide
aggcgggccgccgtggacac

SEQ ID NO: 408861 - DNA, 20 bp, Artificial Sequence
  Description of Artificial Sequence: Synthetic oligonucleotide
ggcgggccgccgtggacact

SEQ ID NO: 408862 - DNA, 23 bp, Artificial Sequence
  Description of Artificial Sequence: Synthetic oligonucleotide
gcgggccgccgtggacacctatt

SEQ ID NO: 408863 - DNA, 23 bp, Artificial Sequence
  Description of Artificial Sequence: Synthetic oligonucleotide
cgggccgccgtggacacctattg

SEQ ID NO: 408864 - DNA, 24 bp, Artificial Sequence
  Description of Artificial Sequence: Synthetic oligonucleotide
gggccgccgtggacacctattgca

SEQ ID NO: 408865 - DNA, 25 bp, Artificial Sequence
  Description of Artificial Sequence: Synthetic oligonucleotide
ggccgccgtggacacctattgcaga

SEQ ID NO: 408866 - DNA, 26 bp, Artificial Sequence
  Description of Artificial Sequence: Synthetic oligonucleotide
gccgccgtggacacctattgcagaca

SEQ ID NO: 408867 - DNA, 27 bp, Artificial Sequence
  Description of Artificial Sequence: Synthetic oligonucleotide
ccgccgtggacacctattgcagacaca

SEQ ID NO: 408868 - DNA, 28 bp, Artificial Sequence
  Description of Artificial Sequence: Synthetic oligonucleotide
cgccgtggacacctattgcagacacaac

SEQ ID NO: 408869 - DNA, 30 bp, Artificial Sequence; identical to SEQ ID NO: 64054
  Description of Artificial Sequence: Synthetic oligonucleotide

SEQ ID NO: 408870 - DNA, 30 bp, Artificial Sequence; identical to SEQ ID NO: 64055
  Description of Artificial Sequence: Synthetic oligonucleotide

SEQ ID NO: 408871 - DNA, 30 bp, Artificial Sequence; identical to SEQ ID NO: 64056
  Description of Artificial Sequence: Synthetic oligonucleotide

SEQ ID NO: 408872 - DNA, 33 bp, Artificial Sequence; identical to SEQ ID NO: 64057
  Description of Artificial Sequence: Synthetic oligonucleotide

SEQ ID NO: 408873 - DNA, 33 bp, Artificial Sequence; identical to SEQ ID NO: 64058
  Description of Artificial Sequence: Synthetic oligonucleotide

SEQ ID NO: 408874 - DNA, 32 bp, Artificial Sequence; identical to SEQ ID NO: 64059
  Description of Artificial Sequence: Synthetic oligonucleotide

SEQ ID NO: 408875 - DNA, 33 bp, Artificial Sequence; identical to SEQ ID NO: 64060
  Description of Artificial Sequence: Synthetic oligonucleotide

SEQ ID NO: 408876 - DNA, 33 bp, Artificial Sequence; identical to SEQ ID NO: 64061
  Description of Artificial Sequence: Synthetic oligonucleotide

SEQ ID NO: 408877 - DNA, 34 bp, Artificial Sequence; identical to SEQ ID NO: 64062
  Description of Artificial Sequence: Synthetic oligonucleotide

SEQ ID NO: 408878 - DNA, 35 bp, Artificial Sequence; identical to SEQ ID NO: 64063
  Description of Artificial Sequence: Synthetic oligonucleotide

SEQ ID NO: 408879 - DNA, 34 bp, Artificial Sequence; identical to SEQ ID NO: 64064
  Description of Artificial Sequence: Synthetic oligonucleotide

SEQ ID NO: 408880 - DNA, 33 bp, Artificial Sequence; identical to SEQ ID NO: 64065
  Description of Artificial Sequence: Synthetic oligonucleotide

SEQ ID NO: 408881 - DNA, 33 bp, Artificial Sequence; identical to SEQ ID NO: 64066
  Description of Artificial Sequence: Synthetic oligonucleotide

SEQ ID NO: 408882 - DNA, 33 bp, Artificial Sequence; identical to SEQ ID NO: 64067
  Description of Artificial Sequence: Synthetic oligonucleotide

SEQ ID NO: 408883 - DNA, 32 bp, Artificial Sequence; identical to SEQ ID NO: 64068
  Description of Artificial Sequence: Synthetic oligonucleotide

SEQ ID NO: 408884 - DNA, 33 bp, Artificial Sequence; identical to SEQ ID NO: 64069
  Description of Artificial Sequence: Synthetic oligonucleotide

SEQ ID NO: 408885 - DNA, 33 bp, Artificial Sequence; identical to SEQ ID NO: 64070
  Description of Artificial Sequence: Synthetic oligonucleotide

SEQ ID NO: 408886 - DNA, 32 bp, Artificial Sequence; identical to SEQ ID NO: 64071
  Description of Artificial Sequence: Synthetic oligonucleotide

SEQ ID NO: 408887 - DNA, 31 bp, Artificial Sequence; identical to SEQ ID NO: 64072
  Description of Artificial Sequence: Synthetic oligonucleotide

SEQ ID NO: 408888 - DNA, 30 bp, Artificial Sequence; identical to SEQ ID NO: 64073
  Description of Artificial Sequence: Synthetic oligonucleotide

SEQ ID NO: 408889 - DNA, 30 bp, Artificial Sequence; identical to SEQ ID NO: 64074
  Description of Artificial Sequence: Synthetic oligonucleotide

SEQ ID NO: 408890 - DNA, 29 bp, Artificial Sequence
  Description of Artificial Sequence: Synthetic oligonucleotide
tgcatctataaccaggaggagtccgtgcg

SEQ ID NO: 408891 - DNA, 28 bp, Artificial Sequence
  Description of Artificial Sequence: Synthetic oligonucleotide
gcatctataaccaggaggagtccgtgcg

SEQ ID NO: 408892 - DNA, 28 bp, Artificial Sequence
  Description of Artificial Sequence: Synthetic oligonucleotide
catctataaccaggaggagtccgtgcgc

SEQ ID NO: 408893 - DNA, 30 bp, Artificial Sequence; identical to SEQ ID NO: 64078
  Description of Artificial Sequence: Synthetic oligonucleotide

SEQ ID NO: 408894 - DNA, 29 bp, Artificial Sequence
  Description of Artificial Sequence: Synthetic oligonucleotide
tctataaccaggaggagtccgtgcgcttc

SEQ ID NO: 408895 - DNA, 28 bp, Artificial Sequence
  Description of Artificial Sequence: Synthetic oligonucleotide
ctataaccaggaggagtccgtgcgcttc

SEQ ID NO: 408896 - DNA, 28 bp, Artificial Sequence
  Description of Artificial Sequence: Synthetic oligonucleotide
tataaccaggaggagtccgtgcgcttcg

SEQ ID NO: 408897 - DNA, 27 bp, Artificial Sequence
  Description of Artificial Sequence: Synthetic oligonucleotide
ataaccaggaggagtccgtgcgcttcg

SEQ ID NO: 408898 - DNA, 27 bp, Artificial Sequence
  Description of Artificial Sequence: Synthetic oligonucleotide
taaccaggaggagtccgtgcgcttcga

SEQ ID NO: 408899 - DNA, 26 bp, Artificial Sequence
  Description of Artificial Sequence: Synthetic oligonucleotide
aaccaggaggagtccgtgcgcttcga

SEQ ID NO: 408900 - DNA, 25 bp, Artificial Sequence
  Description of Artificial Sequence: Synthetic oligonucleotide
accaggaggagtccgtgcgcttcga

SEQ ID NO: 408901 - DNA, 24 bp, Artificial Sequence
  Description of Artificial Sequence: Synthetic oligonucleotide
ccaggaggagtccgtgcgcttcga

SEQ ID NO: 408902 - DNA, 25 bp, Artificial Sequence
  Description of Artificial Sequence: Synthetic oligonucleotide
caggaggagtccgtgcgcttcgaca

SEQ ID NO: 408903 - DNA, 25 bp, Artificial Sequence
  Description of Artificial Sequence: Synthetic oligonucleotide
aggaggagtccgtgcgcttcgacag

SEQ ID NO: 408904 - DNA, 24 bp, Artificial Sequence
  Description of Artificial Sequence: Synthetic oligonucleotide
ggaggagtccgtgcgcttcgacag

SEQ ID NO: 408905 - DNA, 25 bp, Artificial Sequence
  Description of Artificial Sequence: Synthetic oligonucleotide
gagagcttcacagtgcagcggcgag

SEQ ID NO: 408906 - DNA, 22 bp, Artificial Sequence
  Description of Artificial Sequence: Synthetic oligonucleotide
ggagctggggcggcctgatgct

SEQ ID NO: 408907 - DNA, 23 bp, Artificial Sequence
  Description of Artificial Sequence: Synthetic oligonucleotide
gagctggggcggcctgatgctga

SEQ ID NO: 408908 - DNA, 25 bp, Artificial Sequence
  Description of Artificial Sequence: Synthetic oligonucleotide
agctggggcggcctgatgctgagta

SEQ ID NO: 408909 - DNA, 24 bp, Artificial Sequence
  Description of Artificial Sequence: Synthetic oligonucleotide
gctggggcggcctgatgctgagta

SEQ ID NO: 408910 - DNA, 25 bp, Artificial Sequence
  Description of Artificial Sequence: Synthetic oligonucleotide
ctggggcggcctgatgctgagtact

SEQ ID NO: 408911 - DNA, 25 bp, Artificial Sequence
  Description of Artificial Sequence: Synthetic oligonucleotide
tggggcggcctgatgctgagtactg

SEQ ID NO: 408912 - DNA, 24 bp, Artificial Sequence
  Description of Artificial Sequence: Synthetic oligonucleotide
ggggcggcctgatgctgagtactg

SEQ ID NO: 408913 - DNA, 26 bp, Artificial Sequence
  Description of Artificial Sequence: Synthetic oligonucleotide
gggcggcctgatgctgagtactggaa

SEQ ID NO: 408914 - DNA, 27 bp, Artificial Sequence
  Description of Artificial Sequence: Synthetic oligonucleotide
ggcggcctgatgctgagtactggaaca

SEQ ID NO: 408915 - DNA, 27 bp, Artificial Sequence
  Description of Artificial Sequence: Synthetic oligonucleotide
gcggcctgatgctgagtactggaacag

SEQ ID NO: 408916 - DNA, 27 bp, Artificial Sequence
  Description of Artificial Sequence: Synthetic oligonucleotide
cggcctgatgctgagtactggaacagc

SEQ ID NO: 408917 - DNA, 27 bp, Artificial Sequence
  Description of Artificial Sequence: Synthetic oligonucleotide
ggcctgatgctgagtactggaacagcc

SEQ ID NO: 408918 - DNA, 28 bp, Artificial Sequence
  Description of Artificial Sequence: Synthetic oligonucleotide
gcctgatgctgagtactggaacagccag

SEQ ID NO: 408919 - DNA, 30 bp, Artificial Sequence; identical to SEQ ID NO: 64104
  Description of Artificial Sequence: Synthetic oligonucleotide

SEQ ID NO: 408920 - DNA, 30 bp, Artificial Sequence; identical to SEQ ID NO: 64105
  Description of Artificial Sequence: Synthetic oligonucleotide

SEQ ID NO: 408921 - DNA, 31 bp, Artificial Sequence; identical to SEQ ID NO: 64106
  Description of Artificial Sequence: Synthetic oligonucleotide

SEQ ID NO: 408922 - DNA, 30 bp, Artificial Sequence; identical to SEQ ID NO: 64107
  Description of Artificial Sequence: Synthetic oligonucleotide

SEQ ID NO: 408923 - DNA, 30 bp, Artificial Sequence; identical to SEQ ID NO: 64108
  Description of Artificial Sequence: Synthetic oligonucleotide

SEQ ID NO: 408924 - DNA, 29 bp, Artificial Sequence
  Description of Artificial Sequence: Synthetic oligonucleotide
tgctgagtactggaacagccagaaggacc

SEQ ID NO: 408925 - DNA, 31 bp, Artificial Sequence; identical to SEQ ID NO: 64110
  Description of Artificial Sequence: Synthetic oligonucleotide

SEQ ID NO: 408926 - DNA, 30 bp, Artificial Sequence; identical to SEQ ID NO: 64111
  Description of Artificial Sequence: Synthetic oligonucleotide

SEQ ID NO: 408927 - DNA, 29 bp, Artificial Sequence
  Description of Artificial Sequence: Synthetic oligonucleotide
ctggaacagccagaaggacatcctggaag

SEQ ID NO: 408928 - DNA, 30 bp, Artificial Sequence; identical to SEQ ID NO: 64113
  Description of Artificial Sequence: Synthetic oligonucleotide

SEQ ID NO: 408929 - DNA, 29 bp, Artificial Sequence
  Description of Artificial Sequence: Synthetic oligonucleotide
ggaacagccagaaggacatcctggaagac

SEQ ID NO: 408930 - DNA, 29 bp, Artificial Sequence
  Description of Artificial Sequence: Synthetic oligonucleotide
gaacagccagaaggacatcctggaagacg

SEQ ID NO: 408931 - DNA, 30 bp, Artificial Sequence; identical to SEQ ID NO: 64116
  Description of Artificial Sequence: Synthetic oligonucleotide

SEQ ID NO: 408932 - DNA, 29 bp, Artificial Sequence
  Description of Artificial Sequence: Synthetic oligonucleotide
acagccagaaggacatcctggaagacgag

SEQ ID NO: 408933 - DNA, 28 bp, Artificial Sequence
  Description of Artificial Sequence: Synthetic oligonucleotide
cagccagaaggacatcctggaagacgag

SEQ ID NO: 408934 - DNA, 28 bp, Artificial Sequence
  Description of Artificial Sequence: Synthetic oligonucleotide
agccagaaggacatcctggaagacgagc

SEQ ID NO: 408935 - DNA, 27 bp, Artificial Sequence
  Description of Artificial Sequence: Synthetic oligonucleotide
gccagaaggacatcctggaagacgagc

SEQ ID NO: 408936 - DNA, 27 bp, Artificial Sequence
  Description of Artificial Sequence: Synthetic oligonucleotide
ccagaaggacatcctggaagacgagcg

SEQ ID NO: 408937 - DNA, 27 bp, Artificial Sequence
  Description of Artificial Sequence: Synthetic oligonucleotide
cagaaggacatcctggaagacgagcgg

SEQ ID NO: 408938 - DNA, 27 bp, Artificial Sequence
  Description of Artificial Sequence: Synthetic oligonucleotide
agaaggacatcctggaagacgagcggg

SEQ ID NO: 408939 - DNA, 26 bp, Artificial Sequence
  Description of Artificial Sequence: Synthetic oligonucleotide
gaaggacatcctggaagacgagcggg

SEQ ID NO: 408940 - DNA, 26 bp, Artificial Sequence
  Description of Artificial Sequence: Synthetic oligonucleotide
aaggacatcctggaagacgagcgggc

SEQ ID NO: 408941 - DNA, 25 bp, Artificial Sequence
  Description of Artificial Sequence: Synthetic oligonucleotide
aggacatcctggaagacgagcgggc

SEQ ID NO: 408942 - DNA, 24 bp, Artificial Sequence
  Description of Artificial Sequence: Synthetic oligonucleotide
ggacatcctggaagacgagcgggc

SEQ ID NO: 408943 - DNA, 24 bp, Artificial Sequence
  Description of Artificial Sequence: Synthetic oligonucleotide
gacatcctggaagacgagcgggcc

SEQ ID NO: 408944 - DNA, 24 bp, Artificial Sequence
  Description of Artificial Sequence: Synthetic oligonucleotide
acatcctggaagacgagcgggccg

SEQ ID NO: 408945 - DNA, 23 bp, Artificial Sequence
  Description of Artificial Sequence: Synthetic oligonucleotide
catcctggaagacgagcgggccg

SEQ ID NO: 408946 - DNA, 23 bp, Artificial Sequence
  Description of Artificial Sequence: Synthetic oligonucleotide
atcctggaagacgagcgggccgc

SEQ ID NO: 408947 - DNA, 22 bp, Artificial Sequence
  Description of Artificial Sequence: Synthetic oligonucleotide
tcctggaagacgagcgggccgc

SEQ ID NO: 408948 - DNA, 21 bp, Artificial Sequence
  Description of Artificial Sequence: Synthetic oligonucleotide
cctggaagacgagcgggccgc

SEQ ID NO: 408949 - DNA, 21 bp, Artificial Sequence
  Description of Artificial Sequence: Synthetic oligonucleotide
ctggaagacgagcgggccgcg

SEQ ID NO: 408950 - DNA, 22 bp, Artificial Sequence
  Description of Artificial Sequence: Synthetic oligonucleotide
tggaagacgagcgggccgcggt

SEQ ID NO: 408951 - DNA, 21 bp, Artificial Sequence
  Description of Artificial Sequence: Synthetic oligonucleotide
ggaagacgagcgggccgcggt

SEQ ID NO: 408952 - DNA, 21 bp, Artificial Sequence
  Description of Artificial Sequence: Synthetic oligonucleotide
gaagacgagcgggccgcggtg

SEQ ID NO: 408953 - DNA, 22 bp, Artificial Sequence
  Description of Artificial Sequence: Synthetic oligonucleotide
aagacgagcgggccgcggtgga

SEQ ID NO: 408954 - DNA, 21 bp, Artificial Sequence
  Description of Artificial Sequence: Synthetic oligonucleotide
agacgagcgggccgcggtgga

SEQ ID NO: 408955 - DNA, 20 bp, Artificial Sequence
  Description of Artificial Sequence: Synthetic oligonucleotide
gacgagcgggccgcggtgga

SEQ ID NO: 408956 - DNA, 21 bp, Artificial Sequence
  Description of Artificial Sequence: Synthetic oligonucleotide
acgagcgggccgcggtggaca

SEQ ID NO: 408957 - DNA, 20 bp, Artificial Sequence
  Description of Artificial Sequence: Synthetic oligonucleotide
cgagcgggccgcggtggaca

SEQ ID NO: 408958 - DNA, 20 bp, Artificial Sequence
  Description of Artificial Sequence: Synthetic oligonucleotide
gagcgggccgcggtggacac

SEQ ID NO: 408959 - DNA, 22 bp, Artificial Sequence
  Description of Artificial Sequence: Synthetic oligonucleotide
agcgggccgcggtggacaccta

SEQ ID NO: 408960 - DNA, 25 bp, Artificial Sequence
  Description of Artificial Sequence: Synthetic oligonucleotide
agaggcgggccgcggtggacaatta

SEQ ID NO: 408961 - DNA, 24 bp, Artificial Sequence
  Description of Artificial Sequence: Synthetic oligonucleotide
gaggcgggccgcggtggacaatta

SEQ ID NO: 408962 - DNA, 25 bp, Artificial Sequence
  Description of Artificial Sequence: Synthetic oligonucleotide
aggcgggccgcggtggacaattact

SEQ ID NO: 408963 - DNA, 24 bp, Artificial Sequence
  Description of Artificial Sequence: Synthetic oligonucleotide
ggcgggccgcggtggacaattact

SEQ ID NO: 408964 - DNA, 24 bp, Artificial Sequence
  Description of Artificial Sequence: Synthetic oligonucleotide
gcgggccgcggtggacaattactg

SEQ ID NO: 408965 - DNA, 25 bp, Artificial Sequence
  Description of Artificial Sequence: Synthetic oligonucleotide
cgggccgcggtggacaattactgca

SEQ ID NO: 408966 - DNA, 26 bp, Artificial Sequence
  Description of Artificial Sequence: Synthetic oligonucleotide
gggccgcggtggacaattactgcaga

SEQ ID NO: 408967 - DNA, 27 bp, Artificial Sequence
  Description of Artificial Sequence: Synthetic oligonucleotide
ggccgcggtggacaattactgcagaca

SEQ ID NO: 408968 - DNA, 27 bp, Artificial Sequence
  Description of Artificial Sequence: Synthetic oligonucleotide
gccgcggtggacaattactgcagacac

SEQ ID NO: 408969 - DNA, 29 bp, Artificial Sequence
  Description of Artificial Sequence: Synthetic oligonucleotide
ccgcggtggacaattactgcagacacaac

SEQ ID NO: 408970 - DNA, 31 bp, Artificial Sequence; identical to SEQ ID NO: 64155
  Description of Artificial Sequence: Synthetic oligonucleotide

SEQ ID NO: 408971 - DNA, 31 bp, Artificial Sequence; identical to SEQ ID NO: 64156
  Description of Artificial Sequence: Synthetic oligonucleotide

SEQ ID NO: 408972 - DNA, 31 bp, Artificial Sequence; identical to SEQ ID NO: 64157
  Description of Artificial Sequence: Synthetic oligonucleotide

SEQ ID NO: 408973 - DNA, 31 bp, Artificial Sequence; identical to SEQ ID NO: 64158
  Description of Artificial Sequence: Synthetic oligonucleotide

SEQ ID NO: 408974 - DNA, 31 bp, Artificial Sequence; identical to SEQ ID NO: 64159
  Description of Artificial Sequence: Synthetic oligonucleotide

SEQ ID NO: 408975 - DNA, 33 bp, Artificial Sequence; identical to SEQ ID NO: 64160
  Description of Artificial Sequence: Synthetic oligonucleotide

SEQ ID NO: 408976 - DNA, 32 bp, Artificial Sequence; identical to SEQ ID NO: 64161
  Description of Artificial Sequence: Synthetic oligonucleotide

SEQ ID NO: 408977 - DNA, 33 bp, Artificial Sequence; identical to SEQ ID NO: 64162
  Description of Artificial Sequence: Synthetic oligonucleotide

SEQ ID NO: 408978 - DNA, 33 bp, Artificial Sequence; identical to SEQ ID NO: 64163
  Description of Artificial Sequence: Synthetic oligonucleotide

SEQ ID NO: 408979 - DNA, 32 bp, Artificial Sequence; identical to SEQ ID NO: 64164
  Description of Artificial Sequence: Synthetic oligonucleotide

SEQ ID NO: 408980 - DNA, 33 bp, Artificial Sequence; identical to SEQ ID NO: 64165
  Description of Artificial Sequence: Synthetic oligonucleotide

SEQ ID NO: 408981 - DNA, 32 bp, Artificial Sequence; identical to SEQ ID NO: 64166
  Description of Artificial Sequence: Synthetic oligonucleotide

SEQ ID NO: 408982 - DNA, 31 bp, Artificial Sequence; identical to SEQ ID NO: 64167
  Description of Artificial Sequence: Synthetic oligonucleotide

SEQ ID NO: 408983 - DNA, 30 bp, Artificial Sequence; identical to SEQ ID NO: 64168
  Description of Artificial Sequence: Synthetic oligonucleotide

SEQ ID NO: 408984 - DNA, 29 bp, Artificial Sequence
  Description of Artificial Sequence: Synthetic oligonucleotide
actgcagacacaactacggggttgtggag

SEQ ID NO: 408985 - DNA, 28 bp, Artificial Sequence
  Description of Artificial Sequence: Synthetic oligonucleotide
ctgcagacacaactacggggttgtggag

SEQ ID NO: 408986 - DNA, 29 bp, Artificial Sequence
  Description of Artificial Sequence: Synthetic oligonucleotide
tgcagacacaactacggggttgtggagag

SEQ ID NO: 408987 - DNA, 28 bp, Artificial Sequence
  Description of Artificial Sequence: Synthetic oligonucleotide
gcagacacaactacggggttgtggagag

SEQ ID NO: 408988 - DNA, 28 bp, Artificial Sequence
  Description of Artificial Sequence: Synthetic oligonucleotide
cagacacaactacggggttgtggagagc

SEQ ID NO: 408989 - DNA, 30 bp, Artificial Sequence; identical to SEQ ID NO: 64174
  Description of Artificial Sequence: Synthetic oligonucleotide

SEQ ID NO: 408990 - DNA, 29 bp, Artificial Sequence
  Description of Artificial Sequence: Synthetic oligonucleotide
gacacaactacggggttgtggagagcttc

SEQ ID NO: 408991 - DNA, 30 bp, Artificial Sequence; identical to SEQ ID NO: 64176
  Description of Artificial Sequence: Synthetic oligonucleotide

SEQ ID NO: 408992 - DNA, 29 bp, Artificial Sequence
  Description of Artificial Sequence: Synthetic oligonucleotide
cacaactacggggttgtggagagcttcac

SEQ ID NO: 408993 - DNA, 30 bp, Artificial Sequence; identical to SEQ ID NO: 64178
  Description of Artificial Sequence: Synthetic oligonucleotide

SEQ ID NO: 408994 - DNA, 29 bp, Artificial Sequence
  Description of Artificial Sequence: Synthetic oligonucleotide
caactacggggttgtggagagcttcacag

SEQ ID NO: 408995 - DNA, 30 bp, Artificial Sequence; identical to SEQ ID NO: 64180
  Description of Artificial Sequence: Synthetic oligonucleotide

SEQ ID NO: 408996 - DNA, 29 bp, Artificial Sequence
  Description of Artificial Sequence: Synthetic oligonucleotide
actacggggttgtggagagcttcacagtg

SEQ ID NO: 408997 - DNA, 28 bp, Artificial Sequence
  Description of Artificial Sequence: Synthetic oligonucleotide
ctacggggttgtggagagcttcacagtg

SEQ ID NO: 408998 - DNA, 28 bp, Artificial Sequence
  Description of Artificial Sequence: Synthetic oligonucleotide
tacggggttgtggagagcttcacagtgc

SEQ ID NO: 408999 - DNA, 27 bp, Artificial Sequence
  Description of Artificial Sequence: Synthetic oligonucleotide
acggggttgtggagagcttcacagtgc

SEQ ID NO: 409000 - DNA, 27 bp, Artificial Sequence
  Description of Artificial Sequence: Synthetic oligonucleotide
cggggttgtggagagcttcacagtgca

SEQ ID NO: 409001 - DNA, 27 bp, Artificial Sequence
  Description of Artificial Sequence: Synthetic oligonucleotide
ggggttgtggagagcttcacagtgcag

SEQ ID NO: 409002 - DNA, 27 bp, Artificial Sequence
  Description of Artificial Sequence: Synthetic oligonucleotide
gggttgtggagagcttcacagtgcagc

SEQ ID NO: 409003 - DNA, 27 bp, Artificial Sequence
  Description of Artificial Sequence: Synthetic oligonucleotide
ggttgtggagagcttcacagtgcagcg

SEQ ID NO: 409004 - DNA, 27 bp, Artificial Sequence
  Description of Artificial Sequence: Synthetic oligonucleotide
gttgtggagagcttcacagtgcagcgg

SEQ ID NO: 409005 - DNA, 27 bp, Artificial Sequence
  Description of Artificial Sequence: Synthetic oligonucleotide
ttgtggagagcttcacagtgcagcggc

SEQ ID NO: 409006 - DNA, 25 bp, Artificial Sequence
  Description of Artificial Sequence: Synthetic oligonucleotide
tccgtgcgcttcgacagcgacgtga

SEQ ID NO: 409007 - DNA, 24 bp, Artificial Sequence
  Description of Artificial Sequence: Synthetic oligonucleotide
ccgtgcgcttcgacagcgacgtga

SEQ ID NO: 409008 - DNA, 24 bp, Artificial Sequence
  Description of Artificial Sequence: Synthetic oligonucleotide
cgtgcgcttcgacagcgacgtgag

SEQ ID NO: 409009 - DNA, 24 bp, Artificial Sequence
  Description of Artificial Sequence: Synthetic oligonucleotide
gtgcgcttcgacagcgacgtgagg

SEQ ID NO: 409010 - DNA, 25 bp, Artificial Sequence
  Description of Artificial Sequence: Synthetic oligonucleotide
tgcgcttcgacagcgacgtgaggga

SEQ ID NO: 409011 - DNA, 24 bp, Artificial Sequence
  Description of Artificial Sequence: Synthetic oligonucleotide
gcgcttcgacagcgacgtgaggga

SEQ ID NO: 409012 - DNA, 26 bp, Artificial Sequence
  Description of Artificial Sequence: Synthetic oligonucleotide
cgcttcgacagcgacgtgagggagta

SEQ ID NO: 409013 - DNA, 26 bp, Artificial Sequence
  Description of Artificial Sequence: Synthetic oligonucleotide
gcttcgacagcgacgtgagggagtac

SEQ ID NO: 409014 - DNA, 26 bp, Artificial Sequence
  Description of Artificial Sequence: Synthetic oligonucleotide
cttcgacagcgacgtgagggagtacc

SEQ ID NO: 409015 - DNA, 26 bp, Artificial Sequence
  Description of Artificial Sequence: Synthetic oligonucleotide
ttcgacagcgacgtgagggagtaccg

SEQ ID NO: 409016 - DNA, 25 bp, Artificial Sequence
  Description of Artificial Sequence: Synthetic oligonucleotide
tcgacagcgacgtgagggagtaccg

SEQ ID NO: 409017 - DNA, 24 bp, Artificial Sequence
  Description of Artificial Sequence: Synthetic oligonucleotide
cgacagcgacgtgagggagtaccg

SEQ ID NO: 409018 - DNA, 24 bp, Artificial Sequence
  Description of Artificial Sequence: Synthetic oligonucleotide
gacagcgacgtgagggagtaccgg

SEQ ID NO: 409019 - DNA, 24 bp, Artificial Sequence
  Description of Artificial Sequence: Synthetic oligonucleotide
acagcgacgtgagggagtaccggg

SEQ ID NO: 409020 - DNA, 23 bp, Artificial Sequence
  Description of Artificial Sequence: Synthetic oligonucleotide
cagcgacgtgagggagtaccggg

SEQ ID NO: 409021 - DNA, 23 bp, Artificial Sequence
  Description of Artificial Sequence: Synthetic oligonucleotide
agcgacgtgagggagtaccgggc

SEQ ID NO: 409022 - DNA, 22 bp, Artificial Sequence
  Description of Artificial Sequence: Synthetic oligonucleotide
gcgacgtgagggagtaccgggc

SEQ ID NO: 409023 - DNA, 22 bp, Artificial Sequence
  Description of Artificial Sequence: Synthetic oligonucleotide
cgacgtgagggagtaccgggcg

SEQ ID NO: 409024 - DNA, 23 bp, Artificial Sequence
  Description of Artificial Sequence: Synthetic oligonucleotide
gacgtgagggagtaccgggcggt

SEQ ID NO: 409025 - DNA, 24 bp, Artificial Sequence
  Description of Artificial Sequence: Synthetic oligonucleotide
acgtgagggagtaccgggcggtga

SEQ ID NO: 409026 - DNA, 23 bp, Artificial Sequence
  Description of Artificial Sequence: Synthetic oligonucleotide
cgtgagggagtaccgggcggtga

SEQ ID NO: 409027 - DNA, 23 bp, Artificial Sequence
  Description of Artificial Sequence: Synthetic oligonucleotide
gtgagggagtaccgggcggtgac

SEQ ID NO: 409028 - DNA, 23 bp, Artificial Sequence
  Description of Artificial Sequence: Synthetic oligonucleotide
tgagggagtaccgggcggtgacg

SEQ ID NO: 409029 - DNA, 22 bp, Artificial Sequence
  Description of Artificial Sequence: Synthetic oligonucleotide
gagggagtaccgggcggtgacg

SEQ ID NO: 409030 - DNA, 23 bp, Artificial Sequence
  Description of Artificial Sequence: Synthetic oligonucleotide
agggagtaccgggcggtgacgga

SEQ ID NO: 409031 - DNA, 26 bp, Artificial Sequence
  Description of Artificial Sequence: Synthetic oligonucleotide
acagccagaaggacctcctggagcag

SEQ ID NO: 409032 - DNA, 25 bp, Artificial Sequence
  Description of Artificial Sequence: Synthetic oligonucleotide
cagccagaaggacctcctggagcag

SEQ ID NO: 409033 - DNA, 25 bp, Artificial Sequence
  Description of Artificial Sequence: Synthetic oligonucleotide
agccagaaggacctcctggagcagg

SEQ ID NO: 409034 - DNA, 24 bp, Artificial Sequence
  Description of Artificial Sequence: Synthetic oligonucleotide
gccagaaggacctcctggagcagg

SEQ ID NO: 409035 - DNA, 24 bp, Artificial Sequence
  Description of Artificial Sequence: Synthetic oligonucleotide
ccagaaggacctcctggagcaggc

SEQ ID NO: 409036 - DNA, 24 bp, Artificial Sequence
  Description of Artificial Sequence: Synthetic oligonucleotide
cagaaggacctcctggagcaggcg

SEQ ID NO: 409037 - DNA, 24 bp, Artificial Sequence
  Description of Artificial Sequence: Synthetic oligonucleotide
agaaggacctcctggagcaggcgc

SEQ ID NO: 409038 - DNA, 23 bp, Artificial Sequence
  Description of Artificial Sequence: Synthetic oligonucleotide
gaaggacctcctggagcaggcgc

SEQ ID NO: 409039 - DNA, 23 bp, Artificial Sequence
  Description of Artificial Sequence: Synthetic oligonucleotide
aaggacctcctggagcaggcgcg

SEQ ID NO: 409040 - DNA, 22 bp, Artificial Sequence
  Description of Artificial Sequence: Synthetic oligonucleotide
aggacctcctggagcaggcgcg

SEQ ID NO: 409041 - DNA, 21 bp, Artificial Sequence
  Description of Artificial Sequence: Synthetic oligonucleotide
ggacctcctggagcaggcgcg

SEQ ID NO: 409042 - DNA, 21 bp, Artificial Sequence
  Description of Artificial Sequence: Synthetic oligonucleotide
gacctcctggagcaggcgcgg

SEQ ID NO: 409043 - DNA, 21 bp, Artificial Sequence
  Description of Artificial Sequence: Synthetic oligonucleotide
acctcctggagcaggcgcggg

SEQ ID NO: 409044 - DNA, 20 bp, Artificial Sequence
  Description of Artificial Sequence: Synthetic oligonucleotide
cctcctggagcaggcgcggg

SEQ ID NO: 409045 - DNA, 20 bp, Artificial Sequence
  Description of Artificial Sequence: Synthetic oligonucleotide
ctcctggagcaggcgcgggc

SEQ ID NO: 409046 - DNA, 20 bp, Artificial Sequence
  Description of Artificial Sequence: Synthetic oligonucleotide
tcctggagcaggcgcgggcc

SEQ ID NO: 409047 - DNA, 20 bp, Artificial Sequence
  Description of Artificial Sequence: Synthetic oligonucleotide
cctggagcaggcgcgggcct

SEQ ID NO: 409048 - DNA, 20 bp, Artificial Sequence
  Description of Artificial Sequence: Synthetic oligonucleotide
ctggagcaggcgcgggccgt

SEQ ID NO: 409049 - DNA, 20 bp, Artificial Sequence
  Description of Artificial Sequence: Synthetic oligonucleotide
tggagcaggcgcgggccgct

SEQ ID NO: 409050 - DNA, 20 bp, Artificial Sequence
  Description of Artificial Sequence: Synthetic oligonucleotide
ggagcaggcgcgggccgctt

SEQ ID NO: 409051 - DNA, 20 bp, Artificial Sequence
  Description of Artificial Sequence: Synthetic oligonucleotide
gagcaggcgcgggccgcgtt

SEQ ID NO: 409052 - DNA, 20 bp, Artificial Sequence
  Description of Artificial Sequence: Synthetic oligonucleotide
agcaggcgcgggccgcggtt

SEQ ID NO: 409053 - DNA, 20 bp, Artificial Sequence
  Description of Artificial Sequence: Synthetic oligonucleotide
gcaggcgcgggccgcggttt

SEQ ID NO: 409054 - DNA, 20 bp, Artificial Sequence
  Description of Artificial Sequence: Synthetic oligonucleotide
caggcgcgggccgcggtgtt

SEQ ID NO: 409055 - DNA, 20 bp, Artificial Sequence
  Description of Artificial Sequence: Synthetic oligonucleotide
aggcgcgggccgcggtggat

SEQ ID NO: 409056 - DNA, 20 bp, Artificial Sequence
  Description of Artificial Sequence: Synthetic oligonucleotide
ggcgcgggccgcggtggatt

SEQ ID NO: 409057 - DNA, 20 bp, Artificial Sequence
  Description of Artificial Sequence: Synthetic oligonucleotide
gcgcgggccgcggtggacat

SEQ ID NO: 409058 - DNA, 20 bp, Artificial Sequence
  Description of Artificial Sequence: Synthetic oligonucleotide
cgcgggccgcggtggacact

SEQ ID NO: 409059 - DNA, 30 bp, Artificial Sequence; identical to SEQ ID NO: 64244
  Description of Artificial Sequence: Synthetic oligonucleotide

SEQ ID NO: 409060 - DNA, 29 bp, Artificial Sequence
  Description of Artificial Sequence: Synthetic oligonucleotide
cctactgcagacacaactacggggttgtg

SEQ ID NO: 409061 - DNA, 29 bp, Artificial Sequence
  Description of Artificial Sequence: Synthetic oligonucleotide
ctactgcagacacaactacggggttgtgg

SEQ ID NO: 409062 - DNA, 41 bp, Artificial Sequence; identical to SEQ ID NO: 64247
  Description of Artificial Sequence: Synthetic oligonucleotide

SEQ ID NO: 409063 - DNA, 44 bp, Artificial Sequence; identical to SEQ ID NO: 64248
  Description of Artificial Sequence: Synthetic oligonucleotide

SEQ ID NO: 409064 - DNA, 43 bp, Artificial Sequence; identical to SEQ ID NO: 64249
  Description of Artificial Sequence: Synthetic oligonucleotide

SEQ ID NO: 409065 - DNA, 43 bp, Artificial Sequence; identical to SEQ ID NO: 64250
  Description of Artificial Sequence: Synthetic oligonucleotide

SEQ ID NO: 409066 - DNA, 43 bp, Artificial Sequence; identical to SEQ ID NO: 64251
  Description of Artificial Sequence: Synthetic oligonucleotide

SEQ ID NO: 409067 - DNA, 42 bp, Artificial Sequence; identical to SEQ ID NO: 64252
  Description of Artificial Sequence: Synthetic oligonucleotide

SEQ ID NO: 409068 - DNA, 41 bp, Artificial Sequence; identical to SEQ ID NO: 64253
  Description of Artificial Sequence: Synthetic oligonucleotide

SEQ ID NO: 409069 - DNA, 40 bp, Artificial Sequence; identical to SEQ ID NO: 64254
  Description of Artificial Sequence: Synthetic oligonucleotide

SEQ ID NO: 409070 - DNA, 41 bp, Artificial Sequence; identical to SEQ ID NO: 64255
  Description of Artificial Sequence: Synthetic oligonucleotide

SEQ ID NO: 409071 - DNA, 40 bp, Artificial Sequence; identical to SEQ ID NO: 64256
  Description of Artificial Sequence: Synthetic oligonucleotide

SEQ ID NO: 409072 - DNA, 39 bp, Artificial Sequence; identical to SEQ ID NO: 64257
  Description of Artificial Sequence: Synthetic oligonucleotide

SEQ ID NO: 409073 - DNA, 39 bp, Artificial Sequence; identical to SEQ ID NO: 64258
  Description of Artificial Sequence: Synthetic oligonucleotide

SEQ ID NO: 409074 - DNA, 38 bp, Artificial Sequence; identical to SEQ ID NO: 64259
  Description of Artificial Sequence: Synthetic oligonucleotide

SEQ ID NO: 409075 - DNA, 38 bp, Artificial Sequence; identical to SEQ ID NO: 64260
  Description of Artificial Sequence: Synthetic oligonucleotide

SEQ ID NO: 409076 - DNA, 39 bp, Artificial Sequence; identical to SEQ ID NO: 64261
  Description of Artificial Sequence: Synthetic oligonucleotide

SEQ ID NO: 409077 - DNA, 37 bp, Artificial Sequence; identical to SEQ ID NO: 64262
  Description of Artificial Sequence: Synthetic oligonucleotide

SEQ ID NO: 409078 - DNA, 37 bp, Artificial Sequence; identical to SEQ ID NO: 64263
  Description of Artificial Sequence: Synthetic oligonucleotide

SEQ ID NO: 409079 - DNA, 36 bp, Artificial Sequence; identical to SEQ ID NO: 64264
  Description of Artificial Sequence: Synthetic oligonucleotide

SEQ ID NO: 409080 - DNA, 35 bp, Artificial Sequence; identical to SEQ ID NO: 64265
  Description of Artificial Sequence: Synthetic oligonucleotide

SEQ ID NO: 409081 - DNA, 36 bp, Artificial Sequence; identical to SEQ ID NO: 64266
  Description of Artificial Sequence: Synthetic oligonucleotide

SEQ ID NO: 409082 - DNA, 36 bp, Artificial Sequence; identical to SEQ ID NO: 64267
  Description of Artificial Sequence: Synthetic oligonucleotide

SEQ ID NO: 409083 - DNA, 35 bp, Artificial Sequence; identical to SEQ ID NO: 64268
  Description of Artificial Sequence: Synthetic oligonucleotide

SEQ ID NO: 409084 - DNA, 35 bp, Artificial Sequence; identical to SEQ ID NO: 64269
  Description of Artificial Sequence: Synthetic oligonucleotide

SEQ ID NO: 409085 - DNA, 35 bp, Artificial Sequence; identical to SEQ ID NO: 64270
  Description of Artificial Sequence: Synthetic oligonucleotide

SEQ ID NO: 409086 - DNA, 34 bp, Artificial Sequence; identical to SEQ ID NO: 64271
  Description of Artificial Sequence: Synthetic oligonucleotide

SEQ ID NO: 409087 - DNA, 33 bp, Artificial Sequence; identical to SEQ ID NO: 64272
  Description of Artificial Sequence: Synthetic oligonucleotide

SEQ ID NO: 409088 - DNA, 32 bp, Artificial Sequence; identical to SEQ ID NO: 64273
  Description of Artificial Sequence: Synthetic oligonucleotide

SEQ ID NO: 409089 - DNA, 34 bp, Artificial Sequence; identical to SEQ ID NO: 64274
  Description of Artificial Sequence: Synthetic oligonucleotide

SEQ ID NO: 409090 - DNA, 33 bp, Artificial Sequence; identical to SEQ ID NO: 64275
  Description of Artificial Sequence: Synthetic oligonucleotide

SEQ ID NO: 409091 - DNA, 32 bp, Artificial Sequence; identical to SEQ ID NO: 64276
  Description of Artificial Sequence: Synthetic oligonucleotide

SEQ ID NO: 409092 - DNA, 32 bp, Artificial Sequence; identical to SEQ ID NO: 64277
  Description of Artificial Sequence: Synthetic oligonucleotide

SEQ ID NO: 409093 - DNA, 33 bp, Artificial Sequence; identical to SEQ ID NO: 64278
  Description of Artificial Sequence: Synthetic oligonucleotide

SEQ ID NO: 409094 - DNA, 32 bp, Artificial Sequence; identical to SEQ ID NO: 64279
  Description of Artificial Sequence: Synthetic oligonucleotide

SEQ ID NO: 409095 - DNA, 31 bp, Artificial Sequence; identical to SEQ ID NO: 64280
  Description of Artificial Sequence: Synthetic oligonucleotide

SEQ ID NO: 409096 - DNA, 32 bp, Artificial Sequence; identical to SEQ ID NO: 64281
  Description of Artificial Sequence: Synthetic oligonucleotide

SEQ ID NO: 409097 - DNA, 31 bp, Artificial Sequence; identical to SEQ ID NO: 64282
  Description of Artificial Sequence: Synthetic oligonucleotide

SEQ ID NO: 409098 - DNA, 30 bp, Artificial Sequence; identical to SEQ ID NO: 64283
  Description of Artificial Sequence: Synthetic oligonucleotide

SEQ ID NO: 409099 - DNA, 29 bp, Artificial Sequence
  Description of Artificial Sequence: Synthetic oligonucleotide
aaccaagaggagtacgtgcgcttcgacag

SEQ ID NO: 409100 - DNA, 28 bp, Artificial Sequence
  Description of Artificial Sequence: Synthetic oligonucleotide
accaagaggagtacgtgcgcttcgacag

SEQ ID NO: 409101 - DNA, 27 bp, Artificial Sequence
  Description of Artificial Sequence: Synthetic oligonucleotide
ccaagaggagtacgtgcgcttcgacag

SEQ ID NO: 409102 - DNA, 27 bp, Artificial Sequence
  Description of Artificial Sequence: Synthetic oligonucleotide
caagaggagtacgtgcgcttcgacagc

SEQ ID NO: 409103 - DNA, 27 bp, Artificial Sequence
  Description of Artificial Sequence: Synthetic oligonucleotide
aagaggagtacgtgcgcttcgacagcg

SEQ ID NO: 409104 - DNA, 27 bp, Artificial Sequence
  Description of Artificial Sequence: Synthetic oligonucleotide
cagccagaaggacctcctggagcagaa

SEQ ID NO: 409105 - DNA, 27 bp, Artificial Sequence
  Description of Artificial Sequence: Synthetic oligonucleotide
agccagaaggacctcctggagcagaag

SEQ ID NO: 409106 - DNA, 26 bp, Artificial Sequence
  Description of Artificial Sequence: Synthetic oligonucleotide
gccagaaggacctcctggagcagaag

SEQ ID NO: 409107 - DNA, 26 bp, Artificial Sequence
  Description of Artificial Sequence: Synthetic oligonucleotide
ccagaaggacctcctggagcagaagc

SEQ ID NO: 409108 - DNA, 26 bp, Artificial Sequence
  Description of Artificial Sequence: Synthetic oligonucleotide
cagaaggacctcctggagcagaagcg

SEQ ID NO: 409109 - DNA, 26 bp, Artificial Sequence
  Description of Artificial Sequence: Synthetic oligonucleotide
agaaggacctcctggagcagaagcgg

SEQ ID NO: 409110 - DNA, 25 bp, Artificial Sequence
  Description of Artificial Sequence: Synthetic oligonucleotide
gaaggacctcctggagcagaagcgg

SEQ ID NO: 409111 - DNA, 25 bp, Artificial Sequence
  Description of Artificial Sequence: Synthetic oligonucleotide
aaggacctcctggagcagaagcggg

SEQ ID NO: 409112 - DNA, 24 bp, Artificial Sequence
  Description of Artificial Sequence: Synthetic oligonucleotide
aggacctcctggagcagaagcggg

SEQ ID NO: 409113 - DNA, 23 bp, Artificial Sequence
  Description of Artificial Sequence: Synthetic oligonucleotide
ggacctcctggagcagaagcggg

SEQ ID NO: 409114 - DNA, 23 bp, Artificial Sequence
  Description of Artificial Sequence: Synthetic oligonucleotide
gacctcctggagcagaagcgggc

SEQ ID NO: 409115 - DNA, 23 bp, Artificial Sequence
  Description of Artificial Sequence: Synthetic oligonucleotide
acctcctggagcagaagcgggcc

SEQ ID NO: 409116 - DNA, 22 bp, Artificial Sequence
  Description of Artificial Sequence: Synthetic oligonucleotide
cctcctggagcagaagcgggcc

SEQ ID NO: 409117 - DNA, 22 bp, Artificial Sequence
  Description of Artificial Sequence: Synthetic oligonucleotide
ctcctggagcagaagcgggccg

SEQ ID NO: 409118 - DNA, 22 bp, Artificial Sequence
  Description of Artificial Sequence: Synthetic oligonucleotide
tcctggagcagaagcgggccgc

SEQ ID NO: 409119 - DNA, 21 bp, Artificial Sequence
  Description of Artificial Sequence: Synthetic oligonucleotide
cctggagcagaagcgggccgc

SEQ ID NO: 409120 - DNA, 21 bp, Artificial Sequence
  Description of Artificial Sequence: Synthetic oligonucleotide
ctggagcagaagcgggccgcg

SEQ ID NO: 409121 - DNA, 22 bp, Artificial Sequence
  Description of Artificial Sequence: Synthetic oligonucleotide
tggagcagaagcgggccgcggt

SEQ ID NO: 409122 - DNA, 21 bp, Artificial Sequence
  Description of Artificial Sequence: Synthetic oligonucleotide
ggagcagaagcgggccgcggt

SEQ ID NO: 409123 - DNA, 21 bp, Artificial Sequence
  Description of Artificial Sequence: Synthetic oligonucleotide
gagcagaagcgggccgcggtg

SEQ ID NO: 409124 - DNA, 22 bp, Artificial Sequence
  Description of Artificial Sequence: Synthetic oligonucleotide
agcagaagcgggccgcggtgga

SEQ ID NO: 409125 - DNA, 21 bp, Artificial Sequence
  Description of Artificial Sequence: Synthetic oligonucleotide
gcagaagcgggccgcggtgga

SEQ ID NO: 409126 - DNA, 22 bp, Artificial Sequence
  Description of Artificial Sequence: Synthetic oligonucleotide
cagaagcgggccgcggtggaca

SEQ ID NO: 409127 - DNA, 22 bp, Artificial Sequence
  Description of Artificial Sequence: Synthetic oligonucleotide
agaagcgggccgcggtggacac

SEQ ID NO: 409128 - DNA, 21 bp, Artificial Sequence
  Description of Artificial Sequence: Synthetic oligonucleotide
gaagcgggccgcggtggacac

SEQ ID NO: 409129 - DNA, 23 bp, Artificial Sequence
  Description of Artificial Sequence: Synthetic oligonucleotide
aagcgggccgcggtggacaccta

SEQ ID NO: 409130 - DNA, 32 bp, Artificial Sequence; identical to SEQ ID NO: 64315
  Description of Artificial Sequence: Synthetic oligonucleotide

SEQ ID NO: 409131 - DNA, 33 bp, Artificial Sequence; identical to SEQ ID NO: 64316
  Description of Artificial Sequence: Synthetic oligonucleotide

SEQ ID NO: 409132 - DNA, 32 bp, Artificial Sequence; identical to SEQ ID NO: 64317
  Description of Artificial Sequence: Synthetic oligonucleotide

SEQ ID NO: 409133 - DNA, 33 bp, Artificial Sequence; identical to SEQ ID NO: 64318
  Description of Artificial Sequence: Synthetic oligonucleotide

SEQ ID NO: 409134 - DNA, 32 bp, Artificial Sequence; identical to SEQ ID NO: 64319
  Description of Artificial Sequence: Synthetic oligonucleotide

SEQ ID NO: 409135 - DNA, 31 bp, Artificial Sequence; identical to SEQ ID NO: 64320
  Description of Artificial Sequence: Synthetic oligonucleotide

SEQ ID NO: 409136 - DNA, 26 bp, Artificial Sequence
  Description of Artificial Sequence: Synthetic oligonucleotide
cagaaggacctcctggagcagaggct

SEQ ID NO: 409137 - DNA, 26 bp, Artificial Sequence
  Description of Artificial Sequence: Synthetic oligonucleotide
agaaggacctcctggagcagaggctg

SEQ ID NO: 409138 - DNA, 25 bp, Artificial Sequence
  Description of Artificial Sequence: Synthetic oligonucleotide
gaaggacctcctggagcagaggctg

SEQ ID NO: 409139 - DNA, 25 bp, Artificial Sequence
  Description of Artificial Sequence: Synthetic oligonucleotide
aaggacctcctggagcagaggctgg

SEQ ID NO: 409140 - DNA, 24 bp, Artificial Sequence
  Description of Artificial Sequence: Synthetic oligonucleotide
aggacctcctggagcagaggctgg

SEQ ID NO: 409141 - DNA, 23 bp, Artificial Sequence
  Description of Artificial Sequence: Synthetic oligonucleotide
ggacctcctggagcagaggctgg

SEQ ID NO: 409142 - DNA, 23 bp, Artificial Sequence
  Description of Artificial Sequence: Synthetic oligonucleotide
gacctcctggagcagaggctggc

SEQ ID NO: 409143 - DNA, 23 bp, Artificial Sequence
  Description of Artificial Sequence: Synthetic oligonucleotide
acctcctggagcagaggctggcc

SEQ ID NO: 409144 - DNA, 22 bp, Artificial Sequence
  Description of Artificial Sequence: Synthetic oligonucleotide
cctcctggagcagaggctggcc

SEQ ID NO: 409145 - DNA, 22 bp, Artificial Sequence
  Description of Artificial Sequence: Synthetic oligonucleotide
ctcctggagcagaggctggccg

SEQ ID NO: 409146 - DNA, 22 bp, Artificial Sequence
  Description of Artificial Sequence: Synthetic oligonucleotide
tcctggagcagaggctggccgc

SEQ ID NO: 409147 - DNA, 21 bp, Artificial Sequence
  Description of Artificial Sequence: Synthetic oligonucleotide
cctggagcagaggctggccgc

SEQ ID NO: 409148 - DNA, 21 bp, Artificial Sequence
  Description of Artificial Sequence: Synthetic oligonucleotide
ctggagcagaggctggccgcg

SEQ ID NO: 409149 - DNA, 22 bp, Artificial Sequence
  Description of Artificial Sequence: Synthetic oligonucleotide
tggagcagaggctggccgcggt

SEQ ID NO: 409150 - DNA, 21 bp, Artificial Sequence
  Description of Artificial Sequence: Synthetic oligonucleotide
ggagcagaggctggccgcggt

SEQ ID NO: 409151 - DNA, 21 bp, Artificial Sequence
  Description of Artificial Sequence: Synthetic oligonucleotide
gagcagaggctggccgcggtg

SEQ ID NO: 409152 - DNA, 22 bp, Artificial Sequence
  Description of Artificial Sequence: Synthetic oligonucleotide
agcagaggctggccgcggtgga

SEQ ID NO: 409153 - DNA, 21 bp, Artificial Sequence
  Description of Artificial Sequence: Synthetic oligonucleotide
gcagaggctggccgcggtgga

SEQ ID NO: 409154 - DNA, 22 bp, Artificial Sequence
  Description of Artificial Sequence: Synthetic oligonucleotide
cagaggctggccgcggtggaca

SEQ ID NO: 409155 - DNA, 22 bp, Artificial Sequence
  Description of Artificial Sequence: Synthetic oligonucleotide
agaggctggccgcggtggacac

SEQ ID NO: 409156 - DNA, 21 bp, Artificial Sequence
  Description of Artificial Sequence: Synthetic oligonucleotide
gaggctggccgcggtggacac

SEQ ID NO: 409157 - DNA, 23 bp, Artificial Sequence
  Description of Artificial Sequence: Synthetic oligonucleotide
aggctggccgcggtggacaccta

SEQ ID NO: 409158 - DNA, 22 bp, Artificial Sequence
  Description of Artificial Sequence: Synthetic oligonucleotide
ggctggccgcggtggacaccta

SEQ ID NO: 409159 - DNA, 23 bp, Artificial Sequence
  Description of Artificial Sequence: Synthetic oligonucleotide
gctggccgcggtggacacctact

SEQ ID NO: 409160 - DNA, 23 bp, Artificial Sequence
  Description of Artificial Sequence: Synthetic oligonucleotide
ctggccgcggtggacacctactg

SEQ ID NO: 409161 - DNA, 24 bp, Artificial Sequence
  Description of Artificial Sequence: Synthetic oligonucleotide
tggccgcggtggacacctactgca

SEQ ID NO: 409162 - DNA, 43 bp, Artificial Sequence; identical to SEQ ID NO: 64347
  Description of Artificial Sequence: Synthetic oligonucleotide

SEQ ID NO: 409163 - DNA, 42 bp, Artificial Sequence; identical to SEQ ID NO: 64348
  Description of Artificial Sequence: Synthetic oligonucleotide

SEQ ID NO: 409164 - DNA, 42 bp, Artificial Sequence; identical to SEQ ID NO: 64349
  Description of Artificial Sequence: Synthetic oligonucleotide

SEQ ID NO: 409165 - DNA, 42 bp, Artificial Sequence; identical to SEQ ID NO: 64350
  Description of Artificial Sequence: Synthetic oligonucleotide

SEQ ID NO: 409166 - DNA, 41 bp, Artificial Sequence; identical to SEQ ID NO: 64351
  Description of Artificial Sequence: Synthetic oligonucleotide

SEQ ID NO: 409167 - DNA, 40 bp, Artificial Sequence; identical to SEQ ID NO: 64352
  Description of Artificial Sequence: Synthetic oligonucleotide

SEQ ID NO: 409168 - DNA, 39 bp, Artificial Sequence; identical to SEQ ID NO: 64353
  Description of Artificial Sequence: Synthetic oligonucleotide

SEQ ID NO: 409169 - DNA, 39 bp, Artificial Sequence; identical to SEQ ID NO: 64354
  Description of Artificial Sequence: Synthetic oligonucleotide

SEQ ID NO: 409170 - DNA, 38 bp, Artificial Sequence; identical to SEQ ID NO: 64355
  Description of Artificial Sequence: Synthetic oligonucleotide

SEQ ID NO: 409171 - DNA, 37 bp, Artificial Sequence; identical to SEQ ID NO: 64356
  Description of Artificial Sequence: Synthetic oligonucleotide

SEQ ID NO: 409172 - DNA, 38 bp, Artificial Sequence; identical to SEQ ID NO: 64357
  Description of Artificial Sequence: Synthetic oligonucleotide

SEQ ID NO: 409173 - DNA, 37 bp, Artificial Sequence; identical to SEQ ID NO: 64358
  Description of Artificial Sequence: Synthetic oligonucleotide

SEQ ID NO: 409174 - DNA, 37 bp, Artificial Sequence; identical to SEQ ID NO: 64359
  Description of Artificial Sequence: Synthetic oligonucleotide

SEQ ID NO: 409175 - DNA, 37 bp, Artificial Sequence; identical to SEQ ID NO: 64360
  Description of Artificial Sequence: Synthetic oligonucleotide

SEQ ID NO: 409176 - DNA, 38 bp, Artificial Sequence; identical to SEQ ID NO: 64361
  Description of Artificial Sequence: Synthetic oligonucleotide

SEQ ID NO: 409177 - DNA, 37 bp, Artificial Sequence; identical to SEQ ID NO: 64362
  Description of Artificial Sequence: Synthetic oligonucleotide

SEQ ID NO: 409178 - DNA, 37 bp, Artificial Sequence; identical to SEQ ID NO: 64363
  Description of Artificial Sequence: Synthetic oligonucleotide

SEQ ID NO: 409179 - DNA, 37 bp, Artificial Sequence; identical to SEQ ID NO: 64364
  Description of Artificial Sequence: Synthetic oligonucleotide

SEQ ID NO: 409180 - DNA, 36 bp, Artificial Sequence; identical to SEQ ID NO: 64365
  Description of Artificial Sequence: Synthetic oligonucleotide

SEQ ID NO: 409181 - DNA, 35 bp, Artificial Sequence; identical to SEQ ID NO: 64366
  Description of Artificial Sequence: Synthetic oligonucleotide

SEQ ID NO: 409182 - DNA, 34 bp, Artificial Sequence; identical to SEQ ID NO: 64367
  Description of Artificial Sequence: Synthetic oligonucleotide

SEQ ID NO: 409183 - DNA, 33 bp, Artificial Sequence; identical to SEQ ID NO: 64368
  Description of Artificial Sequence: Synthetic oligonucleotide

SEQ ID NO: 409184 - DNA, 33 bp, Artificial Sequence; identical to SEQ ID NO: 64369
  Description of Artificial Sequence: Synthetic oligonucleotide

SEQ ID NO: 409185 - DNA, 32 bp, Artificial Sequence; identical to SEQ ID NO: 64370
  Description of Artificial Sequence: Synthetic oligonucleotide

SEQ ID NO: 409186 - DNA, 31 bp, Artificial Sequence; identical to SEQ ID NO: 64371
  Description of Artificial Sequence: Synthetic oligonucleotide

SEQ ID NO: 409187 - DNA, 30 bp, Artificial Sequence; identical to SEQ ID NO: 64372
  Description of Artificial Sequence: Synthetic oligonucleotide

SEQ ID NO: 409188 - DNA, 30 bp, Artificial Sequence; identical to SEQ ID NO: 64373
  Description of Artificial Sequence: Synthetic oligonucleotide

SEQ ID NO: 409189 - DNA, 29 bp, Artificial Sequence
  Description of Artificial Sequence: Synthetic oligonucleotide
atgtcatttcttcaacgggacggagcggg

SEQ ID NO: 409190 - DNA, 28 bp, Artificial Sequence
  Description of Artificial Sequence: Synthetic oligonucleotide
tgtcatttcttcaacgggacggagcggg

SEQ ID NO: 409191 - DNA, 27 bp, Artificial Sequence
  Description of Artificial Sequence: Synthetic oligonucleotide
gtcatttcttcaacgggacggagcggg

SEQ ID NO: 409192 - DNA, 28 bp, Artificial Sequence
  Description of Artificial Sequence: Synthetic oligonucleotide
tcatttcttcaacgggacggagcgggtg

SEQ ID NO: 409193 - DNA, 27 bp, Artificial Sequence
  Description of Artificial Sequence: Synthetic oligonucleotide
catttcttcaacgggacggagcgggtg

SEQ ID NO: 409194 - DNA, 27 bp, Artificial Sequence
  Description of Artificial Sequence: Synthetic oligonucleotide
atttcttcaacgggacggagcgggtgc

SEQ ID NO: 409195 - DNA, 27 bp, Artificial Sequence
  Description of Artificial Sequence: Synthetic oligonucleotide
tttcttcaacgggacggagcgggtgca

SEQ ID NO: 409196 - DNA, 26 bp, Artificial Sequence
  Description of Artificial Sequence: Synthetic oligonucleotide
ttcttcaacgggacggagcgggtgca

SEQ ID NO: 409197 - DNA, 25 bp, Artificial Sequence
  Description of Artificial Sequence: Synthetic oligonucleotide
tcttcaacgggacggagcgggtgca

SEQ ID NO: 409198 - DNA, 24 bp, Artificial Sequence
  Description of Artificial Sequence: Synthetic oligonucleotide
cttcaacgggacggagcgggtgca

SEQ ID NO: 409199 - DNA, 26 bp, Artificial Sequence
  Description of Artificial Sequence: Synthetic oligonucleotide
ttcaacgggacggagcgggtgcagtt

SEQ ID NO: 409200 - DNA, 25 bp, Artificial Sequence
  Description of Artificial Sequence: Synthetic oligonucleotide
tcaacgggacggagcgggtgcagtt

SEQ ID NO: 409201 - DNA, 24 bp, Artificial Sequence
  Description of Artificial Sequence: Synthetic oligonucleotide
caacgggacggagcgggtgcagtt

SEQ ID NO: 409202 - DNA, 24 bp, Artificial Sequence
  Description of Artificial Sequence: Synthetic oligonucleotide
aacgggacggagcgggtgcagttc

SEQ ID NO: 409203 - DNA, 23 bp, Artificial Sequence
  Description of Artificial Sequence: Synthetic oligonucleotide
acgggacggagcgggtgcagttc

SEQ ID NO: 409204 - DNA, 22 bp, Artificial Sequence
  Description of Artificial Sequence: Synthetic oligonucleotide
cgggacggagcgggtgcagttc

SEQ ID NO: 409205 - DNA, 23 bp, Artificial Sequence
  Description of Artificial Sequence: Synthetic oligonucleotide
gggacggagcgggtgcagttcct

SEQ ID NO: 409206 - DNA, 23 bp, Artificial Sequence
  Description of Artificial Sequence: Synthetic oligonucleotide
ggacggagcgggtgcagttcctg

SEQ ID NO: 409207 - DNA, 26 bp, Artificial Sequence
  Description of Artificial Sequence: Synthetic oligonucleotide
gacggagcgggtgcagttcctggaaa

SEQ ID NO: 409208 - DNA, 27 bp, Artificial Sequence
  Description of Artificial Sequence: Synthetic oligonucleotide
acggagcgggtgcagttcctggaaaga

SEQ ID NO: 409209 - DNA, 26 bp, Artificial Sequence
  Description of Artificial Sequence: Synthetic oligonucleotide
cggagcgggtgcagttcctggaaaga

SEQ ID NO: 409210 - DNA, 27 bp, Artificial Sequence
  Description of Artificial Sequence: Synthetic oligonucleotide
ggagcgggtgcagttcctggaaagact

SEQ ID NO: 409211 - DNA, 27 bp, Artificial Sequence
  Description of Artificial Sequence: Synthetic oligonucleotide
gagcgggtgcagttcctggaaagactc

SEQ ID NO: 409212 - DNA, 29 bp, Artificial Sequence
  Description of Artificial Sequence: Synthetic oligonucleotide
agcgggtgcagttcctggaaagactcttc

SEQ ID NO: 409213 - DNA, 28 bp, Artificial Sequence
  Description of Artificial Sequence: Synthetic oligonucleotide
gcgggtgcagttcctggaaagactcttc

SEQ ID NO: 409214 - DNA, 33 bp, Artificial Sequence; identical to SEQ ID NO: 64399
  Description of Artificial Sequence: Synthetic oligonucleotide

SEQ ID NO: 409215 - DNA, 33 bp, Artificial Sequence; identical to SEQ ID NO: 64400
  Description of Artificial Sequence: Synthetic oligonucleotide

SEQ ID NO: 409216 - DNA, 35 bp, Artificial Sequence; identical to SEQ ID NO: 64401
  Description of Artificial Sequence: Synthetic oligonucleotide

SEQ ID NO: 409217 - DNA, 36 bp, Artificial Sequence; identical to SEQ ID NO: 64402
  Description of Artificial Sequence: Synthetic oligonucleotide

SEQ ID NO: 409218 - DNA, 36 bp, Artificial Sequence; identical to SEQ ID NO: 64403
  Description of Artificial Sequence: Synthetic oligonucleotide

SEQ ID NO: 409219 - DNA, 35 bp, Artificial Sequence; identical to SEQ ID NO: 64404
  Description of Artificial Sequence: Synthetic oligonucleotide

SEQ ID NO: 409220 - DNA, 36 bp, Artificial Sequence; identical to SEQ ID NO: 64405
  Description of Artificial Sequence: Synthetic oligonucleotide

SEQ ID NO: 409221 - DNA, 37 bp, Artificial Sequence; identical to SEQ ID NO: 64406
  Description of Artificial Sequence: Synthetic oligonucleotide

SEQ ID NO: 409222 - DNA, 36 bp, Artificial Sequence; identical to SEQ ID NO: 64407
  Description of Artificial Sequence: Synthetic oligonucleotide

SEQ ID NO: 409223 - DNA, 36 bp, Artificial Sequence; identical to SEQ ID NO: 64408
  Description of Artificial Sequence: Synthetic oligonucleotide

SEQ ID NO: 409224 - DNA, 35 bp, Artificial Sequence; identical to SEQ ID NO: 64409
  Description of Artificial Sequence: Synthetic oligonucleotide

SEQ ID NO: 409225 - DNA, 34 bp, Artificial Sequence; identical to SEQ ID NO: 64410
  Description of Artificial Sequence: Synthetic oligonucleotide

SEQ ID NO: 409226 - DNA, 34 bp, Artificial Sequence; identical to SEQ ID NO: 64411
  Description of Artificial Sequence: Synthetic oligonucleotide

SEQ ID NO: 409227 - DNA, 35 bp, Artificial Sequence; identical to SEQ ID NO: 64412
  Description of Artificial Sequence: Synthetic oligonucleotide

SEQ ID NO: 409228 - DNA, 34 bp, Artificial Sequence; identical to SEQ ID NO: 64413
  Description of Artificial Sequence: Synthetic oligonucleotide

SEQ ID NO: 409229 - DNA, 34 bp, Artificial Sequence; identical to SEQ ID NO: 64414
  Description of Artificial Sequence: Synthetic oligonucleotide

SEQ ID NO: 409230 - DNA, 34 bp, Artificial Sequence; identical to SEQ ID NO: 64415
  Description of Artificial Sequence: Synthetic oligonucleotide

SEQ ID NO: 409231 - DNA, 33 bp, Artificial Sequence; identical to SEQ ID NO: 64416
  Description of Artificial Sequence: Synthetic oligonucleotide

SEQ ID NO: 409232 - DNA, 32 bp, Artificial Sequence; identical to SEQ ID NO: 64417
  Description of Artificial Sequence: Synthetic oligonucleotide

SEQ ID NO: 409233 - DNA, 31 bp, Artificial Sequence; identical to SEQ ID NO: 64418
  Description of Artificial Sequence: Synthetic oligonucleotide

SEQ ID NO: 409234 - DNA, 31 bp, Artificial Sequence; identical to SEQ ID NO: 64419
  Description of Artificial Sequence: Synthetic oligonucleotide

SEQ ID NO: 409235 - DNA, 30 bp, Artificial Sequence; identical to SEQ ID NO: 64420
  Description of Artificial Sequence: Synthetic oligonucleotide

SEQ ID NO: 409236 - DNA, 32 bp, Artificial Sequence; identical to SEQ ID NO: 64421
  Description of Artificial Sequence: Synthetic oligonucleotide

SEQ ID NO: 409237 - DNA, 31 bp, Artificial Sequence; identical to SEQ ID NO: 64422
  Description of Artificial Sequence: Synthetic oligonucleotide

SEQ ID NO: 409238 - DNA, 31 bp, Artificial Sequence; identical to SEQ ID NO: 64423
  Description of Artificial Sequence: Synthetic oligonucleotide

SEQ ID NO: 409239 - DNA, 20 bp, Artificial Sequence
  Description of Artificial Sequence: Synthetic oligonucleotide
tggggcggcctgctgcggag

SEQ ID NO: 409240 - DNA, 20 bp, Artificial Sequence
  Description of Artificial Sequence: Synthetic oligonucleotide
ggggcggcctgctgcggagt

SEQ ID NO: 409241 - DNA, 20 bp, Artificial Sequence
  Description of Artificial Sequence: Synthetic oligonucleotide
gggcggcctgctgcggagca

SEQ ID NO: 409242 - DNA, 21 bp, Artificial Sequence
  Description of Artificial Sequence: Synthetic oligonucleotide
ggcggcctgctgcggagcact

SEQ ID NO: 409243 - DNA, 21 bp, Artificial Sequence
  Description of Artificial Sequence: Synthetic oligonucleotide
gcggcctgctgcggagcactg

SEQ ID NO: 409244 - DNA, 23 bp, Artificial Sequence
  Description of Artificial Sequence: Synthetic oligonucleotide
cggcctgctgcggagcactggaa

SEQ ID NO: 409245 - DNA, 24 bp, Artificial Sequence
  Description of Artificial Sequence: Synthetic oligonucleotide
ggcctgctgcggagcactggaaca

SEQ ID NO: 409246 - DNA, 24 bp, Artificial Sequence
  Description of Artificial Sequence: Synthetic oligonucleotide
gcctgctgcggagcactggaacag

SEQ ID NO: 409247 - DNA, 24 bp, Artificial Sequence
  Description of Artificial Sequence: Synthetic oligonucleotide
cctgctgcggagcactggaacagc

SEQ ID NO: 409248 - DNA, 25 bp, Artificial Sequence
  Description of Artificial Sequence: Synthetic oligonucleotide
ctgctgcggagcactggaacagcca

SEQ ID NO: 409249 - DNA, 27 bp, Artificial Sequence
  Description of Artificial Sequence: Synthetic oligonucleotide
tgctgcggagcactggaacagccagaa

SEQ ID NO: 409250 - DNA, 26 bp, Artificial Sequence
  Description of Artificial Sequence: Synthetic oligonucleotide
gctgcggagcactggaacagccagaa

SEQ ID NO: 409251 - DNA, 26 bp, Artificial Sequence
  Description of Artificial Sequence: Synthetic oligonucleotide
ctgcggagcactggaacagccagaag

SEQ ID NO: 409252 - DNA, 27 bp, Artificial Sequence
  Description of Artificial Sequence: Synthetic oligonucleotide
tgcggagcactggaacagccagaagga

SEQ ID NO: 409253 - DNA, 26 bp, Artificial Sequence
  Description of Artificial Sequence: Synthetic oligonucleotide
gcggagcactggaacagccagaagga

SEQ ID NO: 409254 - DNA, 26 bp, Artificial Sequence
  Description of Artificial Sequence: Synthetic oligonucleotide
cggagcactggaacagccagaaggac

SEQ ID NO: 409255 - DNA, 27 bp, Artificial Sequence
  Description of Artificial Sequence: Synthetic oligonucleotide
ggagcactggaacagccagaaggacct

SEQ ID NO: 409256 - DNA, 27 bp, Artificial Sequence
  Description of Artificial Sequence: Synthetic oligonucleotide
gagcactggaacagccagaaggacctc

SEQ ID NO: 409257 - DNA, 27 bp, Artificial Sequence
  Description of Artificial Sequence: Synthetic oligonucleotide
agcactggaacagccagaaggacctcc

SEQ ID NO: 409258 - DNA, 27 bp, Artificial Sequence
  Description of Artificial Sequence: Synthetic oligonucleotide
gcactggaacagccagaaggacctcct

SEQ ID NO: 409259 - DNA, 27 bp, Artificial Sequence
  Description of Artificial Sequence: Synthetic oligonucleotide
cactggaacagccagaaggacctcctg

SEQ ID NO: 409260 - DNA, 28 bp, Artificial Sequence
  Description of Artificial Sequence: Synthetic oligonucleotide
tggaacagccagaaggacatcctggagc

SEQ ID NO: 409261 - DNA, 27 bp, Artificial Sequence
  Description of Artificial Sequence: Synthetic oligonucleotide
ggaacagccagaaggacatcctggagc

SEQ ID NO: 409262 - DNA, 28 bp, Artificial Sequence
  Description of Artificial Sequence: Synthetic oligonucleotide
gaacagccagaaggacatcctggagcag

SEQ ID NO: 409263 - DNA, 28 bp, Artificial Sequence
  Description of Artificial Sequence: Synthetic oligonucleotide
aacagccagaaggacatcctggagcagg

SEQ ID NO: 409264 - DNA, 27 bp, Artificial Sequence
  Description of Artificial Sequence: Synthetic oligonucleotide
acagccagaaggacatcctggagcagg

SEQ ID NO: 409265 - DNA, 26 bp, Artificial Sequence
  Description of Artificial Sequence: Synthetic oligonucleotide
cagccagaaggacatcctggagcagg

SEQ ID NO: 409266 - DNA, 26 bp, Artificial Sequence
  Description of Artificial Sequence: Synthetic oligonucleotide
agccagaaggacatcctggagcaggc

SEQ ID NO: 409267 - DNA, 25 bp, Artificial Sequence
  Description of Artificial Sequence: Synthetic oligonucleotide
gccagaaggacatcctggagcaggc

SEQ ID NO: 409268 - DNA, 25 bp, Artificial Sequence
  Description of Artificial Sequence: Synthetic oligonucleotide
ccagaaggacatcctggagcaggcg

SEQ ID NO: 409269 - DNA, 25 bp, Artificial Sequence
  Description of Artificial Sequence: Synthetic oligonucleotide
cagaaggacatcctggagcaggcgc

SEQ ID NO: 409270 - DNA, 25 bp, Artificial Sequence
  Description of Artificial Sequence: Synthetic oligonucleotide
agaaggacatcctggagcaggcgcg

SEQ ID NO: 409271 - DNA, 24 bp, Artificial Sequence
  Description of Artificial Sequence: Synthetic oligonucleotide
gaaggacatcctggagcaggcgcg

SEQ ID NO: 409272 - DNA, 24 bp, Artificial Sequence
  Description of Artificial Sequence: Synthetic oligonucleotide
aaggacatcctggagcaggcgcgg

SEQ ID NO: 409273 - DNA, 23 bp, Artificial Sequence
  Description of Artificial Sequence: Synthetic oligonucleotide
aggacatcctggagcaggcgcgg

SEQ ID NO: 409274 - DNA, 22 bp, Artificial Sequence
  Description of Artificial Sequence: Synthetic oligonucleotide
ggacatcctggagcaggcgcgg

SEQ ID NO: 409275 - DNA, 22 bp, Artificial Sequence
  Description of Artificial Sequence: Synthetic oligonucleotide
gacatcctggagcaggcgcggg

SEQ ID NO: 409276 - DNA, 22 bp, Artificial Sequence
  Description of Artificial Sequence: Synthetic oligonucleotide
acatcctggagcaggcgcgggc

SEQ ID NO: 409277 - DNA, 21 bp, Artificial Sequence
  Description of Artificial Sequence: Synthetic oligonucleotide
catcctggagcaggcgcgggc

SEQ ID NO: 409278 - DNA, 21 bp, Artificial Sequence
  Description of Artificial Sequence: Synthetic oligonucleotide
atcctggagcaggcgcgggcc

SEQ ID NO: 409279 - DNA, 23 bp, Artificial Sequence
  Description of Artificial Sequence: Synthetic oligonucleotide
gacctcctggagcagaagcgggg

SEQ ID NO: 409280 - DNA, 23 bp, Artificial Sequence
  Description of Artificial Sequence: Synthetic oligonucleotide
acctcctggagcagaagcggggc

SEQ ID NO: 409281 - DNA, 22 bp, Artificial Sequence
  Description of Artificial Sequence: Synthetic oligonucleotide
cctcctggagcagaagcggggc

SEQ ID NO: 409282 - DNA, 22 bp, Artificial Sequence
  Description of Artificial Sequence: Synthetic oligonucleotide
ctcctggagcagaagcggggcc

SEQ ID NO: 409283 - DNA, 22 bp, Artificial Sequence
  Description of Artificial Sequence: Synthetic oligonucleotide
tcctggagcagaagcggggccg

SEQ ID NO: 409284 - DNA, 21 bp, Artificial Sequence
  Description of Artificial Sequence: Synthetic oligonucleotide
cctggagcagaagcggggccg

SEQ ID NO: 409285 - DNA, 21 bp, Artificial Sequence
  Description of Artificial Sequence: Synthetic oligonucleotide
ctggagcagaagcggggccgg

SEQ ID NO: 409286 - DNA, 22 bp, Artificial Sequence
  Description of Artificial Sequence: Synthetic oligonucleotide
tggagcagaagcggggccgggt

SEQ ID NO: 409287 - DNA, 21 bp, Artificial Sequence
  Description of Artificial Sequence: Synthetic oligonucleotide
ggagcagaagcggggccgggt

SEQ ID NO: 409288 - DNA, 21 bp, Artificial Sequence
  Description of Artificial Sequence: Synthetic oligonucleotide
gagcagaagcggggccgggtg

SEQ ID NO: 409289 - DNA, 22 bp, Artificial Sequence
  Description of Artificial Sequence: Synthetic oligonucleotide
agcagaagcggggccgggtgga

SEQ ID NO: 409290 - DNA, 21 bp, Artificial Sequence
  Description of Artificial Sequence: Synthetic oligonucleotide
gcagaagcggggccgggtgga

SEQ ID NO: 409291 - DNA, 23 bp, Artificial Sequence
  Description of Artificial Sequence: Synthetic oligonucleotide
cagaagcggggccgggtggacaa

SEQ ID NO: 409292 - DNA, 25 bp, Artificial Sequence
  Description of Artificial Sequence: Synthetic oligonucleotide
agaagcggggccgggtggacaacta

SEQ ID NO: 409293 - DNA, 24 bp, Artificial Sequence
  Description of Artificial Sequence: Synthetic oligonucleotide
gaagcggggccgggtggacaacta

SEQ ID NO: 409294 - DNA, 25 bp, Artificial Sequence
  Description of Artificial Sequence: Synthetic oligonucleotide
aagcggggccgggtggacaactact

SEQ ID NO: 409295 - DNA, 24 bp, Artificial Sequence
  Description of Artificial Sequence: Synthetic oligonucleotide
agcggggccgggtggacaactact

SEQ ID NO: 409296 - DNA, 23 bp, Artificial Sequence
  Description of Artificial Sequence: Synthetic oligonucleotide
gcggggccgggtggacaactact

SEQ ID NO: 409297 - DNA, 23 bp, Artificial Sequence
  Description of Artificial Sequence: Synthetic oligonucleotide
cggggccgggtggacaactactg

SEQ ID NO: 409298 - DNA, 24 bp, Artificial Sequence
  Description of Artificial Sequence: Synthetic oligonucleotide
ggggccgggtggacaactactgca

SEQ ID NO: 409299 - DNA, 25 bp, Artificial Sequence
  Description of Artificial Sequence: Synthetic oligonucleotide
gggccgggtggacaactactgcaga

SEQ ID NO: 409300 - DNA, 26 bp, Artificial Sequence
  Description of Artificial Sequence: Synthetic oligonucleotide
ggccgggtggacaactactgcagaca

SEQ ID NO: 409301 - DNA, 27 bp, Artificial Sequence
  Description of Artificial Sequence: Synthetic oligonucleotide
gccgggtggacaactactgcagacaca

SEQ ID NO: 409302 - DNA, 28 bp, Artificial Sequence
  Description of Artificial Sequence: Synthetic oligonucleotide
ccgggtggacaactactgcagacacaac

SEQ ID NO: 409303 - DNA, 30 bp, Artificial Sequence; identical to SEQ ID NO: 64488
  Description of Artificial Sequence: Synthetic oligonucleotide

SEQ ID NO: 409304 - DNA, 30 bp, Artificial Sequence; identical to SEQ ID NO: 64489
  Description of Artificial Sequence: Synthetic oligonucleotide

SEQ ID NO: 409305 - DNA, 30 bp, Artificial Sequence; identical to SEQ ID NO: 64490
  Description of Artificial Sequence: Synthetic oligonucleotide

SEQ ID NO: 409306 - DNA, 30 bp, Artificial Sequence; identical to SEQ ID NO: 64491
  Description of Artificial Sequence: Synthetic oligonucleotide

SEQ ID NO: 409307 - DNA, 30 bp, Artificial Sequence; identical to SEQ ID NO: 64492
  Description of Artificial Sequence: Synthetic oligonucleotide

SEQ ID NO: 409308 - DNA, 29 bp, Artificial Sequence
  Description of Artificial Sequence: Synthetic oligonucleotide
ggacaactactgcagacacaactacgggg

SEQ ID NO: 409309 - DNA, 31 bp, Artificial Sequence; identical to SEQ ID NO: 64494
  Description of Artificial Sequence: Synthetic oligonucleotide

SEQ ID NO: 409310 - DNA, 31 bp, Artificial Sequence; identical to SEQ ID NO: 64495
  Description of Artificial Sequence: Synthetic oligonucleotide

SEQ ID NO: 409311 - DNA, 30 bp, Artificial Sequence; identical to SEQ ID NO: 64496
  Description of Artificial Sequence: Synthetic oligonucleotide

SEQ ID NO: 409312 - DNA, 31 bp, Artificial Sequence; identical to SEQ ID NO: 64497
  Description of Artificial Sequence: Synthetic oligonucleotide

SEQ ID NO: 409313 - DNA, 30 bp, Artificial Sequence; identical to SEQ ID NO: 64498
  Description of Artificial Sequence: Synthetic oligonucleotide

SEQ ID NO: 409314 - DNA, 22 bp, Artificial Sequence
  Description of Artificial Sequence: Synthetic oligonucleotide
tcctggagcagaggcgggccga

SEQ ID NO: 409315 - DNA, 21 bp, Artificial Sequence
  Description of Artificial Sequence: Synthetic oligonucleotide
cctggagcagaggcgggccga

SEQ ID NO: 409316 - DNA, 21 bp, Artificial Sequence
  Description of Artificial Sequence: Synthetic oligonucleotide
ctggagcagaggcgggccgag

SEQ ID NO: 409317 - DNA, 22 bp, Artificial Sequence
  Description of Artificial Sequence: Synthetic oligonucleotide
tggagcagaggcgggccgaggt

SEQ ID NO: 409318 - DNA, 21 bp, Artificial Sequence
  Description of Artificial Sequence: Synthetic oligonucleotide
ggagcagaggcgggccgaggt

SEQ ID NO: 409319 - DNA, 21 bp, Artificial Sequence
  Description of Artificial Sequence: Synthetic oligonucleotide
gagcagaggcgggccgaggtg

SEQ ID NO: 409320 - DNA, 22 bp, Artificial Sequence
  Description of Artificial Sequence: Synthetic oligonucleotide
agcagaggcgggccgaggtgga

SEQ ID NO: 409321 - DNA, 21 bp, Artificial Sequence
  Description of Artificial Sequence: Synthetic oligonucleotide
gcagaggcgggccgaggtgga

SEQ ID NO: 409322 - DNA, 22 bp, Artificial Sequence
  Description of Artificial Sequence: Synthetic oligonucleotide
cagaggcgggccgaggtggaca

SEQ ID NO: 409323 - DNA, 22 bp, Artificial Sequence
  Description of Artificial Sequence: Synthetic oligonucleotide
agaggcgggccgaggtggacac

SEQ ID NO: 409324 - DNA, 21 bp, Artificial Sequence
  Description of Artificial Sequence: Synthetic oligonucleotide
gaggcgggccgaggtggacac

SEQ ID NO: 409325 - DNA, 23 bp, Artificial Sequence
  Description of Artificial Sequence: Synthetic oligonucleotide
aggcgggccgaggtggacaccta

SEQ ID NO: 409326 - DNA, 22 bp, Artificial Sequence
  Description of Artificial Sequence: Synthetic oligonucleotide
ggcgggccgaggtggacaccta

SEQ ID NO: 409327 - DNA, 23 bp, Artificial Sequence
  Description of Artificial Sequence: Synthetic oligonucleotide
gcgggccgaggtggacacctact

SEQ ID NO: 409328 - DNA, 23 bp, Artificial Sequence
  Description of Artificial Sequence: Synthetic oligonucleotide
cgggccgaggtggacacctactg

SEQ ID NO: 409329 - DNA, 24 bp, Artificial Sequence
  Description of Artificial Sequence: Synthetic oligonucleotide
gggccgaggtggacacctactgca

SEQ ID NO: 409330 - DNA, 25 bp, Artificial Sequence
  Description of Artificial Sequence: Synthetic oligonucleotide
ggccgaggtggacacctactgcaga

SEQ ID NO: 409331 - DNA, 26 bp, Artificial Sequence
  Description of Artificial Sequence: Synthetic oligonucleotide
gccgaggtggacacctactgcagaca

SEQ ID NO: 409332 - DNA, 27 bp, Artificial Sequence
  Description of Artificial Sequence: Synthetic oligonucleotide
ccgaggtggacacctactgcagacaca

SEQ ID NO: 409333 - DNA, 28 bp, Artificial Sequence
  Description of Artificial Sequence: Synthetic oligonucleotide
cgaggtggacacctactgcagacacaac

SEQ ID NO: 409334 - DNA, 30 bp, Artificial Sequence; identical to SEQ ID NO: 64519
  Description of Artificial Sequence: Synthetic oligonucleotide

SEQ ID NO: 409335 - DNA, 30 bp, Artificial Sequence; identical to SEQ ID NO: 64520
  Description of Artificial Sequence: Synthetic oligonucleotide

SEQ ID NO: 409336 - DNA, 22 bp, Artificial Sequence
  Description of Artificial Sequence: Synthetic oligonucleotide
agcagaggcgggccgcggtgaa

SEQ ID NO: 409337 - DNA, 21 bp, Artificial Sequence
  Description of Artificial Sequence: Synthetic oligonucleotide
gcagaggcgggccgcggtgaa

SEQ ID NO: 409338 - DNA, 22 bp, Artificial Sequence
  Description of Artificial Sequence: Synthetic oligonucleotide
cagaggcgggccgcggtgaaca

SEQ ID NO: 409339 - DNA, 22 bp, Artificial Sequence
  Description of Artificial Sequence: Synthetic oligonucleotide
agaggcgggccgcggtgaacac

SEQ ID NO: 409340 - DNA, 21 bp, Artificial Sequence
  Description of Artificial Sequence: Synthetic oligonucleotide
gaggcgggccgcggtgaacac

SEQ ID NO: 409341 - DNA, 23 bp, Artificial Sequence
  Description of Artificial Sequence: Synthetic oligonucleotide
aggcgggccgcggtgaacaccta

SEQ ID NO: 409342 - DNA, 22 bp, Artificial Sequence
  Description of Artificial Sequence: Synthetic oligonucleotide
ggcgggccgcggtgaacaccta

SEQ ID NO: 409343 - DNA, 23 bp, Artificial Sequence
  Description of Artificial Sequence: Synthetic oligonucleotide
gcgggccgcggtgaacacctact

SEQ ID NO: 409344 - DNA, 23 bp, Artificial Sequence
  Description of Artificial Sequence: Synthetic oligonucleotide
cgggccgcggtgaacacctactg

SEQ ID NO: 409345 - DNA, 24 bp, Artificial Sequence
  Description of Artificial Sequence: Synthetic oligonucleotide
gggccgcggtgaacacctactgca

SEQ ID NO: 409346 - DNA, 25 bp, Artificial Sequence
  Description of Artificial Sequence: Synthetic oligonucleotide
ggccgcggtgaacacctactgcaga

SEQ ID NO: 409347 - DNA, 26 bp, Artificial Sequence
  Description of Artificial Sequence: Synthetic oligonucleotide
gccgcggtgaacacctactgcagaca

SEQ ID NO: 409348 - DNA, 27 bp, Artificial Sequence
  Description of Artificial Sequence: Synthetic oligonucleotide
ccgcggtgaacacctactgcagacaca

SEQ ID NO: 409349 - DNA, 28 bp, Artificial Sequence
  Description of Artificial Sequence: Synthetic oligonucleotide
cgcggtgaacacctactgcagacacaac

SEQ ID NO: 409350 - DNA, 30 bp, Artificial Sequence; identical to SEQ ID NO: 64535
  Description of Artificial Sequence: Synthetic oligonucleotide

SEQ ID NO: 409351 - DNA, 30 bp, Artificial Sequence; identical to SEQ ID NO: 64536
  Description of Artificial Sequence: Synthetic oligonucleotide

SEQ ID NO: 409352 - DNA, 30 bp, Artificial Sequence; identical to SEQ ID NO: 64537
  Description of Artificial Sequence: Synthetic oligonucleotide

SEQ ID NO: 409353 - DNA, 30 bp, Artificial Sequence; identical to SEQ ID NO: 64538
  Description of Artificial Sequence: Synthetic oligonucleotide

SEQ ID NO: 409354 - DNA, 30 bp, Artificial Sequence; identical to SEQ ID NO: 64539
  Description of Artificial Sequence: Synthetic oligonucleotide

SEQ ID NO: 409355 - DNA, 29 bp, Artificial Sequence
  Description of Artificial Sequence: Synthetic oligonucleotide
gaacacctactgcagacacaactacgggg

SEQ ID NO: 409356 - DNA, 31 bp, Artificial Sequence; identical to SEQ ID NO: 64541
  Description of Artificial Sequence: Synthetic oligonucleotide

SEQ ID NO: 409357 - DNA, 20 bp, Artificial Sequence
  Description of Artificial Sequence: Synthetic oligonucleotide
gcgggccgcggtggacacct

SEQ ID NO: 409358 - DNA, 20 bp, Artificial Sequence
  Description of Artificial Sequence: Synthetic oligonucleotide
cgggccgcggtggacaccgt

SEQ ID NO: 409359 - DNA, 21 bp, Artificial Sequence
  Description of Artificial Sequence: Synthetic oligonucleotide
gggccgcggtggacaccgtgt

SEQ ID NO: 409360 - DNA, 21 bp, Artificial Sequence
  Description of Artificial Sequence: Synthetic oligonucleotide
ggccgcggtggacaccgtgtg

SEQ ID NO: 409361 - DNA, 22 bp, Artificial Sequence
  Description of Artificial Sequence: Synthetic oligonucleotide
gccgcggtggacaccgtgtgca

SEQ ID NO: 409362 - DNA, 23 bp, Artificial Sequence
  Description of Artificial Sequence: Synthetic oligonucleotide
ccgcggtggacaccgtgtgcaga

SEQ ID NO: 409363 - DNA, 24 bp, Artificial Sequence
  Description of Artificial Sequence: Synthetic oligonucleotide
cgcggtggacaccgtgtgcagaca

SEQ ID NO: 409364 - DNA, 26 bp, Artificial Sequence
  Description of Artificial Sequence: Synthetic oligonucleotide
gcggtggacaccgtgtgcagacacaa

SEQ ID NO: 409365 - DNA, 27 bp, Artificial Sequence
  Description of Artificial Sequence: Synthetic oligonucleotide
cggtggacaccgtgtgcagacacaact

SEQ ID NO: 409366 - DNA, 28 bp, Artificial Sequence
  Description of Artificial Sequence: Synthetic oligonucleotide
ggtggacaccgtgtgcagacacaactac

SEQ ID NO: 409367 - DNA, 28 bp, Artificial Sequence
  Description of Artificial Sequence: Synthetic oligonucleotide
gtggacaccgtgtgcagacacaactacg

SEQ ID NO: 409368 - DNA, 28 bp, Artificial Sequence
  Description of Artificial Sequence: Synthetic oligonucleotide
tggacaccgtgtgcagacacaactacgg

SEQ ID NO: 409369 - DNA, 27 bp, Artificial Sequence
  Description of Artificial Sequence: Synthetic oligonucleotide
ggacaccgtgtgcagacacaactacgg

SEQ ID NO: 409370 - DNA, 27 bp, Artificial Sequence
  Description of Artificial Sequence: Synthetic oligonucleotide
gacaccgtgtgcagacacaactacggg

SEQ ID NO: 409371 - DNA, 27 bp, Artificial Sequence
  Description of Artificial Sequence: Synthetic oligonucleotide
acaccgtgtgcagacacaactacgggg

SEQ ID NO: 409372 - DNA, 27 bp, Artificial Sequence
  Description of Artificial Sequence: Synthetic oligonucleotide
caccgtgtgcagacacaactacggggt

SEQ ID NO: 409373 - DNA, 28 bp, Artificial Sequence
  Description of Artificial Sequence: Synthetic oligonucleotide
accgtgtgcagacacaactacggggttg

SEQ ID NO: 409374 - DNA, 27 bp, Artificial Sequence
  Description of Artificial Sequence: Synthetic oligonucleotide
ccgtgtgcagacacaactacggggttg

SEQ ID NO: 409375 - DNA, 27 bp, Artificial Sequence
  Description of Artificial Sequence: Synthetic oligonucleotide
cgtgtgcagacacaactacggggttgg

SEQ ID NO: 409376 - DNA, 28 bp, Artificial Sequence
  Description of Artificial Sequence: Synthetic oligonucleotide
gtgtgcagacacaactacggggttggtg

SEQ ID NO: 409377 - DNA, 29 bp, Artificial Sequence
  Description of Artificial Sequence: Synthetic oligonucleotide
tgtgcagacacaactacggggttggtgag

SEQ ID NO: 409378 - DNA, 28 bp, Artificial Sequence
  Description of Artificial Sequence: Synthetic oligonucleotide
gtgcagacacaactacggggttggtgag

SEQ ID NO: 409379 - DNA, 41 bp, Artificial Sequence; identical to SEQ ID NO: 64564
  Description of Artificial Sequence: Synthetic oligonucleotide

SEQ ID NO: 409380 - DNA, 44 bp, Artificial Sequence; identical to SEQ ID NO: 64565
  Description of Artificial Sequence: Synthetic oligonucleotide

SEQ ID NO: 409381 - DNA, 43 bp, Artificial Sequence; identical to SEQ ID NO: 64566
  Description of Artificial Sequence: Synthetic oligonucleotide

SEQ ID NO: 409382 - DNA, 43 bp, Artificial Sequence; identical to SEQ ID NO: 64567
  Description of Artificial Sequence: Synthetic oligonucleotide

SEQ ID NO: 409383 - DNA, 43 bp, Artificial Sequence; identical to SEQ ID NO: 64568
  Description of Artificial Sequence: Synthetic oligonucleotide

SEQ ID NO: 409384 - DNA, 42 bp, Artificial Sequence; identical to SEQ ID NO: 64569
  Description of Artificial Sequence: Synthetic oligonucleotide

SEQ ID NO: 409385 - DNA, 41 bp, Artificial Sequence; identical to SEQ ID NO: 64570
  Description of Artificial Sequence: Synthetic oligonucleotide

SEQ ID NO: 409386 - DNA, 40 bp, Artificial Sequence; identical to SEQ ID NO: 64571
  Description of Artificial Sequence: Synthetic oligonucleotide

SEQ ID NO: 409387 - DNA, 41 bp, Artificial Sequence; identical to SEQ ID NO: 64572
  Description of Artificial Sequence: Synthetic oligonucleotide

SEQ ID NO: 409388 - DNA, 40 bp, Artificial Sequence; identical to SEQ ID NO: 64573
  Description of Artificial Sequence: Synthetic oligonucleotide

SEQ ID NO: 409389 - DNA, 39 bp, Artificial Sequence; identical to SEQ ID NO: 64574
  Description of Artificial Sequence: Synthetic oligonucleotide

SEQ ID NO: 409390 - DNA, 39 bp, Artificial Sequence; identical to SEQ ID NO: 64575
  Description of Artificial Sequence: Synthetic oligonucleotide

SEQ ID NO: 409391 - DNA, 38 bp, Artificial Sequence; identical to SEQ ID NO: 64576
  Description of Artificial Sequence: Synthetic oligonucleotide

SEQ ID NO: 409392 - DNA, 38 bp, Artificial Sequence; identical to SEQ ID NO: 64577
  Description of Artificial Sequence: Synthetic oligonucleotide

SEQ ID NO: 409393 - DNA, 39 bp, Artificial Sequence; identical to SEQ ID NO: 64578
  Description of Artificial Sequence: Synthetic oligonucleotide

SEQ ID NO: 409394 - DNA, 39 bp, Artificial Sequence; identical to SEQ ID NO: 64579
  Description of Artificial Sequence: Synthetic oligonucleotide

SEQ ID NO: 409395 - DNA, 38 bp, Artificial Sequence; identical to SEQ ID NO: 64580
  Description of Artificial Sequence: Synthetic oligonucleotide

SEQ ID NO: 409396 - DNA, 38 bp, Artificial Sequence; identical to SEQ ID NO: 64581
  Description of Artificial Sequence: Synthetic oligonucleotide

SEQ ID NO: 409397 - DNA, 38 bp, Artificial Sequence; identical to SEQ ID NO: 64582
  Description of Artificial Sequence: Synthetic oligonucleotide

SEQ ID NO: 409398 - DNA, 37 bp, Artificial Sequence; identical to SEQ ID NO: 64583
  Description of Artificial Sequence: Synthetic oligonucleotide

SEQ ID NO: 409399 - DNA, 36 bp, Artificial Sequence; identical to SEQ ID NO: 64584
  Description of Artificial Sequence: Synthetic oligonucleotide

SEQ ID NO: 409400 - DNA, 35 bp, Artificial Sequence; identical to SEQ ID NO: 64585
  Description of Artificial Sequence: Synthetic oligonucleotide

SEQ ID NO: 409401 - DNA, 34 bp, Artificial Sequence; identical to SEQ ID NO: 64586
  Description of Artificial Sequence: Synthetic oligonucleotide

SEQ ID NO: 409402 - DNA, 28 bp, Artificial Sequence
  Description of Artificial Sequence: Synthetic oligonucleotide
tggaacagccagaaggacctcctggaag

SEQ ID NO: 409403 - DNA, 27 bp, Artificial Sequence
  Description of Artificial Sequence: Synthetic oligonucleotide
ggaacagccagaaggacctcctggaag

SEQ ID NO: 409404 - DNA, 28 bp, Artificial Sequence
  Description of Artificial Sequence: Synthetic oligonucleotide
gaacagccagaaggacctcctggaagac

SEQ ID NO: 409405 - DNA, 29 bp, Artificial Sequence
  Description of Artificial Sequence: Synthetic oligonucleotide
aacagccagaaggacctcctggaagacag

SEQ ID NO: 409406 - DNA, 28 bp, Artificial Sequence
  Description of Artificial Sequence: Synthetic oligonucleotide
acagccagaaggacctcctggaagacag

SEQ ID NO: 409407 - DNA, 27 bp, Artificial Sequence
  Description of Artificial Sequence: Synthetic oligonucleotide
cagccagaaggacctcctggaagacag

SEQ ID NO: 409408 - DNA, 27 bp, Artificial Sequence
  Description of Artificial Sequence: Synthetic oligonucleotide
agccagaaggacctcctggaagacagg

SEQ ID NO: 409409 - DNA, 26 bp, Artificial Sequence
  Description of Artificial Sequence: Synthetic oligonucleotide
gccagaaggacctcctggaagacagg

SEQ ID NO: 409410 - DNA, 26 bp, Artificial Sequence
  Description of Artificial Sequence: Synthetic oligonucleotide
ccagaaggacctcctggaagacaggc

SEQ ID NO: 409411 - DNA, 26 bp, Artificial Sequence
  Description of Artificial Sequence: Synthetic oligonucleotide
cagaaggacctcctggaagacaggcg

SEQ ID NO: 409412 - DNA, 26 bp, Artificial Sequence
  Description of Artificial Sequence: Synthetic oligonucleotide
agaaggacctcctggaagacaggcgc

SEQ ID NO: 409413 - DNA, 25 bp, Artificial Sequence
  Description of Artificial Sequence: Synthetic oligonucleotide
gaaggacctcctggaagacaggcgc

SEQ ID NO: 409414 - DNA, 25 bp, Artificial Sequence
  Description of Artificial Sequence: Synthetic oligonucleotide
aaggacctcctggaagacaggcgcg

SEQ ID NO: 409415 - DNA, 24 bp, Artificial Sequence
  Description of Artificial Sequence: Synthetic oligonucleotide
aggacctcctggaagacaggcgcg

SEQ ID NO: 409416 - DNA, 23 bp, Artificial Sequence
  Description of Artificial Sequence: Synthetic oligonucleotide
ggacctcctggaagacaggcgcg

SEQ ID NO: 409417 - DNA, 23 bp, Artificial Sequence
  Description of Artificial Sequence: Synthetic oligonucleotide
gacctcctggaagacaggcgcgc

SEQ ID NO: 409418 - DNA, 23 bp, Artificial Sequence
  Description of Artificial Sequence: Synthetic oligonucleotide
acctcctggaagacaggcgcgcc

SEQ ID NO: 409419 - DNA, 22 bp, Artificial Sequence
  Description of Artificial Sequence: Synthetic oligonucleotide
cctcctggaagacaggcgcgcc

SEQ ID NO: 409420 - DNA, 22 bp, Artificial Sequence
  Description of Artificial Sequence: Synthetic oligonucleotide
ctcctggaagacaggcgcgccg

SEQ ID NO: 409421 - DNA, 22 bp, Artificial Sequence
  Description of Artificial Sequence: Synthetic oligonucleotide
tcctggaagacaggcgcgccgc

SEQ ID NO: 409422 - DNA, 21 bp, Artificial Sequence
  Description of Artificial Sequence: Synthetic oligonucleotide
cctggaagacaggcgcgccgc

SEQ ID NO: 409423 - DNA, 21 bp, Artificial Sequence
  Description of Artificial Sequence: Synthetic oligonucleotide
ctggaagacaggcgcgccgcg

SEQ ID NO: 409424 - DNA, 22 bp, Artificial Sequence
  Description of Artificial Sequence: Synthetic oligonucleotide
tggaagacaggcgcgccgcggt

SEQ ID NO: 409425 - DNA, 21 bp, Artificial Sequence
  Description of Artificial Sequence: Synthetic oligonucleotide
ggaagacaggcgcgccgcggt

SEQ ID NO: 409426 - DNA, 21 bp, Artificial Sequence
  Description of Artificial Sequence: Synthetic oligonucleotide
gaagacaggcgcgccgcggtg

SEQ ID NO: 409427 - DNA, 22 bp, Artificial Sequence
  Description of Artificial Sequence: Synthetic oligonucleotide
aagacaggcgcgccgcggtgga

SEQ ID NO: 409428 - DNA, 21 bp, Artificial Sequence
  Description of Artificial Sequence: Synthetic oligonucleotide
agacaggcgcgccgcggtgga

SEQ ID NO: 409429 - DNA, 20 bp, Artificial Sequence
  Description of Artificial Sequence: Synthetic oligonucleotide
gacaggcgcgccgcggtgga

SEQ ID NO: 409430 - DNA, 21 bp, Artificial Sequence
  Description of Artificial Sequence: Synthetic oligonucleotide
acaggcgcgccgcggtggaca

SEQ ID NO: 409431 - DNA, 20 bp, Artificial Sequence
  Description of Artificial Sequence: Synthetic oligonucleotide
caggcgcgccgcggtggaca

SEQ ID NO: 409432 - DNA, 20 bp, Artificial Sequence
  Description of Artificial Sequence: Synthetic oligonucleotide
aggcgcgccgcggtggacac

SEQ ID NO: 409433 - DNA, 20 bp, Artificial Sequence
  Description of Artificial Sequence: Synthetic oligonucleotide
ggcgcgccgcggtggacact

SEQ ID NO: 409434 - DNA, 23 bp, Artificial Sequence
  Description of Artificial Sequence: Synthetic oligonucleotide
gcgcgccgcggtggacacctatt

SEQ ID NO: 409435 - DNA, 23 bp, Artificial Sequence
  Description of Artificial Sequence: Synthetic oligonucleotide
cgcgccgcggtggacacctattg

SEQ ID NO: 409436 - DNA, 24 bp, Artificial Sequence
  Description of Artificial Sequence: Synthetic oligonucleotide
gcgccgcggtggacacctattgca

SEQ ID NO: 409437 - DNA, 25 bp, Artificial Sequence
  Description of Artificial Sequence: Synthetic oligonucleotide
cgccgcggtggacacctattgcaga

SEQ ID NO: 409438 - DNA, 29 bp, Artificial Sequence
  Description of Artificial Sequence: Synthetic oligonucleotide
aacagccagaaggacatcctggagcagag

SEQ ID NO: 409439 - DNA, 28 bp, Artificial Sequence
  Description of Artificial Sequence: Synthetic oligonucleotide
acagccagaaggacatcctggagcagag

SEQ ID NO: 409440 - DNA, 27 bp, Artificial Sequence
  Description of Artificial Sequence: Synthetic oligonucleotide
cagccagaaggacatcctggagcagag

SEQ ID NO: 409441 - DNA, 27 bp, Artificial Sequence
  Description of Artificial Sequence: Synthetic oligonucleotide
agccagaaggacatcctggagcagagg

SEQ ID NO: 409442 - DNA, 26 bp, Artificial Sequence
  Description of Artificial Sequence: Synthetic oligonucleotide
gccagaaggacatcctggagcagagg

SEQ ID NO: 409443 - DNA, 26 bp, Artificial Sequence
  Description of Artificial Sequence: Synthetic oligonucleotide
ccagaaggacatcctggagcagaggc

SEQ ID NO: 409444 - DNA, 26 bp, Artificial Sequence
  Description of Artificial Sequence: Synthetic oligonucleotide
cagaaggacatcctggagcagaggcg

SEQ ID NO: 409445 - DNA, 26 bp, Artificial Sequence
  Description of Artificial Sequence: Synthetic oligonucleotide
agaaggacatcctggagcagaggcgg

SEQ ID NO: 409446 - DNA, 25 bp, Artificial Sequence
  Description of Artificial Sequence: Synthetic oligonucleotide
gaaggacatcctggagcagaggcgg

SEQ ID NO: 409447 - DNA, 25 bp, Artificial Sequence
  Description of Artificial Sequence: Synthetic oligonucleotide
aaggacatcctggagcagaggcggg

SEQ ID NO: 409448 - DNA, 24 bp, Artificial Sequence
  Description of Artificial Sequence: Synthetic oligonucleotide
aggacatcctggagcagaggcggg

SEQ ID NO: 409449 - DNA, 23 bp, Artificial Sequence
  Description of Artificial Sequence: Synthetic oligonucleotide
ggacatcctggagcagaggcggg

SEQ ID NO: 409450 - DNA, 23 bp, Artificial Sequence
  Description of Artificial Sequence: Synthetic oligonucleotide
gacatcctggagcagaggcgggc

SEQ ID NO: 409451 - DNA, 23 bp, Artificial Sequence
  Description of Artificial Sequence: Synthetic oligonucleotide
acatcctggagcagaggcgggcc

SEQ ID NO: 409452 - DNA, 22 bp, Artificial Sequence
  Description of Artificial Sequence: Synthetic oligonucleotide
catcctggagcagaggcgggcc

SEQ ID NO: 409453 - DNA, 22 bp, Artificial Sequence
  Description of Artificial Sequence: Synthetic oligonucleotide
atcctggagcagaggcgggccg

SEQ ID NO: 409454 - DNA, 40 bp, Artificial Sequence; identical to SEQ ID NO: 64639
  Description of Artificial Sequence: Synthetic oligonucleotide

SEQ ID NO: 409455 - DNA, 39 bp, Artificial Sequence; identical to SEQ ID NO: 64640
  Description of Artificial Sequence: Synthetic oligonucleotide

SEQ ID NO: 409456 - DNA, 39 bp, Artificial Sequence; identical to SEQ ID NO: 64641
  Description of Artificial Sequence: Synthetic oligonucleotide

SEQ ID NO: 409457 - DNA, 39 bp, Artificial Sequence; identical to SEQ ID NO: 64642
  Description of Artificial Sequence: Synthetic oligonucleotide

SEQ ID NO: 409458 - DNA, 38 bp, Artificial Sequence; identical to SEQ ID NO: 64643
  Description of Artificial Sequence: Synthetic oligonucleotide

SEQ ID NO: 409459 - DNA, 37 bp, Artificial Sequence; identical to SEQ ID NO: 64644
  Description of Artificial Sequence: Synthetic oligonucleotide

SEQ ID NO: 409460 - DNA, 36 bp, Artificial Sequence; identical to SEQ ID NO: 64645
  Description of Artificial Sequence: Synthetic oligonucleotide

SEQ ID NO: 409461 - DNA, 35 bp, Artificial Sequence; identical to SEQ ID NO: 64646
  Description of Artificial Sequence: Synthetic oligonucleotide

SEQ ID NO: 409462 - DNA, 36 bp, Artificial Sequence; identical to SEQ ID NO: 64647
  Description of Artificial Sequence: Synthetic oligonucleotide

SEQ ID NO: 409463 - DNA, 35 bp, Artificial Sequence; identical to SEQ ID NO: 64648
  Description of Artificial Sequence: Synthetic oligonucleotide

SEQ ID NO: 409464 - DNA, 34 bp, Artificial Sequence; identical to SEQ ID NO: 64649
  Description of Artificial Sequence: Synthetic oligonucleotide

SEQ ID NO: 409465 - DNA, 33 bp, Artificial Sequence; identical to SEQ ID NO: 64650
  Description of Artificial Sequence: Synthetic oligonucleotide

SEQ ID NO: 409466 - DNA, 33 bp, Artificial Sequence; identical to SEQ ID NO: 64651
  Description of Artificial Sequence: Synthetic oligonucleotide

SEQ ID NO: 409467 - DNA, 32 bp, Artificial Sequence; identical to SEQ ID NO: 64652
  Description of Artificial Sequence: Synthetic oligonucleotide

SEQ ID NO: 409468 - DNA, 31 bp, Artificial Sequence; identical to SEQ ID NO: 64653
  Description of Artificial Sequence: Synthetic oligonucleotide

SEQ ID NO: 409469 - DNA, 30 bp, Artificial Sequence; identical to SEQ ID NO: 64654
  Description of Artificial Sequence: Synthetic oligonucleotide

SEQ ID NO: 409470 - DNA, 30 bp, Artificial Sequence; identical to SEQ ID NO: 64655
  Description of Artificial Sequence: Synthetic oligonucleotide

SEQ ID NO: 409471 - DNA, 29 bp, Artificial Sequence
  Description of Artificial Sequence: Synthetic oligonucleotide
catttcttcaatgggacggagtgggtgcg

SEQ ID NO: 409472 - DNA, 29 bp, Artificial Sequence
  Description of Artificial Sequence: Synthetic oligonucleotide
atttcttcaatgggacggagtgggtgcgg

SEQ ID NO: 409473 - DNA, 28 bp, Artificial Sequence
  Description of Artificial Sequence: Synthetic oligonucleotide
tttcttcaatgggacggagtgggtgcgg

SEQ ID NO: 409474 - DNA, 27 bp, Artificial Sequence
  Description of Artificial Sequence: Synthetic oligonucleotide
ttcttcaatgggacggagtgggtgcgg

SEQ ID NO: 409475 - DNA, 27 bp, Artificial Sequence
  Description of Artificial Sequence: Synthetic oligonucleotide
tcttcaatgggacggagtgggtgcggt

SEQ ID NO: 409476 - DNA, 27 bp, Artificial Sequence
  Description of Artificial Sequence: Synthetic oligonucleotide
cttcaatgggacggagtgggtgcggtt

SEQ ID NO: 409477 - DNA, 27 bp, Artificial Sequence
  Description of Artificial Sequence: Synthetic oligonucleotide
ttcaatgggacggagtgggtgcggttg

SEQ ID NO: 409478 - DNA, 26 bp, Artificial Sequence
  Description of Artificial Sequence: Synthetic oligonucleotide
tcaatgggacggagtgggtgcggttg

SEQ ID NO: 409479 - DNA, 25 bp, Artificial Sequence
  Description of Artificial Sequence: Synthetic oligonucleotide
caatgggacggagtgggtgcggttg

SEQ ID NO: 409480 - DNA, 26 bp, Artificial Sequence
  Description of Artificial Sequence: Synthetic oligonucleotide
aatgggacggagtgggtgcggttgct

SEQ ID NO: 409481 - DNA, 25 bp, Artificial Sequence
  Description of Artificial Sequence: Synthetic oligonucleotide
atgggacggagtgggtgcggttgct

SEQ ID NO: 409482 - DNA, 24 bp, Artificial Sequence
  Description of Artificial Sequence: Synthetic oligonucleotide
tgggacggagtgggtgcggttgct

SEQ ID NO: 409483 - DNA, 23 bp, Artificial Sequence
  Description of Artificial Sequence: Synthetic oligonucleotide
gggacggagtgggtgcggttgct

SEQ ID NO: 409484 - DNA, 23 bp, Artificial Sequence
  Description of Artificial Sequence: Synthetic oligonucleotide
ggacggagtgggtgcggttgctg

SEQ ID NO: 409485 - DNA, 26 bp, Artificial Sequence
  Description of Artificial Sequence: Synthetic oligonucleotide
gacggagtgggtgcggttgctggaaa

SEQ ID NO: 409486 - DNA, 27 bp, Artificial Sequence
  Description of Artificial Sequence: Synthetic oligonucleotide
acggagtgggtgcggttgctggaaaga

SEQ ID NO: 409487 - DNA, 27 bp, Artificial Sequence
  Description of Artificial Sequence: Synthetic oligonucleotide
cggagtgggtgcggttgctggaaagat

SEQ ID NO: 409488 - DNA, 27 bp, Artificial Sequence
  Description of Artificial Sequence: Synthetic oligonucleotide
ggagtgggtgcggttgctggaaagatg

SEQ ID NO: 409489 - DNA, 27 bp, Artificial Sequence
  Description of Artificial Sequence: Synthetic oligonucleotide
gagtgggtgcggttgctggaaagatgc

SEQ ID NO: 409490 - DNA, 29 bp, Artificial Sequence
  Description of Artificial Sequence: Synthetic oligonucleotide
agtgggtgcggttgctggaaagatgcatc

SEQ ID NO: 409491 - DNA, 28 bp, Artificial Sequence
  Description of Artificial Sequence: Synthetic oligonucleotide
gtgggtgcggttgctggaaagatgcatc

SEQ ID NO: 409492 - DNA, 33 bp, Artificial Sequence; identical to SEQ ID NO: 64677
  Description of Artificial Sequence: Synthetic oligonucleotide

SEQ ID NO: 409493 - DNA, 22 bp, Artificial Sequence
  Description of Artificial Sequence: Synthetic oligonucleotide
ctggggcggcctgatgccgagt

SEQ ID NO: 409494 - DNA, 22 bp, Artificial Sequence
  Description of Artificial Sequence: Synthetic oligonucleotide
tggggcggcctgatgccgagtc

SEQ ID NO: 409495 - DNA, 21 bp, Artificial Sequence
  Description of Artificial Sequence: Synthetic oligonucleotide
ggggcggcctgatgccgagtc

SEQ ID NO: 409496 - DNA, 22 bp, Artificial Sequence
  Description of Artificial Sequence: Synthetic oligonucleotide
gggcggcctgatgccgagtcct

SEQ ID NO: 409497 - DNA, 22 bp, Artificial Sequence
  Description of Artificial Sequence: Synthetic oligonucleotide
ggcggcctgatgccgagtcctg

SEQ ID NO: 409498 - DNA, 24 bp, Artificial Sequence
  Description of Artificial Sequence: Synthetic oligonucleotide
gcggcctgatgccgagtcctggaa

SEQ ID NO: 409499 - DNA, 25 bp, Artificial Sequence
  Description of Artificial Sequence: Synthetic oligonucleotide
cggcctgatgccgagtcctggaaca

SEQ ID NO: 409500 - DNA, 25 bp, Artificial Sequence
  Description of Artificial Sequence: Synthetic oligonucleotide
ggcctgatgccgagtcctggaacag

SEQ ID NO: 409501 - DNA, 25 bp, Artificial Sequence
  Description of Artificial Sequence: Synthetic oligonucleotide
gcctgatgccgagtcctggaacagc

SEQ ID NO: 409502 - DNA, 26 bp, Artificial Sequence
  Description of Artificial Sequence: Synthetic oligonucleotide
cctgatgccgagtcctggaacagcca

SEQ ID NO: 409503 - DNA, 27 bp, Artificial Sequence
  Description of Artificial Sequence: Synthetic oligonucleotide
ctgatgccgagtcctggaacagccaga

SEQ ID NO: 409504 - DNA, 28 bp, Artificial Sequence
  Description of Artificial Sequence: Synthetic oligonucleotide
tgatgccgagtcctggaacagccagaag

SEQ ID NO: 409505 - DNA, 27 bp, Artificial Sequence
  Description of Artificial Sequence: Synthetic oligonucleotide
gatgccgagtcctggaacagccagaag

SEQ ID NO: 409506 - DNA, 27 bp, Artificial Sequence
  Description of Artificial Sequence: Synthetic oligonucleotide
atgccgagtcctggaacagccagaagg

SEQ ID NO: 409507 - DNA, 27 bp, Artificial Sequence
  Description of Artificial Sequence: Synthetic oligonucleotide
tgccgagtcctggaacagccagaagga

SEQ ID NO: 409508 - DNA, 26 bp, Artificial Sequence
  Description of Artificial Sequence: Synthetic oligonucleotide
gccgagtcctggaacagccagaagga

SEQ ID NO: 409509 - DNA, 26 bp, Artificial Sequence
  Description of Artificial Sequence: Synthetic oligonucleotide
ccgagtcctggaacagccagaaggac

SEQ ID NO: 409510 - DNA, 27 bp, Artificial Sequence
  Description of Artificial Sequence: Synthetic oligonucleotide
cgagtcctggaacagccagaaggacct

SEQ ID NO: 409511 - DNA, 27 bp, Artificial Sequence
  Description of Artificial Sequence: Synthetic oligonucleotide
gagtcctggaacagccagaaggacctc

SEQ ID NO: 409512 - DNA, 27 bp, Artificial Sequence
  Description of Artificial Sequence: Synthetic oligonucleotide
agtcctggaacagccagaaggacctcc

SEQ ID NO: 409513 - DNA, 27 bp, Artificial Sequence
  Description of Artificial Sequence: Synthetic oligonucleotide
gtcctggaacagccagaaggacctcct

SEQ ID NO: 409514 - DNA, 27 bp, Artificial Sequence
  Description of Artificial Sequence: Synthetic oligonucleotide
tcctggaacagccagaaggacctcctg

SEQ ID NO: 409515 - DNA, 26 bp, Artificial Sequence
  Description of Artificial Sequence: Synthetic oligonucleotide
cctggaacagccagaaggacctcctg

SEQ ID NO: 409516 - DNA, 39 bp, Artificial Sequence; identical to SEQ ID NO: 64701
  Description of Artificial Sequence: Synthetic oligonucleotide

SEQ ID NO: 409517 - DNA, 38 bp, Artificial Sequence; identical to SEQ ID NO: 64702
  Description of Artificial Sequence: Synthetic oligonucleotide

SEQ ID NO: 409518 - DNA, 38 bp, Artificial Sequence; identical to SEQ ID NO: 64703
  Description of Artificial Sequence: Synthetic oligonucleotide

SEQ ID NO: 409519 - DNA, 38 bp, Artificial Sequence; identical to SEQ ID NO: 64704
  Description of Artificial Sequence: Synthetic oligonucleotide

SEQ ID NO: 409520 - DNA, 37 bp, Artificial Sequence; identical to SEQ ID NO: 64705
  Description of Artificial Sequence: Synthetic oligonucleotide

SEQ ID NO: 409521 - DNA, 36 bp, Artificial Sequence; identical to SEQ ID NO: 64706
  Description of Artificial Sequence: Synthetic oligonucleotide

SEQ ID NO: 409522 - DNA, 35 bp, Artificial Sequence; identical to SEQ ID NO: 64707
  Description of Artificial Sequence: Synthetic oligonucleotide

SEQ ID NO: 409523 - DNA, 34 bp, Artificial Sequence; identical to SEQ ID NO: 64708
  Description of Artificial Sequence: Synthetic oligonucleotide

SEQ ID NO: 409524 - DNA, 34 bp, Artificial Sequence; identical to SEQ ID NO: 64709
  Description of Artificial Sequence: Synthetic oligonucleotide

SEQ ID NO: 409525 - DNA, 33 bp, Artificial Sequence; identical to SEQ ID NO: 64710
  Description of Artificial Sequence: Synthetic oligonucleotide

SEQ ID NO: 409526 - DNA, 32 bp, Artificial Sequence; identical to SEQ ID NO: 64711
  Description of Artificial Sequence: Synthetic oligonucleotide

SEQ ID NO: 409527 - DNA, 31 bp, Artificial Sequence; identical to SEQ ID NO: 64712
  Description of Artificial Sequence: Synthetic oligonucleotide

SEQ ID NO: 409528 - DNA, 32 bp, Artificial Sequence; identical to SEQ ID NO: 64713
  Description of Artificial Sequence: Synthetic oligonucleotide

SEQ ID NO: 409529 - DNA, 31 bp, Artificial Sequence; identical to SEQ ID NO: 64714
  Description of Artificial Sequence: Synthetic oligonucleotide

SEQ ID NO: 409530 - DNA, 30 bp, Artificial Sequence; identical to SEQ ID NO: 64715
  Description of Artificial Sequence: Synthetic oligonucleotide

SEQ ID NO: 409531 - DNA, 29 bp, Artificial Sequence
  Description of Artificial Sequence: Synthetic oligonucleotide
gtcatttcttcaatgggacggagggggtg

SEQ ID NO: 409532 - DNA, 29 bp, Artificial Sequence
  Description of Artificial Sequence: Synthetic oligonucleotide
tcatttcttcaatgggacggagggggtgc

SEQ ID NO: 409533 - DNA, 28 bp, Artificial Sequence
  Description of Artificial Sequence: Synthetic oligonucleotide
catttcttcaatgggacggagggggtgc

SEQ ID NO: 409534 - DNA, 28 bp, Artificial Sequence
  Description of Artificial Sequence: Synthetic oligonucleotide
atttcttcaatgggacggagggggtgcg

SEQ ID NO: 409535 - DNA, 27 bp, Artificial Sequence
  Description of Artificial Sequence: Synthetic oligonucleotide
tttcttcaatgggacggagggggtgcg

SEQ ID NO: 409536 - DNA, 26 bp, Artificial Sequence
  Description of Artificial Sequence: Synthetic oligonucleotide
ttcttcaatgggacggagggggtgcg

SEQ ID NO: 409537 - DNA, 25 bp, Artificial Sequence
  Description of Artificial Sequence: Synthetic oligonucleotide
tcttcaatgggacggagggggtgcg

SEQ ID NO: 409538 - DNA, 24 bp, Artificial Sequence
  Description of Artificial Sequence: Synthetic oligonucleotide
cttcaatgggacggagggggtgcg

SEQ ID NO: 409539 - DNA, 26 bp, Artificial Sequence
  Description of Artificial Sequence: Synthetic oligonucleotide
ttcaatgggacggagggggtgcggtt

SEQ ID NO: 409540 - DNA, 25 bp, Artificial Sequence
  Description of Artificial Sequence: Synthetic oligonucleotide
tcaatgggacggagggggtgcggtt

SEQ ID NO: 409541 - DNA, 24 bp, Artificial Sequence
  Description of Artificial Sequence: Synthetic oligonucleotide
caatgggacggagggggtgcggtt

SEQ ID NO: 409542 - DNA, 24 bp, Artificial Sequence
  Description of Artificial Sequence: Synthetic oligonucleotide
aatgggacggagggggtgcggttg

SEQ ID NO: 409543 - DNA, 23 bp, Artificial Sequence
  Description of Artificial Sequence: Synthetic oligonucleotide
atgggacggagggggtgcggttg

SEQ ID NO: 409544 - DNA, 22 bp, Artificial Sequence
  Description of Artificial Sequence: Synthetic oligonucleotide
tgggacggagggggtgcggttg

SEQ ID NO: 409545 - DNA, 21 bp, Artificial Sequence
  Description of Artificial Sequence: Synthetic oligonucleotide
gggacggagggggtgcggttg

SEQ ID NO: 409546 - DNA, 22 bp, Artificial Sequence
  Description of Artificial Sequence: Synthetic oligonucleotide
ggacggagggggtgcggttgct

SEQ ID NO: 409547 - DNA, 22 bp, Artificial Sequence
  Description of Artificial Sequence: Synthetic oligonucleotide
gacggagggggtgcggttgctg

SEQ ID NO: 409548 - DNA, 25 bp, Artificial Sequence
  Description of Artificial Sequence: Synthetic oligonucleotide
acggagggggtgcggttgctggaaa

SEQ ID NO: 409549 - DNA, 24 bp, Artificial Sequence
  Description of Artificial Sequence: Synthetic oligonucleotide
cggagggggtgcggttgctggaaa

SEQ ID NO: 409550 - DNA, 26 bp, Artificial Sequence
  Description of Artificial Sequence: Synthetic oligonucleotide
ggagggggtgcggttgctggaaagat

SEQ ID NO: 409551 - DNA, 26 bp, Artificial Sequence
  Description of Artificial Sequence: Synthetic oligonucleotide
gagggggtgcggttgctggaaagatg

SEQ ID NO: 409552 - DNA, 27 bp, Artificial Sequence
  Description of Artificial Sequence: Synthetic oligonucleotide
agggggtgcggttgctggaaagatgca

SEQ ID NO: 409553 - DNA, 27 bp, Artificial Sequence
  Description of Artificial Sequence: Synthetic oligonucleotide
gggggtgcggttgctggaaagatgcat

SEQ ID NO: 409554 - DNA, 27 bp, Artificial Sequence
  Description of Artificial Sequence: Synthetic oligonucleotide
ggggtgcggttgctggaaagatgcatc

SEQ ID NO: 409555 - DNA, 23 bp, Artificial Sequence
  Description of Artificial Sequence: Synthetic oligonucleotide
gtgggggagtaccgggcggtgat

SEQ ID NO: 409556 - DNA, 23 bp, Artificial Sequence
  Description of Artificial Sequence: Synthetic oligonucleotide
tgggggagtaccgggcggtgatg

SEQ ID NO: 409557 - DNA, 22 bp, Artificial Sequence
  Description of Artificial Sequence: Synthetic oligonucleotide
gggggagtaccgggcggtgatg

SEQ ID NO: 409558 - DNA, 23 bp, Artificial Sequence
  Description of Artificial Sequence: Synthetic oligonucleotide
ggggagtaccgggcggtgatgga

SEQ ID NO: 409559 - DNA, 23 bp, Artificial Sequence
  Description of Artificial Sequence: Synthetic oligonucleotide
gggagtaccgggcggtgatggag

SEQ ID NO: 409560 - DNA, 24 bp, Artificial Sequence
  Description of Artificial Sequence: Synthetic oligonucleotide
ggagtaccgggcggtgatggagct

SEQ ID NO: 409561 - DNA, 24 bp, Artificial Sequence
  Description of Artificial Sequence: Synthetic oligonucleotide
gagtaccgggcggtgatggagctg

SEQ ID NO: 409562 - DNA, 24 bp, Artificial Sequence
  Description of Artificial Sequence: Synthetic oligonucleotide
agtaccgggcggtgatggagctgg

SEQ ID NO: 409563 - DNA, 23 bp, Artificial Sequence
  Description of Artificial Sequence: Synthetic oligonucleotide
gtaccgggcggtgatggagctgg

SEQ ID NO: 409564 - DNA, 23 bp, Artificial Sequence
  Description of Artificial Sequence: Synthetic oligonucleotide
taccgggcggtgatggagctggg

SEQ ID NO: 409565 - DNA, 22 bp, Artificial Sequence
  Description of Artificial Sequence: Synthetic oligonucleotide
accgggcggtgatggagctggg

SEQ ID NO: 409566 - DNA, 21 bp, Artificial Sequence
  Description of Artificial Sequence: Synthetic oligonucleotide
ccgggcggtgatggagctggg

SEQ ID NO: 409567 - DNA, 21 bp, Artificial Sequence
  Description of Artificial Sequence: Synthetic oligonucleotide
cgggcggtgatggagctgggg

SEQ ID NO: 409568 - DNA, 21 bp, Artificial Sequence
  Description of Artificial Sequence: Synthetic oligonucleotide
gggcggtgatggagctggggc

SEQ ID NO: 409569 - DNA, 21 bp, Artificial Sequence
  Description of Artificial Sequence: Synthetic oligonucleotide
ggcggtgatggagctggggcg

SEQ ID NO: 409570 - DNA, 21 bp, Artificial Sequence
  Description of Artificial Sequence: Synthetic oligonucleotide
gcggtgatggagctggggcgg

SEQ ID NO: 409571 - DNA, 21 bp, Artificial Sequence
  Description of Artificial Sequence: Synthetic oligonucleotide
cggtgatggagctggggcggc

SEQ ID NO: 409572 - DNA, 22 bp, Artificial Sequence
  Description of Artificial Sequence: Synthetic oligonucleotide
ggtgatggagctggggcggcct

SEQ ID NO: 409573 - DNA, 24 bp, Artificial Sequence
  Description of Artificial Sequence: Synthetic oligonucleotide
gtgatggagctggggcggcctgat

SEQ ID NO: 409574 - DNA, 24 bp, Artificial Sequence
  Description of Artificial Sequence: Synthetic oligonucleotide
tgatggagctggggcggcctgatg

SEQ ID NO: 409575 - DNA, 23 bp, Artificial Sequence
  Description of Artificial Sequence: Synthetic oligonucleotide
gatggagctggggcggcctgatg

SEQ ID NO: 409576 - DNA, 23 bp, Artificial Sequence
  Description of Artificial Sequence: Synthetic oligonucleotide
atggagctggggcggcctgatgc

SEQ ID NO: 409577 - DNA, 22 bp, Artificial Sequence
  Description of Artificial Sequence: Synthetic oligonucleotide
tggagctggggcggcctgatgc

SEQ ID NO: 409578 - DNA, 26 bp, Artificial Sequence
  Description of Artificial Sequence: Synthetic oligonucleotide
gaacagccagaaggacctcctggagc

SEQ ID NO: 409579 - DNA, 26 bp, Artificial Sequence
  Description of Artificial Sequence: Synthetic oligonucleotide
aacagccagaaggacctcctggagcg

SEQ ID NO: 409580 - DNA, 25 bp, Artificial Sequence
  Description of Artificial Sequence: Synthetic oligonucleotide
acagccagaaggacctcctggagcg

SEQ ID NO: 409581 - DNA, 24 bp, Artificial Sequence
  Description of Artificial Sequence: Synthetic oligonucleotide
cagccagaaggacctcctggagcg

SEQ ID NO: 409582 - DNA, 25 bp, Artificial Sequence
  Description of Artificial Sequence: Synthetic oligonucleotide
agccagaaggacctcctggagcgga

SEQ ID NO: 409583 - DNA, 24 bp, Artificial Sequence
  Description of Artificial Sequence: Synthetic oligonucleotide
gccagaaggacctcctggagcgga

SEQ ID NO: 409584 - DNA, 24 bp, Artificial Sequence
  Description of Artificial Sequence: Synthetic oligonucleotide
ccagaaggacctcctggagcggag

SEQ ID NO: 409585 - DNA, 24 bp, Artificial Sequence
  Description of Artificial Sequence: Synthetic oligonucleotide
cagaaggacctcctggagcggagg

SEQ ID NO: 409586 - DNA, 24 bp, Artificial Sequence
  Description of Artificial Sequence: Synthetic oligonucleotide
agaaggacctcctggagcggaggc

SEQ ID NO: 409587 - DNA, 23 bp, Artificial Sequence
  Description of Artificial Sequence: Synthetic oligonucleotide
gaaggacctcctggagcggaggc

SEQ ID NO: 409588 - DNA, 23 bp, Artificial Sequence
  Description of Artificial Sequence: Synthetic oligonucleotide
aaggacctcctggagcggaggcg

SEQ ID NO: 409589 - DNA, 22 bp, Artificial Sequence
  Description of Artificial Sequence: Synthetic oligonucleotide
aggacctcctggagcggaggcg

SEQ ID NO: 409590 - DNA, 21 bp, Artificial Sequence
  Description of Artificial Sequence: Synthetic oligonucleotide
ggacctcctggagcggaggcg

SEQ ID NO: 409591 - DNA, 21 bp, Artificial Sequence
  Description of Artificial Sequence: Synthetic oligonucleotide
gacctcctggagcggaggcgg

SEQ ID NO: 409592 - DNA, 21 bp, Artificial Sequence
  Description of Artificial Sequence: Synthetic oligonucleotide
acctcctggagcggaggcggg

SEQ ID NO: 409593 - DNA, 20 bp, Artificial Sequence
  Description of Artificial Sequence: Synthetic oligonucleotide
cctcctggagcggaggcggg

SEQ ID NO: 409594 - DNA, 20 bp, Artificial Sequence
  Description of Artificial Sequence: Synthetic oligonucleotide
ctcctggagcggaggcgggc

SEQ ID NO: 409595 - DNA, 20 bp, Artificial Sequence
  Description of Artificial Sequence: Synthetic oligonucleotide
tcctggagcggaggcgggcc

SEQ ID NO: 409596 - DNA, 20 bp, Artificial Sequence
  Description of Artificial Sequence: Synthetic oligonucleotide
cctggagcggaggcgggcct

SEQ ID NO: 409597 - DNA, 20 bp, Artificial Sequence
  Description of Artificial Sequence: Synthetic oligonucleotide
ctggagcggaggcgggccgt

SEQ ID NO: 409598 - DNA, 20 bp, Artificial Sequence
  Description of Artificial Sequence: Synthetic oligonucleotide
tggagcggaggcgggccgct

SEQ ID NO: 409599 - DNA, 20 bp, Artificial Sequence
  Description of Artificial Sequence: Synthetic oligonucleotide
ggagcggaggcgggccgctt

SEQ ID NO: 409600 - DNA, 20 bp, Artificial Sequence
  Description of Artificial Sequence: Synthetic oligonucleotide
gagcggaggcgggccgcgtt

SEQ ID NO: 409601 - DNA, 20 bp, Artificial Sequence
  Description of Artificial Sequence: Synthetic oligonucleotide
agcggaggcgggccgcggtt

SEQ ID NO: 409602 - DNA, 20 bp, Artificial Sequence
  Description of Artificial Sequence: Synthetic oligonucleotide
gcggaggcgggccgcggttt

SEQ ID NO: 409603 - DNA, 20 bp, Artificial Sequence
  Description of Artificial Sequence: Synthetic oligonucleotide
cggaggcgggccgcggtgtt

SEQ ID NO: 409604 - DNA, 20 bp, Artificial Sequence
  Description of Artificial Sequence: Synthetic oligonucleotide
ggaggcgggccgcggtggat

SEQ ID NO: 409605 - DNA, 23 bp, Artificial Sequence
  Description of Artificial Sequence: Synthetic oligonucleotide
gagctggggcggcctgatgccaa

SEQ ID NO: 409606 - DNA, 25 bp, Artificial Sequence
  Description of Artificial Sequence: Synthetic oligonucleotide
agctggggcggcctgatgccaagta

SEQ ID NO: 409607 - DNA, 24 bp, Artificial Sequence
  Description of Artificial Sequence: Synthetic oligonucleotide
gctggggcggcctgatgccaagta

SEQ ID NO: 409608 - DNA, 25 bp, Artificial Sequence
  Description of Artificial Sequence: Synthetic oligonucleotide
ctggggcggcctgatgccaagtact

SEQ ID NO: 409609 - DNA, 25 bp, Artificial Sequence
  Description of Artificial Sequence: Synthetic oligonucleotide
tggggcggcctgatgccaagtactg

SEQ ID NO: 409610 - DNA, 24 bp, Artificial Sequence
  Description of Artificial Sequence: Synthetic oligonucleotide
ggggcggcctgatgccaagtactg

SEQ ID NO: 409611 - DNA, 26 bp, Artificial Sequence
  Description of Artificial Sequence: Synthetic oligonucleotide
gggcggcctgatgccaagtactggaa

SEQ ID NO: 409612 - DNA, 27 bp, Artificial Sequence
  Description of Artificial Sequence: Synthetic oligonucleotide
ggcggcctgatgccaagtactggaaca

SEQ ID NO: 409613 - DNA, 27 bp, Artificial Sequence
  Description of Artificial Sequence: Synthetic oligonucleotide
gcggcctgatgccaagtactggaacag

SEQ ID NO: 409614 - DNA, 27 bp, Artificial Sequence
  Description of Artificial Sequence: Synthetic oligonucleotide
cggcctgatgccaagtactggaacagc

SEQ ID NO: 409615 - DNA, 27 bp, Artificial Sequence
  Description of Artificial Sequence: Synthetic oligonucleotide
ggcctgatgccaagtactggaacagcc

SEQ ID NO: 409616 - DNA, 28 bp, Artificial Sequence
  Description of Artificial Sequence: Synthetic oligonucleotide
gcctgatgccaagtactggaacagccag

SEQ ID NO: 409617 - DNA, 30 bp, Artificial Sequence; identical to SEQ ID NO: 64802
  Description of Artificial Sequence: Synthetic oligonucleotide

SEQ ID NO: 409618 - DNA, 30 bp, Artificial Sequence; identical to SEQ ID NO: 64803
  Description of Artificial Sequence: Synthetic oligonucleotide

SEQ ID NO: 409619 - DNA, 31 bp, Artificial Sequence; identical to SEQ ID NO: 64804
  Description of Artificial Sequence: Synthetic oligonucleotide

SEQ ID NO: 409620 - DNA, 30 bp, Artificial Sequence; identical to SEQ ID NO: 64805
  Description of Artificial Sequence: Synthetic oligonucleotide

SEQ ID NO: 409621 - DNA, 30 bp, Artificial Sequence; identical to SEQ ID NO: 64806
  Description of Artificial Sequence: Synthetic oligonucleotide

SEQ ID NO: 409622 - DNA, 29 bp, Artificial Sequence
  Description of Artificial Sequence: Synthetic oligonucleotide
tgccaagtactggaacagccagaaggacc

SEQ ID NO: 409623 - DNA, 28 bp, Artificial Sequence
  Description of Artificial Sequence: Synthetic oligonucleotide
gccaagtactggaacagccagaaggacc

SEQ ID NO: 409624 - DNA, 29 bp, Artificial Sequence
  Description of Artificial Sequence: Synthetic oligonucleotide
ccaagtactggaacagccagaaggacctc

SEQ ID NO: 409625 - DNA, 29 bp, Artificial Sequence
  Description of Artificial Sequence: Synthetic oligonucleotide
caagtactggaacagccagaaggacctcc

SEQ ID NO: 409626 - DNA, 30 bp, Artificial Sequence; identical to SEQ ID NO: 64811
  Description of Artificial Sequence: Synthetic oligonucleotide

SEQ ID NO: 409627 - DNA, 26 bp, Artificial Sequence
  Description of Artificial Sequence: Synthetic oligonucleotide
ttcgacagcgacgtgggggagtacca

SEQ ID NO: 409628 - DNA, 25 bp, Artificial Sequence
  Description of Artificial Sequence: Synthetic oligonucleotide
tcgacagcgacgtgggggagtacca

SEQ ID NO: 409629 - DNA, 24 bp, Artificial Sequence
  Description of Artificial Sequence: Synthetic oligonucleotide
cgacagcgacgtgggggagtacca

SEQ ID NO: 409630 - DNA, 24 bp, Artificial Sequence
  Description of Artificial Sequence: Synthetic oligonucleotide
gacagcgacgtgggggagtaccag

SEQ ID NO: 409631 - DNA, 24 bp, Artificial Sequence
  Description of Artificial Sequence: Synthetic oligonucleotide
acagcgacgtgggggagtaccagg

SEQ ID NO: 409632 - DNA, 23 bp, Artificial Sequence
  Description of Artificial Sequence: Synthetic oligonucleotide
cagcgacgtgggggagtaccagg

SEQ ID NO: 409633 - DNA, 23 bp, Artificial Sequence
  Description of Artificial Sequence: Synthetic oligonucleotide
agcgacgtgggggagtaccaggc

SEQ ID NO: 409634 - DNA, 22 bp, Artificial Sequence
  Description of Artificial Sequence: Synthetic oligonucleotide
gcgacgtgggggagtaccaggc

SEQ ID NO: 409635 - DNA, 22 bp, Artificial Sequence
  Description of Artificial Sequence: Synthetic oligonucleotide
cgacgtgggggagtaccaggcg

SEQ ID NO: 409636 - DNA, 23 bp, Artificial Sequence
  Description of Artificial Sequence: Synthetic oligonucleotide
gacgtgggggagtaccaggcggt

SEQ ID NO: 409637 - DNA, 24 bp, Artificial Sequence
  Description of Artificial Sequence: Synthetic oligonucleotide
acgtgggggagtaccaggcggtga

SEQ ID NO: 409638 - DNA, 23 bp, Artificial Sequence
  Description of Artificial Sequence: Synthetic oligonucleotide
cgtgggggagtaccaggcggtga

SEQ ID NO: 409639 - DNA, 23 bp, Artificial Sequence
  Description of Artificial Sequence: Synthetic oligonucleotide
gtgggggagtaccaggcggtgac

SEQ ID NO: 409640 - DNA, 23 bp, Artificial Sequence
  Description of Artificial Sequence: Synthetic oligonucleotide
tgggggagtaccaggcggtgacg

SEQ ID NO: 409641 - DNA, 22 bp, Artificial Sequence
  Description of Artificial Sequence: Synthetic oligonucleotide
gggggagtaccaggcggtgacg

SEQ ID NO: 409642 - DNA, 23 bp, Artificial Sequence
  Description of Artificial Sequence: Synthetic oligonucleotide
ggggagtaccaggcggtgacgga

SEQ ID NO: 409643 - DNA, 23 bp, Artificial Sequence
  Description of Artificial Sequence: Synthetic oligonucleotide
gggagtaccaggcggtgacggag

SEQ ID NO: 409644 - DNA, 24 bp, Artificial Sequence
  Description of Artificial Sequence: Synthetic oligonucleotide
ggagtaccaggcggtgacggagct

SEQ ID NO: 409645 - DNA, 24 bp, Artificial Sequence
  Description of Artificial Sequence: Synthetic oligonucleotide
gagtaccaggcggtgacggagctg

SEQ ID NO: 409646 - DNA, 24 bp, Artificial Sequence
  Description of Artificial Sequence: Synthetic oligonucleotide
agtaccaggcggtgacggagctgg

SEQ ID NO: 409647 - DNA, 23 bp, Artificial Sequence
  Description of Artificial Sequence: Synthetic oligonucleotide
gtaccaggcggtgacggagctgg

SEQ ID NO: 409648 - DNA, 23 bp, Artificial Sequence
  Description of Artificial Sequence: Synthetic oligonucleotide
taccaggcggtgacggagctggg

SEQ ID NO: 409649 - DNA, 22 bp, Artificial Sequence
  Description of Artificial Sequence: Synthetic oligonucleotide
accaggcggtgacggagctggg

SEQ ID NO: 409650 - DNA, 21 bp, Artificial Sequence
  Description of Artificial Sequence: Synthetic oligonucleotide
ccaggcggtgacggagctggg

SEQ ID NO: 409651 - DNA, 21 bp, Artificial Sequence
  Description of Artificial Sequence: Synthetic oligonucleotide
caggcggtgacggagctgggg

SEQ ID NO: 409652 - DNA, 21 bp, Artificial Sequence
  Description of Artificial Sequence: Synthetic oligonucleotide
aggcggtgacggagctggggc

SEQ ID NO: 409653 - DNA, 30 bp, Artificial Sequence; identical to SEQ ID NO: 64838
  Description of Artificial Sequence: Synthetic oligonucleotide

SEQ ID NO: 409654 - DNA, 30 bp, Artificial Sequence; identical to SEQ ID NO: 64839
  Description of Artificial Sequence: Synthetic oligonucleotide

SEQ ID NO: 409655 - DNA, 30 bp, Artificial Sequence; identical to SEQ ID NO: 64840
  Description of Artificial Sequence: Synthetic oligonucleotide

SEQ ID NO: 409656 - DNA, 29 bp, Artificial Sequence
  Description of Artificial Sequence: Synthetic oligonucleotide
ggacacctactgcagacacaactacaggg

SEQ ID NO: 409657 - DNA, 31 bp, Artificial Sequence; identical to SEQ ID NO: 64842
  Description of Artificial Sequence: Synthetic oligonucleotide

SEQ ID NO: 409658 - DNA, 31 bp, Artificial Sequence; identical to SEQ ID NO: 64843
  Description of Artificial Sequence: Synthetic oligonucleotide

SEQ ID NO: 409659 - DNA, 30 bp, Artificial Sequence; identical to SEQ ID NO: 64844
  Description of Artificial Sequence: Synthetic oligonucleotide

SEQ ID NO: 409660 - DNA, 31 bp, Artificial Sequence; identical to SEQ ID NO: 64845
  Description of Artificial Sequence: Synthetic oligonucleotide

SEQ ID NO: 409661 - DNA, 30 bp, Artificial Sequence; identical to SEQ ID NO: 64846
  Description of Artificial Sequence: Synthetic oligonucleotide

SEQ ID NO: 409662 - DNA, 31 bp, Artificial Sequence; identical to SEQ ID NO: 64847
  Description of Artificial Sequence: Synthetic oligonucleotide

SEQ ID NO: 409663 - DNA, 32 bp, Artificial Sequence; identical to SEQ ID NO: 64848
  Description of Artificial Sequence: Synthetic oligonucleotide

SEQ ID NO: 409664 - DNA, 31 bp, Artificial Sequence; identical to SEQ ID NO: 64849
  Description of Artificial Sequence: Synthetic oligonucleotide

SEQ ID NO: 409665 - DNA, 30 bp, Artificial Sequence; identical to SEQ ID NO: 64850
  Description of Artificial Sequence: Synthetic oligonucleotide

SEQ ID NO: 409666 - DNA, 30 bp, Artificial Sequence; identical to SEQ ID NO: 64851
  Description of Artificial Sequence: Synthetic oligonucleotide

SEQ ID NO: 409667 - DNA, 29 bp, Artificial Sequence
  Description of Artificial Sequence: Synthetic oligonucleotide
gcagacacaactacagggttggtgagagc

SEQ ID NO: 409668 - DNA, 31 bp, Artificial Sequence; identical to SEQ ID NO: 64853
  Description of Artificial Sequence: Synthetic oligonucleotide

SEQ ID NO: 409669 - DNA, 32 bp, Artificial Sequence; identical to SEQ ID NO: 64854
  Description of Artificial Sequence: Synthetic oligonucleotide

SEQ ID NO: 409670 - DNA, 31 bp, Artificial Sequence; identical to SEQ ID NO: 64855
  Description of Artificial Sequence: Synthetic oligonucleotide

SEQ ID NO: 409671 - DNA, 32 bp, Artificial Sequence; identical to SEQ ID NO: 64856
  Description of Artificial Sequence: Synthetic oligonucleotide

SEQ ID NO: 409672 - DNA, 31 bp, Artificial Sequence; identical to SEQ ID NO: 64857
  Description of Artificial Sequence: Synthetic oligonucleotide

SEQ ID NO: 409673 - DNA, 32 bp, Artificial Sequence; identical to SEQ ID NO: 64858
  Description of Artificial Sequence: Synthetic oligonucleotide

SEQ ID NO: 409674 - DNA, 31 bp, Artificial Sequence; identical to SEQ ID NO: 64859
  Description of Artificial Sequence: Synthetic oligonucleotide

SEQ ID NO: 409675 - DNA, 31 bp, Artificial Sequence; identical to SEQ ID NO: 64860
  Description of Artificial Sequence: Synthetic oligonucleotide

SEQ ID NO: 409676 - DNA, 30 bp, Artificial Sequence; identical to SEQ ID NO: 64861
  Description of Artificial Sequence: Synthetic oligonucleotide

SEQ ID NO: 409677 - DNA, 29 bp, Artificial Sequence
  Description of Artificial Sequence: Synthetic oligonucleotide
ctacagggttggtgagagcttcacagtgc

SEQ ID NO: 409678 - DNA, 30 bp, Artificial Sequence; identical to SEQ ID NO: 64863
  Description of Artificial Sequence: Synthetic oligonucleotide

SEQ ID NO: 409679 - DNA, 29 bp, Artificial Sequence
  Description of Artificial Sequence: Synthetic oligonucleotide
acagggttggtgagagcttcacagtgcag

SEQ ID NO: 409680 - DNA, 28 bp, Artificial Sequence
  Description of Artificial Sequence: Synthetic oligonucleotide
cagggttggtgagagcttcacagtgcag

SEQ ID NO: 409681 - DNA, 28 bp, Artificial Sequence
  Description of Artificial Sequence: Synthetic oligonucleotide
agggttggtgagagcttcacagtgcagc

SEQ ID NO: 409682 - DNA, 26 bp, Artificial Sequence
  Description of Artificial Sequence: Synthetic oligonucleotide
agcgggtgcggttgctggaaagatgc

SEQ ID NO: 409683 - DNA, 25 bp, Artificial Sequence
  Description of Artificial Sequence: Synthetic oligonucleotide
gcgggtgcggttgctggaaagatgc

SEQ ID NO: 409684 - DNA, 26 bp, Artificial Sequence
  Description of Artificial Sequence: Synthetic oligonucleotide
cgggtgcggttgctggaaagatgcgt

SEQ ID NO: 409685 - DNA, 27 bp, Artificial Sequence
  Description of Artificial Sequence: Synthetic oligonucleotide
gggtgcggttgctggaaagatgcgtct

SEQ ID NO: 409686 - DNA, 31 bp, Artificial Sequence
  Description of Artificial Sequence: Synthetic oligonucleotide
ggtgcggttgctggaaagatgcgtctataac

SEQ ID NO: 409687 - DNA, 31 bp, Artificial Sequence
  Description of Artificial Sequence: Synthetic oligonucleotide
gtgcggttgctggaaagatgcgtctataacc

SEQ ID NO: 409688 - DNA, 33 bp, Artificial Sequence
  Description of Artificial Sequence: Synthetic oligonucleotide
tgcggttgctggaaagatgcgtctataaccaag

SEQ ID NO: 409689 - DNA, 32 bp, Artificial Sequence
  Description of Artificial Sequence: Synthetic oligonucleotide
gcggttgctggaaagatgcgtctataaccaag

SEQ ID NO: 409690 - DNA, 33 bp, Artificial Sequence
  Description of Artificial Sequence: Synthetic oligonucleotide
cggttgctggaaagatgcgtctataaccaagag

SEQ ID NO: 409691 - DNA, 33 bp, Artificial Sequence
  Description of Artificial Sequence: Synthetic oligonucleotide
ggttgctggaaagatgcgtctataaccaagagg

SEQ ID NO: 409692 - DNA, 34 bp, Artificial Sequence
  Description of Artificial Sequence: Synthetic oligonucleotide
gttgctggaaagatgcgtctataaccaagaggag

SEQ ID NO: 409693 - DNA, 35 bp, Artificial Sequence
  Description of Artificial Sequence: Synthetic oligonucleotide
ttgctggaaagatgcgtctataaccaagaggagtc

SEQ ID NO: 409694 - DNA, 34 bp, Artificial Sequence
  Description of Artificial Sequence: Synthetic oligonucleotide
tgctggaaagatgcgtctataaccaagaggagtc

SEQ ID NO: 409695 - DNA, 33 bp, Artificial Sequence
  Description of Artificial Sequence: Synthetic oligonucleotide
gctggaaagatgcgtctataaccaagaggagtc

SEQ ID NO: 409696 - DNA, 33 bp, Artificial Sequence
  Description of Artificial Sequence: Synthetic oligonucleotide
ctggaaagatgcgtctataaccaagaggagtcc

SEQ ID NO: 409697 - DNA, 33 bp, Artificial Sequence
  Description of Artificial Sequence: Synthetic oligonucleotide
tggaaagatgcgtctataaccaagaggagtccg

SEQ ID NO: 409698 - DNA, 32 bp, Artificial Sequence
  Description of Artificial Sequence: Synthetic oligonucleotide
ggaaagatgcgtctataaccaagaggagtccg

SEQ ID NO: 409699 - DNA, 33 bp, Artificial Sequence
  Description of Artificial Sequence: Synthetic oligonucleotide
gaaagatgcgtctataaccaagaggagtccgtg

SEQ ID NO: 409700 - DNA, 33 bp, Artificial Sequence
  Description of Artificial Sequence: Synthetic oligonucleotide
aaagatgcgtctataaccaagaggagtccgtgc

SEQ ID NO: 409701 - DNA, 32 bp, Artificial Sequence
  Description of Artificial Sequence: Synthetic oligonucleotide
aagatgcgtctataaccaagaggagtccgtgc

SEQ ID NO: 409702 - DNA, 31 bp, Artificial Sequence
  Description of Artificial Sequence: Synthetic oligonucleotide
agatgcgtctataaccaagaggagtccgtgc

SEQ ID NO: 409703 - DNA, 30 bp, Artificial Sequence
  Description of Artificial Sequence: Synthetic oligonucleotide
gatgcgtctataaccaagaggagtccgtgc

SEQ ID NO: 409704 - DNA, 30 bp, Artificial Sequence
  Description of Artificial Sequence: Synthetic oligonucleotide
atgcgtctataaccaagaggagtccgtgcg

SEQ ID NO: 409705 - DNA, 29 bp, Artificial Sequence
  Description of Artificial Sequence: Synthetic oligonucleotide
tgcgtctataaccaagaggagtccgtgcg

SEQ ID NO: 409706 - DNA, 28 bp, Artificial Sequence
  Description of Artificial Sequence: Synthetic oligonucleotide
gcgtctataaccaagaggagtccgtgcg

SEQ ID NO: 409707 - DNA, 28 bp, Artificial Sequence
  Description of Artificial Sequence: Synthetic oligonucleotide
cgtctataaccaagaggagtccgtgcgc

SEQ ID NO: 409708 - DNA, 30 bp, Artificial Sequence
  Description of Artificial Sequence: Synthetic oligonucleotide
gtctataaccaagaggagtccgtgcgcttc

SEQ ID NO: 409709 - DNA, 31 bp, Artificial Sequence
  Description of Artificial Sequence: Synthetic oligonucleotide
tggacaattactgcagacacaactacggggc

SEQ ID NO: 409710 - DNA, 30 bp, Artificial Sequence
  Description of Artificial Sequence: Synthetic oligonucleotide
ggacaattactgcagacacaactacggggc

SEQ ID NO: 409711 - DNA, 31 bp, Artificial Sequence
  Description of Artificial Sequence: Synthetic oligonucleotide
gacaattactgcagacacaactacggggctg

SEQ ID NO: 409712 - DNA, 32 bp, Artificial Sequence
  Description of Artificial Sequence: Synthetic oligonucleotide
acaattactgcagacacaactacggggctgtg

SEQ ID NO: 409713 - DNA, 31 bp, Artificial Sequence
  Description of Artificial Sequence: Synthetic oligonucleotide
caattactgcagacacaactacggggctgtg

SEQ ID NO: 409714 - DNA, 31 bp, Artificial Sequence
  Description of Artificial Sequence: Synthetic oligonucleotide
aattactgcagacacaactacggggctgtgg

SEQ ID NO: 409715 - DNA, 30 bp, Artificial Sequence
  Description of Artificial Sequence: Synthetic oligonucleotide
attactgcagacacaactacggggctgtgg

SEQ ID NO: 409716 - DNA, 29 bp, Artificial Sequence
  Description of Artificial Sequence: Synthetic oligonucleotide
ttactgcagacacaactacggggctgtgg

SEQ ID NO: 409717 - DNA, 28 bp, Artificial Sequence
  Description of Artificial Sequence: Synthetic oligonucleotide
tactgcagacacaactacggggctgtgg

SEQ ID NO: 409718 - DNA, 27 bp, Artificial Sequence
  Description of Artificial Sequence: Synthetic oligonucleotide
actgcagacacaactacggggctgtgg

SEQ ID NO: 409719 - DNA, 27 bp, Artificial Sequence
  Description of Artificial Sequence: Synthetic oligonucleotide
ctgcagacacaactacggggctgtgga

SEQ ID NO: 409720 - DNA, 26 bp, Artificial Sequence
  Description of Artificial Sequence: Synthetic oligonucleotide
ctggaacagccagaaggacctcctgg

SEQ ID NO: 409721 - DNA, 26 bp, Artificial Sequence
  Description of Artificial Sequence: Synthetic oligonucleotide
tggaacagccagaaggacctcctggg

SEQ ID NO: 409722 - DNA, 25 bp, Artificial Sequence
  Description of Artificial Sequence: Synthetic oligonucleotide
ggaacagccagaaggacctcctggg

SEQ ID NO: 409723 - DNA, 25 bp, Artificial Sequence
  Description of Artificial Sequence: Synthetic oligonucleotide
gaacagccagaaggacctcctgggg

SEQ ID NO: 409724 - DNA, 26 bp, Artificial Sequence
  Description of Artificial Sequence: Synthetic oligonucleotide
aacagccagaaggacctcctggggca

SEQ ID NO: 409725 - DNA, 25 bp, Artificial Sequence
  Description of Artificial Sequence: Synthetic oligonucleotide
acagccagaaggacctcctggggca

SEQ ID NO: 409726 - DNA, 24 bp, Artificial Sequence
  Description of Artificial Sequence: Synthetic oligonucleotide
cagccagaaggacctcctggggca

SEQ ID NO: 409727 - DNA, 25 bp, Artificial Sequence
  Description of Artificial Sequence: Synthetic oligonucleotide
agccagaaggacctcctggggcaga

SEQ ID NO: 409728 - DNA, 24 bp, Artificial Sequence
  Description of Artificial Sequence: Synthetic oligonucleotide
gccagaaggacctcctggggcaga

SEQ ID NO: 409729 - DNA, 24 bp, Artificial Sequence
  Description of Artificial Sequence: Synthetic oligonucleotide
ccagaaggacctcctggggcagag

SEQ ID NO: 409730 - DNA, 24 bp, Artificial Sequence
  Description of Artificial Sequence: Synthetic oligonucleotide
cagaaggacctcctggggcagagg

SEQ ID NO: 409731 - DNA, 24 bp, Artificial Sequence
  Description of Artificial Sequence: Synthetic oligonucleotide
agaaggacctcctggggcagaggc

SEQ ID NO: 409732 - DNA, 23 bp, Artificial Sequence
  Description of Artificial Sequence: Synthetic oligonucleotide
gaaggacctcctggggcagaggc

SEQ ID NO: 409733 - DNA, 23 bp, Artificial Sequence
  Description of Artificial Sequence: Synthetic oligonucleotide
aaggacctcctggggcagaggcg

SEQ ID NO: 409734 - DNA, 22 bp, Artificial Sequence
  Description of Artificial Sequence: Synthetic oligonucleotide
aggacctcctggggcagaggcg

SEQ ID NO: 409735 - DNA, 21 bp, Artificial Sequence
  Description of Artificial Sequence: Synthetic oligonucleotide
ggacctcctggggcagaggcg

SEQ ID NO: 409736 - DNA, 21 bp, Artificial Sequence
  Description of Artificial Sequence: Synthetic oligonucleotide
gacctcctggggcagaggcgg

SEQ ID NO: 409737 - DNA, 21 bp, Artificial Sequence
  Description of Artificial Sequence: Synthetic oligonucleotide
acctcctggggcagaggcggg

SEQ ID NO: 409738 - DNA, 20 bp, Artificial Sequence
  Description of Artificial Sequence: Synthetic oligonucleotide
cctcctggggcagaggcggg

SEQ ID NO: 409739 - DNA, 20 bp, Artificial Sequence
  Description of Artificial Sequence: Synthetic oligonucleotide
ctcctggggcagaggcgggc

SEQ ID NO: 409740 - DNA, 20 bp, Artificial Sequence
  Description of Artificial Sequence: Synthetic oligonucleotide
tcctggggcagaggcgggcc

SEQ ID NO: 409741 - DNA, 20 bp, Artificial Sequence
  Description of Artificial Sequence: Synthetic oligonucleotide
cctggggcagaggcgggcct

SEQ ID NO: 409742 - DNA, 20 bp, Artificial Sequence
  Description of Artificial Sequence: Synthetic oligonucleotide
ctggggcagaggcgggccgt

SEQ ID NO: 409743 - DNA, 20 bp, Artificial Sequence
  Description of Artificial Sequence: Synthetic oligonucleotide
tggggcagaggcgggccgct

SEQ ID NO: 409744 - DNA, 20 bp, Artificial Sequence
  Description of Artificial Sequence: Synthetic oligonucleotide
ggggcagaggcgggccgctt

SEQ ID NO: 409745 - DNA, 20 bp, Artificial Sequence
  Description of Artificial Sequence: Synthetic oligonucleotide
gggcagaggcgggccgcgtt

SEQ ID NO: 409746 - DNA, 20 bp, Artificial Sequence
  Description of Artificial Sequence: Synthetic oligonucleotide
ggcagaggcgggccgcggtt

SEQ ID NO: 409747 - DNA, 39 bp, Artificial Sequence
  Description of Artificial Sequence: Synthetic oligonucleotide
gcatccacagaatcacattttccagtattgaaagacctg

SEQ ID NO: 409748 - DNA, 42 bp, Artificial Sequence
  Description of Artificial Sequence: Synthetic oligonucleotide
catccacagaatcacattttccagtattgaaagacctgaaag

SEQ ID NO: 409749 - DNA, 44 bp, Artificial Sequence
  Description of Artificial Sequence: Synthetic oligonucleotide
atccacagaatcacattttccagtattgaaagacctgaaagatc

SEQ ID NO: 409750 - DNA, 43 bp, Artificial Sequence
  Description of Artificial Sequence: Synthetic oligonucleotide
tccacagaatcacattttccagtattgaaagacctgaaagatc

SEQ ID NO: 409751 - DNA, 42 bp, Artificial Sequence
  Description of Artificial Sequence: Synthetic oligonucleotide
ccacagaatcacattttccagtattgaaagacctgaaagatc

SEQ ID NO: 409752 - DNA, 43 bp, Artificial Sequence
  Description of Artificial Sequence: Synthetic oligonucleotide
cacagaatcacattttccagtattgaaagacctgaaagatcac

SEQ ID NO: 409753 - DNA, 43 bp, Artificial Sequence
  Description of Artificial Sequence: Synthetic oligonucleotide
acagaatcacattttccagtattgaaagacctgaaagatcacg

SEQ ID NO: 409754 - DNA, 42 bp, Artificial Sequence
  Description of Artificial Sequence: Synthetic oligonucleotide
cagaatcacattttccagtattgaaagacctgaaagatcacg

SEQ ID NO: 409755 - DNA, 42 bp, Artificial Sequence
  Description of Artificial Sequence: Synthetic oligonucleotide
agaatcacattttccagtattgaaagacctgaaagatcacgg

SEQ ID NO: 409756 - DNA, 41 bp, Artificial Sequence
  Description of Artificial Sequence: Synthetic oligonucleotide
gaatcacattttccagtattgaaagacctgaaagatcacgg

SEQ ID NO: 409757 - DNA, 42 bp, Artificial Sequence
  Description of Artificial Sequence: Synthetic oligonucleotide
aatcacattttccagtattgaaagacctgaaagatcacggtg

SEQ ID NO: 409758 - DNA, 41 bp, Artificial Sequence
  Description of Artificial Sequence: Synthetic oligonucleotide
atcacattttccagtattgaaagacctgaaagatcacggtg

SEQ ID NO: 409759 - DNA, 40 bp, Artificial Sequence
  Description of Artificial Sequence: Synthetic oligonucleotide
tcacattttccagtattgaaagacctgaaagatcacggtg

SEQ ID NO: 409760 - DNA, 39 bp, Artificial Sequence
  Description of Artificial Sequence: Synthetic oligonucleotide
cacattttccagtattgaaagacctgaaagatcacggtg

SEQ ID NO: 409761 - DNA, 39 bp, Artificial Sequence
  Description of Artificial Sequence: Synthetic oligonucleotide
acattttccagtattgaaagacctgaaagatcacggtgc

SEQ ID NO: 409762 - DNA, 38 bp, Artificial Sequence
  Description of Artificial Sequence: Synthetic oligonucleotide
cattttccagtattgaaagacctgaaagatcacggtgc

SEQ ID NO: 409763 - DNA, 38 bp, Artificial Sequence
  Description of Artificial Sequence: Synthetic oligonucleotide
attttccagtattgaaagacctgaaagatcacggtgcc

SEQ ID NO: 409764 - DNA, 37 bp, Artificial Sequence
  Description of Artificial Sequence: Synthetic oligonucleotide
ttttccagtattgaaagacctgaaagatcacggtgcc

SEQ ID NO: 409765 - DNA, 36 bp, Artificial Sequence
  Description of Artificial Sequence: Synthetic oligonucleotide
tttccagtattgaaagacctgaaagatcacggtgcc

SEQ ID NO: 409766 - DNA, 35 bp, Artificial Sequence
  Description of Artificial Sequence: Synthetic oligonucleotide
ttccagtattgaaagacctgaaagatcacggtgcc

SEQ ID NO: 409767 - DNA, 34 bp, Artificial Sequence
  Description of Artificial Sequence: Synthetic oligonucleotide
tccagtattgaaagacctgaaagatcacggtgcc

SEQ ID NO: 409768 - DNA, 33 bp, Artificial Sequence
  Description of Artificial Sequence: Synthetic oligonucleotide
ccagtattgaaagacctgaaagatcacggtgcc

SEQ ID NO: 409769 - DNA, 35 bp, Artificial Sequence
  Description of Artificial Sequence: Synthetic oligonucleotide
cagtattgaaagacctgaaagatcacggtgccttc

SEQ ID NO: 409770 - DNA, 39 bp, Artificial Sequence
  Description of Artificial Sequence: Synthetic oligonucleotide
agtattgaaagacctgaaagatcacggtgccttcatttc

SEQ ID NO: 409771 - DNA, 38 bp, Artificial Sequence
  Description of Artificial Sequence: Synthetic oligonucleotide
gtattgaaagacctgaaagatcacggtgccttcatttc

SEQ ID NO: 409772 - DNA, 40 bp, Artificial Sequence
  Description of Artificial Sequence: Synthetic oligonucleotide
tattgaaagacctgaaagatcacggtgccttcatttcaac

SEQ ID NO: 409773 - DNA, 39 bp, Artificial Sequence
  Description of Artificial Sequence: Synthetic oligonucleotide
attgaaagacctgaaagatcacggtgccttcatttcaac

SEQ ID NO: 409774 - DNA, 36 bp, Artificial Sequence
  Description of Artificial Sequence: Synthetic oligonucleotide
atcacggtgccttcatttcaactgtgagacatgatg

SEQ ID NO: 409775 - DNA, 35 bp, Artificial Sequence
  Description of Artificial Sequence: Synthetic oligonucleotide
tcacggtgccttcatttcaactgtgagacatgatg

SEQ ID NO: 409776 - DNA, 34 bp, Artificial Sequence
  Description of Artificial Sequence: Synthetic oligonucleotide
cacggtgccttcatttcaactgtgagacatgatg

SEQ ID NO: 409777 - DNA, 41 bp, Artificial Sequence
  Description of Artificial Sequence: Synthetic oligonucleotide
acggtgccttcatttcaactgtgagacatgatgtaattttc

SEQ ID NO: 409778 - DNA, 40 bp, Artificial Sequence
  Description of Artificial Sequence: Synthetic oligonucleotide
cggtgccttcatttcaactgtgagacatgatgtaattttc

SEQ ID NO: 409779 - DNA, 41 bp, Artificial Sequence
  Description of Artificial Sequence: Synthetic oligonucleotide
ggtgccttcatttcaactgtgagacatgatgtaattttcac

SEQ ID NO: 409780 - DNA, 45 bp, Artificial Sequence
  Description of Artificial Sequence: Synthetic oligonucleotide
gtgccttcatttcaactgtgagacatgatgtaattttcacaaatc

SEQ ID NO: 409781 - DNA, 47 bp, Artificial Sequence
  Description of Artificial Sequence: Synthetic oligonucleotide
tgccttcatttcaactgtgagacatgatgtaattttcacaaatctac

SEQ ID NO: 409782 - DNA, 46 bp, Artificial Sequence
  Description of Artificial Sequence: Synthetic oligonucleotide
gccttcatttcaactgtgagacatgatgtaattttcacaaatctac

SEQ ID NO: 409783 - DNA, 48 bp, Artificial Sequence
  Description of Artificial Sequence: Synthetic oligonucleotide
ccttcatttcaactgtgagacatgatgtaattttcacaaatctacaac

SEQ ID NO: 409784 - DNA, 49 bp, Artificial Sequence
  Description of Artificial Sequence: Synthetic oligonucleotide
cttcatttcaactgtgagacatgatgtaattttcacaaatctacaacag

SEQ ID NO: 409785 - DNA, 52 bp, Artificial Sequence
  Description of Artificial Sequence: Synthetic oligonucleotide
ttcatttcaactgtgagacatgatgtaattttcacaaatctacaacagtaag

SEQ ID NO: 409786 - DNA, 51 bp, Artificial Sequence
  Description of Artificial Sequence: Synthetic oligonucleotide
tcatttcaactgtgagacatgatgtaattttcacaaatctacaacagtaag

SEQ ID NO: 409787 - DNA, 50 bp, Artificial Sequence
  Description of Artificial Sequence: Synthetic oligonucleotide
catttcaactgtgagacatgatgtaattttcacaaatctacaacagtaag

SEQ ID NO: 409788 - DNA, 55 bp, Artificial Sequence
  Description of Artificial Sequence: Synthetic oligonucleotide
atttcaactgtgagacatgatgtaattttcacaaatctacaacagtaagatatag

SEQ ID NO: 409789 - DNA, 54 bp, Artificial Sequence
  Description of Artificial Sequence: Synthetic oligonucleotide
tttcaactgtgagacatgatgtaattttcacaaatctacaacagtaagatatag

SEQ ID NO: 409790 - DNA, 53 bp, Artificial Sequence
  Description of Artificial Sequence: Synthetic oligonucleotide
ttcaactgtgagacatgatgtaattttcacaaatctacaacagtaagatatag

SEQ ID NO: 409791 - DNA, 52 bp, Artificial Sequence
  Description of Artificial Sequence: Synthetic oligonucleotide
tcaactgtgagacatgatgtaattttcacaaatctacaacagtaagatatag

SEQ ID NO: 409792 - DNA, 51 bp, Artificial Sequence
  Description of Artificial Sequence: Synthetic oligonucleotide
caactgtgagacatgatgtaattttcacaaatctacaacagtaagatatag

SEQ ID NO: 409793 - DNA, 52 bp, Artificial Sequence
  Description of Artificial Sequence: Synthetic oligonucleotide
aactgtgagacatgatgtaattttcacaaatctacaacagtaagatatagtg

SEQ ID NO: 409794 - DNA, 51 bp, Artificial Sequence
  Description of Artificial Sequence: Synthetic oligonucleotide
actgtgagacatgatgtaattttcacaaatctacaacagtaagatatagtg

SEQ ID NO: 409795 - DNA, 50 bp, Artificial Sequence
  Description of Artificial Sequence: Synthetic oligonucleotide
ctgtgagacatgatgtaattttcacaaatctacaacagtaagatatagtg

SEQ ID NO: 409796 - DNA, 50 bp, Artificial Sequence
  Description of Artificial Sequence: Synthetic oligonucleotide
tgtgagacatgatgtaattttcacaaatctacaacagtaagatatagtgc

SEQ ID NO: 409797 - DNA, 49 bp, Artificial Sequence
  Description of Artificial Sequence: Synthetic oligonucleotide
gtgagacatgatgtaattttcacaaatctacaacagtaagatatagtgc

SEQ ID NO: 409798 - DNA, 51 bp, Artificial Sequence
  Description of Artificial Sequence: Synthetic oligonucleotide
tgagacatgatgtaattttcacaaatctacaacagtaagatatagtgcaac

SEQ ID NO: 409799 - DNA, 50 bp, Artificial Sequence
  Description of Artificial Sequence: Synthetic oligonucleotide
gagacatgatgtaattttcacaaatctacaacagtaagatatagtgcaac

SEQ ID NO: 409800 - DNA, 51 bp, Artificial Sequence
  Description of Artificial Sequence: Synthetic oligonucleotide
agacatgatgtaattttcacaaatctacaacagtaagatatagtgcaacag

SEQ ID NO: 409801 - DNA, 50 bp, Artificial Sequence
  Description of Artificial Sequence: Synthetic oligonucleotide
gacatgatgtaattttcacaaatctacaacagtaagatatagtgcaacag

SEQ ID NO: 409802 - DNA, 50 bp, Artificial Sequence
  Description of Artificial Sequence: Synthetic oligonucleotide
acatgatgtaattttcacaaatctacaacagtaagatatagtgcaacagg

SEQ ID NO: 409803 - DNA, 49 bp, Artificial Sequence
  Description of Artificial Sequence: Synthetic oligonucleotide
catgatgtaattttcacaaatctacaacagtaagatatagtgcaacagg

SEQ ID NO: 409804 - DNA, 50 bp, Artificial Sequence
  Description of Artificial Sequence: Synthetic oligonucleotide
atgatgtaattttcacaaatctacaacagtaagatatagtgcaacaggac

SEQ ID NO: 409805 - DNA, 49 bp, Artificial Sequence
  Description of Artificial Sequence: Synthetic oligonucleotide
tgatgtaattttcacaaatctacaacagtaagatatagtgcaacaggac

SEQ ID NO: 409806 - DNA, 48 bp, Artificial Sequence
  Description of Artificial Sequence: Synthetic oligonucleotide
gatgtaattttcacaaatctacaacagtaagatatagtgcaacaggac

SEQ ID NO: 409807 - DNA, 48 bp, Artificial Sequence
  Description of Artificial Sequence: Synthetic oligonucleotide
atgtaattttcacaaatctacaacagtaagatatagtgcaacaggacc

SEQ ID NO: 409808 - DNA, 47 bp, Artificial Sequence
  Description of Artificial Sequence: Synthetic oligonucleotide
tgtaattttcacaaatctacaacagtaagatatagtgcaacaggacc

SEQ ID NO: 409809 - DNA, 46 bp, Artificial Sequence
  Description of Artificial Sequence: Synthetic oligonucleotide
gtaattttcacaaatctacaacagtaagatatagtgcaacaggacc

SEQ ID NO: 409810 - DNA, 47 bp, Artificial Sequence
  Description of Artificial Sequence: Synthetic oligonucleotide
taattttcacaaatctacaacagtaagatatagtgcaacaggaccag

SEQ ID NO: 409811 - DNA, 46 bp, Artificial Sequence
  Description of Artificial Sequence: Synthetic oligonucleotide
aattttcacaaatctacaacagtaagatatagtgcaacaggaccag

SEQ ID NO: 409812 - DNA, 45 bp, Artificial Sequence
  Description of Artificial Sequence: Synthetic oligonucleotide
attttcacaaatctacaacagtaagatatagtgcaacaggaccag

SEQ ID NO: 409813 - DNA, 44 bp, Artificial Sequence
  Description of Artificial Sequence: Synthetic oligonucleotide
ttttcacaaatctacaacagtaagatatagtgcaacaggaccag

SEQ ID NO: 409814 - DNA, 43 bp, Artificial Sequence
  Description of Artificial Sequence: Synthetic oligonucleotide
tttcacaaatctacaacagtaagatatagtgcaacaggaccag

SEQ ID NO: 409815 - DNA, 42 bp, Artificial Sequence
  Description of Artificial Sequence: Synthetic oligonucleotide
ttcacaaatctacaacagtaagatatagtgcaacaggaccag

SEQ ID NO: 409816 - DNA, 41 bp, Artificial Sequence
  Description of Artificial Sequence: Synthetic oligonucleotide
tcacaaatctacaacagtaagatatagtgcaacaggaccag

SEQ ID NO: 409817 - DNA, 40 bp, Artificial Sequence
  Description of Artificial Sequence: Synthetic oligonucleotide
cacaaatctacaacagtaagatatagtgcaacaggaccag

SEQ ID NO: 409818 - DNA, 45 bp, Artificial Sequence
  Description of Artificial Sequence: Synthetic oligonucleotide
acaaatctacaacagtaagatatagtgcaacaggaccagattaag

SEQ ID NO: 409819 - DNA, 44 bp, Artificial Sequence
  Description of Artificial Sequence: Synthetic oligonucleotide
caaatctacaacagtaagatatagtgcaacaggaccagattaag

SEQ ID NO: 409820 - DNA, 44 bp, Artificial Sequence
  Description of Artificial Sequence: Synthetic oligonucleotide
aaatctacaacagtaagatatagtgcaacaggaccagattaagg

SEQ ID NO: 409821 - DNA, 43 bp, Artificial Sequence
  Description of Artificial Sequence: Synthetic oligonucleotide
aatctacaacagtaagatatagtgcaacaggaccagattaagg

SEQ ID NO: 409822 - DNA, 42 bp, Artificial Sequence
  Description of Artificial Sequence: Synthetic oligonucleotide
atctacaacagtaagatatagtgcaacaggaccagattaagg

SEQ ID NO: 409823 - DNA, 41 bp, Artificial Sequence
  Description of Artificial Sequence: Synthetic oligonucleotide
tctacaacagtaagatatagtgcaacaggaccagattaagg

SEQ ID NO: 409824 - DNA, 40 bp, Artificial Sequence
  Description of Artificial Sequence: Synthetic oligonucleotide
ctacaacagtaagatatagtgcaacaggaccagattaagg

SEQ ID NO: 409825 - DNA, 41 bp, Artificial Sequence
  Description of Artificial Sequence: Synthetic oligonucleotide
tacaacagtaagatatagtgcaacaggaccagattaaggtc

SEQ ID NO: 409826 - DNA, 40 bp, Artificial Sequence
  Description of Artificial Sequence: Synthetic oligonucleotide
acaacagtaagatatagtgcaacaggaccagattaaggtc

SEQ ID NO: 409827 - DNA, 39 bp, Artificial Sequence
  Description of Artificial Sequence: Synthetic oligonucleotide
caacagtaagatatagtgcaacaggaccagattaaggtc

SEQ ID NO: 409828 - DNA, 40 bp, Artificial Sequence
  Description of Artificial Sequence: Synthetic oligonucleotide
aacagtaagatatagtgcaacaggaccagattaaggtctc

SEQ ID NO: 409829 - DNA, 39 bp, Artificial Sequence
  Description of Artificial Sequence: Synthetic oligonucleotide
acagtaagatatagtgcaacaggaccagattaaggtctc

SEQ ID NO: 409830 - DNA, 38 bp, Artificial Sequence
  Description of Artificial Sequence: Synthetic oligonucleotide
cagtaagatatagtgcaacaggaccagattaaggtctc

SEQ ID NO: 409831 - DNA, 38 bp, Artificial Sequence
  Description of Artificial Sequence: Synthetic oligonucleotide
agtaagatatagtgcaacaggaccagattaaggtctcc

SEQ ID NO: 409832 - DNA, 37 bp, Artificial Sequence
  Description of Artificial Sequence: Synthetic oligonucleotide
gtaagatatagtgcaacaggaccagattaaggtctcc

SEQ ID NO: 409833 - DNA, 38 bp, Artificial Sequence
  Description of Artificial Sequence: Synthetic oligonucleotide
taagatatagtgcaacaggaccagattaaggtctcctg

SEQ ID NO: 409834 - DNA, 37 bp, Artificial Sequence
  Description of Artificial Sequence: Synthetic oligonucleotide
aagatatagtgcaacaggaccagattaaggtctcctg

SEQ ID NO: 409835 - DNA, 36 bp, Artificial Sequence
  Description of Artificial Sequence: Synthetic oligonucleotide
agatatagtgcaacaggaccagattaaggtctcctg

SEQ ID NO: 409836 - DNA, 35 bp, Artificial Sequence
  Description of Artificial Sequence: Synthetic oligonucleotide
gatatagtgcaacaggaccagattaaggtctcctg

SEQ ID NO: 409837 - DNA, 35 bp, Artificial Sequence
  Description of Artificial Sequence: Synthetic oligonucleotide
atatagtgcaacaggaccagattaaggtctcctgg

SEQ ID NO: 409838 - DNA, 34 bp, Artificial Sequence
  Description of Artificial Sequence: Synthetic oligonucleotide
tatagtgcaacaggaccagattaaggtctcctgg

SEQ ID NO: 409839 - DNA, 33 bp, Artificial Sequence
  Description of Artificial Sequence: Synthetic oligonucleotide
atagtgcaacaggaccagattaaggtctcctgg

SEQ ID NO: 409840 - DNA, 32 bp, Artificial Sequence
  Description of Artificial Sequence: Synthetic oligonucleotide
tagtgcaacaggaccagattaaggtctcctgg

SEQ ID NO: 409841 - DNA, 31 bp, Artificial Sequence
  Description of Artificial Sequence: Synthetic oligonucleotide
agtgcaacaggaccagattaaggtctcctgg

SEQ ID NO: 409842 - DNA, 30 bp, Artificial Sequence
  Description of Artificial Sequence: Synthetic oligonucleotide
gtgcaacaggaccagattaaggtctcctgg

SEQ ID NO: 409843 - DNA, 33 bp, Artificial Sequence
  Description of Artificial Sequence: Synthetic oligonucleotide
tgcaacaggaccagattaaggtctcctggtttg

SEQ ID NO: 409844 - DNA, 32 bp, Artificial Sequence
  Description of Artificial Sequence: Synthetic oligonucleotide
gcaacaggaccagattaaggtctcctggtttg

SEQ ID NO: 409845 - DNA, 32 bp, Artificial Sequence
  Description of Artificial Sequence: Synthetic oligonucleotide
caacaggaccagattaaggtctcctggtttgc

SEQ ID NO: 409846 - DNA, 34 bp, Artificial Sequence
  Description of Artificial Sequence: Synthetic oligonucleotide
aacaggaccagattaaggtctcctggtttgcaac

SEQ ID NO: 409847 - DNA, 33 bp, Artificial Sequence
  Description of Artificial Sequence: Synthetic oligonucleotide
acaggaccagattaaggtctcctggtttgcaac

SEQ ID NO: 409848 - DNA, 32 bp, Artificial Sequence
  Description of Artificial Sequence: Synthetic oligonucleotide
caggaccagattaaggtctcctggtttgcaac

SEQ ID NO: 409849 - DNA, 32 bp, Artificial Sequence
  Description of Artificial Sequence: Synthetic oligonucleotide
aggaccagattaaggtctcctggtttgcaacc

SEQ ID NO: 409850 - DNA, 31 bp, Artificial Sequence
  Description of Artificial Sequence: Synthetic oligonucleotide
ggaccagattaaggtctcctggtttgcaacc

SEQ ID NO: 409851 - DNA, 33 bp, Artificial Sequence
  Description of Artificial Sequence: Synthetic oligonucleotide
gaccagattaaggtctcctggtttgcaaccatg

SEQ ID NO: 409852 - DNA, 34 bp, Artificial Sequence
  Description of Artificial Sequence: Synthetic oligonucleotide
accagattaaggtctcctggtttgcaaccatgtc

SEQ ID NO: 409853 - DNA, 33 bp, Artificial Sequence
  Description of Artificial Sequence: Synthetic oligonucleotide
ccagattaaggtctcctggtttgcaaccatgtc

SEQ ID NO: 409854 - DNA, 33 bp, Artificial Sequence
  Description of Artificial Sequence: Synthetic oligonucleotide
cagattaaggtctcctggtttgcaaccatgtcc

SEQ ID NO: 409855 - DNA, 33 bp, Artificial Sequence
  Description of Artificial Sequence: Synthetic oligonucleotide
agattaaggtctcctggtttgcaaccatgtccc

SEQ ID NO: 409856 - DNA, 32 bp, Artificial Sequence
  Description of Artificial Sequence: Synthetic oligonucleotide
gattaaggtctcctggtttgcaaccatgtccc

SEQ ID NO: 409857 - DNA, 32 bp, Artificial Sequence
  Description of Artificial Sequence: Synthetic oligonucleotide
attaaggtctcctggtttgcaaccatgtcccc

SEQ ID NO: 409858 - DNA, 31 bp, Artificial Sequence
  Description of Artificial Sequence: Synthetic oligonucleotide
ttaaggtctcctggtttgcaaccatgtcccc

SEQ ID NO: 409859 - DNA, 30 bp, Artificial Sequence
  Description of Artificial Sequence: Synthetic oligonucleotide
taaggtctcctggtttgcaaccatgtcccc

SEQ ID NO: 409860 - DNA, 29 bp, Artificial Sequence
  Description of Artificial Sequence: Synthetic oligonucleotide
aaggtctcctggtttgcaaccatgtcccc

SEQ ID NO: 409861 - DNA, 28 bp, Artificial Sequence
  Description of Artificial Sequence: Synthetic oligonucleotide
aggtctcctggtttgcaaccatgtcccc

SEQ ID NO: 409862 - DNA, 27 bp, Artificial Sequence
  Description of Artificial Sequence: Synthetic oligonucleotide
ggtctcctggtttgcaaccatgtcccc

SEQ ID NO: 409863 - DNA, 28 bp, Artificial Sequence
  Description of Artificial Sequence: Synthetic oligonucleotide
gtctcctggtttgcaaccatgtcccctc

SEQ ID NO: 409864 - DNA, 28 bp, Artificial Sequence
  Description of Artificial Sequence: Synthetic oligonucleotide
tctcctggtttgcaaccatgtcccctcc

SEQ ID NO: 409865 - DNA, 27 bp, Artificial Sequence
  Description of Artificial Sequence: Synthetic oligonucleotide
ctcctggtttgcaaccatgtcccctcc

SEQ ID NO: 409866 - DNA, 29 bp, Artificial Sequence
  Description of Artificial Sequence: Synthetic oligonucleotide
tcctggtttgcaaccatgtcccctccatc

SEQ ID NO: 409867 - DNA, 28 bp, Artificial Sequence
  Description of Artificial Sequence: Synthetic oligonucleotide
cctggtttgcaaccatgtcccctccatc

SEQ ID NO: 409868 - DNA, 29 bp, Artificial Sequence
  Description of Artificial Sequence: Synthetic oligonucleotide
ctggtttgcaaccatgtcccctccatctc

SEQ ID NO: 409869 - DNA, 29 bp, Artificial Sequence
  Description of Artificial Sequence: Synthetic oligonucleotide
tggtttgcaaccatgtcccctccatctcc

SEQ ID NO: 409870 - DNA, 28 bp, Artificial Sequence
  Description of Artificial Sequence: Synthetic oligonucleotide
ggtttgcaaccatgtcccctccatctcc

SEQ ID NO: 409871 - DNA, 32 bp, Artificial Sequence
  Description of Artificial Sequence: Synthetic oligonucleotide
gtttgcaaccatgtcccctccatctcctttac

SEQ ID NO: 409872 - DNA, 33 bp, Artificial Sequence
  Description of Artificial Sequence: Synthetic oligonucleotide
tttgcaaccatgtcccctccatctcctttactc

SEQ ID NO: 409873 - DNA, 32 bp, Artificial Sequence
  Description of Artificial Sequence: Synthetic oligonucleotide
ttgcaaccatgtcccctccatctcctttactc

SEQ ID NO: 409874 - DNA, 31 bp, Artificial Sequence
  Description of Artificial Sequence: Synthetic oligonucleotide
tgcaaccatgtcccctccatctcctttactc

SEQ ID NO: 409875 - DNA, 30 bp, Artificial Sequence
  Description of Artificial Sequence: Synthetic oligonucleotide
gcaaccatgtcccctccatctcctttactc

SEQ ID NO: 409876 - DNA, 30 bp, Artificial Sequence
  Description of Artificial Sequence: Synthetic oligonucleotide
caaccatgtcccctccatctcctttactcc

SEQ ID NO: 409877 - DNA, 31 bp, Artificial Sequence
  Description of Artificial Sequence: Synthetic oligonucleotide
aaccatgtcccctccatctcctttactcctg

SEQ ID NO: 409878 - DNA, 30 bp, Artificial Sequence
  Description of Artificial Sequence: Synthetic oligonucleotide
accatgtcccctccatctcctttactcctg

SEQ ID NO: 409879 - DNA, 29 bp, Artificial Sequence
  Description of Artificial Sequence: Synthetic oligonucleotide
ccatgtcccctccatctcctttactcctg

SEQ ID NO: 409880 - DNA, 31 bp, Artificial Sequence
  Description of Artificial Sequence: Synthetic oligonucleotide
catgtcccctccatctcctttactcctgaac

SEQ ID NO: 409881 - DNA, 32 bp, Artificial Sequence
  Description of Artificial Sequence: Synthetic oligonucleotide
atgtcccctccatctcctttactcctgaacac

SEQ ID NO: 409882 - DNA, 31 bp, Artificial Sequence
  Description of Artificial Sequence: Synthetic oligonucleotide
tgtcccctccatctcctttactcctgaacac

SEQ ID NO: 409883 - DNA, 30 bp, Artificial Sequence
  Description of Artificial Sequence: Synthetic oligonucleotide
gtcccctccatctcctttactcctgaacac

SEQ ID NO: 409884 - DNA, 31 bp, Artificial Sequence
  Description of Artificial Sequence: Synthetic oligonucleotide
tcccctccatctcctttactcctgaacacac

SEQ ID NO: 409885 - DNA, 30 bp, Artificial Sequence
  Description of Artificial Sequence: Synthetic oligonucleotide
cccctccatctcctttactcctgaacacac

SEQ ID NO: 409886 - DNA, 31 bp, Artificial Sequence
  Description of Artificial Sequence: Synthetic oligonucleotide
ccctccatctcctttactcctgaacacactc

SEQ ID NO: 409887 - DNA, 32 bp, Artificial Sequence
  Description of Artificial Sequence: Synthetic oligonucleotide
cctccatctcctttactcctgaacacactcac

SEQ ID NO: 409888 - DNA, 33 bp, Artificial Sequence
  Description of Artificial Sequence: Synthetic oligonucleotide
ctccatctcctttactcctgaacacactcactc

SEQ ID NO: 409889 - DNA, 33 bp, Artificial Sequence
  Description of Artificial Sequence: Synthetic oligonucleotide
tccatctcctttactcctgaacacactcactcc

SEQ ID NO: 409890 - DNA, 32 bp, Artificial Sequence
  Description of Artificial Sequence: Synthetic oligonucleotide
ccatctcctttactcctgaacacactcactcc

SEQ ID NO: 409891 - DNA, 33 bp, Artificial Sequence
  Description of Artificial Sequence: Synthetic oligonucleotide
catctcctttactcctgaacacactcactcctg

SEQ ID NO: 409892 - DNA, 33 bp, Artificial Sequence
  Description of Artificial Sequence: Synthetic oligonucleotide
atctcctttactcctgaacacactcactcctgc

SEQ ID NO: 409893 - DNA, 32 bp, Artificial Sequence
  Description of Artificial Sequence: Synthetic oligonucleotide
tctcctttactcctgaacacactcactcctgc

SEQ ID NO: 409894 - DNA, 31 bp, Artificial Sequence
  Description of Artificial Sequence: Synthetic oligonucleotide
ctcctttactcctgaacacactcactcctgc

SEQ ID NO: 409895 - DNA, 34 bp, Artificial Sequence
  Description of Artificial Sequence: Synthetic oligonucleotide
tcctttactcctgaacacactcactcctgcaaac

SEQ ID NO: 409896 - DNA, 33 bp, Artificial Sequence
  Description of Artificial Sequence: Synthetic oligonucleotide
cctttactcctgaacacactcactcctgcaaac

SEQ ID NO: 409897 - DNA, 34 bp, Artificial Sequence
  Description of Artificial Sequence: Synthetic oligonucleotide
ctttactcctgaacacactcactcctgcaaacag

SEQ ID NO: 409898 - DNA, 36 bp, Artificial Sequence
  Description of Artificial Sequence: Synthetic oligonucleotide
tttactcctgaacacactcactcctgcaaacagttc

SEQ ID NO: 409899 - DNA, 35 bp, Artificial Sequence
  Description of Artificial Sequence: Synthetic oligonucleotide
ttactcctgaacacactcactcctgcaaacagttc

SEQ ID NO: 409900 - DNA, 34 bp, Artificial Sequence
  Description of Artificial Sequence: Synthetic oligonucleotide
tactcctgaacacactcactcctgcaaacagttc

SEQ ID NO: 409901 - DNA, 33 bp, Artificial Sequence
  Description of Artificial Sequence: Synthetic oligonucleotide
actcctgaacacactcactcctgcaaacagttc

SEQ ID NO: 409902 - DNA, 32 bp, Artificial Sequence
  Description of Artificial Sequence: Synthetic oligonucleotide
ctcctgaacacactcactcctgcaaacagttc

SEQ ID NO: 409903 - DNA, 33 bp, Artificial Sequence
  Description of Artificial Sequence: Synthetic oligonucleotide
tcctgaacacactcactcctgcaaacagttctc

SEQ ID NO: 409904 - DNA, 32 bp, Artificial Sequence
  Description of Artificial Sequence: Synthetic oligonucleotide
cctgaacacactcactcctgcaaacagttctc

SEQ ID NO: 409905 - DNA, 34 bp, Artificial Sequence
  Description of Artificial Sequence: Synthetic oligonucleotide
ctgaacacactcactcctgcaaacagttctcttg

SEQ ID NO: 409906 - DNA, 35 bp, Artificial Sequence
  Description of Artificial Sequence: Synthetic oligonucleotide
tgaacacactcactcctgcaaacagttctcttgtc

SEQ ID NO: 409907 - DNA, 34 bp, Artificial Sequence
  Description of Artificial Sequence: Synthetic oligonucleotide
gaacacactcactcctgcaaacagttctcttgtc

SEQ ID NO: 409908 - DNA, 36 bp, Artificial Sequence
  Description of Artificial Sequence: Synthetic oligonucleotide
aacacactcactcctgcaaacagttctcttgtcaag

SEQ ID NO: 409909 - DNA, 35 bp, Artificial Sequence
  Description of Artificial Sequence: Synthetic oligonucleotide
acacactcactcctgcaaacagttctcttgtcaag

SEQ ID NO: 409910 - DNA, 34 bp, Artificial Sequence
  Description of Artificial Sequence: Synthetic oligonucleotide
cacactcactcctgcaaacagttctcttgtcaag

SEQ ID NO: 409911 - DNA, 35 bp, Artificial Sequence
  Description of Artificial Sequence: Synthetic oligonucleotide
acactcactcctgcaaacagttctcttgtcaagtg

SEQ ID NO: 409912 - DNA, 34 bp, Artificial Sequence
  Description of Artificial Sequence: Synthetic oligonucleotide
cactcactcctgcaaacagttctcttgtcaagtg

SEQ ID NO: 409913 - DNA, 34 bp, Artificial Sequence
  Description of Artificial Sequence: Synthetic oligonucleotide
actcactcctgcaaacagttctcttgtcaagtgg

SEQ ID NO: 409914 - DNA, 33 bp, Artificial Sequence
  Description of Artificial Sequence: Synthetic oligonucleotide
ctcactcctgcaaacagttctcttgtcaagtgg

SEQ ID NO: 409915 - DNA, 33 bp, Artificial Sequence
  Description of Artificial Sequence: Synthetic oligonucleotide
tcactcctgcaaacagttctcttgtcaagtggg

SEQ ID NO: 409916 - DNA, 32 bp, Artificial Sequence
  Description of Artificial Sequence: Synthetic oligonucleotide
cactcctgcaaacagttctcttgtcaagtggg

SEQ ID NO: 409917 - DNA, 36 bp, Artificial Sequence
  Description of Artificial Sequence: Synthetic oligonucleotide
actcctgcaaacagttctcttgtcaagtgggaaatg

SEQ ID NO: 409918 - DNA, 35 bp, Artificial Sequence
  Description of Artificial Sequence: Synthetic oligonucleotide
ctcctgcaaacagttctcttgtcaagtgggaaatg

SEQ ID NO: 409919 - DNA, 38 bp, Artificial Sequence
  Description of Artificial Sequence: Synthetic oligonucleotide
tcctgcaaacagttctcttgtcaagtgggaaatgaatg

SEQ ID NO: 409920 - DNA, 37 bp, Artificial Sequence
  Description of Artificial Sequence: Synthetic oligonucleotide
cctgcaaacagttctcttgtcaagtgggaaatgaatg

SEQ ID NO: 409921 - DNA, 37 bp, Artificial Sequence
  Description of Artificial Sequence: Synthetic oligonucleotide
ctgcaaacagttctcttgtcaagtgggaaatgaatgc

SEQ ID NO: 409922 - DNA, 38 bp, Artificial Sequence
  Description of Artificial Sequence: Synthetic oligonucleotide
tgcaaacagttctcttgtcaagtgggaaatgaatgctc

SEQ ID NO: 409923 - DNA, 37 bp, Artificial Sequence
  Description of Artificial Sequence: Synthetic oligonucleotide
gcaaacagttctcttgtcaagtgggaaatgaatgctc

SEQ ID NO: 409924 - DNA, 40 bp, Artificial Sequence
  Description of Artificial Sequence: Synthetic oligonucleotide
caaacagttctcttgtcaagtgggaaatgaatgctcttac

SEQ ID NO: 409925 - DNA, 42 bp, Artificial Sequence
  Description of Artificial Sequence: Synthetic oligonucleotide
aaacagttctcttgtcaagtgggaaatgaatgctcttacaag

SEQ ID NO: 409926 - DNA, 41 bp, Artificial Sequence
  Description of Artificial Sequence: Synthetic oligonucleotide
aacagttctcttgtcaagtgggaaatgaatgctcttacaag

SEQ ID NO: 409927 - DNA, 40 bp, Artificial Sequence
  Description of Artificial Sequence: Synthetic oligonucleotide
acagttctcttgtcaagtgggaaatgaatgctcttacaag

SEQ ID NO: 409928 - DNA, 39 bp, Artificial Sequence
  Description of Artificial Sequence: Synthetic oligonucleotide
cagttctcttgtcaagtgggaaatgaatgctcttacaag

SEQ ID NO: 409929 - DNA, 39 bp, Artificial Sequence
  Description of Artificial Sequence: Synthetic oligonucleotide
agttctcttgtcaagtgggaaatgaatgctcttacaagg

SEQ ID NO: 409930 - DNA, 38 bp, Artificial Sequence
  Description of Artificial Sequence: Synthetic oligonucleotide
gttctcttgtcaagtgggaaatgaatgctcttacaagg

SEQ ID NO: 409931 - DNA, 38 bp, Artificial Sequence
  Description of Artificial Sequence: Synthetic oligonucleotide
ttctcttgtcaagtgggaaatgaatgctcttacaaggc

SEQ ID NO: 409932 - DNA, 37 bp, Artificial Sequence
  Description of Artificial Sequence: Synthetic oligonucleotide
tctcttgtcaagtgggaaatgaatgctcttacaaggc

SEQ ID NO: 409933 - DNA, 36 bp, Artificial Sequence
  Description of Artificial Sequence: Synthetic oligonucleotide
ctcttgtcaagtgggaaatgaatgctcttacaaggc

SEQ ID NO: 409934 - DNA, 41 bp, Artificial Sequence
  Description of Artificial Sequence: Synthetic oligonucleotide
ttgtgaacacatcactgaccagcacagagctaaaataattg

SEQ ID NO: 409935 - DNA, 40 bp, Artificial Sequence
  Description of Artificial Sequence: Synthetic oligonucleotide
tgtgaacacatcactgaccagcacagagctaaaataattg

SEQ ID NO: 409936 - DNA, 39 bp, Artificial Sequence
  Description of Artificial Sequence: Synthetic oligonucleotide
gtgaacacatcactgaccagcacagagctaaaataattg

SEQ ID NO: 409937 - DNA, 39 bp, Artificial Sequence
  Description of Artificial Sequence: Synthetic oligonucleotide
tgaacacatcactgaccagcacagagctaaaataattgg

SEQ ID NO: 409938 - DNA, 38 bp, Artificial Sequence
  Description of Artificial Sequence: Synthetic oligonucleotide
gaacacatcactgaccagcacagagctaaaataattgg

SEQ ID NO: 409939 - DNA, 38 bp, Artificial Sequence
  Description of Artificial Sequence: Synthetic oligonucleotide
aacacatcactgaccagcacagagctaaaataattggg

SEQ ID NO: 409940 - DNA, 37 bp, Artificial Sequence
  Description of Artificial Sequence: Synthetic oligonucleotide
acacatcactgaccagcacagagctaaaataattggg

SEQ ID NO: 409941 - DNA, 36 bp, Artificial Sequence
  Description of Artificial Sequence: Synthetic oligonucleotide
cacatcactgaccagcacagagctaaaataattggg

SEQ ID NO: 409942 - DNA, 36 bp, Artificial Sequence
  Description of Artificial Sequence: Synthetic oligonucleotide
acatcactgaccagcacagagctaaaataattgggg

SEQ ID NO: 409943 - DNA, 35 bp, Artificial Sequence
  Description of Artificial Sequence: Synthetic oligonucleotide
catcactgaccagcacagagctaaaataattgggg

SEQ ID NO: 409944 - DNA, 35 bp, Artificial Sequence
  Description of Artificial Sequence: Synthetic oligonucleotide
atcactgaccagcacagagctaaaataattggggc

SEQ ID NO: 409945 - DNA, 34 bp, Artificial Sequence
  Description of Artificial Sequence: Synthetic oligonucleotide
tcactgaccagcacagagctaaaataattggggc

SEQ ID NO: 409946 - DNA, 33 bp, Artificial Sequence
  Description of Artificial Sequence: Synthetic oligonucleotide
cactgaccagcacagagctaaaataattggggc

SEQ ID NO: 409947 - DNA, 41 bp, Artificial Sequence
  Description of Artificial Sequence: Synthetic oligonucleotide
actgaccagcacagagctaaaataattggggctaaaaatac

SEQ ID NO: 409948 - DNA, 40 bp, Artificial Sequence
  Description of Artificial Sequence: Synthetic oligonucleotide
ctgaccagcacagagctaaaataattggggctaaaaatac

SEQ ID NO: 409949 - DNA, 40 bp, Artificial Sequence
  Description of Artificial Sequence: Synthetic oligonucleotide
tgaccagcacagagctaaaataattggggctaaaaatacc

SEQ ID NO: 409950 - DNA, 39 bp, Artificial Sequence
  Description of Artificial Sequence: Synthetic oligonucleotide
gaccagcacagagctaaaataattggggctaaaaatacc

SEQ ID NO: 409951 - DNA, 39 bp, Artificial Sequence
  Description of Artificial Sequence: Synthetic oligonucleotide
accagcacagagctaaaataattggggctaaaaataccg

SEQ ID NO: 409952 - DNA, 38 bp, Artificial Sequence
  Description of Artificial Sequence: Synthetic oligonucleotide
ccagcacagagctaaaataattggggctaaaaataccg

SEQ ID NO: 409953 - DNA, 38 bp, Artificial Sequence
  Description of Artificial Sequence: Synthetic oligonucleotide
cagcacagagctaaaataattggggctaaaaataccgc

SEQ ID NO: 409954 - DNA, 38 bp, Artificial Sequence
  Description of Artificial Sequence: Synthetic oligonucleotide
agcacagagctaaaataattggggctaaaaataccgcc

SEQ ID NO: 409955 - DNA, 37 bp, Artificial Sequence
  Description of Artificial Sequence: Synthetic oligonucleotide
gcacagagctaaaataattggggctaaaaataccgcc

SEQ ID NO: 409956 - DNA, 37 bp, Artificial Sequence
  Description of Artificial Sequence: Synthetic oligonucleotide
cacagagctaaaataattggggctaaaaataccgccc

SEQ ID NO: 409957 - DNA, 37 bp, Artificial Sequence
  Description of Artificial Sequence: Synthetic oligonucleotide
acagagctaaaataattggggctaaaaataccgcccc

SEQ ID NO: 409958 - DNA, 36 bp, Artificial Sequence
  Description of Artificial Sequence: Synthetic oligonucleotide
cagagctaaaataattggggctaaaaataccgcccc

SEQ ID NO: 409959 - DNA, 43 bp, Artificial Sequence
  Description of Artificial Sequence: Synthetic oligonucleotide
agagctaaaataattggggctaaaaataccgccccaattaaag

SEQ ID NO: 409960 - DNA, 42 bp, Artificial Sequence
  Description of Artificial Sequence: Synthetic oligonucleotide
gagctaaaataattggggctaaaaataccgccccaattaaag

SEQ ID NO: 409961 - DNA, 43 bp, Artificial Sequence
  Description of Artificial Sequence: Synthetic oligonucleotide
agctaaaataattggggctaaaaataccgccccaattaaagtg

SEQ ID NO: 409962 - DNA, 42 bp, Artificial Sequence
  Description of Artificial Sequence: Synthetic oligonucleotide
gctaaaataattggggctaaaaataccgccccaattaaagtg

SEQ ID NO: 409963 - DNA, 47 bp, Artificial Sequence
  Description of Artificial Sequence: Synthetic oligonucleotide
ctaaaataattggggctaaaaataccgccccaattaaagtgttttac

SEQ ID NO: 409964 - DNA, 49 bp, Artificial Sequence
  Description of Artificial Sequence: Synthetic oligonucleotide
taaaataattggggctaaaaataccgccccaattaaagtgttttacatg

SEQ ID NO: 409965 - DNA, 48 bp, Artificial Sequence
  Description of Artificial Sequence: Synthetic oligonucleotide
aaaataattggggctaaaaataccgccccaattaaagtgttttacatg

SEQ ID NO: 409966 - DNA, 47 bp, Artificial Sequence
  Description of Artificial Sequence: Synthetic oligonucleotide
aaataattggggctaaaaataccgccccaattaaagtgttttacatg

SEQ ID NO: 409967 - DNA, 46 bp, Artificial Sequence
  Description of Artificial Sequence: Synthetic oligonucleotide
aataattggggctaaaaataccgccccaattaaagtgttttacatg

SEQ ID NO: 409968 - DNA, 45 bp, Artificial Sequence
  Description of Artificial Sequence: Synthetic oligonucleotide
ataattggggctaaaaataccgccccaattaaagtgttttacatg

SEQ ID NO: 409969 - DNA, 44 bp, Artificial Sequence
  Description of Artificial Sequence: Synthetic oligonucleotide
taattggggctaaaaataccgccccaattaaagtgttttacatg

SEQ ID NO: 409970 - DNA, 43 bp, Artificial Sequence
  Description of Artificial Sequence: Synthetic oligonucleotide
aattggggctaaaaataccgccccaattaaagtgttttacatg

SEQ ID NO: 409971 - DNA, 42 bp, Artificial Sequence
  Description of Artificial Sequence: Synthetic oligonucleotide
attggggctaaaaataccgccccaattaaagtgttttacatg

SEQ ID NO: 409972 - DNA, 41 bp, Artificial Sequence
  Description of Artificial Sequence: Synthetic oligonucleotide
ttggggctaaaaataccgccccaattaaagtgttttacatg

SEQ ID NO: 409973 - DNA, 40 bp, Artificial Sequence
  Description of Artificial Sequence: Synthetic oligonucleotide
tggggctaaaaataccgccccaattaaagtgttttacatg

SEQ ID NO: 409974 - DNA, 39 bp, Artificial Sequence
  Description of Artificial Sequence: Synthetic oligonucleotide
ggggctaaaaataccgccccaattaaagtgttttacatg

SEQ ID NO: 409975 - DNA, 39 bp, Artificial Sequence
  Description of Artificial Sequence: Synthetic oligonucleotide
gggctaaaaataccgccccaattaaagtgttttacatgc

SEQ ID NO: 409976 - DNA, 41 bp, Artificial Sequence
  Description of Artificial Sequence: Synthetic oligonucleotide
ggctaaaaataccgccccaattaaagtgttttacatgcaac

SEQ ID NO: 409977 - DNA, 42 bp, Artificial Sequence
  Description of Artificial Sequence: Synthetic oligonucleotide
gctaaaaataccgccccaattaaagtgttttacatgcaactg

SEQ ID NO: 409978 - DNA, 42 bp, Artificial Sequence
  Description of Artificial Sequence: Synthetic oligonucleotide
ctaaaaataccgccccaattaaagtgttttacatgcaactgg

SEQ ID NO: 409979 - DNA, 44 bp, Artificial Sequence
  Description of Artificial Sequence: Synthetic oligonucleotide
taaaaataccgccccaattaaagtgttttacatgcaactggttc

SEQ ID NO: 409980 - DNA, 43 bp, Artificial Sequence
  Description of Artificial Sequence: Synthetic oligonucleotide
aaaaataccgccccaattaaagtgttttacatgcaactggttc

SEQ ID NO: 409981 - DNA, 42 bp, Artificial Sequence
  Description of Artificial Sequence: Synthetic oligonucleotide
aaaataccgccccaattaaagtgttttacatgcaactggttc

SEQ ID NO: 409982 - DNA, 41 bp, Artificial Sequence
  Description of Artificial Sequence: Synthetic oligonucleotide
aaataccgccccaattaaagtgttttacatgcaactggttc

SEQ ID NO: 409983 - DNA, 40 bp, Artificial Sequence
  Description of Artificial Sequence: Synthetic oligonucleotide
aataccgccccaattaaagtgttttacatgcaactggttc

SEQ ID NO: 409984 - DNA, 39 bp, Artificial Sequence
  Description of Artificial Sequence: Synthetic oligonucleotide
ataccgccccaattaaagtgttttacatgcaactggttc

SEQ ID NO: 409985 - DNA, 38 bp, Artificial Sequence
  Description of Artificial Sequence: Synthetic oligonucleotide
taccgccccaattaaagtgttttacatgcaactggttc

SEQ ID NO: 409986 - DNA, 37 bp, Artificial Sequence
  Description of Artificial Sequence: Synthetic oligonucleotide
accgccccaattaaagtgttttacatgcaactggttc

SEQ ID NO: 409987 - DNA, 36 bp, Artificial Sequence
  Description of Artificial Sequence: Synthetic oligonucleotide
ccgccccaattaaagtgttttacatgcaactggttc

SEQ ID NO: 409988 - DNA, 39 bp, Artificial Sequence
  Description of Artificial Sequence: Synthetic oligonucleotide
cgccccaattaaagtgttttacatgcaactggttcaaac

SEQ ID NO: 409989 - DNA, 39 bp, Artificial Sequence
  Description of Artificial Sequence: Synthetic oligonucleotide
gccccaattaaagtgttttacatgcaactggttcaaacc

SEQ ID NO: 409990 - DNA, 42 bp, Artificial Sequence
  Description of Artificial Sequence: Synthetic oligonucleotide
ccccaattaaagtgttttacatgcaactggttcaaacctttc

SEQ ID NO: 409991 - DNA, 44 bp, Artificial Sequence
  Description of Artificial Sequence: Synthetic oligonucleotide
cccaattaaagtgttttacatgcaactggttcaaacctttcaag

SEQ ID NO: 409992 - DNA, 46 bp, Artificial Sequence
  Description of Artificial Sequence: Synthetic oligonucleotide
ccaattaaagtgttttacatgcaactggttcaaacctttcaagtac

SEQ ID NO: 409993 - DNA, 52 bp, Artificial Sequence
  Description of Artificial Sequence: Synthetic oligonucleotide
caattaaagtgttttacatgcaactggttcaaacctttcaagtactaaaaac

SEQ ID NO: 409994 - DNA, 55 bp, Artificial Sequence
  Description of Artificial Sequence: Synthetic oligonucleotide
aattaaagtgttttacatgcaactggttcaaacctttcaagtactaaaaacaatc

SEQ ID NO: 409995 - DNA, 54 bp, Artificial Sequence
  Description of Artificial Sequence: Synthetic oligonucleotide
attaaagtgttttacatgcaactggttcaaacctttcaagtactaaaaacaatc

SEQ ID NO: 409996 - DNA, 53 bp, Artificial Sequence
  Description of Artificial Sequence: Synthetic oligonucleotide
ttaaagtgttttacatgcaactggttcaaacctttcaagtactaaaaacaatc

SEQ ID NO: 409997 - DNA, 52 bp, Artificial Sequence
  Description of Artificial Sequence: Synthetic oligonucleotide
taaagtgttttacatgcaactggttcaaacctttcaagtactaaaaacaatc

SEQ ID NO: 409998 - DNA, 51 bp, Artificial Sequence
  Description of Artificial Sequence: Synthetic oligonucleotide
aaagtgttttacatgcaactggttcaaacctttcaagtactaaaaacaatc

SEQ ID NO: 409999 - DNA, 50 bp, Artificial Sequence
  Description of Artificial Sequence: Synthetic oligonucleotide
aagtgttttacatgcaactggttcaaacctttcaagtactaaaaacaatc

SEQ ID NO: 410000 - DNA, 49 bp, Artificial Sequence
  Description of Artificial Sequence: Synthetic oligonucleotide
agtgttttacatgcaactggttcaaacctttcaagtactaaaaacaatc

SEQ ID NO: 410001 - DNA, 48 bp, Artificial Sequence
  Description of Artificial Sequence: Synthetic oligonucleotide
gtgttttacatgcaactggttcaaacctttcaagtactaaaaacaatc

SEQ ID NO: 410002 - DNA, 48 bp, Artificial Sequence
  Description of Artificial Sequence: Synthetic oligonucleotide
tgttttacatgcaactggttcaaacctttcaagtactaaaaacaatcc

SEQ ID NO: 410003 - DNA, 47 bp, Artificial Sequence
  Description of Artificial Sequence: Synthetic oligonucleotide
gttttacatgcaactggttcaaacctttcaagtactaaaaacaatcc

SEQ ID NO: 410004 - DNA, 48 bp, Artificial Sequence
  Description of Artificial Sequence: Synthetic oligonucleotide
ttttacatgcaactggttcaaacctttcaagtactaaaaacaatcctg

SEQ ID NO: 410005 - DNA, 47 bp, Artificial Sequence
  Description of Artificial Sequence: Synthetic oligonucleotide
tttacatgcaactggttcaaacctttcaagtactaaaaacaatcctg

SEQ ID NO: 410006 - DNA, 46 bp, Artificial Sequence
  Description of Artificial Sequence: Synthetic oligonucleotide
ttacatgcaactggttcaaacctttcaagtactaaaaacaatcctg

SEQ ID NO: 410007 - DNA, 45 bp, Artificial Sequence
  Description of Artificial Sequence: Synthetic oligonucleotide
tacatgcaactggttcaaacctttcaagtactaaaaacaatcctg

SEQ ID NO: 410008 - DNA, 44 bp, Artificial Sequence
  Description of Artificial Sequence: Synthetic oligonucleotide
acatgcaactggttcaaacctttcaagtactaaaaacaatcctg

SEQ ID NO: 410009 - DNA, 43 bp, Artificial Sequence
  Description of Artificial Sequence: Synthetic oligonucleotide
catgcaactggttcaaacctttcaagtactaaaaacaatcctg

SEQ ID NO: 410010 - DNA, 47 bp, Artificial Sequence
  Description of Artificial Sequence: Synthetic oligonucleotide
atgcaactggttcaaacctttcaagtactaaaaacaatcctgtaaag

SEQ ID NO: 410011 - DNA, 46 bp, Artificial Sequence
  Description of Artificial Sequence: Synthetic oligonucleotide
tgcaactggttcaaacctttcaagtactaaaaacaatcctgtaaag

SEQ ID NO: 410012 - DNA, 45 bp, Artificial Sequence
  Description of Artificial Sequence: Synthetic oligonucleotide
gcaactggttcaaacctttcaagtactaaaaacaatcctgtaaag

SEQ ID NO: 410013 - DNA, 47 bp, Artificial Sequence
  Description of Artificial Sequence: Synthetic oligonucleotide
caactggttcaaacctttcaagtactaaaaacaatcctgtaaagaag

SEQ ID NO: 410014 - DNA, 47 bp, Artificial Sequence
  Description of Artificial Sequence: Synthetic oligonucleotide
aactggttcaaacctttcaagtactaaaaacaatcctgtaaagaagg

SEQ ID NO: 410015 - DNA, 46 bp, Artificial Sequence
  Description of Artificial Sequence: Synthetic oligonucleotide
actggttcaaacctttcaagtactaaaaacaatcctgtaaagaagg

SEQ ID NO: 410016 - DNA, 45 bp, Artificial Sequence
  Description of Artificial Sequence: Synthetic oligonucleotide
ctggttcaaacctttcaagtactaaaaacaatcctgtaaagaagg

SEQ ID NO: 410017 - DNA, 50 bp, Artificial Sequence
  Description of Artificial Sequence: Synthetic oligonucleotide
tggttcaaacctttcaagtactaaaaacaatcctgtaaagaaggaaattc

SEQ ID NO: 410018 - DNA, 49 bp, Artificial Sequence
  Description of Artificial Sequence: Synthetic oligonucleotide
ggttcaaacctttcaagtactaaaaacaatcctgtaaagaaggaaattc

SEQ ID NO: 410019 - DNA, 50 bp, Artificial Sequence
  Description of Artificial Sequence: Synthetic oligonucleotide
gttcaaacctttcaagtactaaaaacaatcctgtaaagaaggaaattctg

SEQ ID NO: 410020 - DNA, 53 bp, Artificial Sequence
  Description of Artificial Sequence: Synthetic oligonucleotide
ttcaaacctttcaagtactaaaaacaatcctgtaaagaaggaaattctgtttc

SEQ ID NO: 410021 - DNA, 52 bp, Artificial Sequence
  Description of Artificial Sequence: Synthetic oligonucleotide
tcaaacctttcaagtactaaaaacaatcctgtaaagaaggaaattctgtttc

SEQ ID NO: 410022 - DNA, 51 bp, Artificial Sequence
  Description of Artificial Sequence: Synthetic oligonucleotide
caaacctttcaagtactaaaaacaatcctgtaaagaaggaaattctgtttc

SEQ ID NO: 410023 - DNA, 52 bp, Artificial Sequence
  Description of Artificial Sequence: Synthetic oligonucleotide
aaacctttcaagtactaaaaacaatcctgtaaagaaggaaattctgtttcag

SEQ ID NO: 410024 - DNA, 51 bp, Artificial Sequence
  Description of Artificial Sequence: Synthetic oligonucleotide
aacctttcaagtactaaaaacaatcctgtaaagaaggaaattctgtttcag

SEQ ID NO: 410025 - DNA, 50 bp, Artificial Sequence
  Description of Artificial Sequence: Synthetic oligonucleotide
acctttcaagtactaaaaacaatcctgtaaagaaggaaattctgtttcag

SEQ ID NO: 410026 - DNA, 49 bp, Artificial Sequence
  Description of Artificial Sequence: Synthetic oligonucleotide
cctttcaagtactaaaaacaatcctgtaaagaaggaaattctgtttcag

SEQ ID NO: 410027 - DNA, 51 bp, Artificial Sequence
  Description of Artificial Sequence: Synthetic oligonucleotide
ctttcaagtactaaaaacaatcctgtaaagaaggaaattctgtttcagaag

SEQ ID NO: 410028 - DNA, 52 bp, Artificial Sequence
  Description of Artificial Sequence: Synthetic oligonucleotide
tttcaagtactaaaaacaatcctgtaaagaaggaaattctgtttcagaagag

SEQ ID NO: 410029 - DNA, 51 bp, Artificial Sequence
  Description of Artificial Sequence: Synthetic oligonucleotide
ttcaagtactaaaaacaatcctgtaaagaaggaaattctgtttcagaagag

SEQ ID NO: 410030 - DNA, 50 bp, Artificial Sequence
  Description of Artificial Sequence: Synthetic oligonucleotide
tcaagtactaaaaacaatcctgtaaagaaggaaattctgtttcagaagag

SEQ ID NO: 410031 - DNA, 49 bp, Artificial Sequence
  Description of Artificial Sequence: Synthetic oligonucleotide
caagtactaaaaacaatcctgtaaagaaggaaattctgtttcagaagag

SEQ ID NO: 410032 - DNA, 49 bp, Artificial Sequence
  Description of Artificial Sequence: Synthetic oligonucleotide
aagtactaaaaacaatcctgtaaagaaggaaattctgtttcagaagagg

SEQ ID NO: 410033 - DNA, 48 bp, Artificial Sequence
  Description of Artificial Sequence: Synthetic oligonucleotide
agtactaaaaacaatcctgtaaagaaggaaattctgtttcagaagagg

SEQ ID NO: 410034 - DNA, 47 bp, Artificial Sequence
  Description of Artificial Sequence: Synthetic oligonucleotide
gtactaaaaacaatcctgtaaagaaggaaattctgtttcagaagagg

SEQ ID NO: 410035 - DNA, 48 bp, Artificial Sequence
  Description of Artificial Sequence: Synthetic oligonucleotide
tactaaaaacaatcctgtaaagaaggaaattctgtttcagaagaggac

SEQ ID NO: 410036 - DNA, 47 bp, Artificial Sequence
  Description of Artificial Sequence: Synthetic oligonucleotide
actaaaaacaatcctgtaaagaaggaaattctgtttcagaagaggac

SEQ ID NO: 410037 - DNA, 46 bp, Artificial Sequence
  Description of Artificial Sequence: Synthetic oligonucleotide
ctaaaaacaatcctgtaaagaaggaaattctgtttcagaagaggac

SEQ ID NO: 410038 - DNA, 46 bp, Artificial Sequence
  Description of Artificial Sequence: Synthetic oligonucleotide
taaaaacaatcctgtaaagaaggaaattctgtttcagaagaggacc

SEQ ID NO: 410039 - DNA, 45 bp, Artificial Sequence
  Description of Artificial Sequence: Synthetic oligonucleotide
aaaaacaatcctgtaaagaaggaaattctgtttcagaagaggacc

SEQ ID NO: 410040 - DNA, 44 bp, Artificial Sequence
  Description of Artificial Sequence: Synthetic oligonucleotide
aaaacaatcctgtaaagaaggaaattctgtttcagaagaggacc

SEQ ID NO: 410041 - DNA, 43 bp, Artificial Sequence
  Description of Artificial Sequence: Synthetic oligonucleotide
aaacaatcctgtaaagaaggaaattctgtttcagaagaggacc

SEQ ID NO: 410042 - DNA, 42 bp, Artificial Sequence
  Description of Artificial Sequence: Synthetic oligonucleotide
aacaatcctgtaaagaaggaaattctgtttcagaagaggacc

SEQ ID NO: 410043 - DNA, 41 bp, Artificial Sequence
  Description of Artificial Sequence: Synthetic oligonucleotide
acaatcctgtaaagaaggaaattctgtttcagaagaggacc

SEQ ID NO: 410044 - DNA, 40 bp, Artificial Sequence
  Description of Artificial Sequence: Synthetic oligonucleotide
caatcctgtaaagaaggaaattctgtttcagaagaggacc

SEQ ID NO: 410045 - DNA, 42 bp, Artificial Sequence
  Description of Artificial Sequence: Synthetic oligonucleotide
aatcctgtaaagaaggaaattctgtttcagaagaggaccttc

SEQ ID NO: 410046 - DNA, 41 bp, Artificial Sequence
  Description of Artificial Sequence: Synthetic oligonucleotide
atcctgtaaagaaggaaattctgtttcagaagaggaccttc

SEQ ID NO: 410047 - DNA, 40 bp, Artificial Sequence
  Description of Artificial Sequence: Synthetic oligonucleotide
tcctgtaaagaaggaaattctgtttcagaagaggaccttc

SEQ ID NO: 410048 - DNA, 39 bp, Artificial Sequence
  Description of Artificial Sequence: Synthetic oligonucleotide
cctgtaaagaaggaaattctgtttcagaagaggaccttc

SEQ ID NO: 410049 - DNA, 42 bp, Artificial Sequence
  Description of Artificial Sequence: Synthetic oligonucleotide
ctgtaaagaaggaaattctgtttcagaagaggaccttcatac

SEQ ID NO: 410050 - DNA, 43 bp, Artificial Sequence
  Description of Artificial Sequence: Synthetic oligonucleotide
tgtaaagaaggaaattctgtttcagaagaggaccttcatacag

SEQ ID NO: 410051 - DNA, 42 bp, Artificial Sequence
  Description of Artificial Sequence: Synthetic oligonucleotide
gtaaagaaggaaattctgtttcagaagaggaccttcatacag

SEQ ID NO: 410052 - DNA, 38 bp, Artificial Sequence
  Description of Artificial Sequence: Synthetic oligonucleotide
cagcaactgatgatgctattgaactcagatgctgattc

SEQ ID NO: 410053 - DNA, 38 bp, Artificial Sequence
  Description of Artificial Sequence: Synthetic oligonucleotide
agcaactgatgatgctattgaactcagatgctgattcg

SEQ ID NO: 410054 - DNA, 37 bp, Artificial Sequence
  Description of Artificial Sequence: Synthetic oligonucleotide
gcaactgatgatgctattgaactcagatgctgattcg

SEQ ID NO: 410055 - DNA, 39 bp, Artificial Sequence
  Description of Artificial Sequence: Synthetic oligonucleotide
caactgatgatgctattgaactcagatgctgattcgttc

SEQ ID NO: 410056 - DNA, 40 bp, Artificial Sequence
  Description of Artificial Sequence: Synthetic oligonucleotide
aactgatgatgctattgaactcagatgctgattcgttctc

SEQ ID NO: 410057 - DNA, 39 bp, Artificial Sequence
  Description of Artificial Sequence: Synthetic oligonucleotide
actgatgatgctattgaactcagatgctgattcgttctc

SEQ ID NO: 410058 - DNA, 38 bp, Artificial Sequence
  Description of Artificial Sequence: Synthetic oligonucleotide
ctgatgatgctattgaactcagatgctgattcgttctc

SEQ ID NO: 410059 - DNA, 38 bp, Artificial Sequence
  Description of Artificial Sequence: Synthetic oligonucleotide
tgatgatgctattgaactcagatgctgattcgttctcc

SEQ ID NO: 410060 - DNA, 37 bp, Artificial Sequence
  Description of Artificial Sequence: Synthetic oligonucleotide
gatgatgctattgaactcagatgctgattcgttctcc

SEQ ID NO: 410061 - DNA, 39 bp, Artificial Sequence
  Description of Artificial Sequence: Synthetic oligonucleotide
atgatgctattgaactcagatgctgattcgttctccaac

SEQ ID NO: 410062 - DNA, 38 bp, Artificial Sequence
  Description of Artificial Sequence: Synthetic oligonucleotide
tgatgctattgaactcagatgctgattcgttctccaac

SEQ ID NO: 410063 - DNA, 37 bp, Artificial Sequence
  Description of Artificial Sequence: Synthetic oligonucleotide
gatgctattgaactcagatgctgattcgttctccaac

SEQ ID NO: 410064 - DNA, 38 bp, Artificial Sequence
  Description of Artificial Sequence: Synthetic oligonucleotide
atgctattgaactcagatgctgattcgttctccaacac

SEQ ID NO: 410065 - DNA, 37 bp, Artificial Sequence
  Description of Artificial Sequence: Synthetic oligonucleotide
tgctattgaactcagatgctgattcgttctccaacac

SEQ ID NO: 410066 - DNA, 36 bp, Artificial Sequence
  Description of Artificial Sequence: Synthetic oligonucleotide
gctattgaactcagatgctgattcgttctccaacac

SEQ ID NO: 410067 - DNA, 38 bp, Artificial Sequence
  Description of Artificial Sequence: Synthetic oligonucleotide
ctattgaactcagatgctgattcgttctccaacactag

SEQ ID NO: 410068 - DNA, 42 bp, Artificial Sequence
  Description of Artificial Sequence: Synthetic oligonucleotide
tattgaactcagatgctgattcgttctccaacactagattac

SEQ ID NO: 410069 - DNA, 41 bp, Artificial Sequence
  Description of Artificial Sequence: Synthetic oligonucleotide
attgaactcagatgctgattcgttctccaacactagattac

SEQ ID NO: 410070 - DNA, 40 bp, Artificial Sequence
  Description of Artificial Sequence: Synthetic oligonucleotide
ttgaactcagatgctgattcgttctccaacactagattac

SEQ ID NO: 410071 - DNA, 39 bp, Artificial Sequence
  Description of Artificial Sequence: Synthetic oligonucleotide
tgaactcagatgctgattcgttctccaacactagattac

SEQ ID NO: 410072 - DNA, 38 bp, Artificial Sequence
  Description of Artificial Sequence: Synthetic oligonucleotide
gaactcagatgctgattcgttctccaacactagattac

SEQ ID NO: 410073 - DNA, 38 bp, Artificial Sequence
  Description of Artificial Sequence: Synthetic oligonucleotide
aactcagatgctgattcgttctccaacactagattacc

SEQ ID NO: 410074 - DNA, 37 bp, Artificial Sequence
  Description of Artificial Sequence: Synthetic oligonucleotide
actcagatgctgattcgttctccaacactagattacc

SEQ ID NO: 410075 - DNA, 36 bp, Artificial Sequence
  Description of Artificial Sequence: Synthetic oligonucleotide
ctcagatgctgattcgttctccaacactagattacc

SEQ ID NO: 410076 - DNA, 36 bp, Artificial Sequence
  Description of Artificial Sequence: Synthetic oligonucleotide
tcagatgctgattcgttctccaacactagattaccc

SEQ ID NO: 410077 - DNA, 35 bp, Artificial Sequence
  Description of Artificial Sequence: Synthetic oligonucleotide
cagatgctgattcgttctccaacactagattaccc

SEQ ID NO: 410078 - DNA, 38 bp, Artificial Sequence
  Description of Artificial Sequence: Synthetic oligonucleotide
agatgctgattcgttctccaacactagattacccaatc

SEQ ID NO: 410079 - DNA, 37 bp, Artificial Sequence
  Description of Artificial Sequence: Synthetic oligonucleotide
gatgctgattcgttctccaacactagattacccaatc

SEQ ID NO: 410080 - DNA, 37 bp, Artificial Sequence
  Description of Artificial Sequence: Synthetic oligonucleotide
atgctgattcgttctccaacactagattacccaatcc

SEQ ID NO: 410081 - DNA, 36 bp, Artificial Sequence
  Description of Artificial Sequence: Synthetic oligonucleotide
tgctgattcgttctccaacactagattacccaatcc

SEQ ID NO: 410082 - DNA, 35 bp, Artificial Sequence
  Description of Artificial Sequence: Synthetic oligonucleotide
gctgattcgttctccaacactagattacccaatcc

SEQ ID NO: 410083 - DNA, 36 bp, Artificial Sequence
  Description of Artificial Sequence: Synthetic oligonucleotide
ctgattcgttctccaacactagattacccaatccag

SEQ ID NO: 410084 - DNA, 36 bp, Artificial Sequence
  Description of Artificial Sequence: Synthetic oligonucleotide
tgattcgttctccaacactagattacccaatccagg

SEQ ID NO: 410085 - DNA, 35 bp, Artificial Sequence
  Description of Artificial Sequence: Synthetic oligonucleotide
gattcgttctccaacactagattacccaatccagg

SEQ ID NO: 410086 - DNA, 36 bp, Artificial Sequence
  Description of Artificial Sequence: Synthetic oligonucleotide
attcgttctccaacactagattacccaatccaggag

SEQ ID NO: 410087 - DNA, 35 bp, Artificial Sequence
  Description of Artificial Sequence: Synthetic oligonucleotide
ttcgttctccaacactagattacccaatccaggag

SEQ ID NO: 410088 - DNA, 34 bp, Artificial Sequence
  Description of Artificial Sequence: Synthetic oligonucleotide
tcgttctccaacactagattacccaatccaggag

SEQ ID NO: 410089 - DNA, 33 bp, Artificial Sequence
  Description of Artificial Sequence: Synthetic oligonucleotide
cgttctccaacactagattacccaatccaggag

SEQ ID NO: 410090 - DNA, 33 bp, Artificial Sequence
  Description of Artificial Sequence: Synthetic oligonucleotide
gttctccaacactagattacccaatccaggagc

SEQ ID NO: 410091 - DNA, 35 bp, Artificial Sequence
  Description of Artificial Sequence: Synthetic oligonucleotide
ttctccaacactagattacccaatccaggagcaag

SEQ ID NO: 410092 - DNA, 34 bp, Artificial Sequence
  Description of Artificial Sequence: Synthetic oligonucleotide
tctccaacactagattacccaatccaggagcaag

SEQ ID NO: 410093 - DNA, 33 bp, Artificial Sequence
  Description of Artificial Sequence: Synthetic oligonucleotide
ctccaacactagattacccaatccaggagcaag

SEQ ID NO: 410094 - DNA, 33 bp, Artificial Sequence
  Description of Artificial Sequence: Synthetic oligonucleotide
tccaacactagattacccaatccaggagcaagg

SEQ ID NO: 410095 - DNA, 32 bp, Artificial Sequence
  Description of Artificial Sequence: Synthetic oligonucleotide
ccaacactagattacccaatccaggagcaagg

SEQ ID NO: 410096 - DNA, 36 bp, Artificial Sequence
  Description of Artificial Sequence: Synthetic oligonucleotide
caacactagattacccaatccaggagcaaggaaatc

SEQ ID NO: 410097 - DNA, 37 bp, Artificial Sequence
  Description of Artificial Sequence: Synthetic oligonucleotide
aacactagattacccaatccaggagcaaggaaatcag

SEQ ID NO: 410098 - DNA, 36 bp, Artificial Sequence
  Description of Artificial Sequence: Synthetic oligonucleotide
acactagattacccaatccaggagcaaggaaatcag

SEQ ID NO: 410099 - DNA, 35 bp, Artificial Sequence
  Description of Artificial Sequence: Synthetic oligonucleotide
cactagattacccaatccaggagcaaggaaatcag

SEQ ID NO: 410100 - DNA, 38 bp, Artificial Sequence
  Description of Artificial Sequence: Synthetic oligonucleotide
actagattacccaatccaggagcaaggaaatcagtaac

SEQ ID NO: 410101 - DNA, 37 bp, Artificial Sequence
  Description of Artificial Sequence: Synthetic oligonucleotide
ctagattacccaatccaggagcaaggaaatcagtaac

SEQ ID NO: 410102 - DNA, 40 bp, Artificial Sequence
  Description of Artificial Sequence: Synthetic oligonucleotide
tagattacccaatccaggagcaaggaaatcagtaacttac

SEQ ID NO: 410103 - DNA, 39 bp, Artificial Sequence
  Description of Artificial Sequence: Synthetic oligonucleotide
agattacccaatccaggagcaaggaaatcagtaacttac

SEQ ID NO: 410104 - DNA, 38 bp, Artificial Sequence
  Description of Artificial Sequence: Synthetic oligonucleotide
gattacccaatccaggagcaaggaaatcagtaacttac

SEQ ID NO: 410105 - DNA, 39 bp, Artificial Sequence
  Description of Artificial Sequence: Synthetic oligonucleotide
attacccaatccaggagcaaggaaatcagtaacttactc

SEQ ID NO: 410106 - DNA, 38 bp, Artificial Sequence
  Description of Artificial Sequence: Synthetic oligonucleotide
ttacccaatccaggagcaaggaaatcagtaacttactc

SEQ ID NO: 410107 - DNA, 37 bp, Artificial Sequence
  Description of Artificial Sequence: Synthetic oligonucleotide
tacccaatccaggagcaaggaaatcagtaacttactc

SEQ ID NO: 410108 - DNA, 36 bp, Artificial Sequence
  Description of Artificial Sequence: Synthetic oligonucleotide
acccaatccaggagcaaggaaatcagtaacttactc

SEQ ID NO: 410109 - DNA, 35 bp, Artificial Sequence
  Description of Artificial Sequence: Synthetic oligonucleotide
cccaatccaggagcaaggaaatcagtaacttactc

SEQ ID NO: 410110 - DNA, 35 bp, Artificial Sequence
  Description of Artificial Sequence: Synthetic oligonucleotide
ccaatccaggagcaaggaaatcagtaacttactcc

SEQ ID NO: 410111 - DNA, 35 bp, Artificial Sequence
  Description of Artificial Sequence: Synthetic oligonucleotide
caatccaggagcaaggaaatcagtaacttactccc

SEQ ID NO: 410112 - DNA, 40 bp, Artificial Sequence
  Description of Artificial Sequence: Synthetic oligonucleotide
aatccaggagcaaggaaatcagtaacttactccctataac

SEQ ID NO: 410113 - DNA, 39 bp, Artificial Sequence
  Description of Artificial Sequence: Synthetic oligonucleotide
atccaggagcaaggaaatcagtaacttactccctataac

SEQ ID NO: 410114 - DNA, 38 bp, Artificial Sequence
  Description of Artificial Sequence: Synthetic oligonucleotide
tccaggagcaaggaaatcagtaacttactccctataac

SEQ ID NO: 410115 - DNA, 37 bp, Artificial Sequence
  Description of Artificial Sequence: Synthetic oligonucleotide
ccaggagcaaggaaatcagtaacttactccctataac

SEQ ID NO: 410116 - DNA, 39 bp, Artificial Sequence
  Description of Artificial Sequence: Synthetic oligonucleotide
caggagcaaggaaatcagtaacttactccctataacttg

SEQ ID NO: 410117 - DNA, 39 bp, Artificial Sequence
  Description of Artificial Sequence: Synthetic oligonucleotide
aggagcaaggaaatcagtaacttactccctataacttgg

SEQ ID NO: 410118 - DNA, 38 bp, Artificial Sequence
  Description of Artificial Sequence: Synthetic oligonucleotide
ggagcaaggaaatcagtaacttactccctataacttgg

SEQ ID NO: 410119 - DNA, 41 bp, Artificial Sequence
  Description of Artificial Sequence: Synthetic oligonucleotide
gagcaaggaaatcagtaacttactccctataacttggaatg

SEQ ID NO: 410120 - DNA, 42 bp, Artificial Sequence
  Description of Artificial Sequence: Synthetic oligonucleotide
agcaaggaaatcagtaacttactccctataacttggaatgtg

SEQ ID NO: 410121 - DNA, 41 bp, Artificial Sequence
  Description of Artificial Sequence: Synthetic oligonucleotide
gcaaggaaatcagtaacttactccctataacttggaatgtg

SEQ ID NO: 410122 - DNA, 41 bp, Artificial Sequence
  Description of Artificial Sequence: Synthetic oligonucleotide
caaggaaatcagtaacttactccctataacttggaatgtgg

SEQ ID NO: 410123 - DNA, 41 bp, Artificial Sequence
  Description of Artificial Sequence: Synthetic oligonucleotide
aaggaaatcagtaacttactccctataacttggaatgtggg

SEQ ID NO: 410124 - DNA, 40 bp, Artificial Sequence
  Description of Artificial Sequence: Synthetic oligonucleotide
aggaaatcagtaacttactccctataacttggaatgtggg

SEQ ID NO: 410125 - DNA, 39 bp, Artificial Sequence
  Description of Artificial Sequence: Synthetic oligonucleotide
ggaaatcagtaacttactccctataacttggaatgtggg

SEQ ID NO: 410126 - DNA, 40 bp, Artificial Sequence
  Description of Artificial Sequence: Synthetic oligonucleotide
gaaatcagtaacttactccctataacttggaatgtgggtg

SEQ ID NO: 410127 - DNA, 40 bp, Artificial Sequence
  Description of Artificial Sequence: Synthetic oligonucleotide
aaatcagtaacttactccctataacttggaatgtgggtgg

SEQ ID NO: 410128 - DNA, 39 bp, Artificial Sequence
  Description of Artificial Sequence: Synthetic oligonucleotide
aatcagtaacttactccctataacttggaatgtgggtgg

SEQ ID NO: 410129 - DNA, 38 bp, Artificial Sequence
  Description of Artificial Sequence: Synthetic oligonucleotide
atcagtaacttactccctataacttggaatgtgggtgg

SEQ ID NO: 410130 - DNA, 37 bp, Artificial Sequence
  Description of Artificial Sequence: Synthetic oligonucleotide
tcagtaacttactccctataacttggaatgtgggtgg

SEQ ID NO: 410131 - DNA, 36 bp, Artificial Sequence
  Description of Artificial Sequence: Synthetic oligonucleotide
cagtaacttactccctataacttggaatgtgggtgg

SEQ ID NO: 410132 - DNA, 37 bp, Artificial Sequence
  Description of Artificial Sequence: Synthetic oligonucleotide
agtaacttactccctataacttggaatgtgggtggag

SEQ ID NO: 410133 - DNA, 36 bp, Artificial Sequence
  Description of Artificial Sequence: Synthetic oligonucleotide
gtaacttactccctataacttggaatgtgggtggag

SEQ ID NO: 410134 - DNA, 36 bp, Artificial Sequence
  Description of Artificial Sequence: Synthetic oligonucleotide
taacttactccctataacttggaatgtgggtggagg

SEQ ID NO: 410135 - DNA, 35 bp, Artificial Sequence
  Description of Artificial Sequence: Synthetic oligonucleotide
aacttactccctataacttggaatgtgggtggagg

SEQ ID NO: 410136 - DNA, 34 bp, Artificial Sequence
  Description of Artificial Sequence: Synthetic oligonucleotide
acttactccctataacttggaatgtgggtggagg

SEQ ID NO: 410137 - DNA, 33 bp, Artificial Sequence
  Description of Artificial Sequence: Synthetic oligonucleotide
cttactccctataacttggaatgtgggtggagg

SEQ ID NO: 410138 - DNA, 33 bp, Artificial Sequence
  Description of Artificial Sequence: Synthetic oligonucleotide
ttactccctataacttggaatgtgggtggaggg

SEQ ID NO: 410139 - DNA, 32 bp, Artificial Sequence
  Description of Artificial Sequence: Synthetic oligonucleotide
tactccctataacttggaatgtgggtggaggg

SEQ ID NO: 410140 - DNA, 31 bp, Artificial Sequence
  Description of Artificial Sequence: Synthetic oligonucleotide
actccctataacttggaatgtgggtggaggg

SEQ ID NO: 410141 - DNA, 31 bp, Artificial Sequence
  Description of Artificial Sequence: Synthetic oligonucleotide
atagttctccctgagtgagacttgcctgctg

SEQ ID NO: 410142 - DNA, 30 bp, Artificial Sequence
  Description of Artificial Sequence: Synthetic oligonucleotide
tagttctccctgagtgagacttgcctgctg

SEQ ID NO: 410143 - DNA, 29 bp, Artificial Sequence
  Description of Artificial Sequence: Synthetic oligonucleotide
agttctccctgagtgagacttgcctgctg

SEQ ID NO: 410144 - DNA, 28 bp, Artificial Sequence
  Description of Artificial Sequence: Synthetic oligonucleotide
gttctccctgagtgagacttgcctgctg

SEQ ID NO: 410145 - DNA, 28 bp, Artificial Sequence
  Description of Artificial Sequence: Synthetic oligonucleotide
ttctccctgagtgagacttgcctgctgc

SEQ ID NO: 410146 - DNA, 27 bp, Artificial Sequence
  Description of Artificial Sequence: Synthetic oligonucleotide
tctccctgagtgagacttgcctgctgc

SEQ ID NO: 410147 - DNA, 27 bp, Artificial Sequence
  Description of Artificial Sequence: Synthetic oligonucleotide
ctccctgagtgagacttgcctgctgct

SEQ ID NO: 410148 - DNA, 27 bp, Artificial Sequence
  Description of Artificial Sequence: Synthetic oligonucleotide
tccctgagtgagacttgcctgctgctc

SEQ ID NO: 410149 - DNA, 27 bp, Artificial Sequence
  Description of Artificial Sequence: Synthetic oligonucleotide
ccctgagtgagacttgcctgctgctct

SEQ ID NO: 410150 - DNA, 27 bp, Artificial Sequence
  Description of Artificial Sequence: Synthetic oligonucleotide
cctgagtgagacttgcctgctgctctg

SEQ ID NO: 410151 - DNA, 27 bp, Artificial Sequence
  Description of Artificial Sequence: Synthetic oligonucleotide
ctgagtgagacttgcctgctgctctgg

SEQ ID NO: 410152 - DNA, 27 bp, Artificial Sequence
  Description of Artificial Sequence: Synthetic oligonucleotide
tgagtgagacttgcctgctgctctggc

SEQ ID NO: 410153 - DNA, 26 bp, Artificial Sequence
  Description of Artificial Sequence: Synthetic oligonucleotide
gagtgagacttgcctgctgctctggc

SEQ ID NO: 410154 - DNA, 26 bp, Artificial Sequence
  Description of Artificial Sequence: Synthetic oligonucleotide
agtgagacttgcctgctgctctggcc

SEQ ID NO: 410155 - DNA, 25 bp, Artificial Sequence
  Description of Artificial Sequence: Synthetic oligonucleotide
gtgagacttgcctgctgctctggcc

SEQ ID NO: 410156 - DNA, 25 bp, Artificial Sequence
  Description of Artificial Sequence: Synthetic oligonucleotide
tgagacttgcctgctgctctggccc

SEQ ID NO: 410157 - DNA, 24 bp, Artificial Sequence
  Description of Artificial Sequence: Synthetic oligonucleotide
gagacttgcctgctgctctggccc

SEQ ID NO: 410158 - DNA, 25 bp, Artificial Sequence
  Description of Artificial Sequence: Synthetic oligonucleotide
agacttgcctgctgctctggcccct

SEQ ID NO: 410159 - DNA, 24 bp, Artificial Sequence
  Description of Artificial Sequence: Synthetic oligonucleotide
gacttgcctgctgctctggcccct

SEQ ID NO: 410160 - DNA, 24 bp, Artificial Sequence
  Description of Artificial Sequence: Synthetic oligonucleotide
acttgcctgctgctctggcccctg

SEQ ID NO: 410161 - DNA, 23 bp, Artificial Sequence
  Description of Artificial Sequence: Synthetic oligonucleotide
cttgcctgctgctctggcccctg

SEQ ID NO: 410162 - DNA, 24 bp, Artificial Sequence
  Description of Artificial Sequence: Synthetic oligonucleotide
ttgcctgctgctctggcccctggt

SEQ ID NO: 410163 - DNA, 23 bp, Artificial Sequence
  Description of Artificial Sequence: Synthetic oligonucleotide
tgcctgctgctctggcccctggt

SEQ ID NO: 410164 - DNA, 22 bp, Artificial Sequence
  Description of Artificial Sequence: Synthetic oligonucleotide
gcctgctgctctggcccctggt

SEQ ID NO: 410165 - DNA, 22 bp, Artificial Sequence
  Description of Artificial Sequence: Synthetic oligonucleotide
cctgctgctctggcccctggtc

SEQ ID NO: 410166 - DNA, 23 bp, Artificial Sequence
  Description of Artificial Sequence: Synthetic oligonucleotide
ctgctgctctggcccctggtcct

SEQ ID NO: 410167 - DNA, 24 bp, Artificial Sequence
  Description of Artificial Sequence: Synthetic oligonucleotide
tgctgctctggcccctggtcctgt

SEQ ID NO: 410168 - DNA, 23 bp, Artificial Sequence
  Description of Artificial Sequence: Synthetic oligonucleotide
gctgctctggcccctggtcctgt

SEQ ID NO: 410169 - DNA, 23 bp, Artificial Sequence
  Description of Artificial Sequence: Synthetic oligonucleotide
ctgctctggcccctggtcctgtc

SEQ ID NO: 410170 - DNA, 24 bp, Artificial Sequence
  Description of Artificial Sequence: Synthetic oligonucleotide
tgctctggcccctggtcctgtcct

SEQ ID NO: 410171 - DNA, 23 bp, Artificial Sequence
  Description of Artificial Sequence: Synthetic oligonucleotide
gctctggcccctggtcctgtcct

SEQ ID NO: 410172 - DNA, 30 bp, Artificial Sequence
  Description of Artificial Sequence: Synthetic oligonucleotide
tgtcctgttctccagcatggtgtgtctgag

SEQ ID NO: 410173 - DNA, 29 bp, Artificial Sequence
  Description of Artificial Sequence: Synthetic oligonucleotide
gtcctgttctccagcatggtgtgtctgag

SEQ ID NO: 410174 - DNA, 29 bp, Artificial Sequence
  Description of Artificial Sequence: Synthetic oligonucleotide
tcctgttctccagcatggtgtgtctgagg

SEQ ID NO: 410175 - DNA, 28 bp, Artificial Sequence
  Description of Artificial Sequence: Synthetic oligonucleotide
cctgttctccagcatggtgtgtctgagg

SEQ ID NO: 410176 - DNA, 28 bp, Artificial Sequence
  Description of Artificial Sequence: Synthetic oligonucleotide
ctgttctccagcatggtgtgtctgaggc

SEQ ID NO: 410177 - DNA, 29 bp, Artificial Sequence
  Description of Artificial Sequence: Synthetic oligonucleotide
tgttctccagcatggtgtgtctgaggctc

SEQ ID NO: 410178 - DNA, 28 bp, Artificial Sequence
  Description of Artificial Sequence: Synthetic oligonucleotide
gttctccagcatggtgtgtctgaggctc

SEQ ID NO: 410179 - DNA, 28 bp, Artificial Sequence
  Description of Artificial Sequence: Synthetic oligonucleotide
ttctccagcatggtgtgtctgaggctcc

SEQ ID NO: 410180 - DNA, 27 bp, Artificial Sequence
  Description of Artificial Sequence: Synthetic oligonucleotide
tctccagcatggtgtgtctgaggctcc

SEQ ID NO: 410181 - DNA, 26 bp, Artificial Sequence
  Description of Artificial Sequence: Synthetic oligonucleotide
ctccagcatggtgtgtctgaggctcc

SEQ ID NO: 410182 - DNA, 27 bp, Artificial Sequence
  Description of Artificial Sequence: Synthetic oligonucleotide
tccagcatggtgtgtctgaggctccct

SEQ ID NO: 410183 - DNA, 26 bp, Artificial Sequence
  Description of Artificial Sequence: Synthetic oligonucleotide
ccagcatggtgtgtctgaggctccct

SEQ ID NO: 410184 - DNA, 26 bp, Artificial Sequence
  Description of Artificial Sequence: Synthetic oligonucleotide
cagcatggtgtgtctgaggctccctg

SEQ ID NO: 410185 - DNA, 27 bp, Artificial Sequence
  Description of Artificial Sequence: Synthetic oligonucleotide
agcatggtgtgtctgaggctccctgga

SEQ ID NO: 410186 - DNA, 26 bp, Artificial Sequence
  Description of Artificial Sequence: Synthetic oligonucleotide
gcatggtgtgtctgaggctccctgga

SEQ ID NO: 410187 - DNA, 26 bp, Artificial Sequence
  Description of Artificial Sequence: Synthetic oligonucleotide
catggtgtgtctgaggctccctggag

SEQ ID NO: 410188 - DNA, 26 bp, Artificial Sequence
  Description of Artificial Sequence: Synthetic oligonucleotide
atggtgtgtctgaggctccctggagg

SEQ ID NO: 410189 - DNA, 25 bp, Artificial Sequence
  Description of Artificial Sequence: Synthetic oligonucleotide
tggtgtgtctgaggctccctggagg

SEQ ID NO: 410190 - DNA, 24 bp, Artificial Sequence
  Description of Artificial Sequence: Synthetic oligonucleotide
ggtgtgtctgaggctccctggagg

SEQ ID NO: 410191 - DNA, 25 bp, Artificial Sequence
  Description of Artificial Sequence: Synthetic oligonucleotide
gtgtgtctgaggctccctggaggct

SEQ ID NO: 410192 - DNA, 25 bp, Artificial Sequence
  Description of Artificial Sequence: Synthetic oligonucleotide
tgtgtctgaggctccctggaggctc

SEQ ID NO: 410193 - DNA, 24 bp, Artificial Sequence
  Description of Artificial Sequence: Synthetic oligonucleotide
gtgtctgaggctccctggaggctc

SEQ ID NO: 410194 - DNA, 25 bp, Artificial Sequence
  Description of Artificial Sequence: Synthetic oligonucleotide
tgtctgaggctccctggaggctcct

SEQ ID NO: 410195 - DNA, 24 bp, Artificial Sequence
  Description of Artificial Sequence: Synthetic oligonucleotide
gtctgaggctccctggaggctcct

SEQ ID NO: 410196 - DNA, 24 bp, Artificial Sequence
  Description of Artificial Sequence: Synthetic oligonucleotide
tctgaggctccctggaggctcctg

SEQ ID NO: 410197 - DNA, 23 bp, Artificial Sequence
  Description of Artificial Sequence: Synthetic oligonucleotide
ctgaggctccctggaggctcctg

SEQ ID NO: 410198 - DNA, 25 bp, Artificial Sequence
  Description of Artificial Sequence: Synthetic oligonucleotide
tgaggctccctggaggctcctgcat

SEQ ID NO: 410199 - DNA, 24 bp, Artificial Sequence
  Description of Artificial Sequence: Synthetic oligonucleotide
gaggctccctggaggctcctgcat

SEQ ID NO: 410200 - DNA, 24 bp, Artificial Sequence
  Description of Artificial Sequence: Synthetic oligonucleotide
aggctccctggaggctcctgcatg

SEQ ID NO: 410201 - DNA, 23 bp, Artificial Sequence
  Description of Artificial Sequence: Synthetic oligonucleotide
ggctccctggaggctcctgcatg

SEQ ID NO: 410202 - DNA, 23 bp, Artificial Sequence
  Description of Artificial Sequence: Synthetic oligonucleotide
gctccctggaggctcctgcatgg

SEQ ID NO: 410203 - DNA, 24 bp, Artificial Sequence
  Description of Artificial Sequence: Synthetic oligonucleotide
ctccctggaggctcctgcatggca

SEQ ID NO: 410204 - DNA, 26 bp, Artificial Sequence
  Description of Artificial Sequence: Synthetic oligonucleotide
tccctggaggctcctgcatggcagtt

SEQ ID NO: 410205 - DNA, 25 bp, Artificial Sequence
  Description of Artificial Sequence: Synthetic oligonucleotide
ccctggaggctcctgcatggcagtt

SEQ ID NO: 410206 - DNA, 26 bp, Artificial Sequence
  Description of Artificial Sequence: Synthetic oligonucleotide
cctggaggctcctgcatggcagttct

SEQ ID NO: 410207 - DNA, 27 bp, Artificial Sequence
  Description of Artificial Sequence: Synthetic oligonucleotide
ctggaggctcctgcatggcagttctga

SEQ ID NO: 410208 - DNA, 27 bp, Artificial Sequence
  Description of Artificial Sequence: Synthetic oligonucleotide
tggaggctcctgcatggcagttctgac

SEQ ID NO: 410209 - DNA, 27 bp, Artificial Sequence
  Description of Artificial Sequence: Synthetic oligonucleotide
ggaggctcctgcatggcagttctgaca

SEQ ID NO: 410210 - DNA, 27 bp, Artificial Sequence
  Description of Artificial Sequence: Synthetic oligonucleotide
gaggctcctgcatggcagttctgacag

SEQ ID NO: 410211 - DNA, 28 bp, Artificial Sequence
  Description of Artificial Sequence: Synthetic oligonucleotide
aggctcctgcatggcagttctgacagtg

SEQ ID NO: 410212 - DNA, 27 bp, Artificial Sequence
  Description of Artificial Sequence: Synthetic oligonucleotide
ggctcctgcatggcagttctgacagtg

SEQ ID NO: 410213 - DNA, 28 bp, Artificial Sequence
  Description of Artificial Sequence: Synthetic oligonucleotide
gctcctgcatggcagttctgacagtgac

SEQ ID NO: 410214 - DNA, 29 bp, Artificial Sequence
  Description of Artificial Sequence: Synthetic oligonucleotide
ctcctgcatggcagttctgacagtgacac

SEQ ID NO: 410215 - DNA, 30 bp, Artificial Sequence; identical to SEQ ID NO: 64894
  Description of Artificial Sequence: Synthetic oligonucleotide

SEQ ID NO: 410216 - DNA, 29 bp, Artificial Sequence
  Description of Artificial Sequence: Synthetic oligonucleotide
cctgcatggcagttctgacagtgacactg

SEQ ID NO: 410217 - DNA, 31 bp, Artificial Sequence; identical to SEQ ID NO: 64896
  Description of Artificial Sequence: Synthetic oligonucleotide

SEQ ID NO: 410218 - DNA, 31 bp, Artificial Sequence; identical to SEQ ID NO: 64897
  Description of Artificial Sequence: Synthetic oligonucleotide

SEQ ID NO: 410219 - DNA, 30 bp, Artificial Sequence; identical to SEQ ID NO: 64898
  Description of Artificial Sequence: Synthetic oligonucleotide

SEQ ID NO: 410220 - DNA, 31 bp, Artificial Sequence; identical to SEQ ID NO: 64899
  Description of Artificial Sequence: Synthetic oligonucleotide

SEQ ID NO: 410221 - DNA, 31 bp, Artificial Sequence; identical to SEQ ID NO: 64900
  Description of Artificial Sequence: Synthetic oligonucleotide

SEQ ID NO: 410222 - DNA, 30 bp, Artificial Sequence; identical to SEQ ID NO: 64901
  Description of Artificial Sequence: Synthetic oligonucleotide

SEQ ID NO: 410223 - DNA, 29 bp, Artificial Sequence
  Description of Artificial Sequence: Synthetic oligonucleotide
ggcagttctgacagtgacactgatggtgc

SEQ ID NO: 410224 - DNA, 30 bp, Artificial Sequence; identical to SEQ ID NO: 64903
  Description of Artificial Sequence: Synthetic oligonucleotide

SEQ ID NO: 410225 - DNA, 31 bp, Artificial Sequence; identical to SEQ ID NO: 64904
  Description of Artificial Sequence: Synthetic oligonucleotide

SEQ ID NO: 410226 - DNA, 31 bp, Artificial Sequence; identical to SEQ ID NO: 64905
  Description of Artificial Sequence: Synthetic oligonucleotide

SEQ ID NO: 410227 - DNA, 30 bp, Artificial Sequence; identical to SEQ ID NO: 64906
  Description of Artificial Sequence: Synthetic oligonucleotide

SEQ ID NO: 410228 - DNA, 31 bp, Artificial Sequence; identical to SEQ ID NO: 64907
  Description of Artificial Sequence: Synthetic oligonucleotide

SEQ ID NO: 410229 - DNA, 30 bp, Artificial Sequence; identical to SEQ ID NO: 64908
  Description of Artificial Sequence: Synthetic oligonucleotide

SEQ ID NO: 410230 - DNA, 25 bp, Artificial Sequence
  Description of Artificial Sequence: Synthetic oligonucleotide
ccactggctttggctggggacacca

SEQ ID NO: 410231 - DNA, 26 bp, Artificial Sequence
  Description of Artificial Sequence: Synthetic oligonucleotide
cactggctttggctggggacaccaga

SEQ ID NO: 410232 - DNA, 26 bp, Artificial Sequence
  Description of Artificial Sequence: Synthetic oligonucleotide
actggctttggctggggacaccagac

SEQ ID NO: 410233 - DNA, 25 bp, Artificial Sequence
  Description of Artificial Sequence: Synthetic oligonucleotide
ctggctttggctggggacaccagac

SEQ ID NO: 410234 - DNA, 26 bp, Artificial Sequence
  Description of Artificial Sequence: Synthetic oligonucleotide
tggctttggctggggacaccagacca

SEQ ID NO: 410235 - DNA, 25 bp, Artificial Sequence
  Description of Artificial Sequence: Synthetic oligonucleotide
ggctttggctggggacaccagacca

SEQ ID NO: 410236 - DNA, 25 bp, Artificial Sequence
  Description of Artificial Sequence: Synthetic oligonucleotide
gctttggctggggacaccagaccac

SEQ ID NO: 410237 - DNA, 27 bp, Artificial Sequence
  Description of Artificial Sequence: Synthetic oligonucleotide
ctttggctggggacaccagaccacgtt

SEQ ID NO: 410238 - DNA, 28 bp, Artificial Sequence
  Description of Artificial Sequence: Synthetic oligonucleotide
tttggctggggacaccagaccacgtttc

SEQ ID NO: 410239 - DNA, 27 bp, Artificial Sequence
  Description of Artificial Sequence: Synthetic oligonucleotide
ttggctggggacaccagaccacgtttc

SEQ ID NO: 410240 - DNA, 27 bp, Artificial Sequence
  Description of Artificial Sequence: Synthetic oligonucleotide
tggctggggacaccagaccacgtttct

SEQ ID NO: 410241 - DNA, 27 bp, Artificial Sequence
  Description of Artificial Sequence: Synthetic oligonucleotide
ggctggggacaccagaccacgtttctt

SEQ ID NO: 410242 - DNA, 27 bp, Artificial Sequence
  Description of Artificial Sequence: Synthetic oligonucleotide
gctggggacaccagaccacgtttcttg

SEQ ID NO: 410243 - DNA, 27 bp, Artificial Sequence
  Description of Artificial Sequence: Synthetic oligonucleotide
ctggggacaccagaccacgtttcttgg

SEQ ID NO: 410244 - DNA, 28 bp, Artificial Sequence
  Description of Artificial Sequence: Synthetic oligonucleotide
tggggacaccagaccacgtttcttggag

SEQ ID NO: 410245 - DNA, 27 bp, Artificial Sequence
  Description of Artificial Sequence: Synthetic oligonucleotide
ggggacaccagaccacgtttcttggag

SEQ ID NO: 410246 - DNA, 29 bp, Artificial Sequence
  Description of Artificial Sequence: Synthetic oligonucleotide
gggacaccagaccacgtttcttggagtac

SEQ ID NO: 410247 - DNA, 30 bp, Artificial Sequence; identical to SEQ ID NO: 64926
  Description of Artificial Sequence: Synthetic oligonucleotide

SEQ ID NO: 410248 - DNA, 32 bp, Artificial Sequence; identical to SEQ ID NO: 64927
  Description of Artificial Sequence: Synthetic oligonucleotide

SEQ ID NO: 410249 - DNA, 32 bp, Artificial Sequence; identical to SEQ ID NO: 64928
  Description of Artificial Sequence: Synthetic oligonucleotide

SEQ ID NO: 410250 - DNA, 31 bp, Artificial Sequence; identical to SEQ ID NO: 64929
  Description of Artificial Sequence: Synthetic oligonucleotide

SEQ ID NO: 410251 - DNA, 32 bp, Artificial Sequence; identical to SEQ ID NO: 64930
  Description of Artificial Sequence: Synthetic oligonucleotide

SEQ ID NO: 410252 - DNA, 31 bp, Artificial Sequence; identical to SEQ ID NO: 64931
  Description of Artificial Sequence: Synthetic oligonucleotide

SEQ ID NO: 410253 - DNA, 32 bp, Artificial Sequence; identical to SEQ ID NO: 64932
  Description of Artificial Sequence: Synthetic oligonucleotide

SEQ ID NO: 410254 - DNA, 33 bp, Artificial Sequence; identical to SEQ ID NO: 64933
  Description of Artificial Sequence: Synthetic oligonucleotide

SEQ ID NO: 410255 - DNA, 32 bp, Artificial Sequence; identical to SEQ ID NO: 64934
  Description of Artificial Sequence: Synthetic oligonucleotide

SEQ ID NO: 410256 - DNA, 33 bp, Artificial Sequence; identical to SEQ ID NO: 64935
  Description of Artificial Sequence: Synthetic oligonucleotide

SEQ ID NO: 410257 - DNA, 32 bp, Artificial Sequence; identical to SEQ ID NO: 64936
  Description of Artificial Sequence: Synthetic oligonucleotide

SEQ ID NO: 410258 - DNA, 33 bp, Artificial Sequence; identical to SEQ ID NO: 64937
  Description of Artificial Sequence: Synthetic oligonucleotide

SEQ ID NO: 410259 - DNA, 37 bp, Artificial Sequence; identical to SEQ ID NO: 64938
  Description of Artificial Sequence: Synthetic oligonucleotide

SEQ ID NO: 410260 - DNA, 36 bp, Artificial Sequence; identical to SEQ ID NO: 64939
  Description of Artificial Sequence: Synthetic oligonucleotide

SEQ ID NO: 410261 - DNA, 38 bp, Artificial Sequence; identical to SEQ ID NO: 64940
  Description of Artificial Sequence: Synthetic oligonucleotide

SEQ ID NO: 410262 - DNA, 41 bp, Artificial Sequence; identical to SEQ ID NO: 64941
  Description of Artificial Sequence: Synthetic oligonucleotide

SEQ ID NO: 410263 - DNA, 40 bp, Artificial Sequence; identical to SEQ ID NO: 64942
  Description of Artificial Sequence: Synthetic oligonucleotide

SEQ ID NO: 410264 - DNA, 39 bp, Artificial Sequence; identical to SEQ ID NO: 64943
  Description of Artificial Sequence: Synthetic oligonucleotide

SEQ ID NO: 410265 - DNA, 38 bp, Artificial Sequence; identical to SEQ ID NO: 64944
  Description of Artificial Sequence: Synthetic oligonucleotide

SEQ ID NO: 410266 - DNA, 38 bp, Artificial Sequence; identical to SEQ ID NO: 64945
  Description of Artificial Sequence: Synthetic oligonucleotide

SEQ ID NO: 410267 - DNA, 37 bp, Artificial Sequence; identical to SEQ ID NO: 64946
  Description of Artificial Sequence: Synthetic oligonucleotide

SEQ ID NO: 410268 - DNA, 36 bp, Artificial Sequence; identical to SEQ ID NO: 64947
  Description of Artificial Sequence: Synthetic oligonucleotide

SEQ ID NO: 410269 - DNA, 36 bp, Artificial Sequence; identical to SEQ ID NO: 64948
  Description of Artificial Sequence: Synthetic oligonucleotide

SEQ ID NO: 410270 - DNA, 37 bp, Artificial Sequence; identical to SEQ ID NO: 64949
  Description of Artificial Sequence: Synthetic oligonucleotide

SEQ ID NO: 410271 - DNA, 36 bp, Artificial Sequence; identical to SEQ ID NO: 64950
  Description of Artificial Sequence: Synthetic oligonucleotide

SEQ ID NO: 410272 - DNA, 36 bp, Artificial Sequence; identical to SEQ ID NO: 64951
  Description of Artificial Sequence: Synthetic oligonucleotide

SEQ ID NO: 410273 - DNA, 35 bp, Artificial Sequence; identical to SEQ ID NO: 64952
  Description of Artificial Sequence: Synthetic oligonucleotide

SEQ ID NO: 410274 - DNA, 34 bp, Artificial Sequence; identical to SEQ ID NO: 64953
  Description of Artificial Sequence: Synthetic oligonucleotide

SEQ ID NO: 410275 - DNA, 34 bp, Artificial Sequence; identical to SEQ ID NO: 64954
  Description of Artificial Sequence: Synthetic oligonucleotide

SEQ ID NO: 410276 - DNA, 33 bp, Artificial Sequence; identical to SEQ ID NO: 64955
  Description of Artificial Sequence: Synthetic oligonucleotide

SEQ ID NO: 410277 - DNA, 34 bp, Artificial Sequence; identical to SEQ ID NO: 64956
  Description of Artificial Sequence: Synthetic oligonucleotide

SEQ ID NO: 410278 - DNA, 33 bp, Artificial Sequence; identical to SEQ ID NO: 64957
  Description of Artificial Sequence: Synthetic oligonucleotide

SEQ ID NO: 410279 - DNA, 32 bp, Artificial Sequence; identical to SEQ ID NO: 64958
  Description of Artificial Sequence: Synthetic oligonucleotide

SEQ ID NO: 410280 - DNA, 32 bp, Artificial Sequence; identical to SEQ ID NO: 64959
  Description of Artificial Sequence: Synthetic oligonucleotide

SEQ ID NO: 410281 - DNA, 32 bp, Artificial Sequence; identical to SEQ ID NO: 64960
  Description of Artificial Sequence: Synthetic oligonucleotide

SEQ ID NO: 410282 - DNA, 31 bp, Artificial Sequence; identical to SEQ ID NO: 64961
  Description of Artificial Sequence: Synthetic oligonucleotide

SEQ ID NO: 410283 - DNA, 31 bp, Artificial Sequence; identical to SEQ ID NO: 64962
  Description of Artificial Sequence: Synthetic oligonucleotide

SEQ ID NO: 410284 - DNA, 30 bp, Artificial Sequence; identical to SEQ ID NO: 64963
  Description of Artificial Sequence: Synthetic oligonucleotide

SEQ ID NO: 410285 - DNA, 30 bp, Artificial Sequence; identical to SEQ ID NO: 64964
  Description of Artificial Sequence: Synthetic oligonucleotide

SEQ ID NO: 410286 - DNA, 29 bp, Artificial Sequence
  Description of Artificial Sequence: Synthetic oligonucleotide
gtgtcatttcttcaatgggacggagcggg

SEQ ID NO: 410287 - DNA, 26 bp, Artificial Sequence
  Description of Artificial Sequence: Synthetic oligonucleotide
ttcaatgggacggagcgggtgcggta

SEQ ID NO: 410288 - DNA, 25 bp, Artificial Sequence
  Description of Artificial Sequence: Synthetic oligonucleotide
tcaatgggacggagcgggtgcggta

SEQ ID NO: 410289 - DNA, 24 bp, Artificial Sequence
  Description of Artificial Sequence: Synthetic oligonucleotide
caatgggacggagcgggtgcggta

SEQ ID NO: 410290 - DNA, 24 bp, Artificial Sequence
  Description of Artificial Sequence: Synthetic oligonucleotide
aatgggacggagcgggtgcggtac

SEQ ID NO: 410291 - DNA, 23 bp, Artificial Sequence
  Description of Artificial Sequence: Synthetic oligonucleotide
atgggacggagcgggtgcggtac

SEQ ID NO: 410292 - DNA, 22 bp, Artificial Sequence
  Description of Artificial Sequence: Synthetic oligonucleotide
tgggacggagcgggtgcggtac

SEQ ID NO: 410293 - DNA, 21 bp, Artificial Sequence
  Description of Artificial Sequence: Synthetic oligonucleotide
gggacggagcgggtgcggtac

SEQ ID NO: 410294 - DNA, 22 bp, Artificial Sequence
  Description of Artificial Sequence: Synthetic oligonucleotide
ggacggagcgggtgcggtacct

SEQ ID NO: 410295 - DNA, 22 bp, Artificial Sequence
  Description of Artificial Sequence: Synthetic oligonucleotide
gacggagcgggtgcggtacctg

SEQ ID NO: 410296 - DNA, 23 bp, Artificial Sequence
  Description of Artificial Sequence: Synthetic oligonucleotide
acggagcgggtgcggtacctgga

SEQ ID NO: 410297 - DNA, 22 bp, Artificial Sequence
  Description of Artificial Sequence: Synthetic oligonucleotide
cggagcgggtgcggtacctgga

SEQ ID NO: 410298 - DNA, 23 bp, Artificial Sequence
  Description of Artificial Sequence: Synthetic oligonucleotide
ggagcgggtgcggtacctggaca

SEQ ID NO: 410299 - DNA, 26 bp, Artificial Sequence
  Description of Artificial Sequence: Synthetic oligonucleotide
gagcgggtgcggtacctggacagata

SEQ ID NO: 410300 - DNA, 27 bp, Artificial Sequence
  Description of Artificial Sequence: Synthetic oligonucleotide
agcgggtgcggtacctggacagatact

SEQ ID NO: 410301 - DNA, 27 bp, Artificial Sequence
  Description of Artificial Sequence: Synthetic oligonucleotide
gcgggtgcggtacctggacagatactt

SEQ ID NO: 410302 - DNA, 27 bp, Artificial Sequence
  Description of Artificial Sequence: Synthetic oligonucleotide
cgggtgcggtacctggacagatacttc

SEQ ID NO: 410303 - DNA, 27 bp, Artificial Sequence
  Description of Artificial Sequence: Synthetic oligonucleotide
gggtgcggtacctggacagatacttcc

SEQ ID NO: 410304 - DNA, 31 bp, Artificial Sequence; identical to SEQ ID NO: 64983
  Description of Artificial Sequence: Synthetic oligonucleotide

SEQ ID NO: 410305 - DNA, 31 bp, Artificial Sequence; identical to SEQ ID NO: 64984
  Description of Artificial Sequence: Synthetic oligonucleotide

SEQ ID NO: 410306 - DNA, 32 bp, Artificial Sequence; identical to SEQ ID NO: 64985
  Description of Artificial Sequence: Synthetic oligonucleotide

SEQ ID NO: 410307 - DNA, 31 bp, Artificial Sequence; identical to SEQ ID NO: 64986
  Description of Artificial Sequence: Synthetic oligonucleotide

SEQ ID NO: 410308 - DNA, 31 bp, Artificial Sequence; identical to SEQ ID NO: 64987
  Description of Artificial Sequence: Synthetic oligonucleotide

SEQ ID NO: 410309 - DNA, 32 bp, Artificial Sequence; identical to SEQ ID NO: 64988
  Description of Artificial Sequence: Synthetic oligonucleotide

SEQ ID NO: 410310 - DNA, 32 bp, Artificial Sequence; identical to SEQ ID NO: 64989
  Description of Artificial Sequence: Synthetic oligonucleotide

SEQ ID NO: 410311 - DNA, 33 bp, Artificial Sequence; identical to SEQ ID NO: 64990
  Description of Artificial Sequence: Synthetic oligonucleotide

SEQ ID NO: 410312 - DNA, 32 bp, Artificial Sequence; identical to SEQ ID NO: 64991
  Description of Artificial Sequence: Synthetic oligonucleotide

SEQ ID NO: 410313 - DNA, 31 bp, Artificial Sequence; identical to SEQ ID NO: 64992
  Description of Artificial Sequence: Synthetic oligonucleotide

SEQ ID NO: 410314 - DNA, 33 bp, Artificial Sequence; identical to SEQ ID NO: 64993
  Description of Artificial Sequence: Synthetic oligonucleotide

SEQ ID NO: 410315 - DNA, 33 bp, Artificial Sequence; identical to SEQ ID NO: 64994
  Description of Artificial Sequence: Synthetic oligonucleotide

SEQ ID NO: 410316 - DNA, 32 bp, Artificial Sequence; identical to SEQ ID NO: 64995
  Description of Artificial Sequence: Synthetic oligonucleotide

SEQ ID NO: 410317 - DNA, 33 bp, Artificial Sequence; identical to SEQ ID NO: 64996
  Description of Artificial Sequence: Synthetic oligonucleotide

SEQ ID NO: 410318 - DNA, 33 bp, Artificial Sequence; identical to SEQ ID NO: 64997
  Description of Artificial Sequence: Synthetic oligonucleotide

SEQ ID NO: 410319 - DNA, 32 bp, Artificial Sequence; identical to SEQ ID NO: 64998
  Description of Artificial Sequence: Synthetic oligonucleotide

SEQ ID NO: 410320 - DNA, 32 bp, Artificial Sequence; identical to SEQ ID NO: 64999
  Description of Artificial Sequence: Synthetic oligonucleotide

SEQ ID NO: 410321 - DNA, 31 bp, Artificial Sequence; identical to SEQ ID NO: 65000
  Description of Artificial Sequence: Synthetic oligonucleotide

SEQ ID NO: 410322 - DNA, 31 bp, Artificial Sequence; identical to SEQ ID NO: 65001
  Description of Artificial Sequence: Synthetic oligonucleotide

SEQ ID NO: 410323 - DNA, 30 bp, Artificial Sequence; identical to SEQ ID NO: 65002
  Description of Artificial Sequence: Synthetic oligonucleotide

SEQ ID NO: 410324 - DNA, 29 bp, Artificial Sequence
  Description of Artificial Sequence: Synthetic oligonucleotide
acttccataaccaggaggagaacgtgcgc

SEQ ID NO: 410325 - DNA, 28 bp, Artificial Sequence
  Description of Artificial Sequence: Synthetic oligonucleotide
cttccataaccaggaggagaacgtgcgc

SEQ ID NO: 410326 - DNA, 30 bp, Artificial Sequence; identical to SEQ ID NO: 65005
  Description of Artificial Sequence: Synthetic oligonucleotide

SEQ ID NO: 410327 - DNA, 29 bp, Artificial Sequence
  Description of Artificial Sequence: Synthetic oligonucleotide
tccataaccaggaggagaacgtgcgcttc

SEQ ID NO: 410328 - DNA, 28 bp, Artificial Sequence
  Description of Artificial Sequence: Synthetic oligonucleotide
ccataaccaggaggagaacgtgcgcttc

SEQ ID NO: 410329 - DNA, 28 bp, Artificial Sequence
  Description of Artificial Sequence: Synthetic oligonucleotide
cataaccaggaggagaacgtgcgcttcg

SEQ ID NO: 410330 - DNA, 29 bp, Artificial Sequence
  Description of Artificial Sequence: Synthetic oligonucleotide
ataaccaggaggagaacgtgcgcttcgac

SEQ ID NO: 410331 - DNA, 28 bp, Artificial Sequence
  Description of Artificial Sequence: Synthetic oligonucleotide
taaccaggaggagaacgtgcgcttcgac

SEQ ID NO: 410332 - DNA, 27 bp, Artificial Sequence
  Description of Artificial Sequence: Synthetic oligonucleotide
aaccaggaggagaacgtgcgcttcgac

SEQ ID NO: 410333 - DNA, 27 bp, Artificial Sequence
  Description of Artificial Sequence: Synthetic oligonucleotide
accaggaggagaacgtgcgcttcgaca

SEQ ID NO: 410334 - DNA, 26 bp, Artificial Sequence
  Description of Artificial Sequence: Synthetic oligonucleotide
ccaggaggagaacgtgcgcttcgaca

SEQ ID NO: 410335 - DNA, 26 bp, Artificial Sequence
  Description of Artificial Sequence: Synthetic oligonucleotide
caggaggagaacgtgcgcttcgacag

SEQ ID NO: 410336 - DNA, 26 bp, Artificial Sequence
  Description of Artificial Sequence: Synthetic oligonucleotide
aggaggagaacgtgcgcttcgacagc

SEQ ID NO: 410337 - DNA, 25 bp, Artificial Sequence
  Description of Artificial Sequence: Synthetic oligonucleotide
ggaggagaacgtgcgcttcgacagc

SEQ ID NO: 410338 - DNA, 26 bp, Artificial Sequence
  Description of Artificial Sequence: Synthetic oligonucleotide
gaggagaacgtgcgcttcgacagcga

SEQ ID NO: 410339 - DNA, 26 bp, Artificial Sequence
  Description of Artificial Sequence: Synthetic oligonucleotide
aggagaacgtgcgcttcgacagcgac

SEQ ID NO: 410340 - DNA, 25 bp, Artificial Sequence
  Description of Artificial Sequence: Synthetic oligonucleotide
ggagaacgtgcgcttcgacagcgac

SEQ ID NO: 410341 - DNA, 26 bp, Artificial Sequence
  Description of Artificial Sequence: Synthetic oligonucleotide
gagaacgtgcgcttcgacagcgacgt

SEQ ID NO: 410342 - DNA, 26 bp, Artificial Sequence
  Description of Artificial Sequence: Synthetic oligonucleotide
agaacgtgcgcttcgacagcgacgtg

SEQ ID NO: 410343 - DNA, 25 bp, Artificial Sequence
  Description of Artificial Sequence: Synthetic oligonucleotide
gaacgtgcgcttcgacagcgacgtg

SEQ ID NO: 410344 - DNA, 25 bp, Artificial Sequence
  Description of Artificial Sequence: Synthetic oligonucleotide
aacgtgcgcttcgacagcgacgtgg

SEQ ID NO: 410345 - DNA, 32 bp, Artificial Sequence; identical to SEQ ID NO: 65024
  Description of Artificial Sequence: Synthetic oligonucleotide

SEQ ID NO: 410346 - DNA, 31 bp, Artificial Sequence; identical to SEQ ID NO: 65025
  Description of Artificial Sequence: Synthetic oligonucleotide

SEQ ID NO: 410347 - DNA, 31 bp, Artificial Sequence; identical to SEQ ID NO: 65026
  Description of Artificial Sequence: Synthetic oligonucleotide

SEQ ID NO: 410348 - DNA, 30 bp, Artificial Sequence; identical to SEQ ID NO: 65027
  Description of Artificial Sequence: Synthetic oligonucleotide

SEQ ID NO: 410349 - DNA, 26 bp, Artificial Sequence
  Description of Artificial Sequence: Synthetic oligonucleotide
gagagcttcacagtgcagcggcgagt

SEQ ID NO: 410350 - DNA, 26 bp, Artificial Sequence
  Description of Artificial Sequence: Synthetic oligonucleotide
agagcttcacagtgcagcggcgagtc

SEQ ID NO: 410351 - DNA, 25 bp, Artificial Sequence
  Description of Artificial Sequence: Synthetic oligonucleotide
gagcttcacagtgcagcggcgagtc

SEQ ID NO: 410352 - DNA, 27 bp, Artificial Sequence
  Description of Artificial Sequence: Synthetic oligonucleotide
agcttcacagtgcagcggcgagtccat

SEQ ID NO: 410353 - DNA, 26 bp, Artificial Sequence
  Description of Artificial Sequence: Synthetic oligonucleotide
gcttcacagtgcagcggcgagtccat

SEQ ID NO: 410354 - DNA, 26 bp, Artificial Sequence
  Description of Artificial Sequence: Synthetic oligonucleotide
cttcacagtgcagcggcgagtccatc

SEQ ID NO: 410355 - DNA, 27 bp, Artificial Sequence
  Description of Artificial Sequence: Synthetic oligonucleotide
ttcacagtgcagcggcgagtccatcct

SEQ ID NO: 410356 - DNA, 27 bp, Artificial Sequence
  Description of Artificial Sequence: Synthetic oligonucleotide
tcacagtgcagcggcgagtccatccta

SEQ ID NO: 410357 - DNA, 27 bp, Artificial Sequence
  Description of Artificial Sequence: Synthetic oligonucleotide
cacagtgcagcggcgagtccatcctaa

SEQ ID NO: 410358 - DNA, 27 bp, Artificial Sequence
  Description of Artificial Sequence: Synthetic oligonucleotide
acagtgcagcggcgagtccatcctaag

SEQ ID NO: 410359 - DNA, 26 bp, Artificial Sequence
  Description of Artificial Sequence: Synthetic oligonucleotide
cagtgcagcggcgagtccatcctaag

SEQ ID NO: 410360 - DNA, 27 bp, Artificial Sequence
  Description of Artificial Sequence: Synthetic oligonucleotide
agtgcagcggcgagtccatcctaaggt

SEQ ID NO: 410361 - DNA, 26 bp, Artificial Sequence
  Description of Artificial Sequence: Synthetic oligonucleotide
gtgcagcggcgagtccatcctaaggt

SEQ ID NO: 410362 - DNA, 27 bp, Artificial Sequence
  Description of Artificial Sequence: Synthetic oligonucleotide
tgcagcggcgagtccatcctaaggtga

SEQ ID NO: 410363 - DNA, 26 bp, Artificial Sequence
  Description of Artificial Sequence: Synthetic oligonucleotide
gcagcggcgagtccatcctaaggtga

SEQ ID NO: 410364 - DNA, 27 bp, Artificial Sequence
  Description of Artificial Sequence: Synthetic oligonucleotide
cagcggcgagtccatcctaaggtgact

SEQ ID NO: 410365 - DNA, 27 bp, Artificial Sequence
  Description of Artificial Sequence: Synthetic oligonucleotide
agcggcgagtccatcctaaggtgactg

SEQ ID NO: 410366 - DNA, 27 bp, Artificial Sequence
  Description of Artificial Sequence: Synthetic oligonucleotide
gcggcgagtccatcctaaggtgactgt

SEQ ID NO: 410367 - DNA, 27 bp, Artificial Sequence
  Description of Artificial Sequence: Synthetic oligonucleotide
cggcgagtccatcctaaggtgactgtg

SEQ ID NO: 410368 - DNA, 30 bp, Artificial Sequence; identical to SEQ ID NO: 65047
  Description of Artificial Sequence: Synthetic oligonucleotide

SEQ ID NO: 410369 - DNA, 30 bp, Artificial Sequence; identical to SEQ ID NO: 65048
  Description of Artificial Sequence: Synthetic oligonucleotide

SEQ ID NO: 410370 - DNA, 32 bp, Artificial Sequence; identical to SEQ ID NO: 65049
  Description of Artificial Sequence: Synthetic oligonucleotide

SEQ ID NO: 410371 - DNA, 35 bp, Artificial Sequence; identical to SEQ ID NO: 65050
  Description of Artificial Sequence: Synthetic oligonucleotide

SEQ ID NO: 410372 - DNA, 36 bp, Artificial Sequence; identical to SEQ ID NO: 65051
  Description of Artificial Sequence: Synthetic oligonucleotide

SEQ ID NO: 410373 - DNA, 35 bp, Artificial Sequence; identical to SEQ ID NO: 65052
  Description of Artificial Sequence: Synthetic oligonucleotide

SEQ ID NO: 410374 - DNA, 35 bp, Artificial Sequence; identical to SEQ ID NO: 65053
  Description of Artificial Sequence: Synthetic oligonucleotide

SEQ ID NO: 410375 - DNA, 34 bp, Artificial Sequence; identical to SEQ ID NO: 65054
  Description of Artificial Sequence: Synthetic oligonucleotide

SEQ ID NO: 410376 - DNA, 34 bp, Artificial Sequence; identical to SEQ ID NO: 65055
  Description of Artificial Sequence: Synthetic oligonucleotide

SEQ ID NO: 410377 - DNA, 35 bp, Artificial Sequence; identical to SEQ ID NO: 65056
  Description of Artificial Sequence: Synthetic oligonucleotide

SEQ ID NO: 410378 - DNA, 34 bp, Artificial Sequence; identical to SEQ ID NO: 65057
  Description of Artificial Sequence: Synthetic oligonucleotide

SEQ ID NO: 410379 - DNA, 27 bp, Artificial Sequence
  Description of Artificial Sequence: Synthetic oligonucleotide
tcaaagacccagcccctgcagcaccat

SEQ ID NO: 410380 - DNA, 27 bp, Artificial Sequence
  Description of Artificial Sequence: Synthetic oligonucleotide
caaagacccagcccctgcagcaccata

SEQ ID NO: 410381 - DNA, 28 bp, Artificial Sequence
  Description of Artificial Sequence: Synthetic oligonucleotide
aaagacccagcccctgcagcaccataac

SEQ ID NO: 410382 - DNA, 27 bp, Artificial Sequence
  Description of Artificial Sequence: Synthetic oligonucleotide
aagacccagcccctgcagcaccataac

SEQ ID NO: 410383 - DNA, 26 bp, Artificial Sequence
  Description of Artificial Sequence: Synthetic oligonucleotide
agacccagcccctgcagcaccataac

SEQ ID NO: 410384 - DNA, 25 bp, Artificial Sequence
  Description of Artificial Sequence: Synthetic oligonucleotide
gacccagcccctgcagcaccataac

SEQ ID NO: 410385 - DNA, 26 bp, Artificial Sequence
  Description of Artificial Sequence: Synthetic oligonucleotide
acccagcccctgcagcaccataacct

SEQ ID NO: 410386 - DNA, 25 bp, Artificial Sequence
  Description of Artificial Sequence: Synthetic oligonucleotide
cccagcccctgcagcaccataacct

SEQ ID NO: 410387 - DNA, 25 bp, Artificial Sequence
  Description of Artificial Sequence: Synthetic oligonucleotide
ccagcccctgcagcaccataacctc

SEQ ID NO: 410388 - DNA, 26 bp, Artificial Sequence
  Description of Artificial Sequence: Synthetic oligonucleotide
cagcccctgcagcaccataacctcct

SEQ ID NO: 410389 - DNA, 26 bp, Artificial Sequence
  Description of Artificial Sequence: Synthetic oligonucleotide
agcccctgcagcaccataacctcctg

SEQ ID NO: 410390 - DNA, 25 bp, Artificial Sequence
  Description of Artificial Sequence: Synthetic oligonucleotide
gcccctgcagcaccataacctcctg

SEQ ID NO: 410391 - DNA, 26 bp, Artificial Sequence
  Description of Artificial Sequence: Synthetic oligonucleotide
cccctgcagcaccataacctcctggt

SEQ ID NO: 410392 - DNA, 27 bp, Artificial Sequence
  Description of Artificial Sequence: Synthetic oligonucleotide
ccctgcagcaccataacctcctggtct

SEQ ID NO: 410393 - DNA, 27 bp, Artificial Sequence
  Description of Artificial Sequence: Synthetic oligonucleotide
cctgcagcaccataacctcctggtctg

SEQ ID NO: 410394 - DNA, 29 bp, Artificial Sequence
  Description of Artificial Sequence: Synthetic oligonucleotide
ctgcagcaccataacctcctggtctgttc

SEQ ID NO: 410395 - DNA, 30 bp, Artificial Sequence; identical to SEQ ID NO: 65074
  Description of Artificial Sequence: Synthetic oligonucleotide

SEQ ID NO: 410396 - DNA, 29 bp, Artificial Sequence
  Description of Artificial Sequence: Synthetic oligonucleotide
gcagcaccataacctcctggtctgttctg

SEQ ID NO: 410397 - DNA, 30 bp, Artificial Sequence; identical to SEQ ID NO: 65076
  Description of Artificial Sequence: Synthetic oligonucleotide

SEQ ID NO: 410398 - DNA, 31 bp, Artificial Sequence; identical to SEQ ID NO: 65077
  Description of Artificial Sequence: Synthetic oligonucleotide

SEQ ID NO: 410399 - DNA, 30 bp, Artificial Sequence; identical to SEQ ID NO: 65078
  Description of Artificial Sequence: Synthetic oligonucleotide

SEQ ID NO: 410400 - DNA, 31 bp, Artificial Sequence; identical to SEQ ID NO: 65079
  Description of Artificial Sequence: Synthetic oligonucleotide

SEQ ID NO: 410401 - DNA, 31 bp, Artificial Sequence; identical to SEQ ID NO: 65080
  Description of Artificial Sequence: Synthetic oligonucleotide

SEQ ID NO: 410402 - DNA, 30 bp, Artificial Sequence; identical to SEQ ID NO: 65081
  Description of Artificial Sequence: Synthetic oligonucleotide

SEQ ID NO: 410403 - DNA, 33 bp, Artificial Sequence; identical to SEQ ID NO: 65082
  Description of Artificial Sequence: Synthetic oligonucleotide

SEQ ID NO: 410404 - DNA, 36 bp, Artificial Sequence; identical to SEQ ID NO: 65083
  Description of Artificial Sequence: Synthetic oligonucleotide

SEQ ID NO: 410405 - DNA, 35 bp, Artificial Sequence; identical to SEQ ID NO: 65084
  Description of Artificial Sequence: Synthetic oligonucleotide

SEQ ID NO: 410406 - DNA, 34 bp, Artificial Sequence; identical to SEQ ID NO: 65085
  Description of Artificial Sequence: Synthetic oligonucleotide

SEQ ID NO: 410407 - DNA, 33 bp, Artificial Sequence; identical to SEQ ID NO: 65086
  Description of Artificial Sequence: Synthetic oligonucleotide

SEQ ID NO: 410408 - DNA, 32 bp, Artificial Sequence; identical to SEQ ID NO: 65087
  Description of Artificial Sequence: Synthetic oligonucleotide

SEQ ID NO: 410409 - DNA, 32 bp, Artificial Sequence; identical to SEQ ID NO: 65088
  Description of Artificial Sequence: Synthetic oligonucleotide

SEQ ID NO: 410410 - DNA, 33 bp, Artificial Sequence; identical to SEQ ID NO: 65089
  Description of Artificial Sequence: Synthetic oligonucleotide

SEQ ID NO: 410411 - DNA, 32 bp, Artificial Sequence; identical to SEQ ID NO: 65090
  Description of Artificial Sequence: Synthetic oligonucleotide

SEQ ID NO: 410412 - DNA, 32 bp, Artificial Sequence; identical to SEQ ID NO: 65091
  Description of Artificial Sequence: Synthetic oligonucleotide

SEQ ID NO: 410413 - DNA, 32 bp, Artificial Sequence; identical to SEQ ID NO: 65092
  Description of Artificial Sequence: Synthetic oligonucleotide

SEQ ID NO: 410414 - DNA, 31 bp, Artificial Sequence; identical to SEQ ID NO: 65093
  Description of Artificial Sequence: Synthetic oligonucleotide

SEQ ID NO: 410415 - DNA, 32 bp, Artificial Sequence; identical to SEQ ID NO: 65094
  Description of Artificial Sequence: Synthetic oligonucleotide

SEQ ID NO: 410416 - DNA, 32 bp, Artificial Sequence; identical to SEQ ID NO: 65095
  Description of Artificial Sequence: Synthetic oligonucleotide

SEQ ID NO: 410417 - DNA, 31 bp, Artificial Sequence; identical to SEQ ID NO: 65096
  Description of Artificial Sequence: Synthetic oligonucleotide

SEQ ID NO: 410418 - DNA, 34 bp, Artificial Sequence; identical to SEQ ID NO: 65097
  Description of Artificial Sequence: Synthetic oligonucleotide

SEQ ID NO: 410419 - DNA, 33 bp, Artificial Sequence; identical to SEQ ID NO: 65098
  Description of Artificial Sequence: Synthetic oligonucleotide

SEQ ID NO: 410420 - DNA, 35 bp, Artificial Sequence; identical to SEQ ID NO: 65099
  Description of Artificial Sequence: Synthetic oligonucleotide

SEQ ID NO: 410421 - DNA, 30 bp, Artificial Sequence; identical to SEQ ID NO: 65100
  Description of Artificial Sequence: Synthetic oligonucleotide

SEQ ID NO: 410422 - DNA, 30 bp, Artificial Sequence; identical to SEQ ID NO: 65101
  Description of Artificial Sequence: Synthetic oligonucleotide

SEQ ID NO: 410423 - DNA, 30 bp, Artificial Sequence; identical to SEQ ID NO: 65102
  Description of Artificial Sequence: Synthetic oligonucleotide

SEQ ID NO: 410424 - DNA, 29 bp, Artificial Sequence
  Description of Artificial Sequence: Synthetic oligonucleotide
gcattgaagtcaggtggttccggaatggc

SEQ ID NO: 410425 - DNA, 29 bp, Artificial Sequence
  Description of Artificial Sequence: Synthetic oligonucleotide
cattgaagtcaggtggttccggaatggcc

SEQ ID NO: 410426 - DNA, 30 bp, Artificial Sequence; identical to SEQ ID NO: 65105
  Description of Artificial Sequence: Synthetic oligonucleotide

SEQ ID NO: 410427 - DNA, 29 bp, Artificial Sequence
  Description of Artificial Sequence: Synthetic oligonucleotide
ttgaagtcaggtggttccggaatggccag

SEQ ID NO: 410428 - DNA, 28 bp, Artificial Sequence
  Description of Artificial Sequence: Synthetic oligonucleotide
tgaagtcaggtggttccggaatggccag

SEQ ID NO: 410429 - DNA, 27 bp, Artificial Sequence
  Description of Artificial Sequence: Synthetic oligonucleotide
gaagtcaggtggttccggaatggccag

SEQ ID NO: 410430 - DNA, 27 bp, Artificial Sequence
  Description of Artificial Sequence: Synthetic oligonucleotide
aagtcaggtggttccggaatggccagg

SEQ ID NO: 410431 - DNA, 27 bp, Artificial Sequence
  Description of Artificial Sequence: Synthetic oligonucleotide
agtcaggtggttccggaatggccagga

SEQ ID NO: 410432 - DNA, 27 bp, Artificial Sequence
  Description of Artificial Sequence: Synthetic oligonucleotide
gtcaggtggttccggaatggccaggaa

SEQ ID NO: 410433 - DNA, 27 bp, Artificial Sequence
  Description of Artificial Sequence: Synthetic oligonucleotide
tcaggtggttccggaatggccaggaag

SEQ ID NO: 410434 - DNA, 27 bp, Artificial Sequence
  Description of Artificial Sequence: Synthetic oligonucleotide
caggtggttccggaatggccaggaaga

SEQ ID NO: 410435 - DNA, 27 bp, Artificial Sequence
  Description of Artificial Sequence: Synthetic oligonucleotide
aggtggttccggaatggccaggaagag

SEQ ID NO: 410436 - DNA, 27 bp, Artificial Sequence
  Description of Artificial Sequence: Synthetic oligonucleotide
ggtggttccggaatggccaggaagaga

SEQ ID NO: 410437 - DNA, 28 bp, Artificial Sequence
  Description of Artificial Sequence: Synthetic oligonucleotide
gtggttccggaatggccaggaagagaag

SEQ ID NO: 410438 - DNA, 29 bp, Artificial Sequence
  Description of Artificial Sequence: Synthetic oligonucleotide
tggttccggaatggccaggaagagaagac

SEQ ID NO: 410439 - DNA, 28 bp, Artificial Sequence
  Description of Artificial Sequence: Synthetic oligonucleotide
ggttccggaatggccaggaagagaagac

SEQ ID NO: 410440 - DNA, 29 bp, Artificial Sequence
  Description of Artificial Sequence: Synthetic oligonucleotide
gttccggaatggccaggaagagaagactg

SEQ ID NO: 410441 - DNA, 29 bp, Artificial Sequence
  Description of Artificial Sequence: Synthetic oligonucleotide
ttccggaatggccaggaagagaagactgg

SEQ ID NO: 410442 - DNA, 28 bp, Artificial Sequence
  Description of Artificial Sequence: Synthetic oligonucleotide
tccggaatggccaggaagagaagactgg

SEQ ID NO: 410443 - DNA, 27 bp, Artificial Sequence
  Description of Artificial Sequence: Synthetic oligonucleotide
ccggaatggccaggaagagaagactgg

SEQ ID NO: 410444 - DNA, 27 bp, Artificial Sequence
  Description of Artificial Sequence: Synthetic oligonucleotide
cggaatggccaggaagagaagactggg

SEQ ID NO: 410445 - DNA, 27 bp, Artificial Sequence
  Description of Artificial Sequence: Synthetic oligonucleotide
ggaatggccaggaagagaagactgggg

SEQ ID NO: 410446 - DNA, 28 bp, Artificial Sequence
  Description of Artificial Sequence: Synthetic oligonucleotide
gaatggccaggaagagaagactggggtg

SEQ ID NO: 410447 - DNA, 28 bp, Artificial Sequence
  Description of Artificial Sequence: Synthetic oligonucleotide
aatggccaggaagagaagactggggtgg

SEQ ID NO: 410448 - DNA, 27 bp, Artificial Sequence
  Description of Artificial Sequence: Synthetic oligonucleotide
atggccaggaagagaagactggggtgg

SEQ ID NO: 410449 - DNA, 27 bp, Artificial Sequence
  Description of Artificial Sequence: Synthetic oligonucleotide
tggccaggaagagaagactggggtggt

SEQ ID NO: 410450 - DNA, 26 bp, Artificial Sequence
  Description of Artificial Sequence: Synthetic oligonucleotide
ggccaggaagagaagactggggtggt

SEQ ID NO: 410451 - DNA, 27 bp, Artificial Sequence
  Description of Artificial Sequence: Synthetic oligonucleotide
gccaggaagagaagactggggtggtgt

SEQ ID NO: 410452 - DNA, 27 bp, Artificial Sequence
  Description of Artificial Sequence: Synthetic oligonucleotide
ccaggaagagaagactggggtggtgtc

SEQ ID NO: 410453 - DNA, 27 bp, Artificial Sequence
  Description of Artificial Sequence: Synthetic oligonucleotide
caggaagagaagactggggtggtgtcc

SEQ ID NO: 410454 - DNA, 28 bp, Artificial Sequence
  Description of Artificial Sequence: Synthetic oligonucleotide
aggaagagaagactggggtggtgtccac

SEQ ID NO: 410455 - DNA, 27 bp, Artificial Sequence
  Description of Artificial Sequence: Synthetic oligonucleotide
ggaagagaagactggggtggtgtccac

SEQ ID NO: 410456 - DNA, 28 bp, Artificial Sequence
  Description of Artificial Sequence: Synthetic oligonucleotide
gaagagaagactggggtggtgtccacag

SEQ ID NO: 410457 - DNA, 28 bp, Artificial Sequence
  Description of Artificial Sequence: Synthetic oligonucleotide
aagagaagactggggtggtgtccacagg

SEQ ID NO: 410458 - DNA, 27 bp, Artificial Sequence
  Description of Artificial Sequence: Synthetic oligonucleotide
agagaagactggggtggtgtccacagg

SEQ ID NO: 410459 - DNA, 26 bp, Artificial Sequence
  Description of Artificial Sequence: Synthetic oligonucleotide
gagaagactggggtggtgtccacagg

SEQ ID NO: 410460 - DNA, 26 bp, Artificial Sequence
  Description of Artificial Sequence: Synthetic oligonucleotide
agaagactggggtggtgtccacaggc

SEQ ID NO: 410461 - DNA, 25 bp, Artificial Sequence
  Description of Artificial Sequence: Synthetic oligonucleotide
gaagactggggtggtgtccacaggc

SEQ ID NO: 410462 - DNA, 26 bp, Artificial Sequence
  Description of Artificial Sequence: Synthetic oligonucleotide
aagactggggtggtgtccacaggcct

SEQ ID NO: 410463 - DNA, 25 bp, Artificial Sequence
  Description of Artificial Sequence: Synthetic oligonucleotide
agactggggtggtgtccacaggcct

SEQ ID NO: 410464 - DNA, 24 bp, Artificial Sequence
  Description of Artificial Sequence: Synthetic oligonucleotide
gactggggtggtgtccacaggcct

SEQ ID NO: 410465 - DNA, 26 bp, Artificial Sequence
  Description of Artificial Sequence: Synthetic oligonucleotide
actggggtggtgtccacaggcctgat

SEQ ID NO: 410466 - DNA, 27 bp, Artificial Sequence
  Description of Artificial Sequence: Synthetic oligonucleotide
ggtggtgtccacaggcctgatccacaa

SEQ ID NO: 410467 - DNA, 28 bp, Artificial Sequence
  Description of Artificial Sequence: Synthetic oligonucleotide
gtggtgtccacaggcctgatccacaatg

SEQ ID NO: 410468 - DNA, 28 bp, Artificial Sequence
  Description of Artificial Sequence: Synthetic oligonucleotide
tggtgtccacaggcctgatccacaatgg

SEQ ID NO: 410469 - DNA, 27 bp, Artificial Sequence
  Description of Artificial Sequence: Synthetic oligonucleotide
ggtgtccacaggcctgatccacaatgg

SEQ ID NO: 410470 - DNA, 28 bp, Artificial Sequence
  Description of Artificial Sequence: Synthetic oligonucleotide
gtgtccacaggcctgatccacaatggag

SEQ ID NO: 410471 - DNA, 29 bp, Artificial Sequence
  Description of Artificial Sequence: Synthetic oligonucleotide
tgtccacaggcctgatccacaatggagac

SEQ ID NO: 410472 - DNA, 28 bp, Artificial Sequence
  Description of Artificial Sequence: Synthetic oligonucleotide
gtccacaggcctgatccacaatggagac

SEQ ID NO: 410473 - DNA, 29 bp, Artificial Sequence
  Description of Artificial Sequence: Synthetic oligonucleotide
tccacaggcctgatccacaatggagactg

SEQ ID NO: 410474 - DNA, 28 bp, Artificial Sequence
  Description of Artificial Sequence: Synthetic oligonucleotide
ccacaggcctgatccacaatggagactg

SEQ ID NO: 410475 - DNA, 28 bp, Artificial Sequence
  Description of Artificial Sequence: Synthetic oligonucleotide
cacaggcctgatccacaatggagactgg

SEQ ID NO: 410476 - DNA, 29 bp, Artificial Sequence
  Description of Artificial Sequence: Synthetic oligonucleotide
acaggcctgatccacaatggagactggac

SEQ ID NO: 410477 - DNA, 28 bp, Artificial Sequence
  Description of Artificial Sequence: Synthetic oligonucleotide
caggcctgatccacaatggagactggac

SEQ ID NO: 410478 - DNA, 28 bp, Artificial Sequence
  Description of Artificial Sequence: Synthetic oligonucleotide
aggcctgatccacaatggagactggacc

SEQ ID NO: 410479 - DNA, 27 bp, Artificial Sequence
  Description of Artificial Sequence: Synthetic oligonucleotide
ggcctgatccacaatggagactggacc

SEQ ID NO: 410480 - DNA, 29 bp, Artificial Sequence
  Description of Artificial Sequence: Synthetic oligonucleotide
gcctgatccacaatggagactggaccttc

SEQ ID NO: 410481 - DNA, 29 bp, Artificial Sequence
  Description of Artificial Sequence: Synthetic oligonucleotide
cctgatccacaatggagactggaccttcc

SEQ ID NO: 410482 - DNA, 30 bp, Artificial Sequence; identical to SEQ ID NO: 65161
  Description of Artificial Sequence: Synthetic oligonucleotide

SEQ ID NO: 410483 - DNA, 31 bp, Artificial Sequence; identical to SEQ ID NO: 65162
  Description of Artificial Sequence: Synthetic oligonucleotide

SEQ ID NO: 410484 - DNA, 30 bp, Artificial Sequence; identical to SEQ ID NO: 65163
  Description of Artificial Sequence: Synthetic oligonucleotide

SEQ ID NO: 410485 - DNA, 30 bp, Artificial Sequence; identical to SEQ ID NO: 65164
  Description of Artificial Sequence: Synthetic oligonucleotide

SEQ ID NO: 410486 - DNA, 29 bp, Artificial Sequence
  Description of Artificial Sequence: Synthetic oligonucleotide
tccacaatggagactggaccttccagacc

SEQ ID NO: 410487 - DNA, 28 bp, Artificial Sequence
  Description of Artificial Sequence: Synthetic oligonucleotide
ccacaatggagactggaccttccagacc

SEQ ID NO: 410488 - DNA, 28 bp, Artificial Sequence
  Description of Artificial Sequence: Synthetic oligonucleotide
cacaatggagactggaccttccagaccc

SEQ ID NO: 410489 - DNA, 29 bp, Artificial Sequence
  Description of Artificial Sequence: Synthetic oligonucleotide
acaatggagactggaccttccagaccctg

SEQ ID NO: 410490 - DNA, 28 bp, Artificial Sequence
  Description of Artificial Sequence: Synthetic oligonucleotide
caatggagactggaccttccagaccctg

SEQ ID NO: 410491 - DNA, 28 bp, Artificial Sequence
  Description of Artificial Sequence: Synthetic oligonucleotide
aatggagactggaccttccagaccctgg

SEQ ID NO: 410492 - DNA, 27 bp, Artificial Sequence
  Description of Artificial Sequence: Synthetic oligonucleotide
atggagactggaccttccagaccctgg

SEQ ID NO: 410493 - DNA, 27 bp, Artificial Sequence
  Description of Artificial Sequence: Synthetic oligonucleotide
tggagactggaccttccagaccctggt

SEQ ID NO: 410494 - DNA, 26 bp, Artificial Sequence
  Description of Artificial Sequence: Synthetic oligonucleotide
ggagactggaccttccagaccctggt

SEQ ID NO: 410495 - DNA, 27 bp, Artificial Sequence
  Description of Artificial Sequence: Synthetic oligonucleotide
gagactggaccttccagaccctggtga

SEQ ID NO: 410496 - DNA, 28 bp, Artificial Sequence
  Description of Artificial Sequence: Synthetic oligonucleotide
agactggaccttccagaccctggtgatg

SEQ ID NO: 410497 - DNA, 27 bp, Artificial Sequence
  Description of Artificial Sequence: Synthetic oligonucleotide
gactggaccttccagaccctggtgatg

SEQ ID NO: 410498 - DNA, 27 bp, Artificial Sequence
  Description of Artificial Sequence: Synthetic oligonucleotide
actggaccttccagaccctggtgatgc

SEQ ID NO: 410499 - DNA, 27 bp, Artificial Sequence
  Description of Artificial Sequence: Synthetic oligonucleotide
ctggaccttccagaccctggtgatgct

SEQ ID NO: 410500 - DNA, 29 bp, Artificial Sequence
  Description of Artificial Sequence: Synthetic oligonucleotide
tttacacctgccaagtggagcacccaagc

SEQ ID NO: 410501 - DNA, 28 bp, Artificial Sequence
  Description of Artificial Sequence: Synthetic oligonucleotide
ttacacctgccaagtggagcacccaagc

SEQ ID NO: 410502 - DNA, 27 bp, Artificial Sequence
  Description of Artificial Sequence: Synthetic oligonucleotide
tacacctgccaagtggagcacccaagc

SEQ ID NO: 410503 - DNA, 26 bp, Artificial Sequence
  Description of Artificial Sequence: Synthetic oligonucleotide
acacctgccaagtggagcacccaagc

SEQ ID NO: 410504 - DNA, 25 bp, Artificial Sequence
  Description of Artificial Sequence: Synthetic oligonucleotide
cacctgccaagtggagcacccaagc

SEQ ID NO: 410505 - DNA, 26 bp, Artificial Sequence
  Description of Artificial Sequence: Synthetic oligonucleotide
acctgccaagtggagcacccaagcgt

SEQ ID NO: 410506 - DNA, 25 bp, Artificial Sequence
  Description of Artificial Sequence: Synthetic oligonucleotide
cctgccaagtggagcacccaagcgt

SEQ ID NO: 410507 - DNA, 26 bp, Artificial Sequence
  Description of Artificial Sequence: Synthetic oligonucleotide
ctgccaagtggagcacccaagcgtga

SEQ ID NO: 410508 - DNA, 27 bp, Artificial Sequence
  Description of Artificial Sequence: Synthetic oligonucleotide
tgccaagtggagcacccaagcgtgaca

SEQ ID NO: 410509 - DNA, 27 bp, Artificial Sequence
  Description of Artificial Sequence: Synthetic oligonucleotide
gccaagtggagcacccaagcgtgacaa

SEQ ID NO: 410510 - DNA, 27 bp, Artificial Sequence
  Description of Artificial Sequence: Synthetic oligonucleotide
ccaagtggagcacccaagcgtgacaag

SEQ ID NO: 410511 - DNA, 27 bp, Artificial Sequence
  Description of Artificial Sequence: Synthetic oligonucleotide
caagtggagcacccaagcgtgacaagc

SEQ ID NO: 410512 - DNA, 27 bp, Artificial Sequence
  Description of Artificial Sequence: Synthetic oligonucleotide
aagtggagcacccaagcgtgacaagcc

SEQ ID NO: 410513 - DNA, 26 bp, Artificial Sequence
  Description of Artificial Sequence: Synthetic oligonucleotide
agtggagcacccaagcgtgacaagcc

SEQ ID NO: 410514 - DNA, 25 bp, Artificial Sequence
  Description of Artificial Sequence: Synthetic oligonucleotide
gtggagcacccaagcgtgacaagcc

SEQ ID NO: 410515 - DNA, 26 bp, Artificial Sequence
  Description of Artificial Sequence: Synthetic oligonucleotide
tggagcacccaagcgtgacaagccct

SEQ ID NO: 410516 - DNA, 25 bp, Artificial Sequence
  Description of Artificial Sequence: Synthetic oligonucleotide
ggagcacccaagcgtgacaagccct

SEQ ID NO: 410517 - DNA, 26 bp, Artificial Sequence
  Description of Artificial Sequence: Synthetic oligonucleotide
gagcacccaagcgtgacaagccctct

SEQ ID NO: 410518 - DNA, 27 bp, Artificial Sequence
  Description of Artificial Sequence: Synthetic oligonucleotide
agcacccaagcgtgacaagccctctca

SEQ ID NO: 410519 - DNA, 26 bp, Artificial Sequence
  Description of Artificial Sequence: Synthetic oligonucleotide
gcacccaagcgtgacaagccctctca

SEQ ID NO: 410520 - DNA, 27 bp, Artificial Sequence
  Description of Artificial Sequence: Synthetic oligonucleotide
cacccaagcgtgacaagccctctcaca

SEQ ID NO: 410521 - DNA, 27 bp, Artificial Sequence
  Description of Artificial Sequence: Synthetic oligonucleotide
acccaagcgtgacaagccctctcacag

SEQ ID NO: 410522 - DNA, 27 bp, Artificial Sequence
  Description of Artificial Sequence: Synthetic oligonucleotide
cccaagcgtgacaagccctctcacagt

SEQ ID NO: 410523 - DNA, 27 bp, Artificial Sequence
  Description of Artificial Sequence: Synthetic oligonucleotide
ccaagcgtgacaagccctctcacagtg

SEQ ID NO: 410524 - DNA, 27 bp, Artificial Sequence
  Description of Artificial Sequence: Synthetic oligonucleotide
caagcgtgacaagccctctcacagtgg

SEQ ID NO: 410525 - DNA, 30 bp, Artificial Sequence; identical to SEQ ID NO: 65204
  Description of Artificial Sequence: Synthetic oligonucleotide

SEQ ID NO: 410526 - DNA, 29 bp, Artificial Sequence
  Description of Artificial Sequence: Synthetic oligonucleotide
agcgtgacaagccctctcacagtggaatg

SEQ ID NO: 410527 - DNA, 28 bp, Artificial Sequence
  Description of Artificial Sequence: Synthetic oligonucleotide
gcgtgacaagccctctcacagtggaatg

SEQ ID NO: 410528 - DNA, 28 bp, Artificial Sequence
  Description of Artificial Sequence: Synthetic oligonucleotide
cgtgacaagccctctcacagtggaatgg

SEQ ID NO: 410529 - DNA, 29 bp, Artificial Sequence
  Description of Artificial Sequence: Synthetic oligonucleotide
gtgacaagccctctcacagtggaatggag

SEQ ID NO: 410530 - DNA, 30 bp, Artificial Sequence; identical to SEQ ID NO: 65209
  Description of Artificial Sequence: Synthetic oligonucleotide

SEQ ID NO: 410531 - DNA, 29 bp, Artificial Sequence
  Description of Artificial Sequence: Synthetic oligonucleotide
gacaagccctctcacagtggaatggagag

SEQ ID NO: 410532 - DNA, 29 bp, Artificial Sequence
  Description of Artificial Sequence: Synthetic oligonucleotide
acaagccctctcacagtggaatggagagc

SEQ ID NO: 410533 - DNA, 28 bp, Artificial Sequence
  Description of Artificial Sequence: Synthetic oligonucleotide
caagccctctcacagtggaatggagagc

SEQ ID NO: 410534 - DNA, 29 bp, Artificial Sequence
  Description of Artificial Sequence: Synthetic oligonucleotide
aagccctctcacagtggaatggagagcac

SEQ ID NO: 410535 - DNA, 28 bp, Artificial Sequence
  Description of Artificial Sequence: Synthetic oligonucleotide
aagatgctgagtggagtcgggggctttg

SEQ ID NO: 410536 - DNA, 27 bp, Artificial Sequence
  Description of Artificial Sequence: Synthetic oligonucleotide
agatgctgagtggagtcgggggctttg

SEQ ID NO: 410537 - DNA, 27 bp, Artificial Sequence
  Description of Artificial Sequence: Synthetic oligonucleotide
gatgctgagtggagtcgggggctttgt

SEQ ID NO: 410538 - DNA, 27 bp, Artificial Sequence
  Description of Artificial Sequence: Synthetic oligonucleotide
atgctgagtggagtcgggggctttgtg

SEQ ID NO: 410539 - DNA, 26 bp, Artificial Sequence
  Description of Artificial Sequence: Synthetic oligonucleotide
tgctgagtggagtcgggggctttgtg

SEQ ID NO: 410540 - DNA, 25 bp, Artificial Sequence
  Description of Artificial Sequence: Synthetic oligonucleotide
gctgagtggagtcgggggctttgtg

SEQ ID NO: 410541 - DNA, 26 bp, Artificial Sequence
  Description of Artificial Sequence: Synthetic oligonucleotide
ctgagtggagtcgggggctttgtgct

SEQ ID NO: 410542 - DNA, 26 bp, Artificial Sequence
  Description of Artificial Sequence: Synthetic oligonucleotide
tgagtggagtcgggggctttgtgctg

SEQ ID NO: 410543 - DNA, 25 bp, Artificial Sequence
  Description of Artificial Sequence: Synthetic oligonucleotide
gagtggagtcgggggctttgtgctg

SEQ ID NO: 410544 - DNA, 25 bp, Artificial Sequence
  Description of Artificial Sequence: Synthetic oligonucleotide
agtggagtcgggggctttgtgctgg

SEQ ID NO: 410545 - DNA, 24 bp, Artificial Sequence
  Description of Artificial Sequence: Synthetic oligonucleotide
gtggagtcgggggctttgtgctgg

SEQ ID NO: 410546 - DNA, 24 bp, Artificial Sequence
  Description of Artificial Sequence: Synthetic oligonucleotide
tggagtcgggggctttgtgctggg

SEQ ID NO: 410547 - DNA, 23 bp, Artificial Sequence
  Description of Artificial Sequence: Synthetic oligonucleotide
ggagtcgggggctttgtgctggg

SEQ ID NO: 410548 - DNA, 23 bp, Artificial Sequence
  Description of Artificial Sequence: Synthetic oligonucleotide
gagtcgggggctttgtgctgggc

SEQ ID NO: 410549 - DNA, 24 bp, Artificial Sequence
  Description of Artificial Sequence: Synthetic oligonucleotide
agtcgggggctttgtgctgggcct

SEQ ID NO: 410550 - DNA, 23 bp, Artificial Sequence
  Description of Artificial Sequence: Synthetic oligonucleotide
gtcgggggctttgtgctgggcct

SEQ ID NO: 410551 - DNA, 23 bp, Artificial Sequence
  Description of Artificial Sequence: Synthetic oligonucleotide
tcgggggctttgtgctgggcctg

SEQ ID NO: 410552 - DNA, 22 bp, Artificial Sequence
  Description of Artificial Sequence: Synthetic oligonucleotide
cgggggctttgtgctgggcctg

SEQ ID NO: 410553 - DNA, 23 bp, Artificial Sequence
  Description of Artificial Sequence: Synthetic oligonucleotide
gggggctttgtgctgggcctgct

SEQ ID NO: 410554 - DNA, 25 bp, Artificial Sequence
  Description of Artificial Sequence: Synthetic oligonucleotide
ggggctttgtgctgggcctgctctt

SEQ ID NO: 410555 - DNA, 25 bp, Artificial Sequence
  Description of Artificial Sequence: Synthetic oligonucleotide
gggctttgtgctgggcctgctcttc

SEQ ID NO: 410556 - DNA, 27 bp, Artificial Sequence
  Description of Artificial Sequence: Synthetic oligonucleotide
ggctttgtgctgggcctgctcttcctt

SEQ ID NO: 410557 - DNA, 27 bp, Artificial Sequence
  Description of Artificial Sequence: Synthetic oligonucleotide
gctttgtgctgggcctgctcttccttg

SEQ ID NO: 410558 - DNA, 27 bp, Artificial Sequence
  Description of Artificial Sequence: Synthetic oligonucleotide
ctttgtgctgggcctgctcttccttgg

SEQ ID NO: 410559 - DNA, 27 bp, Artificial Sequence
  Description of Artificial Sequence: Synthetic oligonucleotide
tttgtgctgggcctgctcttccttggg

SEQ ID NO: 410560 - DNA, 26 bp, Artificial Sequence
  Description of Artificial Sequence: Synthetic oligonucleotide
ttgtgctgggcctgctcttccttggg

SEQ ID NO: 410561 - DNA, 25 bp, Artificial Sequence
  Description of Artificial Sequence: Synthetic oligonucleotide
tgtgctgggcctgctcttccttggg

SEQ ID NO: 410562 - DNA, 33 bp, Artificial Sequence; identical to SEQ ID NO: 65241
  Description of Artificial Sequence: Synthetic oligonucleotide

SEQ ID NO: 410563 - DNA, 34 bp, Artificial Sequence; identical to SEQ ID NO: 65242
  Description of Artificial Sequence: Synthetic oligonucleotide

SEQ ID NO: 410564 - DNA, 33 bp, Artificial Sequence; identical to SEQ ID NO: 65243
  Description of Artificial Sequence: Synthetic oligonucleotide

SEQ ID NO: 410565 - DNA, 32 bp, Artificial Sequence; identical to SEQ ID NO: 65244
  Description of Artificial Sequence: Synthetic oligonucleotide

SEQ ID NO: 410566 - DNA, 31 bp, Artificial Sequence; identical to SEQ ID NO: 65245
  Description of Artificial Sequence: Synthetic oligonucleotide

SEQ ID NO: 410567 - DNA, 31 bp, Artificial Sequence; identical to SEQ ID NO: 65246
  Description of Artificial Sequence: Synthetic oligonucleotide

SEQ ID NO: 410568 - DNA, 30 bp, Artificial Sequence; identical to SEQ ID NO: 65247
  Description of Artificial Sequence: Synthetic oligonucleotide

SEQ ID NO: 410569 - DNA, 33 bp, Artificial Sequence; identical to SEQ ID NO: 65248
  Description of Artificial Sequence: Synthetic oligonucleotide

SEQ ID NO: 410570 - DNA, 32 bp, Artificial Sequence; identical to SEQ ID NO: 65249
  Description of Artificial Sequence: Synthetic oligonucleotide

SEQ ID NO: 410571 - DNA, 31 bp, Artificial Sequence; identical to SEQ ID NO: 65250
  Description of Artificial Sequence: Synthetic oligonucleotide

SEQ ID NO: 410572 - DNA, 30 bp, Artificial Sequence; identical to SEQ ID NO: 65251
  Description of Artificial Sequence: Synthetic oligonucleotide

SEQ ID NO: 410573 - DNA, 30 bp, Artificial Sequence; identical to SEQ ID NO: 65252
  Description of Artificial Sequence: Synthetic oligonucleotide

SEQ ID NO: 410574 - DNA, 31 bp, Artificial Sequence; identical to SEQ ID NO: 65253
  Description of Artificial Sequence: Synthetic oligonucleotide

SEQ ID NO: 410575 - DNA, 30 bp, Artificial Sequence; identical to SEQ ID NO: 65254
  Description of Artificial Sequence: Synthetic oligonucleotide

SEQ ID NO: 410576 - DNA, 31 bp, Artificial Sequence; identical to SEQ ID NO: 65255
  Description of Artificial Sequence: Synthetic oligonucleotide

SEQ ID NO: 410577 - DNA, 30 bp, Artificial Sequence; identical to SEQ ID NO: 65256
  Description of Artificial Sequence: Synthetic oligonucleotide

SEQ ID NO: 410578 - DNA, 30 bp, Artificial Sequence; identical to SEQ ID NO: 65257
  Description of Artificial Sequence: Synthetic oligonucleotide

SEQ ID NO: 410579 - DNA, 29 bp, Artificial Sequence
  Description of Artificial Sequence: Synthetic oligonucleotide
ctggacttcagccaagaggattcctgagc

SEQ ID NO: 410580 - DNA, 30 bp, Artificial Sequence; identical to SEQ ID NO: 65259
  Description of Artificial Sequence: Synthetic oligonucleotide

SEQ ID NO: 410581 - DNA, 29 bp, Artificial Sequence
  Description of Artificial Sequence: Synthetic oligonucleotide
ggacttcagccaagaggattcctgagctg

SEQ ID NO: 410582 - DNA, 26 bp, Artificial Sequence
  Description of Artificial Sequence: Synthetic oligonucleotide
cagaagcggggccgggtggacaatta

SEQ ID NO: 410583 - DNA, 27 bp, Artificial Sequence
  Description of Artificial Sequence: Synthetic oligonucleotide
agaagcggggccgggtggacaattact

SEQ ID NO: 410584 - DNA, 26 bp, Artificial Sequence
  Description of Artificial Sequence: Synthetic oligonucleotide
gaagcggggccgggtggacaattact

SEQ ID NO: 410585 - DNA, 26 bp, Artificial Sequence
  Description of Artificial Sequence: Synthetic oligonucleotide
aagcggggccgggtggacaattactg

SEQ ID NO: 410586 - DNA, 25 bp, Artificial Sequence
  Description of Artificial Sequence: Synthetic oligonucleotide
agcggggccgggtggacaattactg

SEQ ID NO: 410587 - DNA, 24 bp, Artificial Sequence
  Description of Artificial Sequence: Synthetic oligonucleotide
gcggggccgggtggacaattactg

SEQ ID NO: 410588 - DNA, 25 bp, Artificial Sequence
  Description of Artificial Sequence: Synthetic oligonucleotide
cggggccgggtggacaattactgca

SEQ ID NO: 410589 - DNA, 26 bp, Artificial Sequence
  Description of Artificial Sequence: Synthetic oligonucleotide
ggggccgggtggacaattactgcaga

SEQ ID NO: 410590 - DNA, 27 bp, Artificial Sequence
  Description of Artificial Sequence: Synthetic oligonucleotide
gggccgggtggacaattactgcagaca

SEQ ID NO: 410591 - DNA, 27 bp, Artificial Sequence
  Description of Artificial Sequence: Synthetic oligonucleotide
ggccgggtggacaattactgcagacac

SEQ ID NO: 410592 - DNA, 29 bp, Artificial Sequence
  Description of Artificial Sequence: Synthetic oligonucleotide
gccgggtggacaattactgcagacacaac

SEQ ID NO: 410593 - DNA, 31 bp, Artificial Sequence; identical to SEQ ID NO: 65272
  Description of Artificial Sequence: Synthetic oligonucleotide

SEQ ID NO: 410594 - DNA, 31 bp, Artificial Sequence; identical to SEQ ID NO: 65273
  Description of Artificial Sequence: Synthetic oligonucleotide

SEQ ID NO: 410595 - DNA, 31 bp, Artificial Sequence; identical to SEQ ID NO: 65274
  Description of Artificial Sequence: Synthetic oligonucleotide

SEQ ID NO: 410596 - DNA, 42 bp, Artificial Sequence; identical to SEQ ID NO: 65275
  Description of Artificial Sequence: Synthetic oligonucleotide

SEQ ID NO: 410597 - DNA, 42 bp, Artificial Sequence; identical to SEQ ID NO: 65276
  Description of Artificial Sequence: Synthetic oligonucleotide

SEQ ID NO: 410598 - DNA, 41 bp, Artificial Sequence; identical to SEQ ID NO: 65277
  Description of Artificial Sequence: Synthetic oligonucleotide

SEQ ID NO: 410599 - DNA, 40 bp, Artificial Sequence; identical to SEQ ID NO: 65278
  Description of Artificial Sequence: Synthetic oligonucleotide

SEQ ID NO: 410600 - DNA, 39 bp, Artificial Sequence; identical to SEQ ID NO: 65279
  Description of Artificial Sequence: Synthetic oligonucleotide

SEQ ID NO: 410601 - DNA, 39 bp, Artificial Sequence; identical to SEQ ID NO: 65280
  Description of Artificial Sequence: Synthetic oligonucleotide

SEQ ID NO: 410602 - DNA, 38 bp, Artificial Sequence; identical to SEQ ID NO: 65281
  Description of Artificial Sequence: Synthetic oligonucleotide

SEQ ID NO: 410603 - DNA, 37 bp, Artificial Sequence; identical to SEQ ID NO: 65282
  Description of Artificial Sequence: Synthetic oligonucleotide

SEQ ID NO: 410604 - DNA, 38 bp, Artificial Sequence; identical to SEQ ID NO: 65283
  Description of Artificial Sequence: Synthetic oligonucleotide

SEQ ID NO: 410605 - DNA, 38 bp, Artificial Sequence; identical to SEQ ID NO: 65284
  Description of Artificial Sequence: Synthetic oligonucleotide

SEQ ID NO: 410606 - DNA, 37 bp, Artificial Sequence; identical to SEQ ID NO: 65285
  Description of Artificial Sequence: Synthetic oligonucleotide

SEQ ID NO: 410607 - DNA, 37 bp, Artificial Sequence; identical to SEQ ID NO: 65286
  Description of Artificial Sequence: Synthetic oligonucleotide

SEQ ID NO: 410608 - DNA, 36 bp, Artificial Sequence; identical to SEQ ID NO: 65287
  Description of Artificial Sequence: Synthetic oligonucleotide

SEQ ID NO: 410609 - DNA, 35 bp, Artificial Sequence; identical to SEQ ID NO: 65288
  Description of Artificial Sequence: Synthetic oligonucleotide

SEQ ID NO: 410610 - DNA, 36 bp, Artificial Sequence; identical to SEQ ID NO: 65289
  Description of Artificial Sequence: Synthetic oligonucleotide

SEQ ID NO: 410611 - DNA, 35 bp, Artificial Sequence; identical to SEQ ID NO: 65290
  Description of Artificial Sequence: Synthetic oligonucleotide

SEQ ID NO: 410612 - DNA, 35 bp, Artificial Sequence; identical to SEQ ID NO: 65291
  Description of Artificial Sequence: Synthetic oligonucleotide

SEQ ID NO: 410613 - DNA, 34 bp, Artificial Sequence; identical to SEQ ID NO: 65292
  Description of Artificial Sequence: Synthetic oligonucleotide

SEQ ID NO: 410614 - DNA, 33 bp, Artificial Sequence; identical to SEQ ID NO: 65293
  Description of Artificial Sequence: Synthetic oligonucleotide

SEQ ID NO: 410615 - DNA, 33 bp, Artificial Sequence; identical to SEQ ID NO: 65294
  Description of Artificial Sequence: Synthetic oligonucleotide

SEQ ID NO: 410616 - DNA, 33 bp, Artificial Sequence; identical to SEQ ID NO: 65295
  Description of Artificial Sequence: Synthetic oligonucleotide

SEQ ID NO: 410617 - DNA, 32 bp, Artificial Sequence; identical to SEQ ID NO: 65296
  Description of Artificial Sequence: Synthetic oligonucleotide

SEQ ID NO: 410618 - DNA, 32 bp, Artificial Sequence; identical to SEQ ID NO: 65297
  Description of Artificial Sequence: Synthetic oligonucleotide

SEQ ID NO: 410619 - DNA, 31 bp, Artificial Sequence; identical to SEQ ID NO: 65298
  Description of Artificial Sequence: Synthetic oligonucleotide

SEQ ID NO: 410620 - DNA, 32 bp, Artificial Sequence; identical to SEQ ID NO: 65299
  Description of Artificial Sequence: Synthetic oligonucleotide

SEQ ID NO: 410621 - DNA, 31 bp, Artificial Sequence; identical to SEQ ID NO: 65300
  Description of Artificial Sequence: Synthetic oligonucleotide

SEQ ID NO: 410622 - DNA, 31 bp, Artificial Sequence; identical to SEQ ID NO: 65301
  Description of Artificial Sequence: Synthetic oligonucleotide

SEQ ID NO: 410623 - DNA, 30 bp, Artificial Sequence; identical to SEQ ID NO: 65302
  Description of Artificial Sequence: Synthetic oligonucleotide

SEQ ID NO: 410624 - DNA, 30 bp, Artificial Sequence; identical to SEQ ID NO: 65303
  Description of Artificial Sequence: Synthetic oligonucleotide

SEQ ID NO: 410625 - DNA, 29 bp, Artificial Sequence
  Description of Artificial Sequence: Synthetic oligonucleotide
catttctttaatgggacggagcgggtgcg

SEQ ID NO: 410626 - DNA, 29 bp, Artificial Sequence
  Description of Artificial Sequence: Synthetic oligonucleotide
atttctttaatgggacggagcgggtgcgg

SEQ ID NO: 410627 - DNA, 28 bp, Artificial Sequence
  Description of Artificial Sequence: Synthetic oligonucleotide
tttctttaatgggacggagcgggtgcgg

SEQ ID NO: 410628 - DNA, 27 bp, Artificial Sequence
  Description of Artificial Sequence: Synthetic oligonucleotide
ttctttaatgggacggagcgggtgcgg

SEQ ID NO: 410629 - DNA, 27 bp, Artificial Sequence
  Description of Artificial Sequence: Synthetic oligonucleotide
tctttaatgggacggagcgggtgcggt

SEQ ID NO: 410630 - DNA, 27 bp, Artificial Sequence
  Description of Artificial Sequence: Synthetic oligonucleotide
ctttaatgggacggagcgggtgcggta

SEQ ID NO: 410631 - DNA, 27 bp, Artificial Sequence
  Description of Artificial Sequence: Synthetic oligonucleotide
tttaatgggacggagcgggtgcggtac

SEQ ID NO: 410632 - DNA, 26 bp, Artificial Sequence
  Description of Artificial Sequence: Synthetic oligonucleotide
ttaatgggacggagcgggtgcggtac

SEQ ID NO: 410633 - DNA, 25 bp, Artificial Sequence
  Description of Artificial Sequence: Synthetic oligonucleotide
taatgggacggagcgggtgcggtac

SEQ ID NO: 410634 - DNA, 24 bp, Artificial Sequence
  Description of Artificial Sequence: Synthetic oligonucleotide
acctcctggagcagaagcggggca

SEQ ID NO: 410635 - DNA, 23 bp, Artificial Sequence
  Description of Artificial Sequence: Synthetic oligonucleotide
cctcctggagcagaagcggggca

SEQ ID NO: 410636 - DNA, 23 bp, Artificial Sequence
  Description of Artificial Sequence: Synthetic oligonucleotide
ctcctggagcagaagcggggcag

SEQ ID NO: 410637 - DNA, 23 bp, Artificial Sequence
  Description of Artificial Sequence: Synthetic oligonucleotide
tcctggagcagaagcggggcagg

SEQ ID NO: 410638 - DNA, 22 bp, Artificial Sequence
  Description of Artificial Sequence: Synthetic oligonucleotide
cctggagcagaagcggggcagg

SEQ ID NO: 410639 - DNA, 23 bp, Artificial Sequence
  Description of Artificial Sequence: Synthetic oligonucleotide
ctggagcagaagcggggcagggt

SEQ ID NO: 410640 - DNA, 23 bp, Artificial Sequence
  Description of Artificial Sequence: Synthetic oligonucleotide
tggagcagaagcggggcagggtg

SEQ ID NO: 410641 - DNA, 22 bp, Artificial Sequence
  Description of Artificial Sequence: Synthetic oligonucleotide
ggagcagaagcggggcagggtg

SEQ ID NO: 410642 - DNA, 23 bp, Artificial Sequence
  Description of Artificial Sequence: Synthetic oligonucleotide
gagcagaagcggggcagggtgga

SEQ ID NO: 410643 - DNA, 25 bp, Artificial Sequence
  Description of Artificial Sequence: Synthetic oligonucleotide
agcagaagcggggcagggtggacaa

SEQ ID NO: 410644 - DNA, 24 bp, Artificial Sequence
  Description of Artificial Sequence: Synthetic oligonucleotide
gcagaagcggggcagggtggacaa

SEQ ID NO: 410645 - DNA, 26 bp, Artificial Sequence
  Description of Artificial Sequence: Synthetic oligonucleotide
cagaagcggggcagggtggacaacta

SEQ ID NO: 410646 - DNA, 27 bp, Artificial Sequence
  Description of Artificial Sequence: Synthetic oligonucleotide
agaagcggggcagggtggacaactact

SEQ ID NO: 410647 - DNA, 26 bp, Artificial Sequence
  Description of Artificial Sequence: Synthetic oligonucleotide
gaagcggggcagggtggacaactact

SEQ ID NO: 410648 - DNA, 26 bp, Artificial Sequence
  Description of Artificial Sequence: Synthetic oligonucleotide
aagcggggcagggtggacaactactg

SEQ ID NO: 410649 - DNA, 25 bp, Artificial Sequence
  Description of Artificial Sequence: Synthetic oligonucleotide
agcggggcagggtggacaactactg

SEQ ID NO: 410650 - DNA, 24 bp, Artificial Sequence
  Description of Artificial Sequence: Synthetic oligonucleotide
gcggggcagggtggacaactactg

SEQ ID NO: 410651 - DNA, 25 bp, Artificial Sequence
  Description of Artificial Sequence: Synthetic oligonucleotide
cggggcagggtggacaactactgca

SEQ ID NO: 410652 - DNA, 26 bp, Artificial Sequence
  Description of Artificial Sequence: Synthetic oligonucleotide
ggggcagggtggacaactactgcaga

SEQ ID NO: 410653 - DNA, 27 bp, Artificial Sequence
  Description of Artificial Sequence: Synthetic oligonucleotide
gggcagggtggacaactactgcagaca

SEQ ID NO: 410654 - DNA, 27 bp, Artificial Sequence
  Description of Artificial Sequence: Synthetic oligonucleotide
ggcagggtggacaactactgcagacac

SEQ ID NO: 410655 - DNA, 29 bp, Artificial Sequence
  Description of Artificial Sequence: Synthetic oligonucleotide
gcagggtggacaactactgcagacacaac

SEQ ID NO: 410656 - DNA, 31 bp, Artificial Sequence; identical to SEQ ID NO: 65335
  Description of Artificial Sequence: Synthetic oligonucleotide

SEQ ID NO: 410657 - DNA, 31 bp, Artificial Sequence; identical to SEQ ID NO: 65336
  Description of Artificial Sequence: Synthetic oligonucleotide

SEQ ID NO: 410658 - DNA, 23 bp, Artificial Sequence
  Description of Artificial Sequence: Synthetic oligonucleotide
tgggggagttccgggcggtgaca

SEQ ID NO: 410659 - DNA, 22 bp, Artificial Sequence
  Description of Artificial Sequence: Synthetic oligonucleotide
gggggagttccgggcggtgaca

SEQ ID NO: 410660 - DNA, 23 bp, Artificial Sequence
  Description of Artificial Sequence: Synthetic oligonucleotide
ggggagttccgggcggtgacaga

SEQ ID NO: 410661 - DNA, 23 bp, Artificial Sequence
  Description of Artificial Sequence: Synthetic oligonucleotide
gggagttccgggcggtgacagag

SEQ ID NO: 410662 - DNA, 24 bp, Artificial Sequence
  Description of Artificial Sequence: Synthetic oligonucleotide
ggagttccgggcggtgacagagct

SEQ ID NO: 410663 - DNA, 24 bp, Artificial Sequence
  Description of Artificial Sequence: Synthetic oligonucleotide
gagttccgggcggtgacagagctg

SEQ ID NO: 410664 - DNA, 24 bp, Artificial Sequence
  Description of Artificial Sequence: Synthetic oligonucleotide
agttccgggcggtgacagagctgg

SEQ ID NO: 410665 - DNA, 23 bp, Artificial Sequence
  Description of Artificial Sequence: Synthetic oligonucleotide
gttccgggcggtgacagagctgg

SEQ ID NO: 410666 - DNA, 23 bp, Artificial Sequence
  Description of Artificial Sequence: Synthetic oligonucleotide
ttccgggcggtgacagagctggg

SEQ ID NO: 410667 - DNA, 22 bp, Artificial Sequence
  Description of Artificial Sequence: Synthetic oligonucleotide
tccgggcggtgacagagctggg

SEQ ID NO: 410668 - DNA, 21 bp, Artificial Sequence
  Description of Artificial Sequence: Synthetic oligonucleotide
ccgggcggtgacagagctggg

SEQ ID NO: 410669 - DNA, 21 bp, Artificial Sequence
  Description of Artificial Sequence: Synthetic oligonucleotide
cgggcggtgacagagctgggg

SEQ ID NO: 410670 - DNA, 21 bp, Artificial Sequence
  Description of Artificial Sequence: Synthetic oligonucleotide
gggcggtgacagagctggggc

SEQ ID NO: 410671 - DNA, 21 bp, Artificial Sequence
  Description of Artificial Sequence: Synthetic oligonucleotide
ggcggtgacagagctggggcg

SEQ ID NO: 410672 - DNA, 21 bp, Artificial Sequence
  Description of Artificial Sequence: Synthetic oligonucleotide
gcggtgacagagctggggcgg

SEQ ID NO: 410673 - DNA, 21 bp, Artificial Sequence
  Description of Artificial Sequence: Synthetic oligonucleotide
cggtgacagagctggggcggc

SEQ ID NO: 410674 - DNA, 22 bp, Artificial Sequence
  Description of Artificial Sequence: Synthetic oligonucleotide
ggtgacagagctggggcggcct

SEQ ID NO: 410675 - DNA, 24 bp, Artificial Sequence
  Description of Artificial Sequence: Synthetic oligonucleotide
gtgacagagctggggcggcctgat

SEQ ID NO: 410676 - DNA, 24 bp, Artificial Sequence
  Description of Artificial Sequence: Synthetic oligonucleotide
tgacagagctggggcggcctgatg

SEQ ID NO: 410677 - DNA, 23 bp, Artificial Sequence
  Description of Artificial Sequence: Synthetic oligonucleotide
gacagagctggggcggcctgatg

SEQ ID NO: 410678 - DNA, 23 bp, Artificial Sequence
  Description of Artificial Sequence: Synthetic oligonucleotide
acagagctggggcggcctgatgc

SEQ ID NO: 410679 - DNA, 22 bp, Artificial Sequence
  Description of Artificial Sequence: Synthetic oligonucleotide
cagagctggggcggcctgatgc

SEQ ID NO: 410680 - DNA, 22 bp, Artificial Sequence
  Description of Artificial Sequence: Synthetic oligonucleotide
agagctggggcggcctgatgcc

SEQ ID NO: 410681 - DNA, 25 bp, Artificial Sequence
  Description of Artificial Sequence: Synthetic oligonucleotide
ctggggcggcctgatgccgagtatt

SEQ ID NO: 410682 - DNA, 25 bp, Artificial Sequence
  Description of Artificial Sequence: Synthetic oligonucleotide
tggggcggcctgatgccgagtattg

SEQ ID NO: 410683 - DNA, 24 bp, Artificial Sequence
  Description of Artificial Sequence: Synthetic oligonucleotide
ggggcggcctgatgccgagtattg

SEQ ID NO: 410684 - DNA, 26 bp, Artificial Sequence
  Description of Artificial Sequence: Synthetic oligonucleotide
gggcggcctgatgccgagtattggaa

SEQ ID NO: 410685 - DNA, 27 bp, Artificial Sequence
  Description of Artificial Sequence: Synthetic oligonucleotide
ggcggcctgatgccgagtattggaaca

SEQ ID NO: 410686 - DNA, 27 bp, Artificial Sequence
  Description of Artificial Sequence: Synthetic oligonucleotide
gcggcctgatgccgagtattggaacag

SEQ ID NO: 410687 - DNA, 27 bp, Artificial Sequence
  Description of Artificial Sequence: Synthetic oligonucleotide
cggcctgatgccgagtattggaacagc

SEQ ID NO: 410688 - DNA, 27 bp, Artificial Sequence
  Description of Artificial Sequence: Synthetic oligonucleotide
ggcctgatgccgagtattggaacagcc

SEQ ID NO: 410689 - DNA, 28 bp, Artificial Sequence
  Description of Artificial Sequence: Synthetic oligonucleotide
gcctgatgccgagtattggaacagccag

SEQ ID NO: 410690 - DNA, 30 bp, Artificial Sequence; identical to SEQ ID NO: 65369
  Description of Artificial Sequence: Synthetic oligonucleotide

SEQ ID NO: 410691 - DNA, 30 bp, Artificial Sequence; identical to SEQ ID NO: 65370
  Description of Artificial Sequence: Synthetic oligonucleotide

SEQ ID NO: 410692 - DNA, 31 bp, Artificial Sequence; identical to SEQ ID NO: 65371
  Description of Artificial Sequence: Synthetic oligonucleotide

SEQ ID NO: 410693 - DNA, 30 bp, Artificial Sequence; identical to SEQ ID NO: 65372
  Description of Artificial Sequence: Synthetic oligonucleotide

SEQ ID NO: 410694 - DNA, 30 bp, Artificial Sequence; identical to SEQ ID NO: 65373
  Description of Artificial Sequence: Synthetic oligonucleotide

SEQ ID NO: 410695 - DNA, 29 bp, Artificial Sequence
  Description of Artificial Sequence: Synthetic oligonucleotide
tgccgagtattggaacagccagaaggacc

SEQ ID NO: 410696 - DNA, 28 bp, Artificial Sequence
  Description of Artificial Sequence: Synthetic oligonucleotide
gccgagtattggaacagccagaaggacc

SEQ ID NO: 410697 - DNA, 29 bp, Artificial Sequence
  Description of Artificial Sequence: Synthetic oligonucleotide
ccgagtattggaacagccagaaggacctc

SEQ ID NO: 410698 - DNA, 29 bp, Artificial Sequence
  Description of Artificial Sequence: Synthetic oligonucleotide
cgagtattggaacagccagaaggacctcc

SEQ ID NO: 410699 - DNA, 30 bp, Artificial Sequence; identical to SEQ ID NO: 65378
  Description of Artificial Sequence: Synthetic oligonucleotide

SEQ ID NO: 410700 - DNA, 30 bp, Artificial Sequence; identical to SEQ ID NO: 65379
  Description of Artificial Sequence: Synthetic oligonucleotide

SEQ ID NO: 410701 - DNA, 29 bp, Artificial Sequence
  Description of Artificial Sequence: Synthetic oligonucleotide
gtattggaacagccagaaggacctcctgg

SEQ ID NO: 410702 - DNA, 30 bp, Artificial Sequence; identical to SEQ ID NO: 65381
  Description of Artificial Sequence: Synthetic oligonucleotide

SEQ ID NO: 410703 - DNA, 29 bp, Artificial Sequence
  Description of Artificial Sequence: Synthetic oligonucleotide
attggaacagccagaaggacctcctggag

SEQ ID NO: 410704 - DNA, 28 bp, Artificial Sequence
  Description of Artificial Sequence: Synthetic oligonucleotide
ttggaacagccagaaggacctcctggag

SEQ ID NO: 410705 - DNA, 27 bp, Artificial Sequence
  Description of Artificial Sequence: Synthetic oligonucleotide
ctgcagcaccacaacctcctggtctgt

SEQ ID NO: 410706 - DNA, 28 bp, Artificial Sequence
  Description of Artificial Sequence: Synthetic oligonucleotide
tgcagcaccacaacctcctggtctgttc

SEQ ID NO: 410707 - DNA, 27 bp, Artificial Sequence
  Description of Artificial Sequence: Synthetic oligonucleotide
gcagcaccacaacctcctggtctgttc

SEQ ID NO: 410708 - DNA, 28 bp, Artificial Sequence
  Description of Artificial Sequence: Synthetic oligonucleotide
cagcaccacaacctcctggtctgttctg

SEQ ID NO: 410709 - DNA, 29 bp, Artificial Sequence
  Description of Artificial Sequence: Synthetic oligonucleotide
agcaccacaacctcctggtctgttctgtg

SEQ ID NO: 410710 - DNA, 28 bp, Artificial Sequence
  Description of Artificial Sequence: Synthetic oligonucleotide
gcaccacaacctcctggtctgttctgtg

SEQ ID NO: 410711 - DNA, 29 bp, Artificial Sequence
  Description of Artificial Sequence: Synthetic oligonucleotide
caccacaacctcctggtctgttctgtgag

SEQ ID NO: 410712 - DNA, 30 bp, Artificial Sequence; identical to SEQ ID NO: 65391
  Description of Artificial Sequence: Synthetic oligonucleotide

SEQ ID NO: 410713 - DNA, 29 bp, Artificial Sequence
  Description of Artificial Sequence: Synthetic oligonucleotide
ccacaacctcctggtctgttctgtgagtg

SEQ ID NO: 410714 - DNA, 29 bp, Artificial Sequence
  Description of Artificial Sequence: Synthetic oligonucleotide
cacaacctcctggtctgttctgtgagtgg

SEQ ID NO: 410715 - DNA, 32 bp, Artificial Sequence; identical to SEQ ID NO: 65394
  Description of Artificial Sequence: Synthetic oligonucleotide

SEQ ID NO: 410716 - DNA, 31 bp, Artificial Sequence; identical to SEQ ID NO: 65395
  Description of Artificial Sequence: Synthetic oligonucleotide

SEQ ID NO: 410717 - DNA, 25 bp, Artificial Sequence
  Description of Artificial Sequence: Synthetic oligonucleotide
agctggggcggcctgatgccgaata

SEQ ID NO: 410718 - DNA, 24 bp, Artificial Sequence
  Description of Artificial Sequence: Synthetic oligonucleotide
gctggggcggcctgatgccgaata

SEQ ID NO: 410719 - DNA, 25 bp, Artificial Sequence
  Description of Artificial Sequence: Synthetic oligonucleotide
ctggggcggcctgatgccgaatact

SEQ ID NO: 410720 - DNA, 25 bp, Artificial Sequence
  Description of Artificial Sequence: Synthetic oligonucleotide
tggggcggcctgatgccgaatactg

SEQ ID NO: 410721 - DNA, 24 bp, Artificial Sequence
  Description of Artificial Sequence: Synthetic oligonucleotide
ggggcggcctgatgccgaatactg

SEQ ID NO: 410722 - DNA, 26 bp, Artificial Sequence
  Description of Artificial Sequence: Synthetic oligonucleotide
gggcggcctgatgccgaatactggaa

SEQ ID NO: 410723 - DNA, 27 bp, Artificial Sequence
  Description of Artificial Sequence: Synthetic oligonucleotide
ggcggcctgatgccgaatactggaaca

SEQ ID NO: 410724 - DNA, 27 bp, Artificial Sequence
  Description of Artificial Sequence: Synthetic oligonucleotide
gcggcctgatgccgaatactggaacag

SEQ ID NO: 410725 - DNA, 27 bp, Artificial Sequence
  Description of Artificial Sequence: Synthetic oligonucleotide
cggcctgatgccgaatactggaacagc

SEQ ID NO: 410726 - DNA, 27 bp, Artificial Sequence
  Description of Artificial Sequence: Synthetic oligonucleotide
ggcctgatgccgaatactggaacagcc

SEQ ID NO: 410727 - DNA, 28 bp, Artificial Sequence
  Description of Artificial Sequence: Synthetic oligonucleotide
gcctgatgccgaatactggaacagccag

SEQ ID NO: 410728 - DNA, 30 bp, Artificial Sequence; identical to SEQ ID NO: 65407
  Description of Artificial Sequence: Synthetic oligonucleotide

SEQ ID NO: 410729 - DNA, 30 bp, Artificial Sequence; identical to SEQ ID NO: 65408
  Description of Artificial Sequence: Synthetic oligonucleotide

SEQ ID NO: 410730 - DNA, 31 bp, Artificial Sequence; identical to SEQ ID NO: 65409
  Description of Artificial Sequence: Synthetic oligonucleotide

SEQ ID NO: 410731 - DNA, 30 bp, Artificial Sequence; identical to SEQ ID NO: 65410
  Description of Artificial Sequence: Synthetic oligonucleotide

SEQ ID NO: 410732 - DNA, 30 bp, Artificial Sequence; identical to SEQ ID NO: 65411
  Description of Artificial Sequence: Synthetic oligonucleotide

SEQ ID NO: 410733 - DNA, 29 bp, Artificial Sequence
  Description of Artificial Sequence: Synthetic oligonucleotide
tgccgaatactggaacagccagaaggacc

SEQ ID NO: 410734 - DNA, 28 bp, Artificial Sequence
  Description of Artificial Sequence: Synthetic oligonucleotide
gccgaatactggaacagccagaaggacc

SEQ ID NO: 410735 - DNA, 29 bp, Artificial Sequence
  Description of Artificial Sequence: Synthetic oligonucleotide
ccgaatactggaacagccagaaggacctc

SEQ ID NO: 410736 - DNA, 29 bp, Artificial Sequence
  Description of Artificial Sequence: Synthetic oligonucleotide
cgaatactggaacagccagaaggacctcc

SEQ ID NO: 410737 - DNA, 30 bp, Artificial Sequence; identical to SEQ ID NO: 65416
  Description of Artificial Sequence: Synthetic oligonucleotide

SEQ ID NO: 410738 - DNA, 30 bp, Artificial Sequence; identical to SEQ ID NO: 65417
  Description of Artificial Sequence: Synthetic oligonucleotide

SEQ ID NO: 410739 - DNA, 29 bp, Artificial Sequence
  Description of Artificial Sequence: Synthetic oligonucleotide
atactggaacagccagaaggacctcctgg

SEQ ID NO: 410740 - DNA, 20 bp, Artificial Sequence
  Description of Artificial Sequence: Synthetic oligonucleotide
cggtgacggagctggggcgc

SEQ ID NO: 410741 - DNA, 20 bp, Artificial Sequence
  Description of Artificial Sequence: Synthetic oligonucleotide
ggtgacggagctggggcgcc

SEQ ID NO: 410742 - DNA, 21 bp, Artificial Sequence
  Description of Artificial Sequence: Synthetic oligonucleotide
gtgacggagctggggcgccct

SEQ ID NO: 410743 - DNA, 23 bp, Artificial Sequence
  Description of Artificial Sequence: Synthetic oligonucleotide
tgacggagctggggcgccctgat

SEQ ID NO: 410744 - DNA, 22 bp, Artificial Sequence
  Description of Artificial Sequence: Synthetic oligonucleotide
gacggagctggggcgccctgat

SEQ ID NO: 410745 - DNA, 22 bp, Artificial Sequence
  Description of Artificial Sequence: Synthetic oligonucleotide
acggagctggggcgccctgatg

SEQ ID NO: 410746 - DNA, 21 bp, Artificial Sequence
  Description of Artificial Sequence: Synthetic oligonucleotide
cggagctggggcgccctgatg

SEQ ID NO: 410747 - DNA, 21 bp, Artificial Sequence
  Description of Artificial Sequence: Synthetic oligonucleotide
ggagctggggcgccctgatgc

SEQ ID NO: 410748 - DNA, 21 bp, Artificial Sequence
  Description of Artificial Sequence: Synthetic oligonucleotide
gagctggggcgccctgatgcc

SEQ ID NO: 410749 - DNA, 22 bp, Artificial Sequence
  Description of Artificial Sequence: Synthetic oligonucleotide
agctggggcgccctgatgccga

SEQ ID NO: 410750 - DNA, 21 bp, Artificial Sequence
  Description of Artificial Sequence: Synthetic oligonucleotide
gctggggcgccctgatgccga

SEQ ID NO: 410751 - DNA, 23 bp, Artificial Sequence
  Description of Artificial Sequence: Synthetic oligonucleotide
ctggggcgccctgatgccgagta

SEQ ID NO: 410752 - DNA, 24 bp, Artificial Sequence
  Description of Artificial Sequence: Synthetic oligonucleotide
tggggcgccctgatgccgagtact

SEQ ID NO: 410753 - DNA, 23 bp, Artificial Sequence
  Description of Artificial Sequence: Synthetic oligonucleotide
ggggcgccctgatgccgagtact

SEQ ID NO: 410754 - DNA, 23 bp, Artificial Sequence
  Description of Artificial Sequence: Synthetic oligonucleotide
gggcgccctgatgccgagtactg

SEQ ID NO: 410755 - DNA, 25 bp, Artificial Sequence
  Description of Artificial Sequence: Synthetic oligonucleotide
ggcgccctgatgccgagtactggaa

SEQ ID NO: 410756 - DNA, 26 bp, Artificial Sequence
  Description of Artificial Sequence: Synthetic oligonucleotide
gcgccctgatgccgagtactggaaca

SEQ ID NO: 410757 - DNA, 26 bp, Artificial Sequence
  Description of Artificial Sequence: Synthetic oligonucleotide
cgccctgatgccgagtactggaacag

SEQ ID NO: 410758 - DNA, 26 bp, Artificial Sequence
  Description of Artificial Sequence: Synthetic oligonucleotide
gccctgatgccgagtactggaacagc

SEQ ID NO: 410759 - DNA, 27 bp, Artificial Sequence
  Description of Artificial Sequence: Synthetic oligonucleotide
ccctgatgccgagtactggaacagcca

SEQ ID NO: 410760 - DNA, 29 bp, Artificial Sequence
  Description of Artificial Sequence: Synthetic oligonucleotide
acaactacggggttgtggagagcttcacg

SEQ ID NO: 410761 - DNA, 28 bp, Artificial Sequence
  Description of Artificial Sequence: Synthetic oligonucleotide
caactacggggttgtggagagcttcacg

SEQ ID NO: 410762 - DNA, 28 bp, Artificial Sequence
  Description of Artificial Sequence: Synthetic oligonucleotide
aactacggggttgtggagagcttcacgg

SEQ ID NO: 410763 - DNA, 27 bp, Artificial Sequence
  Description of Artificial Sequence: Synthetic oligonucleotide
actacggggttgtggagagcttcacgg

SEQ ID NO: 410764 - DNA, 27 bp, Artificial Sequence
  Description of Artificial Sequence: Synthetic oligonucleotide
ctacggggttgtggagagcttcacggt

SEQ ID NO: 410765 - DNA, 27 bp, Artificial Sequence
  Description of Artificial Sequence: Synthetic oligonucleotide
tacggggttgtggagagcttcacggtg

SEQ ID NO: 410766 - DNA, 26 bp, Artificial Sequence
  Description of Artificial Sequence: Synthetic oligonucleotide
acggggttgtggagagcttcacggtg

SEQ ID NO: 410767 - DNA, 25 bp, Artificial Sequence
  Description of Artificial Sequence: Synthetic oligonucleotide
cggggttgtggagagcttcacggtg

SEQ ID NO: 410768 - DNA, 26 bp, Artificial Sequence
  Description of Artificial Sequence: Synthetic oligonucleotide
ggggttgtggagagcttcacggtgca

SEQ ID NO: 410769 - DNA, 26 bp, Artificial Sequence
  Description of Artificial Sequence: Synthetic oligonucleotide
gggttgtggagagcttcacggtgcag

SEQ ID NO: 410770 - DNA, 26 bp, Artificial Sequence
  Description of Artificial Sequence: Synthetic oligonucleotide
ggttgtggagagcttcacggtgcagc

SEQ ID NO: 410771 - DNA, 26 bp, Artificial Sequence
  Description of Artificial Sequence: Synthetic oligonucleotide
gttgtggagagcttcacggtgcagcg

SEQ ID NO: 410772 - DNA, 26 bp, Artificial Sequence
  Description of Artificial Sequence: Synthetic oligonucleotide
ttgtggagagcttcacggtgcagcgg

SEQ ID NO: 410773 - DNA, 25 bp, Artificial Sequence
  Description of Artificial Sequence: Synthetic oligonucleotide
tgtggagagcttcacggtgcagcgg

SEQ ID NO: 410774 - DNA, 24 bp, Artificial Sequence
  Description of Artificial Sequence: Synthetic oligonucleotide
gtggagagcttcacggtgcagcgg

SEQ ID NO: 410775 - DNA, 24 bp, Artificial Sequence
  Description of Artificial Sequence: Synthetic oligonucleotide
tggagagcttcacggtgcagcggc

SEQ ID NO: 410776 - DNA, 23 bp, Artificial Sequence
  Description of Artificial Sequence: Synthetic oligonucleotide
ggagagcttcacggtgcagcggc

SEQ ID NO: 410777 - DNA, 37 bp, Artificial Sequence
  Description of Artificial Sequence: Synthetic oligonucleotide
tactctacgtctgagtgtcatttcttcaatgggacag

SEQ ID NO: 410778 - DNA, 36 bp, Artificial Sequence
  Description of Artificial Sequence: Synthetic oligonucleotide
actctacgtctgagtgtcatttcttcaatgggacag

SEQ ID NO: 410779 - DNA, 35 bp, Artificial Sequence
  Description of Artificial Sequence: Synthetic oligonucleotide
ctctacgtctgagtgtcatttcttcaatgggacag

SEQ ID NO: 410780 - DNA, 36 bp, Artificial Sequence
  Description of Artificial Sequence: Synthetic oligonucleotide
tctacgtctgagtgtcatttcttcaatgggacagag

SEQ ID NO: 410781 - DNA, 35 bp, Artificial Sequence
  Description of Artificial Sequence: Synthetic oligonucleotide
ctacgtctgagtgtcatttcttcaatgggacagag

SEQ ID NO: 410782 - DNA, 35 bp, Artificial Sequence
  Description of Artificial Sequence: Synthetic oligonucleotide
tacgtctgagtgtcatttcttcaatgggacagagc

SEQ ID NO: 410783 - DNA, 34 bp, Artificial Sequence
  Description of Artificial Sequence: Synthetic oligonucleotide
acgtctgagtgtcatttcttcaatgggacagagc

SEQ ID NO: 410784 - DNA, 33 bp, Artificial Sequence
  Description of Artificial Sequence: Synthetic oligonucleotide
cgtctgagtgtcatttcttcaatgggacagagc

SEQ ID NO: 410785 - DNA, 33 bp, Artificial Sequence
  Description of Artificial Sequence: Synthetic oligonucleotide
gtctgagtgtcatttcttcaatgggacagagcg

SEQ ID NO: 410786 - DNA, 33 bp, Artificial Sequence
  Description of Artificial Sequence: Synthetic oligonucleotide
tctgagtgtcatttcttcaatgggacagagcgg

SEQ ID NO: 410787 - DNA, 32 bp, Artificial Sequence
  Description of Artificial Sequence: Synthetic oligonucleotide
ctgagtgtcatttcttcaatgggacagagcgg

SEQ ID NO: 410788 - DNA, 32 bp, Artificial Sequence
  Description of Artificial Sequence: Synthetic oligonucleotide
tgagtgtcatttcttcaatgggacagagcggg

SEQ ID NO: 410789 - DNA, 31 bp, Artificial Sequence
  Description of Artificial Sequence: Synthetic oligonucleotide
gagtgtcatttcttcaatgggacagagcggg

SEQ ID NO: 410790 - DNA, 32 bp, Artificial Sequence
  Description of Artificial Sequence: Synthetic oligonucleotide
agtgtcatttcttcaatgggacagagcgggtg

SEQ ID NO: 410791 - DNA, 31 bp, Artificial Sequence
  Description of Artificial Sequence: Synthetic oligonucleotide
gtgtcatttcttcaatgggacagagcgggtg

SEQ ID NO: 410792 - DNA, 31 bp, Artificial Sequence
  Description of Artificial Sequence: Synthetic oligonucleotide
tgtcatttcttcaatgggacagagcgggtgc

SEQ ID NO: 410793 - DNA, 30 bp, Artificial Sequence
  Description of Artificial Sequence: Synthetic oligonucleotide
gtcatttcttcaatgggacagagcgggtgc

SEQ ID NO: 410794 - DNA, 30 bp, Artificial Sequence
  Description of Artificial Sequence: Synthetic oligonucleotide
tcatttcttcaatgggacagagcgggtgcg

SEQ ID NO: 410795 - DNA, 29 bp, Artificial Sequence
  Description of Artificial Sequence: Synthetic oligonucleotide
catttcttcaatgggacagagcgggtgcg

SEQ ID NO: 410796 - DNA, 29 bp, Artificial Sequence
  Description of Artificial Sequence: Synthetic oligonucleotide
atttcttcaatgggacagagcgggtgcgg

SEQ ID NO: 410797 - DNA, 28 bp, Artificial Sequence
  Description of Artificial Sequence: Synthetic oligonucleotide
tttcttcaatgggacagagcgggtgcgg

SEQ ID NO: 410798 - DNA, 27 bp, Artificial Sequence
  Description of Artificial Sequence: Synthetic oligonucleotide
ttcttcaatgggacagagcgggtgcgg

SEQ ID NO: 410799 - DNA, 27 bp, Artificial Sequence
  Description of Artificial Sequence: Synthetic oligonucleotide
tcttcaatgggacagagcgggtgcggt

SEQ ID NO: 410800 - DNA, 27 bp, Artificial Sequence
  Description of Artificial Sequence: Synthetic oligonucleotide
cttcaatgggacagagcgggtgcggta

SEQ ID NO: 410801 - DNA, 27 bp, Artificial Sequence
  Description of Artificial Sequence: Synthetic oligonucleotide
ttcaatgggacagagcgggtgcggtac

SEQ ID NO: 410802 - DNA, 26 bp, Artificial Sequence
  Description of Artificial Sequence: Synthetic oligonucleotide
tcaatgggacagagcgggtgcggtac

SEQ ID NO: 410803 - DNA, 25 bp, Artificial Sequence
  Description of Artificial Sequence: Synthetic oligonucleotide
caatgggacagagcgggtgcggtac

SEQ ID NO: 410804 - DNA, 26 bp, Artificial Sequence
  Description of Artificial Sequence: Synthetic oligonucleotide
aatgggacagagcgggtgcggtacct

SEQ ID NO: 410805 - DNA, 25 bp, Artificial Sequence
  Description of Artificial Sequence: Synthetic oligonucleotide
atgggacagagcgggtgcggtacct

SEQ ID NO: 410806 - DNA, 24 bp, Artificial Sequence
  Description of Artificial Sequence: Synthetic oligonucleotide
tgggacagagcgggtgcggtacct

SEQ ID NO: 410807 - DNA, 23 bp, Artificial Sequence
  Description of Artificial Sequence: Synthetic oligonucleotide
gggacagagcgggtgcggtacct

SEQ ID NO: 410808 - DNA, 23 bp, Artificial Sequence
  Description of Artificial Sequence: Synthetic oligonucleotide
ggacagagcgggtgcggtacctg

SEQ ID NO: 410809 - DNA, 24 bp, Artificial Sequence
  Description of Artificial Sequence: Synthetic oligonucleotide
gacagagcgggtgcggtacctgga

SEQ ID NO: 410810 - DNA, 25 bp, Artificial Sequence
  Description of Artificial Sequence: Synthetic oligonucleotide
acagagcgggtgcggtacctggaca

SEQ ID NO: 410811 - DNA, 24 bp, Artificial Sequence
  Description of Artificial Sequence: Synthetic oligonucleotide
cagagcgggtgcggtacctggaca

SEQ ID NO: 410812 - DNA, 27 bp, Artificial Sequence
  Description of Artificial Sequence: Synthetic oligonucleotide
agagcgggtgcggtacctggacagata

SEQ ID NO: 410813 - DNA, 38 bp, Artificial Sequence
  Description of Artificial Sequence: Synthetic oligonucleotide
cacgtttcttggaatactctacgtctgagtgtcatttc

SEQ ID NO: 410814 - DNA, 40 bp, Artificial Sequence
  Description of Artificial Sequence: Synthetic oligonucleotide
acgtttcttggaatactctacgtctgagtgtcatttcttc

SEQ ID NO: 410815 - DNA, 39 bp, Artificial Sequence
  Description of Artificial Sequence: Synthetic oligonucleotide
cgtttcttggaatactctacgtctgagtgtcatttcttc

SEQ ID NO: 410816 - DNA, 42 bp, Artificial Sequence
  Description of Artificial Sequence: Synthetic oligonucleotide
gtttcttggaatactctacgtctgagtgtcatttcttcaatg

SEQ ID NO: 410817 - DNA, 42 bp, Artificial Sequence
  Description of Artificial Sequence: Synthetic oligonucleotide
tttcttggaatactctacgtctgagtgtcatttcttcaatgg

SEQ ID NO: 410818 - DNA, 41 bp, Artificial Sequence
  Description of Artificial Sequence: Synthetic oligonucleotide
ttcttggaatactctacgtctgagtgtcatttcttcaatgg

SEQ ID NO: 410819 - DNA, 40 bp, Artificial Sequence
  Description of Artificial Sequence: Synthetic oligonucleotide
tcttggaatactctacgtctgagtgtcatttcttcaatgg

SEQ ID NO: 410820 - DNA, 39 bp, Artificial Sequence
  Description of Artificial Sequence: Synthetic oligonucleotide
cttggaatactctacgtctgagtgtcatttcttcaatgg

SEQ ID NO: 410821 - DNA, 39 bp, Artificial Sequence
  Description of Artificial Sequence: Synthetic oligonucleotide
ttggaatactctacgtctgagtgtcatttcttcaatggg

SEQ ID NO: 410822 - DNA, 38 bp, Artificial Sequence
  Description of Artificial Sequence: Synthetic oligonucleotide
tggaatactctacgtctgagtgtcatttcttcaatggg

SEQ ID NO: 410823 - DNA, 37 bp, Artificial Sequence
  Description of Artificial Sequence: Synthetic oligonucleotide
ggaatactctacgtctgagtgtcatttcttcaatggg

SEQ ID NO: 410824 - DNA, 38 bp, Artificial Sequence
  Description of Artificial Sequence: Synthetic oligonucleotide
gaatactctacgtctgagtgtcatttcttcaatgggac

SEQ ID NO: 410825 - DNA, 38 bp, Artificial Sequence
  Description of Artificial Sequence: Synthetic oligonucleotide
aatactctacgtctgagtgtcatttcttcaatgggacg

SEQ ID NO: 410826 - DNA, 37 bp, Artificial Sequence
  Description of Artificial Sequence: Synthetic oligonucleotide
atactctacgtctgagtgtcatttcttcaatgggacg

SEQ ID NO: 410827 - DNA, 24 bp, Artificial Sequence
  Description of Artificial Sequence: Synthetic oligonucleotide
aatgggacggagcgggtgcggttc

SEQ ID NO: 410828 - DNA, 23 bp, Artificial Sequence
  Description of Artificial Sequence: Synthetic oligonucleotide
atgggacggagcgggtgcggttc

SEQ ID NO: 410829 - DNA, 22 bp, Artificial Sequence
  Description of Artificial Sequence: Synthetic oligonucleotide
tgggacggagcgggtgcggttc

SEQ ID NO: 410830 - DNA, 21 bp, Artificial Sequence
  Description of Artificial Sequence: Synthetic oligonucleotide
gggacggagcgggtgcggttc

SEQ ID NO: 410831 - DNA, 22 bp, Artificial Sequence
  Description of Artificial Sequence: Synthetic oligonucleotide
ggacggagcgggtgcggttcct

SEQ ID NO: 410832 - DNA, 22 bp, Artificial Sequence
  Description of Artificial Sequence: Synthetic oligonucleotide
gacggagcgggtgcggttcctg

SEQ ID NO: 410833 - DNA, 23 bp, Artificial Sequence
  Description of Artificial Sequence: Synthetic oligonucleotide
acggagcgggtgcggttcctgga

SEQ ID NO: 410834 - DNA, 22 bp, Artificial Sequence
  Description of Artificial Sequence: Synthetic oligonucleotide
cggagcgggtgcggttcctgga

SEQ ID NO: 410835 - DNA, 23 bp, Artificial Sequence
  Description of Artificial Sequence: Synthetic oligonucleotide
ggagcgggtgcggttcctggaga

SEQ ID NO: 410836 - DNA, 26 bp, Artificial Sequence
  Description of Artificial Sequence: Synthetic oligonucleotide
gagcgggtgcggttcctggagagata

SEQ ID NO: 410837 - DNA, 27 bp, Artificial Sequence
  Description of Artificial Sequence: Synthetic oligonucleotide
agcgggtgcggttcctggagagatact

SEQ ID NO: 410838 - DNA, 27 bp, Artificial Sequence
  Description of Artificial Sequence: Synthetic oligonucleotide
gcgggtgcggttcctggagagatactt

SEQ ID NO: 410839 - DNA, 27 bp, Artificial Sequence
  Description of Artificial Sequence: Synthetic oligonucleotide
cgggtgcggttcctggagagatacttc

SEQ ID NO: 410840 - DNA, 27 bp, Artificial Sequence
  Description of Artificial Sequence: Synthetic oligonucleotide
gggtgcggttcctggagagatacttcc

SEQ ID NO: 410841 - DNA, 31 bp, Artificial Sequence; identical to SEQ ID NO: 65433
  Description of Artificial Sequence: Synthetic oligonucleotide

SEQ ID NO: 410842 - DNA, 31 bp, Artificial Sequence; identical to SEQ ID NO: 65434
  Description of Artificial Sequence: Synthetic oligonucleotide

SEQ ID NO: 410843 - DNA, 32 bp, Artificial Sequence; identical to SEQ ID NO: 65435
  Description of Artificial Sequence: Synthetic oligonucleotide

SEQ ID NO: 410844 - DNA, 31 bp, Artificial Sequence; identical to SEQ ID NO: 65436
  Description of Artificial Sequence: Synthetic oligonucleotide

SEQ ID NO: 410845 - DNA, 31 bp, Artificial Sequence; identical to SEQ ID NO: 65437
  Description of Artificial Sequence: Synthetic oligonucleotide

SEQ ID NO: 410846 - DNA, 32 bp, Artificial Sequence; identical to SEQ ID NO: 65438
  Description of Artificial Sequence: Synthetic oligonucleotide

SEQ ID NO: 410847 - DNA, 32 bp, Artificial Sequence; identical to SEQ ID NO: 65439
  Description of Artificial Sequence: Synthetic oligonucleotide

SEQ ID NO: 410848 - DNA, 33 bp, Artificial Sequence; identical to SEQ ID NO: 65440
  Description of Artificial Sequence: Synthetic oligonucleotide

SEQ ID NO: 410849 - DNA, 32 bp, Artificial Sequence; identical to SEQ ID NO: 65441
  Description of Artificial Sequence: Synthetic oligonucleotide

SEQ ID NO: 410850 - DNA, 31 bp, Artificial Sequence; identical to SEQ ID NO: 65442
  Description of Artificial Sequence: Synthetic oligonucleotide

SEQ ID NO: 410851 - DNA, 33 bp, Artificial Sequence; identical to SEQ ID NO: 65443
  Description of Artificial Sequence: Synthetic oligonucleotide

SEQ ID NO: 410852 - DNA, 33 bp, Artificial Sequence; identical to SEQ ID NO: 65444
  Description of Artificial Sequence: Synthetic oligonucleotide

SEQ ID NO: 410853 - DNA, 32 bp, Artificial Sequence; identical to SEQ ID NO: 65445
  Description of Artificial Sequence: Synthetic oligonucleotide

SEQ ID NO: 410854 - DNA, 33 bp, Artificial Sequence; identical to SEQ ID NO: 65446
  Description of Artificial Sequence: Synthetic oligonucleotide

SEQ ID NO: 410855 - DNA, 33 bp, Artificial Sequence; identical to SEQ ID NO: 65447
  Description of Artificial Sequence: Synthetic oligonucleotide

SEQ ID NO: 410856 - DNA, 32 bp, Artificial Sequence; identical to SEQ ID NO: 65448
  Description of Artificial Sequence: Synthetic oligonucleotide

SEQ ID NO: 410857 - DNA, 32 bp, Artificial Sequence; identical to SEQ ID NO: 65449
  Description of Artificial Sequence: Synthetic oligonucleotide

SEQ ID NO: 410858 - DNA, 32 bp, Artificial Sequence; identical to SEQ ID NO: 65450
  Description of Artificial Sequence: Synthetic oligonucleotide

SEQ ID NO: 410859 - DNA, 31 bp, Artificial Sequence; identical to SEQ ID NO: 65451
  Description of Artificial Sequence: Synthetic oligonucleotide

SEQ ID NO: 410860 - DNA, 31 bp, Artificial Sequence; identical to SEQ ID NO: 65452
  Description of Artificial Sequence: Synthetic oligonucleotide

SEQ ID NO: 410861 - DNA, 32 bp, Artificial Sequence; identical to SEQ ID NO: 65453
  Description of Artificial Sequence: Synthetic oligonucleotide

SEQ ID NO: 410862 - DNA, 31 bp, Artificial Sequence; identical to SEQ ID NO: 65454
  Description of Artificial Sequence: Synthetic oligonucleotide

SEQ ID NO: 410863 - DNA, 31 bp, Artificial Sequence; identical to SEQ ID NO: 65455
  Description of Artificial Sequence: Synthetic oligonucleotide

SEQ ID NO: 410864 - DNA, 30 bp, Artificial Sequence; identical to SEQ ID NO: 65456
  Description of Artificial Sequence: Synthetic oligonucleotide

SEQ ID NO: 410865 - DNA, 30 bp, Artificial Sequence; identical to SEQ ID NO: 65457
  Description of Artificial Sequence: Synthetic oligonucleotide

SEQ ID NO: 410866 - DNA, 29 bp, Artificial Sequence
  Description of Artificial Sequence: Synthetic oligonucleotide
tacttccataaccaggaggagtccgtgcg

SEQ ID NO: 410867 - DNA, 28 bp, Artificial Sequence
  Description of Artificial Sequence: Synthetic oligonucleotide
acttccataaccaggaggagtccgtgcg

SEQ ID NO: 410868 - DNA, 27 bp, Artificial Sequence
  Description of Artificial Sequence: Synthetic oligonucleotide
cttccataaccaggaggagtccgtgcg

SEQ ID NO: 410869 - DNA, 27 bp, Artificial Sequence
  Description of Artificial Sequence: Synthetic oligonucleotide
ttccataaccaggaggagtccgtgcgc

SEQ ID NO: 410870 - DNA, 27 bp, Artificial Sequence
  Description of Artificial Sequence: Synthetic oligonucleotide
tccataaccaggaggagtccgtgcgct

SEQ ID NO: 410871 - DNA, 27 bp, Artificial Sequence
  Description of Artificial Sequence: Synthetic oligonucleotide
ccataaccaggaggagtccgtgcgctt

SEQ ID NO: 410872 - DNA, 27 bp, Artificial Sequence
  Description of Artificial Sequence: Synthetic oligonucleotide
cataaccaggaggagtccgtgcgcttc

SEQ ID NO: 410873 - DNA, 23 bp, Artificial Sequence
  Description of Artificial Sequence: Synthetic oligonucleotide
ggagcgggtgcggttcctggaca

SEQ ID NO: 410874 - DNA, 26 bp, Artificial Sequence
  Description of Artificial Sequence: Synthetic oligonucleotide
gagcgggtgcggttcctggacagata

SEQ ID NO: 410875 - DNA, 27 bp, Artificial Sequence
  Description of Artificial Sequence: Synthetic oligonucleotide
agcgggtgcggttcctggacagatact

SEQ ID NO: 410876 - DNA, 27 bp, Artificial Sequence
  Description of Artificial Sequence: Synthetic oligonucleotide
gcgggtgcggttcctggacagatactt

SEQ ID NO: 410877 - DNA, 27 bp, Artificial Sequence
  Description of Artificial Sequence: Synthetic oligonucleotide
cgggtgcggttcctggacagatacttc

SEQ ID NO: 410878 - DNA, 27 bp, Artificial Sequence
  Description of Artificial Sequence: Synthetic oligonucleotide
gggtgcggttcctggacagatacttcc

SEQ ID NO: 410879 - DNA, 31 bp, Artificial Sequence; identical to SEQ ID NO: 65471
  Description of Artificial Sequence: Synthetic oligonucleotide

SEQ ID NO: 410880 - DNA, 31 bp, Artificial Sequence; identical to SEQ ID NO: 65472
  Description of Artificial Sequence: Synthetic oligonucleotide

SEQ ID NO: 410881 - DNA, 32 bp, Artificial Sequence; identical to SEQ ID NO: 65473
  Description of Artificial Sequence: Synthetic oligonucleotide

SEQ ID NO: 410882 - DNA, 31 bp, Artificial Sequence; identical to SEQ ID NO: 65474
  Description of Artificial Sequence: Synthetic oligonucleotide

SEQ ID NO: 410883 - DNA, 31 bp, Artificial Sequence; identical to SEQ ID NO: 65475
  Description of Artificial Sequence: Synthetic oligonucleotide

SEQ ID NO: 410884 - DNA, 32 bp, Artificial Sequence; identical to SEQ ID NO: 65476
  Description of Artificial Sequence: Synthetic oligonucleotide

SEQ ID NO: 410885 - DNA, 32 bp, Artificial Sequence; identical to SEQ ID NO: 65477
  Description of Artificial Sequence: Synthetic oligonucleotide

SEQ ID NO: 410886 - DNA, 33 bp, Artificial Sequence; identical to SEQ ID NO: 65478
  Description of Artificial Sequence: Synthetic oligonucleotide

SEQ ID NO: 410887 - DNA, 32 bp, Artificial Sequence; identical to SEQ ID NO: 65479
  Description of Artificial Sequence: Synthetic oligonucleotide

SEQ ID NO: 410888 - DNA, 31 bp, Artificial Sequence; identical to SEQ ID NO: 65480
  Description of Artificial Sequence: Synthetic oligonucleotide

SEQ ID NO: 410889 - DNA, 30 bp, Artificial Sequence; identical to SEQ ID NO: 65481
  Description of Artificial Sequence: Synthetic oligonucleotide

SEQ ID NO: 410890 - DNA, 30 bp, Artificial Sequence; identical to SEQ ID NO: 65482
  Description of Artificial Sequence: Synthetic oligonucleotide

SEQ ID NO: 410891 - DNA, 30 bp, Artificial Sequence; identical to SEQ ID NO: 65483
  Description of Artificial Sequence: Synthetic oligonucleotide

SEQ ID NO: 410892 - DNA, 31 bp, Artificial Sequence; identical to SEQ ID NO: 65484
  Description of Artificial Sequence: Synthetic oligonucleotide

SEQ ID NO: 410893 - DNA, 31 bp, Artificial Sequence; identical to SEQ ID NO: 65485
  Description of Artificial Sequence: Synthetic oligonucleotide

SEQ ID NO: 410894 - DNA, 30 bp, Artificial Sequence; identical to SEQ ID NO: 65486
  Description of Artificial Sequence: Synthetic oligonucleotide

SEQ ID NO: 410895 - DNA, 29 bp, Artificial Sequence
  Description of Artificial Sequence: Synthetic oligonucleotide
cctggacagatacttccataaccgggagg

SEQ ID NO: 410896 - DNA, 30 bp, Artificial Sequence; identical to SEQ ID NO: 65488
  Description of Artificial Sequence: Synthetic oligonucleotide

SEQ ID NO: 410897 - DNA, 32 bp, Artificial Sequence; identical to SEQ ID NO: 65489
  Description of Artificial Sequence: Synthetic oligonucleotide

SEQ ID NO: 410898 - DNA, 31 bp, Artificial Sequence; identical to SEQ ID NO: 65490
  Description of Artificial Sequence: Synthetic oligonucleotide

SEQ ID NO: 410899 - DNA, 31 bp, Artificial Sequence; identical to SEQ ID NO: 65491
  Description of Artificial Sequence: Synthetic oligonucleotide

SEQ ID NO: 410900 - DNA, 32 bp, Artificial Sequence; identical to SEQ ID NO: 65492
  Description of Artificial Sequence: Synthetic oligonucleotide

SEQ ID NO: 410901 - DNA, 31 bp, Artificial Sequence; identical to SEQ ID NO: 65493
  Description of Artificial Sequence: Synthetic oligonucleotide

SEQ ID NO: 410902 - DNA, 31 bp, Artificial Sequence; identical to SEQ ID NO: 65494
  Description of Artificial Sequence: Synthetic oligonucleotide

SEQ ID NO: 410903 - DNA, 30 bp, Artificial Sequence; identical to SEQ ID NO: 65495
  Description of Artificial Sequence: Synthetic oligonucleotide

SEQ ID NO: 410904 - DNA, 30 bp, Artificial Sequence; identical to SEQ ID NO: 65496
  Description of Artificial Sequence: Synthetic oligonucleotide

SEQ ID NO: 410905 - DNA, 29 bp, Artificial Sequence
  Description of Artificial Sequence: Synthetic oligonucleotide
tacttccataaccgggaggagaacgtgcg

SEQ ID NO: 410906 - DNA, 28 bp, Artificial Sequence
  Description of Artificial Sequence: Synthetic oligonucleotide
acttccataaccgggaggagaacgtgcg

SEQ ID NO: 410907 - DNA, 27 bp, Artificial Sequence
  Description of Artificial Sequence: Synthetic oligonucleotide
cttccataaccgggaggagaacgtgcg

SEQ ID NO: 410908 - DNA, 27 bp, Artificial Sequence
  Description of Artificial Sequence: Synthetic oligonucleotide
ttccataaccgggaggagaacgtgcgc

SEQ ID NO: 410909 - DNA, 27 bp, Artificial Sequence
  Description of Artificial Sequence: Synthetic oligonucleotide
tccataaccgggaggagaacgtgcgct

SEQ ID NO: 410910 - DNA, 27 bp, Artificial Sequence
  Description of Artificial Sequence: Synthetic oligonucleotide
ccataaccgggaggagaacgtgcgctt

SEQ ID NO: 410911 - DNA, 27 bp, Artificial Sequence
  Description of Artificial Sequence: Synthetic oligonucleotide
cataaccgggaggagaacgtgcgcttc

SEQ ID NO: 410912 - DNA, 27 bp, Artificial Sequence
  Description of Artificial Sequence: Synthetic oligonucleotide
ataaccgggaggagaacgtgcgcttcg

SEQ ID NO: 410913 - DNA, 27 bp, Artificial Sequence
  Description of Artificial Sequence: Synthetic oligonucleotide
taaccgggaggagaacgtgcgcttcga

SEQ ID NO: 410914 - DNA, 26 bp, Artificial Sequence
  Description of Artificial Sequence: Synthetic oligonucleotide
aaccgggaggagaacgtgcgcttcga

SEQ ID NO: 410915 - DNA, 25 bp, Artificial Sequence
  Description of Artificial Sequence: Synthetic oligonucleotide
accgggaggagaacgtgcgcttcga

SEQ ID NO: 410916 - DNA, 24 bp, Artificial Sequence
  Description of Artificial Sequence: Synthetic oligonucleotide
ccgggaggagaacgtgcgcttcga

SEQ ID NO: 410917 - DNA, 25 bp, Artificial Sequence
  Description of Artificial Sequence: Synthetic oligonucleotide
cgggaggagaacgtgcgcttcgaca

SEQ ID NO: 410918 - DNA, 25 bp, Artificial Sequence
  Description of Artificial Sequence: Synthetic oligonucleotide
gggaggagaacgtgcgcttcgacag

SEQ ID NO: 410919 - DNA, 23 bp, Artificial Sequence
  Description of Artificial Sequence: Synthetic oligonucleotide
ctcctggagcagaagcggggcca

SEQ ID NO: 410920 - DNA, 23 bp, Artificial Sequence
  Description of Artificial Sequence: Synthetic oligonucleotide
tcctggagcagaagcggggccag

SEQ ID NO: 410921 - DNA, 22 bp, Artificial Sequence
  Description of Artificial Sequence: Synthetic oligonucleotide
cctggagcagaagcggggccag

SEQ ID NO: 410922 - DNA, 23 bp, Artificial Sequence
  Description of Artificial Sequence: Synthetic oligonucleotide
ctggagcagaagcggggccaggt

SEQ ID NO: 410923 - DNA, 23 bp, Artificial Sequence
  Description of Artificial Sequence: Synthetic oligonucleotide
tggagcagaagcggggccaggtg

SEQ ID NO: 410924 - DNA, 22 bp, Artificial Sequence
  Description of Artificial Sequence: Synthetic oligonucleotide
ggagcagaagcggggccaggtg

SEQ ID NO: 410925 - DNA, 23 bp, Artificial Sequence
  Description of Artificial Sequence: Synthetic oligonucleotide
gagcagaagcggggccaggtgga

SEQ ID NO: 410926 - DNA, 25 bp, Artificial Sequence
  Description of Artificial Sequence: Synthetic oligonucleotide
agcagaagcggggccaggtggacaa

SEQ ID NO: 410927 - DNA, 24 bp, Artificial Sequence
  Description of Artificial Sequence: Synthetic oligonucleotide
gcagaagcggggccaggtggacaa

SEQ ID NO: 410928 - DNA, 26 bp, Artificial Sequence
  Description of Artificial Sequence: Synthetic oligonucleotide
cagaagcggggccaggtggacaacta

SEQ ID NO: 410929 - DNA, 27 bp, Artificial Sequence
  Description of Artificial Sequence: Synthetic oligonucleotide
agaagcggggccaggtggacaactact

SEQ ID NO: 410930 - DNA, 26 bp, Artificial Sequence
  Description of Artificial Sequence: Synthetic oligonucleotide
gaagcggggccaggtggacaactact

SEQ ID NO: 410931 - DNA, 26 bp, Artificial Sequence
  Description of Artificial Sequence: Synthetic oligonucleotide
aagcggggccaggtggacaactactg

SEQ ID NO: 410932 - DNA, 25 bp, Artificial Sequence
  Description of Artificial Sequence: Synthetic oligonucleotide
agcggggccaggtggacaactactg

SEQ ID NO: 410933 - DNA, 24 bp, Artificial Sequence
  Description of Artificial Sequence: Synthetic oligonucleotide
gcggggccaggtggacaactactg

SEQ ID NO: 410934 - DNA, 25 bp, Artificial Sequence
  Description of Artificial Sequence: Synthetic oligonucleotide
cggggccaggtggacaactactgca

SEQ ID NO: 410935 - DNA, 26 bp, Artificial Sequence
  Description of Artificial Sequence: Synthetic oligonucleotide
ggggccaggtggacaactactgcaga

SEQ ID NO: 410936 - DNA, 27 bp, Artificial Sequence
  Description of Artificial Sequence: Synthetic oligonucleotide
gggccaggtggacaactactgcagaca

SEQ ID NO: 410937 - DNA, 27 bp, Artificial Sequence
  Description of Artificial Sequence: Synthetic oligonucleotide
ggccaggtggacaactactgcagacac

SEQ ID NO: 410938 - DNA, 29 bp, Artificial Sequence
  Description of Artificial Sequence: Synthetic oligonucleotide
gccaggtggacaactactgcagacacaac

SEQ ID NO: 410939 - DNA, 31 bp, Artificial Sequence; identical to SEQ ID NO: 65531
  Description of Artificial Sequence: Synthetic oligonucleotide

SEQ ID NO: 410940 - DNA, 31 bp, Artificial Sequence; identical to SEQ ID NO: 65532
  Description of Artificial Sequence: Synthetic oligonucleotide

SEQ ID NO: 410941 - DNA, 31 bp, Artificial Sequence; identical to SEQ ID NO: 65533
  Description of Artificial Sequence: Synthetic oligonucleotide

SEQ ID NO: 410942 - DNA, 27 bp, Artificial Sequence
  Description of Artificial Sequence: Synthetic oligonucleotide
agcagaagcggggccaggtggacaatt

SEQ ID NO: 410943 - DNA, 27 bp, Artificial Sequence
  Description of Artificial Sequence: Synthetic oligonucleotide
gcagaagcggggccaggtggacaatta

SEQ ID NO: 410944 - DNA, 27 bp, Artificial Sequence
  Description of Artificial Sequence: Synthetic oligonucleotide
cagaagcggggccaggtggacaattac

SEQ ID NO: 410945 - DNA, 28 bp, Artificial Sequence
  Description of Artificial Sequence: Synthetic oligonucleotide
agaagcggggccaggtggacaattactg

SEQ ID NO: 410946 - DNA, 27 bp, Artificial Sequence
  Description of Artificial Sequence: Synthetic oligonucleotide
gaagcggggccaggtggacaattactg

SEQ ID NO: 410947 - DNA, 27 bp, Artificial Sequence
  Description of Artificial Sequence: Synthetic oligonucleotide
aagcggggccaggtggacaattactgc

SEQ ID NO: 410948 - DNA, 27 bp, Artificial Sequence
  Description of Artificial Sequence: Synthetic oligonucleotide
agcggggccaggtggacaattactgca

SEQ ID NO: 410949 - DNA, 26 bp, Artificial Sequence
  Description of Artificial Sequence: Synthetic oligonucleotide
gcggggccaggtggacaattactgca

SEQ ID NO: 410950 - DNA, 27 bp, Artificial Sequence
  Description of Artificial Sequence: Synthetic oligonucleotide
cggggccaggtggacaattactgcaga

SEQ ID NO: 410951 - DNA, 27 bp, Artificial Sequence
  Description of Artificial Sequence: Synthetic oligonucleotide
ggggccaggtggacaattactgcagac

SEQ ID NO: 410952 - DNA, 28 bp, Artificial Sequence
  Description of Artificial Sequence: Synthetic oligonucleotide
gggccaggtggacaattactgcagacac

SEQ ID NO: 410953 - DNA, 30 bp, Artificial Sequence; identical to SEQ ID NO: 65545
  Description of Artificial Sequence: Synthetic oligonucleotide

SEQ ID NO: 410954 - DNA, 32 bp, Artificial Sequence; identical to SEQ ID NO: 65546
  Description of Artificial Sequence: Synthetic oligonucleotide

SEQ ID NO: 410955 - DNA, 32 bp, Artificial Sequence; identical to SEQ ID NO: 65547
  Description of Artificial Sequence: Synthetic oligonucleotide

SEQ ID NO: 410956 - DNA, 32 bp, Artificial Sequence; identical to SEQ ID NO: 65548
  Description of Artificial Sequence: Synthetic oligonucleotide

SEQ ID NO: 410957 - DNA, 32 bp, Artificial Sequence; identical to SEQ ID NO: 65549
  Description of Artificial Sequence: Synthetic oligonucleotide

SEQ ID NO: 410958 - DNA, 22 bp, Artificial Sequence
  Description of Artificial Sequence: Synthetic oligonucleotide
gtgacggagctggggcggccta

SEQ ID NO: 410959 - DNA, 22 bp, Artificial Sequence
  Description of Artificial Sequence: Synthetic oligonucleotide
tgacggagctggggcggcctag

SEQ ID NO: 410960 - DNA, 21 bp, Artificial Sequence
  Description of Artificial Sequence: Synthetic oligonucleotide
gacggagctggggcggcctag

SEQ ID NO: 410961 - DNA, 21 bp, Artificial Sequence
  Description of Artificial Sequence: Synthetic oligonucleotide
acggagctggggcggcctagc

SEQ ID NO: 410962 - DNA, 20 bp, Artificial Sequence
  Description of Artificial Sequence: Synthetic oligonucleotide
cggagctggggcggcctagc

SEQ ID NO: 410963 - DNA, 20 bp, Artificial Sequence
  Description of Artificial Sequence: Synthetic oligonucleotide
ggagctggggcggcctagcg

SEQ ID NO: 410964 - DNA, 20 bp, Artificial Sequence
  Description of Artificial Sequence: Synthetic oligonucleotide
gagctggggcggcctagcgc

SEQ ID NO: 410965 - DNA, 20 bp, Artificial Sequence
  Description of Artificial Sequence: Synthetic oligonucleotide
agctggggcggcctagcgcc

SEQ ID NO: 410966 - DNA, 20 bp, Artificial Sequence
  Description of Artificial Sequence: Synthetic oligonucleotide
gctggggcggcctagcgcct

SEQ ID NO: 410967 - DNA, 20 bp, Artificial Sequence
  Description of Artificial Sequence: Synthetic oligonucleotide
ctggggcggcctagcgccga

SEQ ID NO: 410968 - DNA, 22 bp, Artificial Sequence
  Description of Artificial Sequence: Synthetic oligonucleotide
tggggcggcctagcgccgagta

SEQ ID NO: 410969 - DNA, 22 bp, Artificial Sequence
  Description of Artificial Sequence: Synthetic oligonucleotide
cagaagcggggccgggtggaca

SEQ ID NO: 410970 - DNA, 22 bp, Artificial Sequence
  Description of Artificial Sequence: Synthetic oligonucleotide
agaagcggggccgggtggacac

SEQ ID NO: 410971 - DNA, 21 bp, Artificial Sequence
  Description of Artificial Sequence: Synthetic oligonucleotide
gaagcggggccgggtggacac

SEQ ID NO: 410972 - DNA, 23 bp, Artificial Sequence
  Description of Artificial Sequence: Synthetic oligonucleotide
aagcggggccgggtggacaccta

SEQ ID NO: 410973 - DNA, 22 bp, Artificial Sequence
  Description of Artificial Sequence: Synthetic oligonucleotide
agcggggccgggtggacaccta

SEQ ID NO: 410974 - DNA, 21 bp, Artificial Sequence
  Description of Artificial Sequence: Synthetic oligonucleotide
gcggggccgggtggacaccta

SEQ ID NO: 410975 - DNA, 22 bp, Artificial Sequence
  Description of Artificial Sequence: Synthetic oligonucleotide
cggggccgggtggacacctact

SEQ ID NO: 410976 - DNA, 22 bp, Artificial Sequence
  Description of Artificial Sequence: Synthetic oligonucleotide
ggggccgggtggacacctactg

SEQ ID NO: 410977 - DNA, 23 bp, Artificial Sequence
  Description of Artificial Sequence: Synthetic oligonucleotide
gggccgggtggacacctactgca

SEQ ID NO: 410978 - DNA, 24 bp, Artificial Sequence
  Description of Artificial Sequence: Synthetic oligonucleotide
ggccgggtggacacctactgcaga

SEQ ID NO: 410979 - DNA, 25 bp, Artificial Sequence
  Description of Artificial Sequence: Synthetic oligonucleotide
gccgggtggacacctactgcagaca

SEQ ID NO: 410980 - DNA, 27 bp, Artificial Sequence
  Description of Artificial Sequence: Synthetic oligonucleotide
ccgggtggacacctactgcagacacaa

SEQ ID NO: 410981 - DNA, 27 bp, Artificial Sequence
  Description of Artificial Sequence: Synthetic oligonucleotide
cgggtggacacctactgcagacacaac

SEQ ID NO: 410982 - DNA, 29 bp, Artificial Sequence
  Description of Artificial Sequence: Synthetic oligonucleotide
gggtggacacctactgcagacacaactac

SEQ ID NO: 410983 - DNA, 26 bp, Artificial Sequence
  Description of Artificial Sequence: Synthetic oligonucleotide
cttcgacagcgacgtgggggagttct

SEQ ID NO: 410984 - DNA, 26 bp, Artificial Sequence
  Description of Artificial Sequence: Synthetic oligonucleotide
ttcgacagcgacgtgggggagttctg

SEQ ID NO: 410985 - DNA, 25 bp, Artificial Sequence
  Description of Artificial Sequence: Synthetic oligonucleotide
tcgacagcgacgtgggggagttctg

SEQ ID NO: 410986 - DNA, 24 bp, Artificial Sequence
  Description of Artificial Sequence: Synthetic oligonucleotide
cgacagcgacgtgggggagttctg

SEQ ID NO: 410987 - DNA, 24 bp, Artificial Sequence
  Description of Artificial Sequence: Synthetic oligonucleotide
gacagcgacgtgggggagttctgg

SEQ ID NO: 410988 - DNA, 24 bp, Artificial Sequence
  Description of Artificial Sequence: Synthetic oligonucleotide
acagcgacgtgggggagttctggg

SEQ ID NO: 410989 - DNA, 23 bp, Artificial Sequence
  Description of Artificial Sequence: Synthetic oligonucleotide
cagcgacgtgggggagttctggg

SEQ ID NO: 410990 - DNA, 23 bp, Artificial Sequence
  Description of Artificial Sequence: Synthetic oligonucleotide
agcgacgtgggggagttctgggc

SEQ ID NO: 410991 - DNA, 22 bp, Artificial Sequence
  Description of Artificial Sequence: Synthetic oligonucleotide
gcgacgtgggggagttctgggc

SEQ ID NO: 410992 - DNA, 22 bp, Artificial Sequence
  Description of Artificial Sequence: Synthetic oligonucleotide
cgacgtgggggagttctgggcg

SEQ ID NO: 410993 - DNA, 23 bp, Artificial Sequence
  Description of Artificial Sequence: Synthetic oligonucleotide
gacgtgggggagttctgggcggt

SEQ ID NO: 410994 - DNA, 24 bp, Artificial Sequence
  Description of Artificial Sequence: Synthetic oligonucleotide
acgtgggggagttctgggcggtga

SEQ ID NO: 410995 - DNA, 23 bp, Artificial Sequence
  Description of Artificial Sequence: Synthetic oligonucleotide
cgtgggggagttctgggcggtga

SEQ ID NO: 410996 - DNA, 23 bp, Artificial Sequence
  Description of Artificial Sequence: Synthetic oligonucleotide
gtgggggagttctgggcggtgac

SEQ ID NO: 410997 - DNA, 23 bp, Artificial Sequence
  Description of Artificial Sequence: Synthetic oligonucleotide
tgggggagttctgggcggtgacg

SEQ ID NO: 410998 - DNA, 22 bp, Artificial Sequence
  Description of Artificial Sequence: Synthetic oligonucleotide
gggggagttctgggcggtgacg

SEQ ID NO: 410999 - DNA, 23 bp, Artificial Sequence
  Description of Artificial Sequence: Synthetic oligonucleotide
ggggagttctgggcggtgacgga

SEQ ID NO: 411000 - DNA, 23 bp, Artificial Sequence
  Description of Artificial Sequence: Synthetic oligonucleotide
gggagttctgggcggtgacggag

SEQ ID NO: 411001 - DNA, 24 bp, Artificial Sequence
  Description of Artificial Sequence: Synthetic oligonucleotide
ggagttctgggcggtgacggagct

SEQ ID NO: 411002 - DNA, 24 bp, Artificial Sequence
  Description of Artificial Sequence: Synthetic oligonucleotide
gagttctgggcggtgacggagctg

SEQ ID NO: 411003 - DNA, 24 bp, Artificial Sequence
  Description of Artificial Sequence: Synthetic oligonucleotide
agttctgggcggtgacggagctgg

SEQ ID NO: 411004 - DNA, 23 bp, Artificial Sequence
  Description of Artificial Sequence: Synthetic oligonucleotide
gttctgggcggtgacggagctgg

SEQ ID NO: 411005 - DNA, 23 bp, Artificial Sequence
  Description of Artificial Sequence: Synthetic oligonucleotide
ttctgggcggtgacggagctggg

SEQ ID NO: 411006 - DNA, 22 bp, Artificial Sequence
  Description of Artificial Sequence: Synthetic oligonucleotide
tctgggcggtgacggagctggg

SEQ ID NO: 411007 - DNA, 21 bp, Artificial Sequence
  Description of Artificial Sequence: Synthetic oligonucleotide
ctgggcggtgacggagctggg

SEQ ID NO: 411008 - DNA, 21 bp, Artificial Sequence
  Description of Artificial Sequence: Synthetic oligonucleotide
tgggcggtgacggagctgggg

SEQ ID NO: 411009 - DNA, 32 bp, Artificial Sequence; identical to SEQ ID NO: 65601
  Description of Artificial Sequence: Synthetic oligonucleotide

SEQ ID NO: 411010 - DNA, 32 bp, Artificial Sequence; identical to SEQ ID NO: 65602
  Description of Artificial Sequence: Synthetic oligonucleotide

SEQ ID NO: 411011 - DNA, 34 bp, Artificial Sequence; identical to SEQ ID NO: 65603
  Description of Artificial Sequence: Synthetic oligonucleotide

SEQ ID NO: 411012 - DNA, 35 bp, Artificial Sequence; identical to SEQ ID NO: 65604
  Description of Artificial Sequence: Synthetic oligonucleotide

SEQ ID NO: 411013 - DNA, 34 bp, Artificial Sequence; identical to SEQ ID NO: 65605
  Description of Artificial Sequence: Synthetic oligonucleotide

SEQ ID NO: 411014 - DNA, 34 bp, Artificial Sequence; identical to SEQ ID NO: 65606
  Description of Artificial Sequence: Synthetic oligonucleotide

SEQ ID NO: 411015 - DNA, 35 bp, Artificial Sequence; identical to SEQ ID NO: 65607
  Description of Artificial Sequence: Synthetic oligonucleotide

SEQ ID NO: 411016 - DNA, 37 bp, Artificial Sequence; identical to SEQ ID NO: 65608
  Description of Artificial Sequence: Synthetic oligonucleotide

SEQ ID NO: 411017 - DNA, 37 bp, Artificial Sequence; identical to SEQ ID NO: 65609
  Description of Artificial Sequence: Synthetic oligonucleotide

SEQ ID NO: 411018 - DNA, 36 bp, Artificial Sequence; identical to SEQ ID NO: 65610
  Description of Artificial Sequence: Synthetic oligonucleotide

SEQ ID NO: 411019 - DNA, 35 bp, Artificial Sequence; identical to SEQ ID NO: 65611
  Description of Artificial Sequence: Synthetic oligonucleotide

SEQ ID NO: 411020 - DNA, 36 bp, Artificial Sequence; identical to SEQ ID NO: 65612
  Description of Artificial Sequence: Synthetic oligonucleotide

SEQ ID NO: 411021 - DNA, 36 bp, Artificial Sequence; identical to SEQ ID NO: 65613
  Description of Artificial Sequence: Synthetic oligonucleotide

SEQ ID NO: 411022 - DNA, 35 bp, Artificial Sequence; identical to SEQ ID NO: 65614
  Description of Artificial Sequence: Synthetic oligonucleotide

SEQ ID NO: 411023 - DNA, 35 bp, Artificial Sequence; identical to SEQ ID NO: 65615
  Description of Artificial Sequence: Synthetic oligonucleotide

SEQ ID NO: 411024 - DNA, 35 bp, Artificial Sequence; identical to SEQ ID NO: 65616
  Description of Artificial Sequence: Synthetic oligonucleotide

SEQ ID NO: 411025 - DNA, 34 bp, Artificial Sequence; identical to SEQ ID NO: 65617
  Description of Artificial Sequence: Synthetic oligonucleotide

SEQ ID NO: 411026 - DNA, 36 bp, Artificial Sequence; identical to SEQ ID NO: 65618
  Description of Artificial Sequence: Synthetic oligonucleotide

SEQ ID NO: 411027 - DNA, 35 bp, Artificial Sequence; identical to SEQ ID NO: 65619
  Description of Artificial Sequence: Synthetic oligonucleotide

SEQ ID NO: 411028 - DNA, 35 bp, Artificial Sequence; identical to SEQ ID NO: 65620
  Description of Artificial Sequence: Synthetic oligonucleotide

SEQ ID NO: 411029 - DNA, 34 bp, Artificial Sequence; identical to SEQ ID NO: 65621
  Description of Artificial Sequence: Synthetic oligonucleotide

SEQ ID NO: 411030 - DNA, 33 bp, Artificial Sequence; identical to SEQ ID NO: 65622
  Description of Artificial Sequence: Synthetic oligonucleotide

SEQ ID NO: 411031 - DNA, 32 bp, Artificial Sequence; identical to SEQ ID NO: 65623
  Description of Artificial Sequence: Synthetic oligonucleotide

SEQ ID NO: 411032 - DNA, 33 bp, Artificial Sequence; identical to SEQ ID NO: 65624
  Description of Artificial Sequence: Synthetic oligonucleotide

SEQ ID NO: 411033 - DNA, 22 bp, Artificial Sequence
  Description of Artificial Sequence: Synthetic oligonucleotide
tgggggagtaccgggcggtgag

SEQ ID NO: 411034 - DNA, 21 bp, Artificial Sequence
  Description of Artificial Sequence: Synthetic oligonucleotide
gggggagtaccgggcggtgag

SEQ ID NO: 411035 - DNA, 21 bp, Artificial Sequence
  Description of Artificial Sequence: Synthetic oligonucleotide
ggggagtaccgggcggtgagg

SEQ ID NO: 411036 - DNA, 22 bp, Artificial Sequence
  Description of Artificial Sequence: Synthetic oligonucleotide
gggagtaccgggcggtgaggga

SEQ ID NO: 411037 - DNA, 22 bp, Artificial Sequence
  Description of Artificial Sequence: Synthetic oligonucleotide
ggagtaccgggcggtgagggag

SEQ ID NO: 411038 - DNA, 23 bp, Artificial Sequence
  Description of Artificial Sequence: Synthetic oligonucleotide
gagtaccgggcggtgagggagct

SEQ ID NO: 411039 - DNA, 23 bp, Artificial Sequence
  Description of Artificial Sequence: Synthetic oligonucleotide
agtaccgggcggtgagggagctg

SEQ ID NO: 411040 - DNA, 22 bp, Artificial Sequence
  Description of Artificial Sequence: Synthetic oligonucleotide
gtaccgggcggtgagggagctg

SEQ ID NO: 411041 - DNA, 22 bp, Artificial Sequence
  Description of Artificial Sequence: Synthetic oligonucleotide
taccgggcggtgagggagctgg

SEQ ID NO: 411042 - DNA, 21 bp, Artificial Sequence
  Description of Artificial Sequence: Synthetic oligonucleotide
accgggcggtgagggagctgg

SEQ ID NO: 411043 - DNA, 20 bp, Artificial Sequence
  Description of Artificial Sequence: Synthetic oligonucleotide
ccgggcggtgagggagctgg

SEQ ID NO: 411044 - DNA, 20 bp, Artificial Sequence
  Description of Artificial Sequence: Synthetic oligonucleotide
cgggcggtgagggagctggg

SEQ ID NO: 411045 - DNA, 20 bp, Artificial Sequence
  Description of Artificial Sequence: Synthetic oligonucleotide
gggcggtgagggagctgggg

SEQ ID NO: 411046 - DNA, 20 bp, Artificial Sequence
  Description of Artificial Sequence: Synthetic oligonucleotide
ggcggtgagggagctggggc

SEQ ID NO: 411047 - DNA, 20 bp, Artificial Sequence
  Description of Artificial Sequence: Synthetic oligonucleotide
gcggtgagggagctggggcg

SEQ ID NO: 411048 - DNA, 20 bp, Artificial Sequence
  Description of Artificial Sequence: Synthetic oligonucleotide
cggtgagggagctggggcgg

SEQ ID NO: 411049 - DNA, 20 bp, Artificial Sequence
  Description of Artificial Sequence: Synthetic oligonucleotide
ggtgagggagctggggcggc

SEQ ID NO: 411050 - DNA, 21 bp, Artificial Sequence
  Description of Artificial Sequence: Synthetic oligonucleotide
gtgagggagctggggcggcct

SEQ ID NO: 411051 - DNA, 23 bp, Artificial Sequence
  Description of Artificial Sequence: Synthetic oligonucleotide
tgagggagctggggcggcctgat

SEQ ID NO: 411052 - DNA, 22 bp, Artificial Sequence
  Description of Artificial Sequence: Synthetic oligonucleotide
gagggagctggggcggcctgat

SEQ ID NO: 411053 - DNA, 22 bp, Artificial Sequence
  Description of Artificial Sequence: Synthetic oligonucleotide
agggagctggggcggcctgatg

SEQ ID NO: 411054 - DNA, 21 bp, Artificial Sequence
  Description of Artificial Sequence: Synthetic oligonucleotide
gggagctggggcggcctgatg

SEQ ID NO: 411055 - DNA, 25 bp, Artificial Sequence
  Description of Artificial Sequence: Synthetic oligonucleotide
aacgtgcgcttcgacagcgacgtgc

SEQ ID NO: 411056 - DNA, 24 bp, Artificial Sequence
  Description of Artificial Sequence: Synthetic oligonucleotide
acgtgcgcttcgacagcgacgtgc

SEQ ID NO: 411057 - DNA, 23 bp, Artificial Sequence
  Description of Artificial Sequence: Synthetic oligonucleotide
cgtgcgcttcgacagcgacgtgc

SEQ ID NO: 411058 - DNA, 23 bp, Artificial Sequence
  Description of Artificial Sequence: Synthetic oligonucleotide
gtgcgcttcgacagcgacgtgcg

SEQ ID NO: 411059 - DNA, 23 bp, Artificial Sequence
  Description of Artificial Sequence: Synthetic oligonucleotide
tgcgcttcgacagcgacgtgcgg

SEQ ID NO: 411060 - DNA, 22 bp, Artificial Sequence
  Description of Artificial Sequence: Synthetic oligonucleotide
gcgcttcgacagcgacgtgcgg

SEQ ID NO: 411061 - DNA, 23 bp, Artificial Sequence
  Description of Artificial Sequence: Synthetic oligonucleotide
cgcttcgacagcgacgtgcggga

SEQ ID NO: 411062 - DNA, 25 bp, Artificial Sequence
  Description of Artificial Sequence: Synthetic oligonucleotide
gcttcgacagcgacgtgcgggagtt

SEQ ID NO: 411063 - DNA, 25 bp, Artificial Sequence
  Description of Artificial Sequence: Synthetic oligonucleotide
cttcgacagcgacgtgcgggagttc

SEQ ID NO: 411064 - DNA, 25 bp, Artificial Sequence
  Description of Artificial Sequence: Synthetic oligonucleotide
ttcgacagcgacgtgcgggagttcc

SEQ ID NO: 411065 - DNA, 24 bp, Artificial Sequence
  Description of Artificial Sequence: Synthetic oligonucleotide
tcgacagcgacgtgcgggagttcc

SEQ ID NO: 411066 - DNA, 23 bp, Artificial Sequence
  Description of Artificial Sequence: Synthetic oligonucleotide
cgacagcgacgtgcgggagttcc

SEQ ID NO: 411067 - DNA, 23 bp, Artificial Sequence
  Description of Artificial Sequence: Synthetic oligonucleotide
gacagcgacgtgcgggagttccg

SEQ ID NO: 411068 - DNA, 23 bp, Artificial Sequence
  Description of Artificial Sequence: Synthetic oligonucleotide
acagcgacgtgcgggagttccgg

SEQ ID NO: 411069 - DNA, 22 bp, Artificial Sequence
  Description of Artificial Sequence: Synthetic oligonucleotide
cagcgacgtgcgggagttccgg

SEQ ID NO: 411070 - DNA, 22 bp, Artificial Sequence
  Description of Artificial Sequence: Synthetic oligonucleotide
agcgacgtgcgggagttccggg

SEQ ID NO: 411071 - DNA, 21 bp, Artificial Sequence
  Description of Artificial Sequence: Synthetic oligonucleotide
gcgacgtgcgggagttccggg

SEQ ID NO: 411072 - DNA, 21 bp, Artificial Sequence
  Description of Artificial Sequence: Synthetic oligonucleotide
cgacgtgcgggagttccgggc

SEQ ID NO: 411073 - DNA, 21 bp, Artificial Sequence
  Description of Artificial Sequence: Synthetic oligonucleotide
gacgtgcgggagttccgggcg

SEQ ID NO: 411074 - DNA, 22 bp, Artificial Sequence
  Description of Artificial Sequence: Synthetic oligonucleotide
acgtgcgggagttccgggcggt

SEQ ID NO: 411075 - DNA, 21 bp, Artificial Sequence
  Description of Artificial Sequence: Synthetic oligonucleotide
cgtgcgggagttccgggcggt

SEQ ID NO: 411076 - DNA, 22 bp, Artificial Sequence
  Description of Artificial Sequence: Synthetic oligonucleotide
gtgcgggagttccgggcggtga

SEQ ID NO: 411077 - DNA, 22 bp, Artificial Sequence
  Description of Artificial Sequence: Synthetic oligonucleotide
tgcgggagttccgggcggtgac

SEQ ID NO: 411078 - DNA, 21 bp, Artificial Sequence
  Description of Artificial Sequence: Synthetic oligonucleotide
gcgggagttccgggcggtgac

SEQ ID NO: 411079 - DNA, 21 bp, Artificial Sequence
  Description of Artificial Sequence: Synthetic oligonucleotide
cgggagttccgggcggtgacg

SEQ ID NO: 411080 - DNA, 30 bp, Artificial Sequence; identical to SEQ ID NO: 65672
  Description of Artificial Sequence: Synthetic oligonucleotide

SEQ ID NO: 411081 - DNA, 29 bp, Artificial Sequence
  Description of Artificial Sequence: Synthetic oligonucleotide
acagccagaaggacatcctggagcagaag

SEQ ID NO: 411082 - DNA, 28 bp, Artificial Sequence
  Description of Artificial Sequence: Synthetic oligonucleotide
cagccagaaggacatcctggagcagaag

SEQ ID NO: 411083 - DNA, 28 bp, Artificial Sequence
  Description of Artificial Sequence: Synthetic oligonucleotide
agccagaaggacatcctggagcagaagc

SEQ ID NO: 411084 - DNA, 27 bp, Artificial Sequence
  Description of Artificial Sequence: Synthetic oligonucleotide
gccagaaggacatcctggagcagaagc

SEQ ID NO: 411085 - DNA, 27 bp, Artificial Sequence
  Description of Artificial Sequence: Synthetic oligonucleotide
ccagaaggacatcctggagcagaagcg

SEQ ID NO: 411086 - DNA, 27 bp, Artificial Sequence
  Description of Artificial Sequence: Synthetic oligonucleotide
cagaaggacatcctggagcagaagcgg

SEQ ID NO: 411087 - DNA, 27 bp, Artificial Sequence
  Description of Artificial Sequence: Synthetic oligonucleotide
agaaggacatcctggagcagaagcggg

SEQ ID NO: 411088 - DNA, 26 bp, Artificial Sequence
  Description of Artificial Sequence: Synthetic oligonucleotide
gaaggacatcctggagcagaagcggg

SEQ ID NO: 411089 - DNA, 26 bp, Artificial Sequence
  Description of Artificial Sequence: Synthetic oligonucleotide
aaggacatcctggagcagaagcgggg

SEQ ID NO: 411090 - DNA, 25 bp, Artificial Sequence
  Description of Artificial Sequence: Synthetic oligonucleotide
aggacatcctggagcagaagcgggg

SEQ ID NO: 411091 - DNA, 24 bp, Artificial Sequence
  Description of Artificial Sequence: Synthetic oligonucleotide
ggacatcctggagcagaagcgggg

SEQ ID NO: 411092 - DNA, 24 bp, Artificial Sequence
  Description of Artificial Sequence: Synthetic oligonucleotide
gacatcctggagcagaagcggggc

SEQ ID NO: 411093 - DNA, 24 bp, Artificial Sequence
  Description of Artificial Sequence: Synthetic oligonucleotide
acatcctggagcagaagcggggcc

SEQ ID NO: 411094 - DNA, 23 bp, Artificial Sequence
  Description of Artificial Sequence: Synthetic oligonucleotide
catcctggagcagaagcggggcc

SEQ ID NO: 411095 - DNA, 23 bp, Artificial Sequence
  Description of Artificial Sequence: Synthetic oligonucleotide
atcctggagcagaagcggggccg

SEQ ID NO: 411096 - DNA, 29 bp, Artificial Sequence
  Description of Artificial Sequence: Synthetic oligonucleotide
gacaactactgcagacacaactacggggc

SEQ ID NO: 411097 - DNA, 30 bp, Artificial Sequence; identical to SEQ ID NO: 65689
  Description of Artificial Sequence: Synthetic oligonucleotide

SEQ ID NO: 411098 - DNA, 29 bp, Artificial Sequence
  Description of Artificial Sequence: Synthetic oligonucleotide
caactactgcagacacaactacggggctg

SEQ ID NO: 411099 - DNA, 30 bp, Artificial Sequence; identical to SEQ ID NO: 65691
  Description of Artificial Sequence: Synthetic oligonucleotide

SEQ ID NO: 411100 - DNA, 29 bp, Artificial Sequence
  Description of Artificial Sequence: Synthetic oligonucleotide
actactgcagacacaactacggggctgtg

SEQ ID NO: 411101 - DNA, 28 bp, Artificial Sequence
  Description of Artificial Sequence: Synthetic oligonucleotide
ctactgcagacacaactacggggctgtg

SEQ ID NO: 411102 - DNA, 33 bp, Artificial Sequence; identical to SEQ ID NO: 65697
  Description of Artificial Sequence: Synthetic oligonucleotide

SEQ ID NO: 411103 - DNA, 33 bp, Artificial Sequence; identical to SEQ ID NO: 65698
  Description of Artificial Sequence: Synthetic oligonucleotide

SEQ ID NO: 411104 - DNA, 32 bp, Artificial Sequence; identical to SEQ ID NO: 65699
  Description of Artificial Sequence: Synthetic oligonucleotide

SEQ ID NO: 411105 - DNA, 33 bp, Artificial Sequence; identical to SEQ ID NO: 65700
  Description of Artificial Sequence: Synthetic oligonucleotide

SEQ ID NO: 411106 - DNA, 33 bp, Artificial Sequence; identical to SEQ ID NO: 65701
  Description of Artificial Sequence: Synthetic oligonucleotide

SEQ ID NO: 411107 - DNA, 32 bp, Artificial Sequence; identical to SEQ ID NO: 65702
  Description of Artificial Sequence: Synthetic oligonucleotide

SEQ ID NO: 411108 - DNA, 32 bp, Artificial Sequence; identical to SEQ ID NO: 65703
  Description of Artificial Sequence: Synthetic oligonucleotide

SEQ ID NO: 411109 - DNA, 31 bp, Artificial Sequence; identical to SEQ ID NO: 65704
  Description of Artificial Sequence: Synthetic oligonucleotide

SEQ ID NO: 411110 - DNA, 31 bp, Artificial Sequence; identical to SEQ ID NO: 65705
  Description of Artificial Sequence: Synthetic oligonucleotide

SEQ ID NO: 411111 - DNA, 30 bp, Artificial Sequence; identical to SEQ ID NO: 65706
  Description of Artificial Sequence: Synthetic oligonucleotide

SEQ ID NO: 411112 - DNA, 29 bp, Artificial Sequence
  Description of Artificial Sequence: Synthetic oligonucleotide
acttccataaccaggaggagttcgtgcgc

SEQ ID NO: 411113 - DNA, 28 bp, Artificial Sequence
  Description of Artificial Sequence: Synthetic oligonucleotide
cttccataaccaggaggagttcgtgcgc

SEQ ID NO: 411114 - DNA, 30 bp, Artificial Sequence; identical to SEQ ID NO: 65709
  Description of Artificial Sequence: Synthetic oligonucleotide

SEQ ID NO: 411115 - DNA, 29 bp, Artificial Sequence
  Description of Artificial Sequence: Synthetic oligonucleotide
tccataaccaggaggagttcgtgcgcttc

SEQ ID NO: 411116 - DNA, 28 bp, Artificial Sequence
  Description of Artificial Sequence: Synthetic oligonucleotide
ccataaccaggaggagttcgtgcgcttc

SEQ ID NO: 411117 - DNA, 28 bp, Artificial Sequence
  Description of Artificial Sequence: Synthetic oligonucleotide
cataaccaggaggagttcgtgcgcttcg

SEQ ID NO: 411118 - DNA, 29 bp, Artificial Sequence
  Description of Artificial Sequence: Synthetic oligonucleotide
ataaccaggaggagttcgtgcgcttcgac

SEQ ID NO: 411119 - DNA, 28 bp, Artificial Sequence
  Description of Artificial Sequence: Synthetic oligonucleotide
taaccaggaggagttcgtgcgcttcgac

SEQ ID NO: 411120 - DNA, 27 bp, Artificial Sequence
  Description of Artificial Sequence: Synthetic oligonucleotide
aaccaggaggagttcgtgcgcttcgac

SEQ ID NO: 411121 - DNA, 27 bp, Artificial Sequence
  Description of Artificial Sequence: Synthetic oligonucleotide
accaggaggagttcgtgcgcttcgaca

SEQ ID NO: 411122 - DNA, 26 bp, Artificial Sequence
  Description of Artificial Sequence: Synthetic oligonucleotide
ccaggaggagttcgtgcgcttcgaca

SEQ ID NO: 411123 - DNA, 26 bp, Artificial Sequence
  Description of Artificial Sequence: Synthetic oligonucleotide
caggaggagttcgtgcgcttcgacag

SEQ ID NO: 411124 - DNA, 26 bp, Artificial Sequence
  Description of Artificial Sequence: Synthetic oligonucleotide
aggaggagttcgtgcgcttcgacagc

SEQ ID NO: 411125 - DNA, 27 bp, Artificial Sequence
  Description of Artificial Sequence: Synthetic oligonucleotide
gggtgcggtacctggacagatacttcg

SEQ ID NO: 411126 - DNA, 31 bp, Artificial Sequence; identical to SEQ ID NO: 65721
  Description of Artificial Sequence: Synthetic oligonucleotide

SEQ ID NO: 411127 - DNA, 31 bp, Artificial Sequence; identical to SEQ ID NO: 65722
  Description of Artificial Sequence: Synthetic oligonucleotide

SEQ ID NO: 411128 - DNA, 32 bp, Artificial Sequence; identical to SEQ ID NO: 65723
  Description of Artificial Sequence: Synthetic oligonucleotide

SEQ ID NO: 411129 - DNA, 31 bp, Artificial Sequence; identical to SEQ ID NO: 65724
  Description of Artificial Sequence: Synthetic oligonucleotide

SEQ ID NO: 411130 - DNA, 31 bp, Artificial Sequence; identical to SEQ ID NO: 65725
  Description of Artificial Sequence: Synthetic oligonucleotide

SEQ ID NO: 411131 - DNA, 32 bp, Artificial Sequence; identical to SEQ ID NO: 65726
  Description of Artificial Sequence: Synthetic oligonucleotide

SEQ ID NO: 411132 - DNA, 32 bp, Artificial Sequence; identical to SEQ ID NO: 65727
  Description of Artificial Sequence: Synthetic oligonucleotide

SEQ ID NO: 411133 - DNA, 33 bp, Artificial Sequence; identical to SEQ ID NO: 65728
  Description of Artificial Sequence: Synthetic oligonucleotide

SEQ ID NO: 411134 - DNA, 32 bp, Artificial Sequence; identical to SEQ ID NO: 65729
  Description of Artificial Sequence: Synthetic oligonucleotide

SEQ ID NO: 411135 - DNA, 31 bp, Artificial Sequence; identical to SEQ ID NO: 65730
  Description of Artificial Sequence: Synthetic oligonucleotide

SEQ ID NO: 411136 - DNA, 33 bp, Artificial Sequence; identical to SEQ ID NO: 65731
  Description of Artificial Sequence: Synthetic oligonucleotide

SEQ ID NO: 411137 - DNA, 33 bp, Artificial Sequence; identical to SEQ ID NO: 65732
  Description of Artificial Sequence: Synthetic oligonucleotide

SEQ ID NO: 411138 - DNA, 32 bp, Artificial Sequence; identical to SEQ ID NO: 65733
  Description of Artificial Sequence: Synthetic oligonucleotide

SEQ ID NO: 411139 - DNA, 33 bp, Artificial Sequence; identical to SEQ ID NO: 65734
  Description of Artificial Sequence: Synthetic oligonucleotide

SEQ ID NO: 411140 - DNA, 33 bp, Artificial Sequence; identical to SEQ ID NO: 65735
  Description of Artificial Sequence: Synthetic oligonucleotide

SEQ ID NO: 411141 - DNA, 32 bp, Artificial Sequence; identical to SEQ ID NO: 65736
  Description of Artificial Sequence: Synthetic oligonucleotide

SEQ ID NO: 411142 - DNA, 32 bp, Artificial Sequence; identical to SEQ ID NO: 65737
  Description of Artificial Sequence: Synthetic oligonucleotide

SEQ ID NO: 411143 - DNA, 31 bp, Artificial Sequence; identical to SEQ ID NO: 65738
  Description of Artificial Sequence: Synthetic oligonucleotide

SEQ ID NO: 411144 - DNA, 31 bp, Artificial Sequence; identical to SEQ ID NO: 65739
  Description of Artificial Sequence: Synthetic oligonucleotide

SEQ ID NO: 411145 - DNA, 30 bp, Artificial Sequence; identical to SEQ ID NO: 65740
  Description of Artificial Sequence: Synthetic oligonucleotide

SEQ ID NO: 411146 - DNA, 29 bp, Artificial Sequence
  Description of Artificial Sequence: Synthetic oligonucleotide
acttcgataaccaggaggagaacgtgcgc

SEQ ID NO: 411147 - DNA, 28 bp, Artificial Sequence
  Description of Artificial Sequence: Synthetic oligonucleotide
cttcgataaccaggaggagaacgtgcgc

SEQ ID NO: 411148 - DNA, 30 bp, Artificial Sequence; identical to SEQ ID NO: 65743
  Description of Artificial Sequence: Synthetic oligonucleotide

SEQ ID NO: 411149 - DNA, 29 bp, Artificial Sequence
  Description of Artificial Sequence: Synthetic oligonucleotide
tcgataaccaggaggagaacgtgcgcttc

SEQ ID NO: 411150 - DNA, 28 bp, Artificial Sequence
  Description of Artificial Sequence: Synthetic oligonucleotide
cgataaccaggaggagaacgtgcgcttc

SEQ ID NO: 411151 - DNA, 28 bp, Artificial Sequence
  Description of Artificial Sequence: Synthetic oligonucleotide
gataaccaggaggagaacgtgcgcttcg

SEQ ID NO: 411152 - DNA, 33 bp, Artificial Sequence; identical to SEQ ID NO: 65747
  Description of Artificial Sequence: Synthetic oligonucleotide

SEQ ID NO: 411153 - DNA, 33 bp, Artificial Sequence; identical to SEQ ID NO: 65748
  Description of Artificial Sequence: Synthetic oligonucleotide

SEQ ID NO: 411154 - DNA, 32 bp, Artificial Sequence; identical to SEQ ID NO: 65749
  Description of Artificial Sequence: Synthetic oligonucleotide

SEQ ID NO: 411155 - DNA, 33 bp, Artificial Sequence; identical to SEQ ID NO: 65750
  Description of Artificial Sequence: Synthetic oligonucleotide

SEQ ID NO: 411156 - DNA, 33 bp, Artificial Sequence; identical to SEQ ID NO: 65751
  Description of Artificial Sequence: Synthetic oligonucleotide

SEQ ID NO: 411157 - DNA, 32 bp, Artificial Sequence; identical to SEQ ID NO: 65752
  Description of Artificial Sequence: Synthetic oligonucleotide

SEQ ID NO: 411158 - DNA, 32 bp, Artificial Sequence; identical to SEQ ID NO: 65753
  Description of Artificial Sequence: Synthetic oligonucleotide

SEQ ID NO: 411159 - DNA, 31 bp, Artificial Sequence; identical to SEQ ID NO: 65754
  Description of Artificial Sequence: Synthetic oligonucleotide

SEQ ID NO: 411160 - DNA, 31 bp, Artificial Sequence; identical to SEQ ID NO: 65755
  Description of Artificial Sequence: Synthetic oligonucleotide

SEQ ID NO: 411161 - DNA, 30 bp, Artificial Sequence; identical to SEQ ID NO: 65756
  Description of Artificial Sequence: Synthetic oligonucleotide

SEQ ID NO: 411162 - DNA, 29 bp, Artificial Sequence
  Description of Artificial Sequence: Synthetic oligonucleotide
acttccataaccaggaggagtacgtgcgc

SEQ ID NO: 411163 - DNA, 28 bp, Artificial Sequence
  Description of Artificial Sequence: Synthetic oligonucleotide
cttccataaccaggaggagtacgtgcgc

SEQ ID NO: 411164 - DNA, 30 bp, Artificial Sequence; identical to SEQ ID NO: 65759
  Description of Artificial Sequence: Synthetic oligonucleotide

SEQ ID NO: 411165 - DNA, 29 bp, Artificial Sequence
  Description of Artificial Sequence: Synthetic oligonucleotide
tccataaccaggaggagtacgtgcgcttc

SEQ ID NO: 411166 - DNA, 28 bp, Artificial Sequence
  Description of Artificial Sequence: Synthetic oligonucleotide
ccataaccaggaggagtacgtgcgcttc

SEQ ID NO: 411167 - DNA, 28 bp, Artificial Sequence
  Description of Artificial Sequence: Synthetic oligonucleotide
cataaccaggaggagtacgtgcgcttcg

SEQ ID NO: 411168 - DNA, 29 bp, Artificial Sequence
  Description of Artificial Sequence: Synthetic oligonucleotide
ataaccaggaggagtacgtgcgcttcgac

SEQ ID NO: 411169 - DNA, 28 bp, Artificial Sequence
  Description of Artificial Sequence: Synthetic oligonucleotide
taaccaggaggagtacgtgcgcttcgac

SEQ ID NO: 411170 - DNA, 27 bp, Artificial Sequence
  Description of Artificial Sequence: Synthetic oligonucleotide
aaccaggaggagtacgtgcgcttcgac

SEQ ID NO: 411171 - DNA, 27 bp, Artificial Sequence
  Description of Artificial Sequence: Synthetic oligonucleotide
accaggaggagtacgtgcgcttcgaca

SEQ ID NO: 411172 - DNA, 26 bp, Artificial Sequence
  Description of Artificial Sequence: Synthetic oligonucleotide
ccaggaggagtacgtgcgcttcgaca

SEQ ID NO: 411173 - DNA, 26 bp, Artificial Sequence
  Description of Artificial Sequence: Synthetic oligonucleotide
caggaggagtacgtgcgcttcgacag

SEQ ID NO: 411174 - DNA, 26 bp, Artificial Sequence
  Description of Artificial Sequence: Synthetic oligonucleotide
aggaggagtacgtgcgcttcgacagc

SEQ ID NO: 411175 - DNA, 25 bp, Artificial Sequence
  Description of Artificial Sequence: Synthetic oligonucleotide
ggaggagtacgtgcgcttcgacagc

SEQ ID NO: 411176 - DNA, 32 bp, Artificial Sequence; identical to SEQ ID NO: 65771
  Description of Artificial Sequence: Synthetic oligonucleotide

SEQ ID NO: 411177 - DNA, 32 bp, Artificial Sequence; identical to SEQ ID NO: 65772
  Description of Artificial Sequence: Synthetic oligonucleotide

SEQ ID NO: 411178 - DNA, 31 bp, Artificial Sequence; identical to SEQ ID NO: 65773
  Description of Artificial Sequence: Synthetic oligonucleotide

SEQ ID NO: 411179 - DNA, 31 bp, Artificial Sequence; identical to SEQ ID NO: 65774
  Description of Artificial Sequence: Synthetic oligonucleotide

SEQ ID NO: 411180 - DNA, 30 bp, Artificial Sequence; identical to SEQ ID NO: 65775
  Description of Artificial Sequence: Synthetic oligonucleotide

SEQ ID NO: 411181 - DNA, 30 bp, Artificial Sequence; identical to SEQ ID NO: 65776
  Description of Artificial Sequence: Synthetic oligonucleotide

SEQ ID NO: 411182 - DNA, 29 bp, Artificial Sequence
  Description of Artificial Sequence: Synthetic oligonucleotide
tacttccataaccaggaggagaacgcgcg

SEQ ID NO: 411183 - DNA, 28 bp, Artificial Sequence
  Description of Artificial Sequence: Synthetic oligonucleotide
acttccataaccaggaggagaacgcgcg

SEQ ID NO: 411184 - DNA, 27 bp, Artificial Sequence
  Description of Artificial Sequence: Synthetic oligonucleotide
cttccataaccaggaggagaacgcgcg

SEQ ID NO: 411185 - DNA, 27 bp, Artificial Sequence
  Description of Artificial Sequence: Synthetic oligonucleotide
ttccataaccaggaggagaacgcgcgc

SEQ ID NO: 411186 - DNA, 27 bp, Artificial Sequence
  Description of Artificial Sequence: Synthetic oligonucleotide
tccataaccaggaggagaacgcgcgct

SEQ ID NO: 411187 - DNA, 27 bp, Artificial Sequence
  Description of Artificial Sequence: Synthetic oligonucleotide
ccataaccaggaggagaacgcgcgctt

SEQ ID NO: 411188 - DNA, 27 bp, Artificial Sequence
  Description of Artificial Sequence: Synthetic oligonucleotide
cataaccaggaggagaacgcgcgcttc

SEQ ID NO: 411189 - DNA, 27 bp, Artificial Sequence
  Description of Artificial Sequence: Synthetic oligonucleotide
ataaccaggaggagaacgcgcgcttcg

SEQ ID NO: 411190 - DNA, 27 bp, Artificial Sequence
  Description of Artificial Sequence: Synthetic oligonucleotide
taaccaggaggagaacgcgcgcttcga

SEQ ID NO: 411191 - DNA, 26 bp, Artificial Sequence
  Description of Artificial Sequence: Synthetic oligonucleotide
aaccaggaggagaacgcgcgcttcga

SEQ ID NO: 411192 - DNA, 25 bp, Artificial Sequence
  Description of Artificial Sequence: Synthetic oligonucleotide
accaggaggagaacgcgcgcttcga

SEQ ID NO: 411193 - DNA, 24 bp, Artificial Sequence
  Description of Artificial Sequence: Synthetic oligonucleotide
ccaggaggagaacgcgcgcttcga

SEQ ID NO: 411194 - DNA, 25 bp, Artificial Sequence
  Description of Artificial Sequence: Synthetic oligonucleotide
caggaggagaacgcgcgcttcgaca

SEQ ID NO: 411195 - DNA, 25 bp, Artificial Sequence
  Description of Artificial Sequence: Synthetic oligonucleotide
aggaggagaacgcgcgcttcgacag

SEQ ID NO: 411196 - DNA, 24 bp, Artificial Sequence
  Description of Artificial Sequence: Synthetic oligonucleotide
ggaggagaacgcgcgcttcgacag

SEQ ID NO: 411197 - DNA, 24 bp, Artificial Sequence
  Description of Artificial Sequence: Synthetic oligonucleotide
gaggagaacgcgcgcttcgacagc

SEQ ID NO: 411198 - DNA, 25 bp, Artificial Sequence
  Description of Artificial Sequence: Synthetic oligonucleotide
aggagaacgcgcgcttcgacagcga

SEQ ID NO: 411199 - DNA, 24 bp, Artificial Sequence
  Description of Artificial Sequence: Synthetic oligonucleotide
ggagaacgcgcgcttcgacagcga

SEQ ID NO: 411200 - DNA, 24 bp, Artificial Sequence
  Description of Artificial Sequence: Synthetic oligonucleotide
gagaacgcgcgcttcgacagcgac

SEQ ID NO: 411201 - DNA, 25 bp, Artificial Sequence
  Description of Artificial Sequence: Synthetic oligonucleotide
agaacgcgcgcttcgacagcgacgt

SEQ ID NO: 411202 - DNA, 24 bp, Artificial Sequence
  Description of Artificial Sequence: Synthetic oligonucleotide
gaacgcgcgcttcgacagcgacgt

SEQ ID NO: 411203 - DNA, 24 bp, Artificial Sequence
  Description of Artificial Sequence: Synthetic oligonucleotide
aacgcgcgcttcgacagcgacgtg

SEQ ID NO: 411204 - DNA, 23 bp, Artificial Sequence
  Description of Artificial Sequence: Synthetic oligonucleotide
ggggagttccgggcggtgacgaa

SEQ ID NO: 411205 - DNA, 23 bp, Artificial Sequence
  Description of Artificial Sequence: Synthetic oligonucleotide
gggagttccgggcggtgacgaag

SEQ ID NO: 411206 - DNA, 24 bp, Artificial Sequence
  Description of Artificial Sequence: Synthetic oligonucleotide
ggagttccgggcggtgacgaagct

SEQ ID NO: 411207 - DNA, 24 bp, Artificial Sequence
  Description of Artificial Sequence: Synthetic oligonucleotide
gagttccgggcggtgacgaagctg

SEQ ID NO: 411208 - DNA, 24 bp, Artificial Sequence
  Description of Artificial Sequence: Synthetic oligonucleotide
agttccgggcggtgacgaagctgg

SEQ ID NO: 411209 - DNA, 23 bp, Artificial Sequence
  Description of Artificial Sequence: Synthetic oligonucleotide
gttccgggcggtgacgaagctgg

SEQ ID NO: 411210 - DNA, 23 bp, Artificial Sequence
  Description of Artificial Sequence: Synthetic oligonucleotide
ttccgggcggtgacgaagctggg

SEQ ID NO: 411211 - DNA, 22 bp, Artificial Sequence
  Description of Artificial Sequence: Synthetic oligonucleotide
tccgggcggtgacgaagctggg

SEQ ID NO: 411212 - DNA, 21 bp, Artificial Sequence
  Description of Artificial Sequence: Synthetic oligonucleotide
ccgggcggtgacgaagctggg

SEQ ID NO: 411213 - DNA, 21 bp, Artificial Sequence
  Description of Artificial Sequence: Synthetic oligonucleotide
cgggcggtgacgaagctgggg

SEQ ID NO: 411214 - DNA, 21 bp, Artificial Sequence
  Description of Artificial Sequence: Synthetic oligonucleotide
gggcggtgacgaagctggggc

SEQ ID NO: 411215 - DNA, 21 bp, Artificial Sequence
  Description of Artificial Sequence: Synthetic oligonucleotide
ggcggtgacgaagctggggcg

SEQ ID NO: 411216 - DNA, 21 bp, Artificial Sequence
  Description of Artificial Sequence: Synthetic oligonucleotide
gcggtgacgaagctggggcgg

SEQ ID NO: 411217 - DNA, 21 bp, Artificial Sequence
  Description of Artificial Sequence: Synthetic oligonucleotide
cggtgacgaagctggggcggc

SEQ ID NO: 411218 - DNA, 22 bp, Artificial Sequence
  Description of Artificial Sequence: Synthetic oligonucleotide
ggtgacgaagctggggcggcct

SEQ ID NO: 411219 - DNA, 24 bp, Artificial Sequence
  Description of Artificial Sequence: Synthetic oligonucleotide
gtgacgaagctggggcggcctgat

SEQ ID NO: 411220 - DNA, 24 bp, Artificial Sequence
  Description of Artificial Sequence: Synthetic oligonucleotide
tgacgaagctggggcggcctgatg

SEQ ID NO: 411221 - DNA, 23 bp, Artificial Sequence
  Description of Artificial Sequence: Synthetic oligonucleotide
gacgaagctggggcggcctgatg

SEQ ID NO: 411222 - DNA, 23 bp, Artificial Sequence
  Description of Artificial Sequence: Synthetic oligonucleotide
acgaagctggggcggcctgatgc

SEQ ID NO: 411223 - DNA, 22 bp, Artificial Sequence
  Description of Artificial Sequence: Synthetic oligonucleotide
cgaagctggggcggcctgatgc

SEQ ID NO: 411224 - DNA, 22 bp, Artificial Sequence
  Description of Artificial Sequence: Synthetic oligonucleotide
gaagctggggcggcctgatgcc

SEQ ID NO: 411225 - DNA, 23 bp, Artificial Sequence
  Description of Artificial Sequence: Synthetic oligonucleotide
aagctggggcggcctgatgccga

SEQ ID NO: 411226 - DNA, 22 bp, Artificial Sequence
  Description of Artificial Sequence: Synthetic oligonucleotide
ggacggagcgggtgcggtacgt

SEQ ID NO: 411227 - DNA, 22 bp, Artificial Sequence
  Description of Artificial Sequence: Synthetic oligonucleotide
gacggagcgggtgcggtacgtg

SEQ ID NO: 411228 - DNA, 23 bp, Artificial Sequence
  Description of Artificial Sequence: Synthetic oligonucleotide
acggagcgggtgcggtacgtgga

SEQ ID NO: 411229 - DNA, 22 bp, Artificial Sequence
  Description of Artificial Sequence: Synthetic oligonucleotide
cggagcgggtgcggtacgtgga

SEQ ID NO: 411230 - DNA, 23 bp, Artificial Sequence
  Description of Artificial Sequence: Synthetic oligonucleotide
ggagcgggtgcggtacgtggaca

SEQ ID NO: 411231 - DNA, 26 bp, Artificial Sequence
  Description of Artificial Sequence: Synthetic oligonucleotide
gagcgggtgcggtacgtggacagata

SEQ ID NO: 411232 - DNA, 27 bp, Artificial Sequence
  Description of Artificial Sequence: Synthetic oligonucleotide
agcgggtgcggtacgtggacagatact

SEQ ID NO: 411233 - DNA, 27 bp, Artificial Sequence
  Description of Artificial Sequence: Synthetic oligonucleotide
gcgggtgcggtacgtggacagatactt

SEQ ID NO: 411234 - DNA, 27 bp, Artificial Sequence
  Description of Artificial Sequence: Synthetic oligonucleotide
cgggtgcggtacgtggacagatacttc

SEQ ID NO: 411235 - DNA, 27 bp, Artificial Sequence
  Description of Artificial Sequence: Synthetic oligonucleotide
gggtgcggtacgtggacagatacttcc

SEQ ID NO: 411236 - DNA, 31 bp, Artificial Sequence; identical to SEQ ID NO: 65831
  Description of Artificial Sequence: Synthetic oligonucleotide

SEQ ID NO: 411237 - DNA, 31 bp, Artificial Sequence; identical to SEQ ID NO: 65832
  Description of Artificial Sequence: Synthetic oligonucleotide

SEQ ID NO: 411238 - DNA, 32 bp, Artificial Sequence; identical to SEQ ID NO: 65833
  Description of Artificial Sequence: Synthetic oligonucleotide

SEQ ID NO: 411239 - DNA, 31 bp, Artificial Sequence; identical to SEQ ID NO: 65834
  Description of Artificial Sequence: Synthetic oligonucleotide

SEQ ID NO: 411240 - DNA, 31 bp, Artificial Sequence; identical to SEQ ID NO: 65835
  Description of Artificial Sequence: Synthetic oligonucleotide

SEQ ID NO: 411241 - DNA, 32 bp, Artificial Sequence; identical to SEQ ID NO: 65836
  Description of Artificial Sequence: Synthetic oligonucleotide

SEQ ID NO: 411242 - DNA, 32 bp, Artificial Sequence; identical to SEQ ID NO: 65837
  Description of Artificial Sequence: Synthetic oligonucleotide

SEQ ID NO: 411243 - DNA, 33 bp, Artificial Sequence; identical to SEQ ID NO: 65838
  Description of Artificial Sequence: Synthetic oligonucleotide

SEQ ID NO: 411244 - DNA, 32 bp, Artificial Sequence; identical to SEQ ID NO: 65839
  Description of Artificial Sequence: Synthetic oligonucleotide

SEQ ID NO: 411245 - DNA, 31 bp, Artificial Sequence; identical to SEQ ID NO: 65840
  Description of Artificial Sequence: Synthetic oligonucleotide

SEQ ID NO: 411246 - DNA, 33 bp, Artificial Sequence; identical to SEQ ID NO: 65841
  Description of Artificial Sequence: Synthetic oligonucleotide

SEQ ID NO: 411247 - DNA, 23 bp, Artificial Sequence
  Description of Artificial Sequence: Synthetic oligonucleotide
gagcagaagcggggccgggtgaa

SEQ ID NO: 411248 - DNA, 25 bp, Artificial Sequence
  Description of Artificial Sequence: Synthetic oligonucleotide
agcagaagcggggccgggtgaacaa

SEQ ID NO: 411249 - DNA, 24 bp, Artificial Sequence
  Description of Artificial Sequence: Synthetic oligonucleotide
gcagaagcggggccgggtgaacaa

SEQ ID NO: 411250 - DNA, 26 bp, Artificial Sequence
  Description of Artificial Sequence: Synthetic oligonucleotide
cagaagcggggccgggtgaacaacta

SEQ ID NO: 411251 - DNA, 27 bp, Artificial Sequence
  Description of Artificial Sequence: Synthetic oligonucleotide
agaagcggggccgggtgaacaactact

SEQ ID NO: 411252 - DNA, 26 bp, Artificial Sequence
  Description of Artificial Sequence: Synthetic oligonucleotide
gaagcggggccgggtgaacaactact

SEQ ID NO: 411253 - DNA, 26 bp, Artificial Sequence
  Description of Artificial Sequence: Synthetic oligonucleotide
aagcggggccgggtgaacaactactg

SEQ ID NO: 411254 - DNA, 25 bp, Artificial Sequence
  Description of Artificial Sequence: Synthetic oligonucleotide
agcggggccgggtgaacaactactg

SEQ ID NO: 411255 - DNA, 24 bp, Artificial Sequence
  Description of Artificial Sequence: Synthetic oligonucleotide
gcggggccgggtgaacaactactg

SEQ ID NO: 411256 - DNA, 25 bp, Artificial Sequence
  Description of Artificial Sequence: Synthetic oligonucleotide
cggggccgggtgaacaactactgca

SEQ ID NO: 411257 - DNA, 26 bp, Artificial Sequence
  Description of Artificial Sequence: Synthetic oligonucleotide
ggggccgggtgaacaactactgcaga

SEQ ID NO: 411258 - DNA, 27 bp, Artificial Sequence
  Description of Artificial Sequence: Synthetic oligonucleotide
gggccgggtgaacaactactgcagaca

SEQ ID NO: 411259 - DNA, 27 bp, Artificial Sequence
  Description of Artificial Sequence: Synthetic oligonucleotide
ggccgggtgaacaactactgcagacac

SEQ ID NO: 411260 - DNA, 29 bp, Artificial Sequence
  Description of Artificial Sequence: Synthetic oligonucleotide
gccgggtgaacaactactgcagacacaac

SEQ ID NO: 411261 - DNA, 31 bp, Artificial Sequence; identical to SEQ ID NO: 65856
  Description of Artificial Sequence: Synthetic oligonucleotide

SEQ ID NO: 411262 - DNA, 31 bp, Artificial Sequence; identical to SEQ ID NO: 65857
  Description of Artificial Sequence: Synthetic oligonucleotide

SEQ ID NO: 411263 - DNA, 31 bp, Artificial Sequence; identical to SEQ ID NO: 65858
  Description of Artificial Sequence: Synthetic oligonucleotide

SEQ ID NO: 411264 - DNA, 31 bp, Artificial Sequence; identical to SEQ ID NO: 65859
  Description of Artificial Sequence: Synthetic oligonucleotide

SEQ ID NO: 411265 - DNA, 31 bp, Artificial Sequence; identical to SEQ ID NO: 65860
  Description of Artificial Sequence: Synthetic oligonucleotide

SEQ ID NO: 411266 - DNA, 33 bp, Artificial Sequence; identical to SEQ ID NO: 65861
  Description of Artificial Sequence: Synthetic oligonucleotide

SEQ ID NO: 411267 - DNA, 32 bp, Artificial Sequence; identical to SEQ ID NO: 65862
  Description of Artificial Sequence: Synthetic oligonucleotide

SEQ ID NO: 411268 - DNA, 33 bp, Artificial Sequence; identical to SEQ ID NO: 65863
  Description of Artificial Sequence: Synthetic oligonucleotide

SEQ ID NO: 411269 - DNA, 37 bp, Artificial Sequence; identical to SEQ ID NO: 65864
  Description of Artificial Sequence: Synthetic oligonucleotide

SEQ ID NO: 411270 - DNA, 36 bp, Artificial Sequence; identical to SEQ ID NO: 65865
  Description of Artificial Sequence: Synthetic oligonucleotide

SEQ ID NO: 411271 - DNA, 38 bp, Artificial Sequence; identical to SEQ ID NO: 65866
  Description of Artificial Sequence: Synthetic oligonucleotide

SEQ ID NO: 411272 - DNA, 41 bp, Artificial Sequence; identical to SEQ ID NO: 65867
  Description of Artificial Sequence: Synthetic oligonucleotide

SEQ ID NO: 411273 - DNA, 40 bp, Artificial Sequence; identical to SEQ ID NO: 65868
  Description of Artificial Sequence: Synthetic oligonucleotide

SEQ ID NO: 411274 - DNA, 39 bp, Artificial Sequence; identical to SEQ ID NO: 65869
  Description of Artificial Sequence: Synthetic oligonucleotide

SEQ ID NO: 411275 - DNA, 38 bp, Artificial Sequence; identical to SEQ ID NO: 65870
  Description of Artificial Sequence: Synthetic oligonucleotide

SEQ ID NO: 411276 - DNA, 38 bp, Artificial Sequence; identical to SEQ ID NO: 65871
  Description of Artificial Sequence: Synthetic oligonucleotide

SEQ ID NO: 411277 - DNA, 37 bp, Artificial Sequence; identical to SEQ ID NO: 65872
  Description of Artificial Sequence: Synthetic oligonucleotide

SEQ ID NO: 411278 - DNA, 36 bp, Artificial Sequence; identical to SEQ ID NO: 65873
  Description of Artificial Sequence: Synthetic oligonucleotide

SEQ ID NO: 411279 - DNA, 36 bp, Artificial Sequence; identical to SEQ ID NO: 65874
  Description of Artificial Sequence: Synthetic oligonucleotide

SEQ ID NO: 411280 - DNA, 37 bp, Artificial Sequence; identical to SEQ ID NO: 65875
  Description of Artificial Sequence: Synthetic oligonucleotide

SEQ ID NO: 411281 - DNA, 36 bp, Artificial Sequence; identical to SEQ ID NO: 65876
  Description of Artificial Sequence: Synthetic oligonucleotide

SEQ ID NO: 411282 - DNA, 36 bp, Artificial Sequence; identical to SEQ ID NO: 65877
  Description of Artificial Sequence: Synthetic oligonucleotide

SEQ ID NO: 411283 - DNA, 35 bp, Artificial Sequence; identical to SEQ ID NO: 65878
  Description of Artificial Sequence: Synthetic oligonucleotide

SEQ ID NO: 411284 - DNA, 34 bp, Artificial Sequence; identical to SEQ ID NO: 65879
  Description of Artificial Sequence: Synthetic oligonucleotide

SEQ ID NO: 411285 - DNA, 34 bp, Artificial Sequence; identical to SEQ ID NO: 65880
  Description of Artificial Sequence: Synthetic oligonucleotide

SEQ ID NO: 411286 - DNA, 33 bp, Artificial Sequence; identical to SEQ ID NO: 65881
  Description of Artificial Sequence: Synthetic oligonucleotide

SEQ ID NO: 411287 - DNA, 34 bp, Artificial Sequence; identical to SEQ ID NO: 65882
  Description of Artificial Sequence: Synthetic oligonucleotide

SEQ ID NO: 411288 - DNA, 33 bp, Artificial Sequence; identical to SEQ ID NO: 65883
  Description of Artificial Sequence: Synthetic oligonucleotide

SEQ ID NO: 411289 - DNA, 32 bp, Artificial Sequence; identical to SEQ ID NO: 65884
  Description of Artificial Sequence: Synthetic oligonucleotide

SEQ ID NO: 411290 - DNA, 32 bp, Artificial Sequence; identical to SEQ ID NO: 65885
  Description of Artificial Sequence: Synthetic oligonucleotide

SEQ ID NO: 411291 - DNA, 32 bp, Artificial Sequence; identical to SEQ ID NO: 65886
  Description of Artificial Sequence: Synthetic oligonucleotide

SEQ ID NO: 411292 - DNA, 31 bp, Artificial Sequence; identical to SEQ ID NO: 65887
  Description of Artificial Sequence: Synthetic oligonucleotide

SEQ ID NO: 411293 - DNA, 31 bp, Artificial Sequence; identical to SEQ ID NO: 65888
  Description of Artificial Sequence: Synthetic oligonucleotide

SEQ ID NO: 411294 - DNA, 30 bp, Artificial Sequence; identical to SEQ ID NO: 65889
  Description of Artificial Sequence: Synthetic oligonucleotide

SEQ ID NO: 411295 - DNA, 30 bp, Artificial Sequence; identical to SEQ ID NO: 65890
  Description of Artificial Sequence: Synthetic oligonucleotide

SEQ ID NO: 411296 - DNA, 29 bp, Artificial Sequence
  Description of Artificial Sequence: Synthetic oligonucleotide
gtgtcaattcttcaatgggacggagcggg

SEQ ID NO: 411297 - DNA, 30 bp, Artificial Sequence; identical to SEQ ID NO: 65892
  Description of Artificial Sequence: Synthetic oligonucleotide

SEQ ID NO: 411298 - DNA, 29 bp, Artificial Sequence
  Description of Artificial Sequence: Synthetic oligonucleotide
gtcaattcttcaatgggacggagcgggtg

SEQ ID NO: 411299 - DNA, 29 bp, Artificial Sequence
  Description of Artificial Sequence: Synthetic oligonucleotide
tcaattcttcaatgggacggagcgggtgc

SEQ ID NO: 411300 - DNA, 28 bp, Artificial Sequence
  Description of Artificial Sequence: Synthetic oligonucleotide
caattcttcaatgggacggagcgggtgc

SEQ ID NO: 411301 - DNA, 28 bp, Artificial Sequence
  Description of Artificial Sequence: Synthetic oligonucleotide
aattcttcaatgggacggagcgggtgcg

SEQ ID NO: 411302 - DNA, 27 bp, Artificial Sequence
  Description of Artificial Sequence: Synthetic oligonucleotide
attcttcaatgggacggagcgggtgcg

SEQ ID NO: 411303 - DNA, 32 bp, Artificial Sequence; identical to SEQ ID NO: 65898
  Description of Artificial Sequence: Synthetic oligonucleotide

SEQ ID NO: 411304 - DNA, 33 bp, Artificial Sequence; identical to SEQ ID NO: 65899
  Description of Artificial Sequence: Synthetic oligonucleotide

SEQ ID NO: 411305 - DNA, 33 bp, Artificial Sequence; identical to SEQ ID NO: 65900
  Description of Artificial Sequence: Synthetic oligonucleotide

SEQ ID NO: 411306 - DNA, 32 bp, Artificial Sequence; identical to SEQ ID NO: 65901
  Description of Artificial Sequence: Synthetic oligonucleotide

SEQ ID NO: 411307 - DNA, 33 bp, Artificial Sequence; identical to SEQ ID NO: 65902
  Description of Artificial Sequence: Synthetic oligonucleotide

SEQ ID NO: 411308 - DNA, 33 bp, Artificial Sequence; identical to SEQ ID NO: 65903
  Description of Artificial Sequence: Synthetic oligonucleotide

SEQ ID NO: 411309 - DNA, 34 bp, Artificial Sequence; identical to SEQ ID NO: 65904
  Description of Artificial Sequence: Synthetic oligonucleotide

SEQ ID NO: 411310 - DNA, 36 bp, Artificial Sequence; identical to SEQ ID NO: 65905
  Description of Artificial Sequence: Synthetic oligonucleotide

SEQ ID NO: 411311 - DNA, 35 bp, Artificial Sequence; identical to SEQ ID NO: 65906
  Description of Artificial Sequence: Synthetic oligonucleotide

SEQ ID NO: 411312 - DNA, 34 bp, Artificial Sequence; identical to SEQ ID NO: 65907
  Description of Artificial Sequence: Synthetic oligonucleotide

SEQ ID NO: 411313 - DNA, 34 bp, Artificial Sequence; identical to SEQ ID NO: 65908
  Description of Artificial Sequence: Synthetic oligonucleotide

SEQ ID NO: 411314 - DNA, 35 bp, Artificial Sequence; identical to SEQ ID NO: 65909
  Description of Artificial Sequence: Synthetic oligonucleotide

SEQ ID NO: 411315 - DNA, 34 bp, Artificial Sequence; identical to SEQ ID NO: 65910
  Description of Artificial Sequence: Synthetic oligonucleotide

SEQ ID NO: 411316 - DNA, 34 bp, Artificial Sequence; identical to SEQ ID NO: 65911
  Description of Artificial Sequence: Synthetic oligonucleotide

SEQ ID NO: 411317 - DNA, 34 bp, Artificial Sequence; identical to SEQ ID NO: 65912
  Description of Artificial Sequence: Synthetic oligonucleotide

SEQ ID NO: 411318 - DNA, 33 bp, Artificial Sequence; identical to SEQ ID NO: 65913
  Description of Artificial Sequence: Synthetic oligonucleotide

SEQ ID NO: 411319 - DNA, 33 bp, Artificial Sequence; identical to SEQ ID NO: 65914
  Description of Artificial Sequence: Synthetic oligonucleotide

SEQ ID NO: 411320 - DNA, 32 bp, Artificial Sequence; identical to SEQ ID NO: 65915
  Description of Artificial Sequence: Synthetic oligonucleotide

SEQ ID NO: 411321 - DNA, 34 bp, Artificial Sequence; identical to SEQ ID NO: 65916
  Description of Artificial Sequence: Synthetic oligonucleotide

SEQ ID NO: 411322 - DNA, 33 bp, Artificial Sequence; identical to SEQ ID NO: 65917
  Description of Artificial Sequence: Synthetic oligonucleotide

SEQ ID NO: 411323 - DNA, 32 bp, Artificial Sequence; identical to SEQ ID NO: 65918
  Description of Artificial Sequence: Synthetic oligonucleotide

SEQ ID NO: 411324 - DNA, 31 bp, Artificial Sequence; identical to SEQ ID NO: 65919
  Description of Artificial Sequence: Synthetic oligonucleotide

SEQ ID NO: 411325 - DNA, 31 bp, Artificial Sequence; identical to SEQ ID NO: 65920
  Description of Artificial Sequence: Synthetic oligonucleotide

SEQ ID NO: 411326 - DNA, 30 bp, Artificial Sequence; identical to SEQ ID NO: 65921
  Description of Artificial Sequence: Synthetic oligonucleotide

SEQ ID NO: 411327 - DNA, 29 bp, Artificial Sequence
  Description of Artificial Sequence: Synthetic oligonucleotide
ccataaacaggaggagaacgtgcgcttcg

SEQ ID NO: 411328 - DNA, 30 bp, Artificial Sequence; identical to SEQ ID NO: 65923
  Description of Artificial Sequence: Synthetic oligonucleotide

SEQ ID NO: 411329 - DNA, 31 bp, Artificial Sequence; identical to SEQ ID NO: 65924
  Description of Artificial Sequence: Synthetic oligonucleotide

SEQ ID NO: 411330 - DNA, 30 bp, Artificial Sequence; identical to SEQ ID NO: 65925
  Description of Artificial Sequence: Synthetic oligonucleotide

SEQ ID NO: 411331 - DNA, 29 bp, Artificial Sequence
  Description of Artificial Sequence: Synthetic oligonucleotide
aaacaggaggagaacgtgcgcttcgacag

SEQ ID NO: 411332 - DNA, 28 bp, Artificial Sequence
  Description of Artificial Sequence: Synthetic oligonucleotide
aacaggaggagaacgtgcgcttcgacag

SEQ ID NO: 411333 - DNA, 27 bp, Artificial Sequence
  Description of Artificial Sequence: Synthetic oligonucleotide
acaggaggagaacgtgcgcttcgacag

SEQ ID NO: 411334 - DNA, 22 bp, Artificial Sequence
  Description of Artificial Sequence: Synthetic oligonucleotide
tgggggagttccgggcggtgag

SEQ ID NO: 411335 - DNA, 21 bp, Artificial Sequence
  Description of Artificial Sequence: Synthetic oligonucleotide
gggggagttccgggcggtgag

SEQ ID NO: 411336 - DNA, 21 bp, Artificial Sequence
  Description of Artificial Sequence: Synthetic oligonucleotide
ggggagttccgggcggtgagg

SEQ ID NO: 411337 - DNA, 22 bp, Artificial Sequence
  Description of Artificial Sequence: Synthetic oligonucleotide
gggagttccgggcggtgaggga

SEQ ID NO: 411338 - DNA, 22 bp, Artificial Sequence
  Description of Artificial Sequence: Synthetic oligonucleotide
ggagttccgggcggtgagggag

SEQ ID NO: 411339 - DNA, 23 bp, Artificial Sequence
  Description of Artificial Sequence: Synthetic oligonucleotide
gagttccgggcggtgagggagct

SEQ ID NO: 411340 - DNA, 23 bp, Artificial Sequence
  Description of Artificial Sequence: Synthetic oligonucleotide
agttccgggcggtgagggagctg

SEQ ID NO: 411341 - DNA, 22 bp, Artificial Sequence
  Description of Artificial Sequence: Synthetic oligonucleotide
gttccgggcggtgagggagctg

SEQ ID NO: 411342 - DNA, 22 bp, Artificial Sequence
  Description of Artificial Sequence: Synthetic oligonucleotide
ttccgggcggtgagggagctgg

SEQ ID NO: 411343 - DNA, 21 bp, Artificial Sequence
  Description of Artificial Sequence: Synthetic oligonucleotide
tccgggcggtgagggagctgg

SEQ ID NO: 411344 - DNA, 22 bp, Artificial Sequence
  Description of Artificial Sequence: Synthetic oligonucleotide
tgacggagctggggcggcctgt

SEQ ID NO: 411345 - DNA, 21 bp, Artificial Sequence
  Description of Artificial Sequence: Synthetic oligonucleotide
gacggagctggggcggcctgt

SEQ ID NO: 411346 - DNA, 21 bp, Artificial Sequence
  Description of Artificial Sequence: Synthetic oligonucleotide
acggagctggggcggcctgtc

SEQ ID NO: 411347 - DNA, 20 bp, Artificial Sequence
  Description of Artificial Sequence: Synthetic oligonucleotide
cggagctggggcggcctgtc

SEQ ID NO: 411348 - DNA, 20 bp, Artificial Sequence
  Description of Artificial Sequence: Synthetic oligonucleotide
ggagctggggcggcctgtcg

SEQ ID NO: 411349 - DNA, 20 bp, Artificial Sequence
  Description of Artificial Sequence: Synthetic oligonucleotide
gagctggggcggcctgtcgc

SEQ ID NO: 411350 - DNA, 20 bp, Artificial Sequence
  Description of Artificial Sequence: Synthetic oligonucleotide
agctggggcggcctgtcgcc

SEQ ID NO: 411351 - DNA, 20 bp, Artificial Sequence
  Description of Artificial Sequence: Synthetic oligonucleotide
gctggggcggcctgtcgcct

SEQ ID NO: 411352 - DNA, 20 bp, Artificial Sequence
  Description of Artificial Sequence: Synthetic oligonucleotide
ctggggcggcctgtcgccga

SEQ ID NO: 411353 - DNA, 21 bp, Artificial Sequence
  Description of Artificial Sequence: Synthetic oligonucleotide
tggggcggcctgtcgccgagt

SEQ ID NO: 411354 - DNA, 20 bp, Artificial Sequence
  Description of Artificial Sequence: Synthetic oligonucleotide
ggggcggcctgtcgccgagt

SEQ ID NO: 411355 - DNA, 20 bp, Artificial Sequence
  Description of Artificial Sequence: Synthetic oligonucleotide
gggcggcctgtcgccgagtc

SEQ ID NO: 411356 - DNA, 21 bp, Artificial Sequence
  Description of Artificial Sequence: Synthetic oligonucleotide
ggcggcctgtcgccgagtcct

SEQ ID NO: 411357 - DNA, 21 bp, Artificial Sequence
  Description of Artificial Sequence: Synthetic oligonucleotide
gcggcctgtcgccgagtcctg

SEQ ID NO: 411358 - DNA, 23 bp, Artificial Sequence
  Description of Artificial Sequence: Synthetic oligonucleotide
cggcctgtcgccgagtcctggaa

SEQ ID NO: 411359 - DNA, 24 bp, Artificial Sequence
  Description of Artificial Sequence: Synthetic oligonucleotide
ggcctgtcgccgagtcctggaaca

SEQ ID NO: 411360 - DNA, 24 bp, Artificial Sequence
  Description of Artificial Sequence: Synthetic oligonucleotide
gcctgtcgccgagtcctggaacag

SEQ ID NO: 411361 - DNA, 24 bp, Artificial Sequence
  Description of Artificial Sequence: Synthetic oligonucleotide
cctgtcgccgagtcctggaacagc

SEQ ID NO: 411362 - DNA, 25 bp, Artificial Sequence
  Description of Artificial Sequence: Synthetic oligonucleotide
ctgtcgccgagtcctggaacagcca

SEQ ID NO: 411363 - DNA, 27 bp, Artificial Sequence
  Description of Artificial Sequence: Synthetic oligonucleotide
tgtcgccgagtcctggaacagccagaa

SEQ ID NO: 411364 - DNA, 26 bp, Artificial Sequence
  Description of Artificial Sequence: Synthetic oligonucleotide
gtcgccgagtcctggaacagccagaa

SEQ ID NO: 411365 - DNA, 26 bp, Artificial Sequence
  Description of Artificial Sequence: Synthetic oligonucleotide
tcgccgagtcctggaacagccagaag

SEQ ID NO: 411366 - DNA, 25 bp, Artificial Sequence
  Description of Artificial Sequence: Synthetic oligonucleotide
cgccgagtcctggaacagccagaag

SEQ ID NO: 411367 - DNA, 21 bp, Artificial Sequence
  Description of Artificial Sequence: Synthetic oligonucleotide
ggacggagcgggtgcggtacc

SEQ ID NO: 411368 - DNA, 21 bp, Artificial Sequence
  Description of Artificial Sequence: Synthetic oligonucleotide
gacggagcgggtgcggtaccg

SEQ ID NO: 411369 - DNA, 21 bp, Artificial Sequence
  Description of Artificial Sequence: Synthetic oligonucleotide
acggagcgggtgcggtaccgg

SEQ ID NO: 411370 - DNA, 20 bp, Artificial Sequence
  Description of Artificial Sequence: Synthetic oligonucleotide
cggagcgggtgcggtaccgg

SEQ ID NO: 411371 - DNA, 21 bp, Artificial Sequence
  Description of Artificial Sequence: Synthetic oligonucleotide
ggagcgggtgcggtaccggga

SEQ ID NO: 411372 - DNA, 22 bp, Artificial Sequence
  Description of Artificial Sequence: Synthetic oligonucleotide
gagcgggtgcggtaccgggaca

SEQ ID NO: 411373 - DNA, 25 bp, Artificial Sequence
  Description of Artificial Sequence: Synthetic oligonucleotide
agcgggtgcggtaccgggacagata

SEQ ID NO: 411374 - DNA, 24 bp, Artificial Sequence
  Description of Artificial Sequence: Synthetic oligonucleotide
gcgggtgcggtaccgggacagata

SEQ ID NO: 411375 - DNA, 26 bp, Artificial Sequence
  Description of Artificial Sequence: Synthetic oligonucleotide
cgggtgcggtaccgggacagatactt

SEQ ID NO: 411376 - DNA, 26 bp, Artificial Sequence
  Description of Artificial Sequence: Synthetic oligonucleotide
gggtgcggtaccgggacagatacttc

SEQ ID NO: 411377 - DNA, 27 bp, Artificial Sequence
  Description of Artificial Sequence: Synthetic oligonucleotide
ggtgcggtaccgggacagatacttcca

SEQ ID NO: 411378 - DNA, 30 bp, Artificial Sequence; identical to SEQ ID NO: 65973
  Description of Artificial Sequence: Synthetic oligonucleotide

SEQ ID NO: 411379 - DNA, 30 bp, Artificial Sequence; identical to SEQ ID NO: 65974
  Description of Artificial Sequence: Synthetic oligonucleotide

SEQ ID NO: 411380 - DNA, 29 bp, Artificial Sequence
  Description of Artificial Sequence: Synthetic oligonucleotide
gcggtaccgggacagatacttccataacc

SEQ ID NO: 411381 - DNA, 30 bp, Artificial Sequence; identical to SEQ ID NO: 65976
  Description of Artificial Sequence: Synthetic oligonucleotide

SEQ ID NO: 411382 - DNA, 30 bp, Artificial Sequence; identical to SEQ ID NO: 65977
  Description of Artificial Sequence: Synthetic oligonucleotide

SEQ ID NO: 411383 - DNA, 31 bp, Artificial Sequence; identical to SEQ ID NO: 65978
  Description of Artificial Sequence: Synthetic oligonucleotide

SEQ ID NO: 411384 - DNA, 31 bp, Artificial Sequence; identical to SEQ ID NO: 65979
  Description of Artificial Sequence: Synthetic oligonucleotide

SEQ ID NO: 411385 - DNA, 30 bp, Artificial Sequence; identical to SEQ ID NO: 65980
  Description of Artificial Sequence: Synthetic oligonucleotide

SEQ ID NO: 411386 - DNA, 29 bp, Artificial Sequence
  Description of Artificial Sequence: Synthetic oligonucleotide
ccgggacagatacttccataaccaggagg

SEQ ID NO: 411387 - DNA, 30 bp, Artificial Sequence; identical to SEQ ID NO: 65982
  Description of Artificial Sequence: Synthetic oligonucleotide

SEQ ID NO: 411388 - DNA, 32 bp, Artificial Sequence; identical to SEQ ID NO: 65983
  Description of Artificial Sequence: Synthetic oligonucleotide

SEQ ID NO: 411389 - DNA, 31 bp, Artificial Sequence; identical to SEQ ID NO: 65984
  Description of Artificial Sequence: Synthetic oligonucleotide

SEQ ID NO: 411390 - DNA, 32 bp, Artificial Sequence; identical to SEQ ID NO: 65985
  Description of Artificial Sequence: Synthetic oligonucleotide

SEQ ID NO: 411391 - DNA, 31 bp, Artificial Sequence; identical to SEQ ID NO: 65986
  Description of Artificial Sequence: Synthetic oligonucleotide

SEQ ID NO: 411392 - DNA, 35 bp, Artificial Sequence; identical to SEQ ID NO: 65987
  Description of Artificial Sequence: Synthetic oligonucleotide

SEQ ID NO: 411393 - DNA, 37 bp, Artificial Sequence; identical to SEQ ID NO: 65988
  Description of Artificial Sequence: Synthetic oligonucleotide

SEQ ID NO: 411394 - DNA, 36 bp, Artificial Sequence; identical to SEQ ID NO: 65989
  Description of Artificial Sequence: Synthetic oligonucleotide

SEQ ID NO: 411395 - DNA, 35 bp, Artificial Sequence; identical to SEQ ID NO: 65990
  Description of Artificial Sequence: Synthetic oligonucleotide

SEQ ID NO: 411396 - DNA, 34 bp, Artificial Sequence; identical to SEQ ID NO: 65991
  Description of Artificial Sequence: Synthetic oligonucleotide

SEQ ID NO: 411397 - DNA, 37 bp, Artificial Sequence; identical to SEQ ID NO: 65992
  Description of Artificial Sequence: Synthetic oligonucleotide

SEQ ID NO: 411398 - DNA, 36 bp, Artificial Sequence; identical to SEQ ID NO: 65993
  Description of Artificial Sequence: Synthetic oligonucleotide

SEQ ID NO: 411399 - DNA, 35 bp, Artificial Sequence; identical to SEQ ID NO: 65994
  Description of Artificial Sequence: Synthetic oligonucleotide

SEQ ID NO: 411400 - DNA, 35 bp, Artificial Sequence; identical to SEQ ID NO: 65995
  Description of Artificial Sequence: Synthetic oligonucleotide

SEQ ID NO: 411401 - DNA, 35 bp, Artificial Sequence; identical to SEQ ID NO: 65996
  Description of Artificial Sequence: Synthetic oligonucleotide

SEQ ID NO: 411402 - DNA, 34 bp, Artificial Sequence; identical to SEQ ID NO: 65997
  Description of Artificial Sequence: Synthetic oligonucleotide

SEQ ID NO: 411403 - DNA, 35 bp, Artificial Sequence; identical to SEQ ID NO: 65998
  Description of Artificial Sequence: Synthetic oligonucleotide

SEQ ID NO: 411404 - DNA, 35 bp, Artificial Sequence; identical to SEQ ID NO: 65999
  Description of Artificial Sequence: Synthetic oligonucleotide

SEQ ID NO: 411405 - DNA, 34 bp, Artificial Sequence; identical to SEQ ID NO: 66000
  Description of Artificial Sequence: Synthetic oligonucleotide

SEQ ID NO: 411406 - DNA, 34 bp, Artificial Sequence; identical to SEQ ID NO: 66001
  Description of Artificial Sequence: Synthetic oligonucleotide

SEQ ID NO: 411407 - DNA, 35 bp, Artificial Sequence; identical to SEQ ID NO: 66002
  Description of Artificial Sequence: Synthetic oligonucleotide

SEQ ID NO: 411408 - DNA, 35 bp, Artificial Sequence; identical to SEQ ID NO: 66003
  Description of Artificial Sequence: Synthetic oligonucleotide

SEQ ID NO: 411409 - DNA, 34 bp, Artificial Sequence; identical to SEQ ID NO: 66004
  Description of Artificial Sequence: Synthetic oligonucleotide

SEQ ID NO: 411410 - DNA, 33 bp, Artificial Sequence; identical to SEQ ID NO: 66005
  Description of Artificial Sequence: Synthetic oligonucleotide

SEQ ID NO: 411411 - DNA, 33 bp, Artificial Sequence; identical to SEQ ID NO: 66006
  Description of Artificial Sequence: Synthetic oligonucleotide

SEQ ID NO: 411412 - DNA, 32 bp, Artificial Sequence; identical to SEQ ID NO: 66007
  Description of Artificial Sequence: Synthetic oligonucleotide

SEQ ID NO: 411413 - DNA, 33 bp, Artificial Sequence; identical to SEQ ID NO: 66008
  Description of Artificial Sequence: Synthetic oligonucleotide

SEQ ID NO: 411414 - DNA, 33 bp, Artificial Sequence; identical to SEQ ID NO: 66009
  Description of Artificial Sequence: Synthetic oligonucleotide

SEQ ID NO: 411415 - DNA, 32 bp, Artificial Sequence; identical to SEQ ID NO: 66010
  Description of Artificial Sequence: Synthetic oligonucleotide

SEQ ID NO: 411416 - DNA, 32 bp, Artificial Sequence; identical to SEQ ID NO: 66011
  Description of Artificial Sequence: Synthetic oligonucleotide

SEQ ID NO: 411417 - DNA, 31 bp, Artificial Sequence; identical to SEQ ID NO: 66012
  Description of Artificial Sequence: Synthetic oligonucleotide

SEQ ID NO: 411418 - DNA, 31 bp, Artificial Sequence; identical to SEQ ID NO: 66013
  Description of Artificial Sequence: Synthetic oligonucleotide

SEQ ID NO: 411419 - DNA, 30 bp, Artificial Sequence; identical to SEQ ID NO: 66014
  Description of Artificial Sequence: Synthetic oligonucleotide

SEQ ID NO: 411420 - DNA, 29 bp, Artificial Sequence
  Description of Artificial Sequence: Synthetic oligonucleotide
acttccataaccaggaggagttcctgcgc

SEQ ID NO: 411421 - DNA, 28 bp, Artificial Sequence
  Description of Artificial Sequence: Synthetic oligonucleotide
cttccataaccaggaggagttcctgcgc

SEQ ID NO: 411422 - DNA, 30 bp, Artificial Sequence; identical to SEQ ID NO: 66017
  Description of Artificial Sequence: Synthetic oligonucleotide

SEQ ID NO: 411423 - DNA, 29 bp, Artificial Sequence
  Description of Artificial Sequence: Synthetic oligonucleotide
tccataaccaggaggagttcctgcgcttc

SEQ ID NO: 411424 - DNA, 28 bp, Artificial Sequence
  Description of Artificial Sequence: Synthetic oligonucleotide
ccataaccaggaggagttcctgcgcttc

SEQ ID NO: 411425 - DNA, 28 bp, Artificial Sequence
  Description of Artificial Sequence: Synthetic oligonucleotide
cataaccaggaggagttcctgcgcttcg

SEQ ID NO: 411426 - DNA, 29 bp, Artificial Sequence
  Description of Artificial Sequence: Synthetic oligonucleotide
ataaccaggaggagttcctgcgcttcgac

SEQ ID NO: 411427 - DNA, 28 bp, Artificial Sequence
  Description of Artificial Sequence: Synthetic oligonucleotide
taaccaggaggagttcctgcgcttcgac

SEQ ID NO: 411428 - DNA, 27 bp, Artificial Sequence
  Description of Artificial Sequence: Synthetic oligonucleotide
aaccaggaggagttcctgcgcttcgac

SEQ ID NO: 411429 - DNA, 27 bp, Artificial Sequence
  Description of Artificial Sequence: Synthetic oligonucleotide
accaggaggagttcctgcgcttcgaca

SEQ ID NO: 411430 - DNA, 26 bp, Artificial Sequence
  Description of Artificial Sequence: Synthetic oligonucleotide
ccaggaggagttcctgcgcttcgaca

SEQ ID NO: 411431 - DNA, 26 bp, Artificial Sequence
  Description of Artificial Sequence: Synthetic oligonucleotide
caggaggagttcctgcgcttcgacag

SEQ ID NO: 411432 - DNA, 26 bp, Artificial Sequence
  Description of Artificial Sequence: Synthetic oligonucleotide
aggaggagttcctgcgcttcgacagc

SEQ ID NO: 411433 - DNA, 25 bp, Artificial Sequence
  Description of Artificial Sequence: Synthetic oligonucleotide
ggaggagttcctgcgcttcgacagc

SEQ ID NO: 411434 - DNA, 26 bp, Artificial Sequence
  Description of Artificial Sequence: Synthetic oligonucleotide
gaggagttcctgcgcttcgacagcga

SEQ ID NO: 411435 - DNA, 26 bp, Artificial Sequence
  Description of Artificial Sequence: Synthetic oligonucleotide
aggagttcctgcgcttcgacagcgac

SEQ ID NO: 411436 - DNA, 25 bp, Artificial Sequence
  Description of Artificial Sequence: Synthetic oligonucleotide
ggagttcctgcgcttcgacagcgac

SEQ ID NO: 411437 - DNA, 26 bp, Artificial Sequence
  Description of Artificial Sequence: Synthetic oligonucleotide
gagttcctgcgcttcgacagcgacgt

SEQ ID NO: 411438 - DNA, 26 bp, Artificial Sequence
  Description of Artificial Sequence: Synthetic oligonucleotide
agttcctgcgcttcgacagcgacgtg

SEQ ID NO: 411439 - DNA, 25 bp, Artificial Sequence
  Description of Artificial Sequence: Synthetic oligonucleotide
gttcctgcgcttcgacagcgacgtg

SEQ ID NO: 411440 - DNA, 25 bp, Artificial Sequence
  Description of Artificial Sequence: Synthetic oligonucleotide
ttcctgcgcttcgacagcgacgtgg

SEQ ID NO: 411441 - DNA, 24 bp, Artificial Sequence
  Description of Artificial Sequence: Synthetic oligonucleotide
tcctgcgcttcgacagcgacgtgg

SEQ ID NO: 411442 - DNA, 23 bp, Artificial Sequence
  Description of Artificial Sequence: Synthetic oligonucleotide
cctgcgcttcgacagcgacgtgg

SEQ ID NO: 411443 - DNA, 23 bp, Artificial Sequence
  Description of Artificial Sequence: Synthetic oligonucleotide
ctgcgcttcgacagcgacgtggg

SEQ ID NO: 411444 - DNA, 32 bp, Artificial Sequence; identical to SEQ ID NO: 66039
  Description of Artificial Sequence: Synthetic oligonucleotide

SEQ ID NO: 411445 - DNA, 32 bp, Artificial Sequence; identical to SEQ ID NO: 66040
  Description of Artificial Sequence: Synthetic oligonucleotide

SEQ ID NO: 411446 - DNA, 31 bp, Artificial Sequence; identical to SEQ ID NO: 66041
  Description of Artificial Sequence: Synthetic oligonucleotide

SEQ ID NO: 411447 - DNA, 31 bp, Artificial Sequence; identical to SEQ ID NO: 66042
  Description of Artificial Sequence: Synthetic oligonucleotide

SEQ ID NO: 411448 - DNA, 30 bp, Artificial Sequence; identical to SEQ ID NO: 66043
  Description of Artificial Sequence: Synthetic oligonucleotide

SEQ ID NO: 411449 - DNA, 30 bp, Artificial Sequence; identical to SEQ ID NO: 66044
  Description of Artificial Sequence: Synthetic oligonucleotide

SEQ ID NO: 411450 - DNA, 29 bp, Artificial Sequence
  Description of Artificial Sequence: Synthetic oligonucleotide
tacttccataaccaggaggagtacgcgcg

SEQ ID NO: 411451 - DNA, 28 bp, Artificial Sequence
  Description of Artificial Sequence: Synthetic oligonucleotide
acttccataaccaggaggagtacgcgcg

SEQ ID NO: 411452 - DNA, 27 bp, Artificial Sequence
  Description of Artificial Sequence: Synthetic oligonucleotide
cttccataaccaggaggagtacgcgcg

SEQ ID NO: 411453 - DNA, 27 bp, Artificial Sequence
  Description of Artificial Sequence: Synthetic oligonucleotide
ttccataaccaggaggagtacgcgcgc

SEQ ID NO: 411454 - DNA, 27 bp, Artificial Sequence
  Description of Artificial Sequence: Synthetic oligonucleotide
tccataaccaggaggagtacgcgcgct

SEQ ID NO: 411455 - DNA, 27 bp, Artificial Sequence
  Description of Artificial Sequence: Synthetic oligonucleotide
ccataaccaggaggagtacgcgcgctt

SEQ ID NO: 411456 - DNA, 27 bp, Artificial Sequence
  Description of Artificial Sequence: Synthetic oligonucleotide
cataaccaggaggagtacgcgcgcttc

SEQ ID NO: 411457 - DNA, 27 bp, Artificial Sequence
  Description of Artificial Sequence: Synthetic oligonucleotide
ataaccaggaggagtacgcgcgcttcg

SEQ ID NO: 411458 - DNA, 27 bp, Artificial Sequence
  Description of Artificial Sequence: Synthetic oligonucleotide
taaccaggaggagtacgcgcgcttcga

SEQ ID NO: 411459 - DNA, 26 bp, Artificial Sequence
  Description of Artificial Sequence: Synthetic oligonucleotide
aaccaggaggagtacgcgcgcttcga

SEQ ID NO: 411460 - DNA, 25 bp, Artificial Sequence
  Description of Artificial Sequence: Synthetic oligonucleotide
accaggaggagtacgcgcgcttcga

SEQ ID NO: 411461 - DNA, 24 bp, Artificial Sequence
  Description of Artificial Sequence: Synthetic oligonucleotide
ccaggaggagtacgcgcgcttcga

SEQ ID NO: 411462 - DNA, 25 bp, Artificial Sequence
  Description of Artificial Sequence: Synthetic oligonucleotide
caggaggagtacgcgcgcttcgaca

SEQ ID NO: 411463 - DNA, 25 bp, Artificial Sequence
  Description of Artificial Sequence: Synthetic oligonucleotide
aggaggagtacgcgcgcttcgacag

SEQ ID NO: 411464 - DNA, 38 bp, Artificial Sequence; identical to SEQ ID NO: 66059
  Description of Artificial Sequence: Synthetic oligonucleotide

SEQ ID NO: 411465 - DNA, 37 bp, Artificial Sequence; identical to SEQ ID NO: 66060
  Description of Artificial Sequence: Synthetic oligonucleotide

SEQ ID NO: 411466 - DNA, 37 bp, Artificial Sequence; identical to SEQ ID NO: 66061
  Description of Artificial Sequence: Synthetic oligonucleotide

SEQ ID NO: 411467 - DNA, 36 bp, Artificial Sequence; identical to SEQ ID NO: 66062
  Description of Artificial Sequence: Synthetic oligonucleotide

SEQ ID NO: 411468 - DNA, 35 bp, Artificial Sequence; identical to SEQ ID NO: 66063
  Description of Artificial Sequence: Synthetic oligonucleotide

SEQ ID NO: 411469 - DNA, 36 bp, Artificial Sequence; identical to SEQ ID NO: 66064
  Description of Artificial Sequence: Synthetic oligonucleotide

SEQ ID NO: 411470 - DNA, 35 bp, Artificial Sequence; identical to SEQ ID NO: 66065
  Description of Artificial Sequence: Synthetic oligonucleotide

SEQ ID NO: 411471 - DNA, 35 bp, Artificial Sequence; identical to SEQ ID NO: 66066
  Description of Artificial Sequence: Synthetic oligonucleotide

SEQ ID NO: 411472 - DNA, 34 bp, Artificial Sequence; identical to SEQ ID NO: 66067
  Description of Artificial Sequence: Synthetic oligonucleotide

SEQ ID NO: 411473 - DNA, 33 bp, Artificial Sequence; identical to SEQ ID NO: 66068
  Description of Artificial Sequence: Synthetic oligonucleotide

SEQ ID NO: 411474 - DNA, 33 bp, Artificial Sequence; identical to SEQ ID NO: 66069
  Description of Artificial Sequence: Synthetic oligonucleotide

SEQ ID NO: 411475 - DNA, 33 bp, Artificial Sequence; identical to SEQ ID NO: 66070
  Description of Artificial Sequence: Synthetic oligonucleotide

SEQ ID NO: 411476 - DNA, 32 bp, Artificial Sequence; identical to SEQ ID NO: 66071
  Description of Artificial Sequence: Synthetic oligonucleotide

SEQ ID NO: 411477 - DNA, 32 bp, Artificial Sequence; identical to SEQ ID NO: 66072
  Description of Artificial Sequence: Synthetic oligonucleotide

SEQ ID NO: 411478 - DNA, 31 bp, Artificial Sequence; identical to SEQ ID NO: 66073
  Description of Artificial Sequence: Synthetic oligonucleotide

SEQ ID NO: 411479 - DNA, 32 bp, Artificial Sequence; identical to SEQ ID NO: 66074
  Description of Artificial Sequence: Synthetic oligonucleotide

SEQ ID NO: 411480 - DNA, 31 bp, Artificial Sequence; identical to SEQ ID NO: 66075
  Description of Artificial Sequence: Synthetic oligonucleotide

SEQ ID NO: 411481 - DNA, 31 bp, Artificial Sequence; identical to SEQ ID NO: 66076
  Description of Artificial Sequence: Synthetic oligonucleotide

SEQ ID NO: 411482 - DNA, 30 bp, Artificial Sequence; identical to SEQ ID NO: 66077
  Description of Artificial Sequence: Synthetic oligonucleotide

SEQ ID NO: 411483 - DNA, 30 bp, Artificial Sequence; identical to SEQ ID NO: 66078
  Description of Artificial Sequence: Synthetic oligonucleotide

SEQ ID NO: 411484 - DNA, 29 bp, Artificial Sequence
  Description of Artificial Sequence: Synthetic oligonucleotide
catttcttcaatgggatggagcgggtgcg

SEQ ID NO: 411485 - DNA, 29 bp, Artificial Sequence
  Description of Artificial Sequence: Synthetic oligonucleotide
atttcttcaatgggatggagcgggtgcgg

SEQ ID NO: 411486 - DNA, 28 bp, Artificial Sequence
  Description of Artificial Sequence: Synthetic oligonucleotide
tttcttcaatgggatggagcgggtgcgg

SEQ ID NO: 411487 - DNA, 27 bp, Artificial Sequence
  Description of Artificial Sequence: Synthetic oligonucleotide
ttcttcaatgggatggagcgggtgcgg

SEQ ID NO: 411488 - DNA, 27 bp, Artificial Sequence
  Description of Artificial Sequence: Synthetic oligonucleotide
tcttcaatgggatggagcgggtgcggt

SEQ ID NO: 411489 - DNA, 27 bp, Artificial Sequence
  Description of Artificial Sequence: Synthetic oligonucleotide
cttcaatgggatggagcgggtgcggta

SEQ ID NO: 411490 - DNA, 27 bp, Artificial Sequence
  Description of Artificial Sequence: Synthetic oligonucleotide
ttcaatgggatggagcgggtgcggtac

SEQ ID NO: 411491 - DNA, 26 bp, Artificial Sequence
  Description of Artificial Sequence: Synthetic oligonucleotide
tcaatgggatggagcgggtgcggtac

SEQ ID NO: 411492 - DNA, 25 bp, Artificial Sequence
  Description of Artificial Sequence: Synthetic oligonucleotide
caatgggatggagcgggtgcggtac

SEQ ID NO: 411493 - DNA, 26 bp, Artificial Sequence
  Description of Artificial Sequence: Synthetic oligonucleotide
aatgggatggagcgggtgcggtacct

SEQ ID NO: 411494 - DNA, 25 bp, Artificial Sequence
  Description of Artificial Sequence: Synthetic oligonucleotide
atgggatggagcgggtgcggtacct

SEQ ID NO: 411495 - DNA, 24 bp, Artificial Sequence
  Description of Artificial Sequence: Synthetic oligonucleotide
tgggatggagcgggtgcggtacct

SEQ ID NO: 411496 - DNA, 23 bp, Artificial Sequence
  Description of Artificial Sequence: Synthetic oligonucleotide
gggatggagcgggtgcggtacct

SEQ ID NO: 411497 - DNA, 23 bp, Artificial Sequence
  Description of Artificial Sequence: Synthetic oligonucleotide
ggatggagcgggtgcggtacctg

SEQ ID NO: 411498 - DNA, 24 bp, Artificial Sequence
  Description of Artificial Sequence: Synthetic oligonucleotide
gatggagcgggtgcggtacctgga

SEQ ID NO: 411499 - DNA, 25 bp, Artificial Sequence
  Description of Artificial Sequence: Synthetic oligonucleotide
atggagcgggtgcggtacctggaca

SEQ ID NO: 411500 - DNA, 24 bp, Artificial Sequence
  Description of Artificial Sequence: Synthetic oligonucleotide
tggagcgggtgcggtacctggaca

SEQ ID NO: 411501 - DNA, 21 bp, Artificial Sequence
  Description of Artificial Sequence: Synthetic oligonucleotide
ggagctggggcggcctgatgg

SEQ ID NO: 411502 - DNA, 21 bp, Artificial Sequence
  Description of Artificial Sequence: Synthetic oligonucleotide
gagctggggcggcctgatggc

SEQ ID NO: 411503 - DNA, 22 bp, Artificial Sequence
  Description of Artificial Sequence: Synthetic oligonucleotide
agctggggcggcctgatggcga

SEQ ID NO: 411504 - DNA, 21 bp, Artificial Sequence
  Description of Artificial Sequence: Synthetic oligonucleotide
gctggggcggcctgatggcga

SEQ ID NO: 411505 - DNA, 23 bp, Artificial Sequence
  Description of Artificial Sequence: Synthetic oligonucleotide
ctggggcggcctgatggcgagta

SEQ ID NO: 411506 - DNA, 24 bp, Artificial Sequence
  Description of Artificial Sequence: Synthetic oligonucleotide
tggggcggcctgatggcgagtact

SEQ ID NO: 411507 - DNA, 23 bp, Artificial Sequence
  Description of Artificial Sequence: Synthetic oligonucleotide
ggggcggcctgatggcgagtact

SEQ ID NO: 411508 - DNA, 23 bp, Artificial Sequence
  Description of Artificial Sequence: Synthetic oligonucleotide
gggcggcctgatggcgagtactg

SEQ ID NO: 411509 - DNA, 25 bp, Artificial Sequence
  Description of Artificial Sequence: Synthetic oligonucleotide
ggcggcctgatggcgagtactggaa

SEQ ID NO: 411510 - DNA, 26 bp, Artificial Sequence
  Description of Artificial Sequence: Synthetic oligonucleotide
gcggcctgatggcgagtactggaaca

SEQ ID NO: 411511 - DNA, 26 bp, Artificial Sequence
  Description of Artificial Sequence: Synthetic oligonucleotide
cggcctgatggcgagtactggaacag

SEQ ID NO: 411512 - DNA, 26 bp, Artificial Sequence
  Description of Artificial Sequence: Synthetic oligonucleotide
ggcctgatggcgagtactggaacagc

SEQ ID NO: 411513 - DNA, 27 bp, Artificial Sequence
  Description of Artificial Sequence: Synthetic oligonucleotide
gcctgatggcgagtactggaacagcca

SEQ ID NO: 411514 - DNA, 27 bp, Artificial Sequence
  Description of Artificial Sequence: Synthetic oligonucleotide
cctgatggcgagtactggaacagccag

SEQ ID NO: 411515 - DNA, 29 bp, Artificial Sequence
  Description of Artificial Sequence: Synthetic oligonucleotide
ctgatggcgagtactggaacagccagaag

SEQ ID NO: 411516 - DNA, 29 bp, Artificial Sequence
  Description of Artificial Sequence: Synthetic oligonucleotide
tgatggcgagtactggaacagccagaagg

SEQ ID NO: 411517 - DNA, 28 bp, Artificial Sequence
  Description of Artificial Sequence: Synthetic oligonucleotide
gatggcgagtactggaacagccagaagg

SEQ ID NO: 411518 - DNA, 29 bp, Artificial Sequence
  Description of Artificial Sequence: Synthetic oligonucleotide
atggcgagtactggaacagccagaaggac

SEQ ID NO: 411519 - DNA, 28 bp, Artificial Sequence
  Description of Artificial Sequence: Synthetic oligonucleotide
tggcgagtactggaacagccagaaggac

SEQ ID NO: 411520 - DNA, 27 bp, Artificial Sequence
  Description of Artificial Sequence: Synthetic oligonucleotide
ggcgagtactggaacagccagaaggac

SEQ ID NO: 411521 - DNA, 27 bp, Artificial Sequence
  Description of Artificial Sequence: Synthetic oligonucleotide
gcgagtactggaacagccagaaggacc

SEQ ID NO: 411522 - DNA, 21 bp, Artificial Sequence
  Description of Artificial Sequence: Synthetic oligonucleotide
gtgacggagctggggcggcgt

SEQ ID NO: 411523 - DNA, 23 bp, Artificial Sequence
  Description of Artificial Sequence: Synthetic oligonucleotide
tgacggagctggggcggcgtgat

SEQ ID NO: 411524 - DNA, 22 bp, Artificial Sequence
  Description of Artificial Sequence: Synthetic oligonucleotide
gacggagctggggcggcgtgat

SEQ ID NO: 411525 - DNA, 22 bp, Artificial Sequence
  Description of Artificial Sequence: Synthetic oligonucleotide
acggagctggggcggcgtgatg

SEQ ID NO: 411526 - DNA, 21 bp, Artificial Sequence
  Description of Artificial Sequence: Synthetic oligonucleotide
cggagctggggcggcgtgatg

SEQ ID NO: 411527 - DNA, 21 bp, Artificial Sequence
  Description of Artificial Sequence: Synthetic oligonucleotide
ggagctggggcggcgtgatgc

SEQ ID NO: 411528 - DNA, 21 bp, Artificial Sequence
  Description of Artificial Sequence: Synthetic oligonucleotide
gagctggggcggcgtgatgcc

SEQ ID NO: 411529 - DNA, 22 bp, Artificial Sequence
  Description of Artificial Sequence: Synthetic oligonucleotide
agctggggcggcgtgatgccga

SEQ ID NO: 411530 - DNA, 21 bp, Artificial Sequence
  Description of Artificial Sequence: Synthetic oligonucleotide
gctggggcggcgtgatgccga

SEQ ID NO: 411531 - DNA, 23 bp, Artificial Sequence
  Description of Artificial Sequence: Synthetic oligonucleotide
ctggggcggcgtgatgccgagta

SEQ ID NO: 411532 - DNA, 24 bp, Artificial Sequence
  Description of Artificial Sequence: Synthetic oligonucleotide
tggggcggcgtgatgccgagtact

SEQ ID NO: 411533 - DNA, 23 bp, Artificial Sequence
  Description of Artificial Sequence: Synthetic oligonucleotide
ggggcggcgtgatgccgagtact

SEQ ID NO: 411534 - DNA, 23 bp, Artificial Sequence
  Description of Artificial Sequence: Synthetic oligonucleotide
gggcggcgtgatgccgagtactg

SEQ ID NO: 411535 - DNA, 25 bp, Artificial Sequence
  Description of Artificial Sequence: Synthetic oligonucleotide
ggcggcgtgatgccgagtactggaa

SEQ ID NO: 411536 - DNA, 26 bp, Artificial Sequence
  Description of Artificial Sequence: Synthetic oligonucleotide
gcggcgtgatgccgagtactggaaca

SEQ ID NO: 411537 - DNA, 26 bp, Artificial Sequence
  Description of Artificial Sequence: Synthetic oligonucleotide
cggcgtgatgccgagtactggaacag

SEQ ID NO: 411538 - DNA, 26 bp, Artificial Sequence
  Description of Artificial Sequence: Synthetic oligonucleotide
ggcgtgatgccgagtactggaacagc

SEQ ID NO: 411539 - DNA, 27 bp, Artificial Sequence
  Description of Artificial Sequence: Synthetic oligonucleotide
gcgtgatgccgagtactggaacagcca

SEQ ID NO: 411540 - DNA, 27 bp, Artificial Sequence
  Description of Artificial Sequence: Synthetic oligonucleotide
cgtgatgccgagtactggaacagccag

SEQ ID NO: 411541 - DNA, 29 bp, Artificial Sequence
  Description of Artificial Sequence: Synthetic oligonucleotide
gtgatgccgagtactggaacagccagaag

SEQ ID NO: 411542 - DNA, 33 bp, Artificial Sequence; identical to SEQ ID NO: 66137
  Description of Artificial Sequence: Synthetic oligonucleotide

SEQ ID NO: 411543 - DNA, 32 bp, Artificial Sequence; identical to SEQ ID NO: 66138
  Description of Artificial Sequence: Synthetic oligonucleotide

SEQ ID NO: 411544 - DNA, 33 bp, Artificial Sequence; identical to SEQ ID NO: 66139
  Description of Artificial Sequence: Synthetic oligonucleotide

SEQ ID NO: 411545 - DNA, 33 bp, Artificial Sequence; identical to SEQ ID NO: 66140
  Description of Artificial Sequence: Synthetic oligonucleotide

SEQ ID NO: 411546 - DNA, 32 bp, Artificial Sequence; identical to SEQ ID NO: 66141
  Description of Artificial Sequence: Synthetic oligonucleotide

SEQ ID NO: 411547 - DNA, 33 bp, Artificial Sequence; identical to SEQ ID NO: 66142
  Description of Artificial Sequence: Synthetic oligonucleotide

SEQ ID NO: 411548 - DNA, 32 bp, Artificial Sequence; identical to SEQ ID NO: 66143
  Description of Artificial Sequence: Synthetic oligonucleotide

SEQ ID NO: 411549 - DNA, 31 bp, Artificial Sequence; identical to SEQ ID NO: 66144
  Description of Artificial Sequence: Synthetic oligonucleotide

SEQ ID NO: 411550 - DNA, 32 bp, Artificial Sequence; identical to SEQ ID NO: 66145
  Description of Artificial Sequence: Synthetic oligonucleotide

SEQ ID NO: 411551 - DNA, 31 bp, Artificial Sequence; identical to SEQ ID NO: 66146
  Description of Artificial Sequence: Synthetic oligonucleotide

SEQ ID NO: 411552 - DNA, 30 bp, Artificial Sequence; identical to SEQ ID NO: 66147
  Description of Artificial Sequence: Synthetic oligonucleotide

SEQ ID NO: 411553 - DNA, 30 bp, Artificial Sequence; identical to SEQ ID NO: 66148
  Description of Artificial Sequence: Synthetic oligonucleotide

SEQ ID NO: 411554 - DNA, 29 bp, Artificial Sequence
  Description of Artificial Sequence: Synthetic oligonucleotide
gcagacacaactacgggattgtggagagc

SEQ ID NO: 411555 - DNA, 31 bp, Artificial Sequence; identical to SEQ ID NO: 66150
  Description of Artificial Sequence: Synthetic oligonucleotide

SEQ ID NO: 411556 - DNA, 32 bp, Artificial Sequence; identical to SEQ ID NO: 66151
  Description of Artificial Sequence: Synthetic oligonucleotide

SEQ ID NO: 411557 - DNA, 31 bp, Artificial Sequence; identical to SEQ ID NO: 66152
  Description of Artificial Sequence: Synthetic oligonucleotide

SEQ ID NO: 411558 - DNA, 32 bp, Artificial Sequence; identical to SEQ ID NO: 66153
  Description of Artificial Sequence: Synthetic oligonucleotide

SEQ ID NO: 411559 - DNA, 31 bp, Artificial Sequence; identical to SEQ ID NO: 66154
  Description of Artificial Sequence: Synthetic oligonucleotide

SEQ ID NO: 411560 - DNA, 32 bp, Artificial Sequence; identical to SEQ ID NO: 66155
  Description of Artificial Sequence: Synthetic oligonucleotide

SEQ ID NO: 411561 - DNA, 31 bp, Artificial Sequence; identical to SEQ ID NO: 66156
  Description of Artificial Sequence: Synthetic oligonucleotide

SEQ ID NO: 411562 - DNA, 31 bp, Artificial Sequence; identical to SEQ ID NO: 66157
  Description of Artificial Sequence: Synthetic oligonucleotide

SEQ ID NO: 411563 - DNA, 30 bp, Artificial Sequence; identical to SEQ ID NO: 66158
  Description of Artificial Sequence: Synthetic oligonucleotide

SEQ ID NO: 411564 - DNA, 29 bp, Artificial Sequence
  Description of Artificial Sequence: Synthetic oligonucleotide
ctacgggattgtggagagcttcacagtgc

SEQ ID NO: 411565 - DNA, 30 bp, Artificial Sequence; identical to SEQ ID NO: 66160
  Description of Artificial Sequence: Synthetic oligonucleotide

SEQ ID NO: 411566 - DNA, 29 bp, Artificial Sequence
  Description of Artificial Sequence: Synthetic oligonucleotide
acgggattgtggagagcttcacagtgcag

SEQ ID NO: 411567 - DNA, 28 bp, Artificial Sequence
  Description of Artificial Sequence: Synthetic oligonucleotide
cgggattgtggagagcttcacagtgcag

SEQ ID NO: 411568 - DNA, 28 bp, Artificial Sequence
  Description of Artificial Sequence: Synthetic oligonucleotide
gggattgtggagagcttcacagtgcagc

SEQ ID NO: 411569 - DNA, 28 bp, Artificial Sequence
  Description of Artificial Sequence: Synthetic oligonucleotide
ggattgtggagagcttcacagtgcagcg

SEQ ID NO: 411570 - DNA, 28 bp, Artificial Sequence
  Description of Artificial Sequence: Synthetic oligonucleotide
gattgtggagagcttcacagtgcagcgg

SEQ ID NO: 411571 - DNA, 28 bp, Artificial Sequence
  Description of Artificial Sequence: Synthetic oligonucleotide
attgtggagagcttcacagtgcagcggc

SEQ ID NO: 411572 - DNA, 30 bp, Artificial Sequence; identical to SEQ ID NO: 66167
  Description of Artificial Sequence: Synthetic oligonucleotide

SEQ ID NO: 411573 - DNA, 31 bp, Artificial Sequence; identical to SEQ ID NO: 66168
  Description of Artificial Sequence: Synthetic oligonucleotide

SEQ ID NO: 411574 - DNA, 31 bp, Artificial Sequence; identical to SEQ ID NO: 66169
  Description of Artificial Sequence: Synthetic oligonucleotide

SEQ ID NO: 411575 - DNA, 33 bp, Artificial Sequence; identical to SEQ ID NO: 66170
  Description of Artificial Sequence: Synthetic oligonucleotide

SEQ ID NO: 411576 - DNA, 32 bp, Artificial Sequence; identical to SEQ ID NO: 66171
  Description of Artificial Sequence: Synthetic oligonucleotide

SEQ ID NO: 411577 - DNA, 33 bp, Artificial Sequence; identical to SEQ ID NO: 66172
  Description of Artificial Sequence: Synthetic oligonucleotide

SEQ ID NO: 411578 - DNA, 33 bp, Artificial Sequence; identical to SEQ ID NO: 66173
  Description of Artificial Sequence: Synthetic oligonucleotide

SEQ ID NO: 411579 - DNA, 34 bp, Artificial Sequence; identical to SEQ ID NO: 66174
  Description of Artificial Sequence: Synthetic oligonucleotide

SEQ ID NO: 411580 - DNA, 36 bp, Artificial Sequence; identical to SEQ ID NO: 66175
  Description of Artificial Sequence: Synthetic oligonucleotide

SEQ ID NO: 411581 - DNA, 35 bp, Artificial Sequence; identical to SEQ ID NO: 66176
  Description of Artificial Sequence: Synthetic oligonucleotide

SEQ ID NO: 411582 - DNA, 34 bp, Artificial Sequence; identical to SEQ ID NO: 66177
  Description of Artificial Sequence: Synthetic oligonucleotide

SEQ ID NO: 411583 - DNA, 34 bp, Artificial Sequence; identical to SEQ ID NO: 66178
  Description of Artificial Sequence: Synthetic oligonucleotide

SEQ ID NO: 411584 - DNA, 35 bp, Artificial Sequence; identical to SEQ ID NO: 66179
  Description of Artificial Sequence: Synthetic oligonucleotide

SEQ ID NO: 411585 - DNA, 34 bp, Artificial Sequence; identical to SEQ ID NO: 66180
  Description of Artificial Sequence: Synthetic oligonucleotide

SEQ ID NO: 411586 - DNA, 34 bp, Artificial Sequence; identical to SEQ ID NO: 66181
  Description of Artificial Sequence: Synthetic oligonucleotide

SEQ ID NO: 411587 - DNA, 34 bp, Artificial Sequence; identical to SEQ ID NO: 66182
  Description of Artificial Sequence: Synthetic oligonucleotide

SEQ ID NO: 411588 - DNA, 33 bp, Artificial Sequence; identical to SEQ ID NO: 66183
  Description of Artificial Sequence: Synthetic oligonucleotide

SEQ ID NO: 411589 - DNA, 33 bp, Artificial Sequence; identical to SEQ ID NO: 66184
  Description of Artificial Sequence: Synthetic oligonucleotide

SEQ ID NO: 411590 - DNA, 32 bp, Artificial Sequence; identical to SEQ ID NO: 66185
  Description of Artificial Sequence: Synthetic oligonucleotide

SEQ ID NO: 411591 - DNA, 34 bp, Artificial Sequence; identical to SEQ ID NO: 66186
  Description of Artificial Sequence: Synthetic oligonucleotide

SEQ ID NO: 411592 - DNA, 33 bp, Artificial Sequence; identical to SEQ ID NO: 66187
  Description of Artificial Sequence: Synthetic oligonucleotide

SEQ ID NO: 411593 - DNA, 32 bp, Artificial Sequence; identical to SEQ ID NO: 66188
  Description of Artificial Sequence: Synthetic oligonucleotide

SEQ ID NO: 411594 - DNA, 31 bp, Artificial Sequence; identical to SEQ ID NO: 66189
  Description of Artificial Sequence: Synthetic oligonucleotide

SEQ ID NO: 411595 - DNA, 31 bp, Artificial Sequence; identical to SEQ ID NO: 66190
  Description of Artificial Sequence: Synthetic oligonucleotide

SEQ ID NO: 411596 - DNA, 30 bp, Artificial Sequence; identical to SEQ ID NO: 66191
  Description of Artificial Sequence: Synthetic oligonucleotide

SEQ ID NO: 411597 - DNA, 29 bp, Artificial Sequence
  Description of Artificial Sequence: Synthetic oligonucleotide
ctatcaccaagaggagtacgtgcgcttcg

SEQ ID NO: 411598 - DNA, 30 bp, Artificial Sequence; identical to SEQ ID NO: 66193
  Description of Artificial Sequence: Synthetic oligonucleotide

SEQ ID NO: 411599 - DNA, 29 bp, Artificial Sequence
  Description of Artificial Sequence: Synthetic oligonucleotide
atcaccaagaggagtacgtgcgcttcgac

SEQ ID NO: 411600 - DNA, 28 bp, Artificial Sequence
  Description of Artificial Sequence: Synthetic oligonucleotide
tcaccaagaggagtacgtgcgcttcgac

SEQ ID NO: 411601 - DNA, 27 bp, Artificial Sequence
  Description of Artificial Sequence: Synthetic oligonucleotide
caccaagaggagtacgtgcgcttcgac

SEQ ID NO: 411602 - DNA, 33 bp, Artificial Sequence; identical to SEQ ID NO: 66197
  Description of Artificial Sequence: Synthetic oligonucleotide

SEQ ID NO: 411603 - DNA, 37 bp, Artificial Sequence; identical to SEQ ID NO: 66198
  Description of Artificial Sequence: Synthetic oligonucleotide

SEQ ID NO: 411604 - DNA, 36 bp, Artificial Sequence; identical to SEQ ID NO: 66199
  Description of Artificial Sequence: Synthetic oligonucleotide

SEQ ID NO: 411605 - DNA, 24 bp, Artificial Sequence
  Description of Artificial Sequence: Synthetic oligonucleotide
ggggccgggtggacaactactgga

SEQ ID NO: 411606 - DNA, 25 bp, Artificial Sequence
  Description of Artificial Sequence: Synthetic oligonucleotide
gggccgggtggacaactactggaga

SEQ ID NO: 411607 - DNA, 26 bp, Artificial Sequence
  Description of Artificial Sequence: Synthetic oligonucleotide
ggccgggtggacaactactggagaca

SEQ ID NO: 411608 - DNA, 27 bp, Artificial Sequence
  Description of Artificial Sequence: Synthetic oligonucleotide
gccgggtggacaactactggagacaca

SEQ ID NO: 411609 - DNA, 28 bp, Artificial Sequence
  Description of Artificial Sequence: Synthetic oligonucleotide
ccgggtggacaactactggagacacaac

SEQ ID NO: 411610 - DNA, 30 bp, Artificial Sequence; identical to SEQ ID NO: 66205
  Description of Artificial Sequence: Synthetic oligonucleotide

SEQ ID NO: 411611 - DNA, 30 bp, Artificial Sequence; identical to SEQ ID NO: 66206
  Description of Artificial Sequence: Synthetic oligonucleotide

SEQ ID NO: 411612 - DNA, 30 bp, Artificial Sequence; identical to SEQ ID NO: 66207
  Description of Artificial Sequence: Synthetic oligonucleotide

SEQ ID NO: 411613 - DNA, 30 bp, Artificial Sequence; identical to SEQ ID NO: 66208
  Description of Artificial Sequence: Synthetic oligonucleotide

SEQ ID NO: 411614 - DNA, 30 bp, Artificial Sequence; identical to SEQ ID NO: 66209
  Description of Artificial Sequence: Synthetic oligonucleotide

SEQ ID NO: 411615 - DNA, 29 bp, Artificial Sequence
  Description of Artificial Sequence: Synthetic oligonucleotide
ggacaactactggagacacaactacgggg

SEQ ID NO: 411616 - DNA, 31 bp, Artificial Sequence; identical to SEQ ID NO: 66211
  Description of Artificial Sequence: Synthetic oligonucleotide

SEQ ID NO: 411617 - DNA, 32 bp, Artificial Sequence; identical to SEQ ID NO: 66212
  Description of Artificial Sequence: Synthetic oligonucleotide

SEQ ID NO: 411618 - DNA, 31 bp, Artificial Sequence; identical to SEQ ID NO: 66213
  Description of Artificial Sequence: Synthetic oligonucleotide

SEQ ID NO: 411619 - DNA, 31 bp, Artificial Sequence; identical to SEQ ID NO: 66214
  Description of Artificial Sequence: Synthetic oligonucleotide

SEQ ID NO: 411620 - DNA, 30 bp, Artificial Sequence; identical to SEQ ID NO: 66215
  Description of Artificial Sequence: Synthetic oligonucleotide

SEQ ID NO: 411621 - DNA, 29 bp, Artificial Sequence
  Description of Artificial Sequence: Synthetic oligonucleotide
ctactggagacacaactacggggttgtgg

SEQ ID NO: 411622 - DNA, 30 bp, Artificial Sequence; identical to SEQ ID NO: 66217
  Description of Artificial Sequence: Synthetic oligonucleotide

SEQ ID NO: 411623 - DNA, 29 bp, Artificial Sequence
  Description of Artificial Sequence: Synthetic oligonucleotide
actggagacacaactacggggttgtggag

SEQ ID NO: 411624 - DNA, 28 bp, Artificial Sequence
  Description of Artificial Sequence: Synthetic oligonucleotide
ctggagacacaactacggggttgtggag

SEQ ID NO: 411625 - DNA, 29 bp, Artificial Sequence
  Description of Artificial Sequence: Synthetic oligonucleotide
tggagacacaactacggggttgtggagag

SEQ ID NO: 411626 - DNA, 28 bp, Artificial Sequence
  Description of Artificial Sequence: Synthetic oligonucleotide
ggagacacaactacggggttgtggagag

SEQ ID NO: 411627 - DNA, 28 bp, Artificial Sequence
  Description of Artificial Sequence: Synthetic oligonucleotide
gagacacaactacggggttgtggagagc

SEQ ID NO: 411628 - DNA, 32 bp, Artificial Sequence; identical to SEQ ID NO: 66223
  Description of Artificial Sequence: Synthetic oligonucleotide

SEQ ID NO: 411629 - DNA, 32 bp, Artificial Sequence; identical to SEQ ID NO: 66224
  Description of Artificial Sequence: Synthetic oligonucleotide

SEQ ID NO: 411630 - DNA, 34 bp, Artificial Sequence; identical to SEQ ID NO: 66225
  Description of Artificial Sequence: Synthetic oligonucleotide

SEQ ID NO: 411631 - DNA, 35 bp, Artificial Sequence; identical to SEQ ID NO: 66226
  Description of Artificial Sequence: Synthetic oligonucleotide

SEQ ID NO: 411632 - DNA, 34 bp, Artificial Sequence; identical to SEQ ID NO: 66227
  Description of Artificial Sequence: Synthetic oligonucleotide

SEQ ID NO: 411633 - DNA, 34 bp, Artificial Sequence; identical to SEQ ID NO: 66228
  Description of Artificial Sequence: Synthetic oligonucleotide

SEQ ID NO: 411634 - DNA, 35 bp, Artificial Sequence; identical to SEQ ID NO: 66229
  Description of Artificial Sequence: Synthetic oligonucleotide

SEQ ID NO: 411635 - DNA, 37 bp, Artificial Sequence; identical to SEQ ID NO: 66230
  Description of Artificial Sequence: Synthetic oligonucleotide

SEQ ID NO: 411636 - DNA, 37 bp, Artificial Sequence; identical to SEQ ID NO: 66231
  Description of Artificial Sequence: Synthetic oligonucleotide

SEQ ID NO: 411637 - DNA, 36 bp, Artificial Sequence; identical to SEQ ID NO: 66232
  Description of Artificial Sequence: Synthetic oligonucleotide

SEQ ID NO: 411638 - DNA, 35 bp, Artificial Sequence; identical to SEQ ID NO: 66233
  Description of Artificial Sequence: Synthetic oligonucleotide

SEQ ID NO: 411639 - DNA, 36 bp, Artificial Sequence; identical to SEQ ID NO: 66234
  Description of Artificial Sequence: Synthetic oligonucleotide

SEQ ID NO: 411640 - DNA, 36 bp, Artificial Sequence; identical to SEQ ID NO: 66235
  Description of Artificial Sequence: Synthetic oligonucleotide

SEQ ID NO: 411641 - DNA, 35 bp, Artificial Sequence; identical to SEQ ID NO: 66236
  Description of Artificial Sequence: Synthetic oligonucleotide

SEQ ID NO: 411642 - DNA, 35 bp, Artificial Sequence; identical to SEQ ID NO: 66237
  Description of Artificial Sequence: Synthetic oligonucleotide

SEQ ID NO: 411643 - DNA, 35 bp, Artificial Sequence; identical to SEQ ID NO: 66238
  Description of Artificial Sequence: Synthetic oligonucleotide

SEQ ID NO: 411644 - DNA, 34 bp, Artificial Sequence; identical to SEQ ID NO: 66239
  Description of Artificial Sequence: Synthetic oligonucleotide

SEQ ID NO: 411645 - DNA, 36 bp, Artificial Sequence; identical to SEQ ID NO: 66240
  Description of Artificial Sequence: Synthetic oligonucleotide

SEQ ID NO: 411646 - DNA, 35 bp, Artificial Sequence; identical to SEQ ID NO: 66241
  Description of Artificial Sequence: Synthetic oligonucleotide

SEQ ID NO: 411647 - DNA, 35 bp, Artificial Sequence; identical to SEQ ID NO: 66242
  Description of Artificial Sequence: Synthetic oligonucleotide

SEQ ID NO: 411648 - DNA, 34 bp, Artificial Sequence; identical to SEQ ID NO: 66243
  Description of Artificial Sequence: Synthetic oligonucleotide

SEQ ID NO: 411649 - DNA, 33 bp, Artificial Sequence; identical to SEQ ID NO: 66244
  Description of Artificial Sequence: Synthetic oligonucleotide

SEQ ID NO: 411650 - DNA, 32 bp, Artificial Sequence; identical to SEQ ID NO: 66245
  Description of Artificial Sequence: Synthetic oligonucleotide

SEQ ID NO: 411651 - DNA, 33 bp, Artificial Sequence; identical to SEQ ID NO: 66246
  Description of Artificial Sequence: Synthetic oligonucleotide

SEQ ID NO: 411652 - DNA, 32 bp, Artificial Sequence; identical to SEQ ID NO: 66247
  Description of Artificial Sequence: Synthetic oligonucleotide

SEQ ID NO: 411653 - DNA, 31 bp, Artificial Sequence; identical to SEQ ID NO: 66248
  Description of Artificial Sequence: Synthetic oligonucleotide

SEQ ID NO: 411654 - DNA, 32 bp, Artificial Sequence; identical to SEQ ID NO: 66249
  Description of Artificial Sequence: Synthetic oligonucleotide

SEQ ID NO: 411655 - DNA, 31 bp, Artificial Sequence; identical to SEQ ID NO: 66250
  Description of Artificial Sequence: Synthetic oligonucleotide

SEQ ID NO: 411656 - DNA, 30 bp, Artificial Sequence; identical to SEQ ID NO: 66251
  Description of Artificial Sequence: Synthetic oligonucleotide

SEQ ID NO: 411657 - DNA, 29 bp, Artificial Sequence
  Description of Artificial Sequence: Synthetic oligonucleotide
aaccaagaggagaacgtgcgcttcgacag

SEQ ID NO: 411658 - DNA, 28 bp, Artificial Sequence
  Description of Artificial Sequence: Synthetic oligonucleotide
accaagaggagaacgtgcgcttcgacag

SEQ ID NO: 411659 - DNA, 27 bp, Artificial Sequence
  Description of Artificial Sequence: Synthetic oligonucleotide
ccaagaggagaacgtgcgcttcgacag

SEQ ID NO: 411660 - DNA, 27 bp, Artificial Sequence
  Description of Artificial Sequence: Synthetic oligonucleotide
caagaggagaacgtgcgcttcgacagc

SEQ ID NO: 411661 - DNA, 27 bp, Artificial Sequence
  Description of Artificial Sequence: Synthetic oligonucleotide
aagaggagaacgtgcgcttcgacagcg

SEQ ID NO: 411662 - DNA, 27 bp, Artificial Sequence
  Description of Artificial Sequence: Synthetic oligonucleotide
agaggagaacgtgcgcttcgacagcga

SEQ ID NO: 411663 - DNA, 22 bp, Artificial Sequence
  Description of Artificial Sequence: Synthetic oligonucleotide
agcgacgtgggggagtaccggc

SEQ ID NO: 411664 - DNA, 21 bp, Artificial Sequence
  Description of Artificial Sequence: Synthetic oligonucleotide
gcgacgtgggggagtaccggc

SEQ ID NO: 411665 - DNA, 21 bp, Artificial Sequence
  Description of Artificial Sequence: Synthetic oligonucleotide
cgacgtgggggagtaccggcc

SEQ ID NO: 411666 - DNA, 21 bp, Artificial Sequence
  Description of Artificial Sequence: Synthetic oligonucleotide
gacgtgggggagtaccggccg

SEQ ID NO: 411667 - DNA, 22 bp, Artificial Sequence
  Description of Artificial Sequence: Synthetic oligonucleotide
acgtgggggagtaccggccggt

SEQ ID NO: 411668 - DNA, 21 bp, Artificial Sequence
  Description of Artificial Sequence: Synthetic oligonucleotide
cgtgggggagtaccggccggt

SEQ ID NO: 411669 - DNA, 22 bp, Artificial Sequence
  Description of Artificial Sequence: Synthetic oligonucleotide
gtgggggagtaccggccggtga
